United States Patent 9,572,897 (MODIFIED POLYNUCLEOTIDES FOR THE PRODUCTION OF CYTOPLASMIC AND CYTOSKELETAL PROTEINS) - sequence listing, part 15

SEQ ID NO: 27877 - DNA, 3006 bp, Artificial Sequence
  Description of Artificial Sequence: Synthetic coding sequence
atgcagtccacagatctaggtaataaggaatcaggtaaaatctggcaccgaaaaccgtctccggcaactagagatggcatcatagtgaacatcatccataacacgtcagattatcacccaaaggtcctgcggttcctaaacgtcgcgtttgacggaaccggggattgcctgatagccggagatcaccagggcaatatttatgtcttcgatctacacggcaaccgattcaatcttgtccaacgaacagctcaagcctgtactgcgctggcattcaaccttcggcgtaaatcggaattcttggtggcgctggccgactattccattaagtgttttgacactgtgacaaaggaactggtaagctggatgcggggacacgagtcgtccgtattctcaatttccgtgcacgcttccggcaagtacgccatcactacttcgagtgacaccgctcagctctgggacctggatacttttcaacggaagcggaagctgaacattcgccaatctgtcggcatccagaaggtgttttttctgcccctttccaacaccatcctctcgtgctttaaggataactccatcttcgcctgggagtgcgatacgcttttctgtaagtatcaactcccagcccctccagagagcagcagcatcctgtataaggtgtttgctgtgacgagggacggaagaattctagccgcaggaggtaagagtaaccatttgcacttgtggtgcttggaagctagacagctgttccggataatacagatgcctaccaaagtgagagctatcaggcatctggagttcctacctgactctttcgatgctggctctaaccaggtgctgggtgtcctgagtcaggacggcatcatgcgatttatcaatatgcaaacttgtaaactgctgtttgagatcggctctctcgacgaaggcataagcagcagcgctattagcccccacggccgttatatcgcttccatcatggagaatgggagcctcaatatttatagcgtgcaggctctaacacaggagatcaataaaccacccccaccactggttaaagtgatcgaggacttgccaaagaacaagctgtcctcctctgatctgaagatgaaggttacaagtggaagagtccagcagcccgcaaagtctcgcgagtccaaaatgcagacccgtatcctcaagcaggatctcactggggacttcgaatcgaagaaaaatgaattacccgacggactaaacaagaaaagactacagattctgctgaaaggatatggcgaatatccaactaagtaccgcatgttcatctggcgatccctcttgcagctgcccgaaaatcacacagctttttcaactctgatcgacaagggaacccatgtggcgtttttgaacctgcaaaagaagtaccctatcaagtcaagaaagcttcttagggtgctgcagcgcactctgtccgccctcgcccactggtcagtcattttcagtgacacaccctacttgccattactggcatttccctttgtgaaactgttccaaaacaaccagctcatctgtttcgaggtaattgccactctgatcatcaactggtgtcagcactggtttgaatactttccaaatcctcccataaatatcctgtccatgatcgaaaacgtgctggcatttcacgataaagagctgctgcagcatttcatcgaccatgacattacttcacagctgtacgcatggccccttttagagaccgtcttctcagaagtgctgactagagaagagtggctgaagctttttgacaatatttttagcaaccatcccagcttcctcctgatgaccgttgtggcgtacaatatctgcagtaggacccctctgctctcctgcaatctcaaggatgacttcgagttcttcttccatcacaggaataacctggatattaacgtcgtcatccgacaggtctatcatctcatggaaaccacgcctacggatatacacccagacagtatgctgaacgtgtttgtggctctgactaaaggccaatatccagtgtttaaccagtaccctaaatttattgtagattaccagacacaggaaagggaacgcattcggaatgatgaactggattatttaagagagaggcagaccgtggaagatatgcaggccaaggtggatcagcagcgggtggaagatgaagcctggtatcaaaagcaggagttgttgcgcaaagcagaggagactagaagggagatgcttctgcaggaggaagagaagatgattcagcagcgccagcggttagccgctgtgaagagagagctgaaagtaaaggaaatgcacctgcaagacgcggctagacggaggttcctaaaattgcagcaggatcaacaggagatggagctccgacgcctagacgacgagataggaagaaaggtttatatgcgtgatcgcgagattgccgctacagctagggatctggaaatgaggcagctggagctggagtctcagaaaaggctctacgagaaaaaccttaccgaaaatcaggaagcgcttgccaaggagatgcgagcggatgcagacgcatatcggaggaaagtggacctcgaggaacatatgttccacaaactgatagaagcaggcgaaactcagtcccagaagacacagaagtggaaagaggctgaagggaaggaattcagacttagatcagctaaaaaggcttctgctctgtccgatgcaagtagaaagtggttcctgaagcaagagatcaacgctgccgtggaacacgcagaaaatccctgccacaaggaggagcctcggttccagaacgagcaggattctagttgtctgccccgaacttcccagctgaacgactcaagcgaaatggatccctctacccagattagcctgaaccggagagcggtcgaatgggacaccacagggcaaaatttaatcaaaaaagtccggaacctgcggcagaggctgacagcccgagctcggcatcgctgccagacaccacatttgctcgccgcttag

SEQ ID NO: 27878 - DNA, 651 bp, Artificial Sequence
  Description of Artificial Sequence: Synthetic coding sequence
atgagcttcttattcgggagccgttcgagcaaaacttttaaacccaagaaaaacatacctgaggggagtcatcagtacgaactgctcaaacacgcagaggctacacttggcagcggaaatcttagaatggcggtgatgctcccggaaggcgaggatctgaacgagtgggtggctgttaatactgtggacttttttaatcaaatcaacatgctctacggtaccatcacagatttttgtacagaggaatcctgtcctgtgatgtccgctgggccaaagtacgaataccattgggctgatgggacaaatattaagaagccaattaagtgcagtgctccgaagtacatcgactatctgatgacatgggtgcaggaccagctggacgacgaaacactttttcccagcaagatcggggtcccctttcccaaaaactttatgtccgtcgctaagaccatacttaagcggctgttccgtgtatatgcgcatatttaccatcagcatttcgatcctgtgatccagttacaggaagaagcacatctcaatacttcgttcaaacactttattttttttgtgcaggagtttaacctgatagacagacgggagctggccccactgcaggaactcatagagaagctcacgtctaaagatcgatag

SEQ ID NO: 27879 - DNA, 477 bp, Artificial Sequence
  Description of Artificial Sequence: Synthetic coding sequence
atggcagcccagggcgttggacctggtccaggaagtgcagcgccacctggcttggaggctgcccgtcagaaactagcattgcgcaggaagaaagtgttgtccaccgaagagatggaactttacgagctggcccaagccgctgggggaggaattgacccggatgtgttcaaaatactggtagacctattaaagcttaatgtggcccctcttgccgtgtttcagatgctcaagagcatgtgcgccggacagcggttagccagcgagccacaagacccggcagccgtttcgctgcccacgtccagcgtcccagaaactcgaggtagagataaaggtagtgccgctctgggcggtgtattagcactggcggaaagaagcaaccatgaggggagttcccaaagaatgccaaggcagccttccgccacaagactgccaaaaggagggggtcctggcaaaagcccgacccagggatcaacgtag

SEQ ID NO: 27880 - DNA, 1425 bp, Artificial Sequence
  Description of Artificial Sequence: Synthetic coding sequence
atgaattcggtgtcgccagccgctgcacagtacaggtccagtagtccagaggatgccaggcgaagacccgaagcacggagacctagaggcccaaggggccctgatcccaatggcctgggtccctctggcgctagcggccctgctctcggctccccaggagcagggccatccgagccagacgaagttgataaattcaaagcgaaattcctgaccgcctggaacaatgtcaaatatgggtgggtggtcaaaagccgaacatcgttttctaagatctcttctatacatctctgcggacggaggtataggttcgaaggtgagggagacattcagcggtttcagagagactttgtgtctcgcctgtggctcacttacaggagagactttcctcccctgcccggtgggtgcctgaccagtgactgcggctggggatgtatgctgcggagcgggcagatgatgctcgctcagggcttgttgctgcacttcctgcctcgagactggacatgggctgaaggcatgggattgggacctccggaattgtctggttccgcaagcccatcccggtatcacggtcccgcacgatggatgccccctcgctgggcacagggagctcccgaactagagcaagagagaaggcataggcagattgtgagctggttcgcagatcatcccagggccccatttggtctgcatagactggtggagttaggacagtcgtcaggtaagaaggcaggagattggtacggaccctcactcgtggcgcacattcttcggaaagctgttgaatcctgttcagacgtaacgaggctggtagtctacgtgtcccaggactgtaccgtctacaaggctgacgtagcccgtctggtcgctagaccggatccaaccgccgagtggaagtctgtggtcatcctggtccccgtgagactcggtggggaaaccctgaatccagtgtacgttccctgtgtgaaggagttgctcagatgtgagctgtgtctgggcattatgggtggcaaaccacggcactctctctactttatcggttatcaggatgactttcttctctacctggatcctcactactgtcagcccaccgttgacgtatcccaggccgactttcccctagagtcgttccattgtaccagcccacggaaaatggcttttgctaaaatggacccatcctgcacagtaggtttctatgccggtgatagaaaagaatttgagaccctgtgttctgagcttacaagggtcttatccagtagtagcgccaccgaacggtaccccatgtttacattggccgagggacacgcacaggaccattcactggatgacttgtgttctcagcttgcccagcctaccttacgcctcccaaggacaggcaggttgttaagggccaagcgccctagttccgaggactttgtgtttctgtag

SEQ ID NO: 27881 - DNA, 945 bp, Artificial Sequence
  Description of Artificial Sequence: Synthetic coding sequence
atggcctttgtgacgcggcagtttatgcgatctgtatcatcttcttcaaccgctagcgctagtgcgaagaaaatcattgtgaagcatgtgaccgtcattggcggaggtttgatgggtgcagggatagctcaggtcgcagccgcaacaggtcacacagtggtattggtcgaccagaccgaggatattcttgctaagagtaaaaagggtatcgaggagagcttgcggaaagtggccaaaaagaagttcgcagagaacctaaaggccggtgatgaatttgtagaaaaaacactgtccacgatcgcaactagtaccgacgctgccagtgttgttcattctactgacctcgtcgtggaagcaatcgtggagaacttgaaagtgaaaaacgagctgttcaagcggcttgacaagttcgccgctgagcatactatctttgctagcaatacaagttcgttacagattacatcaattgctaatgccaccacgaggcaggaccgattcgctgggcttcactttttcaaccccgtccctgtcatgaaactcgtcgaggttatcaaaacgccaatgacgtcacagaaaacatttgagagcctggtggacttttcaaaggcgctcggcaagcacccagtaagttgtaaggatactccaggatttatcgtcaatcgccttttagtgccataccttatggaggctatccgcctgtacgagagaggagatgcttctaaggaagatattgacacggctatgaagttaggtgctgggtatcccatgggtccattcgagctgctggactacgttggcctcgacacaacgaaatttatagtggacgggtggcacgagatggacgcagaaaatccgctccaccagcctagccctagcctgaacaaactagttgctgagaataagtttggtaaaaaaaccggcgaaggcttttacaagtataagtag

SEQ ID NO: 27882 - DNA, 810 bp, Artificial Sequence
  Description of Artificial Sequence: Synthetic coding sequence
atggggaactgttgttggacccagtgcttcggcttgcttaggaaggaagcaggtagactgcagcgcgtgggtggcggaggaggaagtaaatatttccgaacgtgtagccggggagagcatttaacaattgagttcgagaatctcgtagaatcagacgagggtgaaagcccagggtccagccataggccactgaccgaggaggagattgtcgaccttagagagaggcattatgactccattgcggaaaaacaaaaggacctcgataagaagattcagaaagaacaggagagacaacggatagtgcagcagtatcacccctctaacaacggtgaatatcagagtagtggtccagaggacgacttcgagagctgtctacggaatatgaaatcccagtatgaagtctttagatcttctcgtctatcaagcgacgccactgtgcttacccccaacacagagtcttcttgtgacctgatgactaagacgaagtcgacttctggcaacgatgacagtacatctctcgatcttgagtgggaggatgaggagggtatgaacaggatgctgcctatgcgcgagcgctccaagaccgaggaggacatcctgagggcagcactgaaatattcaaataagaaaaccggaagcaatccaacgtcagcctcagacgactccaacggcctcgaatgggaaaatgatttcgtgtcagcagagatggatgataacggcaactctgaatactctggatttgtgaaccccgtcctggagctctcagatagcggcattaggcacagcgatacagaccaacaaacacggtag

SEQ ID NO: 27883 - DNA, 1371 bp, Artificial Sequence
  Description of Artificial Sequence: Synthetic coding sequence
atgaagtgcgagcattgcaccaggaaggagtgcagtaagaagacgaagaccgatgaccaggaaaacgtgtctgcagacgccccttctccggcacaagaaaacggagaaaagggagaattccataagctggccgacgcgaagatcttcttaagcgactgtctcgcttgtgacagttgcatgacggccgaggagggtgtgcagctctcgcagcagaatgcaaaagacttctttagggttctgaacctgaacaagaaatgcgacacttcaaaacataaggtcctggtggtgagcgtgtgcccacaaagcttaccctacttcgcggctaagttcaatctgtccgtgactgacgcaagtagacggttgtgcggtttcctgaagtctctcggagtccactacgtgttcgatacaacaatagccgctgacttctctattctcgagtctcagaaggagttcgtgcgaagatatcggcaacattcagaagaagagcggacccttcccatgctaactagcgcatgtccgggatgggtccggtacgcagaaagggtgctcggcaggccaataaccgcccatctctgcactgcgaagtctccacaacaggtgatgggttctctggtgaaagactatttcgctaggcaacagaatctgtctcccgaaaaaatcttccacgtaattgtggccccttgctacgacaaaaaattagaagcgctccaggagagcctcccacccgctttgcacgggagcagaggcgctgactgcgtgttgacgtctggtgaaatcgctcagataatggagcagggtgacttgtccgtccgcgacgctgctgttgacaccctttttggggacctgaaagaagacaaggtaacaaggcacgacggggcaagcagcgacgggcaccttgcacacatttttcggcatgcggcaaaagaattgtttaatgaggacgttgaggaggttacctatagagcactccggaataaggacttccaggaggtgacgctcgaaaagaacggcgaagtcgtgctgaggtttgcggctgcttacggctttcggaacatccagaatatgattctgaagctcaaaaaaggcaagttcccttttcatttcgtggaggtgctggcatgtgcgggaggttgcctgaatggcagaggacaggcacagacaccagatggtcacgcagataaggctctcttgcggcagatggaagggatctatgctgatatccccgtacgtagaccggagtccagtgcccatgtgcaggagttgtaccaggagtggctcgaagggatcaactccccaaaagcccgagaggtactccacaccacctatcaatcacaggagagaggcactcactcactcgatatcaaatggtag

SEQ ID NO: 27884 - DNA, 612 bp, Artificial Sequence
  Description of Artificial Sequence: Synthetic coding sequence
atggcacacgtgtccagtgaaacccaggatgtttcacctaaggatgagttaactgcctcggaggccagcacgcgatccccactttgtgaacacaccttccctggggattccgacctgaggtctatgattgaggagcacgcctttcaggtgctgtctcagggttccttgcttgagtccccgtcatacacagtctgcgtcagcgagcccgataaggacgacgactttctgagcttaaacttccccagaaaactttggaaaattgtggagtctgaccagtttaaatccatctcttgggacgaaaatggcacttgtatcgtcattaacgaagagctgtttaaaaaagaaattttagagactaaggccccttaccgcatttttcaaaccgatgcaattaagtcttttgtcaggcaactgaatctctacggtttctccaagatccagcagaattttcagcgttccgcatttctggctacttttctcagtgaggagaaggaatcctccgtgctgtcaaagatacgatttactaagatgaagctgtcaagatcatcgacatatgaaaaccgttacttgtgctgtaatctgcacttgaaagatgaatctaactattcctag

SEQ ID NO: 27885 - DNA, 2052 bp, Artificial Sequence
  Description of Artificial Sequence: Synthetic coding sequence
atgaacacctcaatcccctaccagcagaatccatacaatcctagagggagcagcaacgtgattcagtgctaccgctgtggcgacacttgtaagggtgaagttgtgagagttcacaacaatcattttcacattcggtgcttcacatgtcaggtctgcggatgtggtctcgcccagtccggattttttttcaagaaccaggaatatatttgcactcaggattatcaacagctttacggcaccaggtgtgacagctgcagagatttcattacaggcgaagtaatcagcgcgttaggccgaacataccaccctaagtgtttcgtctgcagcttgtgcaggaagcccttccctatcggcgacaaggtcacattttcaggcaaagaatgcgtctgccagacctgtagccagagtatggcaagcagcaagcccatcaagatccggggacccagccactgtgccggttgtaaggaggagattaaacatgggcagtccctactggcactggacaaacagtggcacgtttcctgcttcaagtgtcaaacctgctccgtgatcctgaccggagagtacattagcaaagacggggttccgtattgcgagagcgactaccacgcccaatttggaatcaagtgcgagacttgtgatcggtacatatccggcagggtactggaagccggtggtaagcactaccaccccacatgcgcaagatgtgttagatgtcaccagatgtttaccgagggtgaggaaatgtacctgactggaagtgaagtgtggcacccgatttgcaagcaagctgcaagagccgagaaaaaactgaaacacagacgaacatcagagacatcaatctcaccacctggaagtagtattggctccccgaatcgcgtcatatgcgccaaggttgacaacgaaatattgaactacaaagacctggcggcactccccaaggttaaatctatttacgaagttcaacgacccgaccttattagctacgagccacactcccgttacatgtccgacgagatgctcgaacggtgcggatatggagagtcgctaggtactttgagcccctacagccaggacatctacgaaaacttggacctcagacagagaagagcgtcatctcccggatatatcgattcgcccacctacagccgtcaggggatgtcccctacatttagtcggtcaccccatcactattataggtcaggtccagagtctgggaggtcttctccttaccatagtcaactggacgtgcggtcctccaccccaactagctaccaagcacctaaacattttcatattcctgcaggagattccaacatttatcgtaagccccctatttataaacgccatggcgacctgtccacagccaccaagtccaaaacttctgaggacatcagtcaaacctcaaagtactcccccatctatagtccagacccatactacgcttccgaaagcgaatactggacctatcatggaagccccaaggttcctagggctagacgtttctcaagcggaggtgaggaggatgactttgaccgctccatgcacaagctgcaatccggcatcggaaggctcattctcaaagaggaaatgaaggccagatcaagctcctacgccgacccctggaccccaccccgaagtagtacgtcctcccgagaggcacttcacacggccggatacgagatgagtctgaacggctcacctcgatcccactatcttgcggattctgatcccctcatatctaagtcagctagtttgcctgcttataggcgaaatggattgcatagaacaccttccgctgatctttttcattacgactctatgaacgctgtaaactggggcatgcgtgaatacaagatatacccttatgaactcctgcttgtgactactcggggaagaaacagattgccgaaggacgtcgaccgcactaggcttgaacgccatctcagccaggaagaattctatcaggtatttggcatgaccatttccgagttcgacaggctcgccctatggaaacgaaatgaactcaagaaacaggcgaggctcttttag

SEQ ID NO: 27886 - DNA, 2541 bp, Artificial Sequence
  Description of Artificial Sequence: Synthetic coding sequence
atgctgttcacggttagctgctccaagatgtccagcattgtggaccgcgatgactccagtatatttgatggacttgttgaggaagacgataaggataaggccaagcgtgtgtccaggaacaaatctgaaaaaaagcgcagggaccaattcaacgtactgatcaaagaattaggttccatgttacctggtaacgcaagaaaaatggacaaatcaacggtgctccaaaaaagcatagatttcctgcgcaaacacaaggaaattaccgcccagtccgacgctagcgagatccgccaggactggaagccaacctttttgtcaaacgaagagttcacgcagctgatgctggaggctctggacgggttcttcttggccatcatgaccgacggctctatcatctacgtgtctgagtccgttacttccctgctggagcatctgccaagcgacctggtggatcagtccatctttaattttatcccagaaggcgaacacagcgaggtgtataaaatactgagcacccatctgctggaaagtgactctctgacgccagaataccttaaaagtaagaaccaattagaattttgctgtcatatgctgcgcggaactattgacccaaaggagccatctacttacgagtacgtcaaattcatagggaattttaaatccttaaactctgtttccagctctgcacacaatggcttcgagggcacaatccaaagaactcaccggccttcctatgaggaccgggtctgtttcgtagcgaccgtgcggctggccacaccccagtttatcaaagagatgtgtaccgtggaggaacctaacgaagagtttacctcccggcacagcctcgagtggaagtttctgtttctggaccatcgtgctccacccatcatcggctatcttcctttcgaggtgctggggacctccggctatgactactatcacgttgacgatctcgagaacctggcaaaatgccatgaacatctaatgcaatacgggaaaggaaaatcgtgttattaccgcttcctgacaaaagggcagcaatggatttggctgcaaacacattactatatcacataccatcagtggaatagcagaccagaattcattgtctgcacgcataccgtggtgtcttacgctgaggtgcgagctgaacggcgacgagagctaggcatagaagagtcattgccagaaactgcagcggataagtctcaggactcaggcagcgacaatagaattaatactgtctctctgaaagaggcccttgaacgctttgaccacagccccactccttccgccagctcccggtcgagccgtaagagcagccacacagcggtgtctgatcccagttccacgcccacgaagattccgaccgacactagtacccccccacggcaacatttgccggctcacgagaagatggtgcagcgccgaagcagcttctcatcccagagcataaattcacagtctgtcggcagctcccttacacagccagtgatgtcccaggcgaccaacctgccaatccctcagggcatgagtcagttccagttttcagcccaactgggagcaatgcagcatctgaaggatcagttggagcagagaacacgcatgatcgaggccaatatccaccggcaacaagaggagctgcgtaaaatacaggagcagctccagatggtccacggacagggcctacagatgtttttgcagcagagtaaccccggactgaacttcggatcagttcagttgtccagcggcaatagcagtaatattcagcaattggcaccaattaacatgcagggtcaggttgtgcctactaaccaaatccagagcggcatgaataccggtcatatcggcacaacccagcatatgatacaacaacagacacttcaaagtacaagtactcagagtcagcagaacgttctaagcggccattcccagcaaacgagcctgcccagccaaacccagagcacgttaactgcccctctgtataacaccatggtgatttctcagccggctgcgggaagcatggtccaaatacccagttcgatgccccagaacagtacccagtctgccgctgttaccacgttcactcaagatcgccagatacgtttttcccaggggcaacagctggtgaccaaactggttaccgccccagttgcctgcggcgctgttatggtgcccagcactatgcttatgggccaggtcgtgacagcttatccgacattcgccacccaacagcaacagtcccagacactctcggtcacgcagcagcaacagcaacagtcaagccaggaacagcagctgacttctgtccagcaacctagccaggcgcagctgactcaacctccgcaacagtttctgcagacatctaggctgctgcacggaaatccctctacccagctgatactgagtgctgcatttcctctccagcagtccaccttccctcaatcccatcatcagcaacatcagtcccagcagcagcagcagctcagtcgccaccggaccgactcacttcctgaccctagcaaggttcagcctcagtag

SEQ ID NO: 27887 - DNA, 1656 bp, Artificial Sequence
  Description of Artificial Sequence: Synthetic coding sequence
atggggcgaaaagccattgtcctggctatcgcaaatacttccctcgccttcccgctttgccagcacctggtcaccttttgcttaggggaggacgatggcgtgcatacagtagaggatgcaagccggaagctggccgttatggacagccaggggagagtatgggcacaggagatgcttcttcgcgtctcacctgaccacgtcactttacttgaccctgcctcaaaggaagagttggagtcttatcctctcggcgcaatcgtgcgttgcgatgcggtcatgccacctggcagatctagaagcctcttgcttcttgtttgccaggagcctgagcgcgctcagcccgatgtgcacttctttcagggacttagacttggagccgaactaatacgtgaggatattcagggcgctctacataactatcggtccgggagaggagaacggcgagctgccgctcttcgagccactcaagaggaattacaaagggacaggagtccagctgcggaaaccccaccgctgcagaggcgcccttcagttcgcgcagttatctcgacagtggagcgcggagctgggaggggtagaccccaggccaaaccaattccagaggctgaggaagctcagcggccagagcctgtggggacttcctctaatgcagactccgcctctcctgatctaggtcctcgtggaccggacctcgccgtgctccaagctgagagggaagtggacatcctgaatcatgtttttgacgacgtagagtcttttgtttcgaggttgcagaagagcgccgaggcagccagggtgctggagcaccgtgagcgcggaaggcgctcgaggaggcgagcagctggcgaaggtttactcaccctgcgcgcaaaaccaccatccgaagctgaatatacagatgtgctgcagaagataaagtatgcttttagtctactggcacggctccgagggaatatagcagacccatcctcacctgagctcctgcattttctgttcgggccactgcagatgatcgtgaatacctccggcggaccagaattcgcctcctctgtgcgccgtccccatctcaccagcgacgctgtggcgcttctgcgggacaatgtgactcccagggagaatgagttgtggacgagcctgggggattcttggacccgtcccggtcttgagttgtcccctgaggagggacctccctacagacccgaattcttctctggatgggagccccctgtcacagatcctcagtcacgcgcatgggaagacccagtggaaaagcagctccaacatgagcgacgcaggagacaggttacccaggcaacacaacaggggagggggtgggaagtgagaggacgtgggcgtagcgcttggccgagactgaccagactgagctacttccttcaacagagcgcacctcaagtcgccgtaaatggccaccgcgacctggagcccgaaagtgagcctcagttagagagcgaaacagccggaaaatgggtgctgtgtaactatgattttcaggccaggaactcgagcgagcttagcgttaagcagagggacgtcctcgaggcgctgcaagacaaggaaaaagtttccgagctagaagccgtgatggaaaaacagaagaaaaaggtggagggagaggtggagatggaggtcatttag

SEQ ID NO: 27888 - DNA, 1689 bp, Artificial Sequence
  Description of Artificial Sequence: Synthetic coding sequence
atggccgctagcgccaagagaaagcaggaagaaaagcatttaaagatgttacgcgacatgaccggtctcccacacaatcgcaaatgcttcgattgcgaccagagaggcccaacatatgtgaacatgacagtcggttcttttgtgtgcacaagctgttctggtagtttgagaggactgaaccctccccatagggtgaaatccatctccatgactacatttacacagcaggaaatagaattcctgcagaagcatggtaacgaggtgtgtaagcaaatatggctgggactgttcgacgaccggtcctcggccatccctgacttcagggatcctcaaaaagtgaaagaattcttgcaggagaagtatgaaaaaaaacgctggtatgtgcctccagagcaagccaaggtggtcgcctctgtacatgcgtcaatttctggtagttctgcctcctccacaagctccacccccgaggttaaacccctaaaaagtttattgggagattcggcaccgacattgcatctgaacaagggtactccttctcagagcccggtagtggggaggtcccaggggcagcagcaggaaaagaagcagtttgacctcttatcagacctggggtccgacatcttcgcggcacccgcaccacaatccactgcgacagctaactttgcaaacttcgcacacttcaattcccacgcagcccagaattctgcaaacgcagacttcgctaatttcgatgcctttggtcagagctctgggagtagtaacttcggaggctttcctactgcatcacactccccgttccagccccaaactacaggaggcagcgctgcttcagtgaatgcaaacttcgctcatttcgataattttcctaaaagttcatccgcagatttcgggacgtttaatacctcccagtcccaccagacggcctccgccgtgagcaaggtgagcacaaacaaagcagggctgcagaccgccgacaaatatgccgctttggccaacctggacaatattttctcagctggacaagggggtgaccaggggagcgggttcggtacaacaggcaaggcgcctgtgggctctgtcgtatctgttccctcacagtcaagcgcctcttccgataagtatgcggctcttgccgagctcgattctgtgttctcaagtgctgcgacatctagcaatgcatacacgtctacatccaacgccagctctaatgtgttcggcacggtgccagtggttgcttcagcacagacacagcccgcttcctcttcagttccggctccttttggagctacaccttccacgaatcccttcgtggccgctgccggtccgagtgtagcatctagtacaaacccgttccaaactaacgcgaggggggctaccgcagctacttttggtactgcttccatgagcatgcctacaggcttcgggacccccgcaccctacagtctgcctacatccttcagtggctcgtttcagcaacccgctttcccagcccaagctgcctttccccagcagacagcatttagtcagcaaccgaatggggcaggatttgcagcgttcggccagactaagcctgtcgtcactccattcgggcaggtggctgcggcaggagtgagcagtaatccctttatgacgggcgctcctacaggccagttccccaccggctcaagctctacaaatcctttcctctag

SEQ ID NO: 27889 - DNA, 2052 bp, Artificial Sequence
  Description of Artificial Sequence: Synthetic coding sequence
atggctgcagctgtggcagcgcctctcgcagcagggggtgaagaggcagccgcaaccacctcagttcccggtagccccggtttacctggtaggcggagtgctgagagagctctggaggaagccgtcgctaccggcacattgaacctctctaatcgcagactgaaacacttccctcgtggcgctgctcggtcctatgatttgtcagatatcacgcaagccgatttatcacgtaatagattcccagaagtacccgaggccgcatgccaactggttagcctggagggcctgtcactctaccataactgcctaagatgtctcaaccctgcacttggaaatctgactgccttgacttacttgaacctgtctcgcaaccagctgagtctactgcccccatacatctgccaactgcccctgcgggtactgatcgtgtcaaataataagcttggcgctctcccacccgatataggtactcttgggtccctgagacagctagatgtgtctagcaatgagctgcagagtttgccaagtgagctgtgcggcctcagctcgttacgagacctaaacgtccgcagaaatcaattgagcaccctccctgaagagctgggggatcttcctcttgtccgtctggatttcagttgtaatcgagtgtcccgtatccccgtcagtttttgccgcctcagacacttgcaggttattcttctcgactcaaaccctcttcagagccctcctgctcaggtatgtttgaagggtaaactccacattttcaagtatctttcaacagaagcgggacagagaggttctgccctgggggatctcgctccttccagacccccatcattttcaccatgccctgctgaagatctgtttccgggtcaccggtacgacggtgggctggactctggattccactcagttgacagcggcagcaagcgctggagtggcaacgagtccaccgatgaatttagtgagctcagtttccgcatcagcgaactagccagggagccccgaggtccaagagagcggaaggaggatggatcagcggacggggaccccgtgcagatcgactttattgacagtcatgtcccgggagaggatgaggaacggggtacagttgaggagcagagaccacctgagctgtctcctggggcaggtgaccgcgaacgggctcctagttctcgacgggaggagcctgctggcgaagagcgaagaaggcccgacacgttgcagctgtggcaggagcgtgaacggagacaacagcagcagagcggcgcatggggagctcccagaaaagattctctgctcaaaccagggctcagagccgttgtgggaggggcagctgccgtcagcacccaggctatgcataatggcagtcccaagtcctcagcctcacaggccggtgctgctgccggacagggcgctccagcccctgcccctgcctcacaggagccactccctatagctggtccagcaaccgctcccgctccaaggcctctcggaagtattcagcgcccaaactccttcctctttaggtctagctcccaaagtgggagtggaccctcttcccccgatagtgttttgcggccaaggagatacccacaagtgcccgatgagaaggatctcatgacgcagttgagacaggttctcgaaagcaggcttcaacgccctctgccggaagatctggcagaggccttagcatcaggagtgattctgtgtcagctggccaatcaactgaggccgaggtctgtcccattcatacatgtgccaagccctgccgttcccaagttgtcggctctgaaagccaggaagaacgtggagtcttttctggaagcatgcaggaagatgggcgtgccagaggctgatctgtgttctccgtccgatctcctccagggcacagccagaggattaagaaccgcactcgaggctgtgaaaagggtaggcggaaaagccctgccacctttatggccccctagcgggctgggaggtttcgtggtgttttacgtcgtacttatgctcctgctgtacgttacttacacacgactgctgggctcatag

SEQ ID NO: 27890 - DNA, 303 bp, Artificial Sequence
  Description of Artificial Sequence: Synthetic coding sequence
atgtctacctccacttcctgtcccattcctggcggtcgcgaccaacttcctgactgttattcaactaccccagggggtacactctatgctactacacccggaggcacacggataatttacgatcgaaaattcctgctggaatgcaaaaactcccctatcgcgaggaccccaccttgctgtctcccacagataccaggggtaacaactcccccaaccgctccactgagtaaactggaggaactcaaggaacaggagaccgaagaggagattccagatgatgcgcaatttgagatggacatttag

SEQ ID NO: 27891 - DNA, 2382 bp, Artificial Sequence
  Description of Artificial Sequence: Synthetic coding sequence
atgccaatggagagtgcctctagtgataacaaaaagcagatacccaacgaggccagtgcaaggagtgagagagacacttccgatctagagcaaaattggtcactccaggaccactaccggatgtattcaccaatcatctatcaagcactgtgtgagcacgttcagacgcagatgtctctgatgaacgacctgacatcaaaaaatatccccaacggcatcccagccgtgccttgtcatgctcccagtcacagcgagagccaagccacaccacactcaagctacgggctctgtacctcgactcccgtatggtccctgcagcggccaccatgtccacccaaagttcattcagaagtccaaaccgacgggaatagccagttcgcttcacaaggtaagactgtgtctgctacctgtaccgacgttctccggaacagctttaatacatcgccaggtgtcccctgtagcttacctaaaaccgatatctccgccatccccaccttgcagcagttaggtctggtgaatggcatattgccacagcaggggatccacaaggaaacagatctacttaagtgcatccagacttacttgtccctttttcgctctcacggtaaggaaactcaccttgattctcagacacatagaagtccaacacagtcacagccggcatttctcgcaacaaacgaagaaaagtgtgctcgggagcaaattagggaagcaacctctgaaaggaaggacctcaatatccacgtgcgagataccaagaccgtgaaagatgtgcagaaggccaagaatgtgaataagacagcagaaaaggtgcgtatcattaaatatcttctgggtgagctgaaagctttagtggctgagcaggaggacagcgaaatccagcggctgattaccgaaatggaggcctgtatcagtgttctgccaacagtgagcggaaatactgacatccaagtcgagattgctttggctatgcagccattgaggtcggagaacgcacagttgcgtaggcagctgcggatactgaaccagcaactcagggagcagcagaagacacagaaaccttcaggcgctgttgactgtaatcttgagctcttttctttgcaatcactcaacatgtccctgcagaatcagctggaagagtctctgaaatcacaggagctattgcagagtaaaaatgaagaactgctcaaggttatcgagaatcagaaagacgagaacaagaagttcagttcaatttttaaggataaggaccagacaatcctcgagaataaacagcagtacgatattgagatcaccaggattaagatcgagctggaggaggctctggtcaacgtcaagtctagccaatttaaactagagactgcagagaaggaaaatcaaattctcggtatcacactgaggcagcgagacgccgaggttactaggctgagagagctgacacgcacactgcagacctctatggcaaagctcctgagcgacctgtccgtggatagcgctcgttgcaaacctggcaataacctgaccaaaagtctcttgaacatacacgacaaacagctccaacatgatcccgctcccgctcatacaagcataatgtcctatctcaacaagctcgagacgaattatagtttcacacacagtgagcctttatctaccatcaagaatgaggagacaattgaacctgacaagacctacgagaacgtgctgtcctctcggggacctcagaacagcaacacccgaggcatggaggaggctagcgccccaggcatcatttctgccctatccaaacaagattctgacgagggatctgaaacaatggcccttatagaagacgaacacaaccttgacaacactatttatattccttttgcaaggtccacgcccgagaagaaatctcctctctccaagaggctctctccacaaccacaaatacgggctgcgaccacccagctggttagcaattcagggttagccgttagcggaaaggagaataaattatgtacacccgtgatttgctctagcagcaccaaagaggcagaggacgcgccagaaaagctgtctcgcgcttcagatatgaaggacacacagctattaaaaaagataaaggaggcaatcggcaagattcctgcagccacaaaggaaccggaggagcaaaccgcttgccacggtccttccgggtgcctctccaattcactccaagtgaaaggcaataccgtatgcgatggttccgttttcacttcggatttgatgtctgactggtcaatttcaagtttctcaacctttacgtcccgggacgaacaggactttaggaacggcctggccgctctggacgcaaacatagcacggctacagaagtccctccgtactggcctgttggagaaatag

SEQ ID NO: 27892 - DNA, 1119 bp, Artificial Sequence
  Description of Artificial Sequence: Synthetic coding sequence
atgaccttccagtttaacttcactatagaggatcatctcgagaacgaacttactcctatacgagacggggctctgactctagactcctccaaggaactctctgttagcgaatcacagaagggagaggagcgcgataggaagtgcagcgccgaacagtttgacctcccccaagaccacttatgggagcacaagtcaatggagaatgccgctccaagccaagataccgacagtcctctctcagcagctagcagttcgcgaaatctcgagcctcacgggaagcagccctctctacgcgctgcaaaagagcacgcgatgcccaaagatctgaagaaaatgctcgagaacaaggttatagagaccctgcccggattccagcatgtgaaactgtccgttgtgaaaactatcctgcttaaggaaaatttcccgggagagaacatcgtgagcaagtctttttcatctcattccgatctcattaccggggtatacgaaggcggtctgaaaatttgggagtgtacattcgaccttttggcctactttacaaaagcaaaagtgaagttcgccggtaagaaagtcctcgatctgggctgcggctccggactgcttgggattaccgcttttaagggaggcagcaaggagatacacttccaggattacaactcgatggtcattgacgaagtcacactccccaatgtagtggccaattccactctggaggacgaggaaaacgatgtgaatgaacctgatgtcaaacgctgtagaaagcccaaagttacccaattgtataagtgtagatttttttctggcgagtggtcagagttttgtaagctggtgttgtctagcgagaagctgttcgtgaaatacgatctcatcctgacctccgaaactatctataacccagactattactccaacctgcaccagacatttctccgccttctgtccaagaatggacgcgtgctgttggcaagtaaggctcactactttggtgtgggcggtggtgtacacttattccagaagttcgtggaggaaagggacgtcttcaagaccagaatcctgaagattatcgacgagggactgaagagatttatcatcgagattaccttcaagtttcccggatag

SEQ ID NO: 27893 - DNA, 336 bp, Artificial Sequence
  Description of Artificial Sequence: Synthetic coding sequence
atgactacactgcgggcattcacctgtgacgatctctttagatttaacaacattaatctggatccactgacggagacttacgggatccctttctatctgcagtacctcgcccattggcctgaatatttcattgtagctgaagccccagggggagagctgatgggctatattatgggaaaagcagagggtagcgttgccagagaagaatggcacggccatgtcaccgctctgtcagtggctcccgaattccgcagactgggcctcgccgctaagctgatggaactgctggaagagatcagcgaaaggtatgaggagtctactttccagggctattag

SEQ ID NO: 27894 - DNA, 1449 bp, Artificial Sequence
  Description of Artificial Sequence: Synthetic coding sequence
atgaatggcacattggatcacccagaccaacctgatctggatgctatcaagatgtttgtgggacaagtccccaggacttggtccgagaaagatctgagggagctctttgagcagtacggggcagtatacgagatcaatgtgctgcgagacagaagccagaatccccctcagtcaaaaggttgctgcttcgtaacattctacacgcgaaaagcggctctagaggcccagaacgcacttcataacatgaaagtgctaccgggtatgcatcaccccattcagatgaaaccagctgactccgagaaaaacaacgccgtggaggacaggaagctgttcataggcatgatatcaaaaaagtgtaccgagaacgacatccgtgtgatgttcagcagtttcggtcagattgaagagtgtaggattctccgtggccctgatgggttgtctcgcggatgtgccttcgtgacctttaccactcgggctatggctcagaccgcaataaaggccatgcatcaggcccagactatggagggttgttccagtcctatggtggtgaaattcgctgacacacaaaaggataaggagcagaaaagaatggctcagcagctgcagcagcagatgcagcagatttctgccgctagcgtctggggtaatctggccggactcaataccctaggacctcagtacctggcgctcctgcaacagacagctagttccggcaacctgaatacattatcgtccctgcaccccatgggcggtcttaatgccatgcagctgcagaacctggctgcattggctgcagcagcctctgcggcacaaaacaccccttcagggacgaacgctcttacaacctctagtagtccactgagtgtgctaacatcctcagggagtagcccgagctcaagctcgagcaactccgtgaaccctatagcctctctgggggctctccaaaccctcgcaggagctacagccggtttaaacgtgggttccctggctggtatggcagctttgaatgggggactggggtcaagtggcctgtccaacgggaccggatcaaccatggaggccttgacccaagcttattccggaatacagcagtatgctgcagccgctctcccgacactatacaaccaaaatctgctaactcagcaatctattggtgcagccggatcacagaaagagggacctgagggtgcaaacttgtttatttatcatttgccacaggagttcggagatcaagacctcttacaaatgtttatgccgttcggtaatgtagtgtctgccaaggtgttcatcgacaagcagacgaatctaagtaaatgctttggtttcgtgagctatgataaccccgtgtcagctcaggcagcaatacagtcaatgaacggttttcaaatcgggatgaagagactgaaggtccagctgaaaaggtctaagaacgactctaagccgtactag

SEQ ID NO: 27895 - DNA, 1347 bp, Artificial Sequence
  Description of Artificial Sequence: Synthetic coding sequence
atgtctcccctggagtgcagcgaatgctttggagatcagctgcttcaccgcacttatacttggcagcttactctgcactctcgaccgaactacacccggaagagagatacccgctctgagagcctggaaataccgatctcagtggtgctgccgcagcgaggtactgccgagccatttccccgactgcacaacctatactcgacaccgcgatgtgcacagcaggctgccctgcccagactttctcgaaggatggcctcccagcattcttatcctctgaacaggttttcttctgtacccctggatcctatggaaagacccatgagccaggcagacctcgaactcgactacaacccaccgcgtgtccaactgtcagacgaaatgttcgttttccaagatggcagatgggtcaatgaaaactgccgcctacagtctccgtatttttcgccctcagcatcatttcatcacaagctgcaccacaagcgcctggctaaggagtgtatgctccaggaagaaaataagtccctccgggaagaaaacaaagcgcttagagaagagaacagaatgctttccaaggaaaataaaattctgcaagtgttctgggaggagcataaggctagcctcggccgtgaagaaagccgcgctcccagtcctctgctccataaagattctgccagtctggaggtcgtaaagaaagaccacgttgcattgcaggtaccgcgtggaaaagaagatagcacgctacagttactgcgagaagaaaatagagccctgcaacagctcctcgagcagaagcaagcttactgggctcaggcggaagacactgctgcacccgctgaggaaagcaagccagctcccagtccccatgaagaaccttgctcccccggactcctgcaggaccagggatccggcctgagctccaggtttgaggagcctaagggcccaccagccaggcaggaggacagtaaggaacttcgggctcttcgaaagatggttagtaacatgtctggaccttctggagaggaggaggcgaaggtagggccagggctgccagatggctgtcaacctctgcagctcctgagggagatgcgacaagcgctgcaggccttgcttaaggaaaatagacttttacaggaagagaacaggactctgcaggtccttagggcggaacacagaggttttcaggaggaaaacaaggccctgtgggagaataataaactgaagttgcagcagaaactcgtgatcgacacagttactgaggtaactgcgcgaatggaaatgttgatcgaggagctctacgcattcatgcctgcccgatctcaggatccgaaaaaacctagccgagtctag

SEQ ID NO: 27896 - DNA, 1002 bp, Artificial Sequence
  Description of Artificial Sequence: Synthetic coding sequence
atggcagcagcagcagccggtaccgcaaccagccagaggttttttcaaagcttcagtgatgccctgattgatgaggatccacaggcagccctggaggagctgactaaggctctggagcagaaaccggatgacgcacagtattactgtcagagagcctattgccatatcctgctgggaaactactgcgtggcagtagcagacgcaaagaaatcactggagctgaaccctaataacagcacagcaatgctgaggaaagggatctgcgaataccacgagaagaactacgcagcagctctggagacctttaccgagggccaaaagttggacagcgccgatgccaacttcagcgtgtggatcaagcgctgccaagaagctcagaacggtagcgaatcagaagtctggacccaccaaagcaagatcaagtacgattggtatcaaactgaaagtcaggtcgtcattacgctgatgataaaaaatgtccaaaaaaacgacgtaaatgtagagttcagcgagaaggaactttcggccctggttaagctgccgagcggcgaggactataatttgaaactggagcttctgcaccccattatacccgaacaaagcacctttaaagtcttgagcactaagatagagataaagctgaaaaaaccagaagctgttcgctgggagaagctcgagggtcagggggacgtgcccaccccaaaacagtttgtggctgatgtgaaaaatctgtatcctagttcaagcccttatacgcgcaattgggacaaattggtaggagagatcaaggaagaggaaaagaacgaaaaactcgagggagatgctgctttaaacagactttttcaacagatctactccgatggcagtgacgaagttaaaagagctatgaacaagtcttttatggagagcggagggactgtgctgagtacgaactggtcggatgtgggcaagcggaaagttgaaatcaatcctcctgatgacatggaatggaagaaatactag

SEQ ID NO: 27897 - DNA, 1029 bp, Artificial Sequence
  Description of Artificial Sequence: Synthetic coding sequence
atgtctctacacggaaagcgaaaggaaatttataaatatgaggccccatggacagtctacgctatgaactggagcgttcgccctgacaagaggtttcggctcgcccttgggagcttcgtggaggaatataataacaaagtccaactggtgggtctggatgaggagtctagtgagttcatttgcaggaataccttcgatcacccctaccctacaaccaagctgatgtggatccctgatacaaagggtgtctacccagaccttctggccacctctggcgactatctgcgggtgtggcgggtgggggagacggagactcgactcgaatgcctgttgaataacaacaaaaatagtgacttctgtgctccactcacaagctttgattggaacgaagtggacccctatctgcttgggacaagctctatcgacacaacgtgcactatttggggattggagaccggtcaggtcctcggtcgagttaacctagtatcagggcacgtgaagacgcagctcatcgcccacgacaaggaagtttacgatatcgcctttagccgggcagggggtgggagggacatgtttgcttctgtcggtgccgacggctcggtgcggatgtttgacctcagacacctggagcattctactattatctatgaggacccccagcatcaccctcttttgcggctttgctggaacaagcaggatccgaattatctggctacaatggcaatggatggtatggaggtagtgatcctggacgtgcgcgtcccatgtaccccagtcgccagactgaacaaccacagggcctgcgtcaatggcatcgcctgggcaccacacagctcctgccatatctgcacagccgcagacgaccatcaggctttaatttgggatatccagcagatgcctcgtgccatcgaggacccaatactcgcttacacagcagagggggaaataaacaacgtacagtgggcctcaacacagccagattggatagccatttgctacaacaactgtttagagattctgcgggtttag

SEQ ID NO: 27898 - DNA, 507 bp, Artificial Sequence
  Description of Artificial Sequence: Synthetic coding sequence
atggccgagggctcgcgcatccctcaagctcgcgcactactgcagcagtgtctccacgccaggctacagatcaggcctgccgacggagacgtggcagctcaatgggttgaggtgcagagaggcctcgtgatctatgtgtgcttctttaaaggggcagataaggaactgctacccaagatggtaaacacgcttctcaacgtcaagttatccgaaactgagaatggcaaacatgtgtccatcttggaccttccaggcaatatccttattattccccaggccacgttgggcggacgactgaaaggcagaaacatgcagtaccatagcaatagcgggaaggaggagggatttgagctgtattcccagtttgtgactctgtgtgagaaggaagtagcagctaacagcaagtgtgcagaagccagagtggtggtggagcacgggacttatggcaaccggcaggtcctgaaactggacactaatggaccatttacccacctgatcgagttttag

SEQ ID NO: 27899 - DNA, 3069 bp, Artificial Sequence
  Description of Artificial Sequence: Synthetic coding sequence
atggagggggctttaactgcacgagacaaggtgggtgtgcaggacttcgtattgctggacgcttacacatccgaatccgcatttgtggacaatctccgaaagcgcttcagcgagaacctgatctacacgtatattggtaccctcctcgtaagtgtgaatccttatcaggaactgggcatctacactgtgagccagatggagctttatcagggggttaattttttcgagctcccgccacatgtgtacgctatcgccgacaacgcctaccgcatgatgtgtgccgaactgaataatcactttattctcatttccggggagagtggggcagggaagacggaggcatctaagaagatactggagtacttcgcagttacttgcccaatgacccagtctctacagatcgccagggaccggctgctgttcagcaatcccgtccttgaagcttttggtaacgctcgaacacttaggaatgataattcctccagatttggtaagtatatggatatacagtttgacttccagggtatcccagtggggggacacattattagctatctcatcgagaagagccgggtggtttaccagaatgagggcgaacggaacttccatatcttctaccagctgcttgcgggtggtgaggaagagcgtctttcctatttgggcctcgaacgggaccctcaactgtacaagtaccttagtcagggtcactgtgccaaggagtcctccatcagcgataagaacgattggaaaactgtttccaacgcgttctccgttatagacttcacggaagcggatttggagaatctcttcggcatcatcgcaagcgtgctccacctgggaaacatcgggttcgaagaagacgaccagggctgcgctacaatccctgacacccacgaaatcaagtggatcgcgaagctgcttggcgttcacccttccgtcctcctggaggcccttacccaccgtaagattgaggccaagactgaagaggtgatctgcccactgacacttgagctctccgtgtatgctagggacgctatggcgaaagcagtgtatgggcgtacattcacttggcttgtgaataagattaactcttctttagtcaacaaagactttacccggaagacggtgattggcctgctggatatctacgggtttgaggtcttcgataagaacgggttcgaacagttctgcatcaattactgcaatgaaaaattgcagcaacttctgatcgagcgcaccctgaaagctgagcaagccgagtatgagatggagggcatcgagtgggagccaattaaatacttcaataataaaatcatctgcgaccttgttgaggagaggcacaaagggatcatctcaatcctggacgaggaatgcatcaggcccggacccgcaactgacctgagctttcttgagaaacttgaggagaaagttggtaagcacgcacactttgagaccaggaaattagccggtcccaagggacgaaagaggatcggatggatggagttcagattattgcattacgctggggaagttacttactgtaccaaagggttcctggagaagaacaatgatctgctctataggcatttgaaagaggttctgtgcaagagcaagaatataatactgcgcgagtgcttcctgctggctgagctcgagaatcgccgacggccaccaactgtgggcacacagtttaagaacagtttgtcatccctgctggaaactttaatctcaaaggaacccagctacatacggtgcataaaacccaacgacagaaaggaaccctcaaaattcgatgacttcctcattcgacaccaaattaagtacctgggtctgatggagcatttacgcgtccgacgcgctggctttgcgtaccggcgtaaatatgagcatttcctacaacgctacaaaagcctgtgccctgacacgtggccccattggcatggacctcctgcagagggtgtcgagagactgattaagtacataggctacaaacccgaggagtataagctcggaaagactaagatattcatacggtttccgcgaaccttgtttgccacggaggatgccttcgagttctcgaaacaccagctggtcgctaggatccaggccacctataagagatgcctgggacgacgggagtacgtaaagaagagacaagctgccatcaagctcgaggctcattggagaggggctctcgccaggaaggccatacagcgtaggaaatgggccgtccgtatcatcaggaagtttataaaaggcttcattagcaggaataaacctctgtgtcctgacaacgaagagtttatcgtgtttgtgagaaaaaattacatcctgaaccttaggtaccacttaccaaagacggttctggataagtcttggttgcgacctcccggtattcttgaaaacgcttcagacctgctacgcaagatgtgtgtgagaaatcttgttcaaaagtactgtcgcggaattactgcagaacgaaaagctatgatgcagcagaaggtcgtgacaagtgagatatttcggggaaggaaggacggctatacagaaagtttaaaccagccattcgtgaacagcaggatagatgagggcgacattaatccaaaggtgttgcagttgatttctcacgagaagatccagtacggtgtcccagtgattaagtatgaccgcaagggttttaaggctcgtcagagacagctcatcctaacccagaaggccgcatacgtggtggagcttgccaaaatcaagcagaagatcgaatactctgctcttaaaggcgtctccacgtccaacttgagcgatggcatacttgtgatccacgtctcacccgaagatagcaagcagaagggcgacgctgtgttacaatgcggacatgtttttgaggctgtgacgaagctggtgatgctggtcaaaaaagaaaacatcgtgaatgtcgtccagggaagcctgcagttttttatctctccaggcaaagagggtaccattgtgtttgatacagggctagaggagcaggtttataaaaataaaaacggacagctcaccgttgtgtctgtgcggaggaagtcttag

SEQ ID NO: 27900 - DNA, 1044 bp, Artificial Sequence
  Description of Artificial Sequence: Synthetic coding sequence
atgaatactcttatggatgttctgcgccaccgcccagggtgggtggaggtcaaagatgaaggggagtgggatttctactggtgcgacgtctcatggctgagggagaactttgaccacacatacatggatgaacacgtcagaatcagtcatttcagaaatcactacgagttgaccaggaaaaattatatggtgaagaatctgaagcgattcagaaaacagttagagagagaggccggaaagctggaagcggctaagtgcgatttctttcccaagacattcgagatgccctgcgagtaccacctgttcgtagaagaattccgcaagaatcctggcatcacttggatcatgaaacctgttgctcggagtcaggggaaaggcatcttcctgtttagaagattgaaggacattgtagattggcgcaaggatacccgcagctccgacgaccaaaaagacgatatacctgtggagaactatgtggcccagagatacatcgaaaacccttacctgattggcggaaggaagtttgacttacgagtctacgttctggtgatgtcatatattccccttcgggcatggctttaccgcgacggtttcgccagattcagtaacactcggtttaccctcaatagtatagatgatcagtacgtgcacctgaccaatgttgctgtgcagaagacaagcccagattatcacccgaaaaaaggatgcaaatggaccctgcaaagattccggcagtacctagcctccaaacacggccctgaggctgtcgagaccttatttagggatatcgataatatcttcgtgaaaagcctgcagtcagttcaaaaagttatcatatctgacaaacactgcttcgagctctatggatacgacatccttatagaccaggacttgaaaccttggctccttgaagtgaacgccagtcctagcctgactgcttcctcgcaagaggactacgaattaaagacatgcctgctcgaagacacactgcacgtcgtggatatggaggcaagatcactgagagccgattctccatgttggtag

SEQ ID NO: 27901 - DNA, 444 bp, Artificial Sequence
  Description of Artificial Sequence: Synthetic coding sequence
atgtcctcagaacctccacctccaccccagcccccaacccatcaagcaagcgttgggttgcttgatacccccagaagccgcgagaggtcaccgagccccctcagaggcaatgtcgtccctagccccctgccaacacggcgtacccgaacattctctgccaccgtgcgtgcctcccaggggcctgtgtacaagggcgtgtgcaagtgtttctgtcgtagcaagggccacggcttcattaccccggcagacggtggacctgatattttcctccacataagcgatgtggagggggagtacgtacctgtcgaaggggacgaagtcacctacaagatgtgctcaattcccccaaaaaatgaaaaactgcaggccgtagaggttgtcatcactcacctagcaccgggaacaaagcacgagacctggtcaggacacgttattagctcctag

SEQ ID NO: 27902 - DNA, 558 bp, Artificial Sequence
  Description of Artificial Sequence: Synthetic coding sequence
atggccgacggaggcggtggcggtgggacaggggctgtgggcggaggcggtacctcacaggcgtctgccggtgctgccaccggcgctaccggtgcttccggaggcggtgggccaattaaccctgcatcattgccccctggggatccccagctcattgccctcatcgttgaacagttgaaatccagggggcttttcgatagtttcaggcgcgactgtctggctgatgtcgatactaaacctgcctaccagaatcttcgccagaaagtggacaatttcgtgagcacgcacctggataaacaagagtggaaccccaccatgaataagaatcagctgagaaatggcctcagacagtctgtcgtccaaagcggcatgttagaagcaggcgtggatcggattataagtcaagttgtagaccctaaacttaaccacatattcaggccccagatagagagagccattcatgagtttctcgccgcacaaaagaaagcagctgttccagcacccccacctgagccggaaggacaggatcccccagccccatctcaggacacttcttag

SEQ ID NO: 27903 - DNA, 6351 bp, Artificial Sequence
  Description of Artificial Sequence: Synthetic coding sequence
atggatgaggtcgaacaggaccagcatgaggccaggcttaaagagctgttcgactctttcgacacaacgggtaccggatccctaggacaggaggagctcacagacttgtgtcatatgttgtctctcgaggaggtggccccagtgcttcagcagacacttctgcaggacaacctgttgggcagggtgcactttgaccaatttaaggaggcactcattctaatcctttcacgcaccttgagcaacgaagaacattttcaagagcctgactgtagcctcgaggcccaaccgaagtatgttaggggcggtaagcggtatgggcgacggtccctcccggaattccaggagagtgtagaggaatttcctgaggtgaccgtgatagagccactcgacgaagaagctagaccgtcccacatacccgctggcgactgctccgaacactggaagactcaaagaagcgaagagtacgaagctgagggacagctgcgcttctggaatcccgatgatctgaatgcttctcagtccggctcatcacccccacaggactggattgaagagaaactgcaagaggtgtgtgaggatctgggaataaccagagacggccacctgaatcgcaagaaacttgtctcgatctgcgagcagtacgggctccagaacgtggatggggagatgttagaggaagtgttccataacctcgacccagacggaaccatgtcagtggaagacttcttttatggtctgtttaaaaacggcaagagcctgacgccgtcggcctctacaccgtaccgtcagctcaaacggcatttgtcgatgcaaagctttgatgaaagcggcagacggaccactacaagttcagctatgacatccacgataggtttccgggtgttcagttgccttgatgacgggatgggacatgcgagcgtcgagcgaatcttggacacctggcaggaagaaggaattgaaaattcacaagaaattctgaaagccctggactttagtcttgatggcaatattaatctgaccgagcttacgctggccctcgagaatgagttgttggttactaagaactctatacatcaggccgcacttgcgagcttcaaagcagagatccgccatcttcttgaaagggtggaccaggtagtgcgcgaaaaggagaaactccggagcgacctggacaaggccgagaaactgaagtccctcatggccagcgaagttgacgatcaccatgctgctatagagaggcgcaacgagtataacctccggaaactcgacgaggaatacaaagagcgaatagctgcacttaaaaatgagctccgaaaagagcgcgagcaaattctgcagcaggctgggaaacagcggctcgagcttgaacaggagattgaaaaagctaaaaccgaagagaattatatccgagaccgcttggccctgtcactcaaggagaattcaaggctggagaatgagttgctggaaaatgcagagaacgttcttgctgagaaattcggcgacctcgatccttcgagcgccgagttcttcctgcaggaggagcgattaacccagatgcggaatgagtatgaacgtcagtgtagggtgctgcaggaccaggtggatgagctgcagtcagaactggaagagtatcgggcacaggggagggttctccgacttccgctcaaaaattccccttctgaggaggtagaagccaactctggtggaatcgaaccagagcacgggctgggttcggaagagtgtaatccactgaacatgtcaattgaagccgagctcgtgatcgagcagatgaaggaacagcaccaccgggatatctgctgccttaggttggaactcgaagacaaggtgcggcattatgagaagcagctggatgagactgtcgtaagttgtaaaaaagctcaagaaaacatgaaacagcgccacgaaaatgagactcacaccctcgagaagcaaattagtgatctgaagaatgagatcgctgagctgcaggggcaggccgctgtgctgaaggaggcccatcatgaggctacgtgtcggcacgaagaagagaagaagcagcttcaggtgaagctggaagaggaaaaaacccacctccaggaaaaactcagacttcaacatgagatggagctcaaagcacggctgacccaggcccaggcgtcctttgaaagagaacgagaaggcctgcagagctccgcctggacagaggagaaggtccgcggtcttacacaggagctggagcagttccatcaggaacaattaacttccctggtcgaaaagcatactctggaaaaagaggaacttagaaaggagctgcttgagaagcaccagcgagaactgcaggaaggcagagagaagatggagactgagtgcaatagacgcacctcccagattgaggcccagtttcagtcagactgtcagaaggtgacagagcgatgtgagtcagccctgcaatcgcttgagggacggtaccgtcaggaattgaaagaccttcaggagcagcaacgcgaagaaaagtcccaatgggagtttgaaaaagatgagttgactcaggaatgtgccgaagcccaggagctgttaaaggagacactcaaacgggaaaaaacaactagcctggtgctgacccaagagcgagaaatgctcgagaaaacatataaagaacacctcaattcaatggtggtggagcgccaacaactacttcaagacttggaggatctacgaaacgtatccgagacccagcagtccctgctgagcgatcagattctggaactcaagagctctcacaaacgcgaactaagagagagagaggaggtgctctgtcaggccggagcatctgaacagctcgcctcacaacgactagagagactggaaatggaacatgaccaggagcgccaggagatgatgtccaagttactggcaatggagaatattcacaaggccacttgcgagacagcggatagagaaagagctgagatgagcacagaaatatccagactgcagtcgaagattaaggagatgcagcaggctacctcccccctttcaatgctacagagcgggtgccaggtgattggggaagaagaagtggagggggatggagccctgtctctactgcagcagggagagcaattgcttgaagagaacggggacgtcttgctctcactgcagcgggctcacgaacaggcggtcaaagaaaatgtgaaaatggccaccgagatctccagattacagcagagactccagaagttagagcccggtctggtgatgtcctcatgtttggatgaaccggcaaccgagttctttgggaacaccgccgagcaaacagagcagtttctgcagcaaaatagaactaaacaggtggaaggagtgacccgccgtcatgtgctgtcagatcttgaggacgatgaggtccgagacctcgggagtacgggcacctctagcgtgcaacgacaggaagtcaagattgaagagtcagaggcctccgtggagggatttagcgagcttgagaattctgaggaaactcgcacagaaagctgggagctgaagaatcaaatctcacagctgcaggagcagttaatgatgctgtgtgccgactgcgaccgtgcctcagagaaaaaacaggatctactgtttgatgtatcagtgctgaaaaagaagcttaaaatgttggagcggattccagaggcctctcccaagtacaaactgctgtatgaggatgtgagtagagagaatgattgcctgcaagaggagctccgcatgatggagactaggtacgatgaagccctcgaaaacaataaggagctgaccgcagaagtgttcaggttgcaagacgagttgaagaagatggaagaggtgacagaaaccttccttagtctggaaaaaagctacgatgaggtcaaaatcgaaaacgagggcctgaatgtgttagtgttaagattgcaggggaagatcgaaaaattacaggagtcggtggtgcagagatgtgattgttgtctgtgggaggcgagtctagaaaatctcgagatagaacctgacggtaatatcctgcagctgaatcagacattggaggaatgcgtgccaagagtgcgctccgtacaccatgtcattgaagaatgtaaacaggaaaaccagtaccttgagggaaacacacagctgctggagaaggtcaaggctcatgagatagcctggctgcacggaaccatccagacgcatcaagaaaggccacgggtgcaaaatcaggtgattctggaggagaacacaaccctgctggggtttcaagacaagcatttccagcatcaggctactattgctgagttagagctagaaaagaccaagctccaggagttgactcgtaaactgaaggagcgggttacaattctcgtaaagcagaaggacgttctaagtcatggcgagaaagaggaggagctgaaagcgatgatgcacgacctgcagatcacttgtagcgagatgcagcagaaagtcgagcttctgcgctatgagtctgaaaaactgcagcaggaaaactcaatcctgaggaatgaaatcactacactcaacgaagaagattcaatttctaacctgaagttggggactctgaatggtagccaggaggagatgtggcagaagaccgaaaccgtgaaacaggagaacgcagcggtccaaaaaatggttgagaacctgaaaaaacagatttctgaacttaaaattaaaaatcagcagttggacctggagaacactgagttaagtcagaagaactcccaaaatcaggagaagctccaagaactgaatcagcgcctgaccgaaatgctgtgtcagaaggagaaagagcccggtaacagcgcccttgaggagcgcgagcaagaaaagttcaacctcaaggaggaactcgagcgttgcaaagtgcagtcttcgacgctcgtgagtagcctcgaggccgagctgtccgaagtgaaaattcagactcacatagtgcagcaggagaatcacttgctgaaggatgaattagagaagatgaaacagcttcatcgttgtccagatttatctgacttccagcaaaagatttcctccgtgttgagttacaatgagaaactgctgaaggagaaagaggccttgtcagaagagctgaattcttgtgttgataagctggcgaaatcctccctgttggagcacagaatcgcaacaatgaagcaggaacagaaaagctgggagcatcagtccgcctccttgaagtcccagctggtggcgagtcaggagaaggtgcaaaatcttgaggatacagtccagaacgtgaatctgcagatgtcaaggatgaagtccgatctgcgagtgacccagcaggaaaaggaagcgctaaagcaggaagtgatgtccctgcataaacagctgcagaacgctggtggtaaatcctgggctccggagatcgctacacatcctagcggacttcataatcagcaaaagcgactaagctgggacaagttggatcatttaatgaatgaggaacagcagctgctctggcaggagaacgaacgcctacaaacaatggtccagaataccaaggctgaactcacacactcaagagagaaggtcagacagcttgaatcaaatctgctgccaaagcatcagaaacacctgaacccctccggcacgatgaaccctacggagcaggaaaagctgtccctgaagcgggagtgcgaccagtttcagaaggagcaatcacccgctaaccggaaggtgtctcagatgaatagcctggagcaagagcttgaaacaattcacctggaaaatgaaggacttaaaaaaaagcaggtcaagttggacgagcagctgatggaaatgcagcatcttcggtcgactgccacaccctctccttctcctcacgcatgggacctacagctcctgcagcagcaagcttgccccatggtgcctcgggagcagttcctgcaactacaacgacagctgctacaggcagagaggatcaaccagcatctgcaggaagagctcgagaaccgaacttcagagacgaacactccccaaggcaaccaagagcagttagtcaccgtgatggaggagaggatgatcgaggtggagcaaaagctgaagctcgttaagcgtctgctccaggagaaagtaaaccagctaaaagagcagctttgcaagaatacgaaggcagacgcaatggtcaaagatctgtatgtcgagaatgcacagttgttaaaagcactagaggtgaccgagcaacgacaaaagacagcagagaagaaaaattatctgttggaggaaaaaatcgcgtccctgtcaaacatagttcgcaacctgacccccgcacccttgacctccactcctccattgcggtcttag

SEQ ID NO: 27904 - DNA, 2664 bp, Artificial Sequence
  Description of Artificial Sequence: Synthetic coding sequence
atgcccattcttttgtttctgattgacactagtgcttcaatgaaccagcgtagtcatctcggcacaacatacctggatacagctaagggcgctgtggagacattcatgaagctacgcgctagggatcctgcatccagaggggatcggtatatgctcgtgactttcgaagagccaccttacgctatcaaggccggttggaaggaaaaccacgccacctttatgaatgagctgaagaacctccaggccgaagggctgaccaccctgggccaaagcctacggaccgcttttgacttgcttaaccttaaccgtctcgtaaccggcatcgataattacggccaggggaggaatccctttttcctggaaccggcaatcatcataacaattaccgacgggtcaaaactgacaaccactagcggtgtacaggacgagttacacctccccctgaatagcccactgcctggaagcgagttaaccaaagagcctttccgctgggaccaacggttgttcgctcttgttctgagactccctgggacaatgtccgtggagtctgagcagctaactggggtgccccttgatgacagcgccattactccgatgtgtgaggtgaccggagggaggagttacagtgtgtgttctcctagaatgctcaatcagtgtctggaaagcctagtgcagaaggtccagtcgggcgtggtgataaattttgagaaggctgggcctgacccttctccagtagaggacggccaacccgatataagtcgtcccttcgggagtcagccatggcactcgtgccacaagctgatttacgtacgcccaaaccctaagaccggcgtgcccatcggtcactggccagtaccggagagcttctggccggaccaaaacagtcccaccctaccccctagaacaagccaccccgtggtcaagttcagctgtacagactgtgaaccaatggtgatcgacaagctcccttttgacaagtatgagctggagcctagtcctctgacccagtttattcttgaacggaagtcgcctcagacatgctggcaggtttacgtcagtaattccgccaagtatagtgagctgggccacccgtttggctacttgaaagccagcacagctctgaactgtgttaacctgtttgtgatgccttataattaccccgtgctgctgcccctcctggacgacctgtttaaggttcataaggcaaaaccaaccctgaagtggcgacagtcgttcgaaagctacctgaagaccatgcctccctattatctgggccctctcaaaaaggccgtaagaatgatgggtgcgccaaacttaatagcggatagcatggaatatggtctgtcctactcagtcatatcctatctaaaaaaattaagtcagcaggccaagattgagtcagaccgtgttatcggatctgtcgggaagaaagttgtgcaggaaaccggaatcaaggtcagatcaaggtcacacggcttatccatggcttacaggaaggactttcagcagttgctgcagggaattagcgaggacgtaccccacagactcttagacctgaatatgaaggagtataccggcttccaggtggccctgcttaataaggacctgaagccccagacgttccgtaacgcctatgacatcccacggcgtaacttacttgaccaccttacacgaatgcggagcaacctcttgaagagtacccgaaggtttctcaaaggtcaggacgaggaccaagtgcacagcgtgcccatcgctcagatgggaaactatcaggagtacctaaaacaagtcccttctccacttcgcgaactcgatccggaccaacccagacgccttcacactttcggcaatcctttcaaacttgataaaaagggaatgatgatcgatgaagccgatgagtttgttgccggacctcaaaataagcacaaaagaccgggtgaacccaacatgcagggcatacccaaaagacgcagatgcatgtcccccctcctacgaggaagacagcagaatccagtcgtgaataaccatatcggaggcaaggggcctccagctccgactacccaagctcagcccgatctgattaagccattgcctttgcataagatcagtgaaacaactaacgactccatcatccatgacgtggtcgagaatcacgtggctgatcagctcagtagcgacattacccctaacgctatggacaccgagttctccgcttcttccccggcttctctgctcgagagaccaactaatcacatggaagcactgggacacgatcacttggggaccaacgacctgaccgtgggcggtttcttggaaaaccatgaggagccgagagacaaggagcaatgtgctgaagagaacatccccgcaagcagcctgaataaagggaaaaagctgatgcactgtcgcagtcacgaagaggttaataccgagctcaaggcccagatcatgaaggaaattcgcaagcctgggcgtaagtatgagagaatcttcacattgctaaagcacgtccagggttccctacagacgagacttatattcctccagaacgttatcaaggaagcttctaggtttaaaaagagaatgctgatagaacagttggagaattttctggacgagatacaccggcgagccaatcagatcaaccacatcaatagcaactag

SEQ ID NO: 27905 - DNA, 1944 bp, Artificial Sequence
  Description of Artificial Sequence: Synthetic coding sequence
atgtctgatgaggtgttctcaacgaccctggcttacaccaagtcaccaaaagtgaccaagagaacgaccttccaggacgagttgattagagctataacagccagaagtgctagacaaagaagcagcgagtactctgatgacttcgacagtgacgagattgtgagtcttggcgacttctccgacaccagcgcagacgagaatagtgtgaacaaaaagatgaatgactttcacatcagtgatgacgaggaaaaaaaccccagcaagttgttgttcctgaagacaaacaaaagcaacggaaatatcactaaggacgaacccgtgtgtgccattaagaatgaggaagagatggcacccgacggatgtgaggacattgtggtgaagtccttttcagaatcacagaataaggatgaagaatttgaaaaagataaaataaagatgaagcccaagcctcgcattctgtccattaaatccacgtcctccgctgaaaataactcgttggacacggacgaccatttcaaaccgagcccaaggccacgctcgatgctgaagaagaaatcgcatatggaagagaaagacggtctcgaggacaaagaaacagccttgtccgaagagttggagctgcactctgcaccatcgtccctgcctactcctaatggtattcagttagaagccgagaaaaaagcattttccgaaaatctggatcccgaggactcctgtttgaccagcctggcatccagctcgctgaaacagattctcggcgatagcttcagtcctgggtcagagggcaacgcctcaggtaaagatcctaatgaggagataacggaaaaccataacagcctgaagtcagatgagaacaaagaaaattcattctctgctgaccatgtgacaaccgcagttgagaagagtaaggagtctcaggtcactgccgatgacttggaggaagagaaggccaaagcagagctgattatggacgacgacaggaccgtcgatcccttgctgagcaagtctcagagtatactaatcagcacatccgctactgcttcaagtaagaagacgattgaggataggaacatcaaaaacaaaaagtccacgaacaatagggcctcttctgccagtgccaggctgatgacatctgagtttttgaagaagagctcgagcaagagacggacaccctcaacaacgaccagcagtcactacctagggacactcaaggtgttggaccagaaaccctctcagaagcagagcatcgagcccgatagagcagacaacatacgggcagccgtgtatcaggaatggctagagaagaaaaatgtgtacctgcacgaaatgcaccgtataaaaagaattgagtctgagaatctgaggatccagaacgaacagaaaaaagcagctaagagagaggaggccctggccagcttcgaggcctggaaggctatgaaggaaaaagaggctaaaaagatagccgcaaagaaaaggctggaggaaaaaaataaaaaaaaaacagaggaagagaacgccgcaagaaagggtgaggctttgcaggctttcgaaaagtggaaagaaaagaaaatggaatatctgaaggaaaaaaatcggaaggagagggagtacgagagagctaaaaagcagaaagaagaggaaactgtcgcagaaaagaaaaaggataacctcacggcggtggaaaaatggaacgagaagaaggaggccttctttaaacagaaagagaaagagaagattaatgagaagaggaaggaggaactcaaacgtgctgagaaaaaagataaggacaagcaagcgatcaacgagtacgagaagtggcttgaaaacaaagagaagcaggaacgcattgagcgaaaacagaaaaagcggcatagcttcttggagagtgaggctcttcctccttggtccccaccgtccagaaccgtttttgcgaaggtattctag

SEQ ID NO: 27906 - DNA, 1074 bp, Artificial Sequence
  Description of Artificial Sequence: Synthetic coding sequence
atgcaaacattccttaaggggaaacgcgtagggtactggctcagcgaaaaaaaaattaagaagctcaactttcaggcgttcgccgagctgtgcagaaagcgcggtatggaagtggtacagttgaatctgtctcgacctattgaggaacaaggcccattggatgtcattattcacaagctcaccgacgtgatactcgaagctgaccagaacgatagccagtctttggagctggttcaccgtttccaggaatacatcgacgcccaccccgaaaccatagtcctggaccccctgccagccattcggactctgttagacaggtctaagagttacgagctcatccgaaagattgaagcctatatggaggatgacaggatctgttcccctcccttcatggaactgacttctctgtgtggcgacgatacgatgagactgcttgaaaaaaacgggctcacattcccttttatttgcaaaactcgtgttgcccatgggaccaattcacatgaaatggccatcgtcttcaaccaagagggcctgaacgcaatacagccaccttgcgtggtgcagaacttcattaatcacaatgccgtgctctataaggtcttcgtcgtaggtgagtcatacaccgtggtgcagcggccttccctgaagaatttcagcgcaggtaccagtgatagagaatccatatttttcaattcacacaacgtgagtaagcccgaatcaagcagcgtgcttactgagctggacaagatcgaaggggtgttcgagcggccaagcgatgaagtcatccgagagctttctagagcccttcgccaagccctgggagtaagcctgtttgggatcgatattatcataaataaccaaactggacagcatgccgtgatcgatattaacgcctttccaggctacgaaggcgtgagcgaattcttcaccgatctgctcaatcatatagcaacagttcttcagggacaatctactgctatggcagctccatcgggcgagttccgcgctggcgacctttgctgtgacctaggcaaatcatttcaggtattcgggcctccacctccctgcttgtag

SEQ ID NO: 27907 - DNA, 852 bp, Artificial Sequence
  Description of Artificial Sequence: Synthetic coding sequence
atgctgaggtgcggtcaaatgattttcgctcaggcactggtgtgcagacatctgggaagagactggcgttggacacaacggaagagacagcccgacagctacttttctgtgcttaacgcttttatcgacaggaaggatagttactactctattcaccagattgctcagatgggagtcggggaggggaaaagcattggccagtggtatgggccaaacaccgtcgcccaggtgctgaagaagctggccgtgtttgatacctggagttcattggcggtgcatatcgctatggacaatactgtcgtaatggaggagatccgaaggctgtgtaggacaagcgtgccgtgtgcgggagcgactgcctttccagccgattccgataggcactgcaacggcttccccgctggggctgaggtgaccaaccggccttcaccttggcggcctctggtgttgcttattcctctgcgcctgggactgacagatattaacgaggcttacgtggagactctgaagcactgcttcatgatgccacagagcctgggcgtgattggcggtaagcctaattcagctcactatttcattggctacgtgggcgaggagctgatctatctggacccccacaccacccagcccgcagtggagcccacggatgggtgttttatacctgacgagtccttccactgccagcaccctccatgtaggatgtcaatagctgaacttgatcctagtatcgctgtcgtcttgggggttggtaagcagggcagactggtacgtagcataccctgggctccccgtccgtcatcatggtgcgccgctgtcctcggcgctgcagtggtgatgtgcgggacgccctag

SEQ ID NO: 27908 - DNA, 2160 bp, Artificial Sequence
  Description of Artificial Sequence: Synthetic coding sequence
atggggttcagtaacatggaagatgatgggccagaagaagaggagcgagtggcggagcctcaggcaaatttcaatacacctcaagcacttcggtttgaagaactgctcgccaacctcctcaacgaacagcatcagattgcaaaggagctgtttgaacaactcaaaatgaagaagcctagtgcaaagcagcaaaaagaggtggagaaagtcaaaccccagtgcaaggaggttcatcagacccttattctggaccctgctcagcgcaagcgtctgcagcagcaaatgcagcagcatgtgcagttgctcacacagattcacctgctggccacctgcaacccgaacttaaatcctgaagcgtctagtacccggatctgcctgaaggagcttggaacattcgcccagagctcaattgcactgcaccaccagtataaccctaaatttcagaccctctttcagccatgcaatctcatgggagccatgcagctgattgaggatttttccacccatgtcagcattgactgttcgcctcacaagaccgtgaaaaaaaccgccaatgagttcccatgtctgccaaaacaggtggcgtggatcctcgctaccagcaaggtctttatgtacccagaactgctgcccgtctgcagtttaaaggcaaagaacccccaggacaaaatcttattcacgaaagctgaggacaacaagtaccttttaacgtgtaaaacagcccgacaattgactgtgcgcataaaaaaccttaacatgaacagggcaccggacaacattattaagttctataaaaagacgaagcagttgccagtcctgggtaaatgttgtgaggagatccagccgcatcagtggaaaccgcctatcgagagagaagagcatagactccctttctggctaaaggcaagcctgcctagcatccaggaggagcttagacacatggctgacggcgctagagaggtggggaacatgactggcaccacagaaataaattcagaccagggtctcgagaaagacaactccgaactcggctctgaaacccgctacccacttctgcttcctaaaggtgtcgtcttgaagttgaagcctgtggccgatcggttccctaaaaaagcttggaggcagaaacgctcatcagtgcttaagcccctgctgatccagcctagccccagtctgcagccttccttcaaccccggaaagaccccagcgcagagcacccattccgaagctccacccagtaaaatggtactaagaatccctcatcccatccagcctgctaccgttctgcagacagtccccggagtgcccccactgggagtgtcaggcggtgaaagttttgagagtccagccgcacttccagccatgcccccagaagcacgaacatcttttcctctgagcgagagccagactctcctctccagcgcaccagtccctaaggtaatgatgccctctcctgcaagttccatgtttcggaaaccttatgttcggcgtagaccgtcgaagcggaggggcgctcgcgcattccgctgtattaaaccagctcccgtcattcaccctgcctctgtgatattcaccgtgccggctacaactgttaagatcgtctcattgggaggcggttgtaacatgatacagcctgtgaacgcagctgttgctcagtccccacagaccattccaattgccactctcctggtgaaccccacttccttcccgtgcccgctaaatcagcctctggtggcaagcagtgtgtcacccttaattgtgagcggcaactcagtaaacctgccgatcccctcaacccccgaagataaggcgcacatgaacgtagacattgcctgcgccgttgccgatggtgagaatgctttccagggactcgagcccaagttagagccgcaggagctgagccccctatcggctactgtctttcccaaagtggaacacagccccggaccccctcccgtcgataagcagtgccaggagggtttgtcagagaacagcgcctatcgatggacggtggttaaaacagaagagggcaggcaagctcttgagccgcttcctcagggcattcaggaaagcctgaacaactcctcaccaggggatttggaggaagtcgttaagatggaacctgaagatgccacagaagagataagtggcttcctgtag

SEQ ID NO: 27909 - DNA, 1134 bp, Artificial Sequence
  Description of Artificial Sequence: Synthetic coding sequence
atggaagctgccgcagttaccgtgactagatccgcaacgcggagaaggaggcgccagctacaggggctggccgcacccgaagctggcactcaggaggaacaggaggatcaggaacctagacctaggagaaggcggcctgggaggtccataaaggatgaagaggaagaaaccgtattccgcgaagttgtgtctttctcccccgacccgctgccagtccgctactacgataaggacaccaccaagcctatctcattttacctctcatctttggaggaattacttgcctggaagccacgcttagaggatgggttcaacgtagcgctggaaccgctcgcttgcaggcaacccccactatcttcgcagcgaccgagaaccctcctctgtcacgacatgatggggggttatttggatgaccggttcattcagggcagtgtggtccagacaccctatgcattttaccactggcaatgtattgacgtgttcgtctacttctcacaccacaccgttaccataccccctgtgggatggacgaatacggcacaccgccatggggtctgtgtcctggggacctttattactgagtggaacgagggaggtaggctgtgcgaggccttccttgccggagacgagaggtcatatcaagctgtggccgatagactggtgcaaataactcagttcttccggtttgacggatggttgataaacatcgaaaacagtctgtcactagcagccgtcggtaatatgcctccctttctcagatacttaactacccagttgcaccgacaggtgccaggcggattggtgctatggtacgactctgttgtgcagagtggtcagctaaaatggcaggacgagctgaatcaacacaaccgtgtattctttgactcctgcgacggcttcttcacaaactacaattggcgagaagagcacctcgagaggatgctagggcaggcaggagagcgcagagctgacgtctatgtcggagttgatgtgttcgccaggggcaatgtagtggggggaaggttcgacacagacaagtccctcgagttgatccggaagcacgggtttagcgtcgctctgttcgctccgggatgctccgtgtttccaggggtgggtaacctgctctgttgctag

SEQ ID NO: 27910 - DNA, 927 bp, Artificial Sequence
  Description of Artificial Sequence: Synthetic coding sequence
atgcggggaaaacgcagacctcagactcgggcagctcgcagattggctgcccaagagtcttctgaagctgaagatatgtctgtccccagaggcccaatcgcccagtgggctgatggagctatcagtcctaacggccacaggccgcagctgcgtgcagcttcaggggaagactcgactgaagaggccctggccgctgccgcagccccttgggagggtgggccagtcccgggtgttgacacttcacctttcgccaagtcactcgggcattcccggggagaagcagatttatttgactcaggggatattttctccacaggtaccgggagccagtctgtggaaagaacaaagcctaaagcgaagatcgctgaaaaccctgccaacccaccagtcgggggaaaggcgaaatcgcctatgtttccagctttaggcgaggccagctctgacgatgatttgttccagtcggccaaacctaagcccgcaaagaagaccaatccctttcctctattagaggacgaggatgacctgtttactgatcagaaggtgaaaaaaaacgagacgaagagctcatcccaacaggacgtcatactgacgacccaggacatcttcgaagacgatatttttgccacagaagcgattaagccttctcaaaaaacaagagagaaggaaaagacactggagtcgaacctattcgatgacaatattgacatcttcgccgacctgactgtcaaacccaaggagaaatccaagaaaaaggttgaggctaagtcgatctttgatgatgacatggacgatattttttccactggaattcaggccaaaacaaccaagcctaagtctcgcagtgctcaagctgccccagaaccaagatttgaacataaggtgagcaatatcttcgacgacccattgaacgccttcggcggacaatag

SEQ ID NO: 27911 - DNA, 933 bp, Artificial Sequence
  Description of Artificial Sequence: Synthetic coding sequence
atgcttaagaataaagggcacagcagcaagaaagataacctagctgttaacgccgtggccctgcaagaccacatcttgcacgacttacaactccgcaatctgagcgtagccgaccacagtaagacacaggtacaaaagaaggagaacaaaagtcttaagagagacaccaaagccattatagataccggcctgaagaaaacaacccagtgcccaaagctggaggactctgaaaaggagtacgtcttggatccgaagccaccaccactcaccctggcccagaagttaggactaattggccctccaccccctcctctgtcttcagacgaatgggaaaaagtaaagcagcggagcctcttgcagggcgacagtgtgcagccctgccccatatgtaaggaggaatttgagctgagaccacaggtgctcctttcatgctctcacgtttttcataaggcttgtctgcaggcattcgaaaagttcactaataaaaagacttgcccactatgcaggaagaatcagtaccagaccagggtgattcacgacggcgcaagactgtttcggattaagtgcgtcacaaggatccaggcttattggagaggctgcgtggtgcgaaaatggtatagaaatctccgtaagacagtgcccccaacagacgccaaactgcggaaaaagttcttcgaaaaaaaatttaccgaaatttcgcatagaattttgtgctcctacaataccaatatcgaggagctattcgcagaaattgatcagtgcttagccattaatcggtcagtgttacaacagctcgaggagaaatgtggacatgaaatcacagaggaggagtgggagaaaattcaagtgcagaacgaaacaagcgcgtgtttcgaagatccatgcctcggcgctcacgggtcccatttctccctcagtaacttcttgctgtag

SEQ ID NO: 27912 - DNA, 1119 bp, Artificial Sequence
  Description of Artificial Sequence: Synthetic coding sequence
atgagagttggcccagtccggtccgcgatgtcaggggcaagccagccgagaggtcccgctctcctttttcccgcaacccgcggagtgccagccaagcgcctgctggatgccgacgatgcggctgccgtggcagccaaatgtccaaggctgagcgagtgttccagtcccccagattacctgtcaccgcctggttctccctgcagccctcaaccccctccagctgctccaggagccggaggtggcagtggcagcgcaccgggtccaagcagaatcgccgactatcttcttttgcctctcgccgaacgggaacacgttagcagagctctatgcatccatactggcagggaacttcgctgcaaagtattccccataaagcactaccaagataaaattcggccatacatccagctcccaagccactcaaatatcacaggcattgtggaggtgatcctgggcgaaaccaaggcgtacgtgtttttcgagaaggatttcggagacatgcattcctatgtgagaagcaggaaaaggttgagggaagaagaggctgccagactatttaaacaaatagtgtccgcagtagcgcactgccaccaaagcgcgattgtgctcggtgacctcaaacttagaaagtttgtatttagtaccgaggaaagaacacagcttaggctggaaagtctcgaagacacgcatatcatgaaaggtgaggatgatgctctgtctgataagcacgggtgcccggcttatgtttcacccgaaatcttgaatacaaccggcacttatagcgggaaagccgctgacgtatggagcctgggcgtcatgctctacacgttgttagtgggaaggtacccttttcatgacagtgatccctccgcccttttctcgaaaattcgtcgcggacagttttgcataccagagcatatctctccaaaagcacgatgtctcattaggagcctgttaaggagggaaccaagtgaacggctgaccgctccggagattttgcttcatccttggtttgaaagtgtattggaacctggttacattgactcagaaattggaaccagtgaccaaatcgttccggaatatcaggaagattccgacatcagttcctttttctgttag

SEQ ID NO: 27913 - DNA, 1554 bp, Artificial Sequence
  Description of Artificial Sequence: Synthetic coding sequence
atggagactgacctcaattcccaggaccggaaggacctggataaatttattaaattttttgccctgaaaaccgtccaagtgatcgtccaagcacgcttaggtgagaagatctgcacacgatcgtcaagctcgcctactgggagcgactggttcaacctggcgattaaggatatccctgaagtgactcatgaggccaagaaggctctcgccggtcaactgccggctgtgggtcgctccatgtgcgtggaaatctctcttaagacatcagagggtgacagcatggagcttgagatttggtgcctggaaatgaatgaaaaatgtgataaggagattaaggtgtcgtacactgtctataacaggcttagtctattgctgaaatcgctgctcgcgattaccagggtgacccctgcctaccgtctgagcagaaagcagggccacgaatacgtgattctctaccgaatttattttggtgaggtgcaactctccggcttgggggaaggttttcagacggtccgcgtcggaactgtgggcacgcccgtcggaaccatcaccctgagctgtgcctaccggattaatctggcctttatgtcaacacgccagttcgagcgcaccccacctatcatgggcattatcatcgaccatttcgtggaccgcccataccccagcagctcaccgatgcatccatgcaattatagaactgcgggagaggacacaggggttatttatccttctgtggaggacagccaggaggtctgtactacatccttttcaaccagcccccctagtcagctatcatcctcccgcctgtcttaccagcccgcagcgctaggcgtcgggagtgccgaccttgcatacccagtggtgtttgcagctggtctaaacgcgactcacccacatcagctgatggtgcctggcaaggagggcggagtacctctggctccaaaccaacctgtgcatggaacacaggctgaccaggagcgactagctacttgtacaccctccgacaggacacactgtgctgcgacacctagctcttctgaagacaccgagacagtttcaaactcatctgaaggccgtgcgtccccacatgatgtgctggaaaccatcttcgtccgtaaagtgggggcatttgttaataaacctatcaatcaagtgactttgacgagtttggacatccccttcgccatgttcgcacccaaaaatctggaattggaggataccgatcccatggttaatccgcctgacagtccagaaactgaatcaccgctgcagggctccctgcattctgacggatcgtccggaggctcatcggggaacacccacgatgacttcgtgatgatagatttcaaaccagccttctcaaaggatgacattctgcctatggatcttgggactttctaccgggaattccagaacccaccacaactgtcctccttgagcatagatatcggggcacagtctatggccgaggatctggactctctcccagagaaactggccgtccacgaaaagaacgtcagggaatttgatgccttcgtggaaacgctccagtag

SEQ ID NO: 27914 - DNA, 1488 bp, Artificial Sequence
  Description of Artificial Sequence: Synthetic coding sequence
atgtggaggggttgtgccaggtcaagaaaaagaaagaaggttgacaacgattataatgcactgcgtgagcgtctgagtacccttcctgacaagttgagctataatataatggtccctttcggcccattcgctttcatgccgggaaagctggtccataccaatgaagtgacagttcttcttggggataattggtttgctaaatgcagcgcgaagcaggcagtcggcttggtggagcatcgcaaagaacacgtacggaagacaatcgatgacctgaaaaaggtgatgaagaatttcgagtctcgggttgaattcaccgaagaccttcaaaagatgagcgatgccgctggtgatattgtggatattcgggaagagatcaaatgtgacttcgagttcaaggcaaagcacaggatagcccacaagccccactcgaagccaaaaacttctgatattttcgaggccgacatagcaaatgatgtgaaatctaaggatctgctggccgacaaggagctgtgggcccgactggaggagctagagaggcaagaggaactgctgggtgagttggatagcaaacccgataccgtgattgccaatggtgaggatacaacaagtagtgaggaggagaaggaggacagaaataccaatgtaaacgccatgcaccaggttaccgactctcatactccatgtcataaagacgtggcaagcagtgagcccttttcaggacaggtcaatagtcagctgaactgttctgtgaatgggtcgtcctcctaccactccgacgatgacgatgacgatgacgatgatgatgatgacgacaatatcgacgacgatgacggagataatgatcatgaggccctgggtgtgggagacaactcaataccgactatttactttagccataccgtggaacctaagcgagttaggatcaacacaggaaagaatactacccttaaattttccgaaaagaaggaagaagccaagcgcaaacggaaaaactcaacgggaagtggtcacagcgcccaggaattacccacaatccgcacgccagctgatatttaccgcgcatttgttgacgtggtgaacggagagtatgtgccacgaaagagcatcttgaagagtcggtctagagagaattcggtgtgctccgacacttccgagtctagcgccgcagagttcgatgacaggcgaggtgtcctcaggtctatatcttgtgaggaagccacttgcagcgacacatccgagagtattctggaggaggaaccccaagaaaaccagaagaagctgctcccactgagtgtcacacccgaggcttttagcggcaccgtcatcgagaaagaattcgtctctccttccttaacccccccacccgctatcgcccacccagctctgcccacaattcctgaaagaaaagaggtgcttctggaggccagtgaggagaccgggaagagagtcagtaagtttaaagccgctcgattgcagcagaaggattag

SEQ ID NO: 27915 - DNA, 1458 bp, Artificial Sequence
  Description of Artificial Sequence: Synthetic coding sequence
atgtgccaggtgggtgaagattacggggaacctgcgccagaggaaccacctcccgcaccgcgtccgagcagggagcaaaagtgcgttaagtgcaaagaagcccagcctgtggtggtgattcgcgctggggacgccttctgccgcgactgtttcaaggctttttacgtccataaattcagagctatgctgggcaaaaaccgccttatctttccaggggagaaagtgctgctggcctggtctggaggcccttcgtcctcatctatggtgtggcaggtgctggaaggactgagtcaggacagcgctaagcggcttcggttcgttgccggtgtaatattcgttgatgaaggggcagcatgtggccaaagtctggaggaaagaagtaagacacttgcagaagtcaagcccatcctgcaggcaacgggatttccctggcatgttgtggctttggaagaggtgtttagtctgcctccatcggtgctgtggtgctccgctcaagaactggtgggcagtgaaggagcctataaggccgcagtggatagttttcttcagcagcaacatgtgctcggagcgggtggcggacctggaccaacacagggagaagaacaacctcctcaacctcctcttgatccacagaatctggctagacctccggctcccgcacagaccgaggctctgagccaactattttgttctgtgcgaactctcacagctaaggaggaacttttgcagactttgaggacccacctgatcctgcacatggcacgcgctcatggctatagcaaagtaatgacaggagattcttgtaccaggttagccattaagctgatgaccaatttggcactcggacgcggagcattcctggcctgggatactggattctctgatgagaggcatggagatgtggtggtggtcaggcccatgcgggatcatactctgaaagaagtcgctttctataatcgtctgttctctgttccttcggtctttactcctgctgtggacaccaaagcacccgagaaggcctctatccaccggctgatggaggcattcatcttgcgactgcaaacgcagttcccctcaacagtgtccaccgtttatagaaccagtgaaaagctcgtgaagggcccaagagacggcccagccgcaggtgatagtggcccacgatgcttgctctgcatgtgtgccctcgatgtagatgctgcggactccgccaccgcatttggggctcagacttctagcagactaagtcagatgcaaagtccaattccactgactgaaaccagaaccccacctggaccttgctgttcacctggagtcggatgggcccaacgttgtgggcaaggagcctgcaggcgcgaggacccccaagcatgtatagaagaacagctgtgttactcatgccgggtgaatatgaaggatctgggactgggacttgcaggggatcccggtctatccgactag

SEQ ID NO: 27916 - DNA, 1353 bp, Artificial Sequence
  Description of Artificial Sequence: Synthetic coding sequence
atgagtttgagactgagttccgcttcacggagatcatgtcctagaccaactactggcagcctccggctgtatgggggtggcactagcttcggaacaggtaatagctgcggcatctctggcatcgggtctggcttctcatcagccttcggtggcagctcatctggcggaaataccggcggtgggaacccatgtgctgggtttaccgtgaacgagcgtgggctcctgagtggtaatgaaaaggtgacaatgcagaacctcaacgaccggctcgccagctaccttgactcagtacatgcactagaagaggccaatgccgatctcgaacagaaaataaagggatggtacgagaagttcggcccaggctcctgccggggactcgatcatgactactcaagatacttcccgatcattgacgatctcaagaatcagatcatcgctagcactactagcaacgccaacgccgttctgcaaatcgacaacgccaggttgaccgctgatgatttccgcctgaaatatgaaaatgagcttgctcttcatcagagcgttgaggctgacgttaatgggctgaggagggtgttggacgagataaccctctgcagaaccgacctcgagattcaatatgaaacgctgtcagaggaaatgacttatctcaagaagaaccacaaggaagagatgcaggtgctccaatgtgctgctggcggaaacgtgaatgtggagatgaatgcggctcctggcgtcgacttgaccgtccttctcaacaacatgagggccgagtatgaggccctcgctgagcagaaccgccgtgatgctgaggcctggtttaatgagaaatccgcgtctttacagcagcaaatctcggaagatgtcggtgccacaacctccgcaaggaacgagctcactgagatgaaacgcaccctgcaaaccctcgaaatcgagcttcaatccctcttggccacgaaacatagtctcgagtgttcactgacagagaccgaaagcaattactgtgctcagctcgcccaaatccaagctcagattggcgcactggaagaacaattacatcaagtccggactgagaccgagggccagaaactcgaatacgaacaactgttggacatcaagctgcatcttgagaaggagatagaaacatactgcctgctgatcgggggtgacgatggcgcttgtaaatcaggaggctataaatcaaaggattacggctcagggaacgttggtagccaggtaaaggatccggcaaaagccatcgtcgtgaagaaggtactggaggaggtggaccaaagatcgaagatactgaccactagacttcacagtttagaagagaagagtcagagtaactag

SEQ ID NO: 27917 - DNA, 2679 bp, Artificial Sequence
  Description of Artificial Sequence: Synthetic coding sequence
atggaccaacccgaggcaccctgctcatctacaggccctcgtctagccgtggcacgtgagctcctgctggccgctctcgaagagctttctcaggagcaactaaagcggtttaggcacaaactgagagatgtcggcccagacgggagaagtataccttggggccgactggagcgcgcagacgcagtcgatcttgccgagcagctggctcaattctacggccctgagcctgctctggaagtggccaggaagactctcaaacgcgctgacgccagagacgtcgcggcacagctgcaggagcgcagacttcagcggttgggcttggggtccggaacactgttatccgtgtctgagtataagaagaaataccgagagcatgtgctgcagttgcatgccagggtgaaagagcggaatgcccgatctgtgaagattaccaaaaggttcacaaagctgctcatcgcacctgaaagtgcagctcctgaagaggcgatgggtcctgctgaagaaccagagcccggtcgggcaaggcgcagtgatacgcatacctttaatcgccttttccgcagggatgaggaaggacgccgacccctgacagtggtgctgcaaggaccagctggtatcgggaaaactatggccgctaaaaagatactctacgattgggcggctgggaaactgtatcaggggcaggtggacttcgccttttttatgccgtgcggtgagctactggagcgtccagggacacgcagcttggcggacctcattctcgaccagtgtcccgaccggggagccccagtcccacagatgctagctcaacctcagcgattgttatttattctcgacggcgctgatgagctccccgcacttggaggcccagaggcagcaccttgtactgatccatttgaggctgccagtggtgctagggtcttgggaggcttattgagcaaggcgctcctacctaccgccctgctcttagtcaccacaagggccgcagccccagggaggctccaggggcgtctgtgctcaccccagtgcgccgaggtgcgtggtttcagtgacaaagataagaaaaaatacttttacaaatatttcagagatgagagaagagccgagagggcctacaggtttgtgaaggaaaatgaaactctgttcgccctctgtttcgtcccctttgtttgttggatcgtgtgcactgttctgagacaacagttggagctcggacgtgacctgtccagaacatctaagaccacaacgtctgtgtatctgttgtttataacatcagtactgtccagcgcccctgtggccgacgggcctcgcttacagggggacctccgaaacctgtgccggttggccagggaaggtgttctcggcagaagagcgcagttcgcggaaaaggagttagagcaactagagttacgcggatcgaaagtgcagaccctcttcctatccaaaaaggagttacctggggtccttgagactgaagttacttaccaattcatcgaccaaagcttccaggagttcttagcagcattgtcttacttactggaagatgggggagtccctcgcacagcagccggtggtgtagggacacttctgcggggagacgctcagccgcattctcacctggtcctgaccacccgcttcctttttggtctccttagtgctgaacgtatgagggatattgagcgccacttcggctgcatggtgtcggaacgggttaaacaggaagcacttcggtgggtgcagggccaggggcagggctgtcccggagttgcacctgaagtaactgagggcgctaagggtctcgaagacactgaggaacccgaggaggaagaagagggggaggagccaaactaccccctggagctcttgtactgcctgtatgagacacaggaggatgccttcgtcagacaagccctgtgccggttcccagaattggctctgcaacgggtgcgcttttgtaggatggacgttgccgtgctgtcatactgtgttcgctgttgccctgcaggccaggcactccgacttatctcgtgtcgtcttgtcgcagcacaggagaaaaaaaaaaaaagcttaggaaagaggctccaggccagcctcggcggaggttctagctcccagggaactacgaagcagctcccagcatccctgttgcatccactctttcaggcaatgactgaccccctgtgccatctctctagtctgaccttatctcattgcaaacttcctgacgccgtttgccgggacctgtctgaggccctccgggctgccccagccctgaccgaactaggtctgctgcacaaccgcctgagcgaggccggtttgagaatgttgagcgagggacttgcctggcctcagtgtcgcgtgcagaccgttcgggtgcaattgccagacccccagcggggactccaatatctggtaggaatgttgagacagtccccagcactgactacactcgatcttagtggatgccagttgccagcccctatggtcacgtatctttgtgcggtcctgcagcatcagggttgtgggcttcagaccctgagcctggctagtgtggagctttcagagcagagtctgcaggaattgcaggctgtgaagcgggcaaagcctgaccttgtgattactcatccggctttggatgggcacccccagccgccaaaggagttgatttccaccttctag

SEQ ID NO: 27918 - DNA, 1047 bp, Artificial Sequence
  Description of Artificial Sequence: Synthetic coding sequence
atgggcaaagactactataaaatcctgggaataccaagcggggctaatgaagatgaaattaaaaaagcgtataggaaaatggccctgaaatatcaccccgacaagaataaagaaccgaacgccgaggagaaatttaaggagattgcggaagcttatgatgttctgtcagatcccaagaaacggggattgtatgatcagtacggagaggagggcctgaagacaggaggcggtacgtctggcggttcaagcgggtctttccactacacttttcatggagatcctcatgcaacatttgcaagtttttttgggggatccaatccattcgacatttttttcgcgtcatcccggtctacacgccctttctccggatttgaccctgacgatatggatgtcgacgaggacgaagatccctttggtgcctttggtagattcggctttaacggactgtcgaggggtccacgacgcgctccagagcctctttatcccagacgcaaagttcaggaccctccggtggtgcacgagctgcgagtgagcctcgaagaaatttatcacggctcaacaaaacgcatgaagattactcgcaggcggcttaacccagatggtcgtaccgtgagaaccgaagacaagattttgcatatcgtaattaaacggggttggaaggaagggacaaaaatcacctttccgaaagaaggcgacgctacccctgacaacatcccagccgacatagtgttcgttctgaaagataaaccacatgcacactttaggcgggatgggaccaatgtactgtatagcgccctgataagtctgaaagaggccctgtgtgggtgtacagtaaatattcccaccatcgatggtagggtcattcctctcccctgtaatgatgtcataaagccaggaacagtgaagaggctgagaggggaaggcttgcccttccccaaggttccgactcagcggggagatttgatcgttgaattcaaagtcagattcccagaccgcctgacaccacagactcggcaaatcctgaagcagcatctgccatgcagctag

SEQ ID NO: 27919 - DNA, 1899 bp, Artificial Sequence
  Description of Artificial Sequence: Synthetic coding sequence
atggatactatgatgctgaatgtgcgtaacctatttgagcagctggtcagaagagtagagattttgagtgagggtaatgaggtgcagtttattcaactggccaaggattttgaggattttcggaaaaagtggcagcgcaccgatcacgaactgggaaaatacaaggatctccttatgaaagctgaaaccgaacgttctgctctggatgtaaagctgaagcacgcacgtaaccaggtagatgttgaaattaagaggcgccagcgagccgaggctgactgtgagaaacttgagagacaaattcagctgatccgcgaaatgcttatgtgtgacacctctggttcaatccagctgagcgaggaacaaaagtcagccctggcattcttgaacaggggtcagccctcgagttctaacgccggaaacaaaagactgagcaccattgacgagtcaggaagtattttgtccgacatctcatttgacaagacagacgagagcttagattgggactccagtctggtgaaaacatttaaactgaaaaagcgagaaaaacggagatccacatcacggcagtttgtggatggtccccctggccctgtgaaaaagacccgctctataggcagcgcagtcgaccaagggaatgaatctatcgtcgcgaaaacgactgttactgtacctaacgacggagggcctattgaagcagtttcaacaattgagacggtgccatattggacccggtctagacgcaaaactggaactcttcagccttggaactccgatagtacccttaacagccggcaacttgagccgcgaacagagacagacagtgtgggtaccccacagagtaacgggggaatgcgactacacgatttcgtttctaagaccgtcataaaaccagagagctgcgtgccatgcggtaagagaatcaaatttgggaaactctcccttaagtgtcgggattgtcgcgtggtgtctcatcccgagtgtcgagataggtgtcccctgccttgcatcccaactttgattggaactcccgtcaaaattggggagggcatgctggccgattttgtaagccagacctcaccaatgattccttcaatcgtggttcactgtgttaatgagatcgagcaaagaggattgacggagacgggactgtataggatatccggatgtgacagaaccgtgaaggagctcaaggagaagtttctccgtgtcaagactgtgccgttgctgagcaaggtggacgatatccacgcaatttgtagtctcctgaaggatttcctgaggaatctaaaagaaccactgctgaccttccgattgaaccgcgcttttatggaagcggcagaaattacagatgaggataattcgattgcggctatgtaccaggctgtgggggagttgccccaagcaaacagggacactctggccttcctaatgatccatctacagcgagtcgctcagagcccccatacaaaaatggacgtcgccaatctcgctaaggtgttcggtccaaccatagtggctcatgcggtacccaatcccgatcccgttactatgctacaagacattaagcgccaacccaaggttgttgagcgtttgcttagcttgcctctagaatactggagccaatttatgatggtcgagcaggagaacattgatcctttacacgtgatagaaaactccaatgcattctcgaccccacagacccccgacattaaagtgtcccttctaggtccagtgaccacccccgaacatcagctcctgaagacaccatcttcttcatccttgtcccagcgagtgcgatccaccctgacaaagaacactccccgtttcggatcaaagtctaaatccgcaaccaatctggggcgacagggcaacttcttcgcatcacctatgttaaagtag

SEQ ID NO: 27920 - DNA, 12075 bp, Artificial Sequence
  Description of Artificial Sequence: Synthetic coding sequence
atgtcctccgagcaggataagtccgcgtctaaagagaagagcaaaaagcctgtccgctttctgccacagctgtcaatggaaaagctggcttctaaggaaaaatttaaggccccagctagagcactccctcaattaagcatggtatcaacaaagccgcattggcagcaggcagcaccctcatttcacttgagtgtgaagcaggacgacgaatcccccgaaccattctcagtcaagaatgagcaatcccatgccgaatatatggagcggtttggcaagaagggcaagctcccccaccaagtagacgactcgtacgtgggacctagcaccagcaaatctaaggggaaaagtccccataaagagagagaaaactttagaagcaccctggtgaatgtaattatgcagcaagatgcggatctggattctgcagttcctgatggttcaacaatccccaaacccacagcttcagccatcgagaaagacatcctccgctactattactatattcaccacggcattgatacagaccatgtcgccccaatggaagacagttggctggaacacgttttggacctggtcccccagcatctgaaggtctttacggattctatcgtgactctttctgatgaaatgcgggaagattacctactgtctgtgaggaaaagcattgtggactttgtgcttaaggacccccgtgagaaaggtgatgataagaaaactgacgagctgcccgcacaccgtgcagagatggaaatcctcccgaagccctggaggaagtccttcctcgccgcaagttcctatatccgtgaccacctaaatgctatgaatccaactatgctggccgttctcgacctctggcatactaacttcaagaaactgaggttagtggatatcaaagaattccataattgccaggatgcactggaattaagcagttttcagaatattattatgcgccatatggacagcgccaaggagacgcttctgaaaatgtggttccccgaggttcagaacatctattaccaggggaataagaagaagcaactgccaactggggattctagcgccaagctagaaagcttttttaattgtgccgctgccttgatgaccttacaacttcaagatctgacactggtatcgatgcaagactttactgatctcatcgcccagccacccgactccgtcagggcttttgaacatcctggctttatcatgcgcctgattctcgataacgatactatcaaattcgagcctgaactgagtgattatatcgatatcttcctcaacgtgtacgacgtaatgattaaggctgttagcttcgtacctcgcgtagagaccaagctgtattcaaaatgggaaagcaaaagcaaaccgactacactcaagccaattattcttaacgagatcgtcgatgcccataaggagaagataaaggaggttattatgaaggagtcagtcgcacccactgagcatttacgcttgtatgacaagtacgactttctgatcaccagaaaagcagaaagggatgtggataacttcctggccgagaatcattcatatgagaagatcatcgatgagatttgcaaataccagaagttaatcgaggaaatacaatatacatccatcaaaacgatcaggctgggcatgtttgagatgcactgtgaagaattgatacgggctctggttaagcgcgctgacatcatctgcggtaagctgttggccaaaatgttccgggatcaccaggaggttaacactagactgtgtgacgagtttgagcgcattgccgagaaagccctctccactcccccaaacactgctgaactcatggagatgaaggcctatattcagaaggtggaggtgacagacatgatcgagctggaacaacgacttgtggattcaaagaactgcctggcctttctcatagagtatgttaacttcagcccagcagatatgcggctgaacaattcagtgttccagtggtacgggcgtatgggagagatattcgaagagcacaggaagattatcaaagagaaaatcgaacagtatcaggagggcctaaagctgaggtgtgaaaggttcgtggaagaactggagtcctacgcaaagcagagtgaggaattttatagtttcggagatctgcaagacgtgcaaaggtaccttaaaaaggctcagattctgaatgggaaactggaccttgctgccgataaaatcgagcaattcaatgccgaggaggaagccttcgggtggttgccatctgtgtaccctcagagaaaaaaaatacaggacgggctgaatccctatctccggttatacgagaccgcggttgaattcagtagcaattacagggcctggacagaggggccttaccataaggtaaatccggaccaggtggaagcagatataggcaattattggaggggtctgtataagttggaaaagaccttccacgattcaccctacgctctagccatgactaagaaagtccgcagcaaggtggaagatttcaagcagcacattccactgatacaggtgatctgtaatccgggactgcgacctcgacattgggaggcgatgtcagccatcgtggggtaccctctccagccttctgatgactctacggtgagcagtttcctagacatgaatttagaaccatacatagatcggttcgagggaattagcgaggctgcctcaaaggagtatagtcttgaaaaggctatggagaagatgattacagagtgggacgctgtcgaatttgtgattcactcctacagggaaactggcactttcatcctagcctctgttgacgaaattcagatgttgctagacgatcatattattaagacccagaccatgcgagggtccccctttatcaagccctatgaaaaacaaatgagagaatgggaaggaaagctgctgctgttacaagagatcctcgatgagtggctcaaggtgcaagcgacttggctttatctggaaccaatcttctctagccccgacatcatgtctcagatgcccgaggagggccgtagatttaccgcggttgacaaaacatggcgggacattatgaggagcgtaatgcaggataagcacgtcctaaccgtagttaccattgacagaatgctggagaggcttaagaagagcaacgagctcctggagctgatcctaaagggcctgaatgaatatttagagaagaagagactgttctttcctaggtttttcttcctgagtaacgatgaactgctggaaatcctcagtgaaacgaaggaccccacccgtgtgcagccacacctcaagaagtgttttgaaggtatcgccaaggtcgaatttactgaaaccttggacattacccatatgaaaagctccgagggagaagtagtggagttaatcgaaatcatttccaccgccaaggccagggggcaggtcgagaaatggttggtggaactggagagagtgatgattaactctatccataaggtgaccggcgacgccacgttcgcctacaccaagtatgaacggattaactgggtgcgggactggcccggtcagacagtcctttgcgtctcgcagatattttggacaaaagaagtgcaaaccgccattcccatggggatcaaggccttggaacagtacctcaaaacatgtaataggcagattgacgatattgtcacccttgtacggggaaagttgagcatgcagaaccgtgtcacacttggggctctggtcgttctggacgtacacgccagagacgtcctctcatctctggttaagaaaaacatatctgacgacagtgattttgagtggttaagtcaactcaggtactactggcaggaaaatcatctggaaacgaaaatgattaacgccggactgcggtacggctatgagtacctgggcaattccccccgactcgttatcacgccgttgaccgaccggtgctatcggaccttattcggtgcactccacctccacctggggggagcaccggagggcccagccggaactgggaaaacagagacaaccaaggatctggcaaaggcagtggcaaagcagtgcgttgtcttcaactgtagtgacggcctggattatctcgcgcttggcaagtttttcaagggcctgctttcatgcggggcatgggcttgcttcgatgaatttaacaggattgacctagaggtgctctccgtcgtcgctcagcagattctaacaatccagcgcggtataaacgccggagccgatattctgatgttcgaaggcacagaactcaagctcgatccgacctgtgccgtgtttattaccatgaaccccggttacgccggtagaagtgagttgccggacaacctgaaagcattgtttaggacagtagcgatgatggtgcctgactacgcgatgatagccgagatcgttctctattcctgcggctttgtgactgccagaccattaagcgtgaagatcgtggccacatacaggctgtgctcagaacagctgtcaagccagcaccattacgactacgggatgcgggcagttaaaagtgtgctaaccgcggcaggaaatctgaagttgaagtatcctaatgagaacgaggagattctactcctgcggtcaattattgacgtgaacctccctaaattcctcagtcatgacctacccctcttcgaagggatcacatctgacctgttccctggggtcaaattacccaagcctgactacaatgatttgctcgcagccatcaaagataactgcgcctcaatgaacttgcagatgactgcctttttctctgagaaaattctacaggtctatgaaatgatgatcgtccgacatgggttcatgatcgtcggggagcccttcggcggaaagacatcagcttaccgcgtcttagctggggctctcaacgacatctgcgaaaaaggattaatggaggagaataaggttcagatcactgtgcttaatcccaagtccgtgacaatgggacagctgtacggacagttcgactcggtttcccacgagtggagcgatggagtgttagccgtgtccttccgcgcattcgctagttccgtcacacccgataggaaatggctgatctttgatgggccagtggatgcggtgtggattgaaaatatgaatactgtccttgatgataataagaagctatgcctaatgagtggtgaaataattcaaatgtcaccacagatgaatctcatcttcgagccgatggatctcgaagtagcatccccagccacagtatcaagatgcggcatgatctacatggagccacacatgctgggctggaggcctctgatgctgtcctgggtcaacctcctgccagcaagcgtcagtgtgattcagaaggaattcatcatgggactgttcgacaggatggtgcccgtatcagtggagttcataagaaagcacacaaaggaactgtcgcctacctccgacacgaaccttgtgcgctccctaatgaacctgatcgactgcttcatggatgactttgcagatgaggtcaagctcaaagagaggaacgaccgcgaaacatactccctcttggaaggcatcttcctattttctttaatctggagcgttggggcaagctgcaccgacgacgacagactgaagttcaataagatcctgcgggagctgatggagagcccaatttctgaccggactcgcaacaccttcaagctccagtccggcacagaacagacgagctcaaaggctctcacagtcccctttcctgaaaaggggactatctacgattaccaattcgtaacagagggaatcggaaaatgggagccctggatcaagaagctaaaggaagcccctccaatccctaaggacgtgatgttcaacgaaatcatcgtcccaacactggacacaatcagatattccgccctgatggaactgttgaccactcatcagaagcctagtattttcgttggccctacgggcaccggcaagagtgtgtatatcacgaatttcttgctgaaccagttgaacaaggagatctataaaccacttctgattaatttcagtgctcagacaacagctgcccaaactcaaaatatcgtgatgagtaaacttgacaaacggagaaaaggagtatttggtccgccacttggcaaaagaatggtggtgtttgtcgatgatgtgaatatgcccgctagggaggtctacggcgcacagccaccaatcgagttattacgccagtggttggatcattggaattggtacgacctgaaggattgtagtatgatcaaattggtagacatccaaatcatgtgcgccatgggccctcccggaggcggtcgcaatcccgtgacacctcgctacatgagacactttaacatcattaccattaatgaattctcagacaagtctatgtatactatcttcagcagaatactaacgtggcacctcgagatatgttacaagttccctgatgagtttctcgaccttacaacacagattgtgaatggtaccatgaccctctacaaggaggcaatgaagaacctgctccctacacccgctaagagtcactatctatttaatctacgcgacttctccagagttatccagggggtatgtctttccagacccgagacaactgagaccacggaggtaatcaaacgcctctgggtgcatgaggtgctccgggtttattacgatcgccttttggacaacacagataggtcctggctgattaactatatccaggagatcctgcgaaactatatgtacgaggattttcatgagctttttcagcgcctcgatttcgataacgatggaatggtggaggccgacgacttgaggtccttaatgttctgcgacttccacgatccgaaacgagaagatacaaactatcgtgagattgcagatgtagacaatttacgcatgattgtcgagatccacctggaagaatacaacaacatttctaagaagcctatgaatctggtgctgttcaggttcgcaatagagcatatcagtcgaatctcgcggatactgaagcagcccaggtctcatgctctcttggtcggcgtgggtggatctgggaggcagtctgtgacccgcctagctgcacacatggcagactactccgttttccaggtcgagatttccaaaggctatgacacaacagaatggcacgaagaccttaaggtcatcctgagaaaatgcgctgaaggggagatgcaaggcgtattcctgttcacagacacccaaatcaaggaggaatccttcttggaagacgtttccaatcttctgaatgctggagaaatccccaatctctttgcacttgatgaaaaacaagagatctgcgacaagatgaggcagctggaccggcagagagacaagactaaacagacggatggaagccccatcgccttgtttaatatgttcatcgatcattgtcgcagccagctccacgtggtcttggctatgtctcccattggagacgcttttagaaatcggctgcggaaatttcccgctctggtgaactgttgtactattgactggttccagtcatggcctgaagacgcactacaggctgttgcatcccggttcctggaagagattgaaatgtctgaagagattcgtgacggctgcattgacatgtgtaagtcatttcatacctccaccatcgacctcagcaaatccttcttcgtagaactgcagcgctacaattacgttacacctaccagctatcttgagctgatcagcacatttaaattgctgttagagaaaaagcgctccgaagtgatgaagatgaagaaaaggtacgaagtggggttggaaaaacttgattctgcatcctcccaggttgccacaatgcagatggaattggaggccctacatcctcagctgaaggtggcctcaaaggaggtcgatgagatgatgattatgatcgaaaaagagtctgttgaagtcgcaaaaactgaaaaaatcgtgaaggctgatgaaaccattgccaatgaacaggctatggccagcaaggccattaaggatgaatgcgacgccgaccttgctggcgctctgcctatccttgagagcgctctcgcagcactggacacgctgactgcacaggatatcacagtcgtgaagtcaatgaagtcaccacccgctggcgttaagctcgtgatggaagccatctgtatcctgaaaggcatcaaggccgacaagattccagatccaactggctctggcaaaaagatagaagacttttggggtccagcaaagcgtttgcttggggatatgcggttcctacaaagcctccacgagtacgacaaagataacattcctccagcatatatgaacataattaggaaaaactatattccaaaccccgattttgtgcccgagaagatccggaacgcaagcacagctgccgaaggcctctgcaagtgggtgatcgcaatggacagctacgacaaagtggctaagatcgtagcaccgaagaagattaagctggcggcagccgaaggagagctgaaaatcgcaatggacgggttgcgcaagaagcaggctgccttgaaggaagtgcaggacaaactcgcccgattacaggataccctggagctgaacaagcaaaagaaagccgatctcgagaaccaggttgatctgtgttctaagaagctcgaacgggcagagcaattgataggcggactggggggagaaaagactaggtggagccacaccgccttagaactgggacaattgtatatcaatctgactggggacatcctgatatccagtggggttgtggcttatctgggagcattcaccagcacttatcggcagaatcaaacaaaagagtggacaacactgtgtaagggaagggatattccttgtagtgatgattgctccctcatgggcaccctaggagaagcagtgacaatacgcacctggaatatcgcgggattacctagtgatagttttagcatcgacaacggtatcattattatgaacgcacgcagatggcccctcatgatagacccacagtctcaagctaacaaatggatcaagaatatggagaaagccaactctctctacgtgatcaaacttagtgagccagactatgtccgtacgttggagaattgtatccaatttggtacgcccgtgctgttagaaaacgtgggcgaggagctggaccctatcttggagcctctccttctgaagcagacctttaagcaaggcggaagtacatgcatcagactgggcgattctaccatagagtacgcaccagacttccgtttttatatcacgacaaaactgcgcaatccccactatctcccagagacttccgtaaaagttaccttactgaatttcatgataacacctgagggaatgcaagatcagctcctgggcatcgtcgtcgctcaggaacgccctgacttggaagaggagaaacaggcgttgatcctgcaaggcgcagagaacaagcgccagctcaaggagattgaagacaaaatccttgaggtgctctcctcttccgagggtaatattctggaggacgagacggccattaagatcctctctagttcaaaggcactggctaacgaaatatcacagaaacaagaggtcgccgaagaaacagagaagaaaatcgacacaacccgcatgggctacagacctatcgcaattcattcctctatactgtttttttcgttggccgacttggcaaacatcgaaccaatgtatcagtatagcctgacctggttcattaaccttttcatcctaagcatcgagaatagcgagaaatcagaaatcctcgcgaaaaggctgcagatcctaaaagatcacttcacatacagcttgtatgtgaacgtgtgtcggagcctgtttgaaaaggacaaactgctgttctccttctgcctgacaataaacttgttactacacgaacgagctatcaataaggcagagtggagattcttactgactgggggtataggcctcgacaacccctacgcaaatttgtgtacctggctgccacaaaaatcctgggatgaaatctgtagattagacgatctgcccgcttttaagaccattaggcgggagttcatgaggctcaaggatggatggaagaaggtgtatgactctttggagcctcaccacgaggtcttccctgaagagtgggaagacaaagcaaacgagtttcagcggatgcttattatacggtgtctgagacctgataaagtgattccaatgctgcaggagtttattatcaatcgtctgggacgcgctttcatagagccacccccattcgaccttgctaaagcatttggagattcaaattgctgcgcaccactgatatttgtgctcagcccaggagcggatcctatggccgctctcctgaaatttgccgacgaccaggggtacggagggtctaagctcagctctctttcattgggacaagggcaaggacccatcgcgatgaagatgctcgagaaagccgtgaaggaagggacttgggtggtactccaaaattgccacttggcaacatcctggatgcccaccctcgagaaggtgtgtgaggagctttcccccgagagcacgcatcccgactttcggatgtggttaactagctacccaagcccaaacttccccgtgagcgtgctccagaacggggtgaagatgacaaacgaggcccctaaagggttgcgtgccaacatcattcgaagttacctaatggaccccatttctgatcctgagttttttggtagctgtaagaagcccgaggaatttaagaagttactgtacgggctctgcttcttccacgccctcgtgcaggagcgacgaaaattcggtccactcgggtggaatataccctatgagtttaatgagaccgaccttagaatctcggtgcagcaactccacatgtttctcaatcaatatgaagaactgccttatgaagctcttcggtatatgacaggggagtgtaattacggcggacgcgtcaccgacgactgggacagaaggacactgaggagtatactcaataagtttttcaaccctgagcttgtggagaattcagactacaagtttgatagttcaggcatctatttcgtgcctccctctggtgaccataagtcttatatcgaatacaccaaaaccttgccactgacacctgctcccgaaatctttggcatgaacgccaatgccgacattacaaaagaccagtcagagacccaactcttgtttgataacattctgctgacccagtcaaggtccgccggagcgggtgccaagtcaagtgatgaggtcgtgaatgaagttgccagcgacattctgggaaagctccctaacaacttcgacatcgaggcagccatgcggaggtacccgacaacatacacacaatccatgaacaccgtattagtacaggagatgggaagatttaacaagctcctgaaaacgattagggatagctgtgtgaacatccagaaagcaatcaaaggcctcgccgttatgtcgaccgacctggaggaggtggtgtcgagcatcctcaacgtgaagattccggagatgtggatgggcaagtcttaccccagccttaagcccttaggtagctacgttaacgacttcttggcgaggctaaagtttctgcagcaatggtacgaggtgggacccccacccgtgttctggctaagcgggtttttttttacccaggcttttcttacaggcgcacaacagaattatgcacgaaaatatacaatccctatcgacctactcggctttgattacgaggtcatggaagataaagagtataaacacccgccagaggatggagtctttatccatggattattcctggacggggcttcatggaaccgcaagatcaaaaagctggccgagagccaccccaaaattctctatgataccgtgcccgtaatgtggctaaaaccatgcaaacgcgcagacatccctaagcggccttcttacgtggccccactttataagacaagtgagcggagaggcgtgctgtccaccacaggacattctactaattttgtcattgcaatgacgttgccatctgatcagcccaaggaacattggatagggaggggcgtggcactgctttgccagctcaactcctag

SEQ ID NO: 27921 - DNA, 1506 bp, Artificial Sequence
  Description of Artificial Sequence: Synthetic coding sequence
atgagctctcgacaggacaaaagcgcatccaaagaaaagagtaaaaagcccgtgcgctttctgccacagctgtcaatggaaaaattggcctccaaagaaaagttcaaggcacctgctagagcgctgccccaactgagcatggtgagtactaagccacactggcagcaggcagctccttcctttcatctttctgtgaaacaggacgatgagagtccagagccctttagcgtgaaaaacgaacagtcacatgcagaatatatggagcgctttgggaaaaaaggcaagttgccacatcaagtcgatgatagctacgttggcccatcaaccagcaagtcaaaaggcaaatcacctcataaagaaagggaaaatttccgctctacacttgttaacgtgattatgcagcaggatgctgacctcgattctgccgtgcctgacgggagcacaatcccaaagccaaccgcatccgcaatcgagaaagacatcctccgatactattactacatacaccatggcattgacaccgatcacgtggcccctatggaggattcttggcttgaacatgtgctagacctcgtcccgcagcacttaaaggtgttcacagatagtattgtaacactgagtgatgagatgcgagaggattacctgctgtccgtgcgaaagtcaattgtggacttcgtgctaaaggaccctcgcgagaagggcgatgacaagaagacagatgaacttcctgcacatagggcagaaatggaaattttgcccaagccctggcgtaagtcattccttgctgcctcatcgtatatcagagatcatttaaacgctatgaatcccacaatgctcgccgtcctggacctgtggcacaccaatttcaaaaaattgaggctggtcgacatcaaagagtttcacaattgccaggacgcccttgaattgtccagcttccagaatattattatgcgccatatggactctgcaaaggagaccctgctcaagatgtggttcccggaagtgcaaaatatttattaccagggcaataaaaaaaaacagcttcccaccggggatagcagcgcaaaactagaatcattctttaattgtgcagcagccttaatgaccctgcagcttcaggacctcactctggtgtccatgcaggactttactgaccttatagcccaacccccagatagcgtgagagcgttcgaacaccctggtttcatcatgagacttattctggataacgacactataaaatttgagcccgaattatctgattacatcgacatattcctgaacgtgtatgatgtgatgatcaaagcggtaagtttcgtgcccagggtggagacaaagttgtactcgaagtggagaaataaggccaagccgggacacttttatttttcgcacatccaacgttctgtgaccttccagcacagcgaagtcagttcaccccagaacagccactttaaaattgtgtcaccatttagcgtgttgggcttcacgtggcgttgccagctctag

SEQ ID NO: 27922 - DNA, 840 bp, Artificial Sequence
  Description of Artificial Sequence: Synthetic coding sequence
atggcagctcctgttcgccgaaccctgttaggggtggccggagggtggcgccgattcgagagactctgggccggtagcctgtccagccgttcactcgcgctggccgctgccccttcatccaatggttcaccctggagactgctgggggcattgtgtttgcaaagacctcccgtggtgagcaagccgctgacccctctgcaagaggagatggccagtcttcttcagcagatcgagatcgagcgttccctctattcagatcacgaacttagggcacttgatgagaaccaaagacttgctaagaaaaaagccgacctccatgatgaagaagacgaacaggatattttgctcgctcaagacctcgaagatatgtgggaacaaaagtttcttcaattcaaattaggagcaagaatcaccgaggctgacgagaaaaatgatagaacctcccttaatcgcaaactggacaggaatctggtgctgctggttcgagagaagttcggtgatcaggacgtttggattctgcctcaggctgagtggcaacccggagagaccctgcgtgggaccgctgaacggactttggcgacactgtccgagaataatatggaggctaaatttctcggcaatgccccttgcggtcattacacattcaagtttccgcaagctatgaggacagagtcaaatctgggcgctaaggtttttttcttcaaggcactgttgctcacaggcgatttttcacaggccggaaataaggggcatcacgtgtgggtgacaaaggatgagctcggggactacctgaaacccaagtaccttgctcaagttcgacggttcgtgtctgatttgtag

SEQ ID NO: 27923 - DNA, 609 bp, Artificial Sequence
  Description of Artificial Sequence: Synthetic coding sequence
atggaggctgaggctggtggcttagaggaactcactgacgaagagatggcagctctgggtaaggaggagctggtcagacgactgcggcgtgaggaggccgctaggctggccgctctggtacagagagggaggctgatgcaggaggtcaatcggcagctgcaggggcatctcggcgagattcgagagctgaagcagcttaaccgaaggttgcaagcagagaatcgcgagctccgggatctttgctgcttcctggacagcgagcgtcaaagagggcgacgagccgctagacagtggcagctgtttggtacacaggccagccgggctgtgcgcgaggacctgggaggttgctggcagaagttggccgagctggaggggcgtcaagaggagctcctaagggagaacctggccctgaaagaactctgtttggcattaggagaggaatggggccctcgcggagggccaagtggggcaggcggatctggtgcagggccagcacccgagctggcgctgcctccatgtgggccacgggacctgggggacggctcgtcatccacaggaagcgtcgggtcacctgaccagctgcccctggcctgctcacccgatgactag

SEQ ID NO: 27924 - DNA, 1353 bp, Artificial Sequence
  Description of Artificial Sequence: Synthetic coding sequence
atgcgcgagtgtataagcatccacgtgggacaggcaggggtccaaatcggaaatgcctgttgggagctatactgccttgaacatggaatccaacctgacggccagatgccttccgacaagaccatcgggggtggggacgattccttcaatacgttcttcagcgaaacaggtgctggaaaacatgtccctcgagccgtgttcgtggatctcgagcccaccgtagtggacgaagtgcgtacgggaacatacaggcaactctttcaccctgaacagttgatcaccgggaaagaggacgctgccagtaactacgcacgcggtcattacactataggcaaagaaatcgtcgacttagtactcgatcgcatcaggaagctggccgatctctgcacgggactgcagggctttttgatctttcattcattcgggggaggcaccggatctggattcgcatctctgttgatggagcgtctgagcgtcgactattctaagaaaagtaagcttgagttcgcgatttacccagcccctcaggtttcaaccgcggttgtcgagccatacaacagcatcctcacaacacatacgactctggagcatagtgattgcgctttcatggttgataatgaagcaatctatgacatttgccgcaggaatcttgacattgagcgaccaacgtatacgaacttaaatagactgattggccaaatcgtgtcttctattacagcaagcctgaggtttgacggtgccctgaacgtcgatctcaccgaatttcagaccaatcttgtgccttatcccagaattcacttccccctcgctacttatgcacctgtgataagcgccgagaaggcataccacgagcagctttccgtcgcagaaattaccaatgcatgtttcgagcctgctaaccagatggttaagtgcgatcccaggcatggcaagtatatggcctgctgtatgttgtatcggggagatgtcgtccccaaagatgtgaacgcagccatcgccaccattaagactaaacgtacgatccagtttgtggattggtgtcccacaggattcaaagtcgggattaattatcagccaccaacagtcgtgcctgggggagatcttgcaaaggtccagcgggcagtgtgcatgctgagtaatactaccgcaatcgctgaggcgtgggctcgtctggtacacaagtttgaccttatgtacgcaaagtgggcctttgtccactggtacgtcggtgagggcatggaggagggtgaattttcggaagcgagagaagacctggccgctcttgagaaagattgcgaagaagtgggcgtagattccgttgaggctgaggccgaggagggtgaagcttactag

SEQ ID NO: 27925 - DNA, 3078 bp, Artificial Sequence
  Description of Artificial Sequence: Synthetic coding sequence
atggtagctatggcagaggcggaggccggtgtcgccgtagaggttcgaggactcccccctgctgtcccagacgagcttctgaccctttacttcgaaaatcgacgccgtagcggcggtggaccagtgttaagttggcagcggctgggttgtggaggggtactcaccttccgggaacctgcggacgccgaacgtgtcttggctcaagccgaccacgagctacacggggctcagctttctctgcgacccgctcccccaagagccccagccaggttactgctgcaggggctgcccccaggcacgactcctcaacgcctggagcaacatgtgcaggcactactgcgcgcttctggtcttcctgtgcagccatgttgcgctttggcaagcccaaggccagaccgagccctggtgcaactgcccaagccgctcagcgaagctgacgtgagggtgcttgaagagcaagcacagaatttgggtctcgagggcacacttgtgagtctggctcgggttccccaggctcgcgcagtacgggtggttggcgatggggcttctgttgacttgctgttgctcgagctgtacttggaaaatgaacggcgaagcggcggagggccactagaggatttgcagagactcccaggccctctgggcaccgtggccagctttcagcagtggcaggtggcagagcgcgtgctgcagcaggaacacagactgcaaggctctgagctgtctctggtgccacattacgatatcctggagccagaagagctcgcggaaaatacctcaggcggtgaccacccaagcacgcagggccctagagccaccaaacatgccttactgagaactggaggcctggttaccgcactgcaaggagccggtactgtgaccatggggtccggcgaggaaccaggacagtcaggagcgtccctccggacagggcctatggtgcagggacggggaatcatgaccacaggaagcggccaggagcctggccagtctggtacgtcattaaggactggtcctatggggagcctcggccaggccgagcaggtgtcatccatgccgatgggatcacttgagcatgagggactggtgtcactccgacctgttgggttacaggagcaggaaggacctatgtctctcggaccagttggctccgcgggaccagtggaaacatccaaaggcctcctgggtcaggaagggctggtggaaattgctatggattcaccagaacaagaaggactggtggggcctatggagatcaccatgggcagcttggagaaggcaggccctgtgagccccggatgtgtgaaactcgcaggccaggaaggcctcgtggagatggtcctgctgatggaacccggtgccatgagatttcttcagctgtaccacgaagatcttttggctggccttggggatgttgcactgctgccactggaagggcctgacatgacaggattccgcttgtgcggcgctcaagcgagttgtcaggccgcagaggagtttctccggtcccttctggggagtatctcctgccatgtgctctgcctggagcatcctgggtccgccagatttctccttgggccagaaggccaacacctgctccagggtctcgaggcccagttccagtgcgtcttcgggaccgaacgcctggccactgccacccttgatacaggcctcgaagaagttgaccccacagaagccctgcccgtgctcccagggaacgcgcacacactgtggacacccgactctaccggcggagaccaggaagatgtgtccttagaagaagtgcgtgagctgctcgccaccttggaggggctggatctggatggggaggattggcttccaagggaacttgaagaggaaggaccacaggagcagccagaggaagaggtgacaccaggccacgaggaagaggagcctgtggccccttctactgtggccccacggtggctggaagaagaagccgcactgcaactggctctgcacaggagtctcgagcctcagggacaggtggccgaacaggaggaagccgctgccttgagacaggccctcaccctctctctgctggagcagcctcccctggaagccgaggaacccccagatggagggacagacggaaaagcccagttggtggtgcactcagcctttgaacaagatgtcgaggagctggaccgagcccttcgggcagccctagaagtccacgtgcaggaggaaaccgtgggcccatggcgacgcaccctgcccgctgaactccgggcacggcttgaaaggtgtcacggggtgagtgtagctctgaggggagattgtaccatcttaaggggcttcggggctcatcctgccagggctgctcggcatctggtcgcgctgctcgctggaccttgggaccagagtcttgccttccccctggctgcctccggcccaacactcgcgggacaaacccttaaaggcccttggaacaatctggaaaggttagctgagaatacgggcgaattccaggaggttgtgcgggcattctacgatactttggatgcagccaggagttcaattagggtcgtcagggtcgagcgggtctcacaccctctgctccagcaacaatacgaactatatcgcgagcgactcttacagcgttgtgagagacgacccgtagaacaagttctatatcacggcactactgcccctgccgttccagacatctgtgcccacgggtttaatagaagcttttgcgggaggaatgctactgtctacggtaaaggcgtctattttgcacggagagcctccctgtctgtgcaagaccgctactctccacctaacgcagatgggcataaggccgtttttgtcgcacgcgtgctgacgggagactatgggcagggaaggaggggactgcgagccccacctctgcgcggacccggtcacgttctcctccgatacgacagcgcggtggactgtatctgccagccttctattttcgtcattttccatgacacacaggcactccctacccatctcattacatgtgaacacgttccccgagccagccccgacgacccttcaggcttgcctgggaggtcccccgatacgtag

SEQ ID NO: 27926 - DNA, 390 bp, Artificial Sequence
  Description of Artificial Sequence: Synthetic coding sequence
atgagtcatctgcagtctctactcctggatacactactcgggactaagcacgtggactccgctgcactgattaagattcaggaaagaagcctgtgtgtggcttctcccggttttaacgtgactcccagcgatgttagaacacttgtaaacgggttcgcgaagaaccctctccaagccaggcgcgagggcctttatttcaaggggaaagattatcgatgcgtcagggcggatgagtacagtctgtacgcgaagaatgagaatacgggcgttgttgttgtgaagactcacctgtacctgttggtggcaacatacactgagggcatgtaccctagtatctgtgtggaggccactgaatctctcggagactatctgaggaagaagggctcctag

SEQ ID NO: 27927 - DNA, 945 bp, Artificial Sequence
  Description of Artificial Sequence: Synthetic coding sequence
atgttgggtaaaggcggaaaacggaagtttgatgaacatgaagacggactcgaggggaagatcgtttctccttgcgacggcccttccaaagtctcttatacactgcagaggcagacaatcttcaatatctctctaatgaaactgtataatcataggcccctcaccgagccatctcttcaaaaaactgtgctgatcaacaatatgttgcggaggatccaggaggagctgaagcaggagggcagtctgcgacctatgttcacaccctcaagtcagcctaccaccgagcccagtgatagttatagggaggccccacccgctttctcgcatctggcctccccaagcagccatccttgtgacttgggatcaacaactccacttgaagcctgtttaactcctgcctccctgctcgaggacgatgacgacacgttctgtacaagtcaagcaatgcagccaaccgctcctacgaagctcagccctcctgctctgctccccgaaaaggactcatttagcagcgcgttggatgaaatcgaagagctttgtcccacgtctacatcaacggaggccgcaaccgcagcaacggactctgtgaagggaacgtcatctgaagccggtactcagaaacttgatggaccccaggagagccgcgctgacgattctaagctcatggacagtcttcccggaaattttgaaatcacaactagcactgggttcctgaccgatctgaccctggacgacatcttatttgcggacatcgacacgtccatgtatgatttcgacccatgtacttcgtctagcggcaccgcttccaagatggctcctgtcagcgcagatgacctgctgaagacactggccccttactcatcacagccagttacaccttcccagccgttcaagatggatttgacggagttagatcacataatggaggttctggtcgggtcatag

SEQ ID NO: 27928 - DNA, 246 bp, Artificial Sequence
  Description of Artificial Sequence: Synthetic coding sequence
atgaaaggctctcgcatagagctcggcgatgttacccctcataacatcaaacagctgaagagactgaaccaagtcatttttcctgtgtcatataatgataaattttacaagaagttcgggtttgagatcatagaaacgaagaagaattattacaaaaggattgaaccggctgacgcacatgtattacagaagaacctgaaagtcccttcaggacagaatgccgacgtgcagaaaaccgataattag

SEQ ID NO: 27929 - DNA, 1437 bp, Artificial Sequence
  Description of Artificial Sequence: Synthetic coding sequence
atggcgtccgcaactgaggacccagtactcgaacgatactttaaaggccataaagcagccatcacctctctcgacctctcccccaatggcaagcaactggccacagcaagctgggacacctttctgatgctgtggaacttcaaacctcacgcaagagcctatcggtatgttggccacaaagacgttgtcacctccgtgcagttttcaccacacgggaatcttctggcaagtgcctctagggaccggaccgtcaggctctggattccggacaagcgtggcaaattttctgaatttaaggcacacactgctcctgtcaggagcgttgatttcagtgccgacgggcagtttctcgccactgcatccgaggacaagtccatcaaagtctggtctatgtaccgacagcgattcttgtactctctgtatagacatactcactgggtgcggtgcgcgaaatttagtcccgacggacgtctgatcgtctcttgctctgaagataagactatcaaaatctgggatactacaaataaacagtgtgtgaacaactttagcgattccgtgggctttgccaattttgtggatttcaacccctccgggacctgcatcgcgtcagcgggaagtgaccagacggttaaggtctgggatgtacgggtcaacaagttgttgcagcactaccaggtgcactccggcggagtcaattgcatatctttccatcctagcggaaactacctgattacggcatccagtgacggaacccttaagattctggatctgctcgaggggcgtttgatctacacactgcaaggtcacaccggaccagtttttaccgtcagctttagtaaagggggtgagctgtttgcatccggaggcgctgatactcaggtactcttatggcgtactaacttcgatgagctccactgtaaaggcctgaccaagcggaacttaaagcgcctgcacttcgactcccctccacacttgcttgacatatatccccgtactcctcacccacacgaagaaaaggttgagaccgttgagatcaatccaaaactggaagttattgacctccagatctctacaccacccgtgatggacattttgtcgtttgattctacaaccacgaccgaaacttcaggacggaccctccctgataagggcgaagaagcctgtggatactttcttaaccctagcttaatgtctcctgagtgccttcccaccacaactaagaagaaaacggaggacatgtcagacttaccgtgcgagtcccagcgtagtatccccttggccgtcactgacgccctcgagcatattatggaacagctgaacgtgctgactcaaaccgtttcaatcctcgagcaacgtttgacattgaccgaggacaaattgaaggactgtctggagaaccaacagaagttgtttagcgctgttcagcagaaaagttag

SEQ ID NO: 27930 - DNA, 1263 bp, Artificial Sequence
  Description of Artificial Sequence: Synthetic coding sequence
atgcttaaggcagttatcttaatcgggggtccccagaagggtacacgtttccgtcccttatcttttgaagtcccaaagccactcttcccggttgccggagtgccaatgattcaacatcacatcgaagcctgcgcccaagtcccaggtatgcaggagatcctcctaattggattttaccaacctgatgagcccctaactcagtttctggaggctgcccaacaagagttcaacctcccggtccggtacctgcaggagttcgcacctcttggcactgggggaggtctatatcactttcgcgatcagattcttgctggaagccccgaagccttcttcgttctgaacgccgatgtatgctccgactttcctttgagtgcaatgctcgaggcacacagaagacagaggcaccctttccttctgctcggcaccacagccaaccgaactcagagtctcaattatgggtgcatagtcgagaatccgcagacccacgaagtgcttcactatgtggagaaaccttccacatttatctctgatataatcaattgtgggatctatctcttcagccctgaggcactgaaacccttgagggatgtgttccagcgaaatcagcaggacggccagcttgaagatagcccaggtctgtggcctggggcaggaactatcagattggaacaggacgtgttctctgccttagcaggtcaagggcaaatttatgtgcatcttactgacggtatatggagccaaatcaagagcgctggatctgcactgtatgcgtctcgtctgtatctgtctcgatatcaagacactcaccctgaacgactggccaagcatactcccggaggcccttggattcgcggaaatgtgtacatacaccccaccgctaaggtggccccttcagccgtgcttgggccaaacgtgtcaatcggcaagggcgtcacggtgggggagggcgtgcggctgcgagagtcaatcgtgcttcacggcgcaacgctgcaggagcatacgtgcgtcctccactccattgtcggctggggatccaccgtgggccgatgggctagggtcgaaggcactccctcggaccccaaccctaacgatccaagggccaggatggattctgagtccttgttcaaagatggaaaattgcttccagccatcaccattttggggtgcagagtgcggatccccgctgaggtacttatactgaactccattgtgcttccgcataaggagctgtcaaggtccttcacgaaccagattattctctag

SEQ ID NO: 27931 - DNA, 1215 bp, Artificial Sequence
  Description of Artificial Sequence: Synthetic coding sequence
atggaccaggattacgaacgcagactgctgagacaaatcgtcattcagaatgaaaacaccatgccgagagtgaccgagatgagaagaacactgactcctgcttcttctccagtgagttccccaagtaagcacggtgaccgattcatccccagcagagcaggtgctaactggtccgtgaacttccaccgaattaacgaaaacgagaagagtcctagtcagaacagaaaggctaaggatgcaacctctgacaatggcaaagatggcctggcatatagtgctctgctgaagaatgaattactaggggctgggattgaaaaggtccaggatccgcagacggaggatcgcagattgcagccttccacccccgaaaagaagggcctttttacggttacccgtttatgcgacctttccgtcgaaggagactctgttacatcggttggctggagcgaacgaggcaatctggtagccgttggaacccacaaggggttcgtccagatctgggatgccgctgcaggcaaaaaattgagcatgctcgaaggtcacacagcacgagtgggagctctggcctggaatgccgagcagttaagctctggttctcgggatcgcatgatcctgcagagggacattaggaccccccctctccagagcgaacgcaggctccaggggcaccgacaggaggtctgtgggctcaaatggagcacagaccaccagctcctcgcctcagggggaaatgataataagctgctggtgtggaaccattcttctctgtctcctgtgcaacagtataccgaacacttagccgctgtgaaagcaatcgcttggagccctcatcaacacggattactcgcctcaggcggaggcaccgccgaccgctgcattcggttttggaacactctgacaggccagccgctgcagtgcatagacacaggctcacaggtttgcaacctggcctggtcaaagcacgcaaacgagcttgtaagcacccatggttactcccagaatcaaatcctcgtttggaagtaccccagcttgactcaagtagcaaagctgaccggccacagctatcgggtgctgtatttggctatgtctccagatggcgaggccatcgtcactggcgcaggcgacgagaccctacgtttctggaacgtgtttagcaagactaggtctactaaagagagcgtgtcggtgctcaacttgttcacacgcatccgatag

SEQ ID NO: 27932 - DNA, 5892 bp, Artificial Sequence
  Description of Artificial Sequence: Synthetic coding sequence
atgaagcagcggaagggacaagggtccggtggaagccgagggagaaaaaaacggggtctctctgacatttctccctccacttccctgccacctttggttgagggacagctcagatgttttttgaagctaacggtgaatcgggttatttggaagatagctaaaccccctacatgcgttctagtgcgcgtcagatggtggggtgagactagcgatgggacccttttttgccctagggatgctttacagacagaaccgaaagctgtacgcacaaccacgaggtacgctatcagatgtggaccaaagcagttcaccagctacctgaccgacatggcggtcttggtacttgaggttattaccaagttggatggattgcctatcggaagggtacaaatcaacggcctggcacagctctcccccacacaccagatcaatggcttcttcacaatcgtgagcagcacctccaagaagcttggagagctgcaggtgagcctggctctggagccactaagcgagacttacgatagctatcacccacttccaactacagacatgaccgaaaacgtcctgctgtccaagcagggcttccgagaaaacacggaaccttctagcacccagtttcaggtgccgagtagaccacgcgatatacatactataaagattgacggcaaagaattagccgctaactcaagcagaagtaccacgcccagaggtaaagatcatgtgtgcttcgccgaaaatccggacactatcaaagatagctccttcggccttcagcactcgcttaacagtggccagagcctggagtccgtgacacttaaaggtcgggcaccaagaaaacagatgagtctcctgaattcctccgagttccagcctcagattcggactgtggccaagtctcactccgattcttgtattttaagcagcaacaatctccctacgaaggacttgctttcagcactgctcgagcagggcaataagctgagaaatgctatggttatcagcgctatgaagagtagcccagaaacatctatgctgctggaccaggtgcatcctcccatcaatgaagacagtctgagggccagcacccagattagggccttctcccggaatcggttcaaggatcatatcgaagatcacttgctgccgtccactgagaacacgttttggagacatgatacgaaagctgataccagggccattcagctcctgcttggcagcgcagagttgtctcaggggaacttttgggacggactgggcagccctcccgactccccatctcctggttctgatgtatattgtatatctgagcttaatgatccccagtacgatcagtccctcttagagaacctgttttacactgctcccaagagcgatacttcgataagtgactttctttcggaggaagacgacatcgtccccagcaagaaaattagccaatctaccgcgctcgcgaggtcaagcaaagtgttagaaagcagcgaccacaagctcaagaagcggagtgctggaaagcgaaatcgcaaccttgtcgaacagcagatgttgagcgaaactccagaagacgcccagacaatgacgctgagtgtggacaggctggcactactgggccgaacccatagcgtgcggatcattatagagactatgggggtgcccccagacagccctcaaatgactccagggaagaagtcatacgccggacccccacctaaagtgacaactgctaagaagagaacattcttcgtagagtatcacttcccggtaggcttttctgagagcggccttggcaagacggcactgatcaccgaagtcgtaaggctcgcttcatccaagattaccgatggcaaagtgaagttccagcagcgcttcgtctttcccgtccagtttgggggtccgatgatcgaacactggtggaactccaacttaaccttccaaatctatgtcaagaaaactccccagaagaagcccgaagtaatcggctctgtatccctatccctgagggccgtgattcagtctgaactcctctcattctccgaccagctgcccgtgcaacaagagaatggccagagcccctttgggccactcaaagtgaccatggagctcatcactgacaacaaggacttcactggcataaatactaagctgagtgggaacactcactataccccattgtgtgcccctactagccctaacaaagctcttcccgaactcaaccaggatatgacttgcactaaaaacccacagaatctaaatcaaatacacgaggagaccgccaaaaaggcccagaacctggttctgcctaacagaaagtcaccttctcccgtcgccccacacccatctacattcgtcgctacacctgcttcacacaatctggttaaccagaccaacggtactacgaaggaatctgctcttcttctgcacgtcttgttgatggtccccgatggaaaggattttatcagcggtgaatctgagaaacagagtccatgtaacgtctatttgaactgtaagttgttcagtacagaagaagtgacccgatcagtgatcgcctggggaaccactcagcctgtcttcaacttctcacaggtgatacctgtgtccctctcctcaaaatatctggagcgtctgaagaacaacgtcatggtgatagaaacttggaataaggtgcgcagcccaggccaggataagctgctagggctggtaaagctgcccctgcaccagttttatatgagctttaaagacgcaaagatctccaggttgcttcttgacgcgcagtacccagtggtggctgtggattcttacatgcccgtgatcgacgtgtttagcgggcaccaaaacgggagcttgagggtgttcctggctatgggctcttccaatcagatcatggctctgcagagattgaagaacgaggagggcacactgccgcctttctcacccaggcccgctcattttcttgatcagccaactgccgcttccgtggcgatggccgaggaccggggtaacggactcatggaacactgcttcgagatccacatagaaatggtaaaaggcctggctccacttcaggccacggtgtggggcgaagccgattgctatgtgcagtattatttccctgtacagcacagtcagtccagcgtccttaaagggccagaattcctagaaaatggcattactcttaagcccttccggaccgcgacaaccctgtgtgtccctgatccgatcttcaattccgagcatcaccactcactgttgttgccagccgaagtccccgttcaacggttgctcctgtctgccttcagcgcacagggcttagtgccaggcggaggggttcagttcgaaatatggtgcagatactactatcctaatgtgagagaccagaaagtcgctaaagggacacttcctctttctagaatttgtgctatggttacaacccagcatagagaggacgtgggaatacaaacgttcaacctgccactcaccccacgtatcgaaaatcgcaaagagctgagaaaccagagctcaggcctgctggacgtaggcttgcgctaccgaagaagtccgaggaccgcagaaggggtacttgctgccagaacggtcagtatatcggtgcaaattattcgagcctgcgggctacaggccgctgctaaagccctggcagaaagagagcctgcccttcagttctctgccaccgtcggtgtaaacgcttctgtcacaacccatctgagttttttaccgcagggggaacagaggcgaacccaccctgttgcctgctccttttgcccggagttttcccaccatgtcgagtttacctgcaatctcgttacccagcattgctccggtgaggcttgcttcctggcagaacttctggaatttgcggaagtcatttttgccgtctatcatgaaaacaccaaatcagccagtgacatcattagcattgagtcatgcaaggagtatctgctaggggtcgtaaaggtgcctacaaaggaactcttaattaagcggtctggcataactggatggtatcccatcatcctcccagaggatggagggctgccccacggcctagaactaatgcagaaaattgtgggagggcttgaactgagtatcagttttacacacaggggtgatagggagagggtattggaagctgctgagcatctgggatggagttttgagaattctctgaaggactttgtgcggatggatgagggcgagccagcaacagtgactatcagtaccccaaggctatggttacccattcattgcgtactgctcgcgggtcataaccacattcacaagaacacgtattgttatctccgctataagttctacgatcatgaagcattttggaccccactgaaaaaacccaaggaaagcgtgaacaagaaacaaattatggtcacttttaaagcaagcaaacgtgccgaagttacacggggaccgagccttctgtggtatttcagggaagagcgtctggaaatacaggtgtggagggcgtacggcaatgacagcgttgaacgcccacaccagacagacagctggatagggtctgcatatgtcgacttagcaagactcggggagagatctgcacggactctgactgttagtggagtataccctctgtttggacgtaacgcatcaaatctctcgggggctgcacttcgcgtgcacgtggtgctttcttcacttagcagtcatttggaacctacacacgaactcgacagcatggactgttcatcccacagcgaaagcgaacagctgcccaggagaaacgatgaagtgcagctgtctcctccagaagtgatttcgtgtcaccagaagtcgcctgctagtacccaggtgccgtgcagttccacaacagcagaagtccggctcacacaagaaggcccagcagatctcgatggcacattcgccgtgagcattctggtggagcgagctatgcacctctctctgaaagggtcacccctgactgaacgtaaggtgtcaatcccctcatgctgcgtgagctttgctactgctgatgagagctctccagtgtatacccaggtcgtggagaacactgactcgcctatatggaattttcagcagcaatcaaggttatcaaaggagctcttgctcgaccctcagcagactctggtgtttaaggtatggcacaaaggtgacgaggaaagggttatcgggtttgcatcagtggacctctcccctctgctgtctggttttcagttcgtttgtgggtggtataacatcacagacttttctggggaatgccagggtcaaatcaaggtggccgtatctcccctggagtcccttattcatttcaaggaggaaagacaagccaggcgaggggtggaaacaagcaagagcctgatccctatttactcaccattctcctttcctgcttccgatacatacgccgcattcagctcacatatggctagacagacactggaccaactggcccacgcaagctctaaggaattagactttagcagcccgggtcgtagcgacaccacgagatctcaggcctcccggcacgaagagcatgtgcagaacatcaggcgcttccatgagtccctacatctgcagggcgaggcccctctgccttgtgatgataagcttacaacctctcccctctcatcacaaacaagtattcttacaagcctgcgtaaaaacctgagcgagctcgaccaaatccagcggtattttcgacagaagcttacgaaaccttttctgcctctgtcccctcagacacagacggccatctcccaacatcaggaaagctgtcgggaccaccttggaccaggagcaagctccttagatcctgggagccagtgcatcctggaaaagtcatcaaatctggtgctccaggtgtcatcactcatcaccgggtcctattat

SEQ ID NO: 27933 - DNA, 5586 bp, Artificial Sequence
  Description of Artificial Sequence: Synthetic coding sequence
atgaaacagcgtaagggacaaggatctggagggagtaggggtcgcaagaagagaggactgtccgatatttcccccagcacctccctgcctcccctcgtcgaaggccaattacgatgtttccttaaactcaccgttaacagggtgatttggaagatcgcaaagccacccacctgtgtgttagtgagagttcgctggtggggtgaaacgagtgacggtactctgttctgccccagagatgcactgcaaacagagccaaaggcggtgcggaccacgacccgctacgctattagatgtggccctaagcaatttacttcgtacttaacagatatggcagtactcgtgctggaggttattacaaaacttgacggcctgccgataggcagagtgcagattaatggtctggcccaattgagccctactcaccagattaacggattttttactattgtctcttccacaagcaaaaaactcggtgagttacaggtgtcccttgctcttgaacctctatcggagacctatgacagctatcacccgctccctaccacagacatgactgagaacgttctgctgtccaaacagggtttccgggaaaatactgagcccagcagtacacagttccaagtgcctagccgcccacgggacatacacaccatcaaaatcgacgggaaggagctggccgctaactccagcagaagcacgaccccaagagggaaggatcatgtctgctttgccgaaaaccctgacacaataaaggattcatccttcggcctccagcattccttgaattctggtcagtcccttgaatcagtcacgctcaagggcagggctcctcgaaagcagatgtcattactcaacagctcagaatttcaaccccaaatccgcacagttgcaaagtcccattctgactcatgcatactcagctcaaataatcttcccactaaagatctcttaagtgccttgttagagcaagggaacaagctgcgcaacgcgatggtcatttccgccatgaaaagttcacctgagacctctatgctgctagaccaggtgcacccacccattaatgaggactcattgcgagcaagcacccaaattcgggctttttccagaaatcgctttaaggatcatattgaggaccacctgctcccttcgaccgagaacaccttttggagacacgatactaaggccgacaccagagcaatccagctgcttctcggcagtgcagaactcagccaggggaatttctgggatggcctcgggtctccaccagattccccttcgccaggatccgatgtttactgcatcagcgagctgaatgacccccagtacgaccagtcccttctcgagaatctgttctatacagcaccaaagtccgacacgtccatctccgatttcctcagcgaggaagacgacatagtccctagtaagaagatatcccagagcactgccttggctcggagttcaaaagtgctagagtcgagcgaccataagctgaagaagagaagtgcgggaaaaaggaataggaatctagtggagcagcaaatgctgagtgaaactcctgaggacgcccagacaatgactctgagcgtcgatcggctggcactgctaggacggacccatagtgtcagaatcatcatcgagactatgggggtgcctccagacagcccccagatgacccccggaaaaaagagctatgccggaccaccaccaaaggtaaccacagctaaaaaaagaactttcttcgtggaatatcattttccagttgggttctctgaatccggtctaggcaagacagcactgatcacggaagttgtgcgcctagccagctccaagatcacagatggcaaagtgaaattccagcagagattcgtcttccctgttcagttcgggggtccaatgatagagcattggtggaatagcaatttgacttttcagatttacgtgaaaaagaccccccaaaaaaagcctgaggtaatcggctctgtgagcttgagcctgagagcggtgatacagagtgagctgttatctttttcagatcagctgcccgttcaacaggaaaacggccagagcccatttgggccactcaaggtcactatggaactgatcacagataacaaggactttactggcattaataccaaactctcaggcaacacacactacacccccctctgcgccccaacatcccctaacaaggccttgcctgagttgaaccaggatatgacctgtacaaagaatccacaaaacctgaatcagatacacgaggagaccgctaagaaggctcagaacctagtgctgccaaacaggaagtctccatccccggtcgccccacacccttccacttttgttgccacacctgcctcgcacaatcttgtgaaccagacgaacggtaccactaaggaatcagctttgctgctacatgttcttctgatggtccccgacgggaaagatttcatttctggagagagcgagaaacaaagcccctgcaacgtttatttgaattgcaagctgtttagtaccgaggaggtaacgcgttctgttatagcctggggcactactcaacctgtgttcaatttctctcaggtcatcccagtctcactgagttccaagtatttggaaaggctaaagaacaacgtcatggtgatagaaacttggaacaaggtgcgatcccctggtcaggataaactcctgggcctggtgaaactgcctctgcaccaattttatatgtcattcaaggacgccaagattagcaggctcctattggacgctcagtaccccgtcgtggccgtagactcatatatgcctgtgatcgacgtcttttccggtcatcagaatggatccctccgcgttttcctggccatgggatcgtcaaaccagatcatggcccttcagagacttaagaatgaagagggaacattacccccattcagtcctagacccgcacactttctcgaccagcctactgctgcctccgtggcgatggccgaagatcgaggcaatggcctgatggagcattgcttcgagatccacattgaaatggtgaagggccttgctccattacaggcaaccgtatggggcgaggctgactgttacgtgcagtattacttcccggttcagcacagtcaaagttctgtgctcaaaggccctgagttcctggagaacggcatcacgctgaagccctttaggacagcaactacattatgcgtgcctgatcctatctttaattcagagcaccaccacagtctgctgctgcctgctgaggtccctgtccagcgccttttattgtctgcattctcagctcaaggccttgtcccagggggtggtgttcaattcgagatttggtgtcggtattattaccccaatgttcgtgaccagaaagtggcgaagggaaccctgccgctgtctcggatttgcgcaatggtgacaacgcaacacagagaggacgtgggaatacagaccttcaacttgcccctcacacccaggatcgagaacaggaaggagctgaggaatcagtcatccggcctgctcgacgtaggtctacgctatcggaggtctccacggactgctgagggcgtgctggctgcccgaacagtgtctatcagcgtgcagatcataagagcatgtggcctgcaggctgcagccaaggcactcgcagagcgcgagcccgctttgcagtttagcgccacagtaggagtaaacgcctcagtgactacccacctgagtttcctgccccagggtgagcagaggcgcacacatcccgtcgcttgttcattttgcccggagttctcacatcacgtcgagttcacctgcaatctggtcacacaacattgctctggagaggcttgcttcctggccgagctgctggaattcgccgaagttatttttgccgtttatcatgagaacacaaagtcagcgtcagatattatatcgatcgaatcttgcaaagagtatctgctgggggtcgtcaaagtcccaacaaaagagctgctgatcaaacgcagtgggattaccggttggtatccgattattttgccagaggacggagggctgccccacggcctggagctgatgcaaaagattgtcggaggtctagaacatctcggctggtcctttgagaatagtctgaaggactttgtgcgtatggacgaaggagagcccgcaacggtaaccatcagcactcctaggctttggttgcctattcactgcgttctgctcgcagggcataaccatatccacaagaatacttattgttacctgcgatacaagttttatgatcatgaggctttttggacacccctcaagaaaccaaaagaaagtgtcaataagaagcagataatggttacatttaaggcctccaaacgggcagaagttaccaggggtcctagcctactatggtatttcagagaggagagacttgaaattcaagtatggagagcttatggtaatgattctgttgaacggcctcatcaaaccgattcctggattggatccgcctacgtcgaccttgctcgcttgggcgaacggtcagcacgcacattgacggtcagcggtgtataccctctgttcggcagaaacgcctctaatttgtctggagccgcactccgcgtgcatgtggtcctgtcttctctgagctcccatctagaacccactcatgagctggacagtatggattgcagttcgcacagcgaatccgagcagttgcccagacggaacgacgaagtccagctatccccgccagaagtcatcagctgccatcagaagagtcccgcatccacgcaagttccctgctccagtacaactgctgaagtcaggctcactcaagagggccctgctgaccttgacgggacctttgcagtctctatcctcgtggagcgggctatgcacctgagtcttaagggcagccctctgaccgagaggaaggtgagcatcccttcatgctgcgtgagctttgcgaccgcagatgagtccagccctgtctacacccaggttgttgagaacacggactccccaatctggaactttcagcagcaaagcagactgtctaaggagctgctactagatcctcagcagacgttagtcttcaaggtctggcataagggtgacgaggagagggtgatcggctttgcaagcgtggacctgtctcccctgctgtctgggttccagttcgtgtgcggttggtacaatattacagatttttctggggagtgtcagggccagattaaggtggcagtcagccccctggaaagcctgatacacttcaaggaagagcgccaggctcgacgaggggtggagacaagtaaaagcctcatccctatttattcgcccttctcatttcccgcttcagatacatacgccgcattcagctctcacatggctagacagactctggaccagttagctcacgcgtcgagcaaagaacttgatttttccagccccggtcgcagtgatacaacccggtcacaggcttcgagacatgaggagcacgtccaaaatatcagacgctttcatgaatccttgcatcttcaaggcgaagccccactcccctgcgatgacaagctgaccacctctccgctatcttctcagacttaa

SEQ ID NO: 27934 - DNA, 1131 bp, Artificial Sequence
  Description of Artificial Sequence: Synthetic coding sequence
atgctcacttttcttcagcagttgcgcgtggattggcccgctgccagtgagcgagcttcgagccataccctcagaagccatgctttagaggagctgacgagcgccaatgacggcagaaccctcagtcctggcatcttggggaggctctgtttgaaggagctcgtagaagagcagggacgcactgcgggttacgaccctaacttagataactgcctggtgacagaggatttgctgtccgtgctggcagagctgcaggaggcattatggcattggcccgaagattcccaccctgggctcgccggagcatccgacacagggactgggggatgtcttgtcgttcacgtggtcagctgcgaggaggagttccaacaacagaaattagatttactgtggcaaaaactggtggataaggcaccacttagacaaaagcatcttatatgtggcccagtcaaagttgctggagctccaggcacgctgatgactgcacccgagtattatgagttccggcatacacaggtttgtaaagcatccgcgttaaagcacggaggtgacctcgcccaggaccccgcttggaccgaaattttcggcgtgttgagtgtagcaactattaagtttgagatgctgagcaccgcacctcaaagtcagctgttcctggccctggccgatagctcaatatcaaccaaaggcacgaagagcggcacatttgtgatgtacaattgtgccagactggccacacttttcgagtcctacaagtgctcaatggaacaaggactgtatccgactttccctccggtttccagcttagatttttctctgctacatgatgagggcgaatggctcctcctgtttaatagcattctcccctttccggacttgctatcccgtaccgccgtgctggattgtaccgcaccaggtttacatatcgccgttcgcactgagatgatctgtaaatttctcgtccagctttcaatggatttcagcagctactataatcgcgtgcatattttgggagagcccaggccccacctatttggccagatgtttgtaagactccagctgttgcgagcagttcgtgaggtcctgcatacaggtctagcgatgctgggcttaccacccctgtctcacatctag

SEQ ID NO: 27935 - DNA, 1572 bp, Artificial Sequence
  Description of Artificial Sequence: Synthetic coding sequence
atgaaccagccctgcaattccatggagcccagggttatggacgatgacatgttgaagctagctgtgggggatcaggggccacaagaggaggccggacagctcgctaagcaggaaggcattcttttcaaggacgtgttgagcctgcagctggatttccgcaacatcttacgtatcgataacctgtggcaatttgaaaacctccgcaagctccaacttgacaacaacatcatagaaaagatcgagggactggagaatcttgcccacttagtttggttggatctctcgtttaataacattgagacaatcgaaggtctcgatacattggttaacttggaagatttgagcttattcaacaacagaattagcaaaatcgatagccttgatgccctggtgaaattacaggtgctgtctctcggaaacaatagaattgataacatgatgaacatcatctacctcaggcggttcaaatgcctcaggacgctgtctctctccaggaaccctatcagcgaggcagaagattacaagatgtttatctgtgcctacctcccagacctgatgtatcttgattatagaaggattgatgatcacacaaaaaagctagctgaggcaaagcatcagtatagcatcgacgagctgaagcatcaggaaaatttaatgcaggcacagctcgaagatgagcaggcccaacgcgaagaactcgagaagcataaaaccgcatttgtggagcatctcaatggatcctttctcttcgatagtatgtatgccgaggattctgaaggcaacaaccttagttacctgccgggtgtgggggaacttctggagacttacaaagataaattcgtgattatttgtgtgaacatcttcgagtacggactcaaacagcaggagaaaaggaagaccgagcttgatacctttagcgaatgcgtaagggaggccatacaggaaaatcaggaacaggggaagaggaaaatcgcgaagttcgaggagaagcatctgagttctctctcagccattagggaagagcttgaactgcctaatattgagaagatgattctggaatgttctgcggacatctcagagctgttcgatgccctaatgacgctggaaatgcagctcgttgaacaactggaagagactatcaacatgtttgagagaaacatcgttgacatggtgggcctctttattgagaatgttcagtccctgatggcgcaatgtagagacctggaaaatcatcatcatgaaaagctgctggagatcagcatcagcacgctcgagaagattgtagagggtgatctcgatgaagatctgccaaacgatctcagggcactatttgttgataaagatacaattgtcaatgcggtgggtgcgagccacgatatccatttattgaagatcgacaacagagaagacgagctggtgacccggattaattcttggtgcacaaggttaattgatcggatccataaagacgaaatcatgagaaaccggaaacgggttaaagaaataaatcaatacatcgatcacatgcaaagcgaactcgacaacctcgagtgtggcgatattttggactag

SEQ ID NO: 27936 - DNA, 1680 bp, Artificial Sequence
  Description of Artificial Sequence: Synthetic coding sequence
atgaaggtcatcacctgtgaaatcgcatggcacaacaaggagcctgtatatagtctcgatttccagcatggaaccgccggaaggatccaccggctggcatccgcgggtgttgatactaatgtgcgtatatggaaggtggaaaagggaccagacggtaaggctattgtggaatttctcagtaacctggccagacacacaaaggccgtaaacgtggtaagattcagtcccaccggcgaaatcttagcgtctggaggcgacgacgccgtgatcctgctctggaaagtgaatgacaacaaggaacctgagcaaatcgcttttcaagatgaagatgaagcgcagctcaataaagagaactggaccgtagtgaaaacgctcagaggtcacctggaagacgtgtacgatatttgttgggctactgatggtaacctgatggcttctgccagcgtggacaacaccgccatcatttgggatgtgtccaagggtcagaaaatctcaatctttaacgagcataaaagttatgttcagggggttacgtgggaccccctggggcaatatgtggcaactctcagctgcgatcgcgtgctgcgtgtgtatagcattcagaaaaagcgggttgccttcaacgtatcgaagatgctcagcggcatcggggcagagggcgaggcccgaagttatcgaatgtttcacgacgatagtatgaagtcatttttcagacgcctgtctttcaccccagacggctctctgctgctgactccggcaggttgtgtagaaagcggcgaaaacgttatgaacacgacctacgtcttcagccggaagaatctgaagcggcctattgcccacctcccctgccccggaaaggctaccttagccgtaaggtgctgccctgtctacttcgagctccgaccagttgtggagacaggagtggagttaatgtcactcccctaccgcttggtatttgctgtggctagcgaggattctgttttgctgtatgatacccagcaatcatttcccttcggttacgtgtcgaacatccactatcatacgctgagcgacatttcctggtcttccgacggagcatttctggctattagctctaccgacggatactgcagctttgtgacatttgagaaagatgagctcggcatcccactaaaagaaaaacccgtgttaaatatgcgcacccctgatacggcaaagaaaaccaagagtcagacccacagaggtagttccccgggaccaaggcccgtcgaaggtactcctgcttctcgtacccaagatccgtcctccccaggaactactccacctcaggcgaggcaggcaccagcacccacggtgataagagacccccctagtattacccccgcagttaagagtcccctgcctggaccttccgaggagaagacactgcagccgtccagtcagaacactaaggcacatccctcaaggagggtgaccttgaatactcttcaggcttggtcaaaaactactcctcggaggataaatctgacaccccttaagactgatactcctccctctagtgtgcccacatcagtcatctctactccatccactgaggagatccagtctgaaacacccggtgatgcacagggatctcccccagagctcaagcggcctcgcttagatgagaacaaagggggtaccgaaagtttggatccctag

SEQ ID NO: 27937 - DNA, 1527 bp, Artificial Sequence
  Description of Artificial Sequence: Synthetic coding sequence
atggccgacggtcaggttgccgagctgctccttcgccgattggaagcgtctgatggaggcctggattccgcagagctggcagcagagttggggatggagcatcaagccgtggtgggggctgtgaaatccctccaggcacttggagaagtgatagaagctgaactgcgcagcaccaaacactgggaattaaccgccgagggcgaagaaatagccagggaaggctctcacgaggccagagtgttccggtctattcctcctgaagggctcgctcagtccgagctgatgagactcccatcaggtaaagtgggtttttccaaagcaatgtctaataagtggatcagggtggacaagtcagccgcagacggaccacgcgtcttcagggtggtggattctatggaggacgaggtgcagcgaagacttcagcttgtcagagggggacaggctgagaaattaggggagaaggaacgatccgagttgaggaaaagaaaactcctcgcggaagtcaccctgaagacatactgggtcagcaaaggttctgcattttccactagcatcagcaaacaggagactgaactctcgcctgaaatgatatcatccggaagctggcgcgaccgtccttttaagccctacaattttctggctcacggcgtgctgcccgactcaggccacctacacccactgctgaaagtgcggtcccagtttcggcagatcttcctggaaatgggcttcacagagatgcctaccgacaacttcattgaatcttcattttggaattttgacgcactgtttcagccacagcagcacccggcaagagatcaacacgacacattctttctcagggatcccgctgaagccttacagctgccgatggattacgtgcaaagagtgaagcgtacgcactctcaagggggttacggatctcaggggtataagtataattggaagttggacgaagccaggaaaaatctcttacgtacccataccacctcagcgagcgctcgtgccctgtatcgcctggcccagaagaagccttttacacctgttaaatattttagtattgaccgtgtgttccggaatgagaccctcgacgcaacccacttggccgagtttcaccagatagagggcgtagtggctgatcacggactcacactcgggcacttaatgggtgttctcagggaattcttcacgaagctggggatcactcagctcaggtttaagccggcttataatccttacacagaaccttctatggaggtcttttcctatcaccaaggcctgaaaaaatgggtggaagtgggaaactccggagtgttcaggcccgagatgctgctcccaatgggtcttccagagaatgtgagcgtaattgcctggggcttatcattggaacgtcccacaatgatcaagtacggcattaataacattagagaactcgtgggacataaggtgaatctgcagatggtgtacgacagtccattgtgcagactggatgcagagccccgacctcctccaactcaggaagctgcctag

SEQ ID NO: 27938 - DNA, 1203 bp, Artificial Sequence
  Description of Artificial Sequence: Synthetic coding sequence
atgtcgtcaccattggcatcattgagcaagactcgcaaggttccactacctagtgaacctatgaatccgggtcggaggggtatccggatctacggagacgaggatgaggtcgatatgctttctgatggttgcgggagcgaggagaagattagcgtgcctagctgctatggtggcataggcgctcctgtcagtcgccaaggtgattcgttggcgcctcccgaggtcgactttgaccggctcctggcttcacttcaggacctgtccgagctggtggtggagggagacacccaggtgaccccagtgcccggaggcgctcggctccgcacccttgaacctatcccattgaagctgtataggaacggaatcatgatgtttgatgggcctttccagcccttttacgacccaagtactcagcgctgcctgagggacattttggatggattttttccatccgaacttcagcgcctttatcctaacggcgttccatttaaagtgagtgatctgcggaaccaggtttacctggaagacgggcttgatcctttccccggtgagggcagagtggtaggcagacaactcatgcacaaggcattggacagggtggaggagcaccccggtagcaggatgacagcagagaagtttctgaaccgcctgcctaagttcgtgatccgacagggggaagtcatcgatattaggggaccaatcagggatacactccaaaactgctgccctcttccagccagaatccaagagatagtggtggaaactcccacgctggccgctgagcgggagcggtcgcaagaatcaccaaatactcccgcacctcccctgtctatgctgcgaattaaatctgagaacggagagcaggccttccttctgatgatgcagccagacaacacaatcggcgacgtgcgggctctgcttgcccaagctcgtgtcatggatgcgagtgccttcgaaatattcagcaccttccctcccactctgtaccaggacgacaccctcactcttcaagccgcaggcttggtcccaaaggccgcactcctgctccgcgcaagacgggctcctaagtcatctttaaagttctcccccggaccctgccctggtcccggacctggaccttcacctggcccaggtcccggtccctcacccggtcccggtcctggcccaagcccctgtccaggccctagtccgtctccacagtag

SEQ ID NO: 27939 - DNA, 1350 bp, Artificial Sequence
  Description of Artificial Sequence: Synthetic coding sequence
atggctagcgcgctcagacctcccagggtccccaaacccaagggagtcctgccttcccactactacgagtccttcctggagaagaagggcccatgtgacagagactataaaaagttttgggctggcctgcaaggcctgaccatctacttttacaattccaacagagacttccagcatgtggaaaagctaaatctaggcgctttcgaaaaactgacagacgagattccgtggggctcatcacgggatcccggaacacatttttccctcattctgcgcgatcaagagataaagttcaaggtagagaccttggaatgcagagaaatgtggaagggattcatcctcactgtggtggagctgagggtaccaacagatctaaccttgttgccagggcatctttatatgatgtcagaagttttggctaaagaggaggcgagaagagccttggaaacaccatcttgtttcctgaaagtgtccaggctggaggcccagcttctccttgaacggtatcctgagtgtgggaacttactactaagaccctcgggcgacggagccgatggggtgtcggtgacgacacggcaaatgcacaatgggactcacgtggttcgtcactacaaggtgaagcgagaagggccaaagtatgtcattgatgtggagcaacctttcagctgtacaagtctggatgctgtggtgaattattttgtgagccacactaaaaaggccttggtcccatttttgctcgacgaagattatgagaaggtgttaggatatgtcgaggccgacaaggaaaatggagagaacgtttgggtcgccccttctgctccaggacctgggccagccccatgtacaggcggacctaaacccttgagcccagcgtcatcccaggataaactccctccacttcctccactgcccaatcaagaggagaactatgtgacacctattggagacggacccgcagtggattacgagaatcaagatgtggctagctcatcctggccagtgattttaaaaccaaagaaactccctaagccgcctgctaagctgccaaaaccaccagtgggacctaagccagtcgagaagggattccatcacgttgcacaggccggactggagctcctcacttcatcagatccacctacctctgcatcgcaaagcgccggaatcaccggcgtgagtcaccacacgtggccccacctgagcagtctccctgaacccaaggtcttcaacggaggcctcggacgcaagctgcccgtgtcatctgcgcaacccttattcccgacagcgggactggctgatatgacagctgagctgcagaaaaaacttgaaaaaagacgtgccctggaacactag

SEQ ID NO: 27940 - DNA, 1239 bp, Artificial Sequence
  Description of Artificial Sequence: Synthetic coding sequence
atggatcccattagatccttttgtgggaaactgagaagcttagcctccacactggactgtgaaacagccaggctccagcgtgccttagatggcgaggagtccgatttcgaagactatcctatgcgcattctttatgacctgcacagcgaggtgcagaccctgaaggatgatgtgaatatcctcctggataaagcccgtctggagaaccaggagggaatcgatttcatcaaggctaccaaagttttaatggaaaagaacagcatggacattatgaagattagggaatatttccagaaatatggttactcccccagggtaaagaagaatagcgtgcacgagcaggaagccatcaacagcgacccggaactttctaattgcgaaaacttccagaagaccgacgttaaagacgacttgtctgatcctccagtagcaagctcctgtatttcagaaaaaagccctcgctcaccgcaattgtctgattttggactcgagcgctatatagtgagccaagtgctgcctaatccacctcaggcagtcaataactacaaggaagagcccgtcatcgtaacgcctcccaccaaacaatctcttgttaaggtgctcaagacccccaagtgcgctctgaagatggatgattttgaatgcgtaacaccaaaactggagcacttcggaatctcggagtataccatgtgtctcaacgaggactacactatgggactcaagaacgccaggaataataagagcgaggaagcaatcgatacagagagtaggctgaacgataatgtgtttgccacccccagcccaattattcagcagctcgagaagtcagatgctgaatacacaaattctccacttgtccctacattctgcactccaggactaaaaataccgtctacaaaaaacagcattgctcttgtcagtacaaattatcccctgtcaaagactaactcctcttcaaatgatctcgaagtggaagatcgaacgagcctggtcttaaattctgatacatgcttcgaaaatcttaccgacccttcctcacccacaatctcttcatatgagaatttgctgcgtaccccgacacctcctgaagttaccaagatccctgaagacatattacagttacttagcaaatacaattcaaatctcgcgactccaatcgccataaaggctgtgccaccttccaaacgattcctcaaacacgggcagaatattagagatgtcagcaacaaagaaaactag

SEQ ID NO: 27941 - DNA, 2583 bp, Artificial Sequence
  Description of Artificial Sequence: Synthetic coding sequence
atgacagagggcaccaagaagacctccaaaaaatttaagttctttaaattcaagggctttggttccctctctaacctcccgagatctttcacactccggaggtcttccgctagcatctctaggcaaagtcaccttgagcctgatacttttgaggcaacgcaggacgatatggttactgttcctaagtcccctccagcctacgccagatcctcagatatgtattcgcatatgggcacgatgcctcgacctagtatcaagaaggcccagaatagtcaagccgcaaggcaggcccaggaagccggaccgaagccaaacttagtgccaggaggggtccccgatcctcctggcctcgaggctgccaaagaggtcatggtaaaggccactgggcctttggaggatactccggcaatggagcccaacccatcagcggtggaggtggaccctatacggaagcctgaggtgccgacgggagacgttgaggaggaacgcccaccgagagatgtgcatagcgaaagggcagcaggagaaccagaagctggcagtgattacgtgaaattttccaaagagaagtacattctggacagctcacctgagaagcttcacaaagagctagaagaagaactgaagctatctagtacagacctgagatcccacgcctggtaccacggcagaatccccagggaggtgagcgaaacactcgtgcagaggaacggcgattttctgatccgtgatagtctcacgtcccttggagactatgtactgacgtgcagatggagaaaccaggctctgcacttcaaaatcaacaaggtggttgtaaaggccggagaatcttatacgcacatccagtacctctttgaacaagagtccttcgatcacgtgccggcactcgtaagatatcacgtgggatccagaaaagccgtctccgagcaatcaggggctatcatttactgccctgtcaacaggacctttccgcttcgatatctggaggccagttatggcttgggacaaggttcaagcaaaccagcctccccggtgagcccgtccggcccaaagggttcccatatgaagcggagatctgtgactatgacagacggcctcacagcagacaaggtgactagaagtgatggatgtccaacctcaaccagcctccctagacccagggactctatcaggagctgcgcccttagcatggaccagatccctgatctgcacagccccatgtccccaatctcagagagcccctcatcgcctgcatatagcacggtgacaagggtgcacgccgctcccgcagctcccagcgcaacggcactacccgcttccccggtggcacggagatcatcagaaccccagctgtgtcccggtagcgcccctaagacacatggcgaatccgacaaaggtccccataccagcccttcccatacccttggaaaggccagcccatctccttctctgtcttcctattctgaccccgattctgggcactactgtcagctgcagccacctgtcaggggatccagagagtgggccgctacggaaacatctagtcaacaagccaggagctacggggagaggttgaaagagttatctgagaacggggctcccgagggcgattggggaaagaccttcacggtgccgatagttgaggtcacgagcagcttcaatccagcgacctttcagagtctgttaatccccagagataacagacctctcgaggtgggcctgttgcgtaaggttaaggagctgctggcagaggtggatgcccgaacactggctagacacgttactaaggtcgactgcctggtggccagaatcctgggtgttacaaaagaaatgcaaactttgatgggagtgcgttggggcatggagctcctcacattaccacacggccgtcaattacggctggaccttctagagagattccacaccatgagtattatgttagccgtcgacattctgggttgtacaggatcggcagaagagcgcgctgccttgctgcataaaaccatacagctggctgcggaactgagaggaacgatgggcaacatgttttccttcgccgcagtgatgggcgctctcgatatggcgcagataagccggttggagcagacgtgggtaaccttgaggcagcgccataccgaaggagcaatcctatacgagaagaaactgaagcccttcctcaagagcctgaacgaggggaaagaggggccacccttaagcaacaccactttcccacacgtgttgccgttgatcaccttgctcgagtgcgactctgcccctcctgagggtccagaaccttggggtagcacagaacacggggtggaagtagtgctggcacacttggaggcagcacgtaccgtggcccaccatggcggtctgtaccacacaaacgccgaggttaaactgcagggattccaggccagacctgagctgttagaagtgtttagtacagaattccagatgcgcctcctttggggttcccagggagcctccagttcacaggcaaggaggtatgaaaaattcgacaaggtgctgacggccctgtcccacaagctggagcctgccgtacgctcctccgagctttag

SEQ ID NO: 27942 - DNA, 573 bp, Artificial Sequence
  Description of Artificial Sequence: Synthetic coding sequence
atgaccgtcccatggaggccgggaaaaaggagaattacttacaaggaggaggaagatctgactctccagcccagacctgcctctagcgcccctgaaagcctggtggggttacaggaaggcaaatcaacggaacagggaaatcacgaccaactgaaggagctatattctgcgggaaatctgactgtgcttgcaaccgaccctctgttgcatcaagatccggtgcagctcgattttcattttcggcttacaagccaaacgtccgcccattggcacggactcctgtgtgaccggagactgtttttggacatcccttaccaggcactcgatcaaggcaatcgggagagtctgacagccacactagaatacgttgaagaaaaaaccaacgtggactcggtgttcgtgaatttccagaatgaccgtaacgaccgcggtgcgttgctgcgcgctttcagttacatgggcttcgaagttgtgcgtcccgaccatcctgcccttcctcctctcgataatgtgatctttatggtttaccccctggagcgcgacgtagggcacctccccagtgagcccccatag

SEQ ID NO: 27943 - DNA, 1527 bp, Artificial Sequence
  Description of Artificial Sequence: Synthetic coding sequence
atggcaacagattggctcggatctatcgtgtccattaattgtggcgactcactgggcgtgtatcaggggagagtgtctgcagtggatcaggtgtcccaaaccatctcgctcacaagaccttttcacaatggtgttaaatgcttagtgcccgaggtgacattccgggctggtgatattacggagctgaaaattctggaaattccgggacctggagacaaccagcacttcggcgacctgcatcagaccgaactgggccctagcggtgccggatgccaagtggggattaatcaaaatggaactgggaagttcgtgaagaaacctgcaagcagcagctccgccccacaaaatataccgaagcggaccgacgtgaaaagccaggatgtcgctgttagcccccagcagcaacagtgctccaagagctatgttgataggcacatggaatctctgtctcagagcaaatcttttcggaggcgccacaattcttggtcgtctagctcgagacaccccaatcaggccaccccaaagaagagtggtctcaaaaatggccagatgaagaacaaagatgacgaatgtttcggggatgacatcgaggagattcctgatacagatttcgactttgagggcaacctagccctttttgacaaagctgccgtttttgaagagatcgacacgtatgaacgccgaagtggcacaagatccaggggaattccaaatgaaaggccgacgcgatatagacatgatgagaacattctggaatccgagccaattgtgtatcgcaggatcatcgttccccacaacgtctccaaagaattctgcactgacagcggcctcgtggtgcctagtataagttacgaacttcataaaaaactgctgtccgtagctgaaaaacacggactcaccctcgaaaggcgtctggagatgacaggagtctgcgcctcgcagatggcacttaccctgctgggcggtccaaataggctgaaccctaagaatgtgcatcagaggcctaccgtagcgctgctgtgcggcccacacgtgaaaggagcacaaggaatctcttgcggccgtcacctggccaatcacgacgtgcaggtcatcctgttcctccccaacttcgttaagatgctagagagcatcactaacgagctgagtctttttagcaaaacacagggccagcaagtgtcatccttgaaagacctgcccacaagccccgtggaccttgttataaactgcctggactgtcctgagaacgtcttcttacgcgatcagccttggtataaagcagccgtggcatgggcgaaccaaaatagagccccagtgctgagcattgatccccctgtccacgaggtggaacaagggatagacgcaaagtggtccctagccctcggcctgccattacccctgggtgaacacgcaggacgtatctacctgtgcgacattgggatcccacaacaggtgttccaggaggtagggatcaattaccactcgccgtttggatgtaagttcgtgatcccattgcattccgcatag

SEQ ID NO: 27944 - DNA, 1158 bp, Artificial Sequence
  Description of Artificial Sequence: Synthetic coding sequence
atgggccgttggtgccagacggtcgctagaggtcagcggccacggacaagcgccccatcccgtgccggagctctgctattgctcctcctcctgctcaggtcagccggttgctggggagccggagaggcccctggcgcactctcgaccgccgaccccgcagaccagagtgtccagtgcgtacccaaagctacatgcccgtcttcgaggccacggctcctgtggcagaccccaactacccagactctgcctagcactactatggaaacccagtttccagttagcgagggcaaggtggacccctaccgatcatgtggattctcatatgaacaggacccaacactccgggacccagaagcggtcgctagaagatggccttggatggtttctgttcgagctaacggaacacacatttgcgcgggtactatcattgcttcccagtgggttctcaccgtcgcccactgtctgatctggagagacgtgatttactctgtcagggtcggctctccttggatcgatcagatgacacagactgcatctgacgtccccgtgctccaggtgatcatgcatagtcgatacagagcccagcgtttctggtcctgggttggccaggccaacgacatcgggctactgaagttaaaacaggaattgaaatattctaactacgttagaccaatctgtctacctggaacagactacgtcctgaaggaccattctagatgcactgtcaccgggtggggcttaagcaaggctgatgggatgtggccgcaatttagaacgatccaagaaaaggaagtgattatcctgaataacaaagaatgcgacaatttttatcataacttcaccaagattcccacactggtccagatcataaagagtcaaatgatgtgcgcggaagacactcacagagagaagttctgttacgaattgacaggggagcctctcgtctgctcaatggaaggcacctggtacctagtgggcctggtgagctggggagccggatgccagaaaagtgaagctcctcccatatatcttcaggtgagttcttaccaacattggatttgggattgcctgaacggacaggcactggcacttccagctcctagccgcaccctgctgctggccctgccgttgcccttgtcgctcctcgccgctctgtag

SEQ ID NO: 27945 - DNA, 750 bp, Artificial Sequence
  Description of Artificial Sequence: Synthetic coding sequence
atggtggaccgtctggccaactctgaggcgaatacccgaaggatctccatagttgaaaattgttttggagctgctgggcagcctctgaccattcccggaagggttctgatcggggagggggtcttgactaaactttgtaggaagaaacctaaagctcgacaattctttctcttcaacgacatcctagtatacggtaatatcgtcattcagaaaaagaagtataacaagcagcacattattcccctggagaatgttaccatagattcgatcaaggatgaaggagatctgcgcaatggttggctgattaagactcccactaaaagttttgccgtgtacgcggctacggccaccgaaaagagtgaatggatgaaccacatcaacaaatgcgtgactgacctgctgtcaaagtcagggaaaacaccctctaacgagcacgcagctgtgtgggtccccgactcggaagctaccgtgtgtatgcgttgccagaaggccaaatttactccggtgaaccgcaggcaccattgtcggaaatgcggtttcgtagtgtgtggcccttgttctgaaaagcgtttcctgctgccttcccagtcaagtaaacctgtcagaatttgcgacttctgctacgacctgctctccgcgggagacatggcgacctgccagccggcaaggagcgacagttactctcagtcactgaaatccccactaaacgacatgtccgatgatgacgacgatgacgactctagcgattag

SEQ ID NO: 27946 - DNA, 2745 bp, Artificial Sequence
  Description of Artificial Sequence: Synthetic coding sequence
atgggcgatagtcgtgacctgtgcccccatctcgactccatcggtgaagtgactaaagaggacctgttacttaagagtaaagggacctgccagtcttgtggcgtgactggacccaacttgtgggcctgcctgcaagtggcatgcccttatgtcggctgcggagaaagttttgcagaccactctaccattcacgcgcaggcgaagaagcataatttgactgtgaatctgacaaccttcagactctggtgttatgcctgtgaaaaggaggtgttcttggaacagcgcttagctgcccctcttcttggtagcagtagcaaatttagcgagcaagactcccctcccccttcacaccccctgaaagccgtacctatcgccgtggccgacgagggggaaagtgagtctgaggacgatgacttgaagcctcgagggctgactggcatgaaaaacttaggcaacagttgctatatgaacgccgcattgcaagctttgtcgaattgtccacccttaacgcagttcttcttggagtgcggaggactcgtgcgcaccgataagaaacccgcactgtgcaagagctatcaaaagctagtcagcgaggtttggcataagaagcggcctagctacgtcgtgcctacttccctttctcacggaataaagctggtcaatccgatgttccgaggatacgctcagcaggatacacaagagtttctgcgatgcctgatggaccagttgcacgaagaattgaaggagccggtggtagctaccgttgctttaactgaagcccgtgacagcgattcgtccgacaccgacgagaagagggagggagacaggagcccctccgaggacgagtttctgtcttgcgatagctcctcagacagaggagagggcgatggacagggccgaggtggtggctccagccaggctgagactgagctgttgatccccgacgaggctggtcgggctatttctgagaaagagcggatgaaagaccggaaattctcctggggacagcagcgcaccaactctgagcaggtcgacgaggacgccgacgtggataccgctatggcagccctggacgatcaaccggctgaggcacagccacccagtccccgatcatcatctccttgtcgaactcctgagccagataacgacgcccatctccggagttcctcccgcccttgcagcccagtgcaccatcatgaggggcacgctaaactctccagcagtccaccgcgagcctcccctgtcagaatggctccaagttatgtgcttaaaaaggcccaggtgctatctgctggctccagaagaagaaaagagcagcggtatcgatctgtaatctctgacatctttgacggatctatcctgtccctggtgcagtgccttacatgtgatagggttagtactaccgtcgagacctttcaggatttgagcctccccattccaggaaaagaagaccttgccaaactgcattccgccatataccagaacgtgcccgctaagcctggcgcttgtggagattcgtacgctgcacagggttggttagccttcatagttgagtatatccgcagatttgttgtttcctgcaccccctcttggttctgggggcctgtagttaccctggaagactgtctcgctgcatttttcgcggcagacgagctcaagggagataacatgtacagttgtgagcgttgcaaaaagcttcggaatggagtgaagtactgtaaagtgcttagattacctgaaatcctgtgcatccaccttaagcgctttcgacacgaagtgatgtactcgtttaagattaacagtcacgtgagttttccactcgagggcctggatttgcggccatttcttgccaaggagtgtacctcacagattactacttacgatcttctgtccgtcatctgtcaccatggcactgccggaagcggccactatatcgcctattgccagaacgtaatcaacgggcagtggtacgagttcgatgatcaatatgtgaccgaggtgcacgagactgtggttcaaaacgcagagggctacgtcttgttttatcggaagtcttccgaggaggctatgagggagaggcagcaggtcgtgtctttggcggcaatgcgggaaccgtcgctgttacgtttctatgtttcgcgtgagtggctgaataaattcaacactttcgccgaaccaggacctattaccaatcaaacgtttctttgtagtcacggtggcattcccccacataagtaccactacatcgacgacctggttgtgattctacctcaaaacgtatgggagcacctctacaatcgctttggcggtgggcctgccgtgaaccatctctacgtgtgttccatctgtcaagtggaaattgaggccctcgctaaacggagacgaattgagattgataccttcataaaactcaacaaggcattccaggctgaagaatctccgggagtcatctactgtataagtatgcaatggttccgtgaatgggaggcgttcgttaaagggaaggataatgaaccccctgggccaatcgacaactcccgcattgcccaggtgaaaggtagtggccacgtccaactgaaacagggagccgactatggtcagatttccgaggagacatggacctaccttaacagcttatacggcggagggcctgaaatcgccatacggcagtcagtggcacagcctctgggaccagagaatctacacggtgagcaaaagattgaggctgaaaccagagcagtgtag

SEQ ID NO: 27947 - DNA, 1341 bp, Artificial Sequence
  Description of Artificial Sequence: Synthetic coding sequence
atgagagcggctaggagaggactccattgcgcgggagccgagaggcccaggaggcggggaaggctgtgggactcgagcggagttcctcagcgccagaagagacccggtccatggcgcactcagactcaagaacagatgtccagagacgtatgcatacatacatggccctgtacttattatcttgagcccaagagacgttgggtaacgggtcagctgtccctgacttccctatcgttaaggttcatgacggactctacaggcgagattttagtgtctttcccgctgtcttccattgttgagattaagaaggaggcttctcacttcatcttctcctccatcaccatcttagaaaagggtcatgccaaacattggttttcctcactacggccaagccgcaatgttgtcttcagcatcatcgagcacttctggcgcgaactgcttctctctcagccaggggcagttgccgatgcgtctgtgccccgtaccagaggcgaagaactcacaggacttatggcaggaagccagaaacgacttgaggataccgccagagtcctgcaccatcagggacagcaattggattcggtcatgcggggactggataagatggaatccgacctggaagttgccgaccgcctgctcacagagctcgagagccccgcttggtggccttttagctctaaactctggaagacaccccctgaaaccaagccgcgagaagatgtgagcatgacttcatgcgaaccttttggcaaggaggggatccttataaagattccagccgttatctcccatcgaactgagagccacgttaaacccggtcgcctgactgtgcttgtgagcggtttggagatccacgattctagcagcttactcatgcaccgatttgagcgtgaggatgttgacgatatcaaggtccactccccctacgagattagcatcagacagagattcattggcaagccagatatggcctacagactgatttcagcaaagatgccagaggtgatacctatactagaagtccagttcagtaagaaaatggagttgttagaggatgcactggtgctacggtctgccaggacatcgtcaccggctgagaaatcatgcagtgtgtggcacgcagcgtctgggctaatggggaggacactacatcgggagcctcccgctggtgatcaggaaggtaccgcgctccatctgcagaccagtctcccagccctgtccgaggctgacacgcaagaactgacccagggtttcagaccaatgagtcttagcactcagacggttctggtaatgctgtgtagcgaatcggccggagccttatggcgacagagactgagctag

SEQ ID NO: 27948 - DNA, 1896 bp, Artificial Sequence
  Description of Artificial Sequence: Synthetic coding sequence
atggctattgtccagaccctgccagtgcctctcgagcctgcccctgaggcggctactgcccctcaggcgcctgtaatggggagtgttagctccctgatctctggcaggccctgtcccggtgggccagcaccccctaggcatcacggccctcctggacctacgtttttcaggcagcaggacggactactgcgcggtggctacgaagcccaggaacctctatgccctgccgtccctcctaggaaggctgttcccgttactagttttacctatattaacgaggacttccgcacagagagcccaccgtctccatcctctgatgtcgaggatgccagagagcagcgggctcacaacgcccatctccggggaccaccaccgaagttaatccctgtgagtggcaagcttgagaaaaacatggaaaaaatactgattcgcccaacagccttcaaacctgtgctgccaaagcctcgtggagcgccatctttgcccagttttatgggaccgagggcaaccggcctgtcaggcagccagggcagtctgacccagctattcggaggccctgcatcctctagcagcagtagcagctcaagcagtgcggcagacaaacctctggccttctctggttgggccagtggttgcccaagcggaacacttagtgatagcgggagaaattcactgagttcacttccaacatatagcaccgggggagccgagcctaccacgagtagtcccggagggcatctgccctcacatggctccggacggggagctctccctggacctgccaggggcgttcccaccggcccatcccactcggactccggaagatcttcctcctctaagtcgactggaagcctagggggacgcgtggcgggaggcctgctggggtctggcacaagggcaagcccggattcaagctcttgcggggagaggagccccccacctccgccacccccaccatccgacgaggctctgttacattgcgtgcttgaaggaaaactgcgcgaccgtgaagccgagctgcagcagctacgcgattctctcgatgaaaacgaggctacgatgtgccaagcgtacgaagagcgacagagacattggcagcgtgagcgggaggccctccgcgaagactgcgccgcacaggcacagagagcccagcgagcccaacagttgctgcagcttcaagtgtttcagctgcaacaggaaaagagacagctgcaggatgattttgcgcagctgctgcaagagcgcgagcagcttgagcgaaggtgcgcaacactggagagagaacaaagagagctgggacccagactcgaggagacaaagtgggaagtctgccaaaagtcaggagaaatttccctgctgaagcagcaactaaaagagagccaagctgaattggtgcagaagggctcagaattagtggcccttagagtcgcacttcgggaggccagggcaacattgagagttagcgagggccgtgcccgtggactgcaagaggccgctcgggctagggagttagagctggaggcctgcagtcaggagctgcaaaggcataggcaggaggccgagcagttacgagaaaaggccggtcaattggacgcagaggccgctggactgagagagcccccagttccacccgcaactgccgatcccttccttttggccgagtctgacgaggctagcgcaaccgccaacccagtacacagacggttccaacctacaccggcaagaggggctgggaaaaaaaaggggctgccgccactccatatcccacccgaccctaaggcgagagagtcccagatggctcctgcggctccagacgtccctgcccacatcggcggacaggggagggcctgggcgagatttccgggtcttagttctgcagcgtctctcctggagtag

SEQ ID NO: 27949 - DNA, 1473 bp, Artificial Sequence
  Description of Artificial Sequence: Synthetic coding sequence
atgaatggggctctggaccatagcgaccaaccagatcccgacgccatcaagatgttcgtaggtcagattcccaggagttggagtgaaaaggaattgaaagaactgttcgaaccctatggtgcagtgtatcagatcaacgtccttcgagatcgcagccaaaacccccctcagtctaagggttgctgctttgtcaccttttacactcgaaaggccgctctcgaggctcagaacgccctgcataacattaagacactgcccggaatgcatcatcccatacagatgaagcccgctgactccgagaagagtaatgccgttgaggacagaaaattgtttataggcatggtgagcaaaaaatgtaatgaaaacgacatccgcgtgatgtttagcccctttggacagatagaggaatgccggatccttaggggacccgatggactctcgcgtgggtgtgcctttgtgaccttcagcaccagggcaatggcccagaacgcaattaaggctatgcatcagtcccaaaccatggaagggtgctcttcacccatcgtggtgaagttcgccgatactcaaaaagacaaagaacagcgcagactgcagcaacagctggcacagcagatgcagcaactgaatacggccacctggggtaatttgaccggcctaggcggacttacgcctcaatatctggcacttctccaacaggccacgagctcgtcaaatcttggagcattctctgggatccagcagatggcaggaatgaacgccttgcagttacagaatctggccacgttggccgctgctgctgcagcggctcagactagcgccaccagtaccaacgctaacccgctgtccaccacatcaagcgccctcggcgctttaacatcacctgttgccgcatccaccccaaattctacagctggcgctgccatgaacagtctgacttctctcgggacgctgcagggactggccggagccactgtcggcctgaacaacatcaacgccctggccgtggcccaaatgctatctggaatggccgctctgaatggaggtctgggcgctaccgggctcacgaatggcacggcaggcacaatggacgctctgacgcaggcgtacagtggaatccagcagtacgcggctgccgcacttccaaccctgtattcccaaagtctattgcaacagcagagtgcagccggatcacaaaaggagggtcccgagggagccaatttgtttatctatcacctccctcaggaatttggagatcaggatatcctgcagatgtttatgccgttcgggaatgtaatcagtgccaaagtctttatcgataagcagactaatttgagcaaatgttttggtttcgtgtcttatgataatccagtgtcagcgcaggcggcaattcaggcaatgaacggattccaaatcggaatgaagcggcttaaagttcagcttaagaggagcaagaatgactcaaaaccatactag

SEQ ID NO: 27950 - DNA, 627 bp, Artificial Sequence
  Description of Artificial Sequence: Synthetic coding sequence
atggcggcaagcgtggaacagagggaaggtactatccaggttcaggggcaggccctcttctttcgtgaggccttacctggctcaggccaagcacgcttctccgtattgctgctgcacgggattagattcagttcagaaacttggcagaatcttggaacccttcataggctcgctcaggctggatatagggccgtggctattgacctccctgggctcaagggagaaccacctgcccaggaaccccttctgtcacagtcgcgagcatcttttctggcagccgtggttgacgcattggagcttggccctcccgtggtaatttcaccatccctaagtgggatgtactctctgccctttctgacagcgcctggcagtcagctcccgggattcgtccctgtcgctccaatctgtaccgataagattaacgccgcaaactatgccagcgttaagactcctgctctcatagtgtacggtgaccaggaccccatgggtcaaactagtttcgaacaccttaagcagctcccaaatcatcgggtgcttatcatgaagggggctgggcatccgtgttacctggataagcctgaggagtggcatacggggctactggatttcctgcagggtctccaatag

SEQ ID NO: 27951 - DNA, 546 bp, Artificial Sequence
  Description of Artificial Sequence: Synthetic coding sequence
atggagagccgaagcgtagcacaggctggcgtgcagtggtgcgatctggggtctctgcagccgcctccccctggctttaagcagtttagttacttctccttgcagagcagctgggactacagatacgtccccccatgccccgcaaattttgttttcttggtcgagatgggattccttcatgtggaccaggccggactgaaactcttgacaagtggcatcgatttcgccactcggaagattgcaaaactactgaaaccccagaaggtcattgaacagaatggggacagttttacgatccacactaattcctcgttacgtaattacttcgtgaaattcaaagtgggagaggaatttgatgaagataacagggggcttgacaacaggaaatgtaaaagcttggtgatttgggataacgataggctcacatgcatccaaaaaggggagaagaaaaatcgcggatggacccactggatcgaaggggataagctgcatctggagatgttctgtgagggacaggtctgtaaacagacctttcagcgggcttag

SEQ ID NO: 27952 - DNA, 1647 bp, Artificial Sequence
  Description of Artificial Sequence: Synthetic coding sequence
atgagtgccagtctcaattacaagagcttctctaaggaacagcagaccatggacaacctggaaaagcagcttatttgcccaatttgcctggagatgtttaccaagcccgtcgtcatcctgccgtgtcagcacaacctgtgtagaaaatgtgcttccgatatctttcaagcaagcaacccatacctcccaacacggggaggtacaactatggcgtcagggggtaggttccgctgcccctcatgcaggcatgaagtagttcttgaccgacacggggtatacgggttgcagcggaatctgttagtggaaaacatcatcgatatctataagcaggaaagcactcgccctgagaagaagtccgaccagcctatgtgcgaggaacacgaggaggagaggatcaacatctattgcctgaattgtgaagtgccaacatgttcactgtgtaaagtgtttggcgcacataaagattgccaggtggcccctctgactcacgttttccaacggcagaagagtgaattgtctgatgggatcgctatactggtcggtagtaacgatagggttcaaggggtgatttcgcaacttgaagacacatgcaaaactatcgaagaatgctgccggaaacagaagcaggagctgtgcgaaaaatttgattacctctatggaatcctggaagagagaaagaacgagatgacacaggttatcacacggactcaggaagaaaagctggaacacgtaagagctctcataaagaagtacagcgaccacctggaaaacgtgagcaagttggtcgagtcgggtatacaattcatggatgagcctgaaatggcagtctttctgcagaatgctaaaacattgctcaagaagatttccgaagccagcaaagccttccaaatggagaaaatagagcacggctacgagaacatgaatcattttacggttaatctgaatcgcgaagagaagatcatcagagaaatcgacttttatagagaagacgaagacgaagaggaggaggaaggcggtgaaggcgaaaaagaaggcgagggtgaggtcggaggcgaggccgtcgaggtcgaagaagtggagaatgtgcagactgagttcccaggagaagatgagaaccccgagaaagcaagtgagctcagccaggttgagttacaggccgctccgggagcattacccgttagcagcccagaaccacccccagcactgcctccagctgccgatgcacctgtcacccagggcgaggttgttcctactggttcagaacagacaacagagtctgagacaccagtgcctgctgctgccgagactgctgaccccctgttctacccttcctggtataagggccaaacaagaaaggcgactaccaatcccccttgtacaccaggaagcgagggacttggccagataggtcccccaggctccgaagactctaatgtcaggaaggccgaagtagcggctgccgctgcatccgagcgtgcggctgtctctgggaaggagacaagtgcgccagcagcaacaagtcagattgggtttgaggcccctccactgcaggggcaggccgcagcaccggcttcaggaagtggagcagattcagaaccagcaagacatatcttttcctttagctggctgaactcactcaatgaatag

SEQ ID NO: 27953 - DNA, 1374 bp, Artificial Sequence
  Description of Artificial Sequence: Synthetic coding sequence
atgtttccaaagttctccttacggtccatgtttcacggggcaggaggcggaaacgacatccagtggtgcttctcccaggttaaaggcgctgtggatgatgatgtggcagaggcagacatcatctcaaccgtggaattcaatcattcaggtgagctgctcgccaccggagataaaggcggacgcgtagtcattttccaacaggagcaggagaacaaaatccagagccattctcgcggagaatacaacgtttactctaccttccagtcccacgaaccggagtttgattaccttaagagcctagagattgaggagaagattaacaaaattcggtggcttccacagaaaaatgccgctcagttcctgttgagcacaaatgacaaaaccatcaaactatggaagatctccgagcgggacaaaaggccagaagggtataacctaaaagaggaggacgggaggtaccgcgatcccacgactgtcaccacattgcgggtcccagtcttcagacctatggatctgatggtggaggcctccccacggaggatattcgccaatgcacacacataccacatcaatagtatttcaatcaatagcgactatgaaacatacctttcagccgacgatctcagaataaatctgtggcatctggagatcactgaccgttctttcaatatagtagacatcaaaccagccaacatggaagaacttactgaagttataacggccgctgagttccaccctaactcctgcaatacgtttgtgtactcaagttccaaaggaaccatccgtctctgtgatatgcgcgcttccgctctgtgtgaccgccacagcaagctttttgaagagccagaagatcccagtaaccgcagtttcttcagcgaaatcatcagtagtattagtgacgtgaaatttagccacagcggacggtacatgatgactagggactatctttcagtaaaaatttgggacctcaacatggagaatcgccctgtcgagacctaccaggttcatgagtatctgcgcagcaagctctgctccctgtatgaaaacgactgcattttcgataaatttgagtgctgttggaacgggtcagactccgtcgtgatgaccggatcatataacaacttttttcgcatgttcgacaggaacacaaagagggacattacccttgaggcctctcgggagaataataagcctagaactgttctaaagccacgaaaagtgtgcgccagtggaaagcgaaaaaaggatgagattagcgttgactctttggatttcaacaaaaaaatcctgcacactgcatggcaccctaaggaaaatatcattgccgtggccacaacaaacaatctatatatcttccaggacaaggtcaactag

SEQ ID NO: 27954 - DNA, 738 bp, Artificial Sequence
  Description of Artificial Sequence: Synthetic coding sequence
atggccggactggagctgctcagcgaccagggctatagggtggatgggcgaagggccggtgaactgcgcaagatccaagctagaatgggtgtctttgcgcaggcagatggaagtgcttacatcgagcaagggaatacgaaggccctggctgttgtgtacggaccacacgagattcgtggcagtcgcgctagggccctcccggatagagctctggtgaactgtcagtactcctccgcaaccttctctaccggggaacgcaagcgtcgccctcatggggatcgtaagagttgtgagatgggactgcagctgcggcagacatttgaggccgctatcctcacccaactgcatcccaggagccagatcgatatctacgtgcaggtcttgcaggctgacggcggaacgtacgcagcttgcgtgaatgccgcaaccctggctgtactggatgcaggcatccccatgcgcgatttcgtgtgcgcctgttctgcaggcttcgtggacggcaccgctctggccgacttgagtcatgtggaagaggccgctggaggcccacaacttgccctggccctgctgcccgcatccgggcagatagctctgctggagatggatgccagattacacgaagaccatctggaaagagtgcttgaggcagccgcacaggctgctcgtgacgttcacactcttttggaccgcgtggtaaggcaacacgtccgcgaggcttctatcctcctaggtgactag

SEQ ID NO: 27955 - DNA, 2631 bp, Artificial Sequence
  Description of Artificial Sequence: Synthetic coding sequence
atgatggcagacggcgcagctgcgggagctgggggatccccgagtctgcgcgaattacgtgcaaggatggtggctgcagccaacgagattgccaaagagcgcaggaaacaggacgtcgtgaatcgcgtcgccactcattcctctaatatacgatcaacattcaagcctgtcatcgatggctcaatgttaaagaacgacataaagcagcgcctggctagagagcgacgcgaagagaaacgcaggcagcaagatgctaacaaagagactcagctgctcgaaaaggaacgcaaaaccaagctgcaatacgaaaagcagatggaggaacgccagcgaaagttaaaggagcgaaaggagaaggaagaacagcgacgaatcgcagccgaagagaagcgccaccagaaagacgaggcccagaaggagaagttcacagcaatactgtaccgaacactagaacgaaggagacttgcagatgactaccaacaaaagagatggagttgggggggttctgccatggctaactccgagtccaaaacggcgaacaagcgctcagcgtccaccgagaagctggagcagggcacttccgctctgataaggcaaatgccactctcatcagcaggccttcagaatagcgtggcgaagagaaaaaccgataaagagaggtctagttccctcaatcgacgcgactctaatctccacagcagtacagacaaagaacaggcggaacggaaacctcgagtgactggcgttactaactacgtaatgcagtacgtaactgtgcctctgagaaagtgcaccagcgacgaattgcgtgccgtgatgtttccgatgtcgaccatgaaaatacctcctcagactaaggttgaagagtcacctttagaaaaggttgagaccccacctaaggcttcagtcgatgccccaccgcaagtaaatgtggaagtcttttgcaacactagtatggaggcctcccccaaggccggtgtaggcatggctcccgaggtcagcaccgatagtttccctgtcgtcagtgtggacgtgtctccagtggtctccacttacgactccgaaatgtctatggacgcaagccctgagttatctatcgaggcattaccaaaagtcgacttagagaccgtgcccaaggtctcaatcgttgcaagtccagaagccagcttggaggcaccacctgaagtgtccctggaagctttacccgaggtaagcgtcgaggccgctcccgagggatccttggaagcccctcctaagggaagcgcagaggtggcccctaaggagagcgttaaaggctcccctaaagaaagtatggaagcttcccccgaagcgatggtgaaggcttctcccaaaacatccctggaggcaagtatggaagcctctcccaaggcgaaagcaagagatgcaccaaaaaagtctgagatggacaagcaggcactgatcccaatagccaagaagcgactttcctcatatactgagtgttacaagtggtcttcgagcccagaaaacgcctgcggcctgccaagccccatatctacaaaccgtcagatccaaaagaactgtccgccatcccctctgcctcttatctctaaacagtctcctcagacatcttttccgtataagataatgcccatacagcacaccttgtccgtgcagtctgcgtccagtacagtgaaaaagaaaaaggagactgtctccaaaacaaccaataggtgcgaggctctgtctcagcggcacatgatttatgaagagagcggcaacaagagtaccgccggtattatgaacgctgaagccgctactaaaattttgaccgaattgcgtcggctcgctagagagcaaagagagaaggaagaagaagagcggcagcgcgaggaaatgcagcagcgcgttattaagaagtctaaagacatggccaaggaggccgtgggcggacaggcggaagaccaccttaagctaaaggacggtcaacagcagaatgagacaaaaaagaagaagggatggctcgaccaggaggaccaagaagcccctctgcagaaaggagacgccaaaatcaaagcccaggaggaagctgataaaagaaaaaaggagcacgagcggattatgctgcagaacttgcaggaacgactggaaagaaaaaaaaggatcgaagagatcatgaaaagaacccgtaaaaccgacgtcaatgcctcaaaagtcactgagacatctagtcatgacatctacgaggaggcagaagccgataacgaagagagtgacaaagattcactcaacgagatgttcccttcagccattttaaatggcaccggcagtcctaccaaattcaaaatgcctttcaacaatgccaaaaaaatgacccacaagctcgtgttcctagaagatggaacatctcaggtgcgaaaagaacccaagacttatttcaatggtgatctcaagaattttagacagaagtcaatgaaggatacctctatacaggaagtggtctcgaggccttcctccaaaagaatgacttctcacacgaccaagacaaggaaagctgatgaaactaacactacctcacggagctccgcccagacaaagtctgaggggtttcacgacattctgccgaaatcttccgacacatttcggcagtag

SEQ ID NO: 27956 - DNA, 6290 bp, Artificial Sequence
  Description of Artificial Sequence: Synthetic coding sequence
atgtgctccacccccggaatgccagccccaggggctagcctagctctgcgcgtgagcttcgtggatgtgcatcctgacgtgattccagtccagttatggggattggtgggtgaacgcaggggggagtacctccgcctttcacgggaaatacaggaagccgcagctaccaggggtcagtgggccctgggcagtgcgtccgcttcacctggagagctctgcctggtccaggtagggctgctctggcaccgctgtcgcgtggtcagcagacaggctcaggagagtcgggtttttctgcttgatgaaggccgaactattactgccggtgccggatccctggcgccaggtcggagagagttttttaatctgcctagcgaagtactcggctgtgtgcttgctgggctggtgcccgctggatgtggggctggcagcggagaacctccccaacactggccggctgacgccgtcgatttcctcagcaacctacaggggaaagaagtgcacggatgtgtgttagacgttctgcttctgcacaggctggtcctgctcgaagtacctgacgtctttcaacagatgagagagctgggtctcgcacgtagggtgcccgattcgctgttccgctccttactggaacgatatctgacggcggctaccgcatcagttgggtccggtgtgcctgtgctgtccagagttcctctgaaacagaagcagccagggctagactatttctatccacagctacagttaggggtcacagaggcagtggtgatcactcaggtctgccacccccatcgcattcactgccagcttcgtagcgttagtcaggagattcaccgcctgtccgagtcaatggcccaggtgtatagaggaagcactgggaccggtgacgagaactcaacttccgccacatgggaggagcgggaggaatctccagacaagccaggctccccatgcgccagttgtggactggacgggcactggtaccgcgctctgctgctcgaaacttttagacctcagagatgtgctcaggtccttcacgtcgattatgggcgaaaggagcttgtgagctgcagcagtttaagataccttctgcctgaatatttcaggatgccagtcgtcacatacccatgcgctctctacgggctgtgggacgggggaagggggtggagccgatcccaggtgggcgacctcaagacactgatccttggcaaggctgtgaatgcgaagatcgaattttattgctcatttgagcacgtatactatgtaagcctctacggcgaggatggaattaatttaaaccgggtgtttggagtacagtcatgctgcctcgccgatagagtcctgcagtctcaggctacggaggaggaggaaccagagactagccagtcacagagccccgcagaggaggtagacgaggagatcagcctcccagctctacggagtataaggttaaagatgaacgccttctatgatgcccaggtggagtttgtcaagaatccctccgaattctggatacgtctgcggaagcacaatgtgacattcagcaagctcatgcgtcggatgtgtggtttctatagctcggctagcaaactcgatggtgtggtgttaaaacccgaacctgatgacctttgttgtgtgaaatggaaagagaatggatactatcgggcaatcgttaccaagctagacgacaagagtgtcgatgtttttctggtggaccggggtaattctgaaaacgtggactggtatgatgttagaatgcttctccctcagttcagacaactcccaatccttgctgtgaagtgtacgctggctgacatatggccgctgggtaagacttggagtcaagaagccgtgagctttttcaaaaaaactgtgcttcacaaggagctagtaatccacatcttagataagcaggatcatcagtatgttatcgaaattctcgatgaatcaaggaccggagaggaaaatatttcgaaggtgatcgctcaggccggatacgctaagtaccaggaattcgagaccaaagagaatattctcgtgaatgctcatagccctggccacgtcagcaaccattttacaaccgaaagcaacaagattccattcgccaaaaccggcgagggggagcagaaagctaaacgggaaaataaaactactagcgtctccaaggccttgagtgataccaccgttgtcacaaacgggagcacagagctggtggtgcaagaaaaggttaagagagcttccgtgtacttcccattgatgcagaactgtctggagataaaaccagggtcttcttccaagggggagttggaggtgggatccacggtcgaggtgagagtctcatacgtggagaacccaggatatttttggtgccaactcacacggaatattcaggggttaaaaaccctcatgagtgacattcagtactattgtaagaatacagcggctcctcatcagcggaacactcttgcctgcttagcaaagcgcaccgtcaatcgccagtggtccagagcgctgatctctgggatccagtccgtggagcatgtcaatgtgactttcgtggattatggtgatagagagatggtgtctgtgaaaaacatatacagtatttcagaggaatttctgaaggtgaaagcacaggcattccgatgctccctctacaacctgatccagcctgtgggtcagaaccctttcgtgtgggatgtgaaggccatccaggctttcaacgagtttatcgacaatgcctggcaaaagaatttggagctaaagtgtactatttttgcattggcatcaattaatgaagaattgtttaacatagtggatcttctgacaccctttcagtcagcttgccactttctggtagagaagcggctcgcccgacccgttaagcttcagaagcccttggagagttccgtgcagttgcactcctacttttatagcacacacgacatgaaaattggatcagaggagctggtgtatatcacacatatcgacgacccatggaccttttactgtcagctcgctaggaacgccaacattctggagcagctgtcttgttcaatcacgcagctgagtaaggtcctcctgaatctgaagacctctcctctgaatcctgggacgttgtgtctcgctaagtatactgacggcaactggtacagaggcattgtcatcgagaaagagccaaaaaaggtttttttcgttgattttgggaatatttatgtcgtgacctccgacgacctcctgcccattccttccgacgcatatgatgttttattattgcctatgcaagcggtgcgctgcagcttgtcagatattccagaccatatccctgaggaggttgtcgtctggttccaggaaaccatccttgacaagtctttgaaggccctggttgtagctaaagaccctgacgggaccctgattatagaactgtatggggataacatccagatatctgccagcattaataagaagctcggcctcctgtcatacaaggataggatccggaaaaaggagtccgaggtgctgtgttcgactacagagactctggaagaaaaaaacgagaatatgaaactgccttgcaccgagtatctgtctaagtcagtgggttataagctgcctaataaagagatcttagaagaatcatacaagccacaaataaatagctcttataaagaactcaaactgctccagtcactgaccaagaccaatctggtgactcagtatcaggattccgtgggcaataaaaattctcaggtgtttcctttgacaactgagaaaaaagaagaaatctcggccgagacccctctcaagaccgctagggtcgaggccaccctctcagagcggaaaatcggggactcttgcgacaaggaccttcctctgaagttctgtgagtttccacaaaaaactatcatgcctgggttcaagactacagtctacgtgtctcacataaacgacctgagcgacttctacgtgcaattgatagaggacgaggccgagattagccatctgagtgaaagattaaatagcgttaagacccgccctgagtactacgtgggccctcctctgcaaaggggggatatgatctgtgctgtcttccctgaagataatttgtggtacagggcagtgattaaagagcagcagcctaacgaccttctgagtgttcagttcattgactatggaaacgtgagtgtggtgcacacaaataagataggacgtctcgacctcgttaacgctatactcccaggtctgtgcattcattgctctctgcaggggtttgaggtgcccgacaacaaaaattcaaaaaagatgatgcactacttttcccaaagaacttccgaggctgcaattaggtgtgaattcgtcaaatttcaagatagatgggaggtcatcctggccgatgagcacgggattatcgcggatgatatgatcagtaggtacgcactttcagaaaaaagtcaggttgagctttcaacccaggttattaaatcggcttcttctaaatccgtgaacaaatccgatatcgacacttcagttttcttgaattggtacaaccctgaaaaaaagatgattcgcgcttatgcaaccgtgattgatgggccagaatacttttggtgccagtttgccgatacggagaaactgcagtgtctcgaagtggaagtgcagaccgcgggagaacaggtggcggatcgacgcaattgtattccctgtccctacatcggcgatccgtgtatcgttcgataccgggaggacggccattactatagggccctgatcacaaacatatgtgaagattaccttgtttcagtgcggctagtggatttcggtaacattgaggactgcgtggatcccaaggctctctgggccataccctccgaactattgagcgtccctatgcaggcattcccttgctgcttatccggctttaacatctctgagggactgtgctcccaggagggaaacgattacttctacgaaatcatcaccgaggacgtcctggaaattacaattctagagattcgcagggacgtctgtgacattcctctggcgattgttgacttaaaatccaaaggcaagtccattaacgagaagatggaaaagtactctaaaacaggtatcaagtccgcactgccatacgagaatatcgactcagagatcaagcagaccctgggaagctacaacctggacgtggggctcaaaaaactgtcgaacaaggccgtacagaataagatctacatggagcagcagacggacgaactggccgaaataacagagaaagatgtgaacatcataggtacaaagccgtccaattttagggatcctaagacggataacatttgcgaagggttcgagaatccctgtaaagataagatagacaccgaagaactggagggcgagcttgagtgccacctggtagataaagccgagttcgatgataagtacctgataaccgggttcaatacactgctcccacatgccaatgagacaaaagagatcctggaactaaatagcctggaagttcccttgtctcccgatgacgagtctaaagaatttctggagctggagtcaatcgagctccagaactcactggtggtcgatgaggaaaagggagagctgtctccggtcccgcctaacgttcccctgtcccaggagtgtgttaccaaaggagccatggaacttttcaccctacaattgcccctgtcatgcgaggctgagaagcagcctgaactcgagctccccacagctcaactgccactagacgataagatggacccgctgtccctgggcgtctctcagaaggctcaggagtccatgtgcaccgaggacatgaggaaatcgtcgtgcgtggagagctttgacgatcagcgaaggatgagtctacaccttcatggtgcagactgtgatcctaagacccagaatgaaatgaacatttgcgaagaagagtttgttgaatacaaaaaccgcgacgcaatcagcgctctgatgcccttatttagcgaggaggagtctagcgacgggagcaagcacaacaatggcctccctgaccatatctcagctcagctgcaaaacacatacacgctgaaggcctttacagtagggtctaagtgcgtggtgtggagctcacttcgcaacacctggagtaaatgcgagattctcgagactgccgaagaggggactcgagtgcttaacctatcaaatggaatggaagagatcgtaaaccccgaaaatgtgtggaatgggatacctaagcttgacaagagcccgccagagaagaggggcttagaggtgatggaaatcta

SEQ ID NO: 27957 - DNA, 690 bp, Artificial Sequence
  Description of Artificial Sequence: Synthetic coding sequence
atgggtaaaagttgtaaagtggttgtgtgtggacaggcaagtgtaggcaagaccagtatcctggaacagttactctatggcaatcacgtggtgggaagcgaaatgatcgaaactcaggaagatatctacgtagggagtattgagaccgatcggggagtccgggaacaggtgagattctacgacaccagaggcctgcgtgacggtgctgagttaccacggcactgcttcagttgcactgacggctatgttctggtgtactcgacggacagtcgggaaagttttcagagggtggaattgctcaaaaaagagatcgacaaaagtaaggacaaaaaggaagggcttacgctccccccaagactcgagtgctctggaatgattactgctcattgtagcttaaacctgccaaggctcagatggagctcttgtctgtctccactgctccgcctgcaggtgacgatcgtcgtgctgggtaacaagtgcgatttacaggagcaaaggcgcgtggatcctgacgtggcacagcactgggccaagagcgagaaagtgaaactgtgggaagtgagcgtcgctgaccggaggtcattgctcgagcctttcgtgtatctggcctctaaaatgacccagccccaatcaaaatctgcattcccactgtcgcgcaaaaataaaggtagtgggtcacttgatgggtag

SEQ ID NO: 27958 - DNA, 2412 bp, Artificial Sequence
  Description of Artificial Sequence: Synthetic coding sequence
atggagtccggacctcgagcggagttaggagccggtgcccctcctgctgtcgtcgcgagaaccccacccgagcctcgcccttctcctgaaggggatccctctcccccacctccccctatgagcgcgttagtgcctgatacgccaccggatactcctcctgccatgaagaatgccacatcctcaaagcagctccccttggagcccgaatccccctcggggcaggttgggcctaggccggctccccctcaggaggagagcccttcctccgaggctaagtctaggggccctacccccccagcaatgggacctagagatgcccgacccccacggagaagctctcaacccagccctaccgccgtaccagcatcagacagccccccaacaaagcaggaggtaaagaaagctggcgagcgacacaaactcgcgaaagaaaggcgggaggagcgggcaaagtatctggccgctaagaaagccgtctggttggagaaggaagagaaggccaaggccttgcgggaaaaacagctgcaggaacgccgaaggcgcctggaggaacagcgactgaaagctgagcagcgcagagcagctctcgaagagcgtcaacgacagaagctggagaagaataaggaaaggtacgaagcagccatccaaagaagtgtgaagaagacttgggctgagattcgacagcagaggtggtcctgggccggtgccttacatcacagctcccctggccacaagacaaacaggagtctgcagttatccgcttgggaaagtagcatagtggaccgtcttatgactccaactctctcatttctggccagatcacgctcggccgtcaccctgccacgtaatggcagagaccaagggaggggttgcgaccctggacggggacctacctggggcagggcgggtgcttcacttgccagagggcctcagccggatcggacccatcccagcgctgcggtccctgtgtgcccgagaagtgcaagcgcctccccgctgaccccttgtagcgtcacgaggtccgtccaccgttgtgcacctgccggagaacgcggagaaaggaggaaacctaacgcagggggttcccctgcacccgttcggaggcggccagaggcatctcctgtgcagaaaaaggagaagaaagacaaagaacgggagaacgagaaggagaagtccgcactggcgagagaacggtcccttaagaagcgacagagcctgcccgcttccccacgcgctcgactcagcgcaagcactgcctcagagctcagccccaaatccaaggcgagacctagttctccaagcacatcttggcatcggcctgcctctccgtgcccttcccccggaccaggccatacattgcctcctaagcccccttcccctcggggtacgacagcctctccaaaggggagggttaggcgcaaagaggaggcaaaagagagcccgagtgcagcaggcccagaagataagagccaatcaaaacggagagcgtccaatgaaaaggaaagtgccgctcctgcctcccctgccccttcgcctgccccaagtcctactcctgcgcctccacagaaggagcaaccccctgctgaaacacctacagatgccgctgttcttacttcccctcccgcaccagcaccccctgtaaccccctctaagccgatggccggaaccaccgatagagaggaggcaaccagactgctggcagagaaacgcaggcaagcgagagagcaaagggagagagaagagcaggaaaggcggctgcaggctgaacgcgacaagcgcatgagggaggaacagttagcacgggaagccgaggcgcgtgctgagagggaagccgaggcgcgacggagggaagagcaggaggcccgagagaaggcccaggccgagcaggaggagcaagagcggctccagaaacagaaggaggaagccgaagccaggtctagagaagaggcggaaagacaaagactggagcgcgaaaagcactttcagcagcaggagcaagagcgccaagaaaggagaaaacggctcgaggaaattatgaaacggacgcgtaagagcgaggtgtcggaaacaaaaaaacaggattctaaggaggccaacgccaacggaagtagccccgaaccagtgaaggcagttgaagctaggtcccccggactgcagaaggaggccgtgcaaaaagaagaacccatcccacaggagccccagtggtccctcccgagtaaggaactgcccgcttcactagtcaacggtctgcagcctctacccgctcaccaggaaaatgggtttagcaccaatggcccatccggcgataaatcacttagccgcacccctgaaacgcttcttccgttcgccgaggctgaggcctttctgaaaaaggcagtagttcaaagtccgcaagtgacagaagtgctgtag

SEQ ID NO: 27959 - DNA, 1125 bp, Artificial Sequence
  Description of Artificial Sequence: Synthetic coding sequence
atgcgcgctccaatgttgcaaaaacaacaagcccctcgcatggacaccccaccgcctgaagaacggttagagaagcagaacgagaagctgaacaatcaggaagaggagactgaatttaaggagcttgatggcctgagagaagctctggcaaacctgagaggtttgtcagaagaggaacggagcgagaaagcaatgcttcgctctcggatcgaggagcaaagccagctgatctgcatactaaaaaggcggtctgacgaggccttagagcgttgccagatcctggagctcctaaacgccgagctggaagaaaagatgatgcaggaggctgagaaactcaaggctcaaggtgagtacagccgcaagctggaggaacgttttatgactctggccgctaaccatgagttgatgctccgattcaaggacgagtacaagtccgagaacatcaaactcagagaagagaatgagaaactccgcctcgaaaacagctcactattctcccaagcgctcaaggacgaggaggcgaaggtgcttcagctgaccgtgcggtgcgaggcgctgaccggggaactggagacactgaaagaaaggtgtgctcaggacgcttgccaagcccaggcccgtgagaaggaactgctggagctgcagagccaacaggcttgcacccacactaaagagacagaacagttacggagtcaactccagacactgaagcagcaacatcagcaagctgtcgaacagattgcaaaggccgaggaaactcacagtagtctcagtcaggaacttcaggccagactacagaccgtgacaagagagaaagaggaactgctgcagctgagtatagagcgtggtaaggtcctccagaacaaacaggccgaaatctgccagttggaggagaagttagagatcgccaatgaggatcgcaagcacgctctggaacgctttgaacaagaggcagtggcggtggatagtaacctgcgagtccgggagctgcaacggaaggttgacggaatccaaaaggcctacgacgaacttagactgcaatcagaggcattcaaaaaacactccctggacttgctctctaaagaaagggaactgaatggcaaattgaggcatctatccccctag

SEQ ID NO: 27960 - DNA, 585 bp, Artificial Sequence
  Description of Artificial Sequence: Synthetic coding sequence
atggaagatgggcttttggagattatgacaaaagacggcggagatatgccggcacctctggaggtgtccacagttccagcagtgggcgacgtgatctcaggggagtacaatgggggtatgaaggaactgatggagcatctaaaagcacagttacaggccctcttcgaggatgtgcgggcaatgaggggggcactcgatgagcaggcttcccatattcaagtgcttagcgacgatgtctgcgctaatcagcgagctattgtatcaatgtgtcagattatgacaacggcaccaaggcaggggggactcggggtggtcggtggtaaaggatccttccaatctgaccctcaggaacctgaaacccccagccctggcatcggtgacagcggcttattggggagggatcccgaagatgaagaggaagaggaagaagaaaaggagatgccaagtcccgcaacaccaagttctcactgcgaaaggcccgaatccccctgcgcaggcctactcggcggtgatggtcctctagttgaacctctggacatgccggatattaccctgttgcagttggagggagaggcttccctatag

SEQ ID NO: 27961 - DNA, 1281 bp, Artificial Sequence
  Description of Artificial Sequence: Synthetic coding sequence
atggctcatctgaggggcttcgccaatcaacactcacgcgtcgacccggaggagctgtttaccaagcttgaccgaatcggaaaaggtagcttcggggaagtctataagggcattgataatcacacgaaggaagtcgtcgccattaagatcatcgaccttgaggaggccgaagacgagatcgaggatattcagcaggaaatcaccgtcctctctcagtgcgactccccttacattacccggtattttggaagttacttgaaatcaacaaaactttggataatcatggagtacctcggaggagggtccgcattggatctcctcaaaccaggacccctcgaggagacatatattgctaccatcctgagggaaatcttgaagggtcttgactacctccattctgagcgtaaaatacatagggacatcaaagccgctaatgtgcttctctctgagcagggtgatgttaaattggccgattttggagtcgctggccagctcaccgatacacagatcaaacgaaatacatttgtgggtactccgttctggatggcccctgaggttatcaagcaaagtgcttacgatttcaaagcagacatatggtcgctggggatcacagcaatcgagttggccaagggggaaccgcctaactccgacctgcatccaatgcgcgtgctttttcttattcctaaaaatagcccaccaaccctcgaaggccagcactctaagcccttcaaggaattcgtggaagcatgtcttaacaaggatcccaggttcagacccacagccaaggagctacttaagcacaagtttatcactcgttatactaagaaaacttcattcctgacagaactcatcgaccgatacaaacgatggaaatccgagggtcacggtgaggagtcatcaagtgaggacagcgatattgacggagaggcagaggacggtgagcaggggcctatttggacctttcctccaactatcaggcccagcccccattctaaattgcataagggaacagctctccattcctctcagaaacctgccgagccggtgaaaaggcaacctcgttctcagtgtttgagcacactggtccgtcccgttttcggcgaacttaaagaaaagcacaaacaatcaggtggcagtgtcggggctctagaggaattggagaacgcttttagcttggccgaagaatcttgtccaggtataagcgataagctgatggtgcacctggttgagagagtgcaacgatttagccacaatcgcaaccatctcacttccacccggtag

SEQ ID NO: 27962 - DNA, 1350 bp, Artificial Sequence
  Description of Artificial Sequence: Synthetic coding sequence
atgatgctcagtaccgaaggaagagaaggctttgtggtgaaggtgagagggctaccctggagttgttcagctgatgaagtaatgcggtttttcagcgactgcaagatccagaacggcaccagtggcattcggtttatctacacccgggaagggaggccgagcggcgaagcatttgtagaacttgagagcgaagaggaagtgaaactggcactcaagaaggatagggaaaccatgggccatagatacgttgaggtattcaaaagcaattccgttgaaatggactgggtccttaaacacactgggcctaacagcccagacactgcaaatgacggctttgtccggctgagggggttgcccttcgggtgttctaaggaggaaatcgttcaattcttctctggtcttgaaatcgttcccaatgggatgaccttaccagttgactttcagggccgttcgaccggcgaagcattcgtgcagtttgctagtcaggaaattgccgagaaagcgcttaagaagcataaggagcgaataggccatcgatatatcgaaatctttaaaagcagcagagccgaggtgaggacacactacgacccaccgcgtaagctgatggccatgcagagacccggtccttacgaccggcctggagccggacggggttacaacagcattgggaggggggctggttttgagagaatgagaaggggtgcctatggcggaggctacggcggatatgatgactatggcggatacaatgatggttacggcttcggaagcgatcgatttgggagagacctgaactattgctttagtgggatgtctgatcaccggtatggcgatggcggatcttctttccaatccacaacaggccattgcgtccacatgcggggtcttccataccgggctactgagaacgacatctacaactttttttcacccctcaatccgatgcgagtccacattgagattggcccagatggcagggtaacaggggaagctgatgttgagtttgccacccatgaggatgcggttgctgccatggccaaagataaagccaatatgcagcatcgttatgtggaactcttcctcaactcgactgccggtacatcaggtggagcgtacgatcattcctatgtagagttgtttctgaatagtactgccggagcttcagggggagcctacggttctcagatgatgggcggtatgggcttgtccaatcagagttcatatgggggtccagcaagccagcagctctcaggtggctacgggggtgggtatggagggcagagctcaatgtctggctatgatcaggtgctacaggagaatagttctgattaccagtccaacttggcatag

SEQ ID NO: 27963 - DNA, 1317 bp, Artificial Sequence
  Description of Artificial Sequence: Synthetic coding sequence
atgtgccctaaaaacgcttcatattacggaaaccgagcggcaaccctgatgatgttaggacggttccgggaggcactgggcgatgcccagcaatccgtgaggcttgacgactctttcgttcgcggtcaccttcgcgaaggcaaatgtcacctgtccctgggtaacgcaatggctgcatgccgttcctttcagagggctctcgaacttgatcacaagaatgcacaggcacagcaggagtttaaaaacgctaacgccgtcatggaatacgagaagatagccgagacagacttcgagaagagagacttccggaaggtggtgttctgtatggatagggctctggaattcgcgcctgcatgtcacaggtttaagattctcaaagccgagtgcctcgcaatgctaggtagataccctgaggcccagtcagtggctagcgatattttacgaatggactcaacaaatgcagatgctctgtacgtacgtggactctgtctctactatgaagactgcatagagaaggctgtccagttcttcgtgcaagcattgcggatggcacctgaccatgagaaggcctgcatcgcatgccgcaatgcgaaagctctcaaggccaagaaggaagatggcaataaagcgttcaaagaaggtaattataagctggcctacgaactttacacggaggccctgggcatcgaccccaacaatattaaaactaatgccaagctgtattgcaaccgaggcacagtaaacagcaaattaagaaaactggatgatgcaattgaagactgtaccaatgccgtcaagctggatgacacctatatcaaggcttacctgagacgagctcagtgctacatggacaccgaacagtatgaggaggcggtcagggattatgaaaaagtttaccaaacagaaaaaacgaaggagcacaagcaacttctgaagaatgcacagcttgaactcaaaaaaagcaagcgaaaggattattacaagatcctgggggttgacaagaacgcatctgaggatgaaatcaaaaaggcctataggaaacgggcactgatgcatcacccggatcgccattctggagcaagtgccgaagttcagaaagaggaggagaaaaaatttaaagaagttggagaagcttttaccatcctgagcgatcccaaaaagaaaactcgatacgacagtggtcaggatctagatgaagaaggcatgaacatgggtgattttgatcctaataacattttcaaggccttttttggcggacccggtggattctccttcgaagcgtccggcccaggaaatttcttctttcagtttggctag

SEQ ID NO: 27964 - DNA, 165 bp, Artificial Sequence
  Description of Artificial Sequence: Synthetic coding sequence
atgcctggcaagaaagctagaaagaatgcacaacctagcccagccagggccccagcagagttagaggtcgagtgtgctactcagcttcgcaggtttggcgataagcttaacttccgccagaaactgctcaatttgatcagcaaactgttttgttccggcacttag

SEQ ID NO: 27965 - DNA, 1404 bp, Artificial Sequence
  Description of Artificial Sequence: Synthetic coding sequence
atggcttctgtagcagctgctcgggctgtgcctgtcggaagtgggctgcggggacttcagaggacgctgccattggtagtcattctcggggcaaccggcaccgggaaatcgacactggctttgcagttaggccagaggctgggtggtgaaattgtgtccgctgatagcatgcaggtgtatgaagggctcgacatcataacgaacaaggtctccgcccaggagcagagaatttgcaggcatcatatgatcagcttcgttgatcctctggttacgaattatacagtggtcgatttcaggaaccgtgcaacagcactgattgaagacatcttcgccagggacaaaattccaattgtcgtgggcggaacgaactactatattgagagccttctttggaaagtgctagtgaacaccaagccacaggagatgggaactgagaaagtaatcgataggaaggtggaactggaaaaagaggacggcttggtcctgcacaagaggctatcacaggttgatcctgagatggccgctaaattacacccacacgataagagaaaagtggccagaagtctgcaggtctttgaagaaacgggaatatcacactctgagtttctacatagacagcataccgaagagggaggcggtcctcttgggggaccactaaaattcagtaacccgtgcattctgtggcttcatgcagaccaggccgttctggacgagagacttgacaagcgagtagacgatatgctggccgctgggctcctcgaagaacttagggacttccatcgccgatacaaccagaagaatgtatccgaaaacagtcaggattaccagcatgggatcttccagtccatcggtttcaaagagttccatgaatacctgattacggagggcaaatgcactcttgaaactagcaaccagctgcttaaaaagggtatcgaggccttgaagcaggtgaccaagaggtacgcgagaaagcagaatcgatgggtaaaaaaccgcttcctgtcccggcctggacctatagttcctccggtttatgggcttgaagtgtcagatgtctcgaagtgggaggagtccgttcttgaaccggcattggagattgtccaatcttttatccaaggtcacaaacccaccgctacccccatcaaaatgccctataacgaggccgaaaataaaagatcgtatcatctctgcgatttgtgtgatcggattatcatcggcgaccgagagtgggctgcccacattaagtccaagagtcacttaaaccagctgaagaaaaggcgtagactggactccgacgctgtgaacacaattgagagccaaagcgttagcccagatcataacaaagagcctaaagagaaaggtagtcccggtcagaatgatcaggaactgaaatgttccgtatag

SEQ ID NO: 27966 - DNA, 558 bp, Artificial Sequence
  Description of Artificial Sequence: Synthetic coding sequence
atgggggtgaacctgacaaggtcgaataaggaaaccgtaaaacatagtgacgtattgttccttgccgtgaaaccacacattattccgttcatcctggacgagatcggcgctgatgtacaagcgaggcatatcgtcgtgagttgtgccgctggcgtgactatttcatcagtagagaaaaagctcatggcttttcaacccgctcccaaggtcatcaggtgcatgacaaacactcccgtggtcgttcaggaaggtgcaaccgtgtacgcgacaggcacacacgcgctggtggaggacggacaattgctcgagcagttgatgtccagcgtgggtttctgcaccgaggtcgaagaggatcttatcgacgcagtgaccggattgagtggtagcggaccggcttaccagagcatggcggatcaggagaagataagccccgctgcccttaagaagacgctgctggacagggtcaaattagagtcgccaaccgtgtccacactgactccttccagccctggaaaactcctgacacgcagcctcgctctggggggaaaaaaagactag

SEQ ID NO: 27967 - DNA, 960 bp, Artificial Sequence
  Description of Artificial Sequence: Synthetic coding sequence
atgtctgtcgggtttattggtgcgggacagctcgcaatgctctggaggggagccagcaggccccagcaccctgtggggtctcaagacaattctcaactccccaggaacgagcctgcccatggtgttcgcgctcaagaagacgggtgtgaaccagatactcaacagcaaggggacggtgaggcccagaggagaccggtaagcggttgtgaagctcatattatacctttcattctggacgagatcggagccgatgtccaagcgaggcacattgtcgtcagttgcgctgcaggagtgacgatcagttccgtggagaagaaactaatggcattccaacctgcacccaaggtcatccgctgcatgacaaatactcccgtagtggtccaagaaggagccaccgtctacgccacaggaactcatgcacttgtggaggacgggcagttgctcgagcagctcatgtcgagtgtgggattctgcaccgaggtagaggaggacctgattgacgccgtcacaggcctctcagggagtggtccagcctacgctttcatggctctagacgcgttggccgacggtggagtgaagatgggcttgcctaggcggctggctatccaattgggggcacaggccctgctcggcgcagctaagatgctgctcgacagcgaacagcacccatgtcaactaaaggacaatgtttgttctccaggcggagctactattcatgctctgcattttttggaatcaggtggctttaggagtctactcatcaacgccgtagaggcctcttgtatccggactcgagagttgcaatctatggctgatcaggagaaaatttcacccgctgcattaaagaagacactgctggatcgagtgaaactggagagccctaccgtgagcactttgactccgagcagtccgggtaagttactaacacgatcactggccttaggcggaaagaaagactag

SEQ ID NO: 27968 - DNA, 708 bp, Artificial Sequence
  Description of Artificial Sequence: Synthetic coding sequence
atgctgagcgcaactagaagggcctgtcagctgctcctcctccactcattattccctgtgcccaggatggggaactctgctagtaatatcgtatccccacaggaggcgctacccggacggaaagaacagacaccggtggcagctaaacaccatgttaacggtaatcgcaccgtcgagcctttccctgaaggcacacagatggccgtctttggaatgggttgcttctggggagccgaaagaaagttttgggtcctgaaaggggtatactccacccaagtcggcttcgcaggtggatacacatcaaaccccacatataaggaagtgtgttcagaaaaaaccgggcacgccgaggttgtgcgcgtggtatatcagcccgagcatatgagttttgaagagcttcttaaggtgttttgggagaaccatgatccgacacaggggatgcgccaaggcaacgaccacggaactcagtatcgtagcgccatctacccgactagcgcgaaacaaatggaagccgctctttcctctaaggagaactatcagaaggttctatcagagcatggcttcggcccaattacaaccgatatccgcgaaggtcagaccttttactacgcagaagactaccaccagcagtacctctccaagaaccccaacggttactgcggactgggaggtactggcgtatcgtgcccagtaggaatcaaaaaatag

SEQ ID NO: 27969 - DNA, 3873 bp, Artificial Sequence
  Description of Artificial Sequence: Synthetic coding sequence
atgagcggtcccctcgaaggggctgacggcggaggggatcccagacctggcgaaagcttttgtccgggaggggttccaagtcctgggcctccgcagcatcggccatgccctggtccgagcctggccgacgacacagatgcaaactcgaatgggtccagcggaaatgagtccaatggacacgaatcgcggggagcaagccagcgatcttcacatagcagttcctcaggcaacgggaaggacagtgcgctcttagagaccactgaatcctctaaaagtaccaattcccagtcaccatcgccacctagttccagcatcgcgtatagcttgctgtctgcatcttcagagcaggataacccatcaaccagtggctgctctagtgaacagtcggcacgagctagaacccagaaggaactcatgactgccctccgggagctcaaactgcggcttccccctgaacggagggggaagggccgttctggaactctggctacactgcagtacgcgctcgcgtgtgttaaacaggttcaagccaatcaggagtattaccagcaatggtcactggaagagggtgaaccctgctcaatggacatgtctacctacaccttagaagaactagagcacatcacaagcgaatataccttacagaaccaggacaccttctctgtagccgtgagctttctaaccggccgtatcgtctacatctccgaacaggccgcagtgttactcagatgcaagagagatgtgttccgagggacacgtttctcagaactgctcgcgccacaagacgtgggcgtgttttacggatcaacggctccaagtcgactgcctacctggggaaccggcgctagcgctggctcaggacttcgcgacttcacacaggagaaatccgtcttttgccggattagagggggacctgaccgggaccctgggccacgctatcagcctttcagattgaccccatacgtgaccaagattagagtatccgacggtgcccctgcacagccgtgctgcctgctgattgccgagcgcattcattccggctatgaagctccaagaattcccccagacaagcgcatttttaccactcggcacacccccagctgtctctttcaagatgtggacgagagggctgctccgctcctgggttacctgcctcaggatctccttggagcccctgtcttgttgttcctgcatccagaggatcgtccacttatgctcgccatccacaaaaagattctgcagttggccggacagccatttgatcacagccccattcggttctgcgccagaaatggagagtatgtcactatggatacgagctgggcgggatttgttcacccctggtctcgcaaagtggcctttgtgcttggacggcataaagtgcgcactgctcctctgaatgaagacgtgttcaccccacccgctccctccccggcacctagcttggacacggacattcaggaactaagtgagcaaattcaccggctgcttttgcagcctgttcactccccaagcccaacagggctttgtggagtgggcgctgttacctccccaggacccctgcactcacccggttctagcagcgactctaacgggggagatgctgaggggcctggtccccctgcacctgtaacattccagcagatatgtaaggatgtccacctggtcaaacaccaaggacagcagttgttcatcgagtcccgagctcggcctcagtctcggcctcggttgcctgctactgggacctttaaggccaaggccttgccatgccagagccccgaccctgagctggaggccggaagtgctccggttcaagccccactcgccctcgttccagaggaggcggagcggaaggaggcctcaagttgtagctaccagcagattaattgcctggactcgatcttgaggtacctagagtcatgcaacctgccatcaaccacgaagcggaagtgcgcaagttccagttcctacaccacaagctcagcctcggacgacgacaggcagcggaccggccctgtgtctgttggtaccaaaaaggacccacctagcgccgcactttccggcgagggagctacccctcgcaaagagcctgtggtgggtggcacactaagtcctttggctctggccaacaaggccgaatctgtagtcagtgtgacatctcagtgctcattctctagcacaatcgtccatgtcggcgataaaaagccacctgagagcgacatcatcatgatggaggacttacccggacttgctcccggacctgctccctcacctgcccctagccctaccgtggctcctgaccctgccccagatgcttatcgtcctgttggcttaacgaaagctgtgctctcgcttcacacccagaaagaagagcaggcctttctttcacgcttcagagatctgggcagactccgtggtctggattccagttcaacggccccttccgccttaggggaaaggggatgtcatcacgggcctgcacctccgtcaagacggcaccactgcaggtctaaagcgaaaaggtccaggcatcaccagaacccacgagctgaggcaccatgctatgtgagccacccgagtccagtccccccatcgacaccctggccaactcctcccgctaccactccattcccagccgttgtgcaaccatacccgctgccagtgttctccccaagggggggacctcagcctcttcccccagcaccaacctccgtgccccctgcagccttcccagcgccactcgtgactccaatggttgcccttgtgctcccgaactaccttttccctacaccttccagctacccctatggtgccctccagaccccagccgagggcccacctacgcccgcttcgcattctccgtcccctagtctgcctgccctggccccttcacctccccacaggcctgacagtccgctcttcaacagtcgctgttcatctccgctgcaactgaacctgctccagctggaagaattgccccgagcggagggcgctgccgtggctggaggacccggtagctccgcgggacctcccccaccaagcgccgaagcggcagaaccagaggctcgtctcgccgaagtgaccgaaagctccaaccaggacgctctgtctggatcttccgacttgctagagcttctgctgcaggaagacagcagatctggcaccggaagcgccgctagtggttccctggggagcgggctgggttccgggtcagggtctggctctcatgagggcggatccactagtgcatcgatcacacggtcaagccaatctagccacacctcgaaatattttggttcaattgattcctctgaggctgaggcaggtgccgcaagaggcggagccgagcctggagaccaggtcatcaagtacgtgcttcaagaccccatatggttgctcatggccaacgcagatcagcgggtaatgatgacctatcaggttccgtctcgcgacatgacttcagtgctcaaacaagatagggagcgcctgcgagctatgcaaaaacagcagccaaggttcagcgaggaccagcggagagagctgggagccgttcactcttgggtgagaaagggacagcttcctcgcgcactggatgtgatggcctgcgtggactgcgggagctccacacaggatccagggcaccccgacgaccctcttttctctgagctagatggccttggactggagccaatggaagaaggcggaggcgagcaaggcagtagtggcggtggctcaggcgaaggagaagggtgcgaggaggcccaagggggtgcaaaggcatcctccagtcaagacctcgctatggaggaggaggaggaaggacgaagctctagctccccagccctgcctactgctgggaactgcacctcatag

SEQ ID NO: 27970 - DNA, 2022 bp, Artificial Sequence
  Description of Artificial Sequence: Synthetic coding sequence
atggaaaaagctgtgaacgatggctcgcactcggaggagctattctgccacttgaaaaccatttccgaaaaagaagatcttccaagatgtacctccgagagccatttgtcttgtcttaaacaggacatcctgaatgagaagactgagctggaagccactctcaaagaagctgaactggtgacacattccgtagaactgctcctacccctcttcaaggatacgattgaaaagataaacttcgagaatgcaaacctttctgcgctgaacctgaaaatttcagaacagaaagagatcctgataaaggaactcgatacatttaagagtgtaaagctggctctggagcacctgctaaggaagcgtgattacaaacagactggtgataacctgtcttctatgctgcttgaaaatcttaccgataatgaaagcgaaaacaccaatctgaaaaagaaggtgttcgagaaggaagctcatattcaggagctcagttgtctgtttcaatccgagaaggccaatactcttaaggcaaaccgcttcagccagtccgttaaggtggttcatgagaggctgcagattcagatccacaaaagggaggctgagaacgacaagctgaaagagtacgtcaagtccttggaaaccaagatcgctaaatggaacctccagtcacggatgaataaaaacgaagccatagtcatgaaggaagcatcccgccagaaaacagtggcgctgaaaaaggctagcaaagtttacaagcagaggctagatcacttcacgggagcgatagagaaactgacttctcaaatccgagatcaggaggccaaactctcggagactatctctgctagcaatgcttggaaatcccattacgaaaaaattgtgattgagaaaactgagttggaggtacagatcgagaccatgaagaagcaaattatcaatcttctcgaagatttgaaaaagatggaggatcatggtaagaactcatgcgaggagatcctccgcaaggttcactcaatcgagtacgaaaatgaaaccctgaacttggagaacacaaagctcaaactcagattcccatgccggataaccgaaagtaagaacatgaacattctcattgtgctggacatgttgtgttatatctcttcagagaagaccacactcgccgcacttaaggatgaagtcgtgtccgtggaaaacgagctctcggaactacaagaggtcgagaaaaagcagaagacactgatcgaaatgtacaagacacaagtacaaaaactgcaggaagcggcagaaatcgtgaaatcacgatgcgagaacctgctccataaaaataaccagattactaagacaaaaaacaagaatgtggagaagatgagaggacagatggaatcccatttgaaagagttagagcgcgtgtgtgactccttgactgcggcagaacggaggctccacgagtgtcaggagagtttgcagtgctgcaaaggtaaatgcgctgaccaggagcacacaattcgggagctgcagggtcaagtagatggaaaccataatctgcttactaaattatccctggaagaagagaactgcctgatccaactaaagtgcgagaacctccagcagaagctcgagcagatggatgccgagaataaggagctggaaaagaagctagccaatcaagaagaatgtctgaagcattctaacttaaagttcaaagagaaatcagcggagtataccgcgctggctcggcagctcgaggcagccttggaagagggacgtcaaaaggtggccgaggaaatcgagaagatgtcttcccgcgagtcagccttacagattaaaatcctggacctcgaaacagagcttcgcaagaaaaatgaggagcagaatcagcttgtctgcaagatgaacagtaaggctcagcatcaagaagtgtgtctgaaggaggtgcagaacagcctggaaaagtccgaaaatcagaacgaaagcatcaagaattatctccagtttctcaaaacatcatacgtgacaatgttcgagtag

SEQ ID NO: 27971 - DNA, 798 bp, Artificial Sequence
  Description of Artificial Sequence: Synthetic coding sequence
atggatgacaaggcaagcgtgggaaagatctctgtatcaagtgactctgtgagcacattgaacagcgaggacttcgtactggtcagtagacagggggatgagactccctctactaacaacggaagtgatgacgagaagaccggccttaagatcgtgggtaacggctcagagcagcagctgcagaaagagcttgcagatgtcctgatggatccaccaatggacgaccagcccggtgaaaaggaactggtcaagcgtagtcagctggacggcgaaggggacggccctctgtctaaccagctgtctgcttcctccacaatcaaccccgtgccacttgtggggctgcaaaaacccgaaatgtcccttccagtgaagccgggacagggcgactccgaagctagctcgcctttcactcccgtggccgatgaagacagtgtggtgttcagcaaactgacctacctgggctgtgcttcagtgaatgcccctcgttctgaagtggaggccctgaggatgatgtctatcctgcggtcacaatgtcaaatatcgctcgacgttactcttagtgtgccgaacgttagtgaggggattgtgcggctcttggatcctcagactaacaccgagattgctaattacccgatatataaaatactcttctgtgttcggggtcatgacggaactcccgagagtgattgcttcgcttttactgaatcccactacaatgccgagctcttccggatccacgtcttcaggtgtgagatccaggaggccgtgagcccacaagaaaagacactgtgtaaatag

SEQ ID NO: 27972 - DNA, 636 bp, Artificial Sequence
  Description of Artificial Sequence: Synthetic coding sequence
atgtgggcaagcctaagccttgatcaccccagtgccaaagagaatcaggctcttagactcatagagatgcgtgaggagaacggtaacgtgccgaagactgagcaagccggaagtttgaagccactacgcgataccggcaagtcaaatctgaaggagaagaaggcaaacagtaaattaaaacaaattgagaaggagtacacacagaagctggccaagagcagccagataattgccgagctgcaaactacaatttcctccttgaaggaggagaatagtcagcagcagttggccgctgaacgacgtctgcaggacgtgagacaaaaatttgaagacgaaaagaaacaactcattcgcgacaatgaccaagccataaaggttctccaggatgagctggagaacaggtcgaaccaggtcagatgtgcggaaaagaaactgcaacacaaggagctggaaagccaggaacagattacctacattcgtcaggaatacgaaaccaaactaaaaggtttaatgccagccagtctgcggcaagagttagaggacactatctcaagtcttaagtcacaggtaaactttctccagaagcgggcttctattctacaggaggagctgaccacttatcaggggagaaggtag

SEQ ID NO: 27973 - DNA, 867 bp, Artificial Sequence
  Description of Artificial Sequence: Synthetic coding sequence
atgtcatcaagcatgtggtatatcatgcagagcattcagagtaagtattcattatccgagagattgattaggacgatcgctgcaattcgatcttttccgcacgacaacgtcgaggatcttattcgaggcggtgctgatgtgaattgtacacatggcactttaaaacctctccattgcgcttgtatggtaagtgacgcagattgcgtcgagcttttgcttgagaagggcgctgaggtgaatgctctggacggctacaacaggacggcgctgcactatgccgcagagaaggacgaagcttgtgtggaagtgcttctggagtacggcgctaatcccaacgcattggatggaaatcgggataccccgctccactgggcagcgttcaagaataatgcagagtgcgtgagagcgttactggagagtggagcctccgtgaacgctctggactacaacaatgatactccccttagctgggctgcaatgaagggaaatttagagtccgtgtccatactgctcgattatggtgctgaggttcgtgtgattaatctcatcggacagacaccgatctcccggctggtcgccctcctcgttcgcggtctaggtacagagaaggaagattcatgctttgagttgctgcatcgtgcagtcggtcatttcgagctacgcaagaatggcactatgcccagggaagtagccagagacccacaactgtgcgagaagctaaccgtcctctgctcggcaccaggcaccctgaaaacactggctagatatgccgtcaggcggagcctgggccttcagtacctccctgatgccgtgaaggggctgccactgcccgctagtctgaaggaatacctcctcttactggagtag

SEQ ID NO: 27974 - DNA, 1341 bp, Artificial Sequence
  Description of Artificial Sequence: Synthetic coding sequence
atgagagagatcgtgcatatccaggccggacagtgcggcaaccagattggcactaagttctgggaagtgatctcggatgagcatggaatcgacccagccggtgggtatgtgggggatagcgccttgcaactcgagaggatcaacgtatattacaacgaatcctcatctcagaagtacgtgccacgtgctgctctggtggacctggaacccggaaccatggactctgttagatcagggcctttcggtcagttgttccggcctgacaatttcatctttgggcagacaggcgctggcaacaattgggctaagggacactataccgaaggggctgagctggtggatgcagtactcgacgtggtgcggaaagagtgtgaacattgtgactgcttacagggctttcagctcacccatagtctggggggagggacaggtagcggcatggggacgctgttgataagtaagatccgcgaggagtttcctgacaggattatgaacacgttttcagttatgccaagcccaaaggtctcagacacggttgtagaaccgtataatgcgaccctcagcgtccaccagctggtcgagaatacagacgaaacatactgcattgataacgaagcattatatgacatatgctttaggaccttgaaactgacaaccccaacgtacggggatctgaaccatctggtgagcgccaccatgtctggagttacgacttcattacgattcccgggacaattgaacgccgacctgcgaaagctggccgtcaacatggttccctttccaagactgcatttcttcatgcctggattcgccccattgacctcccgaggctctcagcagtacagagcacttacggtgccagaactaactcagcaaatgtttgatgctcgtaacatgatggctgcctgcgatcccaggcacggcaggtatctgaccgtggccacagtgtttcgcggacccatgtccatgaaggaagtcgatgagcagatgctagcaatccagagcaagaactcctcttattttgtagaatggatcccaaacaatgttaaggttgccgtctgtgatatccccccacgaggcctcaaaatggcgagtacttttattggaaatagcactgcaatccaggagctattcaagcgcatctcagaacagttctccgccatgttccggagaaaggcctttctgcactggtttacaggggagggcatggatgaaatggagtttacagaggcggagagcaacatgaatgacctggtttctgagtatcagcagtatcaggatgccacggcaaatgacggggaggaggcgttcgaggatgaagaggaagagattgacggttag

SEQ ID NO: 27975 - DNA, 792 bp, Artificial Sequence
  Description of Artificial Sequence: Synthetic coding sequence
atgctgagctcaaagggtttgacagtagtggacgtatatcaaggctggtgcggtccttgtaaacctgtagtctcacttttccagaagatgcgcatcgaagtgggcctggatctgctgcatttcgccctggcagaggccgatcgcctggacgtgctcgagaagtatcggggtaaatgtgaaccaacgttcctattttatgccattaaggatgaggcgctgagcgacgaggatgaatgcgtctcacacgggaagaacaacggtgaggacgaagatatggtcagctctgaacgcacttgtaccctggcaatcattaaacctgacgctgtggcccatggcaaaactgacgagattataatgaagatacaggaggcgggattcgaaatactgactaacgaagaaagaactatgacagaagcagaagtgaggctcttctatcagcataaagccggtgaggaggctttcgagaagcttgttcaccacatgtgttccggcccatcccacttgctgattctgaccaggaccgagggatttgaagacgtagtgacgacttggcgcaccgtaatgggcccacgcgatccaaacgtggccagacgagaacagcctgaaagtctccgcgctcagtatggcaccgaaatgccattcaatgccgtgcacggatcccgcgacagagaggacgccgaccgggaattggcgctgctattcccgtctctcaagtttagcgataaagatactgaggcccctcaaggagagtcctcgactcagccacgattgaaaattactgacctcgattag

SEQ ID NO: 27976 - DNA, 1089 bp, Artificial Sequence
  Description of Artificial Sequence: Synthetic coding sequence
atgttgaaaaacaagggacactcttccaaaaaggataatctggcagtaaacgctgtcgcactgcaggatcacatccttcatgatctacagcttagaaatctgtccgtggccgaccacagtaagactcaagtgcagaaaaaggagaataaatcacttaagcgagacacgaaagccattatagatactggcctcaaaaagacaacacaatgtccaaagttggaagattcggagaaagaatatgtgctggaccccaagcctccacccctgacattagcccaaaagctgggactgatcgggcctccacctcccccattgtctagcgacgaatgggagaaggtgaaacagaggtccctcctccagggagacagtgtgcagccatgccccatctgcaaagaggagttcgagctgcgaccgcaggtgctcctgtcctgctctcacgtcttccacaaagcctgcctgcaagcttttgaaaagttcactaataaaaaaacctgcccactgtgccgcaagaaccaataccagaccagggtgatccatgacggcgctcgcctattcaggataaaatgtgttactaggatccaggcttattggaggggctgtgtcgtacggaagtggtatcgcaatttgagaaagacggttccaccaactgacgccaagcttcgaaaaaagttcttcgaaaaaaaatttaccgaaatttcccatcggatcctgtgttcatataatacgaatattgaggagttgtttgctgagattgatcagtgcctcgctattaatcgaagcgtcctgcagcagctcgaggagaaatgtggccatgagatcacagaagaggagtgggagaagatccaagtgcaggcactgagacgcgagacccacgaatgctccatatgtttagccccactgagcgctgccggagggcagagagtcggcgctgggagacggagtagagagatggccctgctgtcatgttctcacgttttccatcatgcctgcctgctggccctggaggaattcagcgtgggcgatcgaccaccttttcatgcctgccccctgtgtaggtcctgctaccagaagaaaatccttgaatgctag

SEQ ID NO: 27977 - DNA, 291 bp, Artificial Sequence
  Description of Artificial Sequence: Synthetic coding sequence
atgatcgaaaagatgcaagggtctagaatggacgaacagaggtgctcttttccaccacctcttaaaacagaagaggactacataccttacccctccgtacatgaagtactgggtcgcgaaggccctttcccattaattctcctgccacagtttggcggatactggatcgaaggtactaaccacgaaatcacctccatccccgagactgagcccttgcagagtcctaccacaaaagtcaagcttgagtgtaatccgactgccagaatataccgcaagcacttcctcgggtag

SEQ ID NO: 27978 - DNA, 459 bp, Artificial Sequence
  Description of Artificial Sequence: Synthetic coding sequence
atggcgggactgccccgacggatcataaaggaaacgcagagactgcttgccgaacctgtcccaggtattaaagcagaacctgacgagtctaacgccagatacttccacgtggtgatagcaggcccacaggattctcccttcgagggaggcacttttaaactcgagctctttctcccagaggaatatcctatggctgcgcctaaagtccgcttcatgactaaaatttatcaccctaatgtggacaagctcgggcgaatttgtctggatattcttaaggacaagtggagccctgccctacagatccgcacagttctgctctctatccaagcattactgtctgcacctaatccagatgacccactggcgaatgacgtggcagaacaatggaaaactaacgaggcccaggccatagaaacagcccgagcctggacaaggttgtacgccatgaacaacatttag

SEQ ID NO: 27979 - DNA, 3354 bp, Artificial Sequence
  Description of Artificial Sequence: Synthetic coding sequence
atgtatagaagctcagcacggagcagtgtcagttcgcatcgacccaaagacgacggaggcggaggacccagatcgggacgatcctcgggttcctcctcaggaccagccagacgcagtagcccgcctccccctcccagcgggtcctcctccaggactcccgcacgcagacccaggtcaccaagtggacatagaggacgacgcgcttctcccagccccccacgcggacgccgagtctccccttccccaccgagagccaggagagggtctccctcgcctcctcgtgggagaaggctcttcccccctgggcctgcaggtttccgagggagtagtagaggggaaagcagagccgattacgcccgagatggaagaggggaccatcccggagactccgggtcacgcaggcggagcccgggactgtgttctgatagcctggagaaatctctcaggataacagtgggtaatgatcacttttgcgtgagtactcctgagcggcgtcgactgtccgataggctgggaagtcctgtcgacaacttggaagatatggaccgtgacgacttaactgacgactccgtcttcacgcggtctagccagtgctccagggggctagaacggtacatttcacaggaagagggtccgctgtcgccgttcctgggccagcttgacgaggactaccgtaccaaagagacctttttgcatcgctccgattacagtccacatatctcatgccacgatgagttacttagaggcaccgagaggaacagagagaaactgaaaggatactctatcaggtccgaggagcggtcaagagaagcaaagcgcccaagatatgacgacaccgtcaaaattaattcaatggggggagatcaccctagttttactagtgggactagaaattaccgacagagacggagatctccttccccacgcttcctggacccggaatttagagagttggacttggctcgtaggaaacgagaggaggaggaagagcggtcacgctcattatcgcaggagctcgttggtgtagatggtgggggaacaggatgcagtattcctggtctatccggcgttctgactgcttcagaaccgggttattcgctacaccgccctgaggaagtttcagtgatgccaaagaagtcaatcctgaaaaagcggatcgaggttgacattatggagccatctatgcagctggaatccttttccagctccacaagttcctcacaagaccaccctctctatagcgggcacccatctctgccccttagcggggcaattgccgctttcgctagcgaaattgagaacaagggcaccatggttgaaaccgccttgaaggagcctcaggggaacctttaccagtggggacccttaccaggtattcccaaagataattccccactgagagagaagttcggctcatttctatgtcacaaggacaacctggacctaaaggcggaaggcccagaaaggcacacggactttctgcttccgcatgagagggcctcccaggacggctccggcttcagtagaattttaagcatgctcgcagactcaacctccactcaggaaaaacgtaggagatcctttcctgacattgaagatgaggaaaagtttctgtacggcgatgaggaagaggaccttaaagctgaaagcgtgccaaagcctctcggcagttccgagagcgaagtgatgaggcagaaagctagcagcctccccagctccgcccctgcggtcaagctagagtccctcgaggagacaaatcccgagtacgccaagatacatgacctactgaaaactattggtctggatatcggggtcgcagagatctctcaattagccgctaggactcaggaaagactgcatggtaaaaagccatcattacggagctctgcagacaggaggtccagtgttgatcgctatttctcagccgaccactgctcatcagtggaccacaggtttagcgctgataggtgctccagcgttgaccattgcttttcagccgacaggcggtcgtctgatccccaccgccttgaatctcgggaggcccaccatagtaatacacattcccctgaggtgtcacatcctcatccaccttctccggtcgatccttacctgttgaccaagaatagcccaccttttctgaagtcagatcacccagttggccatatttccgggccagaagtggttgggagcgggttccagtcatccgtcgccgtaaggtgcatgctgcctagtgccccaagtgctccgatacgactgcctcacaccgccgcactctcgcagttccatatgccacgtgcttctcagtttgccgctgctcgaatcccgccaaattaccaagggccagcgattccaccagccagtttcgacgcatataggcattacatggcatatgctgccagtcgctggcctatgtaccccacttcacagccaagcaatcacccggttcctgagccacatagaattatgcccatcacaaaacaggctactcgttcacgacctaacttgagagttatcccaacagttacccctgataagcctaagcagaaagaaagtcttcggggttccatccccgcagcccaggtgcccgtgcaggtgtctatcccatctctcatcagatacaacccagaaaaaatctctgacgagaagaaccgcgctagccagaaacagaaagtgatcgaggaaagagaaaaacttaagaacgaccgcgaagccaggcaaaaaaaaatgtactatctgcgaactgaactcgagcgcctgcacaagcagcaaggggaaatgctccggaaaaagcgcagggagaaggacggtcataaagacccacttttggttgaagtttcacgattgcaggacaacattatgaaggacatagccgaactgagacaggaagccgaagaggccgagaagaagcagtcagagctggataaagttgctcagattttgggcataaacatctttgacaagtctcagaaaagtttgtctgatagtcgcgaaccgacggagaaacctgggaaggcagagaaatctaaatcccccgaaaaagtaagctcattcagcaactcctccagcaataaggaatcaaaagtaaacaatgagaaattccggacaaaaagccctaagccagcagagtcaccacagagcgcaacaaagcagctcgatcagcctaccgccgcatatgagtactatgacgccggaaaccactggtgcaaggactgcaataccatctgcgggaccatgttcgacttcttcacgcacatgcacaataagaagcatacacagggccaattccagaaaagctccgacttccaaaaagagggcctccagcagacctttctcccgccagagcgacaggggtag

SEQ ID NO: 27980 - DNA, 576 bp, Artificial Sequence
  Description of Artificial Sequence: Synthetic coding sequence
atgtatgtttgtctctgtgtttcagttgccaaagtgacaatggccgaccgcgctgctgcagagagggcttgtaaggacccaaatccaattatcgatggaagaaaagctaacgttaatctggcatatcttggagcaaagccgagaattatgcagcctggcttcgccttcggagtccaacagctgcaccccgctttgatccaacgcccttttgggatacctgcacattacgtatacccccaggcctttgtgcagccaggcgtcgttattccccatgtgcaacctacagctgcagctgcttctaccacaccttacattgactacactggtgcagcctatgctcaatattcagccgcagccgcagccgcagccgcagccgcagcttatgaccagtatccatacgccgcatcgccggcagcggcaggctatgttaccgctgggggttatggctatgcagtccaacaacccatcacagcagcagcgccaggcacagccgctgctgctgctgccgcagccgcagcagcagcagccttcggccagtatcaaccgcagcaactgcagactgaccgtatgcaatag

SEQ ID NO: 27981 - DNA, 330 bp, Artificial Sequence
  Description of Artificial Sequence: Synthetic coding sequence
atggctggtgccccaaccgtttcactgccagagctgcgatccctattagcatcaggacgcgctaggcttttcgatgttagatctagggaggaggcggctgcagggacaattcccggtgctctgaatatacccgtctctgaactcgaaagcgctctccagatggaacccgctgcctttcaggctctctattctgccgaaaagcccaagctggaggacgaacacctggtgttcttttgccaaatggggaagaggggactccaagccacccagctggcccgtagcctcggatatactggatatggcgaggtgtggctgctcgcaggccgatag

SEQ ID NO: 27982 - DNA, 630 bp, Artificial Sequence
  Description of Artificial Sequence: Synthetic coding sequence
atggcccttctggcagagcacctcctcaaaccactgcccgcagacaaacaaattgagactggcccttttctggaggcagtctcacacctgcctccctttttcgattgtctcggcagccccgtgttcacgcccataaaggcagacatcagcgggaatattaccaaaattaaggccgtttacgacactaacccagctaaatttaggaccttgcaaaatatccttgaagtggaaaaggagatgtacggtgccgagtggccaaaggtgggcgctacccttgctctcatgtggctcaagaggggtctgagatttattcaggtgttcctgcagtccatctgcgatggtgagcgggatgaaaatcatccaaacctgattcgtgtgaacgccactaaggcctacgagatggctctgaagaaatatcatgggtggatagtccaaaaaatctttcaggctgccctttatgctgcgccttataaaagtgattttcttaaggccctgtctaagggtcagaacgtcacggaggaggagtgccttgagaagattcggctgtttctagtgaactatactgcaactatagacgtgatatacgaaatgtacactcagatgaatgctgagctcaattacaaggtttag

SEQ ID NO: 27983 - DNA, 474 bp, Artificial Sequence
  Description of Artificial Sequence: Synthetic coding sequence
atggaagaagctcaacggaagaggacccagctgcgcgaggcatttgagcagctgcaggctaagaagcagatggctatggagaagcggcgagccgtgcagaatcaatggcaactccagcaggagaagcaccttcagcatctggcagaagtgagtgcagaggtgcgggagcgaaagacaggcacccagcaagagctggaccgggtgttccagaagctgggcaatctcaagcagcaagccgagcaggaacgggacaagctccagcgctaccagacatttctgcaattactatacactttacagggtaaactgctgtttccagaggcagaggcagaagccgaaaacctgcctgacgacaaaccgcagcagccaacccgtccacaggagcagtctacaggcgatacgatgggcagagaccccggagttagcttcaaagccgtcggcctgcaaccggctggagacgtcaacttgccctag

SEQ ID NO: 27984 - DNA, 639 bp, Artificial Sequence
  Description of Artificial Sequence: Synthetic coding sequence
atggaggtgctccgacggtcctcggtattcgcggcagagattatggacgcatttgaccgaagtcccacagacaaggaactggtcgcccaggctaaagcgcttggacgcgaatatgtgcacgcgagattgttgagggccggtctgagttggagcgctccagagcgcgcagcacccgtgccaggtagattggcagaggtctgcgctgtactgctgaggttgggagacgagttggaaatgatccgaccatccgtctacagaaatgtggccagacaacttcatatttcacttcagagcgagcccgtggttacagatgctttccttgctgtcgcgggacatatcttcagcgccggaattacttgggggaaagtcgtgtccctttatgctgtggctgcagggttggccgtagactgcgtcagacaggctcaaccggctatggttcacgccctagtggactgcctcggggaattcgtccggaaaactctggccacttggcttcgcagaaggggtggatggactgatgtgctgaagtgcgtggtctctaccgatccgggtctgaggtcccactggttagtcgcggcactctgtagctttggcagattccttaaggcggctttcttcgtgctgctccccgagaggtag

SEQ ID NO: 27985 - DNA, 2148 bp, Artificial Sequence
  Description of Artificial Sequence: Synthetic coding sequence
atgtcgcaaagcggcgctgttagctgttgtcccggagccactaacggctcactcggcaggagcgacggcgtcgcaaagatgtctcctaaagatctctttgagcaacgcaagaaatactctaattcaaacgttattatgcacgagactagccagtatcatgtgcagcatctggctacttttatcatggataagagtgaagccattacctctgttgacgacgccatccgaaagctggtgcagctatctagtaaagaaaaaatatggactcaagagatgctgcttcaggttaacgaccagagtctgagacttcttgatatcgaaagtcaggaagaactcgaagattttcctttgcctaccgtccagaggagccagaccgttcttaaccagctgcggtacccctcagtactactcctcgtgtgccaggacagcgaacagagtaagccggacgtgcattttttccactgtgatgaggtagaagccgagctggtgcacgaggatatcgagtcagcccttgccgattgtagattgggaaagaaaatgagaccgcagacgctcaagggtcatcaagagaagatcaggcaacgccagtctatcctccccccacctcagggccctgcccctattcccttccagcataggggcggagacagcccagaggctaaaaatcgggtggggcctcaggttcctctgtctgaaccgggatttagaaggagggagagccaggaagaacccagggctgtgcttgcccagaagatagagaaggagacccagatcctgaattgcgctctcgacgacatcgagtggttcgtggcgaggctgcagaaagctgcagaagccttcaaacagttgaaccagcgaaaaaagggcaagaaaaagggaaaaaaggctcccgctgagggagtccttacactccgggcacggccacccagtgagggtgagtttattgactgctttcagaaaatcaagctcgccataaatctgctggctaaacttcagaagcacattcagaaccccagcgccgcagagctggtgcatttcctttttgggcctctggaccttatcgtgaacacctgcagcgggccagatatagcaaggagcgtgtcatgccctctgctctctcgagatgcagtagatttcctccggggacacctcgttccgaaagagatgtcactctgggaaagtttgggggagagctggatgagaccacgctcagagtggccaagagaaccgcaggtgcctctctacgtgcccaaatttcacagtgggtgggagcctcccgtcgatgttctccaggaagccccatgggaggtagagggtctggcttccgctccaattgaggaagtatcccccgtgagccgtcaatccatcaggaattcccagaagcatagtccaacatcagaacccaccccgccaggcgacgccctgccacccgttagctccccacacacgcacaggggataccaacctacaccagctatggctaagtacgtgaagattctatatgatttcaccgccaggaatgcgaatgagctcagcgtcttaaaagacgaagtgctggaagtgcttgaagatgggaggcagtggtggaaactccgatccagatcgggacaggcaggttacgtaccttgcaatattctcggagaagcccgacctgaggacgccggagctccttttgagcaggctggacagaaatactgggggcctgcttctccgacacataaactgcccccatcgtttcctgggaataaggatgaattaatgcagcacatggatgaggtcaatgacgagcttatccgcaagatcagtaacataagagcccagcctcagcgacactttcgggtggagcggagccagccagtgtctcagccactgacgtacgaatcaggccctgatgaagttagagcttggctggaagccaaagcttttagcccaaggatcgtcgagaacctgggcattctcacaggaccgcagcttttctcccttaacaaagaagaactcaagaaggtctgcggtgaggagggagttcgggtatattctcaactaaccatgcagaaggccttcctggagaagcagcagtccggttcagaactggaagaactgatgaacaagtttcactctatgaaccagagacggggagaggattcctag

SEQ ID NO: 27986 - DNA, 600 bp, Artificial Sequence
  Description of Artificial Sequence: Synthetic coding sequence
atggcatggccatgcatctccaggctctgttgtcttgccaggcgctggaaccagctggatcgctccgacgtggcggtgccactgaccctgcacggttactctgacctcgactctgaagagcccggtaccggcggagccgcaagtaggaggggccagcccccagctggagctcgcgattcaggtcgggatgtaccactgacacagtaccagcgggactttggcttatggacaaccccagcagggcctaaggatccccctccagggcgaggaccgggagcaggcggacgccgaggcaagagtagcgcacagtcctccgcacccccagctccaggggcacggggagtgtatgtgctccccataggcgatgccgatgcggcagcagccgtgacaactagctacagacaggagttccaggcctggaccggcgttaagccatctaggtcaacaaaaactaaacctgccagagtgattaccactcacacaagtgggtgggactcttcgccaggagctggcttccaggtgccggaggtcaggaagaaatttacccctaatcctagcgcgattttccaggcgagtgctcccaggatattaaacgtctag

SEQ ID NO: 27987 - DNA, 5105 bp, Artificial Sequence
  Description of Artificial Sequence: Synthetic coding sequence
atgggcaattctgatagccagtacactctccagggctcgaaaaaccactctaacacgatcactggcgctaaacagatcccctgtagcctgaagatccgtgggatccacgctaaagaagaaaagagcctacacggctggggccacggatccaatggggctggatataaatcaaggagcctggccagatcctgcctcagccacttcaagagtaaccagccttacgcgtctcgcctgggtgggcctacatgcaaggttagccgcggagtggcttactctacacatagaacgaacgcccctggcaaagacttccaaggcatctcagccgcatttagcacagagaacggattccactccgtgggacatgaattggccgacaatcacatcacctccagagactgcaacggccatttgctgaactgctatggtcgcaacgaatctatcgcctctacacctcccggagaagataggaaaagcccacgggtgctgattaagacgttaggcaaacttgatgggtgcctaagagtggaattccacaacgggggtaacccaagcaaggtgcccgcagaagactgctccgagcctgtgcagctccttaggtattcccctacactggcctctgaaacgtccccagttcccgaggcacggagagggagcagcgctgattctctaccttctcatagaccctcacctaccgactcccggctgcgatcaagtaaagggagctcactaagtagtgagagctcatggtacgactctccctggggtaatgccggagaactatccgaggctgagggatcttttcttgcacctggcatgcccgatcccagtttacacgcctcctttccaccaggggacgctaagaagcccttcaatcagtcttcgtccctctctagtctgagagagctctacaaagacgccaacctgggaagtctctcaccatcaggtattagactctccgatgagtatatgggaacccatgcgagcctctctaacagggtctcctttgcatccgatattgatgtgccctcacgggtggcccatggagatcctattcagtattcatcctttaccttgccctgcaggaagccaaaggcatttgtggaagatacagccaagaaagactctctgaaggcccgtatgagacggatcagtgattggacgggctctctgtcccgcaaaaagcggaaactccaggagccacgttctaaggagggcagcgattattttgattcacgctcggatggactgaacaccgacgtgcagggcagctcacaggcaagtgctttcctgtggagcggtggtagcacccagattctgtcccaacggtctgaatcaactcacgcgatcgggtccgatcccctgcggcagaacatctatgaaaactttatgagggagctggagatgagtaggactaataccgagaacatcgagactagcacagaaaccgccgagtcaagcagcgaaagcctttcaagtctcgagcagctagacctcctgttcgaaaaggagcagggcgtcgtccgaaaagccggttggctgttttttaaaccactcgttacagtacagaaggagcggaaactcgagctggtggccaggcggaaatggaagcagtattgggtaaccctgaaaggctgtacactgctcttttacgagacatatggcaagaatagtatggatcagagcagcgccccacgatgtgcgctgtttgctgaagatagtattgtgcagagtgtgcccgagcacccaaaaaaggaaaacgttttctgcttatcaaactcatttggcgatgtctacctgttccaggccacctcacaaacagatctggaaaactgggtcaccgcggtccactctgcttgcgccagcttgttcgccaaaaagcatggaaaggaggacactctgagattgctgaaaaaccaaaccaaaaatctgctccagaagattgacatggattctaagatgaagaagatggctgaactccagctgtccgttgtttctgaccctaaaaatcgtaaggcgattgagaaccagattcagcagtgggaacagaatctggaaaagtttcacatggatttgtttagaatgcggtgctacctcgcctccttacagggtggtgagctccccaatccgaagagcctcctcgcagccgcaagcaggccttcgaaattagctctgggcaggctagggatccttagtgtcagttcattccatgccttggtctgctcacgggacgattcggccctgcgcaagcgaaccctgagcctgactcagcgtggccgaaacaaaaagggcattttttcatcactcaagggcctcgatacgctggctagaaaaggaaaggagaagagaccttctattacccaagtggatgaactactgcacatctatggctccaccgttgacggggtcccgcgagacaacgcatgggagatccaaacgtacgtgcatttccaggataatcatggggtgacagttggtattaagccagagcatagggtagaggatatattaactttagcctgtaaaatgcgccaactggaacccagccactatgggctccagctcaggaaactcgtggacgacaatgtcgagtattgtatcccagccccttacgagtatatgcaacaacaggtttacgatgagattgaggtatttccactaaatgtgtacgacgtccagctcacgaagacaggatccgtctgtgactttggctttgcagtgacagcacaggtcgacgagagacagcatctctcacgaatttttattagtgacgtcctaccagatggactggcttatggtgaaggtctgcggaaaggcaatgagattatgacgttgaacggcgaggccgtttctgacctcgacctgaaacaaatggaggcccttttctccgagaaatccgtgggcctcacactgatcgctagaccacccgatactaaagccacactctgcacatcttggagcgactcagacctcttttcgagggatcaaaagtctctgctgccaccccctaatcaatcgcagttacttgaagaattcctggataattttaagaaaaacactgcaaatgatttttcaaacgttcccgacatcacaaccggtttgaagcgctcgcagaccgacggaacgctcgaccaggtttcgcatcgggagaaaatggagcagactttcagatctgctgagcagattactgctctgtgccgcagctttaacgattcccaggcaaatggcatggagggtcctcgcgagaaccaggatcctccaccaagaagcctggccaggcacctctctgacgctgaccgactgagaaaagtcatccaggaactggttgacacagagaaatcctacgttaaggacctttcttgcctttttgagctgtacctcgaaccattgcaaaacgaaacatttctaactcaggacgagatggaatcactgtttgggtctctgcccgaaatgcttgaatttcaaaaagtcttcttggagacactggaagatgggatctcagcgagctcggactttaacactctcgagacaccatcccagttccgcaagctcctgttttctctggggggatccttcctgtattacgcggatcatttcaagttatattctggattctgtgcgaaccacattaaagtgcagaaggtacttgaacgtgcaaaaacggacaaagcgttcaaggcattcttggacgccagaaatccaaccaagcaacacagcagcacacttgagtcgtatctgattaagcccgttcagcgggttttgaaataccctctgctgctgaaggaacttgtaagtcttacagatcaggagagtgaggagcactaccatctaactgaagcgctgaaggccatggagaaggtggccagccatattaatgagatgcagaagatctatgaggactacggcacagttttcgatcagctggtcgctgaacaatcgggcacagagaaggaagttactgagctgagtatgggggagttgctcatgcactctaccgtgagctggttaaacccattcttgtctctgggtaaggcgaggaaggatctcgaactcaccgtcttcgtgttcaagagagcagtaatactggtgtacaaagagaactgtaaactgaagaaaaagctgccaagcaacagccgaccggcacataatagcaccgatttggatcccttcaagttcagatggttgattcctattagcgctttgcaggtgcgcctgggaaaccccgcaggcactgagaacaactcaatctgggaactgatccacaccaaaagcgaaattgaggggaggcccgagacgatctttcagttgtgttgctctgacagtgagagtaaaacgaatatcgtgaaggttatccggagcattctgcgcgagaacttcaggcggcatattaaatgcgaactgcctcttgaaaaaacatgtaaagaccgactggtccctctgaagaatcgtgtgcccgtgagcgctaaactcgcatcaagcaggtccttaaaggttttgaagaattcatccagcaacgaatggacaggggaaacaggaaaggggaccctactggacagtgacgaagggagcctcagttctggaacccagtcttctggttgtccaaccgccgagggtcggcaggacagcaagtcaacatctcctggaaagtacccccaccccggacttgcagactttgccgataacctcattaaggagtctgacattctcagtgacgaggacgatgatcaccgtcagactgtaaagcaggggagccctaccaaggacatcgaaatccagttccaacggttgaggatttccgaagatcctgatgttcaccccgaggccgaacagcaacctggcccagagtcaggcgaaggacagaaaggaggcgagcagcccaagctggtccgaggccacttctgtccaatcaagcgaaaggctaatagtaccaagagggaccgaggaacactgctaaaggctcagatcagacatcagtctttggacagtcagtccgagaatgccacgatagatttgaatagcgtactcgaacgcgaattttccgtgcagagcctgacatctgtggttagcgaggagtgcttctacgaaactgagtcacacggcaagagcta

SEQ ID NO: 27988 - DNA, 3177 bp, Artificial Sequence
  Description of Artificial Sequence: Synthetic coding sequence
atggacctgggaccactgaatatctgcgaggagatgaccatccttcacggagggtttctgctggccgagcagctgttccatcccaaggccctagccgaattgaccaagtcggattgggaacgggtgggacgacctatcgtggaagccctccgcgagatatctagtgctgccgctcactctcaaccatttgcctggaagaagaaggctctcatcatcatttgggccaaagtactccagccacacccagtcacccctagcgatacggaaacccgatggcaggaagatctgtttttttcagtgggcaacatgatccctaccatcaaccataccattctcttcgaactcctgaaatctcttgaggctagcgggctgtttattcagctgctgatggcgttaccgacaaccatctgtcacgccgaactggagcgcttcctcgaacacgtgacggtcgacaccagcgctgaggacgtggccttcttcttagacgtatggtgggaagtcatgaaacacaaaggtcatccacaggaccccctgctgtcccaattctctgcaatggctcataagtacctaccagcactcgacgaattccctcatcctcccaaaagattgcgatcagacccagacgcctgcccgactatgccactgctcgcaatgttgctgaggggactgacacaaatccaatcgagaatcttgggccctggcaggaaatgttgcgccctggctaatctcgccgacatgctgaccgtttttgctcttaccgaagacgaccctcaggaggttagcgctaccgtgtacctggataaactagctacagtgatcagcgtttggaactcagacacccagaatccgtaccaccaacaagctctggctgaaaaagtgaaagaggctgagcgcgacgtgtccctgactagtctagctaaactgcctagcgagacgattttcgttggctgcgaatttcttcaccacctcctccgcgagtggggggaggaacttcaggccgtgctgagatcatctcaagggaccagttacgattcttatcgactctgtgacagtctcacctctttctcccagaacgcaacactttacctaaatcgaacaagtcttagcaaggaggaccggcaagtcgtaagtgagcttgccgagtgcgttagagattttctccggaagacatcaaccgtgctgaaaaacagagcactcgaggacataactgcctcaatcgccatggcagtaattcagcagaaaatggatcgtcatatggaggtctgctacatattcgcaagcgaaaagaaatgggctttttctgacgagtgggtggcgtgtttgggttctaatcgtgcattatttcgtcagccagatctcgttcttagacttttggaaacagtgatcgatgttagcactgcagatcgcgcaattcccgagagtcagattcggcaagtcattcatctgatactggagtgctacgccgatctctcactcccagggaagaataaggtccttgcagggattctacggtcctgggggagaaaaggactttctgaaaaactgttggcctatgtggaaggattccaagaagatctgaatactaccttcaaccagctgactcagagcgcctcagaacagggacttgccaaggccgtggcttctgtcgctaggctggtgattgtacaccctgaagtgacggttaagaagatgtgttctcttgcagtagtcaaccttggaactcataaatttctcgcccagattctgacggcttttcccgctcttcggtttgtcgaagagcagggccctaatagcagcgccacattcatggtcagttgtcttaaagaaaccgtgtggatgaagtttagcacacccaaggaggagaaacagtttctcgaattgctgaactgcctgatgagtcctgttaagccgcaaggcatccctgtggcagccctactggaacccgatgaagtcctcaaggagttcgtcttgccatttctgcggctggatgtagaggaagttgatctgtcgcttaggattttcattcagaccctagaggccaacgcctgcagagaggagtattggctgcagacctgctcccccttccccctcctgtttagtttgtgtcagctgttagataggttctctaaatattggcaattaccaaaggagaagaggtgcctgagcctggaccgtaaggatctggcaatccatatccttgaactcctgtgcgagattgttagcgctaatgcagagacctttagccccgacgtatggataaagtcgctttcttggttacaccgtaagcttgagcagttggactggaccgtgggactaaggttgaaatccttcttcgagggccattttaagtgcgaggtgccagccaccctatttgagatatgtaaattaagtgaggacgaatggacctcacaagctcatcccggatacggtgcagggactggactcctcgcttggatggaatgttgctgcgtgagtagtggcattagtgaacggatgctgagtttacttgtggtggacgtgggaaatcccgaagaagtgcggctgttcagtaagggcttcctcgtggctctggtccaggtgatgccttggtgcagcccacaggagtggcaacgcctgcaccaactgacccgaaggctgttagagaagcagctgttgcacgtcccctacagcctggaatacatacagttcgtcccccttctaaatctcaagccatttgctcaggaattacagctgagtgttttattcctgcgtacattccagtttctatgctctcacagctgtagagactggctccccttggagggctggaatcatgtcgttaaactgctatgcggttctttaactcgactcctagattccgtgcgggcaatccaggcggctggtccatgggtgcagggacctgaacaggacttgacacaagaggccctgtttgtctacactcaggtgttctgtcacgctcttcacatcatggccatgctgcaccccgaggtgtgcgaacctctgtatgttttagctctggagacattgacttgttacgaaacactttctaaaaccaacccgtccgtgagctccctgctgcaacgtgcccatgaacagcgttttctgaaatccatagccgaaggtataggcccagaggaacgccgacagactctcctgcagaaaatgtcttccttctag

SEQ ID NO: 27989 - DNA, 267 bp, Artificial Sequence
  Description of Artificial Sequence: Synthetic coding sequence
atgtccggcctccgcgtctactccacgtctgtgaccggcagccgcgaaattaaaagccagcagtctgaggtaaccaggattcttgatgggaagcgcattcaataccaactcgtggatatctcacaggacaacgccctacgggatgaaatgcgggcactcgctggcaatccaaaagcgactcctcctcagatcgttaatggcgaccagtactgcggagtgtgggccggagggcgaggcggaggcggatccgttggtagaggcctgtag

SEQ ID NO: 27990 - DNA, 933 bp, Artificial Sequence
  Description of Artificial Sequence: Synthetic coding sequence
atggacgggagcttcgtgcagcattccgtacgcgttctccaggaactcaataagcaacgagaaaaaggccaatactgcgacgctaccctggatgtcggtggattggtgtttaaggcccattggagcgtgttggcgtgctgcagtcactttttccagagcctgtatggcgatgggtctgggggatctgtggtgcttccagccggatttgcagagatcttcggcctgctgctggattttttttacacgggtcacctcgccctgaccagcggcaaccgtgatcaggtgctcctggcagccagggagcttagagtccccgaagctgttgaattgtgtcaaagttttaaacccaagacatccgtgggacaggcggctggcggacagtctggccttggaccgccagcatctcaaaacgtcaattcccacgtcaaagagcccgcaggactggaagaagaggaagtatcgagaacactcggcctggtacctcgtgaccaggagcctagagggtcccacagtccacagcggcctcagcttcacagcccggcacagagcgagggtcctagtagtctgtgcggtaagctcaaacaggccctaaagccatgcccgcttgaggataagaagccggaggactgtaaagtgcccccacggcctctcgaggccgaaggagcccagttgcagggaggatctaatgaatgggaagtggtggttcaggttgaggacgatggagacggcgactacatgtctgaacctgaggccgtgctcactcgtagaaagtctaacgtcatccgtaagccctgtgccgcagaacccgctttgagcgccggatcacttgccgctgagcccgctgaaaatcggaaaggaaccgccgttcccgtggagtgcccaacttgtcataagaagtttctttccaaatattacctgaaagtccacaattag

SEQ ID NO: 27991 - DNA, 600 bp, Artificial Sequence
  Description of Artificial Sequence: Synthetic coding sequence
atgtctagtggaaatgcaaagattgggcatcccgcaccaaatttcaaggctaccgccgtaatgcctgacggtcagttcaaagacatctccctctctgactacaaaggcaaatacgtcgtgtttttcttctatcccttggatttcacttttgtctgccccacagaaatcatagccttttccgaccgcgcagaggagttcaaaaaactaaactgccaggtgatcggcgcatcagtggatagccacttttgccacctggcctgggtgaacacgcccaagaaacaagggggtctgggacccatgaatattcctttggtcagcgacccgaaacgcaccattgcccaggactacggagtcctgaaagctgatgaaggcatatcctttcgtggcctgtttatcatagacgataagggcatcctgaggcagatcacggtcaatgacctgccagtcggccgatccgtcgatgaaaccctccgccttgtgcaggcctttcagttcaccgacaaacatggcgaggtgtgtccggcagggtggaagcctggcagcgacacaatcaagccagacgttcagaaaagtaaggagtacttttctaaacagaaatag

SEQ ID NO: 27992 - DNA, 513 bp, Artificial Sequence
  Description of Artificial Sequence: Synthetic coding sequence
atgtccgtggccggtggggaaatacgcggagacacaggaggtgaagataccgccgctccaggcagattctcctttagccctgaacctacacttgaggacatacgcaggcttcacgcagagttcgccgcagagcgtgactgggaacaatttcaccaacctagaaatctgctcttggccctggtcggagaggtgggcgagctggcggagctttttcagtggaagacagatggcgagcctggaccacagggatggagtccacgggagcgcgcagccctccaggaagagctttccgacgtgctcatttatctggttgcgcttgctgcaaggtgtcgagtggatctgccgctggccgtgctgagcaaaatggatattaaccggaggcgataccctgctcatcttgcacgcagtagttctagaaagtacacagagcttccacacggagccattagcgaggatcaggccgtgggccctgcggatattccgtgcgacagcacggggcagactagtacctag

SEQ ID NO: 27993 - DNA, 702 bp, Artificial Sequence
  Description of Artificial Sequence: Synthetic coding sequence
atgtccgctaagcgagcagaattgaaaaagacccacctgtcaaaaaactacaaagctgtatgcctggaattgaagccagaacctactaaaacttttgattataaagccgtgaaacaggagggtagattcaccaaagccggagtgacacaggatctcaaaaatgagctgcgggaagttagagaggagcttaaagagaagatggaggaaatcaagcagatcaaggatcttatggataaagactttgacaagttacatgaattcgtggagatcatgaaagagatgcagaaggacatggatgagaaaatggatatcctgatcaacacacagaaaaactataagctccctctaaggcgggcacccaaggagcagcaggagctgcgtttgatgggcaaaacccatcgggagcctcaactcaggcctaagaaaatggatggtgcctctggggtgaatggcgcaccttgtgcgctgcacaaaaagaccatggcaccccagaagaccaagcagggcagcctggatcctttgcaccactgcgggacatgttgcgaaaaatgtcttttatgcgctctgaagaataattacaacaggggtaacattccaagcgaagcttctggcctctataaagggggtgaggaacctgttaccacccagccatcagtgggacatgcagtccccgcacccaaatcgcagacagaaggaagatag

SEQ ID NO: 27994 - DNA, 2196 bp, Artificial Sequence
  Description of Artificial Sequence: Synthetic coding sequence
atgagcgtgacactgaccagcgtcaagagggtccagtcctctccgaatctcctcgccgcagggcgtgactcccagagccctgattccgcgtggcgctcatacaatgatggcaaccaggagacactgaacggagatgcaacctacagttcacttgctgccaaaggcttcagatcagtgcggccaaatctccaagacaaacgttcccccacgcagtcccaaatcaccgtgaatgggaacagcggaggtgctgtgtccccgatgagttactaccaacgcccttttagccctagcgcatatagtcttccggctagcctaaacagctcaattgttatgcagcacggaacttcactggactctacagacacgtacccacaacatgcacaatcccttgatggaactaccagcagcagcattccactctatcgatccagcgaagaagaaaaacgggtgaccgttatcaaggcccctcactatccaggtatcgggccagtggatgaatcaggcattccaacagccatccgtacaacagtagaccgcccaaaggattggtataaaaccatgttcaaacagattcacatggtccacaaacctgacgacgacactgatatgtacaataccccctatacctacaacgccggactctacaacccaccatatagcgcccagagccaccccgcagccaagacacagacataccgtccgctgtcaaagagccatagcgacaattctcctaatgcttttaaggatgcttcctcccccgtccctccccctcatgtcccacctcctgtccctcccctacggccacgggacaggtcatccacagagaaacacgattgggatccaccggacagaaaggtggacacacggaaatttcgctctgagccaagatccatatttgagtacgaaccgggaaaatcctcaatactccagcacgagcggccaccaccattgcccactaccccaactcccgtgccgcgagaacctggacgtaagcccctgtctagcagcaggctgggggaggttacaggtagcccatcgcctcctccgcgatccggagctcccacgccctctagccgggctccagcacttagcccaacacgaccccctaagaagcctctggattacgtacaggaccactcaagcggtgtgtttaatgaggccagtctgtatcaatcctccatcgaccgctccctggaaagacctatgagttctgcatctatggctagtgactttcggaaacgccgaaaatctgaaccggcagtcggccctcccagaggccttggcgaccagtccgcctcacggacgtcaccaggaagggtggaccttcctggatcatctacgaccctaaccaagagcttcacctccagtagcccatcttccccgagccgcgcaaaggacagagagtccccccgatcctactctagcacgctgactgacatgggacggagcgctccgcgagaacggcgaggaaccccggagaaggagaagctacccgctaaggcagtatatgatttcaaagcccaaacatctaaggagctttctttcaaaaagggtgataccgtatatatactccgcaagattgaccagaattggtacgaaggggagcaccatggcagagttggcattttccctatcagctacgtcgagaagctcactccaccagaaaaagcacagcctgccagacccccaccaccagcacagcctggtgagattggcgaggcaatcgccaaatataatttcaatgctgatactaatgtagagctgagcctcaggaagggagacagggtgatcctgctgaagagagtcgaccagaattggtatgaaggcaaaatcccaggcaccaaccgacagggtatctttccggtatcctatgttgaagtggttaagaaaaacaccaaaggagcggaggattatccagacccccctattccgcacagctactcttccgacagaatccacagtctctcctcaaacaaaccacagcgacctgtattcacccacgagaacatacaggggggaggggagccatttcaggccctttacaactacacacccaggaatgaggatgaacttgaattgcgggaatcagacgtgatcgacgttatggagaagtgcgatgacgggtggtttgttgggacttctcgtcgaaccaagttttttggaactttccctgggaattatgtcaagcggctgtag

SEQ ID NO: 27995 - DNA, 969 bp, Artificial Sequence
  Description of Artificial Sequence: Synthetic coding sequence
atgacgctggaggctatccggtatagccgtggaagtctccaaatcctagatcagctcctcctgcccaagcagagtagatatgaggcagtgggaagcgtgcatcaagcctgggaggccattcgggcaatgaaagtccgaggggctccagctatcgcactcgtgggctgcttatctctcgcagtcgagttacaggccggtgccggtggacccggtctagctgctctggtcgccttcgtgcgggacaaactgagcttcctcgtgaccgctcggccaacagcagtaaatatggcccgtgcagcgagagatctggcggacgtggccgctcgggaagcggagagggaaggggcaaccgaggaagcagttcgcgagcgtcgagagaccgaactatgcgaacattgggaggaacacaccaggcaaagggagctgcctcttcgcggacccctcggtggtactgttctcgaaacacggccatataaccagggagcacgactgaccgcattcgagctcgtctatgagcagattcccgctacccttataaccgattccatggtcgcagcggctatggcacaccggggagtgagcgctgtggtggtgggggctgatagggttgttgccaacggggacactgctaacaaggtgggaacgtatcagctggctattgtagccaagcaccacgggattccgttttacgtcgcagcacctagcagcagttgcgatctcagactagagaccggcaaggagattatcattgaagaaagaccaggccaggagctgaccgacgtgaacggcgtgcgaatcgcggctcccggaatcggcgtttggaatcctgccttcgatgtgacaccacatgatttgattacaggtggtattattactgaattgggagtgttcgctcctgaggaacttcggactgctctgaccactactatctcttccagagacggaaccctcgacggaccacagatgtag

SEQ ID NO: 27996 - DNA, 5168 bp, Artificial Sequence
  Description of Artificial Sequence: Synthetic coding sequence
atgggcaaccaggatggcaagctgaaacgtagcgccggagacgcactccacgagggaggcggaggcgctgaagacgctctgggccctcgcgacgtggaagcaacaaagaagggcagtggcggaaaaaaagctctggggaagcacggaaaagggggtgggggaggagggggtggcggagagagtggaaaaaagaagtccaaaagtgactccagagcgagcgtattttccaatctgaggataagaaagaacctgtcaaagggaaaaggcgcaggagggagcagggaagacgtgctggattcacaggcacttcaaacaggggagttagatagtgctcacagcctgcttacaaagactcccgacctttctttgtcagcagatgaagccggactatccgataccgaatgcgctgacccctttgaagttactggtccgggaggacctggccctgccgaagccagagtgggtggcaggcccattgccgaggatgtggagacggcagccggtgcccaggatgggcagcgaacctcctccggtagtgacacggacatatactccttccactcggctaccgaacaggaggacctcctcagcgacatccagcaagccattagactccagcaacagcagcaacagcaattacaacttcagctgcagcagcagcagcaacagcagcaactacaaggcgctgaagaacctgctgcaccaccaacagccgtgagccctcagcctggagcatttttgggcttggaccgtttcctcctgggaccctctggcggagcaggagaggctcccggtagccccgataccgagcaggccctgtccgccctgtctgatctgccggagagcctagccgctgagccgcgagaaccgcaacagcccccatcccccggagggcttccagtctccgaagctccaagcctgccagctgcgcagcctgctgccaaggacagtccctccagcaccgctttcccctttcctgaggcaggcccaggagaggaggcagccggtgcacctgttcgtggagctggcgacacagatgaagagggcgaggaagatgcctttgaggatgctccacgaggaagtcctggcgaagagtgggcgcctgaagttggggaggacgcacctcagcgcctgggagaggaacctgaggaggaggcccaggggccagatgcaccagctgccgctagtctacctggctcccctgcccctagtcaacggtgttttaaaccgtatccactcataacaccatgctacattaaaaccaccaccagacaactctcttcacctaatcactcccctagccagtcccctaaccaaagtccaagaataaaaagacggccagagccaagcctgtcacgcggttcgaggaccgctctcgctagcgtagccgctccagctaagaaacacagggcagatggcggtctggcagcgggactgagccgctcagcagactggaccgaggaacttggagctaggacaccaagagtcggaggcagcgcccatctgctggaaagaggagtagcctcggattctggcggaggcgtgtcccccgcactggctgcaaaagcttctggcgctcctgctgcagctgatgggttccagaacgtattcaccggacgaacgctgctggagaagttattttctcaacaggagaacggacctccagaagaagccgagaagttttgttcaaggattatagcaatggggctgctgctacccttttccgactgtttcagagagccttgtaaccagaatgcgcaaaccaatgccgcatcttttgatcaggaccagctgtatacctgggcagcggtgtctcagccgacccacagtttagactattcagagggtcagttccccaggagagtgccaagcatgggacccccttccaaacctcctgatgaagaacaccgattggaggatgccgagaccgaatcgcaaagcgctgtgtctgagactccgcaaaagagaagcgatgcggtccagaaggaagttgtcgatatgaaaagcgagggccaagccaccgtgatccagcaacttgagcagaccatcgaagatcttcgcacaaaaatcgctgaactagagcgacagtaccctgcccttgacacagaggtggcctctggacaccagggtctagagaacggcgtcactgcgtcgggcgatgtgtgcctggaagcgttgcgcctcgaggagaaagaggtgcgccaccatcgaatactggaagccaagtcgatacaaacgtccccaactgaggaggggggagtgctcactctacccccagtcgatggactgcccggacgacccccatgcccccctggcgcagagagtggcccacagactaagttttgctccgaaataagtcttattgtgtctccacggagaatatctgtccagctagacagtcaccagccaacccagtctatctctcagccacctccccctcctagcttactgtggagcgccggtcaaggccagcctggcagtcagccaccccatagcatcagtaccgaattccagacttctcacgagcactcggtgtccagcgcgttcaaaaacagttgtaacattccaagtccacccccactgccatgtaccgagtctagctcatccatgccaggtctgggtatggtcccacctccacctcctcccttgcctggtatgaccgtgccaactctgccctccaccgctatccctcagccacctcctctgcaggggaccgaaatgcttcctcctcctccccctcctctgccgggtgccggaatccccccaccacctcccctgccgggtgctgggatcctcccgctgccccctctcccaggcgcaggaattcccccacccccaccgctgcccggagccgctattcccccaccccctccgctcccgggagccggtatccccctgcccccaccccttccaggcgcaggaataccaccccctccaccactcccaggagccggtatccccccacctcccccactccctggagcagggatccctcctcccccaccactgcctggcgcagggattcccccaccccctccactcccgggagccggaattcctcctcctccaccactacccggtgcaggcatacccccacctccaccccttccaggagccggtatacctccccctcctcctctgccaggagcgggaattccaccccctcccccactcccaggagcagggatcccccctccgcctccgttgccaggcgctggaatcccaccaccgcctccacttccgggagccggaattccacctcctccacctctgcctggagctggaatcccacccccacctccactaccaggggtggggatcccgcctcctcctccactacccggagccggaattcctccccctccaccactgcctggcgctggcatacctccccctccacctctacccggagcaggaataccacctccccctcctctccccagagtcgggatccctcccccaccccctttgcccggtgcgggaattcccccacccccacccttgccaggtgccggtatccccccaccacctccgctgcccggtgtgggaatccctccgccaccgcctttacccggagttggcatacctcctccgccacccctgcccggagcaggaataccccctccccctcccctccctggtatgggaattccccctgccccagccccacccctgcctcccccaggtactggcataccaccccctcccttgttgcctgtatctggcccacccctgctgccgcaggtgggaagttccactctccctactccacaggtctgtgggttcctaccccctcctctccctagtggtttattcggcctgggtatgaatcaggataagggatccaggaaacagcccattgaaccgtgcagacccatgaagccattatactggacccggatccagctacactccaaaagagacagctctacaagcttgatctgggagaagattgaagagccctccattgattgtcacgagttcgaggagctcttcagtaaaaccgccgttaaggaaagaaaaaagccaattagtgatacaatcagcaagaccaaagccaagcaggtggtgaaactgttgagcaacaaaaggtctcaggcggtgggtattctcatgtctagccttcacctggatatgaaagacatccagcacgcagttgtcaatctcgataatagtgtggtggacctggaaaccctgcaggccctctacgagaatagagcacaaagtgacgaactagagaagatcgagaagcacggacgcagctcgaaagataaagaaaatgcaaagagcctcgacaaacctgagcaattcctctatgagctgtcactcatccctaatttcagtgaacgagtgttctgcattttgtttcaatcgaccttttctgaatccatctgtagcatacgcaggaagttagagctgttgcaaaagttatgcgagactctcaagaatggcccaggcgttatgcaggtgcttggtcttgttctggccttcggtaattatatgaacggtggaaataagacccggggacaagcagatggattcggcctggacattctacctaagctcaaagatgttaagtcttccgacaactccaggtccctgttgagttacattgttagctattacctgagaaattttgatgaagacgcaggaaaagagcagtgcctgtttcccctgcctgagccgcaggacctctttcaggctagccaaatgaagtttgaggatttccagaaggacctgcggaaactgaagaaggaccttaaagcgtgcgaagttgaagccggtaaagtctaccaggtttcaagcaaggagcatatgcagccctttaaggagaacatggaacagttcatcatccaggccaaaattgaccaggaggctgaggaaaactctctgactgagacacacaagtgctttctggagactacagcctacttttttatgaaaccaaagctgggcgagaaggaggtgtccccaaacgccttttttagcatttggcatgaattctcgtctgattttaaggatttttggaagaaagagaataaattgcttcttcaagagagggttaaagaggcggaagaagtctgccgacagaagaaaggaaagagtctgtacaagataaaaccacggcacgatagtgggatcaaagccaagatttcaatgaagactta

SEQ ID NO: 27997 - DNA, 3048 bp, Artificial Sequence
  Description of Artificial Sequence: Synthetic coding sequence
atgaccgtcagccagaaaggcggtccccagcctaccccttctccggcaggccctggtacacaactcggtcctatcaccggagaaatggacgaggccgacagcgcctttctgaaattcaaacaaaccgctgatgatagcctgagcctcaccagtcccaacactgaatcgatcttcgtggaggacccatatactgcgtccctgagatcagaaattgagtccgatggccatgagtttgaggccgaatcttggtcgctggcagtggacgcggcatacgcaaagaagcaaaaaagagaggttgttaaaaggcaggacgtcctgtatgaactgatgcagaccgaggtacatcacgttcggaccctcaagatcatgttaaaggtatatagcagggctctgcaggaggagctgcagttttcctcaaaagccatcggccgactcttcccctgtgctgatgacctgctggaaacccactcccattttctggccagattgaaggagcgcaggcaagagtcactagaggagggcagcgacagaaattatgtgatccaaaaaatcggagacctcctggtccagcaattctccggtgagaatggtgagaggatgaaggagaaatatggcgtgttttgttcagggcataatgaggcagtcagccactacaagttactacttcaacagaataagaagttccagaacctcattaaaaaaataggtaatttctccatagtcagaagattaggcgtgcaggagtgtatcctgcttgttactcaacggatcactaaatatcctgtgctggtggaaaggataatacaaaacacagaggccggaactgaggactatgaggatctgacccaggccttgaacctcattaaagacatcatctcacaggtcgacgcgaaggtgagcgaatgtgagaaagggcagagattgcgggaaatcgctgggaaaatggatctgaaatcctcatctaagctcaagaatggcctgactttcaggaaggaagacatgctgcagcgccagctgcacctcgagggtatgctttgttggaagactacctccggtaggctaaaggacatcttagctatactgctaaccgatgtgctgctgctactacaagagaaggaccagaagtacgtgtttgccagcgtggactccaaacctccagtgatctctctgcagaaactcatcgttcgggaagtggccaatgaagagaaggcaatgtttttgatttctgccagtttacagggcccagagatgtacgagatctatacttcaagcaaagaggatcgtaatgcatggatggcccatattcaacgcgcagtggaaagctgcccagatgaggaagagggtcccttcagtctgcccgaagaagaaagaaaagtggtggaagccagagccactagactccgagacttccaggaacggctgtccatgaaggaccagcttatagcccagtcactgctggaaaagcagcaaatttacctagaaatggccgagatggggggactggaagacctgcctcagcccaggggcctgttccggggtggagatccaagcgagaccctccaaggagaattgatcctgaaaagcgctatgagcgaaatcgagggtatacagtctctgatctgccggcagcttggctcagctaatgggcaggcggaagacggcggtagcagtactggccctcccaggagggctgaaactttcgccggttacgactgtaccaacagtccaactaaaaatggatctttcaaaaaaaaagtgtcttcaactgatcccaggccccgagattggcggggaccaccgaactcacccgatttaaagttgagcgattctgacattcctggcagctcggaggaatcaccacaagtggttgaagctccaggaaccgaatcggaccccagattgccaactgtgctcgaatcagagcttgtgcaaaggatccagactctgtcacaactgctactgaacttacaggcagtgatcgcacaccaagacagctacgtcgagacgcaacgtgctgcaatacaagagcgggagaaacagtttcgcctgcagagcaccagaggtaatcttcttttggagcaagagcgtcagcgaaactttgagaagcaaagggaggagcgggcagcactggaaaagctgcagagtcagctgaggcatgaacagcaaaggtgggagcgcgagcggcagtggcaacaccaggagctggagagggccggagctagacttcaggagcgcgagggagaggctagacaattgagagagaggttggagcaggaaagagctgaactggaacgccagagacaggcataccagcacgacctggagcgcctgcgagaggcccagagagcagtcgagagagaaagggagcgcctcgaactgttacgacgccttaagaagcagaatacagccccaggagctctaccacctgatacccttgctgaggctcagcccccatcgcaccccccttcctttaatggcgaaggcctggagggccctcgcgtttctatgttaccctctggcgtgggcccagagtacgcggaaaggcctgaagtggcccgtcgtgactcagcacctaccgaaaacagactggctaaatctgacgttccgatccaactcctgtctgctaccaaccaatttcagagacaggctgctgtgcagcaacagatcccaacaaaattggccgcatcaacaaagggaggaaaagacaaggggggaaagtctcgcggttcccagcggtgggaatccagcgcctcctttgatctcaaacagcaactgctcctaaataaactcatgggcaaggacgagagcactagccgcaaccgtcggtctctttcacccatccttcccggtagacattctccagctccgcctcccgaccccggtttccccgcaccttccccccctccagcggattcaccctccgaaggattttctctgaaggcaggtggcaccgccctgttaccaggtcccccagctccttcacccctgcctgccacgcctctcagcgccaaagaggatgctagcaaagaagacgtgatatttttctag

SEQ ID NO: 27998 - DNA, 2544 bp, Artificial Sequence
  Description of Artificial Sequence: Synthetic coding sequence
atggaagctctgggaccaggaggagacagggccagccccgcaagctcaacttcatctcttgacctttggcacctttcaatgcgcgcagattcagcctactcatccttcagcgccgcttctggtggcccagaacccagaactcagtcgcccggaaccgatctcctaccttacctggactgggattacgtgcgagttgtttgggggggacctggcccagccccaccagatgccgcactgtgtacttccccgagaccacgccctgcggtggctgcccgttcgggcccacagcctaccgaggttccaggtactcctggccctctgaacaggcaggctacaccacttctctacgctttggccgctgaagcagaggctgccgctcaggcagctgagccaccatcacctccggcaagccgggctgcttatagacagaggcttcagggcgctcagcgccgagtactacgtgaaacatcttttcaaagaaaagaactgagaatgagcctgcctgccaggctgaggcctactgttcccgctagacctccggcaactcaccctcgttcagccagcctgtcccatccagggggtgagggagagcccgctaggtcaagggcccctgcaccgggaacggcgggacgtggcccacttgccaaccaacagcggaagtggtgcttctccgagcccggtaagctggatcgagttggcagagggggtggcccagctcgcgagtgcctgggtgaggcatgctcatcgagcggactacccggtcctgagccattggaattccagcaccctgcattggccaagtttgaagatcatgaggtggggtggttacccgagacacagccccaggggtctatgaacctggattctggctctctaaagctcggcgatgcttttcggcctgcgtctaggtcccgcagcgcttccggagaagtactgggctcatggggcggatcaggaggcacaatcccaattgtgcaagcagtgccccagggcgcagagacaccacgaccgctgttccagacgaaacttagcagatttttgccccagaaggaagccgcagtaatgtatcccgcagagctccctcaaagcagccctgccgattctgagcagcgggtttctgaaacctgtatcgttccagcatggctgccatcactgccggacgaggtgtttctagaggaagctcctttggtgaggatgcgctcacctcctgacccacatgcatcccagggccctcccgcaagcgtgcacgcaagcgaccagccatacgggaccggcttgggtcagaggacaggccaggtcacagtgcccactgaataccccctgcacgaatgccctgggacggctggagctgacgactgctggcagggggtgaacggctcagtaggtatctcccgcccaaccagtcatacacctactggcaccgccaatgataacatccctaccatagatccaaccgggcttaccaccaaccctcccaccgctgcagaatccgatctgctaaaaccagtgccggcagacgccctgggcctctcgggcaatgatacccccggaccaagccataatactgccctggcacgtggaactggccagccaggcagcaggccaacatggccctcccagtgcctggaagaattggttcaggaattggctagattggaccctagtctttgtgacccactagccagtcagccttctcctgagcctcccctgggactgttggatgggctcatcccccttgcagaagtgagagctgccatgagaccagcctgcggcgaagccggagaagaagctgcaagtaccttcgagcccggaagttatcaattttcatttacccagttactcccagctccccgagaggaaacacggctggagaatccggcaacgcatcccgtactggatcaaccctgcggacaaggcctccccgctcctaataactccattcaggggaaaaaggttgaactcgcagcaagattacaaaaaatgctccaggacttacacacagagcaggagcgtctgcagggtgaagcccaggcctgggcaagacgccaagctgcattggaagccgctgtgcgtcaagcttgcgcaccacaggagctggaacgctttagtcggttcatggccgacctggaaagagtcttgggtctgttactgcttttggggagtagactggcaagagtgaggcgcgctctcgccagggctgcttcagacagcgatcctgacgagcagaggctccggttgctacaaaggcaggaggaagatgccaaggaattaaaagaacacgtcgcccgtcgagagagggcagtgcgcgaggttctcgttcgggctctccccgtagaggagttgcgggtgtactgtgcgcttttggcgggtaaggctgctgtgctcgcccagcagcgtaacctggatgagcgtattagactgttgcaggaccagttggacgcgatacgggatgatttgggacatcacgcccctagtccgagccccgcaagaccaccagggacatgccccccagtacaacctccttttccactcctacttacctag

SEQ ID NO: 27999 - DNA, 2502 bp, Artificial Sequence
  Description of Artificial Sequence: Synthetic coding sequence
atgaaatttacaaatactaaggttcagatgatgcagaacgtgcacctcgcgcctgagacggacgaggacgacttgtactccggatataacgattataatccaatatatgacatcgaagagctggagaatgacgccgcttttcagcaagcagttaggacctcccatggtcggaggcctccaatcacagcaaaaattagttcaaccgccgtcactcggcctatcgccactggctacggatccaaaaccagcctggcatcaagtatagggagaccgatgaccggcgctatccaggatggtgttacccgtcctatgactgcagtgcgcgctgcagggttcactaaagccgcactgagaggaagcgctttcgatccactctcccagtccaggggccctgcgtcaccattggaagccaaaaaaaaggacagccccgaggaaaaaatcaagcaactggagaaagaggtgaatgagctcgtcgaagagtcttgtatcgccaattcctgcggagatctgaagctggcactggaaaaagctaaagacgctggcagaaaggaaagagttttggtccggcaacgagagcaagttaccactccagagaacatcaacctcgacctcacatattctgttctgtttaatctggcttcacagtactccgtcaacgagatgtatgccgaagctctcaacacctatcaggttatcgttaagaataagatgttttctaacgctggtatcctgaagatgaacatggggaacatctacctcaagcagaggaactattctaaagctatcaaattctaccgcatggccttggaccaggtgccaagcgtgaataagcagatgcgcattaagattatgcaaaatattggtgtgacgtttatccaagcagggcaatactccgacgccataaactcctatgagcacattatgtccatggcacctaatcttaaagccggatataacctgacaatctgttattttgccatcggggaccgggaaaagatgaaaaaggcgttccagaaactcattacagtcccgctggaaatagatgaagacaagtacatttccccctccgacgaccctcacaccaacctcgtcactgaggcaattaaaaacgatcacttgcgccagatggaaagggagagaaaggcaatggcagaaaaatatattatgacgagcgctaagcttattgccccagtaattgagacaagttttgctgctggctacgactggtgcgttgaggttgtgaaagcctctcagtacgtggagcttgccaacgacttggaaatcaacaaagccgtgacttacctccgccaaaaagactacaatcaggctgtggagatcctgaaagtgctggaaaagaaagatagtagagtaaaaagtgcagccgctacaaatttgtccgctctttactacatggggaaagatttcgctcaggcaagctcgtatgccgatatcgccgtcaattccgacaggtacaatccagcggctttaacaaataaaggaaacacagtgtttgcaaacggggattacgagaaggcggcagagttctataaggaggccttgcggaatgattcctcctgcactgaggccctgtacaacatagggctcacctacgagaaattaaaccgtctggatgaggccctggactgcttcctcaagctccacgctattctgcgtaacagcgccgaagtgctgtaccagatcgcaaacatatatgagctgatggaaaaccctagtcaggccatcgagtggctgatgcaggtggtgtcagtgatcccgaccgatccccaggttctgtccaaattaggggaattatatgaccgggagggggataagtcacaggcttttcagtactattatgagtcttacagatacttcccctgcaacatagaagtcatcgaatggctgggggcttactacattgacactcagttctgggagaaagcaattcagtattttgagcgggcatcacttattcagcccacccaggtgaaatggcagctgatggtcgcctcctgttttcgaagaagcggcaactaccaaaaagccttagacacttacaaagacacacatcggaagtttccagaaaatgttgagtgcctccgtttcctggtcagactctgcaccgatctggggttgaaggatgctcaggaatacgctcgtaagctcaagaggttagagaagatgaaggagatacgcgagcagcgcatcaagtctgggagggacgggtccggtgggtctcgtggcaagcgcgaaggaagcgcctcaggcgactcaggccagaattactcagcatctagcaaaggagagcgtttatcagccaggctaagagcactcccgggtactaacgagccgtatgaatcttcaagcaacaaagagattgatgcaagctacgtagatcccctgggtccccagattgagaggcccaagacggcggctaaaaaacgaattgacgaggacgacttcgcagacgaagagctgggggatgatttattgccagagtag

SEQ ID NO: 28000 - DNA, 918 bp, Artificial Sequence
  Description of Artificial Sequence: Synthetic coding sequence
atggacttgtccggggttaagaaaaaaagtctcctcggagttaaggaaaataacaagaaaagctcaaccagagctccttcaccaaccaaacggaaagacaggtcggacgagaagagcaaagacagaagtaaagacaagggggcaaccaaagagagctccgaaaaagatagaggtagagacaagacaaggaagcggagatcagcttcaagcgggtcgtcctctacgaggagccgatcttccagcacctcaagcagcggatccagcaccagcacaggttcatccagtggaagctcatccagttccgcatcatcccgctctgggtcatcaagcaccagccgaagctcaagttcttcctcctcctcaggtagtccctctccatcaagacggaggcatgataaccgacgacgatctcggagtaaatccaagccccctaaaagagatgagaaagaacggaaacgcaggagcccatctcctaaacccacgaaagtgcatatcgggagactgaccagaaacgtcactaaagaccatataatggagatctttagcacttacgggaagatcaaaatgattgacatgcctgtggagaggatgcaccctcatttgtccaagggatatgcctatgtggagtttgagaacccagacgaagctgagaaagccctgaaacatatggacggcggtcagatcgacggccaagaaattacagctactgcggtgctcgcaccttggcctcgaccccctccgagacgcttcagcccccctcgacgaatgttgcctcctccacctatgtggcgccgaagtcctcctcgaatgcgcagaagatctcgttcgcctcggaggcgatccccagtccgccgaaggtcaagaagcccaggaaggcgaaggcaccgcagtagatcctcttcaaactcctccaggtag

SEQ ID NO: 28001 - DNA, 1119 bp, Artificial Sequence
  Description of Artificial Sequence: Synthetic coding sequence
atggacgtcctgtcccccctcagctttatcaaggtgtcacacgtgcgaatgcagggcatactgcttctggtgttcgccaaataccagcacctaccctacatacagatactgagcactaaatctacccctaccgggctgtttggttattggggtaacaaaggaggggtcaacatctgtctaaaactgtacggatattatgtgtcaatcattaactgccacttgccccctcacatatcaaacaattatcagaggctggaacacttcgatcgaatccttgaaatgcagaactgcgaaggccgagacattcctaacattctggaccatgacctgattatatggttcggggatatgaactttcggattgaggattttgggttacacttcgtgagagagagtattaagaatcgatgctacgggggtctctgggaaaaggaccagttgagcatagcaaaaaaacatgatcccctgctgcgcgagttccaagagggaaggctcctatttcctcccacgtacaaattcgataggaattccaatgattacgacacatcagagaaaaagagaaagccagcttggaccgaccgcatcctgtggcgcctcaaacgacagccttgcgccggacctgacaccccgatcccgcctgcatcccattttagcctctcattgaggggctacagctctcacatgacctacgggatcagcgaccataaacctgtatccggaacattcgacctggaactgaagcccctggtgtctgctcccctgattgttctaatgccagaggacctgtggacagtagagaacgacatgatggtatcttactcaagtacgtccgactttccaagttcaccatgggattggataggcctgtacaaggttggactccgcgacgtgaacgattacgtgagttatgcatgggtgggggatagcaaagtctcatgtagcgacaacttgaatcaggtgtacattgacatctctaacatacccaccaccgaagacgaattcctgctgtgctattattcaaatagcctccggagcgttgtgggtatcagccgcccttttcagatcccccctggctcactcagggaggatcctctgggggaagcgcagccgcagatttag

SEQ ID NO: 28002 - DNA, 1692 bp, Artificial Sequence
  Description of Artificial Sequence: Synthetic coding sequence
atgaggctggaccttgcttcgcttatgagcgctccaaagagtctgggttccgcttttaaatcctggcgactggacaaggcccctagtccgcagcacacattcccctccacaagcattcctggcatggcttttgcgctcctagctagtgtgccgcctgttttcggactgtacacgagtttctttcccgtcctcatttattctctcctgggcacaggcaggcacctctcgacaggcaccttcgccatattgtccctgatgacagggagtgccgtagaacgcttggtccccgaacccctagtgggcaacttgtcaggaattgagaaggagcagctggatgctcaaagagtaggcgtggcagctgcagtggctttcggtagcggagccctgatgttaggaatgtttgtgttacagttaggagtactaagcacgttcttgtcagagcctgtcgtgaaagcactgacatcaggcgctgcacttcatgtcctcctgagtcaactgccaagcctccttggacttagcctccccagacagatcggctgtttcagtctgttcaaaacactagcttccttgctgactgctctcccccgttcgagcccagcagaactgaccataagcgctttgtctctggccttattagtccccgtaaaggaactgaacgtcaggtttcgtgatcgcctgccgacacccatccccggagaagtagtgctggtcctgctcgcgagcgtgctatgttttacaagctctgtggacacacgctaccaagtccaaatcgtaggactgttgcctggtggcttcccccaacctttattgcctaacttggccgaactcccgcgaattctggctgacagtttgccaattgcactggtgtcgtttgccgtctctgcatcacttgcctctatacatgctgacaagtactcctacaccatcgattctaaccaggaatttctcgcccacggcgcatccaatctgatctcctctctgttcagctgttttccaaattcagcaaccttagcaacgacgaacctactggttgatgccggaggcaaaacccagctggcgggtttattcagctgcacggtcgtgctaagtgtgctgctttggttggggcctttcttctattatctgccaaaggcagtgctggcttgcatcaacatttcaagtatgaggcaggttttttgccagatgcaggaattacctcagctatggcatatatccagggtggattttcttcttcaggtaccgggactctgcatcttatcctatccaacacccctttacttcggtacccgtgggcagtttcggtgtaatctcgagtggcatctgggccttggcgagggggagaaggagacaagcaaacccgatggtcccatggtagcagtggccgagccagtgcgagtggtcgtgttggattttagtggcgtgacatttgcggatgcagctggggcacgcgaggtagtgcaagtgagagaaagattggcttcaaggtgccgggacgcgaggatcagacttttgctggctcagtgtaacgcacttgtccagggcacacttacaagagttggtctgctggaccgagttacccccgatcagctgttcgtgagcgtccaggatgccgcagcctacgccctaggctcgctgctccgaggctcatctactcggtcgggcagtcaagaggccctcgggtgcggaaaatag

SEQ ID NO: 28003 - DNA, 2892 bp, Artificial Sequence
  Description of Artificial Sequence: Synthetic coding sequence
atggccgagcgtggcggagccggagggggtccaggaggcgcaggaggcggatcagggcagaggggcagcggagtagcacagagccctcaacagccgccaccacagcaacaacagcagcaaccccctcaacaaccaacgcctcctaaattggctcaggctacttctagttcttccagcacttcggccgcagctgctagctcatcctcctcctctacatccacaagtatggcggtcgcggtggcaagtggctcagctcccccagggggtcccggtcctggtcgcacaccagcacctgtgcaaatgaacctttacgcaacttgggaggtggataggtccagttctagctgcgtgcctaggttattttccctgaccctgaagaagctggtgatgctgaaggagatggataaagacttgaacagcgtggtcattgcggtgaaactgcaaggatctaagcggatccttagaagcaacgaaatcgtactccccgctagcggcctcgtggaaaccgagctacagcttactttctccttgcagtatcctcacttcttgaagcgcgatgctaacaagctgcaaattatgctgcagagaagaaaacgctataagaatcggaccattctcggatataagaccttagcagtgggtctgattaacatggctgaggtaatgcaacaccctaatgagggggctctcgttctggggttacacagtaatgtaaaagacgtttccgtgcctgtggctgagatcaagatttattccctcagttctcagcccatagatcatgagggcataaagagcaaactctcggaccgatctccagacattgacaactatagcgaggaggaagaggagtcattcagctccgaacaggaggggtcagatgatccactccatgggcaggatctcttttatgaggacgaagatctaagaaaggtgaagaaaactagacgtaagttaacctctacttccgctatcacgcggcagcccaatatcaaacagaaattcgtggccctgctcaaacgctttaaggtgagcgacgaagtcggattcggcctggaacatgtgtccagggagcaaattcgtgaggtggaagaggaccttgatgaactctatgatagtcttgagatgtacaacccatccgacagcggaccagagatggaagagacagaatccatcctgtccacccctaagcctaaattaaagccattcttcgaggggatgtctcagtcctccagccagactgaaatcggctcgctcaacagtaagggttccctggggaaagacaccacttccccaatggagttggcagctctcgaaaaaataaagagcacatggatcaagaaccaggacgactcactgacggaaacggacacacttgaaatcacagatcaggatatgtttggcgacgcctctacatcgctggttgtgcccgagaaagtaaaaactccaatgaaaagtagcaagacagatctgcaggggtctgccagcccgtccaaggtggagggcgtgcacaccccaagacagaaacgtagcacccccttaaaagagcgccagctgtcaaaacccctgtccgagcgcaccaactctagcgattctgagcgtagccccgatctaggacacagcactcagattccgagaaaagtagtctatgaccagctgaaccaaattcttgtcagcgacgccgcattaccggaaaatgtgatcctggtgaacaccactgattggcaggggcagtacgtcgcagagttattgcaggatcagcgaaagccagtggtgtgtacttgttcgacggtggaggtgcaggcggtcctgagcgccctccttacaaggatacagcgatattgcaactgcaactcaagtatgccaagacccgttaaggttgcagcagtcggcggacaatcatatttgagttccattttaaggttctttgtcaagtcacttgctaacaagacctccgactggctcggttacatgcggtttttaatcatacctctggggtcccacccagttgccaagtatctcgggagtgtagactctaagtacagttcttcctttctcgacagtggctggagggacttgttctccaggagcgaacctcctgtctccgagcagttagatgtcgcaggccgagttatgcaatacgtcaatggtgctgccacgacacaccagctgccggtcgcagaagcaatgctaacctgtcgacacaaatttcctgatgaagacagctatcagaagtttatcccttttattggggtggtcaaggtgggcctcgtcgaggactctccaagcaccgcaggtgatggcgacgattcccccgttgtgagcctgaccgtcccaagtactagcccaccatcgagctcagggcttagccgcgacgccacagccacacccccatcaagcccttccatgtcctctgccctagccatcgtggggtctcctaatagcccctacggagatgtgatcgggctgcaggtggactattggttgggccaccccggtgaaagacggcgagagggcgataaaagagatgcctcttcgaaaaacacactcaagagcgtgttcaggagtgtacaggtgagccgacttccacatagtggggaagcccagctctctgggacaatggctatgaccgttgtcaccaaagagaaaaataagaaagtccctacaatttttctgtctaagaagccccgtgagaaagaagtcgattcgaagtctcaggtgatcgaagggatctcgaggctgatttgcagcgctaagcaacaacagacaatgttaagggtgagcatcgacggggtggagtggagtgatatcaaattttttcagctagcggcacagtggcctactcacgtcaaacattttccagtgggcctattctcaggatctaaagccacctag

SEQ ID NO: 28004 - DNA, 546 bp, Artificial Sequence
  Description of Artificial Sequence: Synthetic coding sequence
atggaggaaattccagcgcaggaagcagcgggaagtccaagagtgcaattccagagcctggagacgcagagcgagtgcctgagtcccgagccacagtttgtgcaagacacagacatggagcagggcttaaccggcgctcccccagtgccacaggtgcctgccttgcccagagaaggctctcctggcgaccaggctgctgctctgctgacagccaggtaccaggaattcgttaccttcgaagatgtggccgttcaccttacccgggaggagtggggatacttggatccagtgcagagggacctgtatagggaagtgatgctggagaattatgggaacgtggtgtctctgggtattctcctgcgattacctacaactagaattcacagcgtgaactcttgcccagctctgagccacacacaggcgagtgcatttagtggggagaccctagccgtattaacagccggtatttccaaacggtggccaaaataccggttacccatcgacattgcccgaccatgcagcgaaaccccatttcctagactttag

SEQ ID NO: 28005 - DNA, 1410 bp, Artificial Sequence
  Description of Artificial Sequence: Synthetic coding sequence
atggtgctcgagggtaaccccgaagtgggctcaccacgtaccagtgaccttcaacaccggggtaacaagggcagctgcgttttatcctcgcccggagaagacgcacagccaggcgaagaacccatcaagtacggagagctaatcgttctgggctgctgcgaggaaggcggagaagagaccgaggcccagcggggagaggtcacaggacccagggctcactcctgttataatggctgcctagcatccggggataagggcaggaggaggtctcgtttagctctgagcaggcggagccacgctaacggcgtgaagcccgatgtgatgcaccatatctccacgcctttagtcagcaaagcactctcaaataggggacaacacagtatcagctacacgctttcccggtcccattctgtgatcgtggagtatacacacgatagcgacacggatatgtttcagatcggcagatccacagagaatatgattgacttcgtagtcacagacaccagccccggaggaggcgcagctgaaggtccttctgcacaaagcaccatctctcggtatgcctgcaggatactctgtgatcggcgaccaccttacactgcgagaatatacgccgctggattcgatgcctcatctaacattttcctgggggaaagggcggctaagtggcgcacaccagacggtctgatggacggcctcacaacaaacggtgtcttggttatgcaccccgcagggggtttctcagaagattccgcacccggtgtgtggagggagatcagcgtgtgtggcaacgtatataccctgagggatagtaggtctgctcaacaaaggggaaaactggtggaaaacgaaagcaatgttcttcaggacggcagtttaatcgatctttgtggcgcaactctgctgtggagaactccagccggattattgagggcacccaccctcaagcagcttgaggcccagagacaagaagcaaatgccgcacgtccgcagtgtcccgtgggcctgagcacgctagctttcccttcaccagctcggggtaggactgcccctgacaaacagcaaccctgggtttatgtgcggtgtggtcacgtacatggctaccacggatgggggtgcaggcgcgagaggggcccacaggaaagggagtgtcctttgtgcaggcttgtggggccttacgtgcccttgtggcttggccaggaagcaggcctgtgtctagacccagggcctccctcacatgcctttgccccttgtggacatgtgtgctccgaaaaaacagcccgatactgggctcagacacctctcccccacggaacacatgcattccacgccgcttgtcccttctgcggtgcatggctcaccggagagcacgggtgtgtacggctcatctttcagggtcccctggactag

SEQ ID NO: 28006 - DNA, 3312 bp, Artificial Sequence
  Description of Artificial Sequence: Synthetic coding sequence
atggccggagcctctgtgaaagtggcagtgcgcgttagacctttcaatgcaagagagacgtcgcaggatgctaagtgtgtcgtcagcatgcaaggcaatactacatctataataaatcccaaacagtcaaaggatgcgccaaaaagttttacctttgattacagctattggtctcatacctcaacagaggacccgcagttcgcctcccagcagcaggtgtatagggacatcggagaggagatgttgttgcacgcctttgaaggatataatgtctgcatctttgcttatggacaaaccggtgctggcaagagctacacgatgatgggacgacaggagccaggacagcaaggcatcgtgcctcagctctgcgaagacctgttctcccgggtgagcgaaaaccagtccgcacaactctcttatagcgtggaggtaagctacatggaaatttactgcgagagagtccgtgacctgcttaacccaaaatcccggggtagcctgcgcgtccgggagcatccgattcttggcccttacgtccaggacctctctaagttggccgttacatcctatgccgacatagccgatttgatggattgcgggaataaggcacggactgtggccgcaacgaacatgaacgagacatcttctcggtcccacgccgtgttcacaattgttttcacgcagcgttgccacgatcagctgaccggcctggacagcgaaaaggtgagtaagatatcgctcgtggacctcgcaggatctgaacgggctgatagctctggtgcacgcggaatgcggttgaaagagggtgctaacatcaataagagcttgacaaccctcggcaaagtcattagcgcactcgcggacatgcagtctaaaaaacgcaagtcagacttcatcccttacagagacagtgttctgacctggttgctgaaggagaacctgggaggcaacagcagaactgccatgatcgctgcattaagtcccgctgatattaattatgaagagactttgtccacactaaggtacgccgatcggacgaaacagatacgctgcaatgccatcatcaatgaagacccgaacgcacgattaatcagggagctccaggaagaggtagcgagactgcgggagctgctgatggcccaaggtcttagtgcctcggcattagagggcttgaaaactgaagaaggaagtgtcagaggcgctctccccgctgtgagctctcccccagccccagtgagcccatcttcaccaaccacccataatggcgaactggaaccctctttcagccccaatactgagagtcagatcgggcctgaagaggccatggaacggctacaggagaccgaaaagataattgctgaactgaatgaaacttgggaggaaaagctccgtaagaccgaagcactcaggatggagagggaagctttactggcagagatgggggttgccgttcgtgaagacggcggaacggtgggtgtgttttctcctaaaaaaacaccacacctggttaacttgaacgaagaccccctgatgtctgaatgcttactttatcacatcaaggacggcgtgacgagagtcggacaggttgacatggacatcaaactgaccggccaattcatacgggagcagcactgcttattcagatcgatccctcagccggatggcgaggtcgtggtaactctggagccgtgtgaaggagccgaaacatacgttaatggaaagctggttacggagcctctggtattgaaaagtggtaataggatcgtcatggggaaaaatcacgtattccggtttaatcatccagaacaggcaaggctggagcgggagagaggtgtgccgccaccaccgggacccccttccgagccggtggattggaacttcgcacagaaggaactgttagaacagcagggcatcgacatcaaactggagatggaaaaacggcttcaggacttggagaaccaatatagaaaagagaaagaagaagccgatctgctccttgagcagcaacgcctctatgcagattccgacagtggagacgactccgataagcgctcatgcgaggagagctggcggctcatttctagcctgcgcgaacagctgcctcctacaacggtacagacgatcgtcaaacgctgcggcctgcctagctcaggcaagcgcagagcgcctagacgggtgtatcagattccgcagagacggcgactacagggcaaggaccctaggtgggctacgatggctgacctgaaaatgcaagcggtgaaggaaatttgttatgaggtggccctggccgactttaggcacggtagagccgagattgaggccctggccgcacttaaaatgcgagaactgtgcagaacctatgggaagcctgacggaccaggagatgcctggcgggctgtcgcaagagatgtatgggatacggtgggcgaagaggaaggcggaggcgcaggatccggaggtggtagtgaggagggcgctcggggagctgaggttgaagacttacgggcacacatcgacaaattaaccggtatcctccaagaggtcaaacttcagaacagttctaaagaccgcgaattgcaggccttgagagaccggatgctgagaatggaacgtgtgatcccactcgcccaggatcacgaggatgaaaacgaggagggcggagaagtgccctgggctcctcctgagggcagcgaggcagccgaagaggctgctccttccgatcgtatgcccagcgctcgccctccctctccccctctttcttcctgggagcgggtctccagactgatggaggaggatcctgcctttaggcgcggtcggctgcggtggttaaaacaggaacagctgcgtcttcagggcctgcagggcagtggcggacgaggcggaggccttagaaggcccccagcccgttttgtccctccacatgactgcaagctgcgtttcccattcaagagcaacccccagcaccgtgagtcatggcctgggatgggtagtggggaggcccctactccattgcaaccccctgaagaagttactcctcacccggctacacccgctaggagaccgccaagtccccgacggtcccaccacccacgtaggaattctcttgatggtggcggaagatcccgcggagccggatccgcccagcctgaacctcagcattttcagcccaagaagcataactcatatcctcagcctcctcaaccctacccggctcagagaccacctgggccaaggtaccccccatataccactccacccaggatgcgcagacaacgaagcgcacccgacctgaaagaatcaggcgcagccgtgtag

SEQ ID NO: 28007 - DNA, 1260 bp, Artificial Sequence
  Description of Artificial Sequence: Synthetic coding sequence
atggccgaacctgttggtaagcgcggacggtggagcggcggttcaggcgcaggacgaggcggacggggagggtggggtggcaggggaaggaggcccagagcccaacgctctccaagccggggaaccctcgatgtcgtttctgtggaccttgtgactgactctgatgaagaaatactggaggtcgcgacagctcgaggagcagctgatgaggtggaggttgagccaccagaacctccaggcccagtggccagccgtgacaactctaatagcgacagcgagggcgaagaccgtaggccggctggaccgcctcgggagcctgtcagacgtcgacgccgactggtgctggatccaggcgaagctcccctcgtccctgtttactcaggcaaggtaaagtcttccctgaggttgattcctgacgatctgtcgttgcttaagctctacccacccggagatgaagaagaagctgaattagccgacagtagcggcctctaccatgagggctccccatctccagggtctccatggaagaccaagctgcgcaccaaagacaaggaagagaagaaaaaaaccgaatttctggacttggacaactcaccactcagcccaccttcccccagaactaaatcccggacgcacacgagggcgcttaaaaagctgtccgaggtcaacaagcgtttgcaggacctccgcagctgtcttagtcccaagcctccacaaggccaggagcagcaaggtcaagaggatgaggtagtgctcgtagaaggccctaccctaccagagacaccaagactattccccttgaagattcgttgcagggccgatctggtaagattacctttgcggatgtcagaacccctgcaaagtgtcgtggaccatatggccacccatttgggcgtgagcccttctcggatcctcctactcttcggcgagaccgaactgagccctacagctaccccgagaaccttaaagctgggcgttgctgacattatcgactgtgtagtactgacatcatcacccgaagcaactgagaccagtcagcaattgcagctgagggtgcagggaaaggagaaacatcaaaccctcgaggtgtctctgagtcgtgattcaccattgaagacgttgatgagccattacgaggaagccatgggtctgtccgggaggaagctttccttttttttcgacggcacaaaactcagtgggagggagctccccgcagacctgggtatggaatccggggacctgattgaagtctggggttag

SEQ ID NO: 28008 - DNA, 384 bp, Artificial Sequence
  Description of Artificial Sequence: Synthetic coding sequence
atgcggccactcgatatagtggagcttgctgagccagaggaagtagaggtgttagaaccggaggaggacttcgagcagttcctcctgccagtcatcaacgagatgcgggaagacatcgcctcacttactagagaacacgggagagcatacctcaggaacagaagtaagttatgggaaatggacaacatgttgatccaaattaaaacccaggtggaagccagtgaggaaagcgctctgaatcatctgcagaaccccggagatgcagcagaaggacgggcagctaagagatgtgaaaaggcagaagaaaaagccaaggagatcgcaaaaatggcagagatgctggtggagctggtgcgtagaatcgagaagtctgaaagctcctag

SEQ ID NO: 28009 - DNA, 1263 bp, Artificial Sequence
  Description of Artificial Sequence: Synthetic coding sequence
atgcccctgcaagtttctgattactcttggcagcaaaccaagacggctgtttttctctctttaccactcaagggcgtgtgcgttcgagatactgatgtattctgtactgaaaactacctcaaggtgaactttcccccattcctgttcgaagcctttctttacgctcctatagatgacgagtcttctaaagctaaaatcggcaatgatacaatcgtcttcactctgtataagaaagaggctgccatgtgggaaacgctgtcagttaccggtgtagataaggaaatgatgcaaaggattagggagaaaagcatcttgcaggcacaggagagagctaaggaggctacggaggccaaagccgctgccaagcgggaggatcagaaatacgctctttccgttatgatgaagatcgaggaggaagagcgtaagaaaattgaagacatgaaagagaacgagaggatcaaggcaaccaaggctcttgaagcctggaaagaatatcagagaaaggccgaggagcagaagaagattcagcgggaggaaaagctgtgtcagaaggaaaagcaaatcaaggaggagaggaagaagattaagtataagagtctcactcgaaatctggcctctaggaacttagcccctaagggcagaaattccgaaaatatattcacagaaaaactgaaagaggactccatcccagcccctcgctccgtgggatcaattaagatcaattttaccccacgagtgttcccaaccgcattacgtgaaagccaagtggccgaggaagaagagtggctgcacaaacaggcagaggctaggcgagccatgaataccgacattgctgagctgtgtgacctcaaagaggaggaaaaaaatcccgagtggctgaaagacaagggaaacaagctgttcgcgaccgaaaattacctggcagctatcaatgcctataacctcgcgattaggctgaataacaaaatgccactgctctaccttaacagggccgcatgccatctaaagcttaagaacttacacaaagccatagaggacagcagtaaggccctcgaattgctgatgcccccagtaactgataacgccaacgctcggatgaaggcacatgtgcgaaggggcacggccttctgccagttggagctctatgtcgaaggattacaggattacgaagccgcactgaagattgatccatcaaataagattgttcagattgatgctgagaaaatccgtaacgtgatccaggggacggaactgaagagttag

SEQ ID NO: 28010 - DNA, 348 bp, Artificial Sequence
  Description of Artificial Sequence: Synthetic coding sequence
atgagatacgttgccagctatctcctggctgcgctgggtggaaatagctcaccgtctgcaaaggacatcaagaaaatcctggacagcgttgggatcgaagccgatgatgataggctgaataaagttataagcgaactgaatggaaagaatatcgaggatgtaatcgcacaggggattgggaagttagccagcgtcccagctgggggagccgtggctgtgtctgctgcccctggctccgcagcacctgccgcaggctctgccccagccgctgcagaggagaagaaagacgagaaaaaagaggagtctgaagaaagcgatgacgatatgggattcggccttttcgactag

SEQ ID NO: 28011 - DNA, 1233 bp, Artificial Sequence
  Description of Artificial Sequence: Synthetic coding sequence
ctcaacagggcctgcttctgtgtgacaggggtccccgaactcgaggtgatttgtgggcttcagcaggcagagtggcctcgcctcggccttagtcacctgggtgcagtcggcggaggatggggcggacttcccacgagtacatgggtgtctctacacacacaagaggtcgacctagcctcagaggtggcattagaagtagtgcggacagcggagcctggcgtgtggttggaggcacaggcacccgtcgccctggtagcccaaccagaaccactgcccgctaccgctggagtcaaacgcgagtctgtgggaatggaggtggccgtacttaccgacgatccactccctgtcgtcgaccaacagcaagtgctagcacggctgcaactgttagagcagcaagtagtgggaggagagcaggcaaagaataaagatttgaaggagaaacacaagcggcgtaagaggtacgccgacgaaagaagaaaacagctcgtagctgccctccagaactctgacgaggactccggagactgggtcttgctcaacgtctacgattccatccaggaggaggtcagagcgaagagtaaattactagagaagatgcagagaaagctgcgtgcagctgaggtggagataaaagatctccagtccgaattccagttggagaagatcgattacttagcaacgattcgcagacaagaaagggattctatgctcttacaacagctgctggaacaagtccagcctctaatcaggagggactgtaattactcaaatcttgaaaaaatcctgcgcgagagttgttgggatgaagataatggcttttggaaaattccccatcctgtcatcaccaaaacatccctgccagttgcggtaagcaccgggcctcagaataagccagcgagaaaaacttccgcggcagacaacggggagcccaatatggaagatgaccgataccgtctgatgctgtctaggtctaatagcgagaacatcgcaagcaactatttccgcagtaagcgggcaagtcaaatactttctacagacgcgcgaaagagcctaacacaccataacagcccacccggactctcttgtcccctgagcaataacagtgctatcccaccaacccaggcccctgaaatgccgcaacctcggccatttagattggaatccctcgacatacccttcacgaaagccaaaaggaaaaaaagcaagagcaatttcggatcagagccgctctag

SEQ ID NO: 28012 - DNA, 1353 bp, Artificial Sequence
  Description of Artificial Sequence: Synthetic coding sequence
atgcgggagtgcatcagtattcacgtcggacaggcgggtgtgcagatcggaaacgcttgttgggagttgtactgtctggagcacgggatacaaccggatgggcaaatgccctccgataagacaatcggcggaggcgatgactcatttaatacctttttttcagagaccggagcaggcaagcacgttccacgagccgtgtttgtggacctggagcctacagtcgtcgatgaagtgcgcaccggcacctaccgccagctttttcaccccgagcagctgataaccggaaaggaagatgcagccaacaattatgcacggggacattataccatcggaaaggaaattgtcgatctggttttggataggatcagaaagcttgccgacctctgcacaggtctccaggggtttttgatcttccacagcttcggcggaggcacaggaagcggatttgcttcactgctgatggaacgtctgagcgttgactacggtaaaaagagcaaactagaattcgctatttaccctgccccacaggtctctacggccgtagtggagccatacaattccattttgactacccatacaacactggaacactctgactgtgcctttatggtagacaatgaagccatttacgatatttgccgaagaaacctggatatcgaaaggccaacctacaccaacctgaaccgccttatcggtcagattgtctcctccattactgcgtccttgcgcttcgacggtgctctgaacgtagatctgacggagtttcagaccaatctcgtgccatatcctaggattcacttcccactggccacgtacgcaccggtgatatctgcggaaaaggcctaccacgaacagctgagcgtcgccgagattaccaacgcttgtttcgagccggcaaatcagatggtgaagtgcgacccccgacacggcaagtatatggcgtgttgtatgctgtatcggggtgatgtcgtgcccaaagatgtgaatgccgcaatcgccacaattaagaccaagagaactatccaattcgtggactggtgtcctactggctttaaagtgggcatcaactaccaacccccaaccgtggtgcctggcggtgacctggctaaagtgcaaagagccgtctgcatgctgagcaatacaaccgccatcgccgaagcttgggcgagactggatcacaaatttgatctgatgtacgcaaagagggcctttgtccactggtacgtaggcgagggaatggaggagggcgagttctcagaagcacgtgaggatttagctgctcttgagaaagattatgaggaagttggcgtggacagtgttgaagccgaggcagaggagggcgaagagtactag

SEQ ID NO: 28013 - DNA, 471 bp, Artificial Sequence
  Description of Artificial Sequence: Synthetic coding sequence
atgtccggaggactgcttaaagccctgagatcagactcctacgtggagctgtctcaatatcgcgaccagcatttcaggggcgataatgaggagcaggagaagctcttaaagaagagttgtacactctacgtggggaatctgtccttctacacaacagaggaacagatttacgaactatttagcaaatccggtgacatcaagaagatcattatgggcctggacaagatgaaaaagaccgcctgcggcttttgttttgttgagtactactcacgcgcagatgccgagaatgccatgagatatatcaacggcacgagactggatgataggattatacgcacggactgggacgccggatttaaagagggaagacaatacggcagaggacgctcaggaggccaggttagggacgaatatcggcaggattatgatgcgggaagagggggttatgggaaactcgctcagaatcagtag

SEQ ID NO: 28014 - DNA, 996 bp, Artificial Sequence
  Description of Artificial Sequence: Synthetic coding sequence
atgggaggagaacaggaggaggaacgctttgacggaatgctgttagcaatggcacagcagcatgaaggcggagtgcaagagcttgtgaatacgtttttttcatttctgcgaaggaaaacagacttcttcataggaggcgaggaaggaatggccgaaaagctcatcacgcagacctttagccatcacaatcaactggcccagaagactcgacgcgaaaagcgggcaagacaggaggccgagcggagagagaaagccgagcgtgccgctcggctcgctaaagaggccaagtccgagacttccggcccacagatcaaggaactgacagatgaggaggcagagcgactgcagctggagatagatcagaaaaaggacgccgagaaccacgaggcccaactgaagaatggctcccttgactccccagggaaacaggataccgaggaagacgaggaagaagatgaaaaggataagggtaaactcaagcccaatcttggtaacggcgctgacctaccaaactacaggtggacacaaacacttagcgagcttgatcttgccgtccctttttgcgtgaactttaggctgaaaggaaaagacatggtggtggatatccagcgacgtcacttgcgtgtgggcctaaagggccagccagccattattgacggcgaactgtataacgaggtgaaggttgaggagtcgtcctggctaatcgaggatggcaaagtcgtgacagttcacctggagaaaataaataagatggagtggtggtcaagactcgtctcaagcgatcccgagattaacaccaagaaaattaacccggagaactccaaactgtccgatctggacagcgaaacccgctctatggtcgagaagatgatgtacgatcagcgacaaaaatccatgggacttcctacctctgacgaacagaaaaaacaggaaatccttaagaagtttatggatcagcaccctgaaatggacttctcaaaggctaagtttaactag

SEQ ID NO: 28015 - DNA, 1860 bp, Artificial Sequence
  Description of Artificial Sequence: Synthetic coding sequence
atggccggaccaggggtgcccggtgccccagccgcaaggtggaagcgacacatcgtaagacagctgaggctgagggacaggacccagaaggccctattcctcgagctcgtcccggcttataatcatctcttagaaaaggctgaactgttggacaaattcagtaagaagctgcagcctgaaccaaatagcgtcaccccaacaactcaccaaggtccctgggaggaaagcgagttggacagcgatcaggtccccagcctcgttgctctgagggtgaagtggcaggaggaggaagaaggcttacgtttggtgtgcggtgagatggcctaccaggtggtagagaagggtgcagctcttggaactcttgagtcagaattgcagcaaaggcaaagccgcctggccgcactagaggcaagagtagcacagctccgggaagctcgcgcacagcaggcccagcaagtcgaggagtggcgcgctcagaatgccgtccagagagctgcctacgaggcccttagggctcatgtgggtttaagggaggccgcactgcgcaggctccaggaggaggcaagagacttgctggagaggcttgtgcagcgcaaagctcgcgcagccgctgagaggaacttgcgcaacgagcggagagaaagagctaagcaagcccgtgtatctcaggagctgaaaaaagctgctaagcgtactgtgagcatctcagagggtcccgatactctcggagacggcatgagggagagaagagagactttggcacttgccccagaacccgagccattagagaaggaggcatgtgaaaagtggaagcgacctttccgctccgctagcgccacatctctgacactgagtcactgcgttgacgtcgtgaaaggccttcttgattttaagaagaggcggggacactcaattggcggtgctccggaacagcggtaccaaattatacccgtgtgtgtggcagccagattgcctacaagggctcaagatgtcctcgacgcacacctctcagaagtcaatgctgtcagatttggcccaaactcgtctctgctggcaaccgggggtgccgacagactgattcatctctggaacgtagtggggtccaggctggaggctaaccagacacttgaaggcgcaggaggatccattacatctgtcgatttcgatccgagtggataccaagtgctcgccgcaacttataaccaggccgctcaactatggaaggtaggtgaggcccaatctaaggaaaccctgtcgggtcacaaagacaaggtgaccgccgcaaaatttaagttgacacggcatcaggcggtcaccgggagccgggatcgcacagtgaaggaatgggacctcggcagagcctactgcagcagaacaatcaatgtcctgtcctactgcaatgacgtcgtgtgcggtgaccacatcattatatctggccacaacgaccagaagatccggttttgggacagcagagggccacattgcacccaggtgatccctgtgcaaggaagagtcacttctctttctctgtcacacgaccaactgcacctactgagctgttctcgtgacaatacactgaaagtcattgatctgagagtaagcaacatcaggcaggtgttcagagccgacggattcaaatgtgggagcgactggaccaaagccgtgtttagtccagataggtcctacgccctggccggaagctgtgatggagctctgtatatttgggatgtggacactggcaaacttgagagccgcttgcagggacctcactgcgcggctgtcaatgctgttgcatggtgctatagtggttcccatatggtgtcagtggatcaagggagaaaggtcgtcctatggcagtag

SEQ ID NO: 28016 - DNA, 5048 bp, Artificial Sequence
  Description of Artificial Sequence: Synthetic coding sequence
atggaaggcaatggtaccgaaaattcctgtagccgtactcgcggatggttgcagcaggacaacgacgcaaaaccctggctctggaagtttagcaactgtttcagcaggcccgagcagacactgcctcactccccacagaccaaagaatacatggaaaataagaaagtggccgtggagcttaaggatgtgccatctccactgcatgcgggttccaaactctttccagccgtgccactaccggatattcggtcactgcagcagcccaagattcaactgtcctctgtgcctaaggtgagttgctgtgcacactgccccaacgagccctctacctcacctatgcggttcggaggcggaggcggtggttcagggggtacaagttctctgattcatccaggggcactccttgactctcaaagtacaaggaccatcacgtgccaggtgggcagcggttttgcattccagtccgcatctagcctccaaaatgccagtgcgagaaataacttagctggaattgcttcagacttccccagtatgtgcctcgaatccaatctgagttcgtgcaaacatctcccttgctgcgggaagcttcacttccagagctgtcacggtaatgtgcataaattgcatcagttcccatctttgcaaggctgcacctccgccggttacttcccttgttcagatttcacatcaggagcccctggccatctcgaagagcacatcagtcagtctgagctgacaccccatctttgtacgaatagcttacacctgaatgtggtaccccctgtgtgtctgaagggtagcttgtactgtgaggactgtctgaataagcccgctcgtaacagcatcatcgatgcagcaaaagtgtggcctaatattcctccgccaaatacacagcctgccccattggcagtgccactttgtaatggttgcggcaccaaggggacgggcaaggaaacaaccctgctgttggccacatccctcggtaaagcagcaagcaagttcggctcacctgaggtagctgtagcgggacaggtgttggagaatcttcccccaataggtgtgttctgggacattgagaattgcagcgtcccaagcggtcgctccgccactgccgtggtgcaaaggatccgggagaaattcttcaaagggcatagggaagcagagtttatctgcgtgtgtgacatttccaaagagaataaagaggtcattcaggagttgaacaactgccaggtgacggtggcacacattaatgccacagcaaagaatgctgcagatgataaactacgccagtcactgaggcggtttgcaaatactcatacggcgcctgctaccgtggtgttggtctcaacggatgtcaacttcgccctggaactctccgacctgcggcacaggcatgggtttcacatcattctggtgcataaaaaccaagcctctgaagcgctgcttcatcatgcaaacgagttaattaggtttgaggaattcatctccgatctgccacccagactaccgctaaagatgccacaatgtcatactttgttgtacgtctataaccttccagcaaataaagatggaaagtcagtgagcaatcgattaagaagactgtctgacaattgcggcggtaaagtcctcagtattaccggctgctccgcgatcctccggtttatcaaccaggattccgcagagagagcccaaaagcgcatggagaatgaagacgtctttggcaacagaatcatcgtgtcattcacacccaagaatcgggagctgtgcgaaaccaagagctctaatgccatcgcggacaaggtaaagtcacccaaaaagttgaaaaatcctaaactttgcctgataaaagatgcgagcgagcagagctctagcgccaaggctacaccagggaaggggtcgcaggctaatagcgggtccgccacaaagaatactaatgttaagtctctccaggaactgtgtcggatggagagcaaaacaggacatcggaacagcgagcatcagcagggtcatttgaggctcgtcgtcccaacacacgggaattccagcgcagccgtgtccaccccaaaaaacagcggagtggccgagccagtttataaaacatcacagaaaaaagaaaatctgtccgccaggtcagtaacttccagcccggttgagaagaaggacaaggaagagacggtgttccaggtctcgtaccccagcgcattcagcaagctggttgcatcgaggcaagtgtccccattgctcgcatcacagagttggagttcacgttccatgtcccctaaccttttaaatcgcgcatccccattggccttcaacatcgctaatagctcctcggaggcagactgtcccgacccattcgccaacggcgcagatgtccaagtctcaaatatagattatcggctcagtagaaaggaactgcagcagctgcttcaagaggcattcgctcgccatggcaaggtgaagagcgtggagttgagccctcacaccgactaccagctcaaggccgtggtgcagatggagaatctccaggatgccatcggtgctgtgaactccctgcatcggtataaaataggctctaaaaaaatcctggtgtcattggcaaccggagctgcgtccaagtcattgtctctgctgtcagctgaaaccatgtcagttttacaagatgcaccggcatgctgtctaccactcttcaaatttactgacatctatgagaagaaatttggacataagctgaatgtgtccgatctgtacaagcttactgacacagtggcgatccgagaacaggggaacgggagactcgtatgtctgctgccgagcagccaggctagacagtcaccactcgggagctcgcagtcccacgatggaagttccaccaactgttcccctattatttttgaagaattggagtaccatgaacctgtgtgtagacagcattgtagcaacaaggacttctctgagcacgagttcgatcccgattcttacaagatccccttcgtgatcctgtctctaaaaacttttgctcctcaggtgcacagcctcctgcaaacacatgagggcaccgtgcctctgttagacccttggctgctgagatctaagtctcccgtcggaaacccccagctgattcagttttctagagaagtgattgatcttctaaagtcacagccatcctgcgttatcccgatctcccactttattcctagctatcaccaccactttgcgaaacaatgtcgtgttagcgactatgggtacagtaaactgattgaactcttggaggcggtgcctcacgttttacagattctgggtatgggtagtaaacgcttactgaccctgacccaccgcgctcaagtgaagcgctttacacaggaccttctgaagttgcttaagtctcaggcaagtaagcaggttattgtgagagaattctcccaggcataccactggtgcttcagcaaggactgggatgttactgagtatggtgtgtgcgaactcattgatatcgtgtccgaaatcccggacactaccatttgcctaagccagcaggataatgaaatggtgatttgcataccgaagcgggaacgcacacaggacgagatagaacggaccaagcagttttctaaggatgtggtggacctgctgcgtcaccagccccacttccggatgccctttaacaagttcatcccttcttatcatcaccactttgggcgacagtgcaagcttgcttactacggctttaccaagctgcttgagttgtttgaggctattccagatacattacaagtgttggaatgcggcgaagaaaagatcctaacccttacagaagtagagcggttcaaggcgctggcagcgcagtttgtgaagttgctacgctcccaaaaggacaactgcctgatgatgacggatctgctcaccgaatacgcaaagacattcgggtacactttccgacttcaggactacgacgtgagctcaatctcagcactgacccagaagctgtgtcatgttgtgaaagtagctgacatcgaatcaggcaggcagatccagctgatcaatagaaaatctctccgcagcctgactgcacagctgctggttctcctgatgagctgggaggggactacccatttaagcgtagaagaactgaaaaggcactacgaatctacccataataccccccttaacccttgcgaatacggatttatgaccctcactgaacttctgaagtccctcccttatctagtcgaggtgttcaccaacgacaagatggaggaatgtgtgaaattaacttccctgtacctttttgcaaagaacgttaggtccctgctgcatacctatcactatcagcagatttttttacacgagttctccatggcctacaccaagtatgtgggcgagacgctccagccgaaaacttacgggcacagctctgttgaagagctgctgggggctattcctcaggtggtgtggataaaggggcatgggcacaagcgaattgtggtgctgaaaaatgacatgaagtcccgcctctcgtccttaagcctgagccctgcaaatcacgaaaaccagccttccgagggcgaacggatcctggaggtgcccgagtcacacaccgcttccgaacttaagctgggtgcagacggctcagggccttcccacactgagcaggagctcctgcgcctcacggacgatagcccggtcgatctactgtgtgctcctgtgccttcctgcctgccttcaccgcaactcagacccgatcctgtcatcctgcagtccgccgacctgattcagttcgaagagcggccacaggagccatccgaaatcatgatcctgaaccaagaagagaagatggaaatccctatacccggaaagagcaagacactcacctccgactctagtagtagctgtatctccgccgctgtgcccgtacctccatgcccaagctcagaaacttcagaatctctattatccaaagaccccgtggagtcgcctgccaaaaaacagccgaaaaatagagtcaagctggctgccaatttctctctcgccccaataactaagctgta

SEQ ID NO: 28017 - DNA, 735 bp, Artificial Sequence
  Description of Artificial Sequence: Synthetic coding sequence
ggtggtggatatgacctcaatctgtttgcgtcgcccccagacagtaacttcgtgtgtagcgtgtgccacggtgtgcttaagcggcctgccaggctgccctgctctcacatcttttgtaagaagtgtattcttcggtggctcgctcgtcagaaaacctgtccctgttgcagaaaggaagtgaagcgcaaaaaggttgtgcatatgaataaactgaggaagacaatcggacggttggaggtcaagtgcaagaacgcagacgccggttgtattgttacctgtccattggcccaccggaaggggcaccaagactcatgcccattcgagctgactgcttgccccaacgaaggctgcacatctcaggtacctaggggaactttagccgagcaccgccaacactgccagcaaggttcccaacagcggtgcccactcggatgcggcgctaccttagatcctgcggaaagagctcgccacaactgttatagggaactacataatgcgtggtctgtccgtcaagaacgcagacgaccactgttgctgtcactgttgagaagggtacggtggctcgaccaggccacctcagtagtgaggagagaactagctgagctgtccaactttcttgaagaggacacagctctcctggagggagcgccacaagaagaagctgaggcggctcctgaagggaacgtgggtgctgaggtagtcggagagccacgggcaaatattccctgcaaatag

SEQ ID NO: 28018 - DNA, 705 bp, Artificial Sequence
  Description of Artificial Sequence: Synthetic coding sequence
ttgccttgcaagcgctgtagaccttccgtgtacagtctgtcatacatcaaacgaggtaagacaaggaactacttgtaccctatatggtccccgtacgcatattacttgtactgctacaaatataggattacactgagagagaagatgcttccccgttgttataagtctattacctacaaagaggaagaggatctgaccttgcagccacggtcttgcctccaatgcgagtccttggtcggcctgcaggagggcaaaagtaccgaacaggggaaccacgatcagcttaaggaactatacagcgcgggtaacttgaccgtcctagcaactgacccacttctgcaccaagatcctgttcagctggatttccactttcggctgacttcccagacgtctgcacattggcacggcctcctgtgtgatcgaagactgtttcttgatataccataccaagctttggatcaggggaatcgcgagtctcttacagccacgctggagtacgtcgaggagaagacaaatgtagattcggtctttgttaattttcagaatgatagaaatgacagaggggcactcctcagggctttttcctatatgggatttgaagtggtccggccagaccacccagctctccccccacttgataacgtgattttcatggtgtaccctctggagcgggacgttggacatctgccttcggaaccgccttag

SEQ ID NO: 28019 - DNA, 2403 bp, Artificial Sequence
  Description of Artificial Sequence: Synthetic coding sequence
atggctgccgcagcgagcgttacaggaagggttacctgggccgcatcccctatgcgctcactcggcttgggacggaggctctccctgcccggacctcgcctcgatgctgtgacagccgctgtgaatcctagcctgtctgaccatgggaacggtctgggaaggggtacccggggatccgggtgttctggcggaagtctggtggctgattggggaggaggcgctgcagccgctgccgctgtggctctggctttggccccagctctgagtacgatgcgcaggggtagctctgagagcgaattggccgcacgctgggaggccgaggccgtcgcagcagctaaggccgctgcaaaagcagaagcagaagccacagccgaaaccgtggccgagcaggtacgggtggacgcaggcgctgcaggagagcccgaatgcaaggccggagaagagcagccaaaggttctggctccggctcccgcacagccgtcagcagctgaagaaggcaatactcaggtgttgcagcggcctccacctactctgcctccttctaagccaaagccagttcagggtttatgcccgcacgggaagccacgggacaagggaaggtcctgcaaacgttcaagtggacacgggtccggtgagaatggatcacagaggcccgtgactgtcgattcgagtaaagccagaacatcgcttgatgccctgaagatttcaattagacagctaaagtggaaagagttccccttcggacggcgactgccttgtgatatctactggcacggcgtctcttttcatgacaatgacatcttctccgggcaggtcaataaatttcctgggatgaccgaaatggtgagaaagattaccctctcgcgggcagtgagaaccatgcagaatctcttccctgaggagtacaatttctatccccgtagctggatcctgccggacgaattccagctgtttgtggcgcaggtacaaatggtcaaggacgacgaccctagctggaagcctaccttcatcgtcaaaccagatgggggatgtcagggtgacggcatttatcttattaaagatccaagcgacattagactggcgggaacactacagtcaagacccgctgtagttcaggaatatatatgcaaaccccttcttatagacaagctgaaatttgatattagattgtacgtgctgcttaagtcattggaccctctggagatttacatcgccaaagacgggttatcacgattttgcaccgagccctaccaggagccgacaccgaaaaaccttcaccgcatctttatgcacctgacgaattattcactgaacatccacagcgggaatttcatccattctgattcggcctctacgggatccaaacgaaccttcagctcaatactatgccgcctgtcttcaaagggcgtggacattaaaaaggtctggtccgacataattagtgttgtcattaaaaccgtgattgcattaacaccagaacttaaagtcttttatcaatccgacatccctactggcagaccaggacccacgtgtttccagatccttggcttcgatattttgctgatgaaaaacttgaaaccaattttactagaagttaatgccaaccccagcatgcgaatcgagcacgagcatgagttatcccccggtgtgttcgagaacgtaccttctctggtggatgaagaggtaaaggtggcagtcatcagagacacactgcgcctgatggacccactaaagaaaaagcgggagaatcagagccaacaactcgagaaacccttcgccggaaaagaagatgcactggatggggagctgacttccgcaccagattgcaacgccaatccagaggcccacttgccctctatctgtctaaaacaggtgttccctaagtacgcaaagcagtttaactacttgcggctcgtggaccgtatggcgaacctttttattcgatttctgggcatcaagggcaccatgaaactggggcctactgggtttcgcacctttatccgtagctgtaagctgtcatctagcagcctgagcatggccgctgtcgatatcctgtacattgacatcacacggagatggaactctatgactctggaccagcgagactccgggatgtgtctgcaggctttcgtggaggcgttcttcttcctcgcccaaaggaaattcaaaatgctgcccctgcacgagcaggtagcttctctgatcgacctgtgcgagtatcacctgtccctgttggatgaaaagagactcgtttgcggcaggggcgtccccagtggagggcgaccccctcaccgcggtcctccgcaggagccaagtccttccgcccaacccgctggcgacaacccccctcccagaacgtcttgtgctaacaaactgtcccacccaaggcacactctgagctag

SEQ ID NO: 28020 - DNA, 981 bp, Artificial Sequence
  Description of Artificial Sequence: Synthetic coding sequence
atgcgagaatgcatcagtattcacgtgggacaggctggagtgcagattggaaatgcttgttgggaactatattgtctggaacatggcatccagccggatggccaaatgccaagcgacaagactataggcggaggcgacgatagttttaacacattcttcagtgagactggagccggtaagcatgtaccgagagctgtcttcgtggacctggagcctaccgtgatcgatgaagtgaggacaggcacctacagacagctgttccaccctgagcagttgatcacgggaaaagaggatgccgctaataattacgccaggggccattacaccatagggaaagagataatcgatcttgttctggatagaatccgcaaactgaagagctttttcgcaacaaaaccacgcattcacttccccctggctacatatgccccagtgatcagcgctgagaaggcctatcatgagcagctcactgtcgctgagattactaatgcctgctttgagccggctaaccagatggttaaatgcgacccccgacacggcaaatacatggcatgctgcctgctatacaggggtgacgtggtgcctaaggacgtgaacgcggctatcgcgacaattaagaccaaaagaaccatacagtttgtcgactggtgtccaacaggcttcaaagtaggtattaactatcagccccctaccgtggtccccggaggtgatctggccaaggtccagcgggcagtgtgtatgctgagtaacaccactgcagtggctgaagcttgggctcgactagaccacaagttcgatctcatgcctctgagacgcattatgcgaagactcgagcagatcgtgctaacagaacggatgagagtgaaatctatcaatctttgtgcagtgctgttacattcctttgtgctcgagctttcctatttctgttccgtaaacgtttattgtcgcaaactgttaattaaattaaaattccccttttag

SEQ ID NO: 28021 - DNA, 1005 bp, Artificial Sequence
  Description of Artificial Sequence: Synthetic coding sequence
atggtcggcagagaaaaagagctctcaattcactttgtcccgggtagttgtagacttgtagaggaagaagtgaatattccgaatcgcagagtactggtgaccggcgcaaccggactcttggggagggccgttcacaaggagttccaacagaataactggcacgctgtggggtgtggctttagaagagccaggcccaaattcgagcaagtaaaccttttggactcgaatgccgtccatcacataatccacgatttccagccccatgtgatagtccattgcgccgcagagaggcgccctgatgtcgttgaaaatcagcctgatgccgcatcccagcttaatgtcgacgcatccgggaacctggccaaggaggctgcggctgtgggcgcatttctgatttacatctctagcgattacgtcttcgacgggaccaaccccccataccgtgaggaggacatcccagcacctttaaacctgtacggcaagaccaagctagacggtgaaaaggctgttctggagaacaacctaggcgcagctgttctgcgcattcccatcttgtacggcgaggttgagaagctcgaggaaagcgctgtaactgtgatgttcgacaaagtgcaattttctaacaagagcgcaaatatggatcactggcagcagagattcccaacacacgtgaaagatgttgcaacagtgtgccgccagctagcggagaagaggatgctggatcctagtatcaaggggacattccattggtcagggaacgaacagatgacaaaatacgagatggcttgtgctatcgccgatgcatttaatttgcccagtagccatctccgtcctatcacagatagtcccgtcctcggggctcaacgaccgagaaacgctcaactggattgttccaagctcgagaccctcgggattggccagagaactccttttaggatcgggataaaggaaagcttgtggccgttcctgattgacaaaaggtggcgtcagacagtgtttcactag

SEQ ID NO: 28022 - DNA, 513 bp, Artificial Sequence
  Description of Artificial Sequence: Synthetic coding sequence
atggcaagtgaagcagaaaagactttccacagatttgcggctttcggagaaagctcctcatccggcacagaaatgaataacaaaaattttagtaagctgtgcaaagactgcggaataatggacgggaaaaccgtgacctcgaccgacgtggacatagtattttccaaggttaaggccaaaaatgctcggaccattacctttcagcagtttaaagaagccgtgaaagaactgggccagaagagattcaagggtaagtctcccgatgaagtccttgaaaacatctacggcctaatggaggggaaggatccagccactacaggagctacgaaagcaaccactgtcggcgcagtcgataggctgaccgataccagcaagtacacaggcacacacaaggagcgcttcgacgagagtgggaaaggaaaagggatagctggcagggaagaaatgaccgataataccggctatgtctcaggatacaagggatccggaacttatgataagaaaaccaagtag

SEQ ID NO: 28023 - DNA, 3582 bp, Artificial Sequence
  Description of Artificial Sequence: Synthetic coding sequence
atgtggagagtgaaaaagctctccctgtcactctcgccgtcgcctcagacaggcaagccgtccatgaggacccccctgcgcgaactgaccttacaaccaggtgcactcactaatagcggaaaacgctctcctgcctgtagctcactgacacctagtctgtgcaaactcggccttcaggaaggctcaaacaactcaagccctgtggactttgtcaacaataaacggaccgaccttagctcagagcacttctcccactctagcaaatggctggaaacctgtcagcacgagtcagacgagcaacctcttgacccaattcctcagatctcaagcacacccaagacttccgaagaagctgtggatccactgggaaactatatggtgaagactattgtgctggtgcctagcccccttgggcaacagcaggacatgatcttcgaggccaggctggatactatggctgaaactaacagtatatcactgaacggtccactcaggacagatgatctcgtacgggaggaggtcgcaccatgtatgggagacagattttctgaggtcgctgccgtatcagaaaagcccattttccaggagtctccatctcacctcctcgaggaatcgccacccaatccatgttcagagcagttacactgctccaaggagtctttaagttcacgaactgaagccgtgcgcgaggacctagtgccctccgagagtaatgcattcctgccatcatccgtcttgtggcttagtccgagcaccgccctggctgccgattttagggtgaatcatgtcgatcccgaagaagagatcgtcgaacacggcgctatggaagaacgcgaaatgcgctttcccacgcacccaaaggaaagtgagaccgaagatcaggcactggtaagctctgtggaagatattctgtctacatgcctgacaccaaacttggtagagatggagtctcaagaagctcctgggcctgccgttgaggatgtcggcagaattctaggttcagacaccgagagctggatgagcccccttgcctggctggagaaaggagtgaacacctcagtgatgctggagaatctgagacagagcttgagcttgccgagtatgctaagagacgcagctattggcactaccccgttcagcacttgcagcgttggaacctggtttacgcctagcgcgcctcaggagaagtccactaatacctcccagaccgggttggtgggaactaagcactcaacttctgagaccgagcagctgctgtgcggcaggcctcccgatctcacagcgttgagccgtcatgatctagaagacaatctcttgtcttccctggttatcctcgaagtactgtcccgccagcttagagattggaaatcccagctggccgtaccccatccggaaacccaggactctagcacacagacggacaccagccacagtggcatcaccaataaattacagcacttaaaagagagccacgaaatgggccaggcgcttcagcaggcacgcaacgtgatgcagagctgggtcttaatcagcaaagagctcatttccttgctgcacctgagtctgctgcacctcgaggaggataagaccaccgtgtctcaggagtcacgtcgcgcagagactctggtttgttgttgctttgatctcctaaagaaactgagagccaagctccagagtttgaaagctgaacgggaagaagccagacaccgcgaagaaatggctctgcgcggaaaggacgcagccgaaattgtcctggaggctttctgtgctcatgcctcccagcggatctctcagttggagcaggacttagcatcaatgcgggagttcaggggccttctcaaggacgcacagacccagttggtgggtctgcatgccaaacaggaggagctggtccagcaaaccgtatccttgaccagtactttacagcaggactggagatctatgcagttagattatactacgtggactgctctcttgtcccgctctcggcagctaacggagaagttgacagtaaagtctcagcaggcactccaggaacgagacgtggcgattgaagagaagcaagaggtgtcacgggtgcttgaacaggtgagcgcacagttagaggaatgcaaaggccaaacagaacaattagaacttgagaacagtcgcctggcaaccgatttgcgcgctcagctgcagatcctcgcgaatatggactctcaactcaaagagttgcaatctcagcacactcactgtgcacaggatcttgccatgaaggatgaactattgtgtcagctgacccagtcaaacgaggagcaagctgcccagtggcagaaggaagaaatggcactcaagcatatgcaggccgaactccaacagcagcaggccgttctcgccaaggaagtgagagatctcaaggagaccctcgaattcgctgaccaggagaaccaggtggcacacctcgagctcgggcaggtggaatgccagctgaagaccactctggaggtgctgagagaaaggagcctgcagtgcgaaaacctcaaggacactgtagaaaacttgaccgccaaactagcctccacaatcgcagacaaccaggagcaggatctggagaagacccgacagtactcccagaaactgggcctgctaaccgagcagttgcagtccctcaccctttttctgcaaaccaaactcaaggagaaaaccgaacaagaaacactcctcttgagcacggcctgtcctccaactcaggaacatccactccctaatgataggaccttcctcggttcaatccttacagctgtggccgacgaagaaccagagtctacccctgtgccacttttgggcagcgacaaaagtgctttcactcgcgtcgcctccatggtgagcttacaaccggctgaaacacccggaatggaggagtcactggccgagatgtcaatcatgaccactgaactgcaatcactttgttcgctactgcaggaatccaaggaggaggcaatccgaacactgcagcggaagatctgtgaactccaggcgcgactgcaagctcaagaagagcagcaccaagaggttcaaaaggctaaagaagctgacattgagaagctcaaccaggccttgtgtcttcggtataaaaatgagaaagagttgcaagaggtgatccagcaacagaacgaaaaaattctagaacagattgataagtccggcgagttaatcagcctaagagaagaggtgacccacttgacccgcagcctccgccgagccgaaacagagactaaagtgttgcaggaggcgttggctggccagctagactcaaactgccagcccatggcaaccaattggatccaggagaaggtgtggttaagccaggaggtggacaagctgcgcgtaatgtttcttgaaatgaaaaacgaaaaagaaaagcttatgataaaattccagagccaccgaaatattctcgaggagaacctacggcgtagcgacaaggaactggagaaactggacgatatcgtgcagcacatctataagactctgctttccattcccgaggtggtgcgcggatgtaaagaattgcagggtttgctagagttcctctcctag

SEQ ID NO: 28024 - DNA, 9140 bp, Artificial Sequence
  Description of Artificial Sequence: Synthetic coding sequence
atgcgcggacggcgaggcaggcctccaaaacaacctgcagcgcctgccgcagagagatgtgccccagctcctccaccccctcctcccccaccgaccagcggtcccattgggggactgcgctctcgacacagaggatcctccagagggagatgggcggctgcgcaagccgaggtggccccaaaaacccgcttatcttctccacgcggtggcagctcttccagacgtaagcctccccctccaccacctgctcccccttctaccagcgctccaggaagaggcggaagaggagggggaggcggtcgcaccgggggtggcggtgggggaggtcacctcgctaggaccacagccgctaggcgcgctgtcaacaaggtagtctacgatgaccacgagtctgaggaagaagaggaggaagaagatatggtctccgaggaagaagaagaggaggatggcgacgcagaggagacacaggatagcgaggacgatgaggaggatgagatggaggaggatgacgatgatagcgactatccggaagagatggaggatgacgatgacgatgcatcatattgcaccgagtctagctttaggagtcacagcacctattcctcaacacctggtaggcggaagccgcgagtgcaccgacccagatcacccatactagaagaaaaagacattcctccactcgagttcccgaagtcctccgaggacctgatggtgcccaacgaacacattatgaatgtgattgctatctacgaggtacttcgaaacttcggtacggtgctcaggctgtccccgttcagatttgaggacttttgtgcggcattagtgagccaagagcaatgtactttgatggcagagatgcacgtagtgctgttgaaggccgttctgagagaggaggatacaagcaataccacattcggcccagctgaccttaaagatagcgtaaacagtacattgtacttcatcgacggaatgacctggcctgaagtgctccgtgtatactgtgaatctgacaaggagtaccaccatgtgctgccatatcaggaggccgaggactatccctatggacccgtggaaaataaaattaaggttcttcagtttctggtcgaccagtttctgactaccaatatagcccgtgaggaactgatgagtgaaggggtgatccagtatgatgaccactgcagagtatgccacaaattgggggacttactatgctgtgaaacctgcagcgcagtctaccacctggagtgtgttaaaccgcctctcgaggaggtgcccgaggatgagtggcagtgtgaggtgtgcgtggcacataaagtgcccggagtaacagactgtgtcgctgaaattcagaagaacaagccatatattagacatgaacctattggctatgaccgttccaggcgcaagtactggttcctgaacagaaggttgattattgaggaggatacagagaatgagaatgagaaaaagatctggtattacagtactaaagtgcagctcgcagaactcattgactgcctggacaaagactactgggaagccgaactgtgcaagattcttgaagaaatgcgagaggaaattcaccgacacatggacatcaccgaggatttaacaaacaaagcaagggggtctaataaatcctttctggccgctgctaatgaggagatcctggagtctatcagggccaaaaagggagacattgataacgtgaaaagcccggaagagactgagaaagataagaatgagaccgagaatgatagcaaggatgctgaaaagaaccgggaagagtttgaagaccagtcccttgagaaggattccgatgataaaaccccagacgacgatcctgaacaggggaagtccgaggaacctacagaggtcggcgataaagggaacagtgtttccgcaaaccttggggacaatacaacaaatgctaccagcgaagagactagtccttccgaagggagatctccagtgggctgcctgagcgaaaccccagactcgagtaatatggcagagaagaaggttgcgtctgagctccctcaggatgtccccgaagaacccaataagacgtgcgagtcctcaaacacatcagctactacgacttcaattcaacccaatctggaaaattcaaactcttctagtgagttgaattccagtcagtcagagtcggctaaggcggcagacgaccctgagaacggagagcgggagagccatactccagtgtccattcaggaggagattgtcggcgattttaagagcgagaaatccaacggcgagctgagcgagagtcctggcgctggaaaaggcgcaagtggctccaccaggattatcactcgcctgcgaaacccggattcaaagctgtctcagctcaagtctcagcaggttgccgcagcagcccacgaagctaataaactgttcaaggaaggaaaggaagttttagtagtcaattcacagggagagataagcagattgagcaccaaaaaggaggttataatgaagggaaatattaataattattttaagcttggccaggaggggaagtaccgggtgtaccacaaccaatactccaccaattcattcgccctcaacaagcatcagcacagggaagaccacgataaacggagacatcttgctcataagttctgtctgacccccgctggggagttcaagtggaatggctctgtccacggtagtaaagtgctgacaatatctacattgagacttaccatcacacagttagagaacaacattccctcaagcttccttcatcctaactgggcaagccaccgggctaactggattaaggcagtgcagatgtgctctaagccacgcgaattcgccttggccctggctattttagagtgcgccgtcaaaccggtggtgatgctgccaatatggcgggagagccttgggcatacccgcctgcatagaatgaccagcatcgagagggaagagaaggaaaaggtgaagaagaaggagaagaaacaggaggaggaagagaccatgcagcaagccacttgggtgaaatataccttcccggtcaaacatcaggtgtggaagcagaaaggggaggagtatcgcgttaccggctacggcggatggtcttggatatctaaaacccacgtctatcgattcgtgccaaagcttcctggtaacactaatgtaaactatagaaaatctctggagggaaccaagaataacatggacgagaatatggacgaatccgacaagagaaagtgcagtcggtcccccaagaaaattaagatagaaccagactctgagaaggacgaagttaagggaagcgatgccgctaagggcgcagatcagaatgaaatggacatctcaaagataaccgaaaaaaaggatcaagatgtcaaagagctactggacagtgactccgacaaaccttgtaaggaggagcctatggaggtggacgatgatatgaaaactgaatcacatgtgaactgtcaggaatccagccaggtggacgtagttaatgtatctgagggcttccatctcagaactagctataagaaaaaaaccaagtccagtaagcttgacgggctgctggagagacgcatcaagcagttcacactcgaggagaagcagcggctcgaaaagatcaagttggagggcggaattaagggaatcggaaagaccagtacaaactcctcgaagaatttgagcgagtctcccgtgattaccaaggccaaggagggatgtcagtctgacagcatgaggcaggagcagtcacctaatgctaacaacgatcagcccgaggatctgattcaggggtgttccgaaagcgatagcagcgtcctccgaatgtcagatccctcccacaccacaaataagttgtaccccaaagaccgagtgcttgacgatgtgagcattaggagccctgaaaccaaatgtccaaaacagaattccatcgaaaatgatatcgaggaaaaagtgagcgacctggcctcccggggtcaagagcccagcaaaagcaaaactaaagggaatgatttctttatcgatgactccaaacttgcttctgcggacgacattggcaccctgatctgcaaaaacaagaaaccgctaatacaggaggaaagcgatacgatcgtgtcgtcttctaaatccgccctgcactcctcagtgcctaaatccacaaacgacagagatgcaacacccttgagtcgggcaatggactttgagggcaagcttgggtgtgattcagagtccaatagtactctcgaaaacagtagcgatacagtgagcattcaggactcatctgaggaggatatgatagttcaaaactctaatgaaagcatttctgagcagtttagaacacgggagcaggatgtcgaagtgttggaacctctaaagtgtgaattggtgtccggcgaatcaaccggaaactgtgaggaccggctgccggtgaagggaactgaggcaaacgggaagaagccttcccagcagaagaaacttgaggaacggcctgtgaacaaatgtagcgaccagatcaaattgaagaataccaccgacaagaagaacaacgaaaacagagaatccgaaaagaaaggccagcgcacatctacatttcagatcaacggcaaagataacaagccaaagatttatcttaagggagaatgcctgaaggagatatccgagtcgagagtcgtctccggtaatgttgaaccgaaggttaacaacatcaacaaaattattcctgaaaatgatattaagtctctcaccgtaaaagagagcgctatccggccattcatcaatggtgatgtcataatggaagattttaatgagcggaactcatccgagaccaagtcccatctgcttagttcctcggatgccgagggaaactaccgagattctctggaaaccctacccagtacgaaagagtctgattcaacccagacgaccactccatctgccagttgcccagagtccaatagtgtcaaccaagtggaagacatggaaatcgagacaagtgaggtgaagaaggttacctcctcccccatcacctccgaggaggagagtaacctttcaaacgactttatagatgaaaacgggttgccgatcaataaaaacgagaatgtgaatggcgaatccaaacggaaaactgtgattaccgaagtgacaactatgacatccaccgttgccacggagtcaaagacagtaattaaggtcgagaagggcgataaacagaccgtggtttcaagtaccgaaaactgcgccaagtcaactgttaccacaaccaccaccacagtgacaaagttgtctacacctagtactggagggtccgtcgatattatctcagtcaaggaacaatctaagaccgttgttactaccaccgtgactgatagcctgaccactactgggggtacccttgttacctcaatgaccgtgagtaaagagtattcaacccgcgataaagtcaaattgatgaagtttagtaggccaaaaaaaacacgatctggcactgcactgccaagttatcgcaagttcgtgactaagtccagtaaaaagtctatattcgtcctgccaaatgatgacctcaagaaattagctaggaaaggtggcatacgtgaagtcccttattttaattataacgcaaaacccgcactggacatttggccttatccctcccctaggcctacttttggcataacatggaggtaccgactccagactgtcaagagcctcgccggagtcagtttaatgctgagacttctttgggcatcccttcggtgggacgatatggccgctaaagctccgccaggcggaggtacaacccggaccgagactagtgagacggagatcaccactacagagattatcaaaagacgcgatgttggaccatacggcataaggtctgaatattgcataagaaagattatatgcccgatcggcgtccccgagacccccaaggagactcccaccccccagcgaaaaggcctgcgctcttcagctttgcggcctaagcggcctgagacccccaagcagacaggacccgtgattatcgagacctgggtggccgaagaggagttggagttgtgggagattcgagctttcgcagaaagagtagaaaaagaaaaggcgcaagcagtggagcagcaggccaagaagcggctcgagcagcaaaagcctaccgtcatcgctacttcgactactagccccaccagttctactacctctacgatctcccctgctcagaaggtcatggtggcacctattagcgggtccgtgacaacaggaaccaaaatggttctcactactaaagtggggtcaccagccacggttacctttcagcagaacaagaatttccaccagactttcgccacgtgggtcaagcagggacaatcgaattcaggtgtggtgcaagtgcagcagaaggtgctaggcatcatcccctccagcaccgggacctcacaacagactttcacctccttccagccacgaacagccacagtaaccatacgtccaaacacatcagggtcagggggaactacttctaattcacaagtgatcacagggccacagatcaggcctggtatgaccgtgattcggacaccactgcagcagtctacgctgggcaaagcaatcattagaaccccagtgatggtccaacccggagccccacaacaggtgatgacccaaatcatacgaggccagccagttagcacggccgtgtcggcccctaacacggtctcctctacacccggacagaagagcctcacctcggctactagtaccagcaacattcagtcctccgccagccagccccctaggccacaacagggccaggtcaagctcaccatggcacagctgacccaactcacccaaggacatgggggtaatcaggggctcactgtggttattcagggccagggtcagactacaggacaactgcagttgatcccccagggagtaacagtactccctggaccgggacagcagctgatgcaggctgctatgcccaacggtacggttcagaggtttctgtttacgcccctggccactaccgcgaccaccgcctcgaccacaacaacgacagtaagtacgactgcagccggtacaggcgaacaacggcagtcaaagctgagcccgcagatgcaagtacaccaagataaaacactaccacctgcgcaatccagtagcgtcggtccagcggaagctcaaccccagactgcacaacctagtgcacagccgcagccccagacacagcctcagtcgcccgctcaaccagaagtgcagacccaaccagaagtgcagactcagactaccgtgtcatcacatgtgccctcagaagcccagcctacccatgctcaaagcagcaagccccaagtggcagcccagtctcaaccccaatccaatgtgcaaggacagagtcccgtacgcgtgcagtctccctcacaaactcgaatcagacccagcacccccagccagctatctcctggacagcaaagccaagtgcaaacaacaactagccagcccattcctatccagccccacacgtcactgcagattccatcacaagggcagcctcagtctcagccccaggtacagtcctccacacaaaccttgtcaagcggtcagacccttaaccaggtcacagtctcttctccctcacgaccgcagcttcagattcaacagccccaacctcaggttattgccgtaccacagctccagcaacaagtccaggtgctcagtcagatacaatctcaagtggtggcccaaatacaggcccaacagtccggcgtaccacaacagatcaaactgcagctccctatccagatacagcagagttcggctgtgcagacgcaccagattcagaacgtcgtcaccgtacaggccgcatctgtgcaggagcagctgcagagagtacagcagttaagagatcaacagcagaagaagaagcagcaacagatcgagatcaagagagaacatacactgcaggcttccaatcaatctgagattatccagaagcaggttgtgatgaagcacaacgctgtcatagagcacttgaagcagaagaagagcatgacacccgctgaacgggaggagaaccagcgcatgattgtatgcaaccaggttatgaaatatattctggacaaaatcgacaaggaggagaaacaggccgcaaaaaagcggaagcgggaagagtccgttgagcagaagcgcagtaagcaaaacgcaacaaagctgtctgccctgttgttcaagcataaggagcagctgcgcgcagagatattgaaaaaacgggcattgctcgataaggaccttcagatcgaggtgcaggaagagttgaagagagatctcaaaataaagaaggaaaaagacctaatgcagctggcccaagctaccgccgtggcagccccatgccctcctgtgacaccggcacctccagctccgccagcccctcctccaagccccccaccgcctcccgcagtgcagcacaccggcctgttaagcaccccgacactcccggctgcaagccagaagcggaaaagagaagaagagaaggactcctcaagcaaaagtaaaaaaaaaaagatgatatctaccacatcaaaggaaaccaaaaaggatactaagttgtactgtatatgtaaaacaccttacgacgagagcaagttttatatcggttgcgatcgctgccagaattggtatcatggacggtgtgtcgggatcctgcagagcgaagcagagctaatagacgaatacgtttgtccgcaatgccagtcaactgaggacgccatgactgtgctgactccacttactgagaaggactatgaggggctgaagcgggtcctgcggtcactacaggcgcacaagatggcttggccgttcttagaaccagtggatccaaacgatgctcccgattattacggagtgatcaaagaacctatggatctcgctacaatggaggaaagggtgcaaaggaggtactacgaaaagctgactgaatttgtagcagacatgacaaagatctttgataattgtcggtactacaacccttctgactcccccttctatcaatgcgcagaggtcttggaaagctttttcgtccagaagttaaaagggtttaaagcttccagaagtcataacaataaactccagagcaccgcgtctta

SEQ ID NO: 28025 - DNA, 927 bp, Artificial Sequence
  Description of Artificial Sequence: Synthetic coding sequence
atggccagctctaatacagttctcatgagattagtggcttcagcctactccattgcccagaaggcaggcatgattgtgcgacgagtgatcgcggagggcgatctagggatcgtggaaaagacttgtgctacagacctccagactaaggctgaccgtctagctcagatgagcatttgctcgtccttggctcgtaagtttccaaagctgacaatcataggcgaggaggatttgccatcagaagaagtggaccaggaactgattgaggattcacagtgggaagaaatattgaagcagccgtgtccctcgcaatacagtgcaataaaagaggaagatctcgtggtttgggtggatccactcgacggcacaaaggaatacaccgaaggtcttttggacaatgtcactgtgttgatcggaatagcttacgaaggaaaagccatagccggtgtgatcaaccagccctattacaactacgaggcagggcctgacgctgttctcgggaggactatctggggggtgcttggattaggggcttttggatttcagttgaaagaggtgccagcaggaaagcatataattacgaccaccagaagtcatagcaataagctcgtgacagattgtgttgccgcaatgaaccctgacgctgttcttcgagtaggtggggcaggcaataaaattattcagctcatcgaaggcaaagcctctgcttacgtgttcgctagccctggctgtaaaaagtgggacacctgtgcccctgaggtgattctgcatgcggtcgggggaaagctgaccgacatccatgggaatgtccttcagtaccacaaagacgtcaagcacatgaacagtgcgggtgttctggcaaccttaagaaactatgactactatgcgtctcgggtccctgaatccataaagaatgccctggtgccatag

SEQ ID NO: 28026 - DNA, 1212 bp, Artificial Sequence
  Description of Artificial Sequence: Synthetic coding sequence
atgtcaggttccgatggaggcctggaggaggagcctgagctttccatcacactgactctcagaatgcttatgcacggcaaagaagtgggttctattatcggcaagaaaggcgagaccgtcaagcgtatccgcgagcagagtagtgcgcgaatcactatttccgagggctcttgccctgagcggattactacaatcacgggcagtaccgctgcagtgttccatgctgtttcaatgatcgctttcaaactggacgaagatctctgcgccgctccagcaaacggaggcaatgtctctcgcccacctgtgacactgaggctggtgattcccgctagtcaatgtgggtctctcattggaaaagccggaaccaagatcaaggagattagagaaacaactggcgctcaagtgcaggtcgccggagaccttcttcccaactctactgagcgagccgtgactgtttcaggagtacccgacgctatcatcctctgcgtgagacagatctgcgccgtgattcttgaaagccccccaaagggcgctacaatcccctaccacccttctctgagccttgggactgtccttctgtcagccaatcagggattttctgtgcagggtcagtacggtgccgttaccccagcggaagtcaccaagctgcagcagctgtcatcacacgctgtccctttcgctacgccgagcgttgtgccgggactggatcctggaacgcagacgagctctcaggaattcctcgtccccaacgacctgatcggctgtgtaatcggtcgccagggctcaaaaatatctgagatcagacagatgagtggcgcacacataaagataggaaatcaggcagagggagcaggagagcgccatgtgaccattacagggtcccctgtcagcatcgccctggcccaatatctgattaccgcgtgcctggaaactgctaaatctacctcaggtggtacccccagctctgctcccgctgatctgcccgctcctttttcacctcctctgacagcactcccaactgcccctcccggattactgggcactccgtatgccatcagtctgtccaacttcattggactaaagcccatgccctttttagcacttccacccgcttcccccggacccccaccgggactcgccgcttatactgctaaaatggctgccgctaatggcagcaaaaaggctgaacgacagaagttctcaccttactag

SEQ ID NO: 28027 - DNA, 654 bp, Artificial Sequence
  Description of Artificial Sequence: Synthetic coding sequence
atgtcttcaaaggtaagccgagacacactttacgaggcagttcgcgaagtgctgcacggaaatcagcgcaagcggcgtaaattcctggagaccgtggagctgcaaatctctctgaagaactacgatccccaaaaagataaacggttctcaggaaccgtgaggttgaaatccacccccaggcctaagttttcggtctgtgtcttgggagaccagcagcactgcgacgaagctaaagcggtcgatattccccacatggatattgaggcgctgaaaaaactcaataagaacaagaaacttgttaagaaactagccaaaaaatacgacgcctttctcgcctcagagtccctgattaagcagattcccagaatacttgggccaggccttaataaggcaggaaagtttcctagccttctcactcataacgaaaatatggtggcaaaagtggacgaggtgaagagtactatcaagttccagatgaagaaggtactctgtctggctgtcgccgtggggcacgtgaaaatgacagacgatgagcttgtgtataacatccatctcgccgtcaacttcctcgtcagtctgctcaagaagaattggcagaacgtgcgtgctctatatattaaaagcactatgggtaagccacagcgcctttattag

SEQ ID NO: 28028 - DNA, 3159 bp, Artificial Sequence
  Description of Artificial Sequence: Synthetic coding sequence
atggagggaagcgaaccggtggccgcacaccagggtgaagaggctagctgttcaagctggggcaccggcagcaccaataaaaaccttcctataatgagtacagcctcggttgagattgatgacgccttgtatagtcggcagagatacgtgctcggtgatacagcaatgcagaagatggccaaatctcatgtttttctgtctggcatggggggactcggcctggagattgccaagaatctagtgctcgctggaatcaaggcggtgacaattcacgatactgagaagtgccaagcttgggacctgggtaccaatttttttctcagtgaagacgatgtggtgaacaagaggaatcgggcagaggcggttctgaagcacattgctgaacttaatccgtatgttcacgtcacatcttccagcgttccctttaatgagaccacggacctgagctttctagataagtaccagtgtgtcgtcctgactgaaatgaaattacctttgcagaagaagatcaacgacttctgccggtcgcaatgtccccctatcaaattcatcagcgctgacgttcacggaatttggtctcgcctcttttgcgactttggagatgaattcgaggttctggacactaccggcgaggagcctaaagagatctttatttccaatattacccaggccaaccctggtatcgtgacctgtctggaaaatcaccctcataagttggaaacagggcagtttttgacttttcgagaaatcaacggaatgacaggcctgaatggctcaattcagcagatcaccgtgattagccccttcagcttctcgattggggacactactgaactcgagccctacctgcacgggggtattgccgtccaggttaagacaccaaaaaccgtgtttttcgagtcactcgaaaggcaactgaagcacccaaagtgccttattgtcgacttcagtaatccagaggccccattagagatacacacagcaatgttggcgcttgatcagttccaggagaagtatagtagaaagccaaacgttggttgtcagcaggactcagaagagctcctgaagttggccacaagcatttctgaaaccctagaggagaaacccgacgttaacgcggatatagtccactggctcagctggacagcccaggggtttctcagccctctcgccgctgctgtggggggtgtggcctcccaggaagtgctgaaagccgttacagggaagttttctcctctgtgccagtggctgtacctcgaagccgcagacatcgtcgagagcctagggaagccggagtgtgaagagtttttgcccagaggggaccgttacgacgctttgcgagcctgcatcggtgacaccctttgccagaaactgcagaatctgaatatatttctcgtgggctgcggcgctattggttgcgaaatgctcaaaaactttgcactcctgggcgttgggacatccaaagaaaaggggatgataaccgtcactgatcctgatcttattgaaaagtcaaacctcaatcgacagtttttgtttaggccacatcatatccagaaacctaagtcctatactgctgcggatgctaccctgaaaataaatagtcagataaaaatcgacgctcatttaaacaaggtctgccccactacagagacaatatataacgacgagttttacacgaagcaggacgtgatcattacggcgttggataacgtagaggccagaagatatgtcgatagcaggtgtttagcaaacctgcgccctctgcttgactctggcacgatgggcaccaagggccatacggaggtaattgtgccccacctcaccgaatcgtacaacagccatagggatcccccagaggaggaaatacctttctgtaccctgaaatcctttcctgctgcgattgagcatactatccagtgggcacgtgacaagtttgaaagctcattctcacacaaaccctctctattcaacaagttttggcagacttactctagcgccgaggaagttcttcagaagattcagtctggacatagtcttgagggctgttttcaggttatcaagctcctgtcccgcagacctagaaactggtcgcagtgcgtggaattggccaggctgaagttcgaaaaatacttcaatcacaaagccctgcagctgctacactgttttccgctcgatatcaggctcaaggacggttctctgttctggcagtcaccaaaaagaccaccctctcctattaagttcgacttgaacgagccgttgcacttgagctttctccagaacgcagcgaagttatatgccacagtttattgcattccttttgcagaagaggacttgagcgcggacgcattactaaacattcttagtgaagtgaaaatccaggagttcaagcctagcaacaaagtagtgcagaccgacgaaacagctagaaagccggatcatgtcccaatctcctctgaagacgagcggaacgccatttttcagttagaaaaagcaatcctgagcaacgaagccaccaagtccgatctgcaaatggccgtactgtcattcgaaaaggacgacgatcacaatggacacattgatttcataacagctgcatctaacctgcgcgcaaagatgtacagcattgagcctgccgaccgatttaagactaagagaatcgcaggcaagatcatccccgctatcgccaccactactgctaccgtatctggattggtcgcactcgaaatgattaaggtgactggcggatacccatttgaagcttacaagaattgctttctgaacctcgccattcccatagtggtttttacagaaaccaccgaggtgcgcaaaacaaaaattcgcaatgggatttcatttaccatctgggaccggtggaccgtgcatggcaaagaagattttacactgttggacttcattaatgccgtgaaggagaaatatgggatcgaaccaacaatggtagtgcaaggcgtgaaaatgctttacgtacccgtaatgccaggccatgccaaaagattgaagctcactatgcacaagttagtgaagcccacgaccgagaagaagtacgttgacctcacagtctctttcgctccagacattgacggtgatgaagatttgcccggaccaccggtccggtattacttttctcatgataccgactag

SEQ ID NO: 28029 - DNA, 1134 bp, Artificial Sequence
  Description of Artificial Sequence: Synthetic coding sequence
atgttaagactagtgcccaccggagcacgcgctattgttgacatgagctacgccagacattttcttgatttccagggctcagcgatccctcaggcaatgcaaaagttggttgtcacacgactgtctccgaattttagggaggcagtgaccctgtcacgagattgtccagtccctttacctggtgatggagacctgcttgtgcggaatcggtttgtgggcgtgaatgccagcgatattaattactcagccggaaggtacgacccgtcagtgaaaccgccattcgatattggatttgagggtattggtgaggttgttgccctggggctgtcagcatctgcacgctacacagtggggcaggctgtcgcatacatggcacccggtagctttgctgaatataccgtggttcctgccagcatagccacaccggtcccctccgtgaaaccagaatacctgacacttctcgtgagtggaacaactgcttacatatccttgaaggaactgggcggactgtccgagggcaagaaggtgctggtgacagccgcagccggtggtactggccagtttgcgatgcaactgtccaagaaggctaagtgccacgtgattggtacctgctcatctgatgagaaatcggccttcctcaaatccctcggatgcgatcgccctatcaattacaagactgagccagtgggaacggtcttgaagcaggaatacccagaaggcgtagacgtggtctacgagagtgtcggcggtgcgatgtttgatctcgctgttgacgctctggcaacgaagggacggcttatagttatcggattcataagcgggtaccagactccaacagggttaagccccgtgaaagctggaactctgcccgcaaagctgctgaaaaaaagtgcttcggtgcagggtttttttctgaatcattatctgagcaagtaccaggcggcaatgagtcacctgctggagatgtgcgtgtccggagatctcgtgtgcgaagtcgatttaggcgatcttagtcccgaagggagatttacagggctggaaagtatctttagagctgtgaattacatgtacatgggaaaaaataccgggaagattgttgtcgagctgccacatagcgtaaattcaaaactatag

SEQ ID NO: 28030 - DNA, 2538 bp, Artificial Sequence
  Description of Artificial Sequence: Synthetic coding sequence
atgtccaattctcggccacgctctcgccgtgacgctgggggaggagctggagcggctgggagagatgagctggtgtctaggagtctgcagtctgccgagcattgtcttggagtgcaggattttggcactgcctacgctcactacctgctggtgctatctctcgctccagaattgaaacatgacgtgaaggaaacgtttcagtacactctgtttcgctgggcagaggaactggatgcattaagcaggatccaagatctgctcgggtgctatgaacaggccttggagctgtttcctgacgacgaggtgatctgtaacagtatgggagaacacctgttccgtatggggttccgagatgaagcggctggatattttcacaaagccgtaaaacttaatcctgacttttccgacgccaaagaaaacttctacagagtggctaactggttagtggagagatggcacttcatcatgttaaacgacaccaaacgcaacacaatctacaatgccgcaatccagaaggcagtgtgtttaggatctaaaagtgtcctggacattggagccggtacaggaattttgagtatgttcgcaaagaaggctggcgcacactctgtgtacgcctgtgagctgagtaaaaccatgtatgagctcgcctgcgatgtggtggcagcgaataagatggaggcaggaatcaaactcctgcatacaaaaagcctggacatcgaaattcccaagcacataccagagcgagtatcccttgtcgttaccgaaacagtggacgccggactgtttggggaaggcattgtggagtctctcatccacgcctgggaacacttgttgctacagccaaagactaagggggaatcggcaaactgtgaaaagtacggtaaggtgataccagcatctgccgtgattttcggaatggcggtcgagtgcgccgagattcggcgtcaccatagggtgggcattaaagatatagcgggtatacatctgcccactaacgtgaaattccagtcccctgcttatagcagcgtggatacagaagagactatcgaaccctatacaaccgagaaaatgagcagggtcccaggcggatatctggcattaaccgagtgcttcgaaatcatgactgtggattttaataacctgcaagagctgaaaagcctcgcaaccaaaaagccggataaaatcggaatccctgtaattaaggagggcatactggatgctataatggtctggttcgtgcttcaattggacgatgagcacagtctttctactagtccttcagaggagacatgttgggaacaggccgtgtatcccgtgcaggacctggcggactactggataaagcccggagaccacgttatgatggaggtttcctgccaggattgctatctacgtattcagtctatcagcgtgttaggtctggaatgtgagatggacgtggccaaaagctttacccagaacaaagacctgttgagtttaggtaatgaggcggagctctgcagcgccctggctaatctacagacttctaaacctgatgcggtggaacagacttgcattctcgaatctacagagattgcactactcaataatatcccctaccacgaagggttcaagatggcgatgtctaaagttttgtcaagtctgacaccagagaaactgtatcaaaccatggatacacactgtcaaaacgaaatgtccagcggtaccgggcagtctaacacagttcagaacattctggagcctttctacgtcctggatgtttcagagggtttttcagtccttccagtgattgccggaacactgggacaggttaaaccgtacagctcagtggagaaggatcaacatagaattgccctagacctgatttctgaggccaaccacttccctaaagagaccctggagttttggctccggcacgtggaagacgagagcgctatgctccagcgacccaagtccgacaagctttggtccatcatcatcctcgatgtgatagagccctcaggcctgattcagcaggaaatcatggagaaagccgcaatttctcgatgtctactccagagtggagggaagattttcccacaatatgtcctaatgttcgggctgctcgtggaatcccagaccttgctggaagagaacgcagttcaaggaacagagcgcacccttggcctgaacatcgccccttttattaaccagttccaagtcccaattagggtgtttctggatctctctagcctgccttgtattccccttagcaaacccgtggaactgttgagattggatctcatgacgccatacctaaacacgagtaatcgagaggttaaagtgtacgtctgtaagtcaggccgtctaaccgcaatacccttctggtaccacatgtacctagacgaagagattcggctggatacatcgtcagaggcttcccactggaaacaggctgcagttgtgctcgacaatcctatccaggtggaaatgggcgaggaattagttctgtccattcagcatcataaaagcaacgtgtctatcactgttaaacagtag

SEQ ID NO: 28031 - DNA, 756 bp, Artificial Sequence
  Description of Artificial Sequence: Synthetic coding sequence
atggctgacctaacatctgtgttgacatctgtgatgttctctcctagctcaaaaatgttcattggtggtctttcctggcagacatcccccgactctcttagggattatttttctaaattcggggagatccgcgagtgcatggtgatgcgggacccaacaactaaaaggagtcggggtttcggattcgtcactttcgcagatccagcctccgtcgataaagtccttggtcagcctcatcacgaactggattctaaaaccattgaccccaaggtggcattccctcggagagcgcagccaaagatggttaccagaacaaagaagatatttgtgggcggactgagtgccaatactgtggtggaggatgtaaagcagtatttcgaacagttcggcaaggtcgaggacgctatgctgatgttcgacaagaccaccaatagacaccgaggctttggatttgtcacattcgagaatgaagatgtggtagaaaaggtatgcgagatccactttcatgagataaataacaaaatggttgaatgtaaaaaggcacaacccaaggaagtgatgtttcctcctgggacaagaggaagggccagaggcctcccttatactatggacgccttcatgttgggaatgggcatgctcggatatccgaattttgtggccacttatggcagggggtaccccggattcgctccgagctatggctaccaattcccagattatctgccagtgagccaggacattatttttataaactag

SEQ ID NO: 28032 - DNA, 510 bp, Artificial Sequence
  Description of Artificial Sequence: Synthetic coding sequence
atggctccgaagcgggcaaaaaggaggaccgtggagggtggttctagcagcgtattctccatgtttgaccagactcagatccaggagtttaaagaggccttcaccgtcatcgaccagaacagggacgggatcatcgataaagaggacctgagggatacgtttgccgctatgggtagacttaatgtgaaaaacgaggagttggacgcgatgatgaaagaggccagtggacctataaactttaccgtctttctgaccatgtttggagagaagcttaagggagccgatccagaagatgttataactggagcctttaaggtcctggaccctgaagggaaaggcacgataaagaagaaatttctggaggagctgctcacaacccagtgtgatcgtttttcccaagaggagattaagaacatgtgggccgcttttccaccggatgtaggaggcaatgttgactacaagaatatctgttatgtaattacacatggagatgccaaagatcaagaatag

SEQ ID NO: 28033 - DNA, 546 bp, Artificial Sequence
  Description of Artificial Sequence: Synthetic coding sequence
atggcaacagaacccgaagctgccgagccagtggttcccagcttagtggaccggtactttaccaggtggtacaagccagacgttaaagggaagttttgcgaggaccattgcattctgcagcactccaaccgcatatgtgttatcacattggcggaatcacatcccgttctgcagtctggaaaaaccattaagtccataagctaccagatttcgactaattgctcacgtcttcagaataaagtttcaggcaagtttaaaaggggcgctcagttcttgacagagctcgcacccttgtgtaagatttattgctcggacggcgaggaatacacagtgtcctcctgtgtgagggggagacttatggaagttaatgaaaatattcttcacaaaccttctattctccaggagaaaccgagtactgaaggctacatagctgtcgtcctccctaagttcgaggagagcaagtcaatcaccgaagggttgcttactcagaagcagtacgaggaagtgatggtcaagagaataaacgctacaactgccaccagctag

SEQ ID NO: 28034 - DNA, 2154 bp, Artificial Sequence
  Description of Artificial Sequence: Synthetic coding sequence
atggagctcagatgcgggggattactgttctcctccaggtttgattccggcaacctggcacacgtggagaaagttgagtcccttagctcagatggggaaggggtaggtggcggtgcaagtgctctgacttcagggatcgcatctagccctgactacgagtttaatgtctggacacgaccagattgtgcggagactgagttcgaaaacggaaacaggtcctggttctatttttccgtcaggggcggaatgcccggtaagttaattaaaatcaatattatgaacatgaataagcagtcaaagctgtactcccagggcatggcgcctttcgtgcgcactcttcccacaaggccaagatgggaaaggattcgagatcgtccaacctttgagatgaccgagacccagttcgtgctgtcattcgtacaccggtttgtggaaggacgcggagctaccacattttttgccttttgctaccccttctcttatagtgactgccaggaattgctgaatcagctagaccagcggttcccagaaaatcatcccactcatagttctcctcttgatactatttactaccatagggagctgttgtgctatagcctcgatggtctccgcgtggacttgttgactataacgagctgtcacggcctacgtgaagatagggaacccaggctggagcagctatttccagatacctcaacacctcggccttttagatttgccggaaagagaatctttttcctgagttcacgagtccatccaggggagaccccctcttccttcgttttcaatggctttcttgatttcatacttaggcctgatgacccacgagctcagacattaaggcgacttttcgtcttcaaacttattcccatgctgaatccagatggtgtggtcaggggccactaccgcacagacagtagaggagtaaatctgaaccgccagtatctgaagccagacgccgtgctgcaccccgcaatatatggggcaaaggccgtgcttctttatcaccacgtccattcccggttaaactctcagtcttcgtcagaacaccagccttccagctgcttgccgcctgacgctcccgtgtcagatctggagaaggctaataatctgcagaatgaagcacagtgtgggcatagcgctgacaggcataatgccgaagcctggaagcaaactgagccagctgagcaaaaacttaactccgtgtggattatgccccagcagtctgccggattggaggagtccgctccggacaccattccacccaaggagagcggggtcgcgtattatgtagacttgcacggtcacgcgagcaagcgaggatgctttatgtacggcaactcgttctccgatgaatcaactcaggtagagaatatgctctatccaaagctgatcagccttaattccgcgcatttcgacttccaaggctgtaatttctcagaaaagaatatgtatgccagagacaggcgagatggccaaagcaaggagggttccggaagggtagcaatatataaagcaagcggaatcattcactcctacaccctcgaatgcaattataacacaggaagatccgtcaacagtatcccagccgcttgtcacgataacggccgtgcctccccccctcccccacctgcctttccaagccgatacacagtggagctgttcgaacaggtgggcagagctatggcgattgcagcactggatatggccgagtgtaacccttggccccgaatcgtgctcagcgaacacagcagcctgacaaatcttcgtgcctggatgctgaaacatgtgagaaattctagaggcctgagttccactctgaacgttggagtgaacaagaagcgcggattgagaacaccgccaaagtcacataacggtttaccagtgagctgttccgagaacacgctgagcagagcccgaagcttttcaacaggcacctccgctggtggttcttcttctagtcagcagaattctccccaaatgaaaaatagtccaagcttcccttttcacgggtcccggcctgcagggctgccaggtctgggtagttcaacacagaaagtgacacacagagtgctagggcctgtacggggaaaaccagtgtgggaacccctgcagcacgtttttggttgtttgggccactgttggggaaaatag

SEQ ID NO: 28035 - DNA, 678 bp, Artificial Sequence
  Description of Artificial Sequence: Synthetic coding sequence
atggttatggccgaggggacagccgtgttgcgtcggaatcggcctgggaccaaggcacaagacttctataattggccggatgaatcatttgacgagatggacagtactctagctgttcagcagtatattcagcagaatatccgggcagattgctctaatattgacaagatcttagagcccccagagggacaggacgagggcgtctggaaatacgaacacctccggcagttctgcctcgaactaaacggacttgcagttaagctgcagagcgagtgtcaccccgatacttgcactcagatgactgcaactgagcagtggatcttcctgtgtgcagcacacaaaacacctaaagaatgccccgcaatagattacaccagacataccttggacggcgcagcttgtctgttaaactctaacaagtattttccgtccagggtgtcgataaaggagagctccgtagccaaactcggctccgtttgtcggagaatataccgaattttttcacacgcatacttccatcaccgccaaattttcgacgagtatgagaacgaaaccttcctctgccacaggttcaccaagtttgtgatgaagtataatctaatgagcaaagacaatctgattgttcctattttagaggaggaggttcagaacagtgtctctggggaatccgaggcttag

SEQ ID NO: 28036 - DNA, 1173 bp, Artificial Sequence
  Description of Artificial Sequence: Synthetic coding sequence
atggccgcacagaaggacctttgggacgccatcgtcattggagctggtattcagggctgcttcacagcttatcacctggctaaacataggaaacgtatcctcctcttggaacagtttttccttccccatagtagaggcagcagtcacggacagagccggatcatccggaaagcgtacctggaagacttttatacaaggatgatgcacgagtgttatcagatttgggcccagttggaacatgaagcaggtacccagctgcatagacagaccgggctcctccttctgggcatgaaagagaatcaagagctgaagacaatccaggccaatctttcccgccagagagttgagcaccagtgtctgtcatcagaggaactgaagcagagattcccaaacatcagactgccacgaggagaggtgggactgctagacaacagcgggggtgtgatctatgcttacaaagcattacgtgccctccaagatgccatccgccagctgggtggcattgttagagacggtgaaaaagtcgtagaaattaaccccggactactcgtcacagtgaagacaacgagcaggtcctaccaggccaaatctctcgtgatcaccgccggtccatggactaaccagctattgcgaccgctggggatagaaatgccactccagacacttcgcatcaatgtgtgctactggcgggagatggtcccgggaagttacggggtgagccaggcttttccctgcttcctgtggcttggcctgtgcccgcaccacatctacggcctgcctaccggcgaataccctggtctgatgaaggtgtcctaccatcatggcaaccatgctgatcccgaagagcgggattgccctacagcacggactgacattggagacgttcagatcctgagctccttcgtgagagaccacctccctgatctgaaaccagaacctgccgtaatcgagtcatgcatgtatacgaatacgcccgatgagcaattcatactcgaccgccatcctaaatacgataacatagtcatcggagccggatttagtggtcatggcttcaagttagcaccagtggttgggaaaatcctttatgagctgagcatgaaactgacgccatcttacgacctcgctcccttccggataagtagattcccgtcactcgggaaggctcacctgtag

SEQ ID NO: 28037 - DNA, 135 bp, Artificial Sequence
  Description of Artificial Sequence: Synthetic coding sequence
atgtccgacaaaccggatatggcggaaatcgagaaatttgacaaatccaagcttaaaaagaccgagatgcaagagaaaaatcctctcccctctaaagaaactatcgagcaagaaaagcaggccagcgaatcttag

SEQ ID NO: 28038 - DNA, 1323 bp, Artificial Sequence
  Description of Artificial Sequence: Synthetic coding sequence
atgcctatcccgcctcctccgcctcccccaccaggccctccacctccgccaactttccatcaggctaacactgagcaacctaagttgagtagagatgagcagagaggcaggggggcattgctgcaggacatttgtaaagggacaaaactgaagaaagtgaccaacatcaacgataggtccgctccaattctggagaaaccgaagggatcgtctggcggatacggatccgggggtgcggctctgcagcccaagggcggtctgttccagggcggagtgctgaagctcaggcccgtgggcgctaaagatggtagtgagaatctcgccggaaagcctgcattacagataccctcatcccgggcagccgctcctcgcccaccagttagtgctgccagcgggaggccacaggatgatacagactcttcccgcgctagtctgcccgagttaccccgaatgcagagaccgtccctccccgatctgtctcggcctaataccaccagtagtaccggcatgaaacattcttcaagtgcccctccaccccctccacctggacggagagccaatgctccacccactcctttgccaatgcatagtagtaaggccccagcttataatcgtgaaaagccgttgcctcccacgcccggacagagacttcatccagggagggagggacctccagcccctcctcctgtaaaaccacctcccagccccgtcaacattcgtactggaccttcagggcagtcactcgccccacctcctccgccttaccgccagccacccggagtgcctaatggaccatcctctccaaccaatgagtccgccccagagttaccacagcgtcacaactccttacaccgaaagaccccgggtcctgtgcgcggtctggctccgccacccccaacctccgcctctccatctctattgagcaataggccccctccacctgccagagatccaccatctagaggtgctgccccacctccgccacctcccgtcattcggaatggcgctcgagacgcgccacctccccctcccccttatagaatgcacgggagtgagccgccatcccgagggaagccacctccacccccatccagaacgccagccggacctcctccgccaccccctcctccacttagaaatgggcaccgcgactcaattactaccgtccgatcttttctcgacgacttcgagtctaaatactcgtttcatccagtggaggattttccagcccctgaggaatacaaacatttccagcgcatatacccgtcaaagacaaatagagcggctaggggcgcaccccctttgcctcctatactccgatag

SEQ ID NO: 28039 - DNA, 2703 bp, Artificial Sequence
  Description of Artificial Sequence: Synthetic coding sequence
atgaactatccgggtcggggtagccctcgctccccagagcacaatggtagggggggaggcggtggagcctgggagctcggcagcgacgcgcgtcccgcatttggaggaggcgtatgctgctttgagcacttacccggtggcgatccagacgatggtgacgtgcctctggcactcctgcggggagagcccggactccatctcgcaccgggaaccgatgaccacaaccaccatcttgctctggacccatgtctgtccgacgagaattacgatttttctagtgccgaaagcggctcatccctgaggtattactctgagggtgagtcagggggaggaggcagcagtttgtccctccatcccccacaacagcctccactggtgcctactaattcaggtggagggggagctacaggtgggagtcccggagagaggaagcgcacccgattgggtggtcccgctgcgaggcacaggtacgaagttgttaccgagctcggccctgaggaggtgcggtggttttacaaggaggataaaaagacctggaagccttttattggctacgattctctccggatagaattggcgtttaggacacttctgcagacaaccggtgctagaccccagggaggagatagagatggcgaccatgtttgctcacctacaggtccagcatcctcaagcggggaagacgacgacgaagatagagcatgtggattctgtcagagtactacaggtcacgaacctgaaatggtcgagttggtgaacattgaaccagtctgtgtcaggggtgggctgtatgaagttgatgttactcagggcgaatgctatccagtttattggaatcaggctgacaaaatccccgtcatgagagggcagtggtttatcgatggaacttggcaaccactggaagaggaagagtctaatttgattgagcaagagcacctcaattgctttagagggcagcagatgcaggaaaattttgacatagaggttagtaagagtatcgacggcaaagatgccgtgcactcattcaagttatcacggaatcatgtggactggcattccgtcgacgaggtttacctttattcagatgcaacgaccagcaagatcgcgcgtactgtcacacagaagctcggattttctaaagcatctagctccggaacgaggctgcaccgtggatatgtggaagaagcgacactggaggacaaaccaagtcaaaccactcatattgtattcgtggtacacggtattgggcagaaaatggaccagggtaggatcattaagaatacagcaatgatgcgtgaagccgctcgaaagattgaggaacgtcacttttcaaaccacgccacgcacgtagagttcctacccgttgaatggcgaagcaaactgactctggacggggacacagttgactcaattacccccgataaagttcgcggtctgagggacatgttgaactccagtgccatggatataatgtattacacatccccgttgtatagagatgaactggtcaaggggttgcagcaggaactaaatcgcctgtacagccttttctgttctcggaacccagacttcgaagagaaaggaggcaaggtatctattgtctctcacagcctgggatgtgtgatcacttatgacataatgaccgggtggaacccagtgcgcctgtacgaacaactcctgcaaaaagaggaagagctgccagatgaacggtggatgagctacgaggagcgacacctcctcgacgaactgtacataacaaagaggagactaaaggaaatcgaggaacgtttgcacggtctgaaggcgtcaagtatgacccagacacccgcactgaagttcaaagtcgagaatttcttttgtatggggtctcctttagccgtgttccttgctctgcgaggcatacgaccaggaaacaccggctcccaggaccatattctgcccagagaaatatgtaaccgcctgcttaacatatttcatcccacggatccagttgcatacaggctggaaccactgatactcaagcattatagcaacatctcacccgtacaaattcactggtataatacctctaatccacttccgtatgagcacatgaaaccatcttttctgaatccagccaaagagcccacgtctgtgagcgagaatgagggcatcagcacgatcccatcgcccgtaacctccccagtcttatccagacggcattacggcgaatctatcaccaacataggaaaggcgtctatcctgggagcagcctccattgggaaaggcctagggggtatgctcttttccaggtttggaagaagctcaactacccagagctctgagacctcgaaagattctatggaagacgagaagaagccagttgcatccccttctgccacaactgtgggcacacaaacgctgccccactcctcttctggtttcttagacagtgcatattttagactccaggagtccttcttcaatctgccgcagctgctctttcccgaaaacgtgatgcagaacaaagacaacgctctggttgagctggaccataggatagatttcgaattaagggagggactcgtcgagagtcgctactggtccgcagtaacctcccatacagcatattggtcttccctcgatgtcgccttattcttgttaaccttcatgtataagcacgagcatgatgacgacgctaaacctaacctggatccgatttag

SEQ ID NO: 28040 - DNA, 1278 bp, Artificial Sequence
  Description of Artificial Sequence: Synthetic coding sequence
atgaataagatgccagccggagaacaggagtgcgaatataacaaggagggcaaatattacagcaaaggtgttaaactagtccgaaaaaagaagaaaatacctgggtacaggtggggggacatcaagattaacatcatcggtgagaaggatgaccttcccatccatttctgtgataaatgcgaccttcccattaagatatatggcaggataattccatgcaagcatgctttctgctaccattgcgctaatctgtacgacaaggtaggctacaaggtatgtcctagatgtcgctatcctgttttgcgcatcgaggctcacaagagagggtccgtgttcatgtgtagtatcgtccagcagtgtaagcggacttatcttagtcagaaatccctgcaggctcatattaagagaaggcataagcgagcaagaaagcaggtgactagtgccagtctggagaaagtacgtccacacatcgccccaccacagacagaaatatcagacatcccaaaacgactccaggatcgcgaccatctatcatatatccccccagagcaacacaccatggtcagccttccttctgtccagcacatgctgcaagaacaacataatcagccccataaagatattcaggccccaccccctgaactgtctctgagtcttcctttcccaatacagtgggaaactgtgtcgatcttcacacgcaagcatggcaacctgacggttgatcacatccagaacaatagtgattccggggctaaaaaacctaccccacccgattattacccagagtgccagtctcaacctgccgttagcagcccccaccacataattccccagaagcagcattacgcccctcctccgtccccatcaagccctgttaaccaccagatgccatacccaccccaagacgtcgtgacaccgaactcagtgcgctcacaggtgcccgcacttaccaccacttacgacccctcctccggttacattatcgtcaaagtgccacccgacatgaattcgcctcctttacgggcaccgcaatctcagaatggcaaccccagtgcatccgagttcgcttctcaccactataacctcaacattcttccacagtttacagaaaatcaggaaactttaagtcctcaattcacgcagaccgacgcaatggatcaccggagatggcccgcttggaaaaggctgtcaccatgcccacccacaagatcacccccaccttccaccctccatggcaggtctcaccattcccatcagcggagacatagacggtactag

SEQ ID NO: 28041 - DNA, 1926 bp, Artificial Sequence
  Description of Artificial Sequence: Synthetic coding sequence
atgggtccgcctttaaagttgtttaaaaaccaaaagtatcaggaacttaaacaagagtgcatcaaggacagtagacttttttgtgaccccacttttttgcctgagaatgatagtctattttacaataggcttttgccagggaaggtggtatggaagagaccccaagacatctgcgatgatcctcaccttatcgtcgggaatatctccaatcatcagcttactcaggggaggctcggccataaaccaatggtgtccgccttctcctgtctcgcagtccaggagagtcattggactaaaactataccaaatcataaggagcaggagtgggaccctcagaaaaccgagaaatacgctggcatctttcactttcgattctggcactttggggaatggaccgaagtcgtgatagatgatctgttaccaactattaatggtgatcttgtgtttagtttttcgacaagcatgaatgagttttggaatgcgttgctcgaaaaagcatacgccaagctgctgggatgttacgaggcactcgatggactaacgatcactgatatcatcgtcgattttacagggactctcgctgaaaccgtggatatgcagaaggggagatatactgaacttgtcgaggagaagtacaaactcttcggggagttgtataagacgttcacgaaggggggtctcatatgctgctcaatcgaatccccgaatcaggaagaacaggaggtggaaacagactgggggctattaaagggccacacatataccatgacagatatccgcaaaatcaggctgggcgaacggctcgtggaggtattctccgcagaaaaggtttacatggtgcggttacgcaaccccctgggcagacaggagtggtccgggccttggtccgagattagtgaagaatggcagcagctgacagcatccgatcggaaaaatctgggcttggtgatgagtgacgatggagaattttggatgtccttagaggacttctgcaggaattttcacaaattgaacgtctgccgtaatgtcaacaatcctatctttgggaggaaggagcttgaatctgtgttaggctgctggacagttgacgatgatcctttgatgaatcggtctgggggttgctataataatagggacaccttcctccaaaatccccaatacatcttcactgtccccgaagatggccacaaagttatcatgtccctccagcagaaagatctgagaacctaccggagaatgggcagacccgataattacattatcggatttgagctttttaaggtcgagatgaatagaaagttccgcctacaccacctgtatattcaagagcgggctgggacgtccacctatattgacactcgaaccgtctttctaagcaagtatctgaaaaaggggaactacgtgctagtgccaacaatgtttcaacacgggcgtacctccgagttcctgctccggatcttctccgaggtccctgtgcaacttagagagctgacactggacatgccaaagatgtcatgctggaatctcgccagaggatatcccaaagttgttacccagatcaccgtccacagcgctgaggatttggagaaaaaatacgctaatgagactgtgaacccatacctggtaattaagtgtgggaaggaggaggtcaggtcacctgtgcagaagaatacggtacatgctatctttgacactcaggccattttttaccgtaggactacggacattccaattattgtccaggtgtggaatagccggaagttctgcgatcagttcctggggcaagttactctcgatgccgatccttccgactgtagggacctgaaaagcctttatttaaggaagaaaggtggcccaactgccaaggtaaagcagggccacatttcgttcaaagtgatttctagtgacgacctgacagaactgtag

SEQ ID NO: 28042 - DNA, 3180 bp, Artificial Sequence
  Description of Artificial Sequence: Synthetic coding sequence
atggctgcagtggctgggtctggcgcagccgctgccccttcatcattgttgctagttgtcgggtccgaattcggctccccaggcttactcacttacgtcctcgaggagctcgagaggggaatcaggagttgggacgtggatcctggggtgtgtaacttagacgagcagcttaaggtcttcgtgtcacgacacagcgcaaccttctcatcaattgtgaaagggcagaggagcctacaccatcgcggagataacttagagacattggttttgttaaaccctagtgataagtccctgtacgatgagctccgcaatctgctcctggacccagcttcccacaagcttctggtgctggccggaccctgcttggaggaaacgggagagctgctgctgcagacagggggattctcgcctcatcacttcctgcaggtgctcaaagatagggagatccgcgacatcctggctacaactccccctcctgtacagccaccgatcctcacgataacctgtccaacattcggcgattgggctcagctggcgcctgcagtgccaggattgcagggtgctcttcgactgcagctccggctcaaccctcctgctcagctaccaaatagtgaaggcttgtgtgagttcctggagtacgtggcagagtctctggagcccccttctccctttgagctgctcgagccccctacctctggtggcttcctcaggttaggtcgaccttgctgctacatcttcccagggggattgggagatgctgccttcttcgctgttaatgggttcactgtgctggtaaacgggggaagcaacccaaaaagtagcttctggaaattagtcagacaccttgatcgggtcgatgccgtgcttgtcacacatccaggagctgattctttgcccggtctaaattccctgctgagacgcaaactggctgaaagatctgaggtagcagctgggggtgggtcttgggacgaccgattgcgacgattgattagccccaatctgggcgtcgtgtttttcaacgcctgcgaagctgcgtctaggttggctcggggagaagacgaggccgagttggcactcagcctgttagcacagctgggcattactccactccccctgtcgagaggtccagtaccagcaaagcctactgttctatttgaaaaaatgggcgtgggcagactggatatgtacgtgctgcaccccccatccgctggggctgagagaacactagcctccgtatgcgcgctactggtgtggcaccctgcaggacctggagaaaaagtggtgagagtcctgtttcccggatgcactccccctgcctgcctgttggacggactcgtcaggctccaacaccttagatttctgagagaacctgtggtgacgcctcaggatctggaaggcccaggccgagcggagtcaaaggagagcgtcggtagccgcgactcctctaaacgcgaggggcttctggccacacaccccagaccgggtcaagaacgccctggcgtggcgagaaaagagcctgcacgcgctgaggctccccgtaagacagagaaggaagcaaaaacaccccgtgagctcaaaaaagaccccaaacccagcgtaagtaggacacagccacgagaggttaggcgggctgcctccagcgttccaaacctaaagaaaaccaatgcgcaggctgcccctaaacccaggaaggccccatctaccagccattccggatttccacccgtggccaatgggccaaggagccctccctcactgcgatgcggcgaagcgtcaccaccgagcgcggcatgtggctctccagcttcccagctggtcgccaccccttcgttggaattaggtcccattcctgctggcgaggagaaagctctggagctcccactcgccgcttcctcaatccccaggccccgaaccccctcaccagaaagccacaggtcgcccgctgaaggcagtgaaaggcttagtctgtccccattacggggtggcgaagctgggccagacgcaagccccacggtgaccacacctaccgtgaccacaccatcactgcccgctgaggtcggttctccccattctactgaggtcgatgagagcttatctgtatctttcgagcaggtgctaccaccatctgcgcctacctcagaggcagggctctccctgccattgcgaggacctcgtgcacggaggagcgcctctcctcatgacgtcgacctgtgtcttgttagtccgtgtgagtttgaacaccggaaagcagtgcctatggcccctgcgcctgccagccccggtagctcaaatgactctagcgcgagatctcaagaaagggcgggtggactgggagcagaagagacaccacctacgtccgtgtccgaaagtttgccaaccctgtctgatagtgatcctgtgcccctggccccaggcgcagcagatagcgatgaggatactgaaggctttggtgtcccccgacacgatccgctgccagatccgctgaaagtccccccaccccttcctgacccgagctctatatgtatggtggacccagaaatgcttccgcctaaaacagccagacaaaccgaaaacgtgagtagaactaggaaacccctggctcggccaaattcgagggccgctgcgcctaaagccactccggtcgctgcagctaaaactaaaggcttagcgggtggggaccgagctagccgtcccctatccgcacggtccgaacctagtgaaaagggcggtagagctccactgagtcgtaaaagtagcactcccaaaacagccaccaggggcccatctggatccgcctcttcacggcctggggtttctgctacgcccccaaagagccctgtttacctggacctggcatatctcccaagtggctcctctgcgcatctcgtggacgaagaatttttccagcgcgttagggccctgtgctacgtcatctcgggccaggaccaacgcaaagaggaaggcatgcgcgcagtcctggatgcgctgttagcgtctaagcaacactgggaccgcgacctgcaagtgacactgatacccacgtttgacagcgtggccatgcacacctggtatgctgaaacacatgccaggcatcaggccctcggcataactgttctgggatctaattccatggtgtccatgcaggacgatgcttttcctgcttgcaaagttgagttctag

SEQ ID NO: 28043 - DNA, 4734 bp, Artificial Sequence
  Description of Artificial Sequence: Synthetic coding sequence
atggaggctggaagtgttgttcgagctatcttcgatttttgtccgtccgtgagcgaggagctcccactctttgtgggtgacattattgaggtgctcgctgtggtggacgaattttggttgctggggaaaaaagaggacgtgacaggtcagtttccatcatcattcgtggaaattgtcactatcccaagtcttaaagagggcgagcgcctgtttgtgtgcatctgtgaatttacaagccaggagttggacaatttgccactgcatcggggtgacctggtgatcttggatggaatcccaaccgctggctggttgcaggggcgatcctgttggggagccagggggttctttccaagtagttgcgtccgtgaactatgtctttcctcccagagcaggcaatggcattcacagagtgcacttttccaaattcctgagtactctatgggccaggctagagctttgatgggcctgagtgcccagctcgacgaggaactggacttccgagagggcgacgttatcactattataggcgtgcctgagccaggatggttcgagggcgagctggagggtcgcagaggcattttcccagagggctttgtcgaattgttgggcccacttcgaaccgtggacgagtctgtctcttccggcaaccaggacgactgcattgtcaatggggaggtcgataccccagttggggaagaggagattggcccagacgaggacgaggaagaaccaggaacctacggcgtggcgctgtacagattccaagccctggaacccaatgagctcgactttgaggtgggcgataaaattcgcattctggctactctagaggatggctggctagagggctccctgaaggggcgaacaggtatcttcccctacaggttcgtgaagctttgcccggacacacgagtggaagagactatggcactgccacaagagggaagccttgctcggatccccgagaccagcttagattgtttagaaaacactctgggagtggaagagcagcgacatgagaccagcgaccatgaagccgaagagcccgattgtatcattagcgaggcacccacatctccccttggtcacctgacaagtgaatacgatacagaccgcaactcttaccaagacgaggataccgcagggggacccccacggtcacctggcgtggaatgggaaatgcccctggctaccgacagcccaacgagcgacccaactgaggtcgttaacggtatcagcagccagccacaggtgcctttccacccgaacttgcaaaagagccaatattacagtacagtcggaggctcgcatcctcatagtgaacaatatcccgatcttctacccttggaagcacggactcgggattatgcctccctgccaccaaagagaatgtatagtcagctaaagaccctccagaagccagttctcccactgtacagaggatcttccgtcagtgcaagtcgagtcgtgaagcccagacagtcttccccacaactccacaacctggccagttacacgaaaaagcaccacaccagttccgtatactccatttcagaacggctcgagatgaagcccggaccgcaagcacagggccttgtgatggaggctgccactcacagccagggtgacggctctaccgatttggattccaagttaacacaacagctgattgagttcgagaagtcactggccggtcctggtaccgagccagataaaatcctcaggcacttctcgataatggactttaacagcgaaaaggatattgtgagggggtcctctaaactgattacggaacaggaactacccgaacgcagaaaggccctgcgtcccccaccgccacgcccttgtacgccagtttccacttctccacatttactagttgaccagaatctgaaacctgccccaccactggtagtgaggcccagtcgcccagctccgttgcctccgtctgctcagcagcgtaccaatgccgtttcaccaaagttgctgtctagacacaggccaacatgcgaaacgcttgagaaggaggggcctggtcacatgggccgatccctagaccaaaccagcccatgccctctggtgctggtgcgaattgaagaaatggagcgcgaccttgacatgtacagccgagcgcaagaggagctcaatctgatgttggaggaaaaacaagacgagtctagccgagccgagaccttagaagacctgaaattttgtgaaagcaatatcgaatccctcaacatggaacttcagcagctgagagaaatgaccctcctctcttctcagtcaagtagcctcgtggccccttccggtagcgtgtccgcagagaatccggaacagcgcatgcttgagaagcgtgctaaagttattgaagaattactacagactgaaagggattacattcgggatctggaaatgtgcattgagagaatcatggtgcctatgcagcaggcccaggtccctaatatcgacttcgagggcctgttcggcaatatgcagatggtgatcaaagtttccaagcagctgctggcggctcttgaaatttcagatgcggtcggcccagtttttctcggccaccgggacgaactggagggcacatacaagatttattgtcagaaccacgacgaggcaatcgccctgttagaaatctacgagaaagatgagaaaattcagaagcatctgcaggatagcctcgccgatctaaaatcgctgtataatgagtggggttgtacgaattatattaatctgggaagcttcctcatcaaacccgttcaaagagtaatgcgctatcctcttctgttgatggaactgctgaattccacccccgaatctcatcctgataaggtaccgctcaccaacgccgtgcttgctgtgaaggaaatcaatgttaacattaatgagtacaagcgcaggaaagacctggtacttaagtatcggaagggcgacgaggattccctcatggagaagatttccaagctcaatatccacagtatcattaagaagtctaacagagttagctcacacctgaaacaccttaccgggttcgctccacagatcaaagatgaggtgttcgaggaaaccgagaaaaattttcggatgcaggagcggttaattaagtcctttatacgagacctttccttgtacttacaacatattcgggagtctgcatgcgttaaggtcgtggcagcagtgtctatgtgggacgtttgtatggagagggggcatcgcgacctggaacagttcgagagagttcaccgctatatctccgaccaattatttacaaatttcaaggagaggactgagcgtctcgtgatctcccctctgaatcagctgctctcaatgtttacaggaccccataagctggttcagaaacgctttgacaagttgctggacttctataattgcactgaaagggccgagaagctaaaggataagaagacattagaagaactgcagtcagctcgcaataattatgaagcactgaatgcacagctactggatgagctgccgaaatttcatcagtacgcgcagggcttgttcaccaactgtgtgcacgggtacgctgaggcacattgtgattttgttcatcaagctcttgagcagctgaaacccctgctatctctcctcaaagttgccggtcgggagggcaatttgatagcaatatttcacgaggagcactcgcgcgttttgcagcagttgcaggtgttcacattttttccagaatcgcttccggcaactaaaaaacctttcgaacgcaagactatcgatcggcagtcagctagaaagccgctgctgggactccccagctacatgctgcagtccgaagagctgcgcgcaagtctgttagccagatatccacccgaaaaactgttccaagccgagagaaactttaatgctgcacaagacctggatgtttcgctcctagagggtgacctggtcggcgtcatcaagaagaaagatcccatgggcagccagaacaggtggctcattgacaacggggtgactaaaggctttgtgtattctagcttcctgaagccctacaacccaaggcgaagccacagcgacgcgtccgtaggctcccattccagcacagagtcggaacatggctcttcatcgccccgatttcccaggcaaaacagtggcagcacgttgacatttaacccatcttctatggccgtcagttttactagcggctcatgtcagaagcaaccgcaggatgccagcccccctccaaaggaatgcgatcagggaacactttcagcttccttgaaccccagcaactccgagtcaagtcccagtcggtgcccttcggatccagactctacgtcccagcctcgctctggcgattcagccgatgtggcgcgagacgtgaagcagcccacggcaactcccaggagctatcgcaacttcagacatcccgaaatcgtggggtactcagtgccaggcagaaacggacagagtcaggaccttgtgaagggctgcgctcgcaccgctcaggcacctgaggaccgaagtactgagcctgatgggagtgaggcagaggggaatcaagtgtactttgctgtgtataccttcaaagctcgcaatccaaacgagctgtccgtctctgcaaaccagaagttaaaaatattggagtttaaagatgtgactggcaatacagagtggtggctcgcagaggtcaacggtaagaagggttacgtccccagtaactatatccgaaagacagagtatacttag

SEQ ID NO: 28044 - DNA, 3186 bp, Artificial Sequence
  Description of Artificial Sequence: Synthetic coding sequence
atgctgagaactgcaggacgcgacgggttgtgtagacttagcacgtatctcgaagagcttgaggctgttgagctcaaaaagttcaaactgtacttaggaacagctactgaactgggggaaggaaaaattccatggggtagtatggagaaggcagggccactcgaaatggcccaactactcatcacccacttcggccctgaggaagcatggagactggccctgtccactttcgaacgcatcaaccggaaagacctgtgggaaagaggccagagggaagacctagtacgagacactccacctggcggaccttcttctctgggtaaccaatctacatgcctgctggaagtcagcctggtgacgcctaggaaagatccccaggaaacgtatcgggactatgtgaggagaaagtttagattaatggaggaccgcaatgccaggctgggcgagtgtgtcaatctcagtcacagatacactcgcctgcttctggtgaaagagcactctaatcccatgcaggtgcagcagcagctgttggataccggacggggacacgcacggactgtcggtcatcaagcaagtcctattaagatagagaccctgttcgagcccgatgaggaacggccagagccgcctagaacagtcgttatgcagggtgcagccggaattgggaagagcatgttggcacataaagtaatgttagactgggctgacgggaagctgtttcagggcaggtttgattatcttttttatattaattgccgggagatgaatcaatctgccacagaatgttctatgcaggatctgatcttttcctgttggccagagcctagtgcccctctgcaggaactcatcagagtgcctgaacgcttattgttcataatcgatggcttcgatgagttgaaaccgagtttccacgatccccaggggccttggtgcctctgctgggaagagaagagacccaccgaacttctcctcaattctctcatccggaagaagctgctgcccgagctgagcctattaataacaactagacctacggctctggaaaagctgcatcggctccttgagcatcctcggcatgtggaaattcttggtttctccgaagctgagaggaaagagtatttctacaaatattttcataacgcagaacaggccggacaggtcttcaattatgttcgcgataatgaaccactgtttactatgtgtttcgttcccctcgtatgttgggtggtgtgtacttgtctgcagcagcaattggaagggggtgggctgctgaggcaaacgtcgaggactacaacggcggtctatatgctgtatctgttgtcgctgatgcaaccaaagcccggagctccgaggctgcagccgccacctaatcaacggggactgtgctcactcgcagcggacggcctttggaatcagaagatcctgttcgaagaacaggacttaaggaagcatggactagatggcgaggatgtgagcgcatttctgaacatgaatattttccaaaaagacatcaactgcgaaagatactatagcttcattcatcttagcttccaggagttcttcgccgctatgtattatattctcgacgagggtgagggtggagccggacccgaccaggatgtcactaggttacttaccgagtatgccttctccgagaggtccttcctggcccttacctcacggtttcttttcgggttgctaaacgaggagactcgcagccacctggagaaatcgctttgttggaaagtctcccctcacatcaaaatggacctcctgcagtggatccagtccaaagcccagtccgacggctccactctgcagcagggatctctggaatttttctcctgtctgtacgagatacaggaggaggaatttattcaacaagcactgagtcactttcaagtgatagtcgtcagcaatatcgccagcaagatggagcatatggtcagctcattttgtctcaagaggtgtcgcagcgcccaggtgctccatctgtacggcgcaacctatagcgcagacggcgaagatcgcgcaaggtgctccgctggggcacataccctcctggtgcaactgccagaacgcacagtgctactagatgcctactcagagcacctcgccgcagccctttgtaccaatccaaacctgatagagctgtccctctataggaatgccctggggagcaggggagtgaaattgctttgccagggtttgcggcacccgaattgtaaactgcagaacctgcggctgaaaagatgtcgtataagctcttccgcttgcgaggatttgagtgctgcccttatcgccaacaagaacctcacccgaatggatctctccgggaatggtgtggggttccctggaatgatgctgctgtgcgaggggctgaggcatccccagtgccgcttgcagatgattcagttgcggaaatgtcagttggagagcggtgcgtgccaggagatggctagcgtgcttggaactaacccccacctagtggagttggacctcacagggaacgccctggaagatctgggactgcgactgctctgtcagggtctgcggcaccctgtctgccggttgcggaccctatggctgaagatctgccggctgaccgctgcggcatgtgatgaactggctagcaccctgagcgtgaatcagtctctcagggaactcgatctttccctaaatgagcttggggatttgggagttcttttgctctgtgagggtctgcgtcaccctacctgcaagttacagacactgcgtctcggcatttgtcgactggggtccgccgcttgcgaagggctgtctgttgtcctgcaggctaatcataatttgagggaactagacctcagttttaacgacctgggcgactggggactctggctgctcgctgaggggctgcagcatcctgcttgccgactgcagaagctgtggcttgacagttgcgggctgaccgccaaggcctgtgagaatctctacttcacactcggaatcaatcagaccctgaccgacctgtatctcaccaacaacgcacttggcgatacaggcgtgcgtctgctgtgtaaacgcctgtcacatcctggatgcaagcttcgagtgctgtggctatttggcatggacttaaacaagatgacacactctaggctggcggcactgcgggtcacgaagccataccttgacatcggatgttag

SEQ ID NO: 28045 - DNA, 3963 bp, Artificial Sequence
  Description of Artificial Sequence: Synthetic coding sequence
atggccaatgactcccctgccaaaagcctggtagacattgacttaagttctcttagggacccagcaggcatatttgagctcgtggaagtggtaggcaacgggacctacggacaggtttacaagggcaggcatgtgaagacaggccagctggccgctattaaagttatggacgtgaccgaggacgaggaggaagagattaagttggaaatcaatatgttaaagaaatactcccaccaccgcaatattgctacatattacggagcttttatcaaaaagagcccacctggccacgacgaccagttgtggctggtcatggaattctgcggcgcaggcagcattaccgatttagttaaaaatacaaaaggcaataccctaaaggaggattggattgcttatatctcacgcgagatcctgagaggcctagcacatctccacatacaccacgtgattcaccgagatattaagggacagaacgtcttgcttacagagaacgccgaggtgaaactggttgactttggcgtgtctgctcagctggaccggaccgtcggacgcagaaacacattcatcggaaccccttactggatggcacctgaggtgatcgcttgtgacgaaaatccagatgccacctacgactataggtcagacctgtggtcatgcggaatcactgccattgagatggccgagggggcacccccactgtgtgatatgcatccaatgagggccctgttcctcattcctaggaatcctcctcctcgactgaagtctaaaaaatggtccaagaagttcttctcctttatcgagggctgtcttgtgaagaattatatgcaacgtccaagtactgagcagcttctgaagcatccctttatcagagaccagccgaacgagcgccaggttcggatccagttaaaggaccatatcgatcggacgaggaagaagcggggtgaaaaagacgagacggaatacgaatacagtggcagcgaagaagaggaggaagaggttcccgagcaggaaggagaaccatcctcgatcgttaatgtgcctggcgaatccaccctgaggagagacttcctgcgcctgcaacaagagaataaggagaggagcgaggctttgagaagacaacagctgctgcaagagcagcagctgagggagcaggaggagtacaagaggcagctgctcgcggagcgacagaagcggatcgagcagcagaaagagcagagacggaggttggaggaacagcagcggagagaacgagaagcaagaaggcagcaggagcgggagcaaagacgtagggaacaagaggagaagcgacgcctcgaggagctcgagcgacgcaggaaagaagaggaggagcgccgacgggcagaggaagaaaagcgtagagtcgagcgggaacaggaatatatcagaaggcagctggaagaggagcaaagacacctggaagtactgcagcaacagctactgcaagaacaagccatgcttctggagtgcagatggagagagatggaggagcatagacaagctgagagactccagcgtcagctgcagcaagaacaggcttatctgttatcacttcagcacgaccacagacggcctcacccccagcattctcagcaaccacctcccccacaacaagaaagaagcaagcccagctttcacgcaccagagccaaaggcccattatgagccagccgaccgcgctagggaagtagaggaccgatttcgaaagaccaatcacagctctcccgaagcgcagtctaaacagaccggtcgtgtcttggaaccccctgtccccagtcgttccgaatccttcagcaatggtaactcagagtctgtccaccccgctctgcagagacccgcagagccccaggtccagtggtctcacttggccagcctaaaaaacaacgtcagccccgtgagcagaagccactccttcagtgacccttccccgaagtttgcgcaccaccatttgcgctcacaggacccatgccccccttcccgctccgaagtcctgtcccagtcaagtgattcaaagagtgaggccccagatccaacacaaaaagcatggagcagatctgatagcgatgaggtcccaccacgagtgcccgtccggacaacatccaggagtcctgtgctcagcaggcgggacagccctctgcagggctctggacaacagaacagtcaagccggacagagaaattccacctcctctatcgagccgcgtcttctttgggaaagagtcgaaaaattagtgcctcggccaggttctggttccagctcaggctcctcaaactccggctcccagccgggtagccacccaggcagtcagtctggatcgggcgagcgctttagggtgcggagtagttctaaatcggaagggagccccagccagaggttagaaaacgccgtaaagaagccggaggacaaaaaagaggtgtttcgtcccctcaagcctgcagtgcgaatcgatctcaccgcattagccaaggaactgcgtgcagttgaggatgtgcggccaccccataaagtcactgactactctagttcctcagaggagagcggtacaaccgatgaggaggacgatgacgtcgagcaggaaggcgcagacgaatccacctccggccctgaggacacgcgggcagcctcttcactaaacctgtctaacggtgagactgagagcgtcaagactatgatcgtgcacgatgacgttgagtcagaaccagccatgaccccttctaaagagggtacacttattgtgaggcagacacagagtgccagcagcacattacagaaacataaatctagctccagcttcacaccatttatcgacccacgactgctccagattagcccatctagcggcaccaccgtcacgagcgtggtcggcttctcttgtgacgggatgcggcctgaggccatccgccaagaccctacccggaagggttccgtggtcaacgtcaaccctaccaatactaggcctcagtctgatactcctgaaatccgtaaatataagaaacgatttaatagcgaaatactgtgtgcggcactctggggggtgaacctcctcgtgggcactgagtctgggctgatgttattggaccggtctgggcaagggaaggtctatccactgatcaaccgtagacggtttcagcagatggacgtcctggagggcctgaacgtgctggtgaccataagcgggaaaaaggataagctgagagtgtactatctgtcatggctgaggaataaaatcttacataacgatccggaagtggagaaaaaacagggttggactactgtcggcgacttggagggctgtgtgcactacaaggtggtcaaatacgagcggattaaatttctggtgatcgctctgaaatccagcgtggaagtatacgcgtgggcccctaagccctaccacaagttcatggccttcaagagctttggcgagctagtgcataagcctcttctggtggacttaactgtggaggagggacagcggctgaaggtcatctatggctcttgcgccggattccatgccgttgacgttgactctggatcagtgtacgatatctaccttcccacccatattcagtgctcaattaaaccccacgccattattatactgccaaatacggacgggatggaactgttagtgtgttacgaggacgagggagtatacgtcaatacgtacggccgaatcactaaggatgtagttttacagtggggggaaatgccaaccagcgtggcctacatcaggtcgaaccagactatggggtggggagaaaaagccatcgaaattcgctcggtggagactgggcacctggatggtgtgttcatgcataaacgcgctcagaggctcaaatttctgtgcgagagaaatgacaaggttttcttcgccagcgtgcgtagcggtgggtcgtcacaagtatatttcatgacgttaggcagaaccagcctcctatcctggtag

SEQ ID NO: 28046 - DNA, 606 bp, Artificial Sequence
  Description of Artificial Sequence: Synthetic coding sequence
atgtatacgctacttagtggtttgtacaaatacatgtttcagaaggatgagtactgtattctcatcctgggtctcgacaatgccggaaaaactaccttcctagagcagtccaagaccaggttcaacaagaactataaaggaatgtcactgagcaaaattaccacgaccgtcggcttaaatattggaacggtggatgtggggaaggcccgtttaatgttctgggatctgggtgggcaggaggaactgcagtccctgtgggacaagtactacgccgagtgccatggtgtcatctacgtgattgactccactgacgaagagaggctggccgaatcaaagcaggctttcgagaaagtggtaacaagcgaggctctctgcggcgtgcccgtactcgtcttggctaacaagcaggatgtggagacctgcttgagtatccctgatatcaagactgcattttcggactgcaccagcaagattggacgccgtgattgcttgacgcaggcgtgcagcgcactcactggaaagggcgtgagggagggcatcgagtggatggtgaaatgtgtggttcgaaatgtgcataggccaccacgacagagggacatcacctag

SEQ ID NO: 28047 - DNA, 1329 bp, Artificial Sequence
  Description of Artificial Sequence: Synthetic coding sequence
atgaggggtgccatggagctggagcccgagctgctcctccaggaggcaagagaaaatgtggaggcagcccagtcgtacaggagagaactagggcaccggctggagggccttcgggaggcaaggaggcagatcaaagagagcgcctcgcagactagggatgtgctcaaacagcactttaatgacctcaaagggaccctgggcaagctcctggacgaacgcctcgttacacttttgcaagaggtcgacacgattgagcaagagactatcaaacctctcgatgattgtcaaaagctgattgaacatggtgtcaataccgcagaggacctggtgagggagggagagattgccatgctgggtggtgtgggcgaggaaaacgagaaattgtggtccttcacaaagaaggcaagccatatacagctcgatagcctgcccgaagtgccattgttggtggatgtaccatgtctctcagcgcagctggacgatagtattcttaatatcgtcaaggaccacatattcaagcacggtaccgtggccagcagacctccagtacagatcgaggagctcatcgaaaaacccggagggataatagtccgttggtgtaaagtagatgatgatttcactgcccaggattatagactacagttcaggaagtgcacctctaaccatttcgaggatgtgtacgtgggatcagagaccgaatttattgtattgcatattgaccccaacgtggattatcagttcagagtatgtgcgaggggcgatgggcgacaggagtggtctccttggtcagttccgcagatcggccattctacactggttccgcacgagtggaccgcaggcttcgaaggttattccctatcaagcaggaggaacatcgccttgcgcaatgacagtgagtcctcaggtgtcctgtactcaagagcccctacatatttttgcgggcagaccctcaccttcagggtagaaacggtcggtcaaccggaccggagagattccatcggcgtttgcgccgaaaagcaggatgggtacgacagtctgcagagagatcaggcagtatgcatctctaccaacggtgctgtgtttgttaatggcaaggagatgaccaaccaactgccagccgtaacctcaggtagcactgttaccttcgacatagaggccgtgacgctgggcaccaccagcaataatgaaggcggtcatttcaagcttagagttaccatatcctccaataacagggaggtggtgttcgattggttgctcgatcagtcatgcggaagtctgtatttcgggtgcagtttcttttaccccggatggaaggtccttgttttctag

SEQ ID NO: 28048 - DNA, 1428 bp, Artificial Sequence
  Description of Artificial Sequence: Synthetic coding sequence
atggcggctttgacaacattattcaaatatatcgatgaaaatcaggatcgctacatcaagaaactagctaaatgggtggcaattcaaagcgtgtccgcttggcccgaaaagcgcggtgagatccggagaatgatggaggtggccgctgctgacgtgaagcagctgggaggtagtgtagagctagtggacatcggtaagcagaaacttcccgacggatcagagatccctttgccgcctattctcctgggccgactgggctccgaccctcagaagaaaaccgtctgcatttatggacacctggatgttcagccagccgctctcgaggacgggtgggacagcgaaccattcaccttagtggagcgggacggcaaactatacggaaggggaagtacagacgacaagggtccagtcgctggctggattaatgctcttgaggcgtatcagaaaactggccaggagattcccgtcaacgtacgcttttgcctggaggggatggaggaatctggtagcgaaggactagacgagctgatcttcgcgagaaaagacacattctttaaagatgtcgactacgtgtgtatttccgacaactactggctcggcaaaaagaagccttgcatcacatatgggctgcgaggaatatgttacttttttatcgaagttgagtgcagcaataaggatctccatagcggagtatacggcggatcagttcacgaggccatgacggacctgatacttcttatgggttctcttgtcgacaagagaggcaatattctcatcccaggcattaatgaagccgttgcggcagttacagaggaggaacacaagttatacgatgacattgatttcgacatcgaggaatttgccaaggatgtgggtgctcagatcttactgcattcacacaaaaaggatatactgatgcataggtggcggtatccaagcttgtccctgcatggaattgagggtgccttcagcggcagcggcgcaaagacggtcattccacgtaaggtagtaggtaaatttagtatccggctggttcccaacatgactcctgaagtcgtcggggaacaggtgacttcctacctgacaaagaaattcgccgagctgcgaagcccaaatgagttcaaggtctacatgggacacggaggcaaaccctgggtatcggacttttcacacccccattacttggccggtagaagggccatgaaaacagtgtttggcgtagagccagaccttactagggaaggcggatctatcccagtgacattaaccttccaggaagccaccggcaaaaacgtgatgctgctgcccgttggatccgcagacgacggcgcacactctcagaacgagaagcttaataggtataattatatcgaggggactaagatgttggccgcatatttgtatgaagtgagtcagctgaaggactag

SEQ ID NO: 28049 - DNA, 6290 bp, Artificial Sequence
  Description of Artificial Sequence: Synthetic coding sequence
atggcagaagtgaccgtgccccgagtgtatgtggtctttggcatccattgcatcatggcaaaggcatcaagtgatgtccaagtgtcaggtttccatcgcaaaatacagcatgtgaagaacgagctgtgtcatatgttgtccctagaggaggtcgcacccgtcttgcagcagacgctcctgcaggacaacctactagggagggtgcactttgatcaattcaaggaagccttgatcctcattctgtcgcgcaccctgtctaacgaggagcatttccaggagcccgactgttcacttgaggcccagccgaagtatgtgagggggggtaaacggtacggaaggcggtccctacccgagttccaagaatcagtagaggaattccctgaggtgactgtcatcgagcctttagacgaagaggcccgaccaagtcacatccccgcaggtgactgttctgagcactggaaaacccagagatctgaggagtacgaggccgagggccagttgcggttttggaaccccgatgatctgaacgcttcccaatccggaagttctccaccacaggattggatcgaggagaagttgcaggaggtctgcgaggatctgggcatcacccgcgacggacatctgaatcgcaaaaaattagtgtccatatgcgaacagtacggacttcagaacgtggacggagagatgttggaagaagtcttccataatttggatcccgatggaacaatgtctgttgaagactttttctacggtttattcaaaaatggaaagagcctgaccccgagtgcatcaactccgtatcgccagctcaaaaggcacctgagcatgcagtcattcgacgagtctggcaggcggacaaccacctccagcgccatgacgagtacgatcggattcagagtgtttagctgtcttgacgacgggatgggacatgcttcagtcgagagaatcttggacacatggcaagaagaagggattgaaaatagccaggaaatactaaaggctctcgatttctcattagatggcaacattaacctgaccgaactgacactagcgctggaaaacgaactgctggtcaccaaaaactccattcatcaggcggctctcgctagttttaaagccgaaatcaggcacctacttgaacgcgttgatcaggtagtgagggagaaggagaagctacggtccgacttagataaagccgagaaactcaaaagcctcatggccagtgaggttgatgaccaccatgcagccatagaacggagaaacgaatacaatctgcggaaactcgatgaggaatacaaagaaagaattgctgccttgaaaaatgaacttaggaaagaaagggagcaaatcctacagcaagctggcaaacagcggcttgaactggaacaggagatcgagaaggccaaaaccgaagagaactacattcgagataggttggccttgtccctcaaagagaatagcagattagaaaatgagttgctcgagaatgccgaaaaactggccgaatatgaaaatttgacaaataagctgcagcgcaacttggaaaacgtcctcgctgagaagtttggtgatctggaccctagttccgccgaattcttccttcaggaagagagactcacccagatgaggaacgaatacgaaaggcagtgtcgtgtgttacaggaccaagtggacgagttgcagtcagagctggaggaatacagagcccaaggaagagttctccgcttgcctcttaaaaactcgccatctgaagaagttgaggccaattccgggggaattgaaccggagcacggcctcggtagcgaagaatgcaaccctctgaatatgagcattgaagccgagctggttatcgaacagatgaaagaacagcaccatagggacatatgctgtctgcgcttggagttggaagataaagtgagacattatgaaaagcagctagatgagactgtcgtctcctgcaagaaggcccaggagaatatgaagcaacgccatgaaaacgagacccatacactggagaaacagatctcggacttaaagaacgagattgccgaattacagggtcaggctgcagtcctcaaggaggcgcatcacgaagcaacttgccgacacgaggaagagaagaagcaactgcaagtgaagctggaagaagaaaagacgcatctgcaggaaaaattgcggctccagcatgagatggaactaaaggctcgtctgactcaagcacaggcctcatttgaaagagaacgcgaggggttacagtcatcagcatggactgaagaaaaggtgcgcggacttacacaggaactggagcagttccaccaggagcagctaacctcactggtggagaaacacacactcgagaaggaagagctgcgtaaggagctgctcgagaagcatcagagggagctccaggaggggcgagagaagatggagacggagtgtaataggaggacctcacaaatcgaagctcagtttcagagcgactgccagaaggtgaccgagcggtgcgagtcagccctccagtctttggagggcaggtacaggcaggagttgaaagatctgcaggagcagcagcgcgaagagaagagccagtgggagtttgagaaggacgagctgacccaggagtgcgcggaagcccaggaactcctgaaggaaacactgaaacgggagaagacgacttctctggtactcactcaggaacgggaaatgctcgagaagacatacaaggaacacctgaatagcatggtggtcgagaggcagcaactgttgcaggacctggaagatttgagaaatgtctccgaaactcagcaatccctcctgtcagaccagattctagagctcaagtcctctcacaagagagagctacgggaacgagaagaagtgctgtgccaggcaggagcaagcgaacagctcgcgagccagcggctggagagactcgaaatggagcatgatcaggagcgtcaggaaatgatgtctaaactgctcgccatggagaatatccacaaggccacctgcgagaccgcagaccgcgagcgcgctgaaatgagcaccgagatctcgagactgcaaagcaagatcaaggagatgcagcaggccactagtccactgagcatgcttcagtctgggtgccaagtcatcggggaggaagaggttgagggcgatggcgctctgtccctgttgcagcagggagaacagcttttggaagagaatggtgacgtacttctctctcttcaaagagcccacgaacaggctgtgaaggagaacgtcaaaatggcaacggagatcagcagactgcagcagcgattacagaaactggaacccggtctggttatgagttcatgtcttgacgagccagctacagaattcttcgggaacaccgccgagcagaccgagcagttcctgcagcagaaccgaaccaaacaagtcgagggggtgacccggcgtcatgttttatccgacctggaggatgacgaagttcgcgacttgggttcaaccggtacctcaagcgtccagcgtcaggaggtgaagatagaggagtccgaagctagtgtggaaggattctctgagctggaaaactcagaggagactaggacggagagttgggagctcaaaaatcaaatctcccagctacaggagcagctcatgatgctctgcgctgattgcgatagggccagtgaaaaaaaacaggatctgctatttgacgtttcagtactgaaaaagaaactgaaaatgctcgaacggatcccagaggcgagcccaaagtacaaactactgtacgaggacgtgtcacgtgaaaacgattgtctgcaagaggagttaaggatgatggagactagatacgacgaggccctcgagaacaacaaggaattgaccgccgaagtcttcaggttgcaagatgaattgaagaagatggaagaggtcacagaaactttcctatcccttgaaaaatcatatgatgaagtcaaaatcgagaatgaaggtctgaacgtcttggttctgagacttcagggcaaaatcgaaaagctccaggagtcggtggtccaaagatgcgattgctgcttgtgggaagcatcgctggagaatctcgaaattgaacctgacgggaatattttacagctcaaccagacactggaggaatgtgtgccgagggtaaggtctgtgcatcatgtgattgaagagtgcaagcaagaaaatcaatatctcgaaggaaacacccagctactcgagaaggtgaaagcacacgagatagcatggctgcacggtaccattcagacccatcaggagaggcctcgcgttcagaatcaggtgatactggaggagaacacaacacttctgggatttcaagataaacactttcagcaccaggccaccatcgctgaattagagctggaaaagaccaaactgcaagagttgacgcggaaattgaaggagagagtgaccatactggtcaagcagaaggacgtactctcccatggcgaaaaggaggaagaactgaaagctatgatgcacgatctgcagattacgtgtagcgaaatgcagcagaaagtcgaactactgaggtatgaatccgaaaagctccagcaggagaacagcatcttgagaaatgagatcactactctgaatgaggaagactcaatctctaacctgaagttgggcaccctgaacggcagccaggaagagatgtggcagaagacggagacagtgaaacaggagaacgcagcagtgcagaaaatggttgagaacctgaagaagcaaataagcgaactgaagatcaaaaaccaacagttggatttagagaataccgaactttctcagaagaactcacagaatcaggagaagttgcaggaactgaaccaaaggttgaccgaaatgttgtgtcagaaagaaaaagagccaggcaactcagcactcgaagagcgggagcaggaaaaattcaacttaaaggaagagctcgagcggtgcaaggtgcagtcctctactctggtgagctcattggaagcggagctctcggaggtgaagattcaaacacatatcgtgcagcaggaaaatcatctgctcaaagatgagctggagaagatgaaacaactccatcgctgccccgatctgtcagatttccagcagaagatatcatcggtcttgagttataatgagaaactgcttaaggaaaaagaagccctgtccgaagaattaaacagctgcgttgataagttggctaagagtagcctcctggagcatcgcatcgccaccatgaagcaggaacaaaagtcctgggagcatcagtccgcaagcctgaagtctcagctggtggccagccaagagaaagtacagaatctcgaagacacagtccagaatgtgaatctgcagatgtctaggatgaagtccgatctgagggttacgcagcaggagaaggaggccctgaagcaggaagtgatgtccctgcacaagcaactgcaaaacgcagggggtaagtcctgggctccggaaattgcgacacacccatccgggctccataatcagcaaaagagattgtcctgggacaaactcgatcaccttatgaatgaggaacagcaactgttatggcaggaaaacgagcggctccagactatggtgcagaatactaaggccgaactcactcattctcgagagaaggttaggcagcttgagtctaacctgctacccaagcaccagaaacacctgaatcccagtggcaccatgaacccaaccgaacaggaaaaattatcccttaagcgggaatgcgaccaattccagaaggaacagagccccgcaaatcgcaaggtgtctcagatgaacagcctagaacaggagctggaaactatccatctggaaaatgagggactcaaaaaaaaacaggtgaagctcgatgaacagctgatggagatgcagcacctaagatcaaccgccactccatccccctctcctcatgcatgggatctccagctgctgcaacagcaggcctgcccgatggtcccacgggagcagttcttgcagctccagcggcagttactccaggcggaaaggattaatcagcacctccaggaggaattggaaaaccggaccagtgaaaccaacaccccacagggcaaccaggaacagttggtgacagttatggaagagcgcatgattgaggtagagcagaaacttaagttagtaaagcggttgcttcaggaaaaagttaatcaacttaaggagcaagttagcttgcctggccatttgtgttcaccgacatcacattctagtttcaactcatcatttacttcactctactgtcatta

SEQ ID NO: 28050 - DNA, 1176 bp, Artificial Sequence
  Description of Artificial Sequence: Synthetic coding sequence
atggccgctctaacaacgctctttaagtatattgacgaaaatcaggatcgctacattaagaagctggccaagtgggtcgcaatccagtccgtgtctgcttggcccgagaagagaggggaaattcggagaatgatggaagtcgccgctgctgacgtgaagcagctgggtggctccgtggagttagtcgatattggtaagcagaaggagattccagtgaacgtgaggttttgtctagaaggaatggaagaatctgggtcagaggggctcgacgagttgatcttcgccaggaaggataccttttttaaggacgtggattacgtgtgcatttctgataactactggttaggcaagaagaagccctgcatcacatacgggctcagaggcatctgctacttcttcatcgaggtagaatgtagtaacaaagacctgcattctggggtatacggcggaagtgtacatgaggccatgaccgacctgatccttctcatgggctcgctggtggacaaaaggggaaacattctgattccaggaatcaacgaggcagtggctgcagtcacagaagaagagcacaagttgtatgatgacattgacttcgatatcgaagaattcgctaaagacgttggcgctcaaattctgctgcactcacacaagaaagatatactcatgcacaggtggcgatatcccagcctgtctttgcatggcattgagggggctttttccgggagtggtgccaaaaccgtcatccccagaaaggtcgtcggtaaattcagcatcaggctggtacccaatatgacccctgaagtcgttggggaacaggtgacctcctatttgacaaagaagtttgccgaactcaggtctcccaacgaatttaaagtctatatgggacatggtggcaagccgtgggtgagcgacttctctcacccccactatctggccggacggcgagccatgaaaaccgtatttggggttgaacctgacttgacccgtgaagggggtagcattcctgttactctaacattccaggaggccacgggtaaaaacgtcatgctgctcccagtcggaagtgcagacgatggtgcgcattctcagaacgagaagctgaatagatataattacattgaaggaactaaaatgctggctgcctatctgtatgaagtgtcacaactgaaggactag

SEQ ID NO: 28051 - DNA, 5969 bp, Artificial Sequence
  Description of Artificial Sequence: Synthetic coding sequence
atggatgaagtcgagcaagaccagcacgaggccaggctgaaagaactgttcgactcctttgacacgaccgggaccggtagcctaggtcaggaggaactgactgatctgtgccacatgctcagccttgaagaagtagcaccagtgctgcagcagactctcctgcaggacaatttgctgggcagggtgcactttgaccagtttaaggaggccctgatcctcatcctgagcaggactttaagcaacgaagagcattttcaagaaccagactgttctctcgaagcgcagccaaagtacgtgcgcggtggaaaacgatatggcaggcggagcctgcctgagtttcaagaatcagtggaggagttccctgaggtaacagttatcgaaccactggacgaagaggcccgtccctcccatattccagccggagattgctccgagcactggaagacacagcgatcagaggagtatgaggcagaaggccagttgcggttctggaaccccgacgacctgaacgcatcccaaagtgggtcttcgccgccacaagactggattgaagaaaaactgcaggaggtctgcgaggatctgggcattacacgggacgggcacctaaacaggaaaaagctggtctccatatgcgagcagtacggcctgcagaacgttgatggggagatgctggaggaggtgttccacaatctggaccccgacggcactatgtcagtagaggattttttctatggactgtttaagaatggaaagtcacttactcctagcgcttctaccccctaccgacagctgaaaaggcatctgtcgatgcagtcttttgatgagagtgggaggagaactacaacttccagtgcaatgacctctacaatcgggtttcgggtgtttagttgcctcgacgacggcatgggccacgcctctgtggaaaggattctcgatacctggcaagaggaggggatcgagaactctcaggagatactcaaggccctggacttctccctcgacggcaacattaaccttacggagctcaccctcgctctggagaacgaattgctagtgacaaaaaactcgatccatcaagccgcactagcttcattcaaggccgaaattaggcatctgctggagagggtcgatcaggttgtgagagagaaagagaagcttcgctccgacttagataaggcagaaaaactaaaatcgctgatggcttccgaagttgatgaccatcatgcggcaatagaacgtcgaaacgagtacaatctgagaaaactcgatgaggagtacaaagaacggatcgctgcgctcaagaatgaactgcgcaaagaacgagagcagattctccaacaagcaggcaagcaaaggttggaactcgagcaggagatcgagaaggccaagactgaagaaaattacatccgcgatcggttggccctgagtctcaaggagaatagccgcctggaaaacgagctgctggaaaacgctgaaaaactggccgaatatgagaacctaaccaataaactgcagcggaacctggagaatgtgctcgcagagaaattcggtgatctagatcctagttctgctgaattctttttgcaggaagagcgattgacacagatgcgaaacgagtatgaaaggcaatgcagggtcttgcaggatcaagttgacgaactacagtctgaattagaggaatatcgtgcccagggcagggtgctccgcttaccgttaaagaattcacctagtgaagaagtagaggcaaactccgggggtatcgagcctgagcacggcctggggtccgaggagtgtaacccattgaacatgagcatagaggcggagctggtgatagagcagatgaaagagcagcatcaccgcgatatttgctgtctgcgtcttgagctagaggataaggtgagacattatgaaaaacagcttgacgaaaccgttgtgtcatgtaagaaagcgcaggaaaatatgaaacaacggcacgagaacgagacccatactttggaaaagcaaataagcgaccttaaaaatgaaatcgccgagctccaggggcaggccgcagtgttgaaggaagcgcaccacgaggctacttgccgccatgaggaagaaaagaagcaattacaggtcaagcttgaagaagagaagacacatctgcaggaaaaactgagattgcagcacgagatggaattaaaggccagactaactcaggcccaggcatcttttgaacgcgaacgggaaggtttacagtccagtgcgtggaccgaggagaaagttaggggactaacgcaggagctcgagcagttccaccaggagcagttgacatccctggtggaaaaacacacactggagaaggaggaactgcggaaggaactgctcgagaagcaccagcgggaattgcaggagggaagagaaaaaatggagactgaatgtaaccgcagaacctcacagatcgaggcacagttccagagcgactgccagaaagtcactgaacgatgtgagagcgcgttacagtccttggaagggagatatcggcaggaactgaaagacctgcaggaacagcagcgagaagagaagagtcagtgggaatttgagaaggatgagctgactcaggagtgtgccgaagctcaagaactacttaaagaaaccctcaagagagaaaaaacgacctcgttagtgctaacccaagaacgggaaatgttggaaaaaacctacaaagaacatctcaactcaatggtagttgagaggcagcaactcctgcaggatctcgaggatctcaggaacgtcagcgagacccaacagtctttgctctcagaccagatcctggagctgaagagttcacacaaacgagagctcagagagagagaagaggttctgtgtcaggccggtgcatcagaacagcttgcgtcccagcggttggaaaggttagaaatggagcatgaccaggagcggcaggagatgatgtctaaactccttgccatggagaatatacacaaagcaacgtgtgagaccgcagacagggagcgggctgagatgtcaacggagatttctagactgcagagcaaaattaaagagatgcagcaggctacctcgcccctgtccatgctgcaatctgggtgccaagttataggtgaggaggaggttgaaggtgacggagctctgagtctgctacagcagggagaacagttgcttgaagagaacggggatgtgcttctttcactgcaacgggcacacgaacaggcagttaaggaaaatgtcaagatggcaacagagattagcaggttgcaacaaaggttgcagaaactggagcctggcctggtgatgtctagctgtctagatgagccagctacagagttcttcggtaacactgctgaacagacagagcagttcctgcagcagaatcgaacaaaacaggtggagggcgtgacaaggcgccacgtgttgtcggatttagaagatgacgaagtccgggacttgggcagcactggaaccagctcggtgcagcgacaggaagtgaaaatagaggaatctgaagctagtgtggaaggcttctcagaactggagaattctgaagagactcgtaccgagagttgggaactcaaaaatcaaatctctcagctgcaagaacagctcatgatgctttgtgctgactgcgacagagcctcagagaagaagcaggatttactgtttgatgtctccgtgctgaaaaagaagctcaagatgctggagcgcatccccgaggctagccctaaatataaactgctctatgaggacgtgtcccgagagaatgattgcctccaggaagagctcagaatgatggagactagatatgacgaagccttagagaataacaaggagctgacagccgaggtgttcagactgcaggatgaactcaaaaaaatggaagaggtcactgagacctttctcagccttgagaagtcatacgatgaggtcaaaattgaaaatgaggggctgaatgtcctggtgctccgtctgcagggtaaaatagaaaagctgcaagaatcagtggtgcaacgctgcgactgctgcctatgggaagcaagccttgagaatctggagattgaacctgatggcaatatcctccagctgaaccagacactggaggaatgtgtaccaagagtgcgctctgtacatcacgtgattgaggagtgtaaacaggagaatcagtatctggagggcaacacacagctcctggaaaaggtaaaggcccacgagattgcatggctgcatggcaccatccagacccatcaggagcggcctcgggtccagaaccaggtgatcctggaagagaacacaacactgctgggattccaggataaacactttcagcatcaggccacaatcgctgagctggaactcgagaaaaccaagctgcaggaattgactaggaagctcaaagaaagggtgacgattctcgtcaagcagaaagatgtcctctcacacggggagaaggaggaggagctgaaagccatgatgcacgacctgcagatcacgtgttctgaaatgcagcaaaaggtggagttgctcaggtacgagtccgaaaaactgcaacaggagaattccattctgcggaacgaaatcaccacccttaacgaggaagactcaatctcgaatctaaagctgggtacactgaatggaagccaggaggagatgtggcaaaagaccgaaactgtgaagcaggagaacgccgctgtccagaagatggtggagaacttgaagaaacagatttcagagctgaaaatcaaaaatcaacaactcgatctggaaaataccgagctgtcccagaaaaacagtcagaatcaagagaaactgcaagaactgaatcagaggctgacggaaatgttgtgtcagaaggagaaggaacctggaaacagcgctcttgaggaacgcgagcaggagaaattcaatctgaaagaggagctggaaaggtgtaaagtacagtcgtccacactagtttcaagcttagaggccgagttgtctgaggtgaaaatccaaactcacattgttcagcaggagaatcacctgctgaaagatgaacttgaaaagatgaagcagctccaccgctgcccagacctctctgactttcaacagaaaatttcaagcgttctgtcgtacaacgaaaaattgctaaaggagaaagaagccctgagtgaggagctgaattcatgcgtggataagttggctaaatcttcgctgctggaacatcggatcgccacgatgaaacaggaacagaaatcttgggagcaccagtccgcctccctgaagagccagctcgtagcctcacaagagaaagtgcaaaatctggaggacacagtacagaacgtgaacctgcagatgagcaggatgaagtccgacctcagagttacccagcaggaaaaggaagctctcaagcaggaggtgatgtcactgcacaagcaactgcaaaatgccggaggcaagtcttgggcacccgaaatagcaacccaccccagcggcctgcataatcaacagaaacggctgtcctgggataagcttgatcacctgatgaatgaggagcagcagctattgtggcaggagaatgaaaggctccaaaccatggtgcagaatactaaggctgaactgacacattcaagagaaaaggttcgccagctggaatctaacttgctgcccaaacatcagaagcacttgaacccatctggaactatgaatcccacagagcaggagaagttgagccttaagagggagtgtgaccaatttcagaaggagcagagtccagccaacagaaaggtcagtcagatgaattcactggaacaggaattggaaaccatacatctggagaatgaggggctgaagaagaagcaggtgaagctcgatgaacagctgatggaaaattctgttgtgggatcgagcagggaagggtgcagctctttgccagagattgtatgcgaggacgccgcaccagaagtgcattgtgatgccta

SEQ ID NO: 28052 - DNA, 915 bp, Artificial Sequence
  Description of Artificial Sequence: Synthetic coding sequence
atgggccagtgtgtcaccaagtgtaaaaatccgagctcaaccctcggcagcaagaacggggaccgggagcctagtaataagagtcacagtcggcgaggtgctggacatcgggaggaacaggtgcctccctgcgggaagccaggaggcgacatcctggtaaacggcaccaagaaagccgaggccgctacagaagcatgccagctgccaacaagctcaggagacgctggaagggaaagtaagagtaacgcagaagagagcagcctgcaaaggctggaggagctgttccgcaggtacaaggatgagagagaggacgcaatcttggaagaaggcatggagcggttttgcaacgacctgtgcgtagatccaacagagttccgagttctcctccttgcttggaagtttcaggccgcaaccatgtgcaagttcaccagaaaagagttctttgacggctgtaaagcaatttccgccgattctatcgacggaatatgtgcaagatttcccagtctgctgaccgaagcaaaacaagaagacaaattcaaggacctctaccgtttcacttttcaatttggactggattccgaggaaggacagcggagcctgcatagggagatagcgatagccctatggaaattggtgttcactcaaaacaatccccctgtgctggaccaatggcttaattttctgaccgaaaatccaagcggaattaaaggaatctctcgggacacatggaacatgtttctgaacttcacccaggtgatcggacctgatctgtcgaattactccgaggacgaagcatggccatctctgttcgacacttttgtggagtgggagatggaacggaggaagcgcgagggcgagggacgaggggcactttcttccgggcctgagggtctgtgtccagaagagcagacctag

SEQ ID NO: 28053 - DNA, 1914 bp, Artificial Sequence
  Description of Artificial Sequence: Synthetic coding sequence
atggctgcgatggcggttggtggggcagggggttcaagagtttcgtcgggccgagaccttaattgtgtgccggaaattgccgatacattgggtgccgtcgccaaacagggattcgattttctctgcatgccagtctttcatccacggttcaaaagggagttcatccaggaacccgctaagaatcgccctggcccacagacaagatccgacctgctgttatctggcagagactggaataccttgattgtgggcaagctaagcccttggatcaggcctgattcgaaagtcgagaagatccggaggaatagtgaggcagcgatgctgcaagagctcaacttcggggcttacttggggctgcccgcatttttgctccctctgaatcaggaggataacaccaacctcgccagggttctgaccaaccatatccatacaggccatcacagctctatgttttggatgagagtgccgttagttgcccctgaggatcttcgagacgacattatcgaaaacgcaccaactacccacacagaggagtacagtggagaagagaagacctggatgtggtggcataatttcagaacattgtgcgactacagtaaacgtatcgcagtggcactggaaattggagccgatcttcccagcaatcatgtgatagacaggtggttaggggaacccatcaaagcagccattctgccaacctcaatctttctgacgaataagaaggggttccctgtgctgtccaaaatgcaccagaggctgatattccgcctgctcaagctcgaagtgcagttcatcatcaccgggaccaaccaccattccgagaaggagttctgttcttacctccagtatctggaatacttgtctcagaaccgccctcctccaaatgcctatgagctcttcgccaaagggtacgaagactacttacagagtcccctgcaacccctcatggacaacctggagtcacagacttacgaagttttcgagaaagaccctataaagtacagtcagtaccaacaagccatctacaaatgcctcctggacagggtacccgaagaggagaaagatacaaatgtgcaggtcctgatggtccttggtgctgggaggggccctctggttaatgcaagtctccgcgctgccaaacaggcagataggcgtatcaaactgtacgccgtggagaaaaacccaaatgccgtggtcaccctagaaaactggcagttcgaggagtggggcagccaggtaaccgtggtgagctccgacatgcgagagtgggtggcccctgagaaggctgacattatcgtttccgagctgcttggcagttttgccgacaacgaactgagccccgaatgcttggacggcgctcagcattttctgaaagatgacggtgtctcaattcctggcgagtataccagctttctcgcccctatctcttcctcaaagctgtacaacgaggtaagagcgtgtcgggagaaagaccgcgacccagaggcccagttcgagatgccctacgtggtgagactccataatttccaccagctgtctgcaccccagccctgctttactttcagccaccctaatagggatcccatgattgacaataacagatactgtaccctggagttccctgtggaagtgaacactgtgctccacgggtttgccggttattttgagactgtactttatcaagatatcactctgtctatccgacccgaaacacattctcctgggatgtttagctggttccctattctcttccccatcaagcagcccataacagttcgcgaaggccagaccatctgcgtgcgattctggcgatgcagtaatagtaaaaaagtctggtatgagtgggcagtaacagcacccgtctgtagcgcaatccataacccaaccgggaggagctatacaattggtctctag

SEQ ID NO: 28054 - DNA, 1041 bp, Artificial Sequence
  Description of Artificial Sequence: Synthetic coding sequence
atggccccaggatccgtgacgtccgacatatcccccagctctacttccacagccggaagttccagaagcccagaaagtgaaaagcctgggccatcccatggcggtgttcctcctggcggacctagccacagctcactacccgtcgggaggcgccatcccccagttttaagaatggtactggaggccctccaagccggagagcagagacgagggaccagcgttgcagccatcaaactgtatatcctgcacaaataccctaccgtggatgtattgcgcttcaagtacctgttaaaacaggctttagcaaccgggatgcgcagagggcttctggctcgacctctgaattccaaggctagaggcgcaaccggatccttcaagctagttcctaaacataagaagaagatacagccaaggaaaatggccccagctacagcccctcgcagggctggagaagcaaagggcaaaggccctaagaaaccgagtgaggctaaagaagaccctcctaacgtcggcaaggtgaaaaaggcagcgaagcggccagccaaagtccagaaacctcctccaaaaccaggggcagccactgaaaaggcgaggaaacaaggcggtgccgctaaagacacaagagctcagtctggcgaagcacgaaaggtcccacccaaacctgataaggccatgcgtgctcctagttccgcgggtgggctaagccggaaagcgaaagcgaaagggtcgaggtcttctcaaggagatgcagaggcctaccgcaaaaccaaggctgaaagtaagagttcaaagcctactgcatccaaagtgaagaatggtgccgctagccccactaaaaagaaggtggtggccaaggccaaggcaccaaaggccggacagggcccaaacaccaaggccgctgcacccgcaaagggcagtggaagcaaggtggtaccagcacatctctccagaaaaaccgaagcaccgaagggaccgaggaaagctggccttccgattaaagcatcatccagcaaggtgtcttcacaacgcgctgaagcttag

SEQ ID NO: 28055 - DNA, 1869 bp, Artificial Sequence
  Description of Artificial Sequence: Synthetic coding sequence
atggcaatggcaccgtcccccagcttggtacaggtgtacacctcgcctgccgctgtggccgtttgggagtggcaggacggactgggcacctggcacccatatagcgcgactgtgtgcagcttcatcgagcaacagttcgtgcagcagaaaggccaaaggtttggacttgggagtttggctcactctattcctctcgggcaggcggaccctagcctcgccccttatataatagaccttccaagttggactcagttccgccaggatacaggcacgatgcgggctgtcagaagacatctgtttcctcagcactcagccccaggtagaggcgtggtctgggagtggctaagtgacgacggctcctggaccgcatatgaggcctccgtctgtgattatctcgagcagcaggtcgctagaggaaatcaattggtagatctggcaccactcggttataactacactgtgaactacaccactcatactcagaccaacaagacgtcatccttttgccgttcggtgcggagacaggctggcccaccttatccagtgaccaccatcattgcaccaccgggtcataccggtgtggcatgctcttgtcaccagtgcctgagcggttctagaaccggccctgtgtccggtaggtatcgccactcaatgactaacttgcctgcatacccagtgccccagcaccctcctcatcggaccgcttccgtgtttggaacgcatcaggcttttgcgccatataataagccgagcctatcgggggctaggagcgctcccaggttgaacactacaaatgcctggggagcagctcccccttctctgggcagccagccgctgtacaggagctcactcagccacctgggtcctcagcacctgcccccaggtagctctacctctggtgcagtcagtgctagtcttccaagtgggcctagtagcagccctggctccgtgcccgcaaccgtccccatgcagatgccaaagccatctagagttcagcaggcacttgccggaatgactagcgtgctcatgtcggctatcggcctgcccgtgtgcctgtcacgagcgcctcagcccacctcaccgccagccagcaggctggctagtaagagtcacgggtcagttaaacgtctgcgcaagatgtccgtgaagggtgctactcccaaaccagagcccgaaccagagcaggttattaaaaactatacagaagaactgaaagtccccccagacgaggactgcattatctgtatggaaaaactgtccactgcctcaggatacagcgatgtgaccgatagcaaagccatcgggtccctggcggtgggccacctgacaaaatgtagccatgcattccacttattgtgcctgctggctatgtactgtaatggcaacaaagacggatctctccagtgcccatcctgcaaaactatctatggagaaaaaacgggaacccagccacagggaaagatggaagtgctacgctttcagatgtcactccctggtcacgaggattgcggcactatcttaatcgtctattcaatcccacacggcatccagggtccagagcaccccaaccccggaaagccctttacagcacgcggatttcctcgacaatgttacctcccagataacgcacagggaagaaaggtactggagctgttgaaagtcgcctggaagaggcgactgatcttcacagtgggcacctctagcacaactggggagaccgacaccgtagtatggaatgaaattcaccacaaaacagagatggaccgaaacattactggccatgggtatcctgacccgaactacctgcaaaatgtgctggcggagttggccgctcagggcgtgacagaggattgtttggagcagcaatag

SEQ ID NO: 28056 - DNA, 786 bp, Artificial Sequence
  Description of Artificial Sequence: Synthetic coding sequence
atggccgcaacagccagagaggacggcgcttctgggcaagaaagagggcaaagggggtgtgaacattacgaccgcggatgccttctcaaagccccatgttgcgacaaattatacacatgtagactttgccacgacaacaatgaggaccatcagttagacagattcaaagtgaaggaggttcagtgcattaactgtgagaagatccagcatgcccaacagacatgtgaggagtgttctaccttgtttggagaatactactgtgatatatgccatctcttcgataaggataagaagcagtaccactgcgaaaattgcgggatttgccggatcgggcctaaggaagactttttccactgtctgaaatgtaatttatgcctcgcaatgaatctgcagggacgacacaaatgcattgagaacgtgagtagacaaaactgtccgatttgcctggaagatatccacacatcccgagtggtcgcccacgtactgccctgcggccaccttctccatcgtacatgttacgaggagatgctgaaggagggctaccgatgcccactgtgtatgcactctgcactcgatatgaccagatattggcggcaacttgatgacgaggtggcccaaactcctatgccctccgagtaccaaaatatgacggttgatattctgtgcaacgactgcaacggtagatccaccgtgcagtttcacatattaggcatgaagtgcaagatctgtgaaagctataatacagctcaggccggaggtaggagaatcagtttagaccagcagtag

SEQ ID NO: 28057 - DNA, 1983 bp, Artificial Sequence
  Description of Artificial Sequence: Synthetic coding sequence
ctgagcctgccgtcagtgacctacctgctgctcgaggtcatccccgattctatgcggaagcaggaggtccggacagggagagaggctggacagggtcatggaacaggctccccagctgagcaggttaaggcactgatggatctcctggccggaaaggggagccaggggtcccaggccccacaggcactcgatcgcactcctgacgctcctctggggccttgcagtaacgactctcgaatacagcggcatagaaaagcattacttagcaaggtggaagcaacacggggaggtggacatccggctagaaccgtagctctggataggctgtttttgcctcttagcagggtgagtgttcctccaagagtgagcatcacaataggagtcgcgggaatgggtaagaccactcttgtacggcactttgtgaggctgtgggctcacggtcaggttggaaaagacttcagcctagttctgccactgacatttcgggaccttaatacacatgaaaagctgtgtgctgaccggctgatctgtagtgttttcccacacgtgggggaaccatcgctggccgtggcagtacctgcaagggcactactcatccttgacggactcgacgagtgccggacacctctggacttcagcaacacagtcgcttgtaccgatcccaaaaaagagatcccagtggatcacctgattactaatatcattcgaggtaacctgttcccggaagtgtcaatctggattacaagtcgaccatcggcatccggccaaattcctggagggctggttgaccgaatgaccgagatcagaggcttcaacgaagaagagataaaagtgtgcttggagcagatgttccctgaagatcaggccctgctaggttggatgctgagccaagtccaggccgatagggctctttacttgatgtgtaccgttcccgctttctgcagacttacagggatggcccttgggcatctctggaggagccgcacaggtccccaagacgccgagctgtggcccccacgaactctgtgtgagttatattcatggtacttccgaatggccctgagcggcgaagggcaggagaagggaaaggcctcacccaggatcgaacaggtagcacatggcggtcggaaaatggttgggactttagggcgtttagcctttcacggtctgctgaagaaaaaatatgtgttctatgaacaggatatgaaagctttcggcgtggaccttgccctgcttcaaggggctccttgttcttgcttcctgcagagggaggaaacccttgcgtcatctgtcgcctattgttttacacacctgagtctgcaagaattcgtggccgctgcttattattatggggcttctaggcgagccatctttgatctgtttacagagtccggagtaagttggccacgtcttggcttcctgacacattttagaagtgccgctcagcgggctatgcaggccgaagacgggcgtctggacgtgtttttacggttcttgagcggcttgctttccccccgtgtaaacgccctgctggccggatcccttctagcacaaggagaacaccaggcatatagaactcaggttgctgaactccttcaggggtgcttgcggcctgacgccgctgtttgtgccagggccatcaatgtgctccactgcttacatgagctccaacacacagagttggctaggtccgtggaagaggccatggaaagtggtgcattggccaggcttacaggtcccgcacaccgtgctgcactggcctatcttttgcaagtttcagatgcatgcgcacaggaagctaacctttccctgtctctgagccaaggcgttctgcagtcccttctgcctcagctcctctactgtcggaagctccggtggattcctggccagggagctggagccggtgaaggggcagaggagcgcgcagaggcagtgccctcgcccccaccaagcttttctgtgtccctcctcggcctgccgtag

SEQ ID NO: 28058 - DNA, 1152 bp, Artificial Sequence
  Description of Artificial Sequence: Synthetic coding sequence
atgctgtctaggaaaaagacgaagaatgaggtttcaaagcccgctgaggtccagggcaagtatgtcaagaaggagacctccccactactcagaaatctgatgccttctttcatacgccacggtcccaccatcccacggcgaactgatatctgtttgcccgacagctcccccaacgcattctctactagtggcgatgtggtgagccgtaatcagtcctttctcaggacaccaatccagcgcaccccacacgaaataatgaggagggaatctaaccgcctttctgcccctagctatctcgcacgctccctcgcagacgtccctcgagaatatggttcttctcagtcctttgtgacagaagttagcttcgcagtcgaaaacggcgactcaggatctcggtattactatagcgataactttttcgacggccagcggaaacggcctcttggtgaccgggctcacgaggactatcgttattacgaatataaccatgatctctttcagagaatgccacaaaaccaggggaggcatgcctcggggatagggagggtggccgctaccagcctaggcaacctgactaatcatggttctgaggatctgccgttgccccctggatggtctgtcgactggaccatgagggggagaaaatattacattgaccacaacacaaatacgactcactggtcgcacccactggagcgggaaggcctccctccaggttgggagagggtcgagagctccgaattcggaacttattatgtcgaccacaccaacaaaaaggcccagtaccgtcatccatgtgccccttccgtcccaaggtacgaccaaccaccgccagttacatatcagccccaacagactgagcgaaaccagtccctcctggtgcccgcaaatccctatcacactgctgaaataccggattggttacaggtatatgcccgtgcccctgtgaaatatgaccacatcctcaaatgggagcttttccagttggcagacctcgacacttaccagggcatgctgaaattgctgttcatgaaagagctggagcagatcgtgaaaatgtatgaggcgtaccgtcaggcactgctgacagaactggaaaaccgtaagcagcggcagcaatggtacgcacagcagcacggaaaaaacttctag

SEQ ID NO: 28059 - DNA, 2376 bp, Artificial Sequence
  Description of Artificial Sequence: Synthetic coding sequence
atgagtaatcagcaggagaaatatgaagctcaaaacatagttaattccaccgaagagtctgatgacgccttcgacaccgtgacaatacccgtgcctagcgaagagcctcaggagagtgaccaaaccgaagagcacgagtctggcatagagcagtttagcgaaagccacgcaattcacgttgaggagcagtccgatcagagcttttccagcctggagcccgataacgagcaactgatggaggaagttatttccccaaggcaggtgtcctatactccccagcaccatgagaaacaatatgccatgcagcgtcctaatgatgattctctggcgtttctggacaagataaagtcagtcaaagaatccctgcaggaatctgtagaagactctttagccacggtgaaggtggttctcatccctgtgggccaggaaatcgtgatcccattcaaagtggatactatcctcaaatacctgaaggaccatttcagccaccttcttggtattccccactcagtattgcagatccgctattcgggcaagatcttaaaaaataacgagaccctcgtgcagcatggggtgaaacctcaagagattgtccaagtggagattttcagtactaatcctgacctgtatcccgtacgtcggatcgacggtttgaccgatgtttctcagatcattaccgttaccgtacagaccgggctggaccaataccagcaggtccctgtggaaattgtcaagtctgatttccataagccttttcttggaggattccgacacaaagtgaccggcgttgagtatcataacgccggaactcagaccgtacccaagcgtatcccagaacgcctaagtatcttctgtcgagacacccaaacggtgtttcagaaaaagaacctgcaacagaccaccaatacaactagcacccagatgacaaatatcggagtttacgtgagtaacatgacagacaagctcgtcacccctggcaagtatttttccgccgctgaataccacgcccaacgacttaaggccgtcatagtcatccaaacttactatagacagtggcacgccaagatcttcgttgagaatctacgtcgccagaagtccctgaggctggagtgggagacacaacaggaactgagaaaaattagagaaaaggaagagtggattaagctggattatcacaggcggcataatcccaagacaaatgaagactttgagtttctgtataatgcactagagttttggcgacaggaggaattgacacggatcaaccaatccttcacaggggctgaacgaaaggccgctttatgcgaactgctcgaaaaagagacccaaatcattgcaagtatcggtcgccacaggtacattgcctatatggccaaccaggaggccgctattcaagctttccttgacaagtgtagtgcaccaaaaatttggcgcacaccaaatggtaaaacaatcgagatggacacccagttcacaattagggcgagggagctccagaatatctacaaatgtattatgcttaagaacatttctcaggacgaacgcctggacgtgctgcttaccctgaagcatacagtcaaagaacatgagtgcaagctgactcaagaaatcctggaattgattgatagagaggtggatcttatgatgaggggcgttaagcaccacaaccttgaaggtctgcgcaaacggatagcgacactcttcttccattacataaaaactcctttattcaatcccgaagtggctaagtacctgaaagtgcctcaggatccactgaagttctacaagaagatctacttctgccattcctgtcagttatacctcccttcaacagagttcagcgtgagttccacatctagacgaatctaccgctgtcgcaattgtatcaatttacaaaatgaggctcagaaacgggagtcttttttgaaatataaatgtctgttgcaacaactgtattatacggaggccgactacgaggatgactcaaaaattgccttcctgatgcagctccaggacatccagtacctcaccgaaaatatttgggccagccagtcagtgctgtctgcatgcgataacctatctgatctggtcatggtgaggtggaataaaagcctcgagtggtccccttggaattgcatattgctgaccaaggacgaggcagcggctcacctcaagctgacttccattgaagaagggtacgaaagatcgttcattcacaagattaaacataaacatatcttggccaaaaattacttcagccaagtccctgttctggctagttttatcctggacgacggcgaaatagatgagatcaggtggaaataccactctgacaccacaccgaagatcattgagtctcaacgaccgccacactag

SEQ ID NO: 28060 - DNA, 1767 bp, Artificial Sequence
  Description of Artificial Sequence: Synthetic coding sequence
atgagttcctgcgtatcgtcccaacccagtagcaacagggcggcacctcaggacgaattagggggacggggatcctcctcctccgaaagccagaagccatgcgaggcactccgtgggttatcaagcctgtcaatccacctgggcatggagagcttcatagtcgtgactgagtgcgaaccaggatgcgcggtggatcttggacttgctagagacaggcctctcgaagcagacggccaggaggtaccgctggataccagcggatcccaggcccgtccccacctgtccggacgaaagctctcactccaagagaggtctcaggggggactagcagccggagggtcgttagatatgaacggaaggtgcatttgccccagccttccctattctcctgtgtccagtccgcagtccagccctagacttcccagaagaccaacggtggagtcccatcatgtctctattacagggatgcaagattgtgtgcaactgaatcagtataccctcaaggatgaaattgggaagggctcatatggagtggtcaaactggcctataatgaaaatgataatacctattatgcaatgaaggtgttatctaagaagaagctaatcagacaggctggttttccgaggagaccacccccaaggggcaccaggcccgctccaggcggatgcatccagcctcgaggccctattgagcaggtatatcaggaaatagcgatcctgaaaaagttggatcatcccaacgtagtgaaactggtcgaggtgctcgatgatcccaacgaggatcatctgtacatggtttttgagttagtcaaccaggggcctgtgatggaggtgcccaccctgaagcctctcagtgaggatcaggccaggttctactttcaggatttgatcaaaggtattgagtaccttcattaccagaaaataatccaccgagacattaagccatccaacttactggtgggagaggacggccacatcaagatcgcagactttggcgtgagcaatgagtttaagggctcagacgcattgttatccaataccgtcggaacaccagctttcatggcgcctgagtccctttccgagacacggaagatcttctctgggaaagccctcgacgtctgggcaatgggagtgaccctgtattgctttgttttcggtcagtgcccttttatggacgagcgaatcatgtgtttacactccaagatcaaaagtcaggccttggagttccccgatcagcccgacattgctgaggatcttaaggatttgattaccagaatgctggacaagaatcctgagtcccgaattgtggtaccagagatcaagctgcatccttgggttactcgtcacggagcggagcccttgccctcggaggacgagaattgtactctcgttgaagtgactgaagaagaggtcgaaaacagcgtcaagcatatcccttccctggcgacagtcatcctcgtgaagacgatgattcgcaagagatcattcgggaatcccttcgaggggtcccgcagagaggaacgaagcttatcagctcccggtaatctgttaacgaaaaagccaactcgcgagtgtgagagcctttcagagttgaaagaagcgaggcagcgccgtcagccccctgggcatcgccctgctcctcggggtggaggcggtagcgcactggtccgcggtagcccctgtgtcgaaagctgctgggctcccgcaccgggatctccagccagaatgcacccgctgaggccggaggaggcgatggaacctgagtag

SEQ ID NO: 28061 - DNA, 2052 bp, Artificial Sequence
  Description of Artificial Sequence: Synthetic coding sequence
atggccttatccaagcgcgaactcgacgagctgaagccctggatagaaaagaccgtgaaaagggtgcttggattttctgagcctactgtggtcaccgccgcattaaactgtgtgggaaagggaatggataaaaaaaaggccgctgatcacctgaaaccatttctggatgacagtactttgaggtttgtcgacaaactcttcgaagccgtggaagagggtcgatcatccagacactcaaaatcttcatccgatcgaagcaggaaacgagagcttaaagaagtcttcggggacgactctgagatctcaaaagagtcttccggcgtcaagaagcggagaatccctcgatttgaggaggtcgaagaggaaccagaggttatcccgggtcccccatcagagagccctggtatgctcaccaagctccagataaagcaaatgatggaagcggcaacacgacagatcgaagagcgcaagaaacagctttctttcatctcccccccaaccccacagcccaaaaccccatcctcatcccaacccgagcgtctacccattgggaatacaatccagccatcccaggccgctacgtttatgaacgatgccatagagaaggcacgcaaggccgctgagcttcaggctcgcatccaggcacaactcgctctgaagcccggactgatcgggaatgcaaacatggttggactcgctaacctccatgctatgggaattgcgccacccaaggtcgagttgaaagatcagaccaagcctacacctctcattctggacgagcaaggaagaacagtggacgcgacaggaaaggaaattgaactgactcaccgtatgcccaccctgaaggcgaacatcagggccgtgaaaagggagcagtttaaacaacagctcaaagaaaaacctagtgaggatatggaatccaacaccttctttgacccgagagtaagcatcgctccgtcacagcgacaaaggcgcacattcaagttccatgataagggcaaattcgaaaagattgcccagcggctacggaccaaggctcagttagaaaaactccaggctgagatttctcaagccgctaggaagacgggaattcacacctctacacgcctggctctgatagcacctaagaaagagctaaaggaaggagacattcccgagattgagtggtgggactcttacatcatcccgaatgggttcgacctgactgaggagaatcctaaaagagaagactactttgggatcacaaatcttgtggaacatcccgcacagctgaacccaccagtcgataatgatacgcctgtcacactgggagtgtaccttaccaagaaagagcaaaagaagctccggagacaaactcgtcgcgaggctcagaaggagttgcaggagaaagtcagactgggtttgatgccccctccggagcctaaagtacgcatctccaacctgatgagggtccttggcaccgaagcagtacaggaccccactaaagtggaagcccacgttcgggctcagatggctaagaggcaaaaagctcatgaggaggccaacgcagcaaggaagctgactgccgagcagcgaaaggtgaaaaagatcaagaaactgaaggaggatattagtcagggggtccatatctcagtctaccgcgtcaggaatctctctaaccctgccaaaaagttcaagatcgaggcgaacgctggtcagctgtaccttactggcgtggtggtcttgcataaagatgttaatgtagtggtcgtcgaggggggaccaaaggctcagaagaagtttaagcggttaatgctgcataggattaaatgggacgaacagactagcaatacgaaaggagacgacgacgaggagagcgatgaggaagcagtgaaaaagacgaataaatgcgtcctagtctgggagggcacagctaaggatagatcttttggggaaatgaagttcaaacagtgtcccaccgaaaatatggcacgcgagcatttcaagaagcatggggcagagcattactgggacttagccttatccgaaagcgtcctagaatcaacggattag

SEQ ID NO: 28062 - DNA, 1938 bp, Artificial Sequence
  Description of Artificial Sequence: Synthetic coding sequence
atgagtgataagtcagatctgaaagcagaactagagagaaaaaaacagaggttggctcagatccgtgaagaaaaaaaaagaaaggaggaggagaggaagaagaaggaggcagatatgcagcagaagaaggagcctgtacaggacgactccgatttagatcgaaaacgcagagaaactgaggctcttctgcagtctatcggcatttctcccgaacctccactggttcagcctcttcacttcctgacttgggacacgtgctactttcactacctggtccctacacccatgtcaccatcaagtaaatctgtctccactcccagcgaggccggttctcaagacagcggggaccttgggcctctgacaaggactcttcagtgggacacagatccatctgtcctgcaattgcagtccgatagtgaattgggtagacggctacataaactgggggtgtccaaagtgacccaggtggattttctaccgagagaggtcgtttcttattccaaagagacccaaacccctcttgccacccatcagagcgaggaagacgaagaagacgaagagatggtcgaatctaaagtggggcaggattccgagctggaaaaccaagacaaaaaacaagaggtgaaagaggcccctcccagagaactgaccgaggaggaaaaacaacaaatactgcattctgaggagtttttgatttttttcgatcgaactatcagagtcattgagcgagcacttgccgaggactcagatatcttttttgactatagcggaagggagctggaggagaaggatggggacgtacaggcgggtgctaatctcagcttcaaccgacagttttacgatgagcactggagtaaacaccgcgtggtgacgtgcatggactggagtttgcagtaccccgagctgatggtggcttcctataataataacgaagacgcaccccatgagcccgatggggtcgccctggtgtggaatatgaagtttaagaagacaacgccagagtatgtgtttcattgccagtcatccgtgatgtctgtgtgtttcgctaggttccaccctaatctagtagtggggggaacttacagcgggcagatcgtactgtgggataaccggtcccataggcgcactccagtgcagagaactccactgagtgccgcagcccacacacaccctgtctactgcgtcaatgtagtgggaactcagaatgcccacaatttgattaccgtatctacagacggcaaaatgtgcagttggagccttgatatgctttcaacgccacaggaaagtatggagctggtttacaacaagtcaaaacccgttgcggttacgggtatggctttccccactggggacgtgaataactttgttgtggggagtgaggaggggactgtgtacaccgcctgcaggcatggcagtaaggctggcattggagaggtatttgagggccaccaaggcccagtaacaggcattaattgtcatatggcagtaggcccaatagatttttcgcacctgttcgtcactagcagctttgactggaccgtcaagctgtggactaccaagcataacaagcccctctactctttcgaggataatgctgattacgtatatgacgtgatgtggagtccagtgcacccagcgctgtttgcttgtgtggatgggatgggacgattggatctctggaacttgaataacgacactgaggtgcccactgcgtcagtggccatagaaggagcctcagcactcaacagagttcgctgggcccaggcaggtaaagaagtcgcagtcggggattcagaaggcaggatatgggtctatgatgtaggagaactggcggttccccataatgatgaatggactaggtttgctcgcaccctcgtggagatcagggcaaacagagcagattcggaggaagaagggactgtcgaattgtctgcctag

SEQ ID NO: 28063 - DNA, 7805 bp, Artificial Sequence
  Description of Artificial Sequence: Synthetic coding sequence
atgaagaggaaagtcgttaatacccacaagttaagactctcccccaacgaagaagctttcatcttaaaagaagactatgagaggaggaggaaacttcggttacttcaagttcgggaacaggagcgcgacatcgccctgcagattcgcgaggatatcaagcaacggcgaaaccagcagttcactagacttgccgaagaattgcgcgctgaatgggaagagagtcagactcagaagattcaaaatctcgagaaactctatctcgcttcactacggtcaatgggagaaggtcaccgccaggctaaggagaatgagcctgacctcgatgcgttggcccaaagagccgctgagcgcaaaaggaaagccgacctgcgccacaaggaagcacttaaggtgcaaaagaatcagaaagaaattttgcttaagcagaagacttggcacataaaagccaggaaggaggctctcttggtagaaaaagaacgatcagcaaagatcacttctctccctccccctccccctacattgttcgaaaacattgaggttaagaggattagtgccgtaaagacgaacagcagcacgtaccatcatttgcacaccttcgtcaacagagagaccgataccaagagacccgatgcaagattggctgctgaggaagaggctaaacgtctggaagagctgcaaaaacaggcagcacaggaacggatggaaagatttgaaaaggcacacgtgcgaggctttcaagctatgaagaaaatacatctcgctcagaatcaggagaaattaatgaaggagctgaaacagctgcagcaagaagacctggccagacgcaggcagacagtggcacagatgcctccgcaactcgtcgagctcccttataagcggagcgaaatgaaggaggattggcagagggagctagagttcgctttcgaagatatgtataatgccgaccggaaggtcaagggcaaccttatcctgcacctggagccagaaccgttacccacggtcaccaaccaaattcaggacgaagaactggacctgtcgatggagcaggaaaatctcggcgcagccgaggatcttcccgtcaccgaagctgaaatctgctccagtgaaaccgatgtccccctcgtaatgaaaactcagcagatcccatcaaaagtcctgtttaaaaaactcctaaacaagattagatcccaaaaaagtctctggaccatcaaaagcatgagcgaagatgagtctgaaatgatcacgactgtgagcgagattgagtcgaaagcccctacagtcgagtctggcacaatcgcgtccaaggaacgaaccctgagctctggacaggaacaggttgtagagtctgatactctgacgattgaatctgggccactagcttcggaggataagccactgtcgtgtggtacaaactccggcaaagagcaggagatcaacgaaaccctgccaattaccaccgttgcgcagagctccgtgctcctgcaccctcaggaagcggctgctcgaatacggatgagcgccagacagaaacagattatggaaatcgaggaacaaaaacagaaacaattggagcttctggagcagatcgaacagcaaaagcttaggctcgaaacagactgctttagagcccagctggaggaggaaaagcgcaagaaaacccagcccacaggagtcgggattgcccctgcgagctgcccagttatctccgatgaggattctcacaggcagatgatccgcaactaccagcatcaactccttcagcaaaaccgtctgcacagacagtcagttgaaaccgcgcgtaagcaattattggaatatcaaaccatgctaaagggaaggtgcccttcagtatcggccccaagcctgatcaccgatagcgtgatctccgtgccttcttggaaatccgaacgaccaacagctatctcggagcattgggatcagggacagagactgaagctgtctccaaacaaatatcagccgatacaacccatccagacatctaagttggaacaggatcatttccaggtggccagacaaaaccactttccccagcgacaggtggagactaccgagactttgagggcatctgacatcttgacaaatcaagccctcgagtctcaggaacacttgcggcagttttcccagaccgagacccagcagcgggactacaagctggtcccaaaggacagcgagacattgtctcgcgctctgtcacacgaccggcagctgatcagtcaggacgccagaaagatctcggagacgttcggagccacaacgtttcagagcctggagagccaacagctcttcagcgagaattctgaaaacatctcctatcatcttaccgagccatcatcttttgttccgctcgttccacagcactctttcagttcattgcctgttaaggtggagagtggcaagattcaggaaccattctctgcaatgagcaagagcacagtcagtacctctcacagcatcatctcccagatgcatgataggccactactgccctcggaaaatattaccgcgcaacagggtaatatgaaggccctgcaggagcagctcgacctccagaagaaagtgctgcaagccacccaggaagcgcaggagcagctgctgctctgtaagcagaaggaagttgaacaacagaccggtctcagtgtgtttctgccactggttacacccgacagttccgctctgctcccaagcgccaaagccgaccttggcagaatccaagagagttctcccaccaagaacaacattgccgtaagcagcgaccatcatgtgatctctcagttgcaggataaaagactctcgctgtctcagccaatcctgtctcagcagaataattttaagtttttgcaagagcaactgaatatacagaaggattctctccaggctcggagggaggcgcaggaggtcctgtatgtccataaacagtctgaattagaccggcgagtctgcagcgagcaggcggagcctagctttccttttcaggtcgcacagcatacgtttacctccttacccagtgcagacactaagagtggaaagatccaagaacagcacagcagtaagtccgagaaggggttagtttcctgtcagagcgacatccccatatctcaggacgggtcactgagcttcctccagcagttcttgcccctgcacgattccctcaagctgctacaggagcagctgaccaaacaaagagatactctgcaagctcgacacgaagcacaagtagagctgttacttcacaggcagagagaccttggggattcaaagtctgggctggtaagtagttcctcatcaccagtagtggtacagcattccgtcgcttcacaggccagcgccaaagccgagccccgtcgcattcaggaattatatctgagcgaaaaggagaacgtgggaccatcctgtcacctcattatccccacttttcaggacaagagtttgtcattcccccaacacagtctcgcccagcaggaaaatttgacaatacttcaggagcagtcacagattcagagagtcatcttaggtgctaaagaaggcacacaggaattcgtccatacggaatcggagctggagaaacgaatctctagtgaacaaacaggcacatcctcaagcctcagtcaggtggacgagtccgagcgatttcaagaatgtatttccataaaaagcgacagcacaatccctctaagtcacccaaaaatccccaggtgccaagaacgtctcttaagagtgagccagcatatgctccctctgcaggacaacctcgaagaacatcaagcgtggctggataccgaaaaagaagcttttcacttctctcaaaaaacgcaggagaataccagtagtgaacagactggctctagttctttcatccctcagcttgtacagctgagcttcacctctctggcctccgctgaaagcgggacaatattagaacccttgttcaccgagtcagaaagcaagattttcagctcgcaccttcagatcccccagcttcaggacaggttacttcgaatttctcaactcatccaaccacaacaggataatctgaaagccctgcaggagcagctggccacgcagcgtgaggcaataatcctcgcacggcaggaagccagagaagagctactattgcatcagtcagagtgggaggggcgtatttctccagaacaagttgataccagttcactccctttggtaccgcagcacagtttcgcctcactacctttgaacgagtctgagagaaaccaggaaccctgctctattaacagtgataatatcgtctcatcagggcactcagaaatccctaccctgcctgacggcctgctgggcttgtcccacctggtcctaccccaacaggacaacctcattgctctggaagagcacctgcacgctcagacagattttctcccttcaatcgagaagacccagaaggagctagtgctttccaaaccctgtaagttcgaagagaaagtatccagtgaacatttcatccaatctcatcacggagatttgcaagcgctccaacagcaactggacacacagaaaaaggcaatccggagtatccaagaggtgcaagaagaactgctactacaacgcctgtctgagctggagaaaagagtctcctcggagcaggtgtgttcaagcagctttgtgtcccaagtgcctgtagcggattctgagcgcactcagaaatctttccccacaaagtcaaacgacaccctaccatcttcacaccgggagattccccgtctgcaagatcggctcctatccttgagcaagcctatccttccccagcaggacaatatgactgcccagctggatgctcagagagaggtgatgtactcctatgagaagccacaggaagagctgtctctgaataaacaacggaaactgaataagagcgagtcggctgaacacacaatcccctctctgtttctgcccaaagagacagagcatagttttattcccctgccctttgcagaagccaagccaaaatccacctgcgagctgtattccagccaaaatgagcacgccgcacccccatcaaatcctgttattcctggctttcaggataggctgctcagcttctctcagagcgtgctaacccagcaggataacttgggtcttcagaaacaactggatctccaaagggaggtgttgcattattcccagaaggcacaagaaaagttgttagtgcagagacagaccgcattgcaacagcagattcagaagcatgaggaaaccttaaaagactttttcaaggactcgcagatctcaaaaccaacggttgagaacgatctcaagacacagaaaatggggcagctcagagattggttcccaaatacccaagatttggcagggaatgatcaagaaaatatcagacatgctgacagaaataactctgacgacaatcacctggcctctgaagacacttccgctaagcagtctggagagcaccttgaaaaagacctgggtcgccgttcttccaaaccgcctgtcgccaaagtcaagtgtggactagatctcaaccagcatgaactgtccgcaatccaggaagtggaaagccccgcaataggcaggacaagtattctgggtaagccagggatatacgaagacagggaccctcttcgggtgtccatttccagagagcaatccttttttggaagtccactcgctcacgatcctttttcctgcttacagctcgtgggacaggaaaacgtctgtggtgatgactatgacgaggccgtgaaacttaaagagagcgttgttgagaatcacgcagttctgagttatgctgtcgaggaagaacacgcctatctcgggcctaccgtgaagccagacgacaaggctaaaacgttatcctacgagcctctctcaagtgccaccgtgagcaccgggtctctgctgtcctacgaaaataccgatctgagcctcacagacccggagagttttagcgagcacatggacgatagcaagcaggagagcacgacttcaaaagaagaagaaaccaatatcattagctctatagtgccaagtactcaggacatctaccagagacaaaacagctccgatgtgcataagtctctgttgcccgcagtggacgaaacgacatgtgggcatacccatttccaacaaatgatcgataaatacattaacgaagcgaacttgatcccagaaaaaaccgatcttcaggagttggaacacatcttccccaatctgcaccaccaactgtttaagcctctggagcctcacccagactttgatttaagttcgagcagttccggcattagccctgacaatcgtgacttttaccaaagatcggattcgtcctccgaatctcactgtgctactggcctatccaagtccaccgtctactttacagccctacggaggacttcaatgcacagttcacttaatacctccccaaatcagcagccagacaccaacttagctcacgtgggggctcattctttcgcgacagagaacatcataggcggatcggagcagtgctttgaacagctgcagcccgagtattcaagccaagaagagtcacagcatgctgacctcccttccatcttcagtatcgaagcacgggactccagccaggggatgaagaatcaaaactatcctagcgaagagcacactgaaatcctccagaacaaaaagaaaattgtgcatttccagctaagcatcggtaacctcagttctgtgtacagttcgtctgatgaggcaaatgtgtttgaccagcttaatgtacagcacagtactccttgtggctctaactcttccgaatgctcaactaagcaccagcttgaatcacggaaggagtcgatgggtttcgaggaactctctaaaaggggagtggtcactatgctgcagtcccagggattaatcgaggataacaaaaacgaaacttgccgggtcttggatattaaccctcaggtggaagagacagattcaaggctgtgcgttagaacagtggagatgggcaccagcatccaggcaccttacagtttgaccacccagaatgagaaatattttgaaaatagtgcggagaccgatattcccaagataaccaaaaaactgagccaactgggtgagtcagaactgttcgcaagctccggctccttttcactgcaaagctccattcccgtctgggaaaccgaaacaggccacggtataatggaggaacctgagctcacattgatttcaaccacagatactagtattgcagagatggattttgccaatcttaccctggaggagaagtccgagaatgaagccaagtgtttttttcaggtttccgaattcctgccactggtttcagcgacagaagcgtcagattaccccgctgtgagtgagttgagtatagaaaaacccagaaccgcttctacagagaccccgaggcggctgacccctgttcctggttccttgcaagaggcctttattaagaggaagaaatctttcatggaacggtctcatcagagacagaaggaaatccgcaacaagattcacgtttcagaaaatagccagatcaagacagtgaaagaaaaaccctccatttcctcctcggtgtcacgactcaaaggtgtcaacaaggttcgggcttctttccccgaggatcgcaagaccacacaagccctccggcaccaacggggtctccgcctgtataaccaattggctgaagttaagcagcaaaaagaggagaaaaccaaacaggaagcctacgcccaaaaccgcgctcgggctaaagaatttcataaaaagaccctggagaagcttcgcgcaaagaatacctgcta

SEQ ID NO: 28064 - DNA, 2397 bp, Artificial Sequence
  Description of Artificial Sequence: Synthetic coding sequence
atggctgcttctctgcctggccctggaagccgactgttcagaacttacggtgccgctgacggacgcagacagcgcaggcccggacgagaggctgcgcaatggtttccccctcaagaccgtaggcgcttctttaactcctctggctccagcgacgcctcgattggggaccctagtcagtccgacgacccagacgatcccgacgaccctgacttccctgggtcacccgtgaggcgccgaagacggcgtccagggggacgggtccccaaagatagacccagtcttactgttactccaaaacgttggaagctccgtgcacgccctagtctgacggtcaccccgaggcggctcgggctacgggctagaccaccacagaagtgtagcactccttgcggcccattgaggctccccccttttcccagcagggatagcgggaggctgtcgcccgacctgtccgtatgcgggcaacctcgtgacggtgacgagctgggtatcagcgcatccttattctctagcctcgcctccccctgtcccggaagtcctacgccgagagattccgtgattagtatcggaaccagtgcgtgcctggtggccgcatctgccgttccaagtgggttgcatctgcccgaagtctctctcgaccgcgctagtctcccttgctcacaggaagaggcaacaggcggtgctaaggacaccaggatggttcatcagacccgggcatccctgcggtctgtgttgtttgggctgatgaattccggcactccagaagactccgaatttcgagccgacgggaagaacatgcgtgaatcctgctgtaaacggaaactggtggtcggcaatggcccagaaggtccaggcttgagctcaaccggcaagcgtagagccactggccaggactcctgtcaagagcggggtttgcaagaagcggtccgccgtgaacaccaggaggcgtctgttccgaaggggaggattgtccctcgagggattgatcgactagagcgcactcgttcttcacggaaatcaaagcaccaagaagccacagaaacttctctacttcattctcatagatttaagaaggggcaaaaactgggcaaagacagctttccgactcaagacttgacccccctgcagaacgtttgcttttggaccaagacacgcgcttccttctccttccataaaaaaaaaattgtgactgacgtgagcgaggtttgctccatttacaccaccgcgacctctctgagtggatctctgctgagtgaatgcagcaatcggccagtgatgaatagaacttcgggtgcaccatcgagttggcattcaagctcgatgtatctcctgtcgcccttaaacaccctcagcatctctaataagaaggcctccgacgcagagaaggtctacggcgagtgtagccagaagggcccagtccctttttcacattgcctgcctaccgagaaattgcagcgatgcgagaagataggtgagggtgtgtttggcgaggtgtttcagactatcgcagaccatacccctgtcgccataaagattattgctatcgagggccctgacctggtcaacggtagtcaccagaagacctttgaagaaatcctccccgagattatcataagtaaggagttgtctttattatctggtgaggtttgcaatcggaccgaggggtttataggtttgaactctgtgcattgtgtgcagggtagctacccccctctgctgctgaaggcttgggatcattataactccaccaagggttccgcaaatgatagaccggatttcttcaaagacgaccagttgtttattgttctcgagttcgaattcggcggtatagacctggagcagatgcggaccaagctgtcaagtctcgccaccgccaagtctatcttgcatcagctgacagcaagcctcgcggtcgccgaagcctccctcaggttcgagcacagggacctacactggggcaatgtcctgttgaaaaaaacttcacttaaaaagcttcactatacgctgaatggcaaaagcagcactatcccctcatgcgggctgcaggtgtctattattgattacacgctctcccggctggaaagggacggtatcgtggtcttttgcgacgtgtccatggacgaagatttgttcaccggcgatggtgactaccaatttgacatttaccggctcatgaagaaggagaataacaaccgctggggcgaataccacccatattccaatgtgctgtggttacactaccttaccgacaagatgctgaaacagatgaccttcaagacaaagtgtaacacccctgcgatgaagcagatcaaacgaaagatccaggagtttcacaggactatgctaaacttctcatccgcaacggacctgctgtgtcagcactcactgttcaaatag

SEQ ID NO: 28065 - DNA, 765 bp, Artificial Sequence
  Description of Artificial Sequence: Synthetic coding sequence
atggtgagggaggctaatattaagcaggctacagccgaaaagcaactcaaggaggcccagggcaagatagacgttcttcaggctgaggtggctgcactcaaaacgctagtactcagctcctccccgacatcaccaacgcaggagcccctgccgggtggaaaaacgccctttaaaaagggacacacgcgcaataagtcgacatcctctgccatgtccggatcccatcaagatctgagcgtcatccagcctattgtgaaagactgcaaggaggccgatctgtccctctacaacgaattccgactgtggaaggacgagccgactatggacaggacttgcccatttctcgacaaaatctaccaggaggatattttcccttgcctgacgttttctaaatctgagctggctagtgccgtgctggaggccgtggaaaacaataccctgagtatagagcccgtggggctgcagcccatccggtttgtgaaggcgagcgcagtcgaatgcggcggtccaaagaaatgtgcgctcacaggccagtctaagagttgtaagcatagaatcaaacttggtgacagtagtaattattattacatcagccctttctgtaggtatcgcattacgagcgtttgcaatttttttacttatatcagatacatccagcaaggcctggtgaaacagcaggacgtggatcagatgttctgggaagtcatgcagctgcggaaagagatgagcctagccaagctaggctatttcaaggaggagctatag

SEQ ID NO: 28066 - DNA, 1077 bp, Artificial Sequence
  Description of Artificial Sequence: Synthetic coding sequence
atgtacgctagccagtggttcttaaccctgtttaccgctaagtttcctctgtgcatggtgtttcatatcatcgatttgctcttatgcgaagggctgaatatcatcttccacgtcgccctagcactgctgaagacgagcaaagaggacttactccaagcagatttcgagggcgctttaaagtttttccgggtccagctgcccaaaaggtacagggcggaagagaacgcacggcgtctgatggagcaggcgtgtaacattaaggtacctaccaagaagctgaagaagtatgaaaaggaatatcagacaatgagggagtcccaactgcagcaggaagacccgatggaccggtataagagggagaaccggagactgcaggaggccagcatgcgactggaacaggagaacgatgacttggcacacgagttggtcacttccaagatcgcgctaaggaacgatctcgatcaagcggaggacaaggctgacgtgctgaacaaagagctgctcctaaccaaacagaggctcgttgaaaccgaagaggagaagaggaagcaggaggaggaaacagcccagctgaaggaggtcttccggaagcagttggagaaagccgaatatgagatcaaaaaaaccaccgctattatcgcggaatacaaacagatctgcagtcaacttagcacaagactggaaaaacaacaagctgcgagtaaggaggagctcgaggtggtgaagggcaagatgatggcgtgcaagcattgttccgacatattcagtaaagaaggagcgctgaagctcgccgctacaggcagagaggatcaggggattgaaacagacgacgaaaaggactcattgaaaaaacagctgcgcgagatggagctggagctggcccagacaaaactgcaactcgtcgaagcaaagtgcaagatccaggagttggaacaccagagaggtgccctgatgaacgaaatccaggctgcaaagaattcttggttctctaaaacccttaacagcataaagaccgctaccgggacccaaccactgcagccagcccctgtaacgcaaccacccaaagagtccacatag

SEQ ID NO: 28067 - DNA, 2436 bp, Artificial Sequence
  Description of Artificial Sequence: Synthetic coding sequence
atgccactttcatccccaaacgctgccgctactgcaagcgacatggataagaattctggtagtaactcctcttccgcatctagcggttcaagtaagggccagcagccgccacgtagtgcttccgctggacctgctggggagtccaagcccaagtccgacggaaagaacagctccggatcaaaaaggtataatcgaaaaagagagctgtcgtatcccaaaaatgagtctttcaacaatcagtcaagacggagttccagccagaagagcaaaacattcaacaagatgccacctcagcgtgggggaggatccagtaaactcttctctagctcctttaatggcggtcgcagagacgaagtcgctgaagcccagagagccgagttttctccggcacaattttcgggcccaaagaaaattaatctaaaccacctgctcaattttacatttgagcctaggggtcagacagggcacttcgaggggagcgggcacgggagctggggtaaacgaaataaatgggggcacaagccatttaataaggagttattcttgcaggccaattgccaatttgtggtcagtgaggaccaggattatacagctcacttcgctgatccagatactttggtcaattgggactttgtggaacaggtgagaatctgcagccatgaggtccccagctgccccatttgcctctacccaccgaccgctgcaaagatcactcgatgcgggcatatcttttgttgggcctgcattcttcactacctgagcctgagcgaaaagacctggtctaagtgccctatttgttattcatccgtgcacaagaaggatctcaaaagtgttgtggctactgaaagtcaccagtatgtggtaggggatactattacaatgcagctcatgaagcgggagaaaggcgtgctggtggcgctgccgaaatcgaagtggatgaatgtggatcaccctattcatctgggtgatgagcagcactctcaatattctaaactgctgctagcaagcaaggaacaggtcttgcaccgcgtggtccttgaagaaaaggtagccctcgagcagcagttggcagaagagaagcacacgcctgagtcctgcttcattgaagcagccatccaggagctgaaaactagagaggaggcactgtccggactggctggtagcaggagagaagtgaccggtgttgtggccgctcttgaacagcttgtcttgatggcccctctggcaaaagagtctgtgtttcaacccagaaaaggagtgcttgagtatcttagtgcctttgatgaagagactacagaagtgtgctcgctcgacacaccctccagaccactcgctcttccactggtcgaagaggaagaggcagtgtcagaaccagaaccagaaggactgccggaggcctgcgatgacttagaactggctgatgataacctgaaggagggtaccatctgcactgaaagcagccaacaggaacctatcacaaagtcagggtttaccaggttgtccagttctccttgctactacttttaccaggctgaggacggacagcacatgtttctgcaccctgtgaacgtgcgttgcttggtgcgggaatatggatctctggaaagatctcccgaaaaaattagtgcaacagtggttgagatagctggctacagcatgagcgaagacgtgcggcagcgccatagatacctttcccacctccccctcacttgtgaattctcgatttgcgagctggccttacaaccgccagttgtgagcaaggaaacactggagatgtttagcgacgatattgagaaaagaaagcgccagaggcaaaaaaaggctcgagaagaacgccgacgcgagcggagaatcgagatcgaggagaataaaaaacagggcaagtatccagaggtgcacattcctctggaaaatctgcagcagttccccgcttttaattcctacacctgttcctcagacagtgccctcggacccaccagcaccgaaggccacggagctttgagcatttctcccctgtcccgttctccgggttcccatgccgatttcttgctgacacctctgtcacccacagctagccaggggagcccttccttctgtgttggctcgctggaagaggactctccattccctagctttgcccaaatgctgcgggtgggcaaagctaaagccgatgtttggcccaagaccgcgccaaaaaaagatgagaattccctggtgcctcccgcacccgtggactcagatggcgagtccgacaattctgacagggtgcctgtgccaagcttccagaattcattctctcaagctattgaggctgcattcatgaaactcgacaccccagcaacgtctgaccccctttctgaagaaaaaggcggaaagaagaggaagaaacaaaagcagaaattgctgttttctacatccgttgtccatacgaaatag

SEQ ID NO: 28068 - DNA, 5825 bp, Artificial Sequence
  Description of Artificial Sequence: Synthetic coding sequence
atgaagaccagcgaccttgttcccagtttcgggtatttcatcaggtctccagagaaacgtgaacctatcgccttaattcgaaagagtgatgtaagccggggaaatctggagaaagaaatggcacacctgaaccatgatctatattctggcgatcttaatgaacaaagtcaggcccaattgtcagagggtagtattactctacaggtcgaagccgtcgaaagcacatctcaagtggatgaaaacgatgtgacgcttactgccgacaaaggaaaaacagaggacacattctttatgtccaataagccccagcgttacaaagataagctgccggattccggagatagtatgctgcggatttctactatcgcctccgccatcgccgaggccagtgtaaatactgatccttcacagcttgccgctatgattaaggcacttagtaataagaccagagacaaaaccttccaggaggatgaaaaacagaaagactacagccacgtcaggcattttttgccgaacgacctcgagaagagtaatggatctaatgcattagacatggagaaatacctcaaaaagacagaggtttctcgatacgagagcgcactggagaacttctctcgggctagcatgtccgatacctgggacctctccttgccaaaggaacagaccacccaggacatccacccggtggatctctcagcaaccagcgtgtccgttcgagcccctgaggagaacacagccgctatagtctacgtggagaatggagagtctgagaatcaggaatcttttagaaccatcaattcaagtaactctgttaccaatagagagaataacagtgccgtcgttgatgtgaagacgtgttcgattgataacaagctgcaggacgtgggcaatgatgaaaaggccacgagtatttcaactcctagcgactcctactcgtcagtcaggaatcctagaattaccagcctgtgcctccttaaagattgtgaggagattcgcgataacagggagaatcagagacagaacgagtgtgtgtccgaaatctctaattccgagaagcacgtaacattcgagaaccatcgtatcgtctcacctaaaaacagcgatctgaagaatacctctcctgaacacgggggacgagggtctgaggatgaacaggagagttttcggcctagtactagtcctctatcccattcgagtccctctgaaattagcggcacctcttccagcgggtgcgcccttgagtcctttggtagcgctgcgcagcagcaacaaccaccatgcgaacaggagctctctccactggtgtgttcaccagccggtgtcagccggctgacgtatgtgtccgagccagaatcgtcctaccccaccacagctaccgacgacgctctggaggaccgtaaaagtgacatcactagcgagttgtctaccacaatcatccagggatctccggctgctctagaggaaagagcaatggaaaagttacgtgaaaaggtgcctttccagaataggggtaaggggacactgagctctatcatccagaacaattccgatactaggaaggcaacagaaacaacatcattgagctcgaagccagagtacgttaagcctgacttccggtggtcaaaggaccctagctccaaaagcggaaaccttctcgagacttccgaagtgggctggacgtcaaatccagaggagcttgatcccatcagactcgctctacttggaaagtctggcctgtcctgtcaggtgggatccgcgacaagccatcccgtgagttgtcaggaacctattgacgaagaccagcgaatctcccctaaggacaaatctactgcaggcagggagttctctgggcaggtcagccaccagaccaccagcgaaaatcagtgtaccccaattccttcttcaacagtccattcctctgtagcagacatgcagaacatgcccgcagctgttcatgccctgttgacccagccatcgctttcagctgcaccctttgcccaaagatatcttggcaccctgccctccacgggaagcacaacactacctcaatgtcacgccggaaatgctacagtgtgcgggttcagcggcggtctcccctaccccgcagtggcgggtgagcccgtccagaattctgttgcagtaggcatctgcctgggatcaaacatcggcagcgggtggatgggaactagcagtctgtgtaatccatactcaaacactcttaatcagaacctgctctctacaacaaagccgttccccgtaccatcagtggggactaattgcggaattgagccgtgggatagcggcgtgacgagtggtctcggaagcgtgagagtgccagaagagttgaaattgccccatgcatgttgtgtcggcatcgccagtcagacgctcctctccgtgctgaaccctaccgatcgctggttgcaggttagtatcggagtgctctctatttcagtcaatggcgagaaagtggacctatccacctacagatgtctggtgtttaagaacaaagctatcatccgtccacacgctactgaggagatcaaggtcctgttcattccctcttcaccaggcgtctttcgctgtacattctcggtggcatcgtggccctgctctactgatgccgaaaccattgtccaagccgaagcccttgcaagtactgtgacactgacagccattgcggagtccccagtaatcgaggtggaaaccgaaaaaaaggatgtcctcgacttcggcgaccttacatatggagggtggaaggcgctccctctgaagctgataaataggactcacgcaacagtccccattcggctcattataaatgcgaatgcagtagcatggcgatgctttaccttcagcaaagagtctgttcgggctccggtggaagtcgcgccatgcgcagatgtcgtgactcgtttggccggtccaagtgttgtgaatcatatgatgccagccagttatgacggacaagaccctgagtttctgatgatatgggttctgttccacagtccgaagaaacagatcagctccagtgacattcttgactcagccgaagagtttagcgccaaggtcgatatcgaagttgacagccccaatcctacccccgtcctccgatcagtctccctgcgggcacgggcaggcatagctcgcatccacgcccctcgcgatttgcaaactatgcatttcctggcgaaagttgcctccagcaggaagcagcatcttcctctcaaaaacgcgggtaatattgaggtatatctggatattaaggtgcccgaacagggctctcatttcagtgtggaccccaaaaacctgctcctgaaacctggggaggagcacgaagtgatcgtgtccttcacccccaaggatccagaagcatgcgaagagcgaatcctgaaaatcttcgtccaaccgttcggtccgcagtacgaggtcgtacttaagggagaggtgatctcctcaggatctaagcctctcagtcctggaccatgccttgacatcccaagcatcctgagcaataagcagtttctagcatggggtggagtcccgctggggagaacacagctccagaagctagcactcaggaacaacagcgctagcactactcagcacttgcggttactcatacggggacaagaccaagattgtttccaactccagaacacttttggaagtgaacaacggctcaccagcaattgcgagattcgcattcatcctaaggaagacatctttatcagtgttcttttcgctcccaccagattgagctgtatgctggcaaggttggaaattaaacaactggggaacagatcccagccaggcattaaattcaccatcccacttagcggctacggcggtacctccaatcttatcctggagggggtcaaaaagttgtccgatagttacatggtaactgttaacggcctggttcctggtaaggagtcaaaaattgtgttttctgtcagaaacaccggcagccgcgcagctttcgttaaagcagtaggatttaaggacagccagaagaaggttctgttagacccaaaagtcttgcgtatcttcccggacaaattcgtacttaaagaacgcacgcaagaaaatgtaactcttatctataatccatcagaccggggaataaataataaaacagctaccgagctgtccaccgtctacctatttgggggtgacgaaatctctcgacaacagtatcgcagggcccttcttcacaagccagagatgatcaagcagatcttacccgagcacagtgtgctgcagaatatcaacttcgtagaggcctttcaggatgaattgctggttacagaggtctacgatctgccacagaggcctaatgacgttcagctcttttatggttcgatgtgcaagatcatcctcagtgtaattggggagttcagagactgcatctccagcagggagttcctgcagccctcttctaaagcctcactggagagcactagtgacctgggcgctagcggcaaacatggaggaaatgtgtctctcgatgtactaccagttaaaggcccacaggggagcccgttacttagccgagctgcacgcccacctcttgaccagttggcatctgaggagccgtggacagtgttaccagaacatcttatcttggtggcgccatctccatgtgacatggcgaagacagggcgttttcagatagttaataactctgtgaggctgctgcggtttgagttgtgttggcccgctcactgccttaccgtaactccgcagcacggttgcgtcgcgcctgaaagcaagctccagattctggtcagcccaaacagctccctgtcgaccaaacagtcgatgtttccttggagcggtcttatctatattcactgtgatgatggtcagaagaagattgtgaaggtgcaaatccgtgaggatctaacccaggttgagctcttaacccgcctgactagcaagccgtttggcatactatctccagtgtctgaaccctccgtgtcccaccttgtcaagccaatgacgaagcccccaagtactaaagttgagatcagaaataaaagcattacttttcccaccacagaaccaggtgagacctccgagtcatgcctagagctcgagaaccatggaacaacagacgtaaagtggcaccttagctcgctggcccctccttacgtgaaaggagtcgacgaatcgggcgacgtatttcgcgcaacatatgcagctttcagatgctcaccgatctccggcctcctggagagtcatggtatccaaaaggtgagcattacgtttcttcctagaggaagaggtgattacgcgcagttctgggacgtagagtgtcatcctctgaaggagccacatatgaagcataccttgaggtttcaactatcaggccaatccattgaagctgagaacgagccagaaaatgcatgtttatcgacggactctctgataaaaatcgatcatctggtgaaacccaggcgccaggctgtctcagaggctagtgctcgtatacctgagcaactggacgtgaccgccagaggcgtgtacgccccagaagacgtgtaccgttttaggccaacatcagtgggcgaatctagaacgttaaaagttaacctcaggaacaacagctttatcacacacagtctgaaattcttaagccctcgagaaccattttacgttaagcattccaaatactctctgagagcgcaacattatatcaatatgcctgtccaattcaagccaaaatctgcaggcaaatttgaggccctgctggttatccagacagacgaagggaaatctattgctattagattgataggtgaagccctaggtaagaacta

SEQ ID NO: 28069 - DNA, 4167 bp, Artificial Sequence
  Description of Artificial Sequence: Synthetic coding sequence
atggcgcctggatgcaagacggaactccgatccgtaaccaatggacagagtaatcagccttctaacgagggggatgccataaaggtattcgtccgcatacgccctcctgctgaaaggagcggaagcgcggatggagagcaaaatctgtgtttaagcgtcctgtcttccacttccctgagacttcactctaaccccgaaccaaagacatttacttttgaccatgtggctgacgttgataccacccaagagtcagtattcgctactgttgccaagtctattgtcgaaagctgcatgtcgggctacaatggaacgatctttgcatacggccagaccggatccgggaaaacattcactatgatgggaccatcagaaagcgacaacttctcccataacctgcgcggtgtcattcctagatcttttgaatatctcttttcactgatagacagagagaaagaaaaggccggagcgggaaaaagctttctgtgtaaatgttctttcattgaaatatacaacgaacagatctacgacctccttgatagtgcttccgccggactttacctgagggaacacatcaagaaaggcgttttcgttgtgggtgcagtcgaacaggtagtgacatcggctgccgaggcctaccaggtgctcagtggtggatggaggaaccggagggttgcctccacctctatgaaccgggagtcctctcggtcacatgccgtgtttactatcactatagaaagtatggaaaagagcaacgagattgtaaacatccgcacaagcctgctcaacttagtggatttggccggtagcgagcggcaaaaagacacacatgccgaaggcatgcgcctcaaggaggccggtaacatcaatagaagcctgtcatgtctgggccaagttatcacggctctagtcgacgtgggtaacggcaagcaaagacacgtgtgctaccgcgatagtaagctgacttttctccttcgcgatagcttggggggaaacgccaagactgccatcattgcaaacgtacaccccggatctaggtgtttcggcgagactttaagtacattgaattttgcccagcgggcaaagctgattaagaataaagctgtagtaaacgaggacactcaggggaatgtaagtcagcttcaggctgaggtgaaaaggctcaaggaacagcttgcggaactagcctcaggccagactccccctgaatctttcttgacgcgtgataaaaaaaaaactaactacatggagtactttcaggaagcaatgctcttcttcaagaaaagcgaacaggaaaaaaagtccctcattgaaaaggtgacccagctcgaagacctgacgctaaaaaaggagaagttcatacagtctaataaaatgatagtaaagtttagagaagaccagatcattcgccttgaaaaactgcacaaggagtcccgaggcggtttcttgcctgaggagcaggatcggttactgagcgaattacgcaatgagattcagaccctgcgcgagcaaatcgaacaccatcctagggtggccaagtacgctatggagaatcattcgctccgcgaggagaacagaaggttgagacttctggagcccgttaaacgagcccaggagatggacgcacagaccatcgcgaaactggaaaaggctttttccgaaatttccggtatggagaaaagtgataaaaaccagcagggatttagtccaaaagctcagaaagagccctgtctgtttgccaacactgagaaacttaaggcgcagctcttgcaaatccagaccgaacttaataactcgaaacaagagtacgaggagttcaaggagctaactcggaagaggcaattggaactggagagcgagcttcaatcactgcagaaagccaacttgaacttagaaaacctgctggaagctactaaggcttgtaaacgacaggaggtctcgcagctgaacaaaattcacgctgagaccctgaaaataattacgacacccacaaaagcctatcagctgcacagtagaccagtccccaaactcagccctgaaatgggaagtttcggttcactgtacacgcagaactcttcgatcctagataacgatatcctgaacgagccggtaccaccagaaatgaacgagcaggcattcgaagccatcagcgaggagcttcgtaccgtccaagagcaaatgtccgccctgcaggctaagctagacgaagaagaacataaaaacctgaagctccagcagcacgttgacaagctcgaacaccactcaactcaaatgcaagagctgttttcatccgagcgaattgattggactaagcagcaggaggaactgctgtctcaactgaacgtgctggagaagcagctccaggaaacacaaactaagaacgatttcctcaaaagcgaagtccatgacctccgcgtcgtccttcattcggccgacaaggaattatcatctgtaaagctggagtatagcagtttcaagactaatcaggaaaaggagttcaacaagctgagcgaacgacacatgcacgttcagctgcagctggataacctaagacttgagaatgaaaaactactggagtcaaaagcgtgtctgcaagactcttatgacaacctgcaggagatcatgaagtttgaaatcgaccagctgagcagaaacctgcagaacttcaagaaggagaacgaaaccctgaaaagtgatctcaataacctgatggagttactggaggccgagaaggaacgtaacaacaagctgtcattgcagtttgaggaagacaaagagaattccagtaaggagattctcaaagtgctcgaagccgtgagacaggagaagcagaaggagactgcaaaatgcgaacagcagatggccaaagtccagaagctggaggagtctctcttagctaccgagaaagtgatttcatcattggagaagtctagggacagtgacaaaaaggtagttgccgatctgatgaaccagatccaggagctccgcactagcgtctgcgagaagactgaaaccattgatactcttaagcaggagctcaaggatatcaactgtaagtacaactctgccctggttgatcgtgaggaaagccgagtactcatcaaaaaacaggaggtggatattttggacctaaaggagacccttcggctgcgcattctgtctgaggatatagaaagggatatgctgtgtgaggatctggcccacgcaacagaacaactgaacatgctgaccgaggcttccaagaagcattccggtctgctgcagtcggcccaggaggagctcactaagaaagaggccctgattcaggagctgcagcacaagctgaatcagaaaaaagaagaggttgagcaaaaaaaaaatgaatataattttaaaatgaggcagttggaacacgtgatggactcggcagccgaagacccacaaagcccaaagacaccaccacatttccagacccacctggccaaacttctggagactcaggaacaggagattgaagatggtcgagctagcaagacgtcactggagcacctcgtgactaagctgaacgaagaccgcgaggtgaaaaacgccgaaatcttacgaatgaaagaacagctccgagaaatggaaaacttaaggttggagtcccagcagcttatagaaaagaattggcttctgcagggtcaactggatgatatcaaacgtcaaaaggaaaattcggatcagaatcatcctgataatcagcagttgaagaacgaacaggaggaatctatcaaagagaggctggcaaagagcaaaattgtggaagagatgctgaagatgaaggctgaccttgaggaggtgcaatctgctctgtacaacaaagaaatggagtgcctgaggatgaccgacgaggtggaacgcacacagaccctggaatcgaaagcattccaggagaaagaacagctccggagtaagcttgaagaaatgtatgaggagcgagaaaggacatctcaggagatggagatgctgcggaaacaggtggagtgcctggcagaagagaatggcaaattggttggtcaccaaaacctgcatcagaaaatccagtatgtcgtaagactaaaaaaggagaacgtgagacttgctgaagaaacagagaaactgagagccgagaatgtgttcttaaaggaaaaaaaaagatccgagagttag

SEQ ID NO: 28070 - DNA, 4766 bp, Artificial Sequence
  Description of Artificial Sequence: Synthetic coding sequence
atgctaccgccaaagcatctgtccgccaccaaaccaaaaaagagctgggccccaaacctgtatgagctcgattccgacttgaccaaggaaccagacgtgattataggggaaggccctactgactccgagttcttccaccagcggttccgaaacctcatctacgttgagtttgttggcccaagaaagacactcattaagctgcgaaatctctgcctcgactggctgcagccagagacaagaacaaaagaggagatcatcgaactgctagtgctcgagcagtatctgacaatcattccagagaagttgaagccatgggtgagggccaagaaaccagaaaactgcgaaaaactggtcactttgctcgaaaattataaggagatgtaccagcccgaggacgacaataattccgacgttacatccgatgatgatatgactaggaacaggcgagaatctagtcccccacacagcgttcactctttttctgatagggattgggatcgaagaggcaggagtagggatatggaaccacgagatcgctggtctcacacgcggaaccctcggagcagaatgccaccccgagatttgagcctgccggtggttgctaaaacctccttcgagatggaccgggaggacgacagagatagtagagcttacgagtcccgaagccaggacgctgaatcttaccaaaatgtggtcgatctagccgaagaccggaagccccacaatacgatacaagacaacatggagaattatcgaaaactgctcagcctggtgcagttagccgaggatgacggccattcccacatgacacagggccactcatccaggagcaaaagaagtgcttacccctcgacctcgaggggtctgaaaacaatgcctgaggcgaaaaagtcaacacacaggcgcggtatttgcgaggacgagtcgagccacggtgtgatcatggaaaagtttatcaaagacgttagccggtcgtctaagtcagggagggcccgagagtctagcgacagatcacagaggtttcccagaatgtccgacgacaactggaaggatatcagcttgaataagcgagagtctgtcattcagcagcgtgtttacgaaggaaacgcattccgcggtggttttcgttttaattctaccttggtatctcgcaaacgcgtcctggagaggaagagacggtatcacttcgatactgacggaaaaggtagcatccatgaccagaagggctgcccccgaaaaaaaccattcgaatgcgggagcgagatgagaaaggctatgtctgtgtcctccctgtcgtccctctccagtccttcatttaccgagagtcaacccattgattttggggctatgccctatgtttgcgacgaatgcgggagatctttttccgtgatctcagagttcgtggagcaccagatcatgcacacaagagagaatctctatgagtacggagagtcctttatccactccgtggccgtgtctgaggtccaaaagagccaggtgggcggaaaacggttcgaatgtaaggactgcggggaaaccttcaacaagagcgctgccttggctgaacatcgcaaaattcatgctagaggatacttagttgagtgcaagaatcaggaatgcgaagaagctttcatgcccagcccaactttttccgagctgcagaagatctacggcaaggacaagttctatgaatgccgggtctgcaaggaaacctttcttcacagttccgcccttatcgagcatcagaaaatccatttcggggacgacaaggataacgagcgcgagcacgagagggaaagggaaagagagcgaggcgagacttttcggccttcccctgcgctgaacgagttccaaaagatgtacggcaaggagaaaatgtacgaatgcaaggtatgtggggagacatttctgcattcctctagtttaaaagagcatcaaaagatacacaccaggggaaacccctttgagaacaagggaaaagtgtgcgaggaaacttttattcccggacagtccttgaaacgtcgtcagaagacgtacaataaggagaaactttgcgattttacagacggccgtgacgccttcatgcagtccagtgagctgtcagaacatcagaaaattcactcaagaaagaatctgtttgaaggcagaggttatgaaaaaagcgttatccattccgggccattcactgaatctcagaaatcccacacaatcactcgcccattggaaagtgatgaagacgagaaagccttcaccatatcaagtaatccctacgagaatcagaaaattcccactaaagaaaatgtgtatgaggccaaatcctatgagcgaagcgttattcactctctggccagcgttgaagcacagaaatcacacagcgtggccggaccgtccaagccgaaagttatggccgagtctacaattcagagctttgacgccataaatcatcaacgtgttcgggcaggcggaaacacaagcgagggaagggaatattcacgtagcgtcattcatagccttgtagctagcaaacctcccaggagccacaacggaaatgagctggtggaatctaacgagaagggagagagcagcatctatattagtgacctgaatgataaaaggcagaaaattccagcccgtgagaacccttgcgagggaggatcgaaaaacagaaactatgaggattctgtaatacaaagcgtctttagggccaagccacagaagagcgttcccggagaagggagcggtgaatttaaaaaagatggagaatttagtgtgcctagttcaaatgtgcgcgaataccaaaaagcacgggcaaagaagaaatatattgagcaccgaagcaacgagacctccgtgatccatagcctgcctttcggagagcagacctttcgtcccagaggtatgctgtatgagtgccaagaatgcggggaatgctttgctcattcttctgacctgactgagcatcaaaagatacatgatagagagaaacccagcggatcccggaactacgagtggagtgtgatccgctctctggctcctaccgacccccagacatcatatgcgcaggagcagtacgcgaaggaacaggccagaaacaagtgtaaggatttcagacagttttttgctactagtgaggacctgaatacaaatcagaaaatatacgatcaggaaaagagccatggtgaagaaagccaaggtgagaataccgatggcgaagaaactcatagcgaagagactcatgggcaagaaaccattgaggaccctgtcattcagggatccgacatggaggatccgcagaaagatgatcctgacgataagatatacgaatgcgaagactgtggacttggcttcgtggacctgaccgacctcactgatcatcaaaaggtccattcccgtaagtgcctcgtcgacagtagagagtacacccattctgtgatacacacccattcaattagcgaatatcaacgggattatacaggcgagcagctctatgagtgccccaagtgtggcgagtcttttattcactcgagttttctattcgagcatcagcgcatccatgagcaggatcagctgtactcaatgaagggttgtgatgatggctttatagctctgcttcccatgaagccacggcgaaaccgtgcggcagagcgtaatccagccctggcaggctcggccatccggtgcctgctgtgtggccagggttttatccattcttctgcactgaatgagcacatgagactccaccgtgaggacgacctacttgaacagagccagatggccgaagaggccattattccgggactggctctgactgagttccaacgaagccagaccgaagaacgtctcttcgagtgtgctgtctgtggagagagcttcgttaaccccgctgagctggcagatcatgtcaccgtccacaaaaatgagccctacgagtacggcagctcatacactcacacaagttttctgaccgaaccactcaaaggagcaattcccttttacgagtgtaaggactgtggaaagagcttcatacatagcactgtcctgaccaaacacaaggaactccatctcgaggaggaagaggaagacgaggcagctgcggcagccgctgcagctgcccaggaagtcgaagcaaatgtgcatgtgccccaggtggtgttgaggatccagggcttgaacgtcgaagcagccgaaccagaggtagaggccgctgaacccgaagtcgaagcagccgaacccgaggtggaagctgctgagcccaacggggaggctgaaggacctgatggagaggctgcagaacccatcggagaggctggacagccgaacggtgaggcggaacagccgaacggtgatgcggacgaaccagacggtgccggtatcgaagatccggaagagcgtgctgaagagccagaagggaaggcagaagaacctgaaggcgatgctgatgaacctgatggagtgggcattgaagaccccgaagaaggcgaggaccaggagatacaagtggaggagccatactacgattgtcatgagtgtacagagacgtttacctcttcaacagccttttcggagcatctcaaaacccatgcatctatgattatcttcgagccagccaatgccttcggtgagtgttcaggctatattgaacgagctagcacctccacaggcggtgccaaccaggccgacgaaaaatacttcaagtgtgacgtctgcgggcagctctttaacgatcggttatccctcgccagacaccagaatacgcacacaggtta

SEQ ID NO: 28071 - DNA, 2508 bp, Artificial Sequence
  Description of Artificial Sequence: Synthetic coding sequence
atggggaattacaaatccaggcctacccagacctgcaccgatgagtggaagaaaaaagtctctgaatcatacgtgattacgatcgaacggcttgaggacgacctgcagatcaaggagaaagagcttacagaactcaggaacatctttggtagcgatgaggccttctctaaagtgaacctcaactatcgcacagagaacgggctttctctcttacacctgtgttgcatctgtggtggcaagaaatcccacatacgtacattgatgctgaagggcttgaggcctagtcggctcactcggaacggtttcacagcgcttcaccttgccgtgtacaaggataacgccgagctgattacgagccttcttcattcaggcgcagacatccagcaggttgggtacggaggcctgacagcgcttcatatagctaccattgcgggtcatctggaggccgcagacgtcctgttgcagcatggcgcaaacgtaaacatccaagatgcagttttctttactcctctgcacatcgctgcctattacggccacgaacaggtcactaggcttctgctgaagtttggggcagacgtgaacgttagcggcgaggtcggcgacagacctctgcacttagcttctgcaaaagggtttctgaacattgctaagctactgatggaggagggatcaaaggctgacgtcaatgcccaggataacgaggatcacgtgccgctgcatttctgtagtagattcggccaccacgacattgtgaaatatctgttgcaatctgacctcgaggttcaaccccacgtggtcaatatctatggagatacccccctccacctcgcgtgttacaacggcaagttcgaggtggccaaagagatcatccaaatttccggtaccgagtccttaaccaaggagaatatctttagcgaaacagcattccactctgcttgcacatacggcaagtctatcgacctggtgaagtttctcctcgaccagaacgtaatcaatatcaaccaccagggtcgcgacggccataccggtttacattccgcatgttatcacgggcatatccgcctggtgcagttccttctggacaatggcgctgacatgaatctggttgcctgcgatccatcacgatccagtggggagaaggacgagcagacctgcctcatgtgggcttacgagaaagggcacgacgctattgtgacactgctgaagcactacaaacggccacaggatgaactgccctgtaatgagtacagtcagcccggtggcgatggcagctacgttagcgtgccctctcctcttgggaagattaagtccatgacaaaggaaaaggccgacatactcttgctgcgtgccggactgcctagccacttccacctacagctgagtgaaatagaattccatgagatcattggcagcggcagctttggtaaggtttacaaaggtagatgtcgcaacaaaattgtagctatcaaacgctatcgcgcaaatacgtactgttcaaagtccgacgtggacatgttttgccgggaagtcagtattctctgccaattaaatcatccatgcgtcatccagttcgtgggcgcatgcctgaatgacccaagtcagttcgcaattgtaacccagtatattagtggaggcagcttattttctctgctgcatgagcagaagaggatactggacctacagagcaagctaatcattgctgtggacgtagcaaaaggcatggaatatctgcataatctcactcaacctatcatccacagagatctgaacagtcacaatattctgctttatgaagatggccacgctgtggtcgctgactttggtgagagtcgttttctccagtctctggacgaagataacatgaccaaacaaccaggaaacctgcggtggatggccccagaagtgttcactcaatgcaccagatacactatcaaggcagacgtgttctcctacgcgctgtgcctgtgggagatcctaacgggcgagattccatttgcgcatctgaaaccagcagcggcagctgctgacatggcctaccatcatatcaggccacctattggttattccataccaaagcccattagctccctcctgattcggggttggaacgcatgtcccgaagggcgaccggagttctcagaggtcgtgatgaagttggaagaatgtctgtgcaacatcgaactcatgtctcccgcttccagcaacagctctggctcattgagcccttcgagctcatctgattgcctggtcaatcggggtgggccaggccgtagccatgtggctgctttaaggagtaggttcgagctggaatacgccctgaatgcacgttcctacgcagcactgagccagtctgcaggacagtacagcagtcaaggcctgagtttagaagagatgaaacgcagcctccagtatacccccattgataaatacggttatgtctcagatcccatgagttctatgcattttcattcatgtagaaactctagtagttttgaagactcgagctag

SEQ ID NO: 28072 - DNA, 1767 bp, Artificial Sequence
  Description of Artificial Sequence: Synthetic coding sequence
atgaataccagtatcccctatcagcagaacccttacaaccctcgcggatccagcaacgttattcagtgctacaggtgcggcgacacctgcaagggggaggtcgtgagggtgcacaataaccactttcacatccgatgttttacctgccaggtgtgcggctgcggcctggcccaaagcggatttttcttcaaaaatcaggaatatatatgtactcaagactaccagcaactatatggaactcgatgtgatagttgcagagattttatcacaggtgaagtgatctccgcgctgggtagaacctatcacccaaaatgctttgtgtgctccttgtgccggaagccattccctattggggacaaggtgacttttagtggcaaggaatgcgtttgccagacctgcagccagagcatggcctcatccaaacctattaaaatccgcggaccttctcattgtgcaggttgcaaggaagagattaaacatggtcaatccctgctcgctttggataagcagtggcacgtcagctgtttcaagtgtcagacatgttcagtgatcttgaccggggagtatatctccaaagacggcgtgccttactgcgagtcggactatcatgctcaattcggtataaagtgcgagacttgcgatcggtacataagcggcagagtactggaggcaggcggtaagcattatcatcctacctgcgctcgctgtgtgagatgccatcagatgttcaccgagggggaagagatgtacctgactgggagtgaggtgtggcaccccatttgcaagcaggcagccagagcggaaaaaaagctcaagcaccgacgtacctcagaaaccagcatatcgccaccagggagctccatcggatccccaaaccgtgtcatctgcgacatctacgagaatctggatctgaggcaacgaagggcatcttcgccagggtacatagatagccccacttattctaggcagggaatgagccccaccttctctcggtcgccccaccactactataggagcgccggagattccaatatttataggaagccacctatctataagcgccatggggatctctcaacagcgactaagagcaagactagcgaggatattagtcaaacctcgaagtactctcccatttacagccccgatccttactacgcctccgaatcagagtactggacatatcacggctctcctaaggtacctagggcaagaaggtttagttccggaggggaggaggacgattttgatcgctcaatgcataagctccagagtggaatcgggcgtctgattttaaaagaagaaatgaaggctcgatctagctcttatgctgatccctggactccacctcggagttccaccagcagccgggaagcattacacaccgcaggatatgagatgtcccttaatggctcacccagatctcactatttagccgattctgacccgctcatatccaaaagcgcaagcctgcctgcttaccgcaggaacggcttacacaggacaccttctgctgatctgtttcactatgacagtatgaatgccgtgaattggggcatgcgggagtacaaaatctatccttacgaactgctgctggtaaccaccagaggtaggaaccggctcccgaaggatgtggatcggacaagattggagagacatctgtcccaggaagagttttaccaagtgtttggaatgaccatcagcgagtttgatcgattggccctctggaagagaaacgagctgaagaagcaggctagactgttttag

SEQ ID NO: 28073 - DNA, 1050 bp, Artificial Sequence
  Description of Artificial Sequence: Synthetic coding sequence
atggccattcccataacagtcctggactgtgacttgttgttgtatggacgaggccacaggacacttgatcgattcaaactggatgatgtaactgacgaatatcttatgagtatgtatgggttccccagacagtttatttattacctcgtcgaactgctgggggctaacctctctcgcccaacacagcgcagtagggctatctctccagagacccaggtgctggccgctcttgggttttacactagcggctctttccagactcggatgggcgacgctattggtatctctcaggcatccatgagcaggtgtgtggctaatgtgacagaagctctggtcgagcgagcgtctcagtttatccgctttcccgctgatgaagcgtcaatccaagccctgaaggatgaattttacggactcgccggaatgccgggtgtcatgggggtggtcgactgcattcatgtggcaatcaaggcaccgaatgcagaagacctaagctatgtcaatcgcaaggggttgcactcgttgaactgtcttatggtctgcgatatccggggaacactgatgacagtcgagacaaactggccaggctctctgcaagactgcgcagtactgcagcaaagtagcctgagttctcagttcgaagccggaatgcataaggatagctggctgcttggtgatagctcgtttttcttgcgtacttggctgatgactcccctacatattcccgaaacaccagcggaatacagatacaatatggcccactccgcaacccactctgtgatcgaaaagacgtttaggacactttgttcccgatttcggtgcctcgacggatcaaagggcgctctgcagtattctcctgagaaatccagccacataattttagcctgttgtgtgctgcacaatatcagtctggaacatggtatggacgtctggtctagccccatgactggtccaatggagcagcctccagaagaggaatatgaacacatggaaagcctggacctggaggctgatcgcattcgccaggaactgatgctaacccactttagttag

SEQ ID NO: 28074 - DNA, 1794 bp, Artificial Sequence
  Description of Artificial Sequence: Synthetic coding sequence
atgtcaagcaaagggagttctacagacgggagaaccgatctggcaaacggcagtctttcttcatctcctgaggaaatgtcaggcgcagaggaaggcagggaaacaagctccgggattgaggtagaagccagtgacctcagcctgtctctgactggagacgacggcggtcctaatcgaacaagcacagagtctcgaggcacagacaccgagtcttctggagaggacaaagatagtgattctatggaggacacaggccattacagcatcaatgatgagaacagagtgcatgataggtctgaggaagaagaggaagaagaggaggaagaggaggaagagcaaccacggcgtagggtgcagcggaagcgtgccaacagagaccaggactcgtctgacgatgagagagcactggaagattgggtctccagcgaaaccagcgctttacctagaccaaggtggcaggctcttccagcactgcgtgagcgggagctgggcagctccgctagattcgtgtacgaagcatgtggcgcacgcgtctttgtgcagaggtttcggcttcaacatggattggaaggtcatacgggatgcgtgaataccctgcatttcaatcagcgtggcacatggctggcctccggctctgacgatctgaaggtcgtagtttgggactgggtacggaggcagcctgtactggatttcgaatctggacacaaatcaaacgttttccaggcaaagttcctcccaaactccggggactcaaccttagcaatgtgcgctcgagacggacaggtgcgcgttgccgagctatcagctacgcaatgctgcaaaaataccaaaagagtagcacaacataaaggcgcaagtcacaagttggctctggaacctgactccccctgtaccttcctatccgcaggggaggacgccgtggtgttcacaattgacctgaggcaggatcgacccgctagcaagcttgtagtaacaaaggaaaaggagaagaaggtgggtttatacaccatctacgtcaaccccgcaaacacgcatcagttcgctgttggcggtcgagaccagtttgtccgcatttatgaccagcgtaagatagacgagaatgagaataatggagtactgaagaaattctgtcctcaccacttggtgaattctgagagcaaagctaacattacctgtttggtgtacagccatgatggcacggaactgttggcaagctacaacgacgaggatatttatctcttcaactcctctcacagcgatggtgcacaatacgttaaaagatataaaggccaccggaacaatgccacggtgaaaggcgtgaacttctacggcccaaagtccgaatttgtagtgtccgggagcgactgtggccatattttcctgtgggagaaaagcagttgccaaatcatacagttcatggagggagataaggggggtgttgtgaactgtcttgaaccccacccccacctcccagtactggccacgtctggccttgaccacgatgtcaaaatctgggccccaacggccgaggcttcaaccgagcttactggtcttaaagacgtgattaaaaaaaacaagcgcgaaagggatgaagatagcttgcaccagaccgatctgttcgactcacacatgctgtggttccttatgcatcacctgcgacagcgaagacatcaccggcgatggcgagaacctggcgtcggggcaaccgacgccgattcagatgagagcccctccagctctgacacttccgacgaagaagaggggcctgaccgcgtgcaatgcatgccatcctag

SEQ ID NO: 28075 - DNA, 933 bp, Artificial Sequence
  Description of Artificial Sequence: Synthetic coding sequence
atgtcgcaacagctgaagaaacgggctaaaaccaggcatcagaaaggactgggcggaagggcgccttcaggcgcaaagccgcgacaggggaagagctctcaggacttgcaggccgagattgaaccagtctccgccgtgtgggcactatgtgacggctatgtctgctacgagccaggaccacaggccctgggaggcgacgatttctcggattgctacattgagtgtgtaattagaggggagttctcacagcctatccttgaggaagattctctgtttgaatctttagagtaccttaagaaaggaagtgaacagcaattgtcacagaaagtattcgaggcctcctccctagaatgttcactggagtatatgaagaagggtgtgaagaaagagctacctcagaagatcgtgggagagaactctctggagtattctgagtacatgaccggtaagaaactgccaccgggaggcattcccggaattgatctgtctgatcccaagcagctggcagagttcgctcgcaagaagccaccaataaacaaagagtatgactcactcagcgctatcgcatgcccccagtccgggtgtacaaggaagctgagaaatagggccgctctccggaaacatctgctgatccatggccctcgggatcacgtgtgcgcagaatgtggtaaggcctttgttgaaagctctaagctgaaacggcactttctcgttcataccggggagaaaccattccgctgcaccttcgaaggttgcggcaaacggttctcactggacttcaatctccggactcatgtgcgcattcataccggcgaaaagaggtttgtctgcccctttcaggggtgtaaccgccgttttatccagagcaataaccttaaagcccacatactgacccatgcgaacactaacaagaatgaacaagagggtaaatag

SEQ ID NO: 28076 - DNA, 1149 bp, Artificial Sequence
  Description of Artificial Sequence: Synthetic coding sequence
atgctgcggtggaccgtccacctggaagggggtcccaggagggttaaccatgctgcggtcgccgttggacatcgcgtctacagcttcggcggatactgttccggagaagactacgagaccctcaggcagatcgacgtgcacatttttaacgcagtgagcctgagatggacaaaactgccacccgtgaagtccgccattaggggtcaagctcctgtggtcccctatatgcgatatgggcacagcactgtcctcatcgatgacacagtcctgctgtgggggggacgaaatgataccgagggcgcttgtaacgtcctttatgctttcgacgttaatactcataagtggtttactcctcgggtgagtgggaccgttccaggtgccagagacggtcatagcgcttgcgttttgggcaagattatgtatatctttggcggttacgagcagcaggcggattgcttctctaacgatatccacaagctggatactagtactatgacctggactctgatttgtaccaagggctcacccgcaagatggcgggacttccatagcgctaccatgctgggatcccacatgtatgtgtttgggggacgtgcagaccggttcggaccttttcattcaaataacgagatctactgtaatcggatccgcgtttttgatacccgtacagaggcctggctggattgcccacccacacccgtcctccccgagggaaggcggtctcactctgcttttggatacaacggagaactatacattttcggaggttataatgcacgattaaataggcacttccacgacctctggaagttcaatcctgtgagcttcacttggaaaaaaattgagccgaaagggaaggggccatgtccccgtcggcgtcaatgctgttgtatagtgggggacaagattgtgcttttcgggggaacgtcccccagtccagaagaagggctgggcgatgagtttgacctcatagatcatagcgatctgcacattctggacttttcgccctcactaaaaacactgtgcaagctagcagtaatccagtataacttagaccaatcatgtttaccccacgacattcgctgggagctcaatgccatgaccaccaacagtaacatttcacggccaatcgtgagtagccatgggtag

SEQ ID NO: 28077 - DNA, 1827 bp, Artificial Sequence
  Description of Artificial Sequence: Synthetic coding sequence
atggccgctgctgcagctgcagtgggtcccggtgcaggcggagccggatccgcagtccctggcggagccggaccgtgcgccacggtttcagtcttccccggagctcgtctgctgacaatcggggatgccaacggagaaattcagagacacgctgagcaacaagcgttacgcctggaagttcgggcaggccctgattctgccggaattgccttgtattcgcatgaagatgtgtgcgtgtttaaatgcagtgtgtcaagggaaaccgagtgttctcgagtggggaaacagagctttattatcacattgggctgcaattctgtgctgatccagtttgccaccccgaacgacttttgttcattctacaatattctgaagacttgcagggggcacaccctggagagaagtgtcttctccgaaagaacagaagaaagttcagccgtccagtatttccaattctatggttatttgtcacagcagcagaatatgatgcaggattatgtgagaacagggacttatcagcgcgcaatccttcagaaccacactgactttaaggataagatcgtgttggatgtggggtgcggctcagggatactaagcttctttgcagcgcaggcaggcgcacggaaaatttatgcagtcgaggcctctaccatggcccaacatgcagaagtgctggtcaaatccaataacctgacagatcggatagtggtgatccccggtaaggtggaggaggtttctctccccgaacaggtggatatcataattagcgaacctatgggctacatgttgtttaatgagcgaatgctcgagtcatacctccatgccaagaaatacctaaaaccttcaggaaatatgtttcctacaattggggatgtccatctggcgccttttaccgatgagcaactttatatggaacagtttacgaaagctaacttctggtatcagccttcattccacggggtggatctgtccgcactccgtggcgcagccgtcgatgaatacttccgccagcccgtcgtcgataccttcgatattagaattttgatggccaaaagtgtgaaatatacagtcaacttcctggaggcaaaagagggcgacttgcaccgcatcgagattccctttaagttccatatgctacacagtgggctggtgcacggtttggccttttggtttgatgtcgcgtttattggcagtatcatgaccgtgtggctcagcacagcacccaccgagccattgacccactggtatcaagtaagatgtttattccagagccctcttttcgccaaggccggtgatacgctgtctggcacctgcctgctgatcgcaaataaacgccaaagctatgatatttccatagtagcccaggtcgaccaaacaggctctaaatcctctaatttattagatctgaaaaaccccttttttagatatacgggaacgactccctcccccccaccgggaagtcattataccagtccttcggagaacatgtggaatacaggctcaacgtacaatctgagctcagggatggccgtggctggtatgccgacagcatacgatctctccagtgttattgcgtcgggctcgagcgtgggccacaacaatctgatccctcttgctaatactggtatcgtgaaccacacacacagccgcatggggtctatcatgagcacaggcatagtgcaaggatcatccggggctcaaggcagcggcggtggttccacgagcgctcattacgcggtgaacagccagtttaccatgggtgggcctgcaatctctatggcttcgcctatgagcattcctactaatacaatgcattacgggtcctag

SEQ ID NO: 28078 - DNA, 2913 bp, Artificial Sequence
  Description of Artificial Sequence: Synthetic coding sequence
atgcagtccaccgacttgggtaacaaagagtctgggaagatttggcacagaaaaccaagtcccgctacacgcgatggcatcattgtcaacatcatccacaacaccagcgactaccaccctaaagtgttgcggttcctcaatgtcgctttcgacggcaccggggactgtctaatcgctggagaccatcaaggcaatatctatgttttcgatctgcacggtaatagattcaatctcgttcaacgcacagcccaggcctgtacggccctagccttcaatctccgccgaaagtcggaattcctggtggcgcttgccgattacagcattaaatgttttgacaccgtaacaaaggaactagtctcttggatgaggggccacgagagcagtgtcttttccatttctgttcacgcctccggtaagtatgccatcaccacttcgtctgacacagcccaactgtgggacctcgacaccttccaaagaaagcgtaaattgaatattcgccagagtgtcggtatccaaaaggtgttctttctccctctatccaacaccattctgtcctgttttaaggacaattccatctttgcatgggagtgtgacaccctgttctgcaagtatcagctcccagccccaccggagtctagcagtattctgtacaaagtgtttgccgtcacccgtgatggacgcatccttgcggcaggaggaaagtccaatcacttgcatttatggtgcctggaagccagacagctctttcgcatcatccagatgcccaccaaggtgcgcgcaatccgccacctggaattccttccagattccttcgacgcgggatcaaatcaggttttgggtgtcttgtctcaggacggtattatgagatttattaacatgcagacctgtaaattattgtttgagatcggatcactagatgaggggataagtagtagcgcgatttctccgcacgggaggtacatcgctagcataatggaaaatgggtctctcaacatttacagcgttcaggccctaactcaggagataaataagccccctcctcctctggttaaagtcattgaagatcttccgaagaacaaattgtcctctagcgatcttaaaatgaaggtaacgtccggaagggtgcagcagccggctaaaagtagagagagtaagatgcaaactagaattctgaagcaggatctgactggtgatttcgaatcaaagaagaacgagctgccagatgggctgaataaaaagaggctgcagatactgctgaaaggctacggggagtatcccactaagtaccgcatgttcatttggcgctccctgctgcagctccccgaaaaccacaccgctttctctacgctgatagacaagggaactcatgtagcgtttttgaacctccagaaaaagtaccctatcaagagtcggaaacttctccgagtcctccagcgtacgctgagcgcgctcgcccactggtctgtcattttctcagacaccccatacctgcctttgcttgcctttccattcgtgaagcttttccagaataaccagcttatctgttttgaggttattgcaacccttatcatcaattggtgccaacactggttcgagtatttccccaacccccctataaacattctctccatgatcgagaacgtgctggcgtttcatgacaaagagctcttgcagcactttatagatcacgacatcacttctcagttgtacgcctggcctctactggagactgtcttcagcgaagtgttgacacgggaggaatggctgaaactgttcgacaacatcttctcaaaccatccatcattcctgcttatgaccgttgtggcgtataatatttgctcaagaacccccctcctgagttgtaacctcaaggatgattttgagtttttcttccaccacaggaacaatctggatatcaatgtggtgattaggcaggtctatcatctgatggaaactacgcccactgacatacaccctgattccatgctgaatgttttcgtggcacttaccaagggtcagtacccggtgtttaatcagtatcccaaatttattgttgattatcagacccaggaacgggagagaattcggaacgatgagcttgattatttaagggagcggcaaacagtcgaggatatgcaggctaaggtggaccaacaacgagtcgaagatgaggcctggtatcaaaaacaggagctgctcaggaaggctgaggaaacccggagagaaatgttactccaagaagaggagaagatgatccaacaaagacagcggctggccgctgtgaaacgggaattgaaggtgaaagagatgcacctgcaggacgccgcacgtcggagatttctgaagctgcagcaggaccagcaagaaatggagttgcggcgtcttgacgacgagattggtcgtaaaaacctcacagaaaatcaggaggcacttgccaaagagatgcgagcagatgccgacgcttacaggagaaaagtcgatctcgaggaacatatgtttcacaagctgattgaggcgggagagactcagtcccagaagacgcaaaaatggaaagaggcagaagggaaggagtttcgactcaggagtgctaagaaggcgtccgccttatccgacgcgtcaaggaagtggtttctgaagcaggagataaacgccgctgttgaacacgccgagaacccatgtcacaaggaggaacctcgattccagaatgaacaggacagctcttgcctccctcgaacgtcccagctgaacgactcatcagaaatggatcctagtactcaaatctcactgaaccgcagggcagtggagtgggacactacaggacagaacctgatcaagaaggttagaaatcttcgtcagcggctcaccgcgagggccagacatcgctgtcagactccacacctattagctgcatag

SEQ ID NO: 28079 - DNA, 648 bp, Artificial Sequence
  Description of Artificial Sequence: Synthetic coding sequence
atgtcatgcacaattgaaaaagcactggccgatgcaaaggccctggttgagaggttgagggatcacgacgatgctgccgaaagcttaattgaacagaccaccgcactcaacaaaagagtcgaggctatgaagcaatatcaggaagagattcaagagctgaatgaggttgccaggcaccgcccacggtccacactcgttatgggcatccaacaggagaaccgacaaatcagagaacttcagcaagagaataaggaactacgaacttccctggaggaacatcagtctgctctcgagctgattatgtctaagtaccgtgaacagatgtttcgattattaatggcaagtaaaaaagacgaccccggaataattatgaagctcaaagagcagcattcaaaggagcttcaggcgcacgtagaccaaattacggaaatggctgctgttatgcggaaagcaatagaaattgatgagcaacaaggctgcaaggaacaggagcgcatttttcagcttgagcaggagaacaaaggcctacgggagatcctgcaaattacccgagagtcattcctgaatctgagaaaggatgatgctagcgaatctacctccctttctgccctggtaactaacagcgacctctctctgcgcaagtcatag

SEQ ID NO: 28080 - DNA, 2676 bp, Artificial Sequence
  Description of Artificial Sequence: Synthetic coding sequence
atggccgtggctcgagtcgacgccgcactcccccctggcgaaggtagtgttgtgaattggtctggccaaggcctgcagaaactgggtcccaacctgccatgcgaggctgatattcacacactgatcctcgataaaaatcagataatcaagctcgagaacctggagaagtgtaagcgcctgattcaattgagcgtggcaaacaacagactcgtacggatgatgggagtggccaaactgaccctcctgagggtgctgaatctgccgcataatagcatcggctgtgtagaagggttaaaggaactggtccatctggagtggctgaacctagccggtaacaatctcaaggccatggagcagatcaacagctgcaccgcattgcagcacttagacctgagtgataacaacatcagccagataggggatctctcaaagctagtatccctcaaaactcttctgctgcatgggaacatcatcacctcattacggatggccccagcttacctgcccagaagccttgcgatcctgtctctggccgaaaacgagatccgcgacttaaatgagatcagctttttggcatctttgacagagctcgagcagctcagcatcatgaataacccttgtgtgatggccacacctagcatacctggtttcgattatcgcccatacatcgtgtcttggtgcctgaaccttcgcgtcctggacggctatgtaatctcccagaaagagtccctcaaggctgagtggttgtattcgcaagggaaaggcagggcataccggccaggacaacacatccagttggtgcaatatctggccacggtgtgcccgctgaccagtacactggggctgcagaccgcagaggatgcaaaattggagaagatcctgtccaagcagcggtttcaccagcggcagctcatgaatcaatcacagaacgaagaattatcacccctagtccccgtggagacacgcgcttctctgattccagaacacagctcaccagtccaggattgtcagatctcccaggagtctgagccagtcatccaggtaaatagctgggtcggaattaattccaacgacgatcagctctttgcagtcaaaaacaattttcccgcatccgtacacaccactcgctactctaggaatgacctacacctcgaagacattcagactgacgaggataaactgaattgttctctcctgtcctccgagagtacctttatgcccgtggcctctggcctgtcaccactgtcaccaaccgtagaactcagactacagggaatcaacctcgggctcgaagacgacggtgtcgctgatgagtccgtgaaaggcctggagagccaggtgttagacaaagaggaggagcagcctttatgggccgctaatgaaaacagcgtacagatgatgcgttctgaaattaatacggaggtgaacgaaaaggctggcctcctcccctgcccggagcccacaatcatctccgctatcttgaaggatgacaatcactcccttaccttttttcccgagagtaccgagcagaagcagagcgatatcaaaaagcccgaaaacacccagcctgagaataaagagaccatctcacaggccacgtcagagaagctaccaatgattctgacccaacgctccgtggcgttagggcaggacaaggtcgctttgcagaagctaaacgacgctgccaccaaactccaggcctgttggcggggtttctacgccagaaattacaacccacaagcaaaggatgtgaggtatgaaatccgtctccgcagaatgcaggagcatatcgtttgtctcaccgacgagattcgtcgcctgcgtaaagaacgcgatgaggagcgaataaagaagtttgtgcaggaagaggcctttcgctttctgtggaaccagaagtggggtctggcaattcttcctaggcctgtgtctaacttctgggctcaagccgtgttccctcctcagccaccaaaggttaggagcctgcaggtgtggcagcagacagtggatcagcgattatccagctggcatacggacgtgcccccaatttcgtccacccttgtgccatcgaagcatccactatttacccaaagccaggagagctcttgtgaccaaaacgcagactggttcattgcatccgacgtggcaccacaagagaagtcactccccgaattccctgactctggctttcatagctcactgacagaacaggtacacagcctgcagcacagcctggattttgagaagtccagcactgaaggcagtgagagcagtatcatggggaactctatcgataccgtccgatacgggaaagaaagcgacctgggcgacgtcagcgaggaacatggggagtggaacaaagaaagttccaataacgagcaggataactccctgctggagcagtatttgactagcgtccagcaattagaggatgctgacgagcgaacaaatttcgacacggaaacccgcgattcaaagctgcacatagcttgttttcctgttcagttggacactttgtccgacggggcttcagtggacgagtcccacggaatatcaccaccactgcagggggaaataagccagactcaagagaactctaagctcaacgccgaagtgcaaggccaacagcccgagtgcgattcaacctttcaactgcttcatgtgggagttacggtatag

SEQ ID NO: 28081 - DNA, 828 bp, Artificial Sequence
  Description of Artificial Sequence: Synthetic coding sequence
atggccgaaccggctagtgtggctgccgagtcccttgctggaagcagagctagagccgctaggaccgtgcttggccaggtggttctgcccggagaagagctacttttgcctgaacaggaggatgccgaaggcccaggaggcgcagtggagcgaccactctctctgaatgctcgcgcatgttctcgcgtcagggtagtgtgcggcccaggcctccgccgttgtggggaccggttgttggtgacaaagtgcggcagactgcgccataaagaaccgggaagtggtagcggtgggggagtgtattgggtggactcacagcagaaacgatatgtgccagttaagggcgaccatgtgatcggcatcgtcaccgccaaatccggggacattttcaaagtggatgttggcggaagcgagcccgcatccctttcctacctgtcattcgagggggcaactaagagaaaccggcctaacgtgcaagtcggcgatttgatttatggacagttcgtcgtggcaaacaaagatatggagcctgaaatggtctgtattgattcgtgtggacgagccaatgggatgggggtgatcgggcaagatgggttactctttaaggtaaccctgggccttatccgaaagctgttggcgcctgattgcgagatcatccaggaggtgggaaagctgtaccccctggaaatcgtgttcggaatgaacgggcgaatttgggtgaaggcaaagaccattcaacagaccctgatactcgccaatatattggaagcctgcgagcacatgacatctgaccaaagaaaacaaatcttctcaagacttgccgagagctag

SEQ ID NO: 28082 - DNA, 1620 bp, Artificial Sequence
  Description of Artificial Sequence: Synthetic coding sequence
atggccacgagcgccccactgaggtccctcgaggaagaggtcacttgtagcatttgcctggattacctccgcgacccggttactatcgattgtggccatgttttctgccgtagttgcactacggacgtacggcctatctccggcagcaggcccgtgtgtcccctgtgcaaaaaacccttcaagaaagagaatataaggcccgtgtggcagctagctagcttagtggagaatatagagcggctaaaggtcgacaaagggaggcagcctggcgaggtgacaagggaacaacaggatgcaaaattgtgcgagagacaccgcgagaaactgcactattactgtgaggacgacgggaagctcctatgtgtgatgtgccgggaaagtagagaacaccgccctcacaccgccgttctgatggagaaagcagcccagccccacagggagaagatccttaaccacctttctacgctgcgcagggaccgcgacaaaatccaggggttccaagctaagggggaagcggatattctcgcggcactgaaaaaactgcaggaccagaggcagtacatcgttgctgaattcgaacaaggccaccaattcctccgggaaagagaggagcatctgctcgaacagttagcaaagctcgaacaagagctgactgaggggagggagaagtttaagagccgtggtgttggagagctggccagattagccctggtgatcagcgaattggaaggcaaagcccagcagcccgctgctgagctcatgcaagacacccgtgatttcctgaaccggtatcccaggaagaagttctgggtgggtaaaccaattgccagagtggtgaaaaaaaaaaccggcgaattctccgacaagctgttgtcactccagagggggctgcgtgagttccagggaaaattgctcagggatcttgagtacaagacggtgtccgtgactctagaccctcagtccgcctccggatacttacagctttccgaagattggaagtgtgttacctacacctccctctacaagagcgcatacctccacccacagcagttcgactgcgagcccggtgtactagggtccaaaggatttacttgggggaaggtttactgggaagtggaggtagaacgggagggttggagcgaggacgaagaagagggcgacgaggaagaggaaggcgaagaggaagaggaagaggaagaagccggatatggggatgggtatgacgactgggagaccgatgaggatgaggagtctctgggcgatgaggaagaggaagaggaggaagaagaggaggaggtcctggagtcctgcatggtgggagtcgctcgagacagcgtcaagaggaagggtgacctcagtctgagacctgaagatggggtctgggctctgcgtctaagcagcagcgggatatgggccaatacttcaccagaagctgaactctttcccgctctgaggccgaggcgcgttgggatagccctggactatgaaggcggtaccgtgacgttcactaacgcagagtcacaagaactgatatatacattcactgccacctttacacggaggctagtaccctttctctggttaaaatggcccggaaccaggctgctgctgcgcccttag

SEQ ID NO: 28083 - DNA, 1233 bp, Artificial Sequence
  Description of Artificial Sequence: Synthetic coding sequence
atgttcaacaacgagctgatggctgacgtgcattttgttgtgggacctcccggtgccaccaggacagtccctgcccacaagtacgtgctggctgttgggagctctgtcttctacgccatgttctatggggacttggcggaagtgaagagtgagattcatattcctgacgttgaacccgcagccttcttgatcttgcttaaatacatgtactctgacgagatcgacttggaggccgacaccgtactggcgactctctacgccgctaagaagtacatcgtgcctgctcttgctaaggcctgcgtgaattttctcgagacaagcctcgaggctaagaacgcctgtgtgctgttgtctcagtctcgcctgtttgaggagccagaactcacacaaagatgctgggaggtgatcgacgctcaggccgagatggccctgaggtccgaaggcttttgtgaaatcgacagacagacactggagattatagtgactagagaggccttaaatacaaaggaggccgtagtgtttgaagcagtgctcaactgggctgaagcagaatgtaagcgtcagggcctccctattacccctaggaataaaaggcatgttctggggcgtgccctctatctggtacgcatccccacaatgacccttgaggagttcgcaaatggcgctgcccagagtgacatccttactcttgaggaaactcattccatcttcctctggtatactgctactaataaacccagactcgactttccgctgacaaaacgaaaagggttagcgccacagcgatgccacagatttcagagtagcgcgtaccgcagcaatcaatggcgataccggggacggtgtgattcgatccaattcgccgtggatcggagagttttcattgcagggcttggactgtacggttcaagttccggaaaagccgaatatagtgtgaagatcgagttgaagcgtctgggcgtggtcctcgcccagaacctgaccaagttcatgtccgatggctcatcaaacacatttcccgtgtggtttgagcaccccgtgcaggtggaacaagacactttttatacggcttccgctgtgttggatggttcagagttgtcatacttcggtcaggagggcatgacagaggtccagtgtgggaaggtagcctttcaatttcagtgtagttcagactctacaaacgggaccggcgtgcagggcggacagattccagagctgatcttttatgcatag

SEQ ID NO: 28084 - DNA, 966 bp, Artificial Sequence
  Description of Artificial Sequence: Synthetic coding sequence
atgcgggcacttgccgcactgtcggctccacccaacgaaaggttgctcccacgcgatcctgcagctaccagggatcctgatgccgcacggcctgcgcgtcgctccgccgtcgagagactggctgccgacagggccaaatacgtccgtggtaggccgggaacggggaggggagtggcatccgagggctccggccctggcgcaatcaaatgtcctggaaacgatccaggccctcccgctcgggctcccgctcccgtggctaggcgcgcaatcgcaaggaagccgcttcgtccagacagtctgatcatctataggcagaagtgcgagttcgtccgaggcagtggcgcagacggcccaagagcatccctagtaaagaaactgttccagggtccagggaaggacaaagcgcctgttcccaggacaggagacgaaggcaaggctgggaatccggagactgtgccaaccactccaggtcccgctgcagatccggctattcccgaaactcctgccccagctgctcgttccgctgcccctagtagcgtccctgccgctcctcctggtcctgagccgagggtcgtgaggcgacgtggtctgcagcgttcacagtctgacttgtcatcgaggtattccgccgctctcgctgagagcgatacttttttccaatattgtggcctggatcccgaggttgtggaggctctgggacgcgaaaatttcaccgcgggaagcgactgtgtgacactcaaggtgaggtcggtttccgtcgcaacgtctgggtctggattctcccgtcactccggcggagatgatgaaggccttcaggaggaggagcttatagagcaggtgcctagtaccacatccgtcatcgagaggaatgcacgtataatcaagtggctttatacatgcaagaaggcaaaggagactccctcacaggagcagtccaggacccgcggaagcaaacccagtagatag

SEQ ID NO: 28085 - DNA, 945 bp, Artificial Sequence
  Description of Artificial Sequence: Synthetic coding sequence
atgtccgagaacgccgcacccggtttgatctccgagctaaagcttgccgttccttgggggcacatagccgctaaagcttgggggagtttacagggccctccagtcctgtgtctacacgggtggctggacaacgcaagcagctttgataggctgatcccactcttgccacaggatttctactacgtcgcgatggatttcgggggacatggcctgtcctctcattacagcccgggtgtgccatattacctgcagacattcgtttcagagataagaagggttgttgctgccctcaaatggaacagattctctattttgggccattcatttggtggggtcgtgggcggtatgtttttctgcacattccccgaaatggttgataagctcatactcctggatacgcctctgttccttctagaatctgacgagatggaaaacttactaacttataagaggcgtgcaatcgagcatgtgctccaggttgaggcaagccaagagccaagccatgtgttttctctgaaacagctcctccagagattgttgaaatctaatagccacctgtctgaggaatgtggggaacttctgctccagcgaggaacgactaaggtcgccaccggtttagtgttaaacagggaccaacgactagcttgggcggagaattcaatcgactttatttcaagagagctgtgtgcccactcaattagaaaattgcaggctcacgtcttgctaatcaaggctgtccatgggtactttgactcacggcagaactacagtgaaaaggagagcttgtctttcatgatcgatactatgaaatctaccttgaaagagcagttccagttcgtggaggtacccggtaaccactgcgtgcacatgtcagaaccacaacacgttgccagcattattagctcgtttttacagtgcacgcacatgctacccgctcagctgtag

SEQ ID NO: 28086 - DNA, 3945 bp, Artificial Sequence
  Description of Artificial Sequence: Synthetic coding sequence
atggcatcgaagggggcagggatgtccttctccaggaagagctatcgtctaacaagcgacgctgaaaaaagcagggtgaccggtatcgtgcaggagaaattgctcaacgactacctgaacagaatcttcagctcctccgagcacgccccaccagccgctaccagtcggaaaccactcaacttccaaaacctccccgaacatctggatcagctcctgcaagtggataatgaggaagaggaatcgcagggacaagttgagggaaggctggggccatccaccgtggtgctcgatcacaccggcggtttcgaaggtctactgctggtggatgacgatctgttgggcgtcatcggacacagcaacttcggaactatccggagtaccacatgtgtttataaaggaaagtggctgtatgaggtgctaatatctagccagggattaatgcagatcggctggtgcacaatttcttgccgcttcaaccaagaagaaggagtcggggatactcacaactcttacgcctatgatggcaacagagtgagaaagtggaatgtcacgaccacaaattacggtaaggcttgggctgctggcgacatcgtgtcttgcttgatcgatcttgacgatgggactctcagtttttgcttgaatggggtttccttgggtaccgcttttgagaatcttagtcgaggcctgggaatggcctacttcccggctatttccctctccttcaaagagtccgttgccttcaatttcggaagcaggcccctgcggtatccagttgcaggatacaggcctctccaggatcctccctcggcagacttggttcgggcacagcgtctgctgggctgcttcagggctgtactatcagtggaactagacccagtggagggaaggctgttggacaaggaatcatcaaaatggaggctgcggggtcaacccactgtgctgctgacattggctcatatttttcaccactttgctcctctcctgaggaaggtttacctcgtggaagctgtcctgatgagcttccttctgggaatcgtggaaaaaggcacccctactcaagctcagtcagtcgtacaccaagtcttggacctcctctggctctttatggaggattatgaagtccaggattgcctgaagcaattgatgatgagcctcttgcgcttatatcgcttctcaccaatcgtgccggaccttggcctgcagatccattatcttagactgacgatagcgatccttcgccatgaaaaaagtcgaaagtttttgctctccaacgtgttgtttgacgtgctgcggagcgtggtatttttttatataaagagccctctgcgcgtagaggaggcgggacttcaggagctgatcccaaccacctggtggcctcactgcagctctcgggagggcaaagaaagtacagagatgaaggaggagaccgcagaggagagattacgcaggagagcgtatgagcgcggatgtcaacggttacgaaaaagaattgaagtggtcgaagagttgcaggtgcaaatcctgaagctgctgctggataacaaagacgacaacgggggtgaagcctcaagatacatatttttgacgaagttcagaaaattcttgcaggaaaacgcatccggccgaggcaatatgccaatgctatgtccccctgagtatatggtctgttttttacacaggttaatttccgctttgcggtattattgggacgagtataaagcttcaaacccacacgcctcctttagcgaggaggcatacataccccctcaggtgttctataacggtaaggtggactattttgacttgcaacgtctcggaggacttctcagccacctgcggaaaactctgaaggacgatctggccagcaaggctaacatcgtcatcgacccccttgaactgcagagcaccgccatggacgacttggacgaagacgaggaacccgctcccgctatggcacaacgtccaatgcaggctttggctgtgggcggaccactgcctctcccacgtccaggatggctcagctctcctacccttggaagagctaatcggtttctatcaacagccgctgtgagtctgatgacgccgaggaggccactttctacatccgaaaaggtgaaagtacgcactctgagcgttgagcagaggacccgagaagacatcgaaggttcgcattggaacgaaggtctactcctgggccgacctcccgaggagccagagcagcctctaacagagaacagcctgctcgaggtgctggatggggcagtcatgatgtataacctctcggtgcaccagcagcttgggaagatggtaggtgtgtctgatgacgtgaatgaatatgcgatggctctgcgtgatactgaggacaaactgcgccgatgtccgaaacgcaggaaggacattctcgcagaattgaccaaaagccagaaggtcttttccgaaaaattggaccacctgtccaggcggctggcgtgggttcacgcaaccgtgtattctcaggagaagatgctggatatctattggcttttgcgggtatgcctgaggacaatcgagcacggagaccggaccggctccctatttgcgttcatgcccgaattttacttgagtgtcgcaatcaattcttacagtgcactcaaaaattacttcggacctgtgcacagtatggaggagctccctggatatgaagagaccctaacgcggctagccgcaatcctggcaaaacacttcgctgacgccagaatagtggggactgatattagggattctcttatgcaggccctggcctcttatgtttgttacccccacagcctgcgggcagtggagaggatacctgaggaacagcgcatagcgatggtgcgtaatcttctcgcaccttatgaacagcgaccttgggcacagaccaactggatcctggtgagactgtggagaggatgcggatttgggtaccgctataccaggctcccacacctgcttaaaacaaaacttgaagatgccaacctgccctcacttcagaagccatgtcccagcacactgctgcagcagcacatggccgacctgttgcagcaaggacccgatgtcgccccttctttcttgaacagtgtgctcaaccagctaaattgggcgttttcagaatttatagggatgatccaggagattcagcaagctgctgaaaggctggagcgtaacttcgtcgactctaggcaacttaaagtttgtgctacatgttttgatctaagcgtctccctgctcagagtgctggagatgacaatcacactcgttccagaaattttcctagattggaccaggcccacatccgagatgctccttcgaaggctggcccagctgctgaaccaagtcctcaatagagtcactgccgaaaggaacctcttcgaccgagtggtgaccctacgcttaccaggactcgaatcagtggaccactaccccattcttgtcgccgtgaccggtattctggtgcagctgctagttcgagggcctgcatctgagcgtgaacaggccactagcgtactgctggccgacccttgttttcaactccgaagcatttgttatctcttgggtcagccagagccccctgcgccagggacagccctgcctgcacctgaccgcaagcgctttagtctccagtcttatgctgactatatttccgccgacgaattggcacaggtagaacagatgctggcccaccttacatcggcgagtgcccaggctgcggctgcaagccttcccacctccgaagaggacctctgtccaatctgctatgcccatcctatctcagctgttttccagccctgtgggcataagtcctgtaaggcctgcattaatcaacatcttatgaacaataaggactgttttttctgcaaaactaccattgtgtctgtggaggattgggagaagggcgctaacacctccaccacctcatcagctgcttag

SEQ ID NO: 28087 - DNA, 2646 bp, Artificial Sequence
  Description of Artificial Sequence: Synthetic coding sequence
atggccggtgcagcgccacgggtgaggtacctcgctggattctgttgtcccctgggcggactggcagccggaaagccgagggtgctgtgtcacgaggctgaagtgttcctctccaccgggtctgagctggtttacgtctatgaccaggagggtggcctgctgaccgcggcattcaggttccccgaccaggtctggcacctggaactattggctcctagacgattgctgtacgccctctgtgccaggaggggcctgtattgcctgtctctggatcatccaggcaggagtcggtccacatctcaggacgatagagacagcgaggatggtgatcagcccagtccggtgatcccagtggaccccgatgcctgtattctgcctgatgcggctctgtgtgcttttaccctgctcgacagtgtgctggtaacactcgttcaaggacctgctcggtggaagatgcaactgtttgagcagccctgccccggtgaagatccaaggcccggagggcagattggtgaggtggagctctcctcctacaccccgccagcaggagtccccggaaagcctgcggctccacatttcctccccgtcctgtgttcagtcagcccatctgggtcaagagttccccatgacctcctgggaggcagtggcggatttacactagaggacgcactgttcgggctcctcttcggggcagatgcaactctcctgcagagcccagtggttctgtgcggactccctgacgggcagctatgctgtgttatactgaaagccctcgtgactagcagatccgccccaggggatccaaatgccttggtcaagatcctccaccacctggaagagccagtaatattcatcggagccctgaagaccgaacctcaggccgctgaagccgctgaaaactttctcccagacgaggatgtgcactgcgattgtctggtcgcgtttggccatcatggtagaatgctggcaatcaaggcctcgtgggacgagtcaggcaagctcgttccagagttgcgcgagtattgcctgcctggaccagtcttgtgtgcagcatgcggcggtggtggtcgggtttaccattcgaccccttccgatctgtgcgtcgtggatctgagcagggggagtacaccactgggcccagagcagccagaggaagggcctggagggttaccaccaatgttgtgtcccgcttccctgaacatctgctctgtggtgtctctcagcgcctccccccgaacccacgaaggtgggacgaagctgttggccctcagcgcgaaaggtcgcctgatgacgtgcagcctggatctcgattccgagatgcctggccctgctcggatgaccacagagagcgccggacaaaaaatcaaggaactgctttctggaatcggcaatatttcagagcgcgtgtctttcctgaagaaagccgttgatcaacgaaacaaggccctcacatcgttgaatgaagccatgaatgtgagctgcgcactactcagttcgggcactggtcctcgccctatctcatgtacaactagcactacttggtcccgactccagacacaggacgtgttgatggcaacgtgtgttctggaaaacagtagcagcttttctctagatcaaggctggacactctgcatacaggtcctgacctcttcctgcgcattagacctggattctgcttgcagtgctatcacctacacaattccagtggatcaacttggtccaggagcccgacgcgaagtgacactgcccttgggacctggggaaaacgggggtctggatctgcccgtgactgtgtcttgcacactattttattctttaagagaagtggtgggaggagcactagcaccgagcgactctgaagatccgtttctagatgaatgcccctccgatgtgctgccagagcaggagggagtttgtctgccgttaagccggcacaccgttgacatgctgcaatgtctgagatttcccggactcgctccccctcacacacgggcacctagtccattgggcccaacacgggacccagtggccacctttcttgaaacatgtcgggaacccggatcacagcctgccggacccgcaagtcttcgcgctgagtatctgcctccatctgtagcctcaatcaaggtgagcgcagagctgctacgggcagcattaaaggacggccatagcggagtcccgctctgctgtgccactctgcagtggcttctggccgagaacgcggctgttgatgtcgtgagagcaagagcactatcaagcatccagggagtcgctcctgatggtgcaaacgtgcacctgatagttagggaggttgccatgactgacctttgtcccgctggccctatccaggctgtcgagattcaggttgagagcagttcactggccgacatatgtcgggcacatcatgctgtcgtgggtcgtatgcagacaatggtgaccgaacaggccacacagggatccagcgctcccgacctccgggtgcagtacctgaggcagatccatgcaaaccacgagactctgctacgggaggtgcagacattgagggatcggttgtgcaccgaagatgaggcatcatcctgcgcaactgctcagagactacttcaggtctaccgtcaactgcgacatccatcactaatccttttatag

SEQ ID NO: 28088 - DNA, 471 bp, Artificial Sequence
  Description of Artificial Sequence: Synthetic coding sequence
atgggcgacaaaaaatctcccactcggccaaagagacaacccaagccatcctctgatgagggctattgggactgctctgtgtgcacattcaggaattccgcagaagcttttaagtgcatgatgtgcgacgttagaaaaggtacatccaccagaaaggaaaagaaggataaggtggaaaaagagaaaagcgagaaggagaccacctccaaaaagaacagccataaaaaaactcgccctcgactgaaaaatgtggaccgaagttccgcacaacatctggaggtgactgttggcgatctgacagttattatcaccgatttcaaggaaaaaaccaagagccccccagccagtagtgccgcttccgccgatcaacactcccaaagcgggagctcttcagacaatactgaaagagggatgagcagatcctcgtcccctcgtggcgaggcatcatcactaaacggcgaatcacattag

SEQ ID NO: 28089 - DNA, 777 bp, Artificial Sequence
  Description of Artificial Sequence: Synthetic coding sequence
atgtgtgcactcgagatggccgtgttggagatacagacaaacggcgatacacgagtgaccgaagaagccattgccagagcaaggcactccctctcagacccaaatatgcgggagtttatcctgtgctgtctggctcgggaccctgctagaagaccgagcgcccactcactactgttccaccgcgtcctgttcgaagtacacagcttaaaacttctcgcagctcattgctttatccaacaccaatacctcatgccagagaatgtcgtggaagagaagaccaaggcaatggacctccatgcagtgctggcggagctgccaagaccaaggagaccaccgctccagtggaggtattccgaggtgtccttcatggagctcgacaagttcctcgaggacgttcgaaacgggatctatcctctgatgaatttcgcggctacacgccctctggggctgccaagggtactggcgcctccaccagaggaggttcagaaggccaaaaccccaaccccagagccattcgatagcgagacccgaaaggtgattcagatgcagtgcaacctggaacggtccgaggacaaagcaagatggcatctgacattgttactggtcctggaggacagactccaccgacagctcacatacgacctgctgccaactgatagcgcacaagaccttgcctctgaactggtccattatggcttcttgcacgaagacgacaggatgaagttggctgcatttttagaatcaacattcctcaaataccgcggtacccaggcctag

SEQ ID NO: 28090 - DNA, 564 bp, Artificial Sequence
  Description of Artificial Sequence: Synthetic coding sequence
atgttggggcgttatagggaatatagcaatggacaagccggagctattgagcatctgaaagagtccttggagcagtccatagatcagcttcggagccaaagactgttacggaactctggtggacggagcatctcagtcacttcactcagtgcttccgacctcgacggtggaacaggctctgagctccaccatttccctcctacctcgcctctcaaagattatggcgacccccagggaatcaaaaggatgcgttcccgcactggggttcggtttgtgcaggagacagatgacatgactcagctgcacgggttccaccagtctcttcgcgacctgtcatctgagcagatccgtctcggagacgactttaatagggagctgagccgccgatctagaagtgacgctgaaaccaaaagggccttggaagaactcacagagaagctgaacgaagcccagaagcaggaagtgttcttcgtaaagtcactcgggaaggtaaagatccagtgcctcagctcagcagaggtggataatgtcttccccataaacgtatggcagtgcggaatctag

SEQ ID NO: 28091 - DNA, 927 bp, Artificial Sequence
  Description of Artificial Sequence: Synthetic coding sequence
atgatggacgtgtccggggtgggatttcctagcaaagtgccttggaagaagatgtcagcagaagagctggaaaaccagtactgtccgagccgctgggttgttcgattaggcgcagaggaagccttacggacctacagccagattgggatcgaggccactactagagctagggctacccggaagtcgttgttgcacgttccttatggcgatggtgaaggcgaaaaagtggatatatactttcccgatgagtccagcgaagccctgcctttttttctcttcttccacggtggatactggcagtcaggcagcaaggacgagtccgcgttcatggtgcaccccttaactgctcagggtgtcgcagtcgtaatcgtagcatacggaatcgccccaaaaggcactctagatcatatggtggaccaggtcacccgcagcgtcgccttcgtccagaaacggtacccttctaacaaggggatctacctatgcggccacagcgctggcgcacatcttgccgctatgatgttactggccgattggacgaagcacggtgtgacacctaacctgaggggatttttccttgtgtctggcgtttttgacttagagcctatcgtgtatacctcgcaaaacgtggccttgcagctgaccttggaggacgcacagagaaactcacctcagctcaaggtagcccaagcccagcccgtggatcccacctgccgagtgttggttgttgtggggcagtttgattcacccgagtttcaccgccagtcctgggaattctatcaagtgctgcccgttcagaccctgtgtcaaggcgaatggaaggcaagctttgaggaactgcacgacgtggaccactttgagatagtggagaatttaacacaaaaggacaacgtgttaactcaaattattctcaagacaatctttcagtag

SEQ ID NO: 28092 - DNA, 1461 bp, Artificial Sequence
  Description of Artificial Sequence: Synthetic coding sequence
atgagcgggagtacacccttccagatgcggttggttcacctcgacctcaagggagccccaccaaaagtaagttacttgtcggagatctttccacttttcagggcactcggggctaatgggctgctcatcgaatacgaggatatgtttccctatgagggtccactgaggctgttgcgagccaagtatgcctactctcctagtgaaattaaggaaatcctacatctcgcaggtctgaacgagctggaagtcatcccgctagtgcaaactttcggccacatggagttcgtgctgaagcataccgcctttgcccaccttagggaggtaggcagcttcccatgcaccctgaatcctcacgaggccgaaagccttgccctcgttggcgctatgatcgaccaggtcctcgagctccacccaggtgcccaaagactccacattggatgcgacgaagtgtactatctaggggaaggcgaggcctccaggaggtggctccagcaggagcagaatagtacaggtaagctgtgtttaagccacatgagagccgtggccagtggagtgaaggctcgcagacccagtgtcactcccctcgtgtgggacgatatgctgagggacttgcccgaggaccaacttgccgcatctggggtccctcagctggtagaacccgtactttgggactatacagcggatctggacgtgcatggcaaagtcctattaatgcaaaaatatcgaaggtgcgggtttccccaactctgggccgcaagtgccttcaaaggtgccactggcccttcacaggctgtacctccggtggagcatcacttgagaaaccatgtgcagtggctgcaagtcgctggatcaggcccaactgattctttgcaaggtattatcctcacgggatggcagaggtatgatcactatagtgtcctgtgcgaactactaccagccggagtgccaagtctagctgcctgtctgcagttactacttcgaggtgggtttgacgaagacgtcaaagccaaggtggaaaacctgcttggtatttcatcacttgaaaaaacagaccctgtgcgcgaaggagctggcagtttccctggttccaacatcctggccctcgtgacccaagtcagtctgcacctgagatccagcgtggacgccctgttggaaggcaacagatatgttaccggctggttttcgccctaccatcggcaaaggaagctgatccacccggtcatggtgcagcatatccagcctgctgccttgagtctgttagcacagtggagtaccctcgtgcaagagctggaagcagccctacagctcgctttctatcccgatgctgtagaggaatggctcgaggagaatgtccacccgtctctgcaaagactgcaggcccttctgcaggacctgtctgaagtgtcagcaccccctctccccccaacgagtccgggacgggatgtggcccaggacccatag

SEQ ID NO: 28093 - DNA, 240 bp, Artificial Sequence
  Description of Artificial Sequence: Synthetic coding sequence
atgagctctcagcagcagcaacgccaacagcagcagtgcccgcctcagcgggctcagcagcaacaggttaaacagccttgtcagcctcctcccgtgaagtgtcaggaaacatgtgctccgaaaacaaaggacccttgcgcgcctcaggtcaaaaaacaatgtccacccaaaggaacaattatacccgctcagcaaaagtgccctagtgcccagcaggcctccaagagtaagcagaaatag

SEQ ID NO: 28094 - DNA, 822 bp, Artificial Sequence
  Description of Artificial Sequence: Synthetic coding sequence
atgggccagaaggtaactggcggtatcaaaaccgtcgacatgagagacccaacctaccgtcctctgaaacaggagttacagggtctcgactattgtaaaccgactcgtctagatttgctactggatatgcctccagtcagctacgatgtccagcttctccattcctggaacaacaacgaccggagtctgaatgtgtttgttaaggaagatgacaagctgatctttcatcggcatcccgtggcccaaagtactgacgcgattcggggtaaagtgggatacaccagaggcctacacgtgtggcagatcacatgggcaatgaggcagcgcggaacacacgcagtagtgggggtcgctacagctgacgctcccctccatagtgtgggctataccactttagtgggaaacaatcatgaaagctggggttgggatctgggaaggaaccgactgtaccacgatggcaaaaatcagccctccaagacctacccagccttcttagagccagacgagaccttcatcgtgcccgactcctttctggtcgctctggatatggacgatgggactttgtccttcattgtagatgggcagtacatgggggtggcgttcaggggcctgaaaggaaaaaagctgtacccggttgtcagcgcagtgtgggggcactgtgagatcagaatgcggtatctcaatggcttagatcctgagccactcccactgatggatttgtgtcgcaggtctgtaagactcgctttgggtagagagcggctgggcgagatccacacacttcccttacccgcaagccttaaagcatacctcctttaccagtag

SEQ ID NO: 28095 - DNA, 3315 bp, Artificial Sequence
  Description of Artificial Sequence: Synthetic coding sequence
atgggaaacgccgcaggctctgctgaacagccggcaggacctgccgctccccctccaaagcagcccgctccgcctaagcagccgatgcccgctgctggggagttagaagaacgctttaatagagcgctaaattgtatgaacctgcctcccgacaaagtgcagctcctgagccaatacgacaacgagaaaaaatgggagcttatctgcgaccaagaacggttccaagtcaaaaatcccccagccgcatatattcagaagctcaagagctacgtggatacagggggagtctcccgtaaagtagccgctgattggatgtcaaacctgggatttaagcgcagggtgcaggaaagcactcaggtgttgcgtgaactagaaacatccctgcggaccaatcacataggatgggttcaagagtttttgaacgaagagaatagagggctcgacgttctgcttgaataccttgctttcgctcaatgttcagttacttacgatatggaatcaacagacaacggtgccagcaatagcgaaaaaaataaaccactggagcaaagtgttgaggacctgtccaagggccctccatcctcggtccccaagtcgcgccacctcaccatcaagttaacccccgcacatagtcgtaaagctctgcgcaactctagaatcgttagccagaaggatgacgtgcacgtgtgtattatgtgtttgcgggcaatcatgaactaccagagtgggttctctttagtcatgaaccatccagcctgcgtgaacgagattgcactgtctctcaacaataaaaaccccagaaccaaagcattggtccttgagctgctagcagccgtttgcttggtaagaggcggacacgacataatactagctgcgtttgacaacttcaaagaggtttgtggggagcagcacagattcgagaagctgatggagtatttcaggaacgaagactccaacatcgatttcatggtagcctgtatgcagtttattaacattgtggtccattccgtggagaatatgaacttccgcgtgttcctccagtatgaatttacccaccttggactcgacctgtacctagagcggctaaggctgacagagagcgataaacttcaagtgcagattcaagcatatctggataacatcttcgatgttggcgcattactcgaggatacggagacgaagaacgctgtactggagcacatggaggaactgcaagaacaggtggctctattaactgagaggttgcgagatgccgagaatgagtccatggctaaaatcgccgaactagagaaacagttgtcgcaggccagaaaagagctggaaacgctcagagaaaggttttcggaatcaaccgcaatgggaccctcacggagaccgccagagcctgaaaaggccccacctgctgcacctacacggcctagtgctctggaattaaaggtggaagaacttgaagagaaaggattgatcagaatactgagagggccaggtgacgcagtgagtatcgaaattctcccggttgccgtggcaacacccagtggcggtgatgcaccaacgcccggtgtgccgactgggtcaccgagtccggaccttgcccctgcggcagagccagccccaggtgctgccccaccaccaccaccccctcttccaggtttgcctagtccccaagaggcccctccttctgcaccaccacaggcccctcccctccctggatcccccgagccaccccctgccccacctcttcctggcgacctacctcctcctcctcctccacctccaccaccccctggcacagatgggcctgtgcctcctccgcctccacctcctccccctcccccaggaggtcctccagatgctttgggacgcagagactccgagctcggacctggggttaaagccaaaaagcctatacagacaaagttcagaatgcctcttcttaattgggtcgcccttaagccgtcacaaattaccggaactgttttcactgaactaaatgacgaaaaggttcttcaggagctggacatgtcggattttgaggaacagttcaagacaaagagccagggtccgtcgttggacctctccgctttgaaaagcaaggctgcccaaaaggccccatcaaaagctactttgattgaagctaatcgggcaaaaaacctggccatcaccctgagaaagggcaatctgggcgctgaacggatatgtcaagcgatcgaagcatatgatctgcaggccctaggcctggactttttagagcttctcatgcgatttctaccgaccgaatacgaacgctcgctgatcacccgcttcgaaagggagcagcggcctatggaggaactctcagaggaagacagattcatgctctgcttttccagaattccacggttgcccgagcggatgactaccctgacctttctcggtaatttcccagacaccgcgcaactgttgatgcctcaactgaacgccatcatagccgcttccatgtccattaagtctagtgacaagcttcgccagattctcgaaattgtgctggccttcggtaattatatgaattcgagtaagaggggagccgcttacggattcagactccagtctttggatgctcttctggagatgaagagcaccgatcgcaaacagacactcctgcattacctggtaaaggtgatcgctgagaagtatccacagctcacaggcttccactccgatctccatttcctcgataaggcgggttctgtgagcctggactcagtcctcgcagatgtacgatctctgcagaggggcctggagctgacacaacgggagtttgtgaggcaggacgactgcatggtgctgaaagagttcctccgcgcaaacagccccaccatggataaactcctcgcggacagcaaaacagcccaggaggcattcgaaagcgttgtggagtactttggggaaaacccaaagacaacatctcctggactcttcttcagcctgttctctcgctttattaaagcatacaaaaaagccgaacaggaggtcgagcagtggaaaaaagaagccgcagctcaggaggccggagctgataccccgggtaaaggggagcctcctgcgcctaaaagtcctccaaaggcaaggcggccacagatggacctcatttcagagctgaaacgtcgccagcagaaggagcctctgatatatgagagcgaccgtgatggagccatcgaggacatcattacagacctccggaaccagccatacatcagagcggataccggcagaagatctgcacgccgtcgtcccccaggccctccacttcaggtaactagcgacttgtcactctag

SEQ ID NO: 28096 - DNA, 603 bp, Artificial Sequence
  Description of Artificial Sequence: Synthetic coding sequence
atggaagagaagccctcgaaagtatctttaaaaagtagcgatagacaagggtccgatgaggaaagcgttcatagtgacactcgggatttgtggacaactactactctgtcgcaggctcagctcaatatgcccctttccgaggtctgtgaggggttcgacgaggaaggcaggaatatctcaaaaacacgaggatggcacagcccagggagaggaagtcttgatgaggggtataaggcatcccacaagcctgaggaactcgacgaacacgcactcgtagaactggagctccatagaggctcttctatggagatcaacctgggtgaaaaagataccgcgtctcagattgaggccgaaaagtccagttctatgtctagtctgaacatcgccaaacacatgccacatagagcctattgggctgaacaacaatctagactgccattgcccttaatggagttaatggagaatgaggctttagaaattctcacgaaggccctcaggagttaccagctgggtattggtcgggaccacttcctgactaaggagttacagagatacatagaaggcctgaagaaaaggagatctaagaggttatacgttaattag

SEQ ID NO: 28097 - DNA, 1044 bp, Artificial Sequence
  Description of Artificial Sequence: Synthetic coding sequence
atgaagctgacatctgagaagctcccaaagaaccccttctacgctagcgtatcccagtatgcagctaagaatcagaagttcttccagtggaagaaggagaagaccgactatacacatgcgaatcttgtggataaggcactccaattgctcaaagaaagaattctgaagggggacaccctggcgtacttcttgcggggtcagctatactttgaggaggggtggtacgaagaagcgcttgagcaatttgaagaaattaaagagaaggatcaccaagcaacttatcagctgggggtcatgtattatgatggcctcgggactaccctcgatgccgagaaaggagtggattacatgaagaagatcctcgacagtccctgcccaaaggccagacacctaaaatttgctgcagcctataacttaggacgcgcatactacgaaggtaaaggagttaaacgatctaatgaggaagccgaaaggctgtggttaattgctgccgacaatggcaacccgaaggcatctgtcaaggcgcagagtatgttaggactttactactctaccaaagaaccgaaagaactagaaaaggccttttactggcattccgaggcatgcggaaacgggaacctcgaatcccagggggctctggggctgatgtacctttacggccagggaatcaggcaggatactgaggccgcattgcagtgcctgcgagaggccgctgagaggggaaacgtgtatgcccagggcaacctggtcgagtactattacaaaatgaagtttttcacaaaatgcgtcgcctttagcaagcggatagccgactatgatgaggtccacgatatccccatgattgcgcaagttactgactgcttgcccgagtttattggtaggggcatggcaatggcatccttctaccatgcccgttgcctacagctgggactgggcatcactcgagatgagaccaccgccaagcactactatagcaaggcctgtagattaaaccctgcactggcagatgaactccactctctcctgatcagacagagaatttag

SEQ ID NO: 28098 - DNA, 3525 bp, Artificial Sequence
  Description of Artificial Sequence: Synthetic coding sequence
atgccactgcctttcggtctgaagctgaagaggacacggaggtacaccgtgagctccaagagttgcttggtcgctaggattcaactgttgaacaacgagttcgtggaattcacactcagcgtggagtccactgggcaagaaagcctggaggcggtcgcgcagaggctggaactgcgcgaagtgacttacttctctttatggtattacaataagcagaaccagcgcagatgggtcgacctggaaaagcctctcaagaaacagctggacaagtatgctctcgagccaactgtgtatttcggagtggtgttctacgtgccatctgttagtcaactgcagcaggagatcacccgctatcagtattacctccagctcaaaaaagacatcctggaagggtccatcccatgtacattagagcaagctattcaacttgcagggttagctgtgcaggccgatttcggagattttgaccagtatgaaagccaggattttctgcagaaatttgcgctgttccccgtcggttggctccaggatgaaaaagtcctggaagaggcaacgcagaaagtagccctgctgcaccagaaataccggggacttacagcgcctgacgcagagatgctttacatgcaggaagtcgaacgcatggacggatatggcgaagagtcctatcccgcaaaggacagccaggggtcagacataagcataggggcatgcctggaggggatcttcgtaaaacacaaaaatggcaggcatcccgtggtgttccgctggcatgatattgcaaatatgtcccacaacaagagctttttcgcactggagcttgccaacaaggaggaaacaattcagttccaaaccgaagacatggagacggccaaatacatttggagactgtgtgtagcccgtcacaagttttatcggcttaaccagtgtaatcttcagactcagacagttactgtgaacccaatcaggagacggagtagctcccgtatgagcctgcccaagccacagccctacgtcatgccccctccccctcaactgcattataatggacactataccgaaccgtacgcctcgtcacaggacaacctgttcgtgcccaatcagaatggctactactgccatagccagacttctctcgaccgagcgcagattgacttgaacgggaggattagaaacggcagcgtctactccgcgcactcaaccaatagcctcaacaatccccaaccttatttgcagccctctcctatgagctcaaatccgtcaattacagggtccgacgtcatgcggccagattacctgcccagccacaggcattctgccgtcatcccccctagctaccgcccaacaccagactacgaaacagtgatgaaacaactgaaccgtggtcttgttcacgctgaacgacagtcacactctcttcggaatctcaatatcgggtcatcctatgcgtactctaggcctgcagcactcgtgtacagccagcctgagatccgcgagcatgcgcagttgccttcgcccgctgccgctcattgcccttttagccttagctattcgttccactctccttccccgtacccttatcccgctgaacgcagacccgttgttggggctgtttcagtgccggagcttacgaacgctcagctgcaggcgcaggattatccctccccgaatatcatgcggactcaggtttatcgtcctccaccaccgtatcccccaccacggcctgctaattccacccctgacctttcacgccatctctacatcagttcgtcgaaccctgatcttataacccgcagagtccaccactccgtgcagacgtttcaggaggattctctcccggtcgcacacagcctccaggaagtgtctgagccgttgacggcggctcggcacgcccaacttcacaagcggaacagcattgaagtagctggtctgagccacggcctagaaggcctacgtcttaaggaaagaacccttagcgcatctgccgcagaggtggctcccagagccgtgagtgtcgggagccagccctcagtattcacggaaaggacccaacgtgaaggaccagaggaagccgagggactccgctatggccacaagaagtctttatccgacgctacaatgctgatccacagctctgaagaggaggaagatgaggactttgaggaggagagcggggcacgcgcacctcctgccagagcgagggaacctaggccaggtctggctcaagacccccctggctgcccacgggttttgctcgctggcccattacacatcctggaacccaaggctcacgttcccgacgcggaaaagcggatgatggacagttctccagtgaggacaacggctgaggcccaacgtccgtggcgtgacggcctccttatgccttccatgagcgaatccgacctcacaacatccggcaggtaccgagctaggcgcgatagcttaaagaagcgccctgttagcgatctgctgtcagggaagaaaaacatcgtggagggactaccgccactcgggggaatgaagaaaacccgggttgatgcaaaaaagattggcccacttaaactggccgctttgaatgggttatctctttctagggtgccattacccgatgaaggaaaggaggtggcaacccgcgctacaaatgatgagcgctgtaagattttagagcagcgtctggaacaaggcatggtgtttaccgagtacgagcgcatattaaaaaaacgactggttgacggcgaatgctctacagcgagactccccgaaaacgcagagcgcaaccgcttccaggatgttctgccatatgatgacgtgcgtgtcgagctggttccgactaaggagaataataccggttacatcaacgctagtcacatcaaggtgagcgtatcaggcatcgagtgggactacatcgccactcaagggccattgcagaacacatgtcaagatttttggcaaatggtttgggagcaaggcatcgccattattgccatggtgaccgctgaagaagagggtggtcgggagaagtccttccgatattggcctcgcctgggttctcggcataacactgtcacttatggaaggtttaagatcacaactcggttccggaccgacagtggctgttacgctaccacaggtcttaaaatgaaacatctgctgacggggcaagagcgcacagtctggcatctgcaatatacggattggccagaacacggatgtccagaggatctcaaggggttcctctcctacctggaggagatccagagtgtgagaagacataccaattccacatcagatcctcaatcacccaaccctccccttctcgtgcattgtagcgccggagtcggcaggaccggggtggttatcctgagcgagattatgatagcctgcctggagcacaacgaggtgttggatatcccacgcgttctcgatatgttacgacagcaacggatgatgttagttcagaccctgtgtcagtatactttcgtatatcgagtcctcattcagttccttaaatcgtctcggctcatttag

SEQ ID NO: 28099 - DNA, 2235 bp, Artificial Sequence
  Description of Artificial Sequence: Synthetic coding sequence
atggctgccgacaaaccggcagatcagggcgctgagaagcatgaaggaacaggacagagctcggggattaccgatcaagaaaaagagctcagtactaatgccttccaggctttcacctccggcaactacgatgcttgtctacagcacctcgcctgtttgcaggacatcaataaagatgactataaaatcatactgaatacggctgtcgcagaattctttaagtctaaccagaccaccaccgacaatttgcggcagacccttaatcagctgaagaatcaggtgcattccgcggtcgaggaaatggatggccttgacgacgtggaaaactccatgctgtactacaaccaggctgtgattctataccatctgagacaatacaccgaagccatttccgtcggcgagaagctataccaattcatcgaaccctttgaagagaagttcgcccaggccgtgtgttttcttctggttgatctttacatcctcacgtaccaagcagagaaagcactgcacctgctcgccgttctggagaagatgattagccagggcaacaacaataaaaacgggaagaatgagacaggcaacaacaacaataaggacggctcgaatcacaaggctgaaagtggggctcttatcgaagctgcgaagtccaaaatccatcagtacaaggtgagggcgtacatccaaatgaaaagcctgaaggcctgcaaaagagagattaaaagcgtcatgaacaccgctggcaactccgcaccatcgcttttcttgaagtccaacttcgagtacctgcggggaaattaccggaaagctgtcaagctgctgaattcaagcaacatcgctgagcatcccggattcatgaaaactggtgaatgccttaggtgtatgttctggaataacctgggatgcatccacttcgcaatgtcaaaacataacctggggattttctattttaaaaaagcccttcaagagaacgacaatgtctgtgcccaactttccgccggttcaacagaccctgggaagaaattctcgggacgacctatgtgcacactactgactaacaaacgatacgagcttctatataattgtggaatccaactgctgcacataggaagacctctggccgcatttgagtgtctcattgaggccgttcaggtgtatcacgccaacccacgcttgtggctgagattggccgaatgctgtatcgccgctaataagggaacatctgaacaggaaactaaaggcctcccgagcaagaagggtattgtccagtccattgtcgggcaagggtatcaccgtaagattgtgcttgccagtcagtctatccaaaacaccgtatataatgacggacagagttccgccattccggttgcctccatggagtttgctgcaatttgtttgcgcaatgccctgttgctactcccagaggagcagcaggacccaaagcaagaaaacggagcaaagaattctaaccagctgggcggaaataccgagagtagcgaaagttcagaaacctgcagcagtaagtctcatgatggagacaagtttattccggcacccccaagcagtcccctgaggaagcaggaactcgagaacctaaagtgtagtatcctcgcttgttctgcctacgtagctctcgccctcggggacaatctcatggcactcaatcacgcggacaaattgttacagcaacctaagctgagcggcagcctcaagtttttgggacatctttacgccgctgaagccttaatctccttggatcggattagcgatgccatcactcacctgaatcctgagaacgtgacagatgtgtccctgggaatctccagcaatgaacaggaccaggggtctgataagggagagaatgaagctatggaatctagcggtaaaagggccccacagtgctacccatctagtgtgaattccgcgaggactgttatgctttttaacctcggcagcgcttactgccttagatctgaatatgataaggctaggaaatgcctgcatcaagcagccagcatgattcatcctaaggaagtaccgcctgaagctattttgctcgctgtctacctggagctgcaaaatggaaacactcagctggccctgcagattataaagcgcaatcaattactgccggcagtaaagactcattccgaggtgagaaaaaaaccagtgtttcagccagtccaccccattcagcccattcagatgcccgcttttacaacggtgcaacgcaagtag

SEQ ID NO: 28100 - DNA, 363 bp, Artificial Sequence
  Description of Artificial Sequence: Synthetic coding sequence
atgcacccacccccacccgctgcagccatggacttcagccagaactctctcttcggctacatggaagacctccaggagcttaccatcatcgagaggcccgtgaggcgttctcttaagacccccgaagagatagagaggcttaccgttgatgaggacctcagtgacattgagcgcgctgtctacttgctgagcgcgggacaggatgtccagggcacaagtgtcatagctaatctcccattcttaatgagacagaatccaacagagactttgcgtagagtactgcctaaggtgcgcgtgcacgaggacgcccaccttttcatccagcgggtgtggatttcacatatgtttgtgcagcgggtatag

SEQ ID NO: 28101 - DNA, 1335 bp, Artificial Sequence
  Description of Artificial Sequence: Synthetic coding sequence
atgcgcgaaattgttctcacacaaattggccaatgtgggaatcagattggcgctaagttctgggaggtaatcagtgatgagcacgccattgattccgccggaacctaccatggagactcccacctccaattagaaaggatcaacgtgtattacaacgaggcatccggcggacgttatgtgcccagagcagtcttggtggacctggagccagggactatggatagcgtgagatctggcccattcggccaagtgtttcggccagacaattttattttcggccagtgcggcgcaggcaacaactgggccaagggtcactacaccgagggggctgagctgatggaatccgtgatggatgtggtcaggaaagaggccgagagttgcgactgcctccagggctttcaactgacacatagcctcggaggtggaaccgggagcgggatgggtacgctgctcctctcaaaaataagagaagagtatccggataggattattaacactttttctatcttgcccagtcccaaagtgagcgacactgtggtcgaaccgtataacgccacgctgagtgtgcatcaactgatcgagaatgcagatgagaccttctgcatcgataacgaggcactgtatgacatttgtagcaagacgttgaaactccctacacctacgtacggcgatctgaatcatctcgtgtcagctacaatgagtggcgtgaccacgtgccttcgcttccctgggcaactgaacgccgacctgcgaaaactggctgtcaacatggtcccgttccccagactccatttcttcatgccagggtttgcacctctgactagccgaggatctcagcagtatcgcgcacttacagttgcagagttgacccagcagatgtttgatgccaaaaacatgatggctgcttgtgaccccaggcacggacggtatcttaccgccgctgcaattttccgagggaggatgcccatgcgtgaggtcgatgaacagatgttcaacatccaggacaagaactccagttacttcgcagactggttgcctaataatgtgaaaactgcagtttgtgatattccccctcggggactcaaaatgagcgcaacatttattggtaataacaccgccatccaggaacttttcaagagggttagcgaacagttcaccgcaatgttcagaagaaaagcttttctccactggtataccggggagggcatggacgagatggagtttactgaagccgaatcaaacatgaacgatcttgtttccgaataccagcagtaccaggacgctacagccgaagaggaagaggacgaggagtacgctgaggaggaggtggcctag

SEQ ID NO: 28102 - DNA, 915 bp, Artificial Sequence
  Description of Artificial Sequence: Synthetic coding sequence
atggccaagattgagaaaaacgccccaaccatggagaaaaaacctgaactctttaacatcatggaggtggacggtgtgcccacgctgattctctcaaaagaatggtgggagaaggtttgtaactttcaagcaaagccagatgacctcatcttagccacctatcccaagagtggaacaacctggatgcacgaaattctggacatgattctgaatgatggcgatgtcgaaaaatgcaaacgagcacagactctggaccgtcacgcttttctggagctaaaatttccccacaaagaaaagccagatctggaattcgtgctggagatgtcatcccctcagcttatcaagacacatctgcccagtcatttgatcccaccatcaatctggaaggagaactgtaaaatcgtgtatgtggctcgtaacccaaaagattgtctggtgtcctactaccactttcataggatggcatctttcatgcctgaccctcagaacctagaagagttttacgaaaaattcatgagcggtaaggtggtgggagggtcatggttcgatcatgttaagggatggtgggccgctaaagacatgcataggattctgtatttgttctatgaggatattaaaaaagatccgaagagggaaatcgagaagattctgaaatttttagaaaaggacatttctgaggaaatcttgaataagattatttatcatacctctttcgacgtaatgaagcagaaccctatgactaactacactacactgcctacttccattatggatcactccatttcgccattcatgagaaagggtatgccgggagattggaagaactacttcactgtggcgcaaaatgaagagtttgataaagattatcaaaagaaaatggccggtagtaccctcaccttccgcaccgaaatctag

SEQ ID NO: 28103 - DNA, 216 bp, Artificial Sequence
  Description of Artificial Sequence: Synthetic coding sequence
atgtgtggttcctattacggcaactattacggtaccccaggctatggattctgtggctacggcggtcttgggtatggatacggtggattgggatgcggctacggctcatgctgcggatgtggattcaggcggctgggctgcggatacggttacgggtcccgcagtctgtgcggatacggttacggatgtggcagtggcagcggatactattattag

SEQ ID NO: 28104 - DNA, 2094 bp, Artificial Sequence
  Description of Artificial Sequence: Synthetic coding sequence
atggacaaaaagtcaaccgccgagaaactgggtaaagagctgggcctacaggctaaggagctctcggccgtccacagcagtcatcatgagatcggagtgaatgatagtaacttgttttctctagaaatgcgcgaacctctggagtctagcaacactaaatcctttcacagtgcagtggagatcaagaatcgttctcaacatgagctgccgtgctttcaacatcatgggatcgatacccccacttctcttcagaagcggagcgcgtgctgtcccccatctctgctgcggctggaggagactgcttcaagctctcaggatggcgatccccagatttgggacgatttaccattctctgagagcttgaacaagttcctggccgtactggagtccgagattgctgtgactcaggcagacgtcagcagcaggaaacaccatgtggacaatgacatcgataagtttcatgcagatcattcaaggctgtctgtgacaccccagcgaaccactggagcactgcataccccaccaattgccttacggagttcccaggtgattgtgaaggcgaactgctccaaggacgactttcttttcaactgcaaggggaacctgtcgccctcagtggagaaggagagccagcccgataacaaagttgaggccgtgagtgtcaaccacaacgggcgtgacatgagtgaatactttctgcctaatccgtatctcagtgctctttcgtcttctagtaaggacctggagaccatcgtcaccctcaaaaagaccatccgaatctctcctcatcgggagtctgatcactcctcgcttaacaacaagtaccttaatggatgcggtgagattagcgtatccgaaatgaatgaaaagttgaccaccctctgctataggaaatataacgacgtgtccgacctctgcaaactggaaaataagcagtattgtaggtggagcaagaatcaggatgactccttcacaatttgtcgcaagcttacctaccccttggagaccttgtgtaattcgccaaacaggtctaccaatacgttaaaggagatgccgtgggggcatataaacaataatgtcacccagagttactccatcggatatgagggcagctacgatgctagtgccgacctgttcgacgatatagccaaagaaatggatatcgcaacggaaattaccaaaaagtcccaagacatcttgctgaagtggggtacctccttagcggaatcgcacccatccgaaagcgatttttctttgcggagcctgtctgaagattttattcagcctagtcagaaactttctctgcagagtctgtccgactcaagacacagccgtacttgcagtccaacacctcacttccagagtgactccgagtacaacttcgaaaattcccaggatttcgtgccatgcagtcaatcaacacccatcagcggttttcaccagacccgcattcacggaattaatcgggctttcaaaaaacctgtcttttatagtgacctcgacggaaactacgaaaagattagaatctttcctgagaatgataagcagcaagcctccccttcctgtccaaagaatattaagacccctagtcagaagattcggtctcctatcgtgagcggggtttcccaaccagatgtgtttaaccactacccgtttgccgagtgtcacgagacggactcagacgaatgggtgccacccacgactcagaaaatttttccctctgatatgttgggctttcaggggatagggcttggcaaatgtttggctgcctaccacttcccggatcagcaagagctcccaagaaaaaagcttaagcacatccggcagggcaccaacaaaggtttgattaaaaaaaaattgaagaatatgttggccgcagtcgtgaccaagaagaaaacccacaagtacaactgcaagtcgtctgggtggatcagtaagtgcccagacatccaggtgcttgcagctcctcaactgcatcccattctcgggccagattcctgcagcgaagtgaaatgctgtctgcccttcagcgaaaaaggacccccatctgtttgcgagactcgcagcgcttggtcacctgagcttttctcctag

SEQ ID NO: 28105 - DNA, 306 bp, Artificial Sequence
  Description of Artificial Sequence: Synthetic coding sequence
atgtccaacacacaggctgaacgctctataatcggaatgattgacatgttccataagtacactggtagagatggcaagatcgagaagccatctctgctgactatgatgaaagagaattttccaaactttctgtccgcctgcgacaaaaaagggatccactatctcgctaccgttttcgagaaaaaggacaagaatgaggacaaaaagatcgatttcagcgagtttctgtcccttcttggcgacattgccgcagactaccacaagcagtctcacggggcagccccatgctcagggggatcccaatag

SEQ ID NO: 28106 - DNA, 678 bp, Artificial Sequence
  Description of Artificial Sequence: Synthetic coding sequence
atggccgtacgcagtttgtgggcagggcgattgcgcgtgcagcggctgctggcatggtccgcggcatgggagtcaaagggatggcctctgcctttttcaactgcaacccagcggactgctggggaggactgcaggagcgaagaccccccagacgaactggggccacccttggcagaaagagccctgcgcgtgaaggcagttaagttggaaaaagaagtgcaagacctgacggtcaggtaccagcgtgcaattgcagactgtgaaaacattcgacgccgaactcagcgatgcgtcgaggacgcaaagatcttcggcattcaatctttctgcaaggacctcgtagaggtcgcagacatcctcgagaagacaacagaatgcatatcagaggagtcagaaccagaggaccagaagctgacattagagaaggtgttcagggggctacttcttctggaggctaaattgaaatccgtcttcgcaaagcacggacttgaaaagctgacgccgatcggtgataaatacgatcctcacgaacacgaattaatctgtcacgtgcctgccggtgttggagtccaacctgggaccgtcgctctggttagacaagatggatacaagttgcacggcaggacgattaggttggcacgagtggaagttgcggtggagtcacagcggagattgtag

SEQ ID NO: 28107 - DNA, 1203 bp, Artificial Sequence
  Description of Artificial Sequence: Synthetic coding sequence
atgacaactaaaaatctagaaacaaaagttacagtaacaagtagccccatccgtggagccggagatggtatggaaactgaagagccacccaagtctgttgaggtgaccagcggagtgcagtcaaggaagcaccacagtcttcagtccccttggaagaaggccgtcccttccgaatcccccggagtgctgcaactgggtaagatgcttactgaaaaagccatggaggtcaaggcggtgcgtattctcgtgccgaaagcagcaattacacacgacattcccaacaaaaacacaaaggttaagtctttaggccatcacaagggtgaatttctcggtcaatccgaaggtgtgattgagcctaacaaagaattgtccgaggttaagaatgtgctcgaaaaactgaaaaattcagaacggcgtcttctgcaagataaggaaggcctgtctaatcagctgagagtgcagacggaagtcaacagagaactgaaaaagctactggtggcctcagttggagacgacctgcagtaccactttgagcgccttgctcgggagaagaaccagctgatcctcgagaatgaggcgctaggtcgaaacactgcacagttatcagagcagctggagcggatgtcaattcaatgtgacgtctggagaagcaagttcctggctagtagggtcatggcggacgaactgaccaacagcagggccgctctccagcgacagaaccgcgacgctcatggagctatccaagatctcttgtcagagagggagcagttcaggcaggagatgattgctacccagaagctccttgaagaactgcttgtgtccctacagtggggcagggagcagacctatagccccagcgttcagccccactccaccgcggagctcgccctcacaaatcacaagctagcaaaggctgttaactctcatttactcggaaatgtgggcatcaataaccagaaaaagatcccatctaccgtggagttttgttcaacacccgctgagaagatggcagaaacggtgctgagaatcttggatcccgttacctgtaaagagtcctctccagataatccttttttcgagtctagtccaaccactctcctcgctactaaaaagaacattggacgattccacccatacactagatacgaaaacatcacatttaattgttgtaaccactgccggggagagcttatagcgttatag

SEQ ID NO: 28108 - DNA, 735 bp, Artificial Sequence
  Description of Artificial Sequence: Synthetic coding sequence
atggatcccggtgcagccttgcaaagaagggcaggcggaggtggcggactgggagccggttcacctgcactatctggtgggcagggcagacggaggaagcagccaccccgaccagccgacttcaagctacaggtcattattatcggcagtcgcggtgtcggaaagaccagcctgatggagcggtttacggacgacacattctgtgaagcctgcaagtcaactgtgggggtagatttcaaaataaaaacagtggagctgagaggcaaaaagattcgcctgcagatttgggacacggccggtcaagagagattcaactctataacatctgcctattaccgttctgcgaaagggattattttagtttacgacatcacaaagaaggagacctttgatgatctccccaaatggatgaagatgattgataagtacgcttcagaagacgcggagttgcttctggtgggcaataagctggactgtgagacggatagagaaataactagacagcagggggagaagtttgctcagcaaataacagggatgcggttttgcgaagcctcagccaaggacaatttcaacgtggatgagatttttttaaaattagtcgacgatattctgaaaaagatgcctttagacattctgcgtaacgaactgtccaatagcatcctatcgttgcagcccgaaccagaaattcccccagaactgcctccgccacggccacacgtgcggtgctgctag

SEQ ID NO: 28109 - DNA, 1158 bp, Artificial Sequence
  Description of Artificial Sequence: Synthetic coding sequence
atggctctgccacatgacagcaatgaaactagttatctgttaccacctaacaacgaggactgggggaggcaaacaattcccgacttcgtttatggacagaaggacctgatggctgaaggaatccagtggccccgtaatgccccaggcattcctgatgctttaccacaatccccttttgatgcagccctgtgctcggcatggaagcagcgcgtggaactgggactgttccggtacagactcagagagctccaaacccagatcctgcctggagcggttggcttcgtggctcagctgaacgtggaacgcggtgtgcaaagaaggcctcctcagacaataaaaagcgttaggcaggcttttgatcccgtgcagtttaatttcaacaaaattcggccaggcgaggttttgtttcgcctacaccgggaacccgacctcccaggcaccctgttacaggaagatatcctggttgttatcaatgtgtcccccttagagtgggggcatgtgttactggtccccgagcccgctcgccagcttccacagagactcctccctggtgctctaagagcaggtatcgaggcggtactcctttccctgcatccaggcttcagagtgggtttcaactcgctcggcggattggcgtcagtgaaccacctgcatctgcatgggtactatctggcccaccggcttccggtagagcaggcccctagtgaaccattagatccaggaggtcacttgcacctgctgcaggacctccccgctcccggattcctgttttacacccgtggcccaggtccagaccttgaatcattgatctctcgggtgtgccgcgcaaccgactatcttaccgaccatgaaattgcccacaatctgttcgtgacaagaggtgctccacccggtaagacctctccatctagtgccctgaccggagttcgagtgatattgtgggccagaaaaagctcatttggcatcaaggatggggaggcttttaatgtcgccctctgcgagctcgcaggacaccttcctgtaaagacgtcacaggacttctccagtctgacagaggccgcagctgtggcgctgattcaagactgtcgactccctcccagtcaagctgaggatgttcaggccgctctcgtggctttgatgagtcaggaagagcagtag

SEQ ID NO: 28110 - DNA, 192 bp, Artificial Sequence
  Description of Artificial Sequence: Synthetic coding sequence
atgctctgcgacaacttccccggtgccgtctttccaggctgttattggggtagctacgggtatccccttggttattcggtgggatgcggatatggttccacatacagcccagttggttatggatttgggtatggatataatgggtgcggtgctttcggataccggaggtattctcctttcgccctctactag

SEQ ID NO: 28111 - DNA, 1083 bp, Artificial Sequence
  Description of Artificial Sequence: Synthetic coding sequence
atgttaggttcaggattcaaggcagaacgcctgcgagtgaacctgagactggttattaataggctgaaactgcttgagaagaaaaagacggaactcgcccagaaagccagaaaggaaattgctgactacctggccgctgggaaagacgaacgagccagaatcagagtggaacacatcattagagaggattacctggtggaggctatggaaattcttgaattatactgcgacctcctgttggccagatttggcctgatacagtccatgaaagaattagattctggactcgctgagagtgtatccacgcttatctgggcagcacctaggctccaatctgaggtagccgaactcaaaatagttgcagaccagctgtgtgccaagtactccaaagagtacgggaaattgtgtaggacaaaccagatcggtacagttaatgaccgtctgatgcataagctgtccgtcgaggcccctcccaagattcttgtcgagaggtatctgattgagatcgcgaagaactacaacgtcccttacgagccagacagtgtcgtaatggcagaggcaccaccgggagtggagactgatttgatcgacgttggatttaccgacgacgttaagaaggggggaccgggtcggggaggttctggagggttcacggccccagtgggcggacccgacggtaccgtgcccatgcctatgccgatgcctatgcccatgccatcagccaacactccattctcgtatccacttccaaagggtccgagtgacttcaatggcctcccaatgggaacttatcaagcctttcccaacatacatccacctcagatccccgctacccccccaagttatgagtcaatgacacttatgcttattagaattagtctgttgcatcgcctcctggtcctagatccttcccagaaaccactacaatctttcctgcccgacctgcagataaccatgaccacactgagctaccagtcttgccacctctgccaaacccactaccagctccatcttctggtccctgcaccccagcatctaaaaacacttactctaatgatcttccccggaggattgaaatcatag

SEQ ID NO: 28112 - DNA, 528 bp, Artificial Sequence
  Description of Artificial Sequence: Synthetic coding sequence
atgcctaagcggtcctgcccatttgccgatgtggcaccgctgcagctgaaggttcgcgtttcgcaacgggaactaagccggggtgtctgtgcagaaaggtactctcaggaggtgttcgagaagaccaagcgcctgctattcctgggcgcacaagcctacttagatcacgtatgggatgaggggtgtgccgtggtccatcttccggagagcccaaagccaggcccaaccggagcccctcgagccgcacggggtcagatgctgattgggcctgatggcaggcttataaggtccctagggcaagcctccgaagcagacccctctggggttgcaagtatagcatgcagctcatgcgtccgcgcagtagacggaaaagccgtgtgcggacagtgcgagagagcgctatgtggacagtgcgttaggacatgctgggggtgcggtagcgtcgcgtgcaccttgtgtgggcttgtggattgcagcgatatgtatgagaaggttttgtgcacatcctgtgccatgttcgagacttag

SEQ ID NO: 28113 - DNA, 366 bp, Artificial Sequence
  Description of Artificial Sequence: Synthetic coding sequence
atggaagctgaggtggataaattggagctcatgttccagaaggcagaatctgatctggattatattcaatatcgacttgagtacgagatcaagactaaccacccagatagtgctagtgaaaaaaaccccgtgaccctacttaaagagctgagcgtgatcaagtccagataccaaacactgtacgcacggtttaagcccgtagctgtggagcaaaaagagagtaagtcacgaatctgcgccactgtgaaaaagactatgaatatgatccagaagctgcagaaacagaccgacctcgagctttcccctttgactaaagaagagaaaaccgctgctgagcagttcaagtttcacatgccagatctctag

SEQ ID NO: 28114 - DNA, 1968 bp, Artificial Sequence
  Description of Artificial Sequence: Synthetic coding sequence
atggtgaccactttggggcctaaaatggccgctgaatggggcggaggtgtgggttactcaggctccggccctgggcgaagccggtggcgatggtcagggagcgtatgggttaggtccgtcctcctgcttttggggggacttagggcttcagcaacctccacgcccgtatccctgggatcatccccaccatgtagacaccacgtgcctagcgataccgaggttatcaataaggtgcacttgaaggctaaccacgtggttaagcgggacgtggatgagcacctccggataaagacagtctacgataagtccgttgaggaactactgcccgaaaaaaaaaatttggttaagaataagttatttccccaggccattagctacctcgaaaaaacttttcaggtgaggaggccagccggtaccattcttctcagtagacagtgtgccacaaatcaataccttcggaaagaaaacgacccgcaccggtactgcactggtgaatgtgccgcacacaccaagtgtggacccgtaatagtccccgaggagcacctgcagcagtgtcgggtgtacagggggggaaaatggccccatggcgctgtcggagtgcccgatcaggagggcatcagcgatgccgatttcgtgctctacgtgggcgcactggcaacggagcgctgtagtcacgaaaatatcatttcttatgccgcttattgtcaacaggaggctaatatggatagacctatcgcaggatatgcaaatctctgtccgaatatgatatctactcagccacaagaatttgttggaatgctctccaccgtcaaacatgaggtgatccatgccttgggcttctctgccggtctttttgcattctatcacgacaaggacgggaaccctctgacttcgcggttcgccgacggactgcccccttttaattatagcctaggcctgtatcagtggagtgacaaagtggtaaggaaggtggagcggctctgggatgtccgcgacaacaaaatagtgcggcacacagtatatctgctcgtgactcctagggttgtagaggaagctcgtaaacattttgattgccccgtcctggaaggtatggaactcgagaaccagggcggagtagggaccgagcttaatcactgggagaagcggctgctggagaacgaagcgatgacagggtcacacacccagaaccgagtactgtctaggatcaccctggccttgatggaggatacgggacggcagatgctgagcccctactgcgataccttgaggagtaaccccctccagcttacttgcagacaggaccagagggccgtcgctgtctgtaatctccagaaatttccaaagcctttacctcaggagtatcagtacttcgacgaactgagtggcatccctgcagaagatctgccctactacgggggtagtgtagagatagctgattattgtccgttctcccaggagtttagctggcatttaagtggggagtatcagcgatctagcgattgccggatcctcgaaaaccagccggagattttcaagaattacggcgctgaaaagtacggaccccactccgtttgtctcatccagaagtccgcgttcgtgatggaaaaatgcgaacgcaagttgtcataccccgactggggctccggttgttatcaggttagctgctctcctcaaggtttgaaagtatgggttcaggatacatcatatctgtgcagccgtgccggacaggttctgcctgtgagcattcagatgaacggttggatccatgatgggaacctcctgtgccccagctgttgggacttctgcgagctttgtcctcctgagaccgaccctcccgctaccaatctaaccagagcactgcccctggacctgtgctcctgctctagctcgcttgtggtgactttatggctccttctgggaaatttgtttcctctgctggccggttttctactgtgcatctggcactag

SEQ ID NO: 28115 - DNA, 408 bp, Artificial Sequence
  Description of Artificial Sequence: Synthetic coding sequence
atgggaagagtgcgaactaaaactgtcaaaaaagcagcccgagttatcatagaaaaatactacacacgcttaggtaacgactttcataccaacaaaagagtttgcgaagaaatcgcgatcattccatcaaagaagctcaggaacaaaatcgccggatacgtgacccacctgatgaagcgtatacagagaggaccagtccgcggaatcagcataaaattgcaggaagaagagagagagaggagagataattacgttcccgaggtttccgcgctagatcaagagatcatcgaggtcgaccccgataccaaagaaatgttaaagctgctcgatttcggcagcctgagtaacttgcaagtcactcagccaacagttgggatgaatttcaagacccctcgaggacccgtatag

SEQ ID NO: 28116 - DNA, 1119 bp, Artificial Sequence
  Description of Artificial Sequence: Synthetic coding sequence
atgaaccactgccagttgccagtcgtgattgataatgggtctggcatgatcaaggccggagtagcaggctgtagggagcctcaatttatataccccaacattattggcagagcaaagggacagagtcgtgcagcccagggaggcttggagctgtgcgtcggcgaccaggcgcaggactggcgaagctccctgtttataagctatcctgttgagcgcggactgattacttcatgggaggacatggaaatcatgtggaaacatatttatgactacaacttgaaactgaagccttgtgacggcccagtgttaatcactgagccagcactgaatcccctcgctaaccgccagcagatcaccgagatgtttttcgaacatctgggagtgccggctttctacatgtccatccaggccgtattggccctatttgccgcaggattcaccaccgggctggtattgaatagcggggctggggtcactcagtcagtgcctattttcgaggggtattgcttgccacatggggtgcagcagctagatctcgccggactggatctcaccaactatttaatggtcctgatgaagaatcacgggataatgctcctgagtgctagcgatcggaagattgtcgaggacatcaaagaaagtttttgctacgtggccatgaactacgaagaagagatggctaaaaagcccgactgccttgaaaaagtgtatcagctgcccgatggcaaggtgattcagctgcacgaccaacttttctcatgccctgaggcactgttttctccttgtcacatgaacctcgaggcacctggtatcgacaaaatttgcttctcctccattatgaagtgtgacactgggttgcgcaactctttcttctctaatatcattcttgccggtggttctacgtcctttccgggactggacaaaaggctcgtgaaggacattgctaaagtggctcccgctaatacagctgtccaagtgattgctcctccggagagaaagattagtgtatggatgggtggctccatactggcctctctgtcagcattccaggacatgtggatcaccgctgctgaattcaaggaagttggacccaacatcgttcaccagaggtgtttctag

SEQ ID NO: 28117 - DNA, 3072 bp, Artificial Sequence
  Description of Artificial Sequence: Synthetic coding sequence
atggatgccaatagcaaggacaaacccccagaaactaaggagtccgcaatgaacaacgcaggaaacgccagctttattctaggcaccggcaagatcgtgacacctcagaagcacgccgagctgccaccgaatccatgtacgcctgacacctttaagtctcccttaaactttagcacggtgacggtggagcaattggggattaccccagaatccttcgtgaggaactcagccggtaagtcatcctcctacctgaagaagtgtcgtcgtcgttcagcagtcggcgctcggggatcccctgaaaccaaccatctaatccgtttcattgcacggcagcaaaatattaagaacgctaggaagagtcctctggcccaggacagcccatctcaggggagccccgctctttaccgtaatgtgaatactcttcgcgagcgcattagcgccttccagtccgcatttcattcaattaaggaaaacgaaaagatgaccgggtgcctggaattctctgaagccggtaaggaaagtgaaatgactgatctgactaggaaggagggcttaagtgcttgccagcagtcaggctttcctgccgtgctgtcttccaaaagaagaaggatctcatatcaacgggatagtgacgaaaacctgactgacgccgaaggcaaggtgattggcttgcagatctttaacatagacaccgatcgagcctgtgccgtggagacttctgtggatctcagcgagatcagctccaaactggggtcaactcagtcaggctttctggtggaggagtctctgccactttcagaattgaccgaaacgtcgaacgctctcaaggtggccgactgcgtggtcggaaagggtagttccgacgccgtgtcacctgataccttcaccgccgaggtgagttcagacgccgtgccggatgtgaggtctcctgcaactcccgcatgtcggagggacttacccactcccaagacctttgtgctgcgcagtgtgctgaaaaagccaagcgtcaagatgtgcctcgagagtctgcaggaacactgcaataacctgtacgacgatgatggcacacacccatctctgatctcaaatcttccaaactgttgtaaagagaaggaagccgaggacgaagaaaattttgaagcccctgccttcctgaatatgaggaaacgaaaacgcgtaacatttggcgaggacctgtctcccgaggtcttcgatgagagcctcccagcgaacacccctctgaggaaaggtggtacacccgtgtgcaaaaaagacttctcgggactgtcgtcactccttctggagcagagtcctgtgcctgaaccgttgccccagccagacttcgacgacaagggggagaaccttgagaatatcgagcccctccaagtcagtttcgctgtgctttcgagtcccaataagtccagcatcagcgagacactgagcggcactgatactttttctagcagcaacaatcacgagaaaatctcctccccaaaagttggccgtatcacacgtacatcgaaccgcagaaaccagttggtgtccgtcgtcgaggagtcggtgtgtaaccttttaaacactgaagtgcagccttgtaaagaaaaaaagatcaatcggcgaaaaagccaggaaaccaagtgtacgaaacgggctttgcccaagaaaagccaggtgttgaaaagttgtcgaaaaaaaaaaggaaaaggtaagaagagcgtgcagaagtcactgtatggagagcgagatatcgcatctaaaaaaccactgttgtcccctatccccgagctcccagaggtgccagaaatgaccccatccatcccatctattaggcggctgggttccggatatttctcttctaacggaaagcttgaagaagtgaaaacgcctaagaatccggtgaagagaaaagacttgcttcgccacgaccccgacttgcacatgcatcagggctatgacaaatatgatgtctccgaattttgctcctatattaagtcgtctagctctcttgggaacgcaacaagcgacgaggaccccaatactaatatcatgaacatcaacgagaataagaacatccctaaagctaaaaacaagtctgaatccgagaacgagcctaaggccggaacagattctcccgtgtcgtgcgcttctgtaactgaggagcgggtggccagcgattctccgaagccagcgctaactttacagcaggggcaggagttcagtgccggtggtcagaacgctgagaatctttgccagtttttcaaaatttctcctgaccttaacatcaagtgcgagcgcaaggatgattttctcggcgctgccgaaggaaagcttcaatgcaaccgactaatgcccaatagccagaaagactgccactgcttgggcgacgtgctgatagagaacaccaaggagtctaaaagccagtccgaggacttaggcaggaagccgatggagtcgtcgtccgtggtgagttgccgtgatcgcaaggaccgccgtcgcagcatgtgctattccgatgggcgtagtctacacttagagaaaaatggtaaccacactccgtcctcatccgtcggatcctccgtcgaaatcagtctggagaactcggagctttttaaggacctcagcgatgcaatcgaacagacgttccagcggaggaattccgagacaaaggtccgcaggtccactcgccttcagaaggatcttgagaacgagggcctggtttggatttctctgcccttgccttctacatcacagaaggcaaagcggagaaccatatgcactttcgatagctcgggcttcgaatccatgtcaccgatcaaagaaacagtctcatcccgccagaaaccccagatggcgccacccgtctccgatccagaaaactcgcaaggacccgcagcgggatcatctgatgagcctggaaagcgccgaaagagcttttgcatctccacactggctaacaccaaggccactagccaatttaagggctaccgacggaggtcctcactcaatgggaagggcgagagttcgctcaccgccttggagcgaattgagcataacggcgaaaggaaacaatag

SEQ ID NO: 28118 - DNA, 963 bp, Artificial Sequence
  Description of Artificial Sequence: Synthetic coding sequence
atgtctaagagcgaatccccaaaagaaccggaacagcttaggaaactgtttataggtggcctatcgtttgagactacagacgaatcactgcgatcccactttgaacaatggggaaccctcacagactgcgtggttatgcgcgaccccaacactaagcgttctagaggcttcggttttgttacctatgcaaccgtggaagaggtggacgccgcaatgaacgccaggccccataaggtggacggaagagtcgtagagcccaagagagcagtctccagggaggattcccaacggccaggagcgcatttaaccgtcaagaaaatttttgtggggggaatcaaagaagacacagaggaacaccacctgagggactacttcgaacagtacggaaaaatcgaggtgattgaaatcatgaccgatcgcggatcaggcaagaaacgcggttttgctttcgtgacttttgatgaccacgactccgtagataaaatcgtgatccaaaagtaccacactgtgaacggacacaattgtgaagtgaggaaagcattatctaagcaagagatggcaagtgcctcctcctcacagcgagggagatcagggtccggtaactttggaggtggacggggaggaggattcggcggaaatgacaattttgggaggggcggtaacttttctggtcggggagggtttggcggttccagaggaggcggtggctacggcggaagcggtgacggctataacgggtttggaaacgacgggaacaacttcggtggcggtggaagctataatgatttcgggaactataataaccagagctctaacttcgggccaatgaagggcggtaactttggcggacgctcctcaggcccttacgggggtgggggtcagtacttcgcgaaaccacgcaaccagggaggctatggcggatcctcaagttcctcttcgtacggatccggtagacggttttag

SEQ ID NO: 28119 - DNA, 141 bp, Artificial Sequence
  Description of Artificial Sequence: Synthetic coding sequence
atgtgcagtctcgccagtggggctacaggatacagccatctgctcaagaaacattttcacacggtttctctgtccatctctcttatcctcacagcctggttcatcaacatggacctgaacttcatggacaccctctcttag

SEQ ID NO: 28120 - DNA, 198 bp, Artificial Sequence
  Description of Artificial Sequence: Synthetic coding sequence
atgtgctactatagcaattactacgggggtctgaggtacggatatggagtactcggaggcggatacggttgtggttgtgggtatggacacggctacggcggtctcggctgcggttatggacgcggatatggcggttatggttatggctgctgtagacccagttgttatggtcgctactggagttgtggcttttactag

SEQ ID NO: 28121 - DNA, 7058 bp, Artificial Sequence
  Description of Artificial Sequence: Synthetic coding sequence
atggagaaggccaccgttcctgtcgctgcagcaactgccgcagagggcgaggggagcccccctgccgttgctgctgttgctggaccccctgccgctgcagaggtgggaggtggtgtaggtggatcttctcgggcacgctcggcatcctctccacgtgggatggtaagagtgtgcgacctgctgctcaaaaaaaaaccgccacagcagcagcatcacaaggctaaacgtaataggacctgtaggcctccctcctcttctgagtcgtctagcgactcggacaactccgggggtggaggcggaggcggtggcggaggaggcggaggaggtgggaccagcagcaacaactctgaagaggaggaagatgatgacgatgaggaggaagaggtttccgaggtggagagctttattttagaccaagatgatcttgaaaatcccatgctggagactgcctccaaactgttgctttctggaaccgctgacggcgctgaccttcggaccgtggatcccgagacccaagcacgactagaggctttgttggaagcggctggcattggcaaattatcaaccgctgacggcaaggccttcgcggatcccgaggtcctcaggcgtttgaccagttccgtaagttgtgccctggacgaagcagccgctgctcttacaagaatgcgggctgaaagtacggcaaacgcgggacagtcagacaataggagccttgccgaagcttgcagcgagggtgatgtcaacgccgtccgaaaattactgatagaggggagatctgttaacgagcacactgaggagggcgagtcccttctatgtcttgcctgtagtgccggttactatgagctggcccaggttctcttggccatgcacgcaaatgtagaggatagagggataaaaggcgatatcactccactgatggccgcagccaatggcggacatgtcaaaatcgttaagctgttactagcacataaggcagatgtgaacgctcagtccagcaccggcaataccgctctcacttatgcatgcgccggaggctacgtggacgtggtaaaagtgctgctggagtccggcgcttcgatcgaagaccataatgaaaacgggcatacccctctgatggaagctggctcggcgggacacgtggaggtggcacgtcttcttttggaaaatggcgcaggcattaatactcactcaaatgaattcaaggagtccgctttgacactcgcatgttataagggacatctcgagatggtcaggttcttacttgaggccggagctgatcaggaacacaaaaccgatgagatgcataccgcgctgatggaggcttgcatggatggtcatgtggaggtggctcgactcttacttgactctggggctcaggttaacatgcccgctgactcatttgagagccctctcacccttgccgcttgtgggggtcatgttgagttggcggctctacttatagaacgcggtgcgtctctggaagaagtcaatgacgaaggatacacacctttgatggaggctgcacgagaggggcatgaggaaatggtcgctctgctactgggtcaaggggcaaacattaatgcccagacagaggagacacaggagacggccctgacactcgcatgctgcggtggcttcctggaggtcgccgattttctcatcaaagctggagccgatattgagcttgggtgtagcactccactgatggaggccgcacaggaaggacatctggagttagttaagtacctactggcggcaggagctaacgtacatgctacgacggccactggggacaccgccctgacctacgcctgcgaaaacggacacaccgatgtcgccgacgtactgctccaggctggggctgatttggagcacgaaagcgagggaggcagaactccactaatgaaagctgctagggccggtcacgtgtgcacagtccagtttcttatttctaagggtgctaacgtgaatagaaccaccgctaataatgatcacactgtcttgtccctggcctgtgccggaggccatctagccgtagtcgagcttctgctggcacacggcgctgacccgacacatcggctgaaggatggctccacaatgcttatcgaggctgcaaaaggaggacataccagcgtggtttgttacctgttagattaccccaataatctgctgtcagcccctcccccagatgtgacccagctgactccacctagccacgacctgaacagagcccctcgcgtacccgttcaggctctccctatggtggtacccccacaggagcctgataagcctcctgccaacgtggcaacgacactgcccatccgaaacaaggcagtgtccggaagagcttctgcgatgagcaatacccctacgcattcgatagctgcttcgatctcccagccacagacacctacgccatcacccattatcagcccctccgccatgttgccaatttaccccgctatagacatcgacgcacagaccgagagcaaccatgataccgcactgacgctggcttgcgcaggtggacacgaggaattagtgcagactctactcgaacgaggagcatccatagaacaccgcgataagaagggatttactccgctcattctggcagccacagccggacacgtcggcgtggttgaaattttgcttgataatggggctgacatagaagcccaatcggagcgaactaaggatacacccctcagcttggcttgctctgggggacgccaggaagtggtagagctgctcttagcaagaggtgctaacaaggagcaccggaatgtaagcgactacactcctctatctctggctgctagtggcggttacgtgaatataattaaaattctgctcaatgcaggagcggagatcaactcccggacaggatcaaagttagggatcagtcctctaatgctcgcagccatgaacgggcacactgctgccgtcaaattactgctcgacatgggatccgacattaatgcacagatcgagactaaccgcaacaccgcccttacgctcgcttgtttccaggggaggactgaggttgtctctttgctgcttgaccgaaaggctaatgtagaacacagggcaaagaccggtctcactccgctcatggaagctgcctctggcggatatgccgaagtcggaagagtgctgctggacaagggagccgatgtgaacgctcctcccgtgccatcctcccgagacactgcgctgaccattgctgccgacaagggtcattataaattttgcgagttgcttattggccgaggagctcatatcgacgttagaaacaagaaagggaacacaccactttggctggccgcaaacggcggtcacctcgacgtggtacagttgttggtgcaggcaggcgcagatgtggatgcagctgacaaccggaagatcacgccgcttatggcagccttcaggaagggccacgtcaaggtggtgcgttacctagttaaggaggtgaaccaattccccagcgacagcgaatgcatgagatatattgcaaccatcacggataaggaaatgctgaagaagtgtcacctgtgcatggaaagcatcgtgcaagcgaaagatcgccaggccgctgaggcgaataagaacgcgtctatcttattggaggagctcgacctggaaaagttacgggaggaatcgcggagactggctcttgccgcaaaaagagagaaaagaaaagaaaagaggagaaagaaaaaggaagagcaacgtcggaagttggaggagattgaagcgaagaacaaagaaaactttgagctacaggccgcacaggaaaaggaaaagttgaaggtggaagacgaacctgaggtcttaacggagcctccgtccgcaaccacaactaccactattgggatatctgccacatggacgacactggcaggatcccatggcaagagaaacaacacaattactacgacgtcatctaaacggaagaatagaaaaaacaagatcacaccagagaacgttcagataatatttgacgacccattgcctatctcctattcgcagcctgaaaaggtgaacggcgaaagcaagtcatctagcacctcagaatccggggattcagacaatatgcgcatatcctcctgctctgatgagtcaagcaattccaattcttccaggaaatcagataaccattctccagccgtggtgactactacagtgtcttcaaaaaagcagccctccgtgcttgtaacatttccgaaagaagaaaggaagtcggtctccggcaaagcaagcataaagctgtccgaaacaataagcgaaggcacaagtaactctctgtccacgtgtacaaaatccgggccatcccctctgtcttccccaaatgggaagctcacagtggcctcacccaagcgcggacagaaacgggaggagggttggaaggaggtggtgcgcaggagcaaaaaggtgagcgttcccagcaccgtgattagcagagttatcggcagaggcggttgtaacatcaacgccatccgggaattcactggggctcatattgacatcgacaagcagaaagataagaccggagacagaataattacgatccgcggaggcactgaatccacgaggcaggctacacagctcatcaatgctttgattaaggatcctgacaaagaaattgatgagttgattcccaaaaatcgattgaagtcaagctccgctaactctaaaattggcagcagcgcgccaacgacgaccgctgccaatacgtccttgatgggcattaaaatgactaccgtcgccctctccagcacctcccagaccgctactgcccttactgtgccagcaatttcaagcgcgagcacacataagacaatcaaaaatccagtgaataacgtgaggcccggttttccagtctcccttccactggcctatcctcccccacagttcgcccatgccctgcttgctgctcagaccttccaacagatccgcccacctcggctgcctatgacccattttggtggaacgtttccccctgcccagtctacatggggccctttcccagtgcgtccactaagcccagcaagagcaacaaactcacccaagccccacatggtgccaagacacagcaatcagaactcatcggggtcccaggttaactccgccggttccctgacgtcctcgcctaccaccacgacctcatcttccgcttcaacagtcccgggaacatctactaatgggtcaccgtcttcaccctcagtccgcaggcaactgtttgtgaccgtggtaaaaacaagcaacgctacaactaccacagttacgactactgcctcaaacaacaatactgcacctacaaacgctacataccccatgccgaccgcgaaagagcattatccagtgagttcccctagttcaccttctcccccagcgcagccgggaggagtcagtagaaacagccctttggactgcggcagcgcatctccaaacaaggtagccagctccagcgagcaggaggccggaagtcctccggttgtggagacaaccaacactcgccctccaaactctagctcatcgtccggtagctcatctgcgcacagcaaccagcagcagcctcccggttccgttagccaagagccccgacctcccctgcagcagagtcaggtacctccccctgaggttcgtatgaccgtgccaccactggccacatctagcgcccctgtcgccgtgccaagcaccgcacctgtgacatatcccatgcctcaaacaccaatgggctgtcctcagccgactccgaagatggagacacccgctatccggccaccacctcatggaaccaccgctccccataagaattcagcatcagtgcagaattcttcggtggccgtcctcagcgtgaatcacataaaaagaccccattcagtcccaagcagtgttcagctccctagcacactgagcacgcagagcgcctgccagaactccgtgcatccagccaataagcctatcgcccctaactttagtgcccctttaccattcggtccatttagtacacttttcgaaaatagtccaacgagtgcccatgctttctggggcggaagtgttgtcagcagtcagtcaactcccgagtccatgcttagcggcaaaagttcctacttgccgaatagcgaccctcttcaccagtctgataccagtaaggctccaggctttcggcctccgctgcagcgacctgccccaagccctagcggcattgtcaatatggactctccctatggaagtgtcacgcctagcagcactcatcttggaaatttcgccagtaacatttccggcggacaaatgtacggaccaggcgcacccctcggtggcgcaccggctgctgccaacttcaatagacagcatttctctcccctgtctctgttaactccctgctcgagcgcttctaacgatagttctgctcagtctgtcagctcaggtgtgcgagcccctagccctgctccaagctccgttcctttgggttctgaaaaacccagcaatgtgagtcaggaccgcaaggtaccagtgccgatcgggaccgaacgcagtgccaggatccggcaaactggaacgtctgctccttccgttattggctcaaatttatccaccagcgtggggcacagcggcatctggagcttcgaagggataggcggtaatcaggataaggtggattggtgtaacccaggcatggggaacccaatgatccataggcccatgagcgaccctggcgttttttctcagcaccaggcaatggagcgagacagtactggtatcgtcacaccctctgggacgttccaccaacatgtccccgcaggctacatggacttcccaaaggtggggggtatgccctttagcgtgtacggtaacgccatgattcctcctgtcgcacccatccccgatggtgccggaggcccaatcttcaatggtcctcatgccgcagacccttcatggaactcactcattaagatggtatcttcctccactgaaaataacggccctcagacagtctggactggaccctgggctcctcacatgaactctgtgcacatgaaccaattgggcta

SEQ ID NO: 28122 - DNA, 1374 bp, Artificial Sequence
  Description of Artificial Sequence: Synthetic coding sequence
atgtccggaactcgggctagcaatgatagacctcccggagctggcggtgtgaaacggggaagactgcagcaggaagcagcggcaactggaagccgagtcacggtggtgctgggggctcagtggggcgatgagggcaagggcaaggtcgttgacctgcttgctaccgacgccgacatcatttcaaggtgtcaaggaggtaacaatgccggtcacactgttgtggtggacgggaaagagtatgatttccatttgctgccatccggtatcatcaacactaaagcggtttcgtttattggaaatggggtggtcattcatttacccggacttttcgaggaggcagagaagaacgagaaaaaggggttaaaggactgggagaagcgattaattattagtgatcgggcacacctggtcttcgattttcaccaggcagttgacggcctccaagaggtacaacgacaggcacaggaagggaagaacatcggcaccaccaaaaaggggattgggcctacttacagcagtaaggccgctcggacaggactcaggatttgcgatcttctatctgatttcgacgagttctcgtcccggtttaagaatctagcccaccagcaccaatcgatgttccccactctcgagatcgatatcgaagggcaactgaagcgacttaaaggatttgcggagaggatccgaccaatggtgcgggatggcgtatacttcatgtatgaagccttgcacgggccacccaagaaaatattagtggaaggtgccaatgctgccctgttagacattgacttcggcacataccccttcgtcacatcctcaaattgcaccgtaggcggagtgtgcactggtctgggcatccccccacaaaacattggtgacgtgtatggggtggtaaaagcctatacaactagggttggcattggggcatttccaacagagcagattaacgagattgggggtctgctgcagacacgcggacacgaatggggggtgactacaggccgaaaacgcaggtgcgggtggcttgatttgatgatccttaggtacgcccatatggtcaatggatttaccgctttggctcttactaagctggatattctagacgtgttaggggaagtgaaagtgggggtgtcctacaagctgaatggtaaaaggatcccgtactttcccgcaaatcaggagatgctgcaaaaggtggaagtcgaatacgagaccctccctggttggaaggccgacacgacaggcgcacgaaggtgggaggatctgccgccacaagcccagaactacatcaggtttgtggaaaaccacgtgggagtggctgttaagtgggtcggagtcgggaagtcccgcgagtcaatgatacagctgttctag

SEQ ID NO: 28123 - DNA, 1596 bp, Artificial Sequence
  Description of Artificial Sequence: Synthetic coding sequence
atgtgtagtctggcgagtggcgcaactggcggacggggtgccgtggagaacgaggaggacctgcctgagctgtctgactcaggcgatgaagccgcatgggaggatgaggacgatgcggacttacctcacggcaagcaacagaccccatgcttgttttgcaatagactttttacgagcgccgaggaaacattttcccattgcaaatccgagcatcagttcaacatcgacagtatggtccataaacacggcctcgaattttatggctacatcaaactaatcaacttcattcggttaaaaaatcctactgtcgagtatatgaattccatttataatcctgtgccctgggagaaggaagaatacctcaaacccgtgttggaggacgatctgctgctgcagttcgacgtagaagacctgtacgaacctgttagtgtcccattttcataccctaatggcctgagcgaaaatacatccgtcgtggaaaaactcaagcatatggaagcacgagccctgtccgccgaggcagctctggcgagggcccgagaggatttgcagaagatgaaacaatttgctcaggattttgtcatgcataccgatgtccgcacctgtagctctagcacctctgtcatagcagacttgcaggaagatgaagatggcgtttacttttcttcctacgggcactatggcattcacgaggagatgttgaaggataagatccgcactgagtcatatagagatttcatttaccagaaccctcatatcttcaaagataaggtagtgttagatgtgggatgcgggacaggtattttaagtatgttcgcggcaaaggcaggtgccaaaaaagtcctgggagtggaccagtctgaaattctgtatcaggccatggatatcatccgattgaacaagctggaggacacaatcacgctgataaaggggaagatcgaagaagttcacctgccggttgaaaaggtggacgtcatcataagcgagtggatgggttactttcttctcttcgagagcatgctcgattctgtgctgtacgccaagaataaatacttggccaaaggtgggagtgtctatccggacatttgtactatatcactagtagccgtcagcgatgtcaacaaacacgcagatcgcatagccttttgggacgatgtgtatggattcaagatgtcatgcatgaaaaaggctgtcatcccagaggccgtcgtggaggtgttagacccgaagacacttattagcgaaccatgtgggatcaaacatattgattgccataccacatccatcagcgacctcgagtttagtagcgacttcactttgaaaatcaccagaacttcaatgtgtactgccattgcgggatattttgatatttacttcgagaaaaattgtcacaacagagttgtgttcagcacaggaccacagagtactaaaacacattggaaacagacagtgtttctgctggaaaaacccttctctgtgaaggcaggagaagccctcaagggtaaggtgaccgtacacaagagtaaaaaagatcctcgttccctgaccgtcacgctgacactgaacaattctactcagacctacggcttgcaatag

SEQ ID NO: 28124 - DNA, 1659 bp, Artificial Sequence
  Description of Artificial Sequence: Synthetic coding sequence
atgtctgtgctctcacccggagacctcaagccaaagaggggatcacctcatcgtggaagcctagatagaactgatgcttccaccgacctcgccatgcgtagctggccaagcgagcttggttcccgtacatgttcaacaagtgcgacgacaacagccccttcgaatagcacaccaatcgcccgacaccctggcaggaccaaaggttataactccgacgacaacttgtgtgaaccctcactggagttcgaagtgccgaaccacagacagtatgtgtccagacccagctctctagagtccagtagaaacacctctagcaacagctcgccgctcaacctgaaaggcagctccgagcaattgcatggacgtagcgagtctttttcttcagaagacctcatcccctcaagagacctcgcaacactccccagggaggcttccacaccaggcagaaatgccctcggcagacatgagtaccccctccccaggaacgggccattaccccaagagggcgctcagaagagaggcaccgctcctccttatgtgggcgtccgcccatgttccgcctcacctagtagcgagatggtcacgctcgaggagttcctggaagaaagcaaccgtagctcccctacacacgacacaccttcctgcagggatgatttgctttccgattatttcagaaaagcctctgaccctcccgcaattggaggccaaccgggaccgccagcaaaaaaagaaggggctaagatgcctaccaactttgtggcccctacagtgaagatggcagctcctacgagcgaaggcaggcctttgaagccaggtcagtacgttaagcctaatttcaggctaacagaagcagaggcacctccttctgtggctcctagacaggctcagcctccccagagcctcagcctcgggaggcctcgtcaggctccagtaccccctgcctcacatgctcctgcctctaggagcgcctcattgtcacgcgcattttctctcgcgagtgccgacttgctccgcgcaagcggccctgaggcttgtaagcaagagagtccccagaaattaggcgctccagaggctcttggaggacgcgaaaccggttcccataccctacaaagccccgcacctccgtcaagccactctctggctcgggagcggaccccccttgtcggcaaagcagggagctcctgtcagggccctggcccacgctccagacctctcgatacaagacgcttctctctggcgccacctaaagaagagcgcctcgcccctttgcaccaatccgctacagcccctgcgatcgccacagcgggagcgggtgcggctgccgctgggtccggatctaattctcagctgctccacttctcccccgcagcagctccagccgcacgcacaaaacccaaagctcccccacgctcaggtgaggtggctacaatcactcctgttcgagcaggcctttctctgtccgaaggggacggggtgccaggccagggctgctccgaggggctgccagcaaagagtcccggacggagccctgatctggcccctcatctaggcagggccctggaagattgttccagagggtcagtgagcaaaagcagtccagcctctcctgagcccggaggggatccccagactgtgtggtacgaatatggctgcgtttag

SEQ ID NO: 28125 - DNA, 774 bp, Artificial Sequence
  Description of Artificial Sequence: Synthetic coding sequence
atggcggacaaaatggacatgtcgctggatgatatcattaaacttaacaggtcacagcggggtgggagaggcggtggacggggtagaggcagggctgggagtcagggcggtagggggggaggcgcacaggctgctgcccgtgtgaacagaggagggggtccaattcggaacagaccagcgatcgctcgaggggcagcaggcggtggcggaaggaataggccggctccttacagcagacctaaacagctgcccgataagtggcagcatgacctgtttgattcgggattcggtgggggagccggtgtcgaaacaggcggaaagctgttggtgtctaacctagactttggtgtgtcagacgccgatatccaggagctttttgctgagttcggtactctaaaaaaggctgcggtgcactacgacagatctgggagaagcctgggtacggccgacgtgcacttcgaacgaaaagccgacgcgctgaaagccatgaaacaatataacggcgtgccacttgatggtagacctatgaatatacagctggtcacaagccagatcgatgcacaaagacggccagcacagagtgttaaccgagggggaatgactcgcaatcgcggagccggaggatttggcggaggaggtggaaccaggcggggaacccgcggaggagccagaggacggggtagaggggcaggtcgcaattctaaacaacagctgtcagccgaggaacttgatgcacagctcgatgcttacaatgcccgaatggataccagctag

SEQ ID NO: 28126 - DNA, 876 bp, Artificial Sequence
  Description of Artificial Sequence: Synthetic coding sequence
atgggcgttgcagctaggccccctgcactccgccactggtttagccactcaattcccctcgcaatcttcgccttattgctgctgtatctgtcagtccgttctctgggagccagatctggttgcgggccaagagcccagccttgtgtccccggagaaactgcaccttttcaggtgagacaggagagcgggacattagaggcccctgagagaaaacagcccccttgtctgggacccagggggatgctggggagaatgatgagaaggtttcacgcatcactcaagccagagggtgacgtcggcctgtctccctacctggctggctggcgagcactcgtagagttcctaacccctttgggctcagtgtttgcgtttgccacacgagaagccttcacaaaggttacggacctggaagcgcgagtccatggcccagacgctgaacactactggagcctcgtggccatggccgcttgggagagaagggccggtctcttggaacaaccaggtgcagcccctcgcgacccgacgaggtcgtccggaagtaggaccctgctcctgttgcatagagccctcagatggagccaactgtgcttgcaccgggtcgctacgggtgccttaggaggcccagacgccggtgttcagtgttccgatgcgtatcgggcagctctcggccctcatcacccctggctcgttcgccagactgcacgcctggcattcctggccttccctggaagaaggcgtttgcttgaactggcctgcccaggcgcaaccgaggcagaagctagggcagctttggtccgcgctgccggaactctcgaggatgtgtacaatagaacccagagcctgcttgcagagcgcggactgctgcaactagcttag

SEQ ID NO: 28127 - DNA, 3303 bp, Artificial Sequence
  Description of Artificial Sequence: Synthetic coding sequence
atgggtaacgcagcgggaagtgcagagcagcccgcaggccctgccgctcctccacccaagcagcctgcgccaccgaaacagccaatgcctgccgcaggcgagctggaggagcggttcaaccgcgctttgaactgcatgaatctgccgccagataaagtccaacttctgagtcagtacgataatgaaaagaaatgggagctgatctgcgatcaggaacggttccaagttaagaatcctccagcggcatatattcagaagttaaagtcttacgttgacactgggggagtatcccggaaggttgcagctgattggatgagcaatctcggttttaagcgacgggtccaggagtccactcaggtgctgagggagctggagacaagcttgaggactaaccacattgggtgggtgcaggaatttctgaacgaggaaaataggggtctggatgtcctgctagagtatctggccttcgcccagtgctctgttacctatgatatggagagcaccgataacggcgctagtaacagtgagaagaacaaacccctagaacagtccgtggaagaccttagcaagggacccccttcctctgtcccaaaaagccggcacctcactatcaagctgacacccgctcatagccgaaaggcactgaggaactctcggattgtgtcccaaaaggacgacgtccacgtgtgtattatgtgccttcgggctataatgaactaccagtccggtttcagccttgttatgaaccatcctgcttgcgtcaacgaaatcgctctaagcctcaataataaaaaccctagaacaaaagctctggtcctggaattgttggccgctgtgtgtctggtccgcggagggcacgacatcatcttggctgcttttgacaactttaaagaagtgtgcggagagcaacataggttcgaaaaactgatggagtatttcaggaatgaggactctaatatagacttcatggtcgcatgcatgcaattcatcaacattgtggtccactctgtcgagaacatgaatttcagggtttttcttcagtacgaatttacacatcttggattggacctctatctggagcgcttgaggctcaccgagagtgataaactccaagttcagatccaggcttacctcgacaacatttttgacgtgggggcactgttggaggacacagagacgaaaaacgccgttctagaacacatggaggagctgcaggagcaggttgcactgctgactgaaagactgcgagatgccgaaaatgaatctatggccaaaatcgccgagctagaaaagcagctgtcgcaggctagaaaggaactggagacacttagagagaggttctcagaaagcacagcaatgggacctagcaggcgacctcccgagcctgagaaggcgccacccgcagccccaacacgaccctccgctctcgagcttaaagttgaagaactggaggagaaaggactcatacgcattctgcgcggtccgggtgatgccgtgtccattgaaatcctgcctgtggcggtagcgaccccctccggcggagatgcacccaccccaggcgttcccaccggttccccctctcccgacctcgcgcctgccgcagagcctgctccgggtgccgcacccccaccaccgcctcccctcccaggactgccgtccccgcaagaagcccctcccagcgcccctccccaggctcccccattgcctggcagccctgaacccccaccagccccacccctaccaggggatctgccccctcccccacccccacctcctccacctcccggaaccgacggaccagtaccccctcccccacctcccccaccgccacctccaggcggaccacccgacgctctcggaagaagagattccgagctcgggcctggggtaaaagccaaaaagccaattcaaaccaagtttcgcatgcctctgctgaattgggtagccctcaagcccagccaaataaccggcaccgtattcactgagctcaacgacgagaaggtgctccaggaattggacatgagcgatttcgaggaacaatttaagaccaaatcccaggggcctagtctcgacctttctgcccttaaatctaaggcggctcagaaagcaccttctaaggctaccctgattgaagctaaccgggctaaaaacttggcgataactttgaggaaaggtaacctgggagccgagcgaatttgtcaggcaatagaagcttatgacctacaggcgctgggcctggacttcctcgagctgctgatgcggtttctgcctaccgaatatgagcgttccttgattacacgctttgaacgcgagcagcgccctatggaagaactcagtgaggaggacagatttatgctgtgtttctccagaattcctagactccccgagagaatgaccacgttaacttttctgggcaactttcctgacactgcacaactgctgatgcctcagcttaacgccataatcgcggcaagtatgtctatcaagtccagcgacaaactgagacaaatactggagattgtcctggctttcggcaattacatgaacagcagcaagcgcggagcagcttatgggttccgcttgcaaagtttggatgcactgctagaaatgaagagcacagacagaaaacagacactgttgcattacctcgtgaaggtgattgcggaaaagtacccacagctgacgggtttccattctgacctccattttctagacaaagcgggatctgtaagcctggactctgtcctagcggatgtgagaagcttgcaacgagggctggagctgacccagagggaatttgtgagacaagatgattgtatggtgctgaaagagtttctgagagccaacagccctaccatggataaacttctggcagacagtaaaacggcccaggaggcctttgaaagtgttgttgagtactttggcgagaacccgaaaacaacatcacccggattgttcttctcacttttttcccgcttcatcaaggcatataagaaggcggaacaggaggtcgagcaatggaagaaagaggcagcagcccaggaggctggcgctgacactcctggcaagggggagcctccagccccaaaaagtccccctaaggctaggaggccccaaatggacctcatttcagagctgaagagacggcagcaaaaagagcccctcatctatgaatctgaccgggacggtgccattgaggacatcatcaccgtgatcaagactgtgccatttactgccaggaccgggaagcgaacatctaggctactctgtgaggctagccttggcgaagagatgcccctctag

SEQ ID NO: 28128 - DNA, 1839 bp, Artificial Sequence
  Description of Artificial Sequence: Synthetic coding sequence
atggaaaaccagttggccaagagtactgaggagcgcaccttccagtaccaggatagcctgcccagtctcccagttccatcccttgaggaatctcttaaaaaatacttggagagcgtcaagccctttgccaaccaagaggaatataagaagacagaggagatcgtacaaaagtttcaaagcggaataggcgagaaactgcaccagaaattgctggagagggctaagggcaagagaaactggctcgaggaatggtggctcaacgttgcctacttggacgtgcggattccctcccaattgaacgtgaacttcgcgggtcctgcagcacatttcgagcactattggccacctaaggagggcacgcaactcgaacgaggatctattactctgtggcataatttaaattactggcagctgctcagaaaagagaaagttccagtgcataaggtggggaatactccgctcgatatgaatcagttccgcatgcttttctcgacttgcaaagtcccaggaattacacgggattcaatcatgaattacttccggacagagagcgagggtcgtagccccaaccacatagtggtcctgtgtcggggacgggctttcgtgttcgacgtcatacacgaaggctgtctcgtgacaccccctgagctcctgcggcaactcacctatatacacaaaaagtgccactctgagccagacggccctggcattgccgcattaacctctgaggaaagaactcgatgggctaaggcccgagaatacctgataggattggacccagagaacctcgccctactggagaagatccagagctctttgctggtgtactccatggaggactcctctcctcacgtcactcccgaggactatagcgagattatagcagcaattctaatcggggatccaacagtcaggtggggtgacaaatcgtacaacctcattagcttctcgaatggtgtctttggctgcaattgtgaccacgctccatttgatgctatgatcatggtgaatatttcttattatgtggacgagaagatattccagaatgagggacggtggaaggggagtgaaaaggtgcgggatatccccctacctgaggaattaatttttatcgtggatgagaaagtattaaacgacattaatcaggccaaagcacagtatctgcgggaagcatcggatcttcagatagcagcctatgcctttacttcttttggtaaaaagctcaccaagaacaagatgctccacccagacacatttattcagctggccttacaacttgcctactatcgtcttcatggacaccccggttgttgttacgaaacagctatgacaaggcatttttaccacgggcgtaccgaaacaatgagatcatgtactgtcgaggccgtgcggtggtgtcagtcaatgcaggatccttccgtcaatcttagggagcgtcagcagaagatgcttcaggcattcgcaaaacacaacaaaatgatgaaggactgcagtgctggtaagggattcgataggcacctgctggggctcctgctcatcgcaaaggaggaaggcctccccgtcccagagctatttactgatcctctgtttagcaaaagcggcggtggcggtaattttgtccttagtacgtcacttgtggggtaccttcgcgtgcagggggtggtcgtccccatggtacacaatgggtatggcttcttctaccacattcgagatgacaggtttgtagtcgcgtgcagtgcttggaagtcatgtcctgaaacagatgcagagaaactggttcaactgactttctgcgcgtttcacgacatgattcagcttatgaatagtacgcacttatag

SEQ ID NO: 28129 - DNA, 1773 bp, Artificial Sequence
  Description of Artificial Sequence: Synthetic coding sequence
atgtccgatagtcccgcagggagcaatccacggactcccgagagcagcgggtccggttctggcggaggaggtaagcggcctgccgttcccgctgccgtttccttgctgcctccagcggaccccctccgccaagccaataggctgcccatacgcgttctcaaaatgctgtccgctcacacaggccatcttctgcatccagagtacctacagccactgagttcaactccggtgtcccccatcgagctcgacgccaagaaaagccctctagctctcctggcccagacttgctcccagattggcaagcctgaccctcccccttctagtaaactgaattccgtagccgcagcggcaaatggcctgggggctgagaaggaccccggtcggagtgcaccaggcgctgccagtgcagccgctgctcttaaacaattgggggatagccccgctgaggacaaatcatcttttaaaccatattcaaaggggagtggcggaggggactctcggaaagactcaggctcaagttccgtgtcctcaacgtcgtcttccagctcttcatctccgggagataaagccggattccgagtgccaagcgcagcatgccctcctttcccacctcacggggctccggtgagtgcaagcagcagctcttcaagccctggcggtagcaggggcggtagtcctcaccactccgattgcaagaacggcggtggcgtgggcggtggcgagctggataagaaagatcaagagcccaaaccaagtccagagccagctgcggtctcccgcggaggaggcggtgagccaggcgctcatgggggtgccgagagtggcgcaagcgggagaaagtccgaaccgcctagcgctctagtaggcgctggtcatgtggcccctgtctcaccctataagcccggacacagcgtcttcccacttccaccgagctctatcggatatcatggctctatcgtgggagcatacgccggatatcccagccagttcgtgccgggactcgatcccagtaaatcagggctcgtgggaggtcagctctccggtggattggggttgccacctgggaagccccctagcagttcgcccctgaccggcgcttcgcctccatctttcctgcaagggttatgtcgcgacccctactgtctgggcggatatcatggtgccagtcatctgggtggatcaagctgttcaacgtgtagcgcacacgatcctgccggtcccagtctgaaggcgggtggctatcctctggtgtacccaggacacccactccagccagctgccctgagttcttccgccgctcaggcagctctgccgggacatcctttgtatacgtacgggtttatgctccagaacgagcctctgccccactcttgcaactgggtggcagccagtggcccatgcgataaacgcttcgccaccagcgaggaactcctgagtcacctgaggacccacacagccttgccgggtgccgagaaactgctggccgcatatcctggtgcatcaggactgggcagcgctgccgctgctgctgcagccgctgcttcctgtcacctgcacctgcccccacctgcagcacctggcagtccaggtagtctcagtctgagaaaccctcacacgctgggactctcgagataccatccctatggaaaaagccatctgagtacggccggaggtctggcagtgcctagcctgcccacagccggtccttactattcaccctacgccttgtatggacagagactcgcaagtgcgtctgccctcggctaccaatag

SEQ ID NO: 28130 - DNA, 1020 bp, Artificial Sequence
  Description of Artificial Sequence: Synthetic coding sequence
atgtggacagcccgaggtccattcaggagggaccgctggtcctctgaggacgaggaggccgctggaccatctcaggctctatcaccgttgctgagtgacactcgcaagatcgtttcagaaggtgagttggatcagcttgcccagatacggcctctgatctttaacttccatgagcagactgctatcaaggactgtttgaagattctcgaagagaaaacggccgcttacgatatcatgcaagagttcatggcactcgagcttaaaaacctgccaggggagttcaactctggcaatcaacccagcaatagggaaaaaaatagatacagggacatactcccatatgatagcaccagggtgccactgggaaagtccaaggactacattaatgcgtcctacattcgcatcgtcaactgtggcgaagagtacttctacattgcaacccagggccctctcctatcaactatcgacgatttctggcagatggttctggaaaataactccaacgtcatcgcgatgattacaagggagattgaaggaggaatcatcaagtgctaccactattggccgattagtcttaaaaagcctctcgaactaaagcacttccgggtgttcttggagaactaccagattctgcagtatttcataattcgtatgtttcaggtggttgaaaaatccacaggtaccagccactccgtcaaacagctccaattcactaaatggccagatcacggcaccccagcgtcggctgatagctttataaagtacatcagatacgcacgcaagtcccacttgacgggacctatggtagttcattgcagcgctgggattggcaggacaggagtattcctgtgcgtggatgtggtcttctgtgccattgtgaaaaactgtagtttcaacatcatggacatcgttgcacagatgagagagcagcgctcaggaatggtgcaaacaaaggaacagtatcacttctgttacgatatagttctggaggtcctccgcaaactgttgaccttggattag

SEQ ID NO: 28131 - DNA, 1917 bp, Artificial Sequence
  Description of Artificial Sequence: Synthetic coding sequence
atgtcagccctggccggtgaagacgtgtggcgttgcccaggatgcggcgatcacatcgcccctagccaaatatggtaccgaacagttaatgagacctggcacggaagctgttttcggtgtagcgaatgccaggactccttaacgaactggtattatgagaaggacgggaagctgtattgtccaaaggattattggggcaaattcggcgaattctgtcatggttgcagcctgctgatgactggtccatttatggtggctggtgagtttaagtatcatcctgaatgttttgcctgcatgtcctgtaaggtgatcatcgaggacggggatgcttatgcattggtgcaacatgccactctctattgtggcaagtgccataatgaggtcgtgctggccccaatgtttgagcggctgtctacagagtctgtgcaggagcaactgccctatagtgtcacactaatttcaatgcccgcaaccacggaagggaggagagggttttcggtcagtgtggagagcgcgtgcagcaactacgccacaaccgtccaagtgaaagaggtcaataggatgcacatcagccccaacaacaggaacgcaatccaccccggagaccgcattctcgagatcaacggcaccccagtcagaactctcagagtggaggaagtggaggacgcgatctcacaaacctcccaaaccttacagttgttaatagagcatgacccagtcagtcagcggcttgaccagcttaggctggaagctcggcttgcccctcacatgcaaaacgccggacacccacacgctctctcaactcttgatactaaagagaatctggaagggactttacgtagacgcagtctgcgacggtctaacagtatttcaaagagccccggtccaagttctcctaaggagcctctgctgttttctcgcgatatcagccggtccgaatccctgcggtgctccagtagctattcacagcagatcttcagaccatgtgacctgatccacggcgaggtgttgggaaaggggttcttcggacaagccatcaaagtcacccacaaggccaccggcaaagtgatggttatgaaagagttgattcgctgtgatgaggaaacgcagaagacctttctcactgaagtcaaggttatgcgctccctcgaccatcccaatgttttgaaatttatcggcgttctctataaggacaaaaagctaaatctcctcaccgaatacattgaggggggaaccctgaaggacttcctgcgctctatggatccatttccctggcaacagaaagtgaggttcgcgaagggcatagcttccggcatggcataccttcactccatgtgcatcatccaccgggatttaaactcccataactgcttgataaagcttgacaaaacggtggtggtggccgatttcggattgtcgaggctgattgtggaggagagaaagcgcgctccgatggagaaagcaactactaaaaagcgaacccttagaaagaatgaccggaaaaagcggtataccgttgtgggtaacccatactggatggcccctgagatgcttaacggcaagagctacgacgagacagtagacatcttcagcttcggcatcgtcctttgtgagattataggccaggtgtatgcggacccggactgccttcccaggacgcttgattttggcctcaatgtcaagctattttgggagaagtttgtccccacagattgcccacctgctttctttccgttggctgcgatatgttgtaggctggaaccggaaagtagacctgcttttagcaaactcgaggacagtttcgaggccctgtctctttatcttggcgaactcggcatcccccttccggcagagctagaagagctcgatcacacagtgtcaatgcagtatggcctaacccgggatagccctccttag

SEQ ID NO: 28132 - DNA, 606 bp, Artificial Sequence
  Description of Artificial Sequence: Synthetic coding sequence
atggccgctgccaaagatacacatgaagaccacgatacttccactgagaacactgacgaatcaaaccatgacccccagttcgagcccatagtttcactccctgagcaggagatcaagaccctggaggaggacgaggaagaactgttcaagatgcgcgctaagttatttcgtttcgccagtgagaatgatttgccagagtggaaggagagaggtactggcgatgtgaagttgctgaagcataaagagaagggggctatcaggctcctcatgcggagggacaagacactcaagatctgcgctaatcattacattacccccatgatggagctgaaaccaaacgccggttccgatcgggcatgggtgtggaacacccatgccgacttcgctgacgagtgccccaagccagagcttctcgctatccgtttcctgaacgcggaaaacgctcaaaagtttaaaaccaagtttgaggagtgtcgaaaagagatcgaggagcgcgagaagaaagcaggctctgggaaaaacgatcacgcagagaaggtggccgaaaagctggaggccctcagcgtgaaagaggaaacaaaggaggatgctgaggaaaaacagtag

SEQ ID NO: 28133 - DNA, 2154 bp, Artificial Sequence
  Description of Artificial Sequence: Synthetic coding sequence
atggccgcagacaaaccagcagaccaaggcgcagagaagcacgaagggactggccagtcctctggaattactgaccaggagaaagaactgagcacaaatgcctttcaagcatttacttctggaaactacgatgcttgcctacaacaccttgcttgcctgcaggacatcaacaaggacgactataagattatcctcaacaccgccgtcgctgagttttttaaatctaaccagaccaccaccgacaatcttcgacagaccctgaatcagctgaagaaccaggttcattccgccgtggaagagatggatggacttgatgatgtcgaaaattctatgctttactataatcaagctgttatactgtatcacctgcggcaatatacggaagcaatcagtgtaggcgagaaactgtaccagttcattgagccattcgaagagaagtttgcgcaagcggtgtgcttcttacttgtggatctgtacatacttacttatcaggctgaaaaagccctgcacctgctggctgtcctcgaaaaaatgatttcccagggcaacaataataagaacggaaagaatgaaactggcaataataacaacaaagatggaagcaatcataaggccgagtctggcgcactgatcgaggcagctaagtccaaaatacatcagtacaaggtgagggcctatattcagatgaaatccctcaaagcctgtaagcgggaaattaaatccgttatgaacacggctggcaattctgccccatccttgttcctgaaaagcaatttcgaatatttacgcggtaattatcgtaaagccgtgaagttactgaattcgagcaacattgcagagcatccgggattcatgaaaactggagagtgcctcagatgtatgttttggaataatctggggtgtattcacttcgccatgtcgaagcacaacctggggatattctatttcaaaaaagcactacaggaaaacgataatgtctgcgcacagctaagtgctggttccaccgaccctggtaagaaattttctggaaggcccatgtgcacgctgctcacaaacaaacgctatgagctcctgtataattgtggtatccagctgttgcatatcgggagacctctcgccgcatttgagtgcttaatcgaggccgtacaagtgtaccacgccaatccgcgattatggctccgactggcagagtgctgcatcgccgcaaataaagggaccagtgagcaggaaacaaaaggcctcccttctaagaaagggattgttcagtctattgtcggccagggttaccaccgcaaaattgtgctcgcctctcaaagcatccagaacactgtctataatgacggccagtcctccgcaattcccgtggcatcaatggagtttgctgccatttgtttacggaacgccctgctccttctgcctgaggagcagcaggaccccaagcaggagaacggggctaaaaattctaaccagctggggggaaacaccgagtcctccgaatcatccgagacctgcaggtgctcaatattagcctgttcggcctacgttgccctcgccctgggggataaccttatggcactaaatcacgccgacaaacttcttcagcagccgaagctgtccgggagcctcaaatttctgggacacctctacgccgcagaagcattaattagcctcgatagaatctctgacgccatcactcatctcaaccctgagaatgtcactgacgtcagtctcggaatcagcagtaatgaacaggatcagggaagcgataagggagagaacgaggctatggagtccagcggcaagagagcacctcagtgctacccatccagtgtcaacagcgccagaacggttatgctttttaacctcggctcagcgtattgcctccgtagcgagtatgacaaggccaggaagtgtctgcaccaggccgcttctatgatacacccaaaagaggtgccccctgaggcgatcttgctcgccgtgtacctcgaattgcagaatgggaacacccagctggctctgcagatcattaagcggaatcagttgctgcccgcagtcaagacccattcagaagtgcgcaagaaacccgttttccagcccgtacatcccatccaacccattcagatgcccgcattcactacagtacagcgcaaatag

SEQ ID NO: 28134 - DNA, 1488 bp, Artificial Sequence
  Description of Artificial Sequence: Synthetic coding sequence
atggaagccctcctggaaggcattcaaaaccgagggcatgggggaggttttctgacatcgtgtgaggcggagcttcaggagctgatgaagcaaattgacatcatggtggctcataaaaaatccgaatgggaaggaagaacccacgcacttgaaacttgcttgaagattagggagcaggaacttaagagccttcgttctcagctcgacgtcactcataaagaagttggaatgctacaccaacaggtggaggagcatgagaagattaaacaggagatgaccatggaatacaagcaggaactgaagaagctacacgaggaattgtgtatccttaaaagatcctacgaaaaactccagaagaaacagatgcgggagttccgcggaaacactaagaatcaccgggaggaccgttccgaaatagagcgcctgaccgcgaagattgaagaatttagacagaagagtttggattgggagaaacagcgcctgatttatcagcaacaggtgagctccctggaggcacaacgcaaagcactggcggagcaaagcgaaatcatacaggcccaacttgtgaaccgtaagcagaaacttgagagcgtagaactgagctcccagtcggaaattcagcatctgagcagcaagctggagcgggctaacgatacgatatgcgcgaacgagctggagattgagcggttaacaatgagagtcaacgatctagttgggacttcaatgacagtcctgcaagagcagcaacagaaggaggagaaacttcgcgaaagcgagaaacttctggaggcgctccaggaagaaaaacgagaactgaaggcagcactacaaagtcaggaaaatctaattcatgaagcacggattcagaaagaaaaactacaagaaaaggtgaaagctacaaacactcagcacgccgtcgaggcaatctcgcttgagtcagtgagcgcaacatgtaagcaactgagccaggagctgatggagaagtatgaggagcttaaacggatggaggcacacaacaacgaatataaagcggaaatcaaaaaactaaaagagcagattttacagggagagcaatcttatagcagtgctttagaggggatgaagatggagatatcccatctgacacaagagcttcatcaaagggacatcacaatcgcaagtacgaagggttccagctctgacatggaaaaacgcctccgggctgagatgcagaaagccgaggacaaggctgtggaacacaaagagattttggaccagctagaatctctaaaactggaaaataggcatctgtcggagatggtgatgaaactagagctgggactgcatgagtgtagcctgccggtgtcccctctgggcagcatcgccacccggttccttgaagaggaggagcttcgatcccatcacatccttgagagacttgatgctcatatcgaggaactcaagagggagagtgagaaaaccgtgagacaattcacggcactcaaatag

SEQ ID NO: 28135 - DNA, 1962 bp, Artificial Sequence
  Description of Artificial Sequence: Synthetic coding sequence
atgattccaccgcaggaagcctctgcccgtcgcagagaaattgaggacaaactgaagcaggaagaagagaccctgtccttcatcagagatagcttagagaagagcgatcagctcacaaagaacatggtgagcatcctttcttcttttgagtcacgtctcatgaagctggaaaactccataatacctgtacacaaacagactgaaaaccttcaaaggctccaggaaaacgtggagaagaccctctcctgcttggaccacgtgatctcatactatcacgtggcatccgacacagagaagattataagggaaggacctacggggaggctagaagagtatctcggctctatggctaagatccagaaagcggtagagtactttcaggataactctccagactctccggagcttaataaggttaagcttctcttcgagcggggtaaggaggctctagaaagtgagtttagatcactgatgactaggcatagcaaagtggtcagccccgtcctgattctcgacctgatatctggagatgatgacctggaggcccaggaggatgtcacgctcgaacacctccccgagagcgtactgcaagacgttattagaatcagcaggtggctggtcgaatatggccgaaaccaggattttatgaatgtctactaccaaattcggtcgagtcagcttgataggagtatcaagggtttgaaggaacacttccacaaatcttcgtccagttcgggggtaccgtatagcccagccattccaaacaagaggaaggatacccccacgaagaaacccgtgaagcggcctggacgggacgatatgctggatgttgaaacagatgcctacatccattgcgtatccgcgtttgtcaagcttgctcaatcagaatatcagttgctggctgatatcatacccgaacaccatcagaaaaaaacattcgattccctcatccaagatgcgctggatggtttaatgctcgaaggtgagaacatcgtgtccgccgcacgcaaggccattgtccgccacgatttctctaccgtactaactgtatttccaatactgaggcacctcaagcagacaaagcccgagttcgaccaggttctccaaggaaccgctgctagtacaaagaacaaattgcctggcctgattacttcgatggaaacgattggagctaaggccctggaggatttcgctgacaatataaagaatgacccggataaggagtacaatatgccgaaagacggcacagtccatgaacttacctcaaatgctattttgtttctgcagcagctgctggattttcaggagacagctggagccatgctggcgtcacaagagaccagctcaagtgcaaccagctacagcagtgaattctccaagcgcctcttgagcacctacatctgcaaggtgcttggtaacctgcagcttaatctcctgtccaagagtaaggtctacgaagacccggcactttccgctatttttctgcacaacaactacaactacatcctgaaatctctcgaaaaatccgagctcatccaattagtggctgttactcagaagacagcagagaggtcttaccgcgagcatatcgagcaacagatccaaacctatcagaggagttggctcaaggtgacagactatatcgccgaaaagaacctcccagtgttccagccgggagttaagctgcgggataaggagcgtcagatcatcaaggaaaggttcaaagggttcaacgacggcctggaagagctgtgtaaaatccaaaaagcatgggcgattccagatacagagcagagagatagaatccgtcaggctcagaaaaccattgtcaaggaaacctatggggcatttctgcagaaatttggctccgtccccttcactaagaacccagagaaatatataaagtacggcgtcgaacaggtcggcgatatgatcgatagactctttgacacaagcgcttag

SEQ ID NO: 28136 - DNA, 735 bp, Artificial Sequence
  Description of Artificial Sequence: Synthetic coding sequence
atggaactgacaatctttatcctccggctggctatttatatcctcacattccctctttatctgctgaattttctaggcctttggagctggatatgcaagaaatggtttccctacttcctggtgcgcttcacagttatttataacgagcagatggcgtctaaaaaacgcgagttgttctccaaccttcaagagtttgcaggccctagcggtaagttatccctgctggaagtaggctgtggtaccggagctaatttcaaattctacccccctggatgtcgtgtcacttgcatcgatccgaatccaaattttgagaagtttctgatcaaatccatcgctgaaaacaggcacctccagtttgagcgatttgtggtggccgctggcgaaaacatgcatcaagtcgccgacggcagtgtagacgtggttgtgtgcactctggtgctgtgttccgtcaagaaccaagagcgtatcttgcgggaagtgtgccgtgtgctgaggccaggcggagctttttactttatggagcacgtagctgccgaatgcagtacctggaattatttttggcagcaggttctggaccccgcttggcacctgctttttgatgggtgtaatctcacccgtgagtcctggaaggccttagagagggcttcgtttagcaaactcaaactgcaacatatccaggctcctctcagctgggagcttgtgcgccctcacatctacggctacgctgtgaagtag

SEQ ID NO: 28137 - DNA, 3522 bp, Artificial Sequence
  Description of Artificial Sequence: Synthetic coding sequence
atggccgtcgaaaccctgagcccggactgggagttcgaccgagtagacgacggtagtcaaaagatccacgcagaggttcagctcaagaactacggaaaatttttggaggaatacacctctcagctccgccgtatcgaggacgcgcttgacgatagtatcggagacgtttgggatttcaacctggaccctatcgctctgaaacttctcccctacgaacagtccagcctgttggagttgatcaagaccgagaacaaagtgcttaataaggtgataactgtgtatgccgctctatgttgtgaaataaaaaagctgaagtacgaagcagagacaaagttttacaatggactacttttttatggcgaaggtgccaccgatgccagtatggtagagggtgactgccaaatccagatgggccgattcatttcgtttctccaggaactttcatgcttcgtgacgaggtgttacgaggtggtcatgaacgtggtccatcagcttgctgctctgtacatttcgaataagatagccccaaagatcatagagacgaccggggtccatttccagacgatgtacgagcaccttggggagctgcttaccgtcctgcttactctggacgagatcattgataaccatataaccctgaaagaccactggaccatgtacaaacggctactgaaatctgtacatcacaacccatcaaagttcggtatccaggaagaaaagctaaaaccattcgagaaattcctgctgaagctggagggccaattgctggacgggatgatatttcaggcctgcatcgagcagcaattcgacagtcttaatggaggagtctcagtgagcaagaactccacctttgctgaggagttcgcccacagtattaggtctatcttcgctaacgtggaagccaaactgggcgaacccagcgagattgaccaaagagacaagtacgtggggatctgcggccttttcgtgctccactttcagatctttcggactatcgataaaaaattttataagtctcttctcgatatttgtaagaaagtgcccgcaattaccctgactgctaatatcatctggtttccagataattttctgatacaaaaaatccccgctgctgccaagctgctggatcgaaaaagcttgcaggccataaaaatccatagagatacattcctgcagcaaaaagcacagagcttgacgaaggacgttcaatcctattatgtgtttgtcagtagctggatgatgaagatggaatccatattgagcaaagaacagcgcatggataagttcgccgaggacttgaccaatcggtgtaacgtcttcatccagggattcctgtacgcttattcaatttcaactatcataaaaacaacaatgaatctctacatgagcatgcagaagcccatgacaaagacctcagtcaaggccctgtgcagactggtagagctgctaaaggctattgagcatatgttttatcggcgtagcatggtggtcgccgattctgtctcacacatcacccagcacctgcagcaccaggcattgcactctatatccgtggccaagaagcgggtcatcagtgacaaaaaatactccgaacagcgccttgatgttctgtcagctctggttctggcagagaacaccctcaacggcccttccacaaagcagagaagacttatcgtgtcattggctctttccgttgggacgcagatgaaaaccttcaaagatgaagagctgttcccactgcaggtggttatgaaaaagctggatcttatctcagaattgagggaacgtgtccagacacaatgcgattgctgttttctgtactggcatagagccgtttttcccatttacctggatgacgtgtacgagaacgcagttgatgctgctcgcctccattatatgttcagcgcactgagggattgcgtgcccgctatgatgcacgctagacacctggaaagctacgaaatcctactggactgttacgataaagagattatggagatcttaaatgaacacctgctcgataagttgtgtaaggaaattgaaaaagatctgcgtttgtctgtgcatactcacttaaagctcgatgatcggaatccttttaaggtgggcatgaaagatctcgccctgtttttctctttaaatcccataagattctttaataggttcatcgatatcagggcatacgtcacccattacctcgacaaaacattctacaaccttacgaccgtggctcttcacgattgggcaacatactcagaaatgcgaaacctagccacacagcgatatgggttggttatgaccgaagcccatctaccctcccaaacattggagcaaggactggatgtcctggagatcatgcgcaacatacacatcttcgtgtcacgatatttgtacaacctcaacaaccagatcttcatcgaaaggacaagcaataacaaacatctcaatacaatcaacattcggcacattgccaactcaatcaggacccacggcaccgggatcatgaataccacagtaaactttacctaccagtttttgaaaaaaaagttctatattttcagccaattcatgtacgacgaacatatcaagagcagattgattaaagatattaggttttttagagagatcaaagaccagaacgaccataagtacccctttgatcgtgccgaaaagtttaacagagggatccgcaagctaggcgtgacgcccgagggccagtcttacctggaccaattccgtcagcttatttcccagattggcaatgccatgggatatgtcaggatgatcagaagcggcggtctgcactgtagctccaatgccatcaggtttgtccctgatctggaggacatcgttaacttcgaagagcttgtgaaggaggaaggactggcggaggagacgctgaaagcggctcgccacctggactccgttctgtccgatcataccagaaactcagcagagggcacagagtatttcaagatgctggtagacgtatttgcaccagagttcagacgacctaagaacattcacctgaggaatttttacatcatagtacctcctttgacactcaacttcgtcgagcattcaataagttgcaaggaaaagctcaataaaaagaataagatcggtgccgctttcacagatgacgggtttgctatgggggttgcctatattctcaagctactcgatcagtaccgcgaattcgattcgctccactggttccaatctgtgagggagaagtaccttaaggagatacgggcagtggccaagcagcagaatgtacagagtgcgagccaagacgaaaagttgctgcagacaatgaatctgactcagaagcgcttggatgtgtacctccaggaatttgaactcctgtacttttcactgagtagcgctagaatattctttagagcagataagactgcagcagaagagaatcaagagaagaaggaaaaggaagaagagacaaaaacaagcaacggtgacctgagcgattctacagtaagtgctgatccagttgtgaaatag

SEQ ID NO: 28138 - DNA, 972 bp, Artificial Sequence
  Description of Artificial Sequence: Synthetic coding sequence
atgcttaggtggaccgtgcacctggagggcggacccaggcgcgtcaaccacgctgccgtggcagtggggcatagggtctattcgtttggaggatactgcagcggggaagactatgagaccctacgccagattgacgtgcatatctttaacgccgatacacacaaatggttcactcccagggtttcaggtaccgtgcccggagcacgggatggccacagcgcatgcgtgttgggaaagattatgtatatttttggtgggtatgaacaacaggccgactgcttctcaaacgacattcataaactcgacacatctacaatgacgtggaccttgatttgcactaagggaagtccagcccgttggagggatttccatagcgccacaatgctgggtagccacatgtacgtgttcggaggcagagcggatcgtttcggcccatttcactccaataatgagatctactgtaatcgaattcgtgtcttcgatacccggactgaagcctggctggattgcccaccaacccccgtcctgcctgaagggcgtaggagccactccgcatttggatacaatggagagctctatatatttggaggctacaacgctcggctgaatcgtcacttccacgatctttggaaatttaatcccgtgtcctttacatggaagaagatcgagccaaagggcaaggggccatgccctagaaggaggcaatgttgctgtatcgtcggtgataagatcgtgctcttcggtggaacttctccatcccctgaagaggggctcggcgacgaattcgacctgattgaccacagcgacttgcatatcctcgattttagtccaagcctcaaaaccctgtgcaaactggccgtgatccagtataacctggaccagagctgccttccccacgatattaggtgggagttgaacgccatgaccacaaacagcaatatatcacggccaattgtgagtagccatggctag

SEQ ID NO: 28139 - DNA, 2517 bp, Artificial Sequence
  Description of Artificial Sequence: Synthetic coding sequence
atgaccggtgcggaaattgagccttcagctcaggcgaagccagagaagaaggcgggagaagaagtgattgccggaccggaaagagagaacgatgtcccactggttgtgagacccaaagtgaggacccaagcaaccaccggggctagacccaaaacagagactaagtccgtgccagcggcaaggccaaagaccgaggcacaggcgatgtcaggtgcacgcccaaaaactgaggtgcaggtgatgggaggggctaggccaaagaccgaggcgcaggggatcaccggcgctaggccaaaaaccgatgcaagagcggtggggggtgctcgctctaagactgacgccaaagccatcccgggtgcaaggccgaaggatgaggcccaagcttgggctcagtccgaatttggcaccgaagctgtaagccaggctgagggtgtcagtcaaaccaacgctgtcgcctggccattggcaactgcggagtccgggtcagtgactaagtccaagggactcagcatggatagggaacttgtgaacgttgacgcggaaacctttcctggtactcagggccaaaagggcatccaaccttggttcgggcctggcgaggagacgaacatgggtagttggtgctactctagaccacgagcgagagaagaagcctcaaatgagtccggcttttggagtgctgatgagacaagtaccgcctcgtcattctggacaggcgaagagaccagtgtacggtcttggcctcgagaggaatctaatactagatcacggcatagggccaagcatcagacaaatcccaggtctagaccacgcagcaagcaggaggcctacgtggattcctggagcgggtccgaagatgaggcaagcaaccctttttcgttctgggtcggcgagaatactaacaacttatttcgtcccagagtgcgcgaagaggcgaacatccgatccaaactacgcaccaatcgggaggactgtttcgagagcgaatccgaggacgagttctacaaacagtcctgggtcctacccggtgaagaggccaactcacgattcaggcaccgggataaggaagaccctaatactgcactcaaactgagagcccagaaggatgtcgactcagaccgggttaaacaagagccgaggtttgaggaggaagtgattattgggagctggttctgggcagaaaaagaggcttctctggagggcggagcttccgcaatttgtgagagcgaaccaggaaccgaggaaggggctattgggggtagcgcctattgggctgaggaaaagagctctctgggagcggtggccagggaggaggccaagccggagtctgaggaagaagcaatctttggaagctggttctgggacagggacgaggcgtgcttcgatcttaatccatgccctgtttacaaggtctccgaccggtttcgcgacgccgctgaggaactcaatgcttcttcaagacctcaaacatgggatgaggtgaccgtcgagttcaaacccggactttttcacggagttggcttcagatccaccagtccattcggcattcctgaggaagcatcagagatgctggaagccaaacctaaaaatttggaactgtcccctgaaggcgaagagcaagaatcacttctacaacctgatcagcctagcccagagtttacattccagtacgatccaagctacaggagcgtaagagagatccgcgaacatctcagggcacgcgaaagcgccgaaagtgagtcttggtcttgcagctgtatccagtgtgagcttaagatcggaagcgaagagtttgaagagtttctgctgctcatggataaaatcagagacccgtttatccacgaaatctcaaaaatcgctatgggcatgaggtccgcttcccagtttaccagagatttcattcgggattccggggtggtaagcttgatcgaaacgttactgaattacccctcttcacgcgtccgcacctctttcttggaaaacatgattcacatggcccctccatatccaaatctcaacatgattgagacctttatctgccaggtgtgcgaagaaaccctggctcacagcgtcgatagtttggaacagctaaccggtattaggatgctacgccacctcacaatgaccattgattatcacacactgattgcgaattacatgtcaggattcctttctctgttgaccacagcaaatgccaggactaagttccatgtcctcaagatgttactgaatttgtcggagaatccagccgttgctaaaaagcttttctctgccaaagcattgtcaatcttcgtggggctgttcaacatcgaggagacaaacgataacatccagatcgttattaagatgtttcagaacatctcaaatataatcaaatcaggcaagatgtcactgatagatgacgacttctcgctagaaccacttattagcgccttccgggagttcgaagaacttgctaaacagctacaggcccagattgataaccagaatgaccccgaggtgggacagcagtcctag

SEQ ID NO: 28140 - DNA, 2649 bp, Artificial Sequence
  Description of Artificial Sequence: Synthetic coding sequence
atgccgggtcgggctcgcaccagggcacgcggtagggcgagacggagggagagttatcagcaggaagcacctggcggacctcgagccccaggatccgcaacaactcaagagcccccacagttgcagtccacccccaggcctctccaggaagaagtgccggtcgttagacctctgcagcctcgcgctgctagaggcggtgccggtggtggtgcgcagtcacaaggtgttaaggagcccggacctgaggccggtctgcatactgccccactgcaggagcgtcgtataggaggtgtctttcaggatctggtggtcaatacaagacaggacatgaaacacgtcaaagacagtaaaacaggctctgaaggcaccgttgtgcagctcttggccaaccattttcgtgtcattagccgtccccaatgggtagcctacaaatacaacgtcgactataagccagatatcgaggatggcaatctcaggaccatcctgttagatcagcaccgcaggaagtttggagagaggcatatttttgatggaaacagtttactgctctcccggccacttaaggagcggagagtggagtggctctctacaacaaaagataagaatatcgtcaaaatcacggtcgaatttagtaaggagctgacacccacatctcctgattgtctgagatactataacattctgttcaggaggacttttaaactgttagatttcgaacaggtgggacgcaactactacactaaaaaaaaggccatacagctgtaccgtcacgggacctctctggagatctggctcggatacgtgaccagcgtgctacagtatgaaaacagtataaccctgtgtgctgacgtgtcacataagctgctgcggatcgaaacagcctacgattttatcaagcggacttcggcccaagcacagaccggcaacatacgtgaggaggtgaccaacaaactgatcgggtcaattgttctgactaaatacaacaacaaaacctaccgggtcgatgacattgactggaagcagaacccagaggatactttcaataagtccgatgggagtaagataacttatatagactactatagacagcagcacaaggaaattgtcaccgtgaagaaacaacccttgctcgtgagccaggggcgatggaaaaagggcctgacgggaacccaacgggaacctattttgcttatccctcaactctgtcatatgactggcctgactgatgaaatctgcaaggactacagtatcgtaaaagagctcgcaaaacataccaggctctcaccaaggcggagacatcacaccctcaaagagttcatcaacacactgcaggataacaagaaagtgcgcgagctgttacagctctgggacttaaagttcgataccaactttttatccgtgcccggaagggtgcttaagaatgcaaatatagtccagggcaggcggatggtgaaagccaatagccagggagactggagccgagaaattagggagcttccgctgctgaacgcaatgccactgcattcttggcttatcctctattccaggtcatcacaccgcgaggcaatgagccttaagggacacttacagagtgtcaccgccccaatgggaattaccatgaaacccgcagagatgatcgaggttgacggcgacgccaactcctatatcgacacattgcgtaaatatacccgccctaccctgcagatgggcatgtcatgcttattggtttttaaagtgatctgtatcctaccaaacgatgataagcgccgatatgacagtatcaaaagatatttgtgcacaaaatgccctatcccctctcagtgcgtcgtgaagaagacattggaaaaagttcaagccagaactattgtcaccaagatcgcccagcagatgaattgcaagatgggtggcgctctctggaaggtggagacagacgttcaacgtacgatgtttgttggcatcgactgcttccatgatattgtgaatagacagaaatccatcgctgggttcgtggcttctacaaacgccgaacttacaaaatggtactcacagtgcgtgatccagaaaaccggagaggagctggtgaaagagctggagatatgcctgaaagcagccctggacgtgtggtgcaagaacgagtcatctatgccacattcagtgattgtatacagggatggtgtgggtgatggccagctccaggccttactggatcatgaggcaaaaaaaatgtcaacgtatttgaagaccattagtcctaataatttcacactggcatttattgtggtaaagaagagaatcaacactcggtttttcctcaagcacggaagcaactttcagaatcctccgcctgggactgtgatcgacgtggagctcacccgcaatgaatggtatgattttttcatcgtgtcacagtccgtgcaggatggtacagtcactcctacacactacaatgtcatctatgacactatcgggttgtccccagacacagtgcagcggctgacctattgcctctgccacatgtactacaacctccccggaatcattagagtgccagcaccctgccactacgcccataagttggcgtacttagtggggcagtccatccatcaagagcccaatcgctcgctctctacaagacttttttatttgtag

SEQ ID NO: 28141 - DNA, 1917 bp, Artificial Sequence
  Description of Artificial Sequence: Synthetic coding sequence
atgaaccggcaagtttgcaagaaaagcttcagcggaagaagccagggattcagcgggagatcagccgtcgtgtcaggttcctcaaggatgtcttgcgtggctaggagcggaggtgcagggggtggtgcttgtggattccggtccggggctgggagttttggctccaggtctctatataatttggggtcgaacaagagcattagtatttctgtggcagccggttctagccgggctggcggtttcggagggggtcgttcttcatgcggctttgccggtggttatgggggaggattcgggggttcctacgggggaggttttgggggaggaagaggggtgggttctggattcggcggagccggagggttcgggggagccggaggattcggaggcccaggcgtgttcggaggcccagggtccttcggtggcccaggtggcttcggccctggaggcttccctgggggaatccaggaggttattgtgaaccagagcttactgcagcctttaaatgtcgagatcgacccccaaatagggcaggtaaaggcacaagaaagagaacagatcaaaacactaaacaataagttcgcctccttcattgacaaagtgcgctttctcgaacagcaaaataaggttctggaaaccaaatgggagttgttgcagcagcagaccacaggcagcggaccatctagcctggaaccatgctttgaaagttatatttccttcctctgcaagcagcttgatagcttgctgggcgagcgcggaaatctggaaggggagctcaagtcaatgcaggatcttgtagaggactttaagaagaagtatgaggacgaaatcaataaacgaacagctgctgagaacgagttcgtgggcctaaagaaggacgtggatgctgccttcatgaacaaagtggagcttcaggctaaggtggactctcttactgatgaagtgagctttctgagaactttatacgagatggaactatcacagatgcagagtcacgcatccgacacatcagtcgtgctaagtatggacaataaccgatgcctcgacctgggatctatcattgcagaagtgcgcgcacagtacgaagagatcgcccaacggagtaaaagcgaggccgaggcactctatcagacaaaacttggcgagctacagacaacagccggacgccacggagacgacctgcgtaacacgaagtctgagatcatggagctaaatcggatgatccagcggctgcgcgctgaaatcgagaacgtaaaaaagcagaacgccaatcttcagacagccattgccgaagcagaacaacgcggagaaatggcacttaaagacgctaatgcaaaactgcaagatttacagacagcgctacaaaaagctaaagatgatttggccaggctcctaagagattatcaggagctaatgaacgtgaaactagccttggacgtggagatcgctacctatcggaaacttctcgaaggcgaggagtgcagaatgagcggcgaatgccagagcgcagtgtgtatatcagtggtttccaacgttacttctaccagtggctcatccggttcctcacggggtgtgtttggcggtgtgagtggatccggcagcgggggttacaaggggggtagtagttcctctagcagttccggatacggcgtctcaggcggttcagggtccggttatggtggagtttcctcgggcagcaccggcggacggggatcaagcggcagctaccagagttcttcttcaggctcccggctggggggtgccggatcgatctctgtgagtcactccgggatgggaagttcctctggttcgatccagacaagtgggggaagcggttataaatctgggggaggagggagcacctctatacggttcagccaaacaacttctagttctcagcattcttctaccaaatag

SEQ ID NO: 28142 - DNA, 1080 bp, Artificial Sequence
  Description of Artificial Sequence: Synthetic coding sequence
atggccgagccgtttctatcggagtaccagcaccagcctcagacatcaaattgcacaggggcagctgccgttcaggaagagctgaacccagagagacctccaggagcggaggagcgggttcctgaagaagactctcgatggcagagccgggcttttccacagctggggggaaggcccggaccagagggagaaggcagcctggaaagccagcccccacccctgcagacccaggcgtgccctgaatccagctgtctcagggaaggggagaaaggacaaaacggcgatgattcctccgctggtggagattttcctccccctgccgaggttgagccgacccccgaagcagaactgctggcacagccctgccacgatagtgaagcgagcaagctgggagcccctgccgctgggggagaggaggaatggggacaacagcagagacagctgggcaaaaagaagcaccgtaggcggcctagcaagaagaaacggcattggaagccatactacaaattgacgtgggaagaaaagaaaaagttcgatgaaaagcagtctctcagagcatctcgcatcagggccgaaatgtttgccaagggacagcctgtggctccatacaataccacacaattcctgatggacgatcatgaccaggaagagcccgacttaaaaaccggattgtactcaaaacgcgctgcagctaaatccgatgacacctccgacgatgattttatggaggaaggcggtgaagaggacgggggatccgacgggatgggcggagatggctccgagttcctacagagagatttcagcgaaacttacgaacgttaccataccgaatccttgcagaacatgagtaagcaggagctgatcaaggagtatctggaacttgaaaaatgcttaagccgtatggaggatgagaacaaccgcttgcgactggaaagcaagcggcttggcggtgacgatgcaagggtacgcgagctcgaactggagctcgatagactccgcgcagagaacctccagttgctcaccgaaaacgagctgcacaggcaacaggagcgggcacccctctccaaattcggtgactag

SEQ ID NO: 28143 - DNA, 2889 bp, Artificial Sequence
  Description of Artificial Sequence: Synthetic coding sequence
atggatgaacaggcacttctaggtttgaatccaaacgcggattctgacttcaggcagcgggctctggcttacttcgaacaactgaaaatctctccagacgcctggcaggtttgtgcagaggctctggcccagcgcacttacagcgatgaccatgtgaagtttttctgctttcaagtacttgaacaccaggtcaaatacaagtacagcgagctgacgacagtgcagcagcagttaattagggaaacattaatctcgtggttgcaggcacagatgctcaaccctcagccagaaaagacttttatcaggaacaaagcggcacaagtgttcgccctcctattcgtcacagagtatttaaccaagtggcctaagtttttttttgacatcttatctgtcgtggatttgaaccccagaggggtcgacctgtacttaagaatcctcatggctatcgacagtgagctcgtagaccgggacgtcgtgcacacatcggaagaggccagacgaaacacgttaattaaggacactatgagagaacaatgtataccgaacctggtggaatcttggtatcagattctgcagaactaccaattcactaatagcgaagtgacatgccagtgtttagaggtggtcggtgcttacgtctcttggattgatctgtccctcatcgcaaacgatcggttcattaatatgctgctgggacacatgagcattgaagtcctgcgcgaagaggcttgcgattgcttatttgaggtcgtcaataaggggatggaccccgtggacaagatgaaactggtggaaagcctatgtcaagtacttcagtcggctgggtttttctcgattgaccaggaagaagatgtggattttctcgcacggtttagcaagctggttaatggcatggggcaatcactgatcgtgagttggtcgaagctgatcaaaaacggcgatatcaaaaacgcccaagaggccctgcaagccattgagaccaaggttgcgctaatgctgcagttactcatacacgaggatgacgatatttcatcaaacatcatcggtttttgctacgactacctgcatatcctgaaacaactgactgtgctctccgaccagcagaaagcaaacgtcgaagcaattatgctagctgtgatgaaaaagctcacctatgacgaagagtacaattttgagaacgaaggagaggatgaggcaatgtttgtggaataccgcaagcagctgaagttattgctcgaccgcttagcccaggtcagtcccgaacttctgcttgcgtctgtgcggcgtgtgtttagctctacccttcagaactggcagacgacaaggttcatggaggtagaggttgccattcggttgctatatatgctggccgaagcactccccgtatctcacggtgctcatttttccggcgacgtgagtaaggcctccgccttgcaggacatgatgcggaccttagtcactagtggagtgagctcctaccagcatacgtcggttacgctcgagttttttgagactgtggtccgttacgaaaaattctttactgtcgagcctcagcatatcccatgcgttctcatggccttcctggatcatagaggccttagacactcgtctgccaaagttcgctctcgcacggcctacttgttctctcggtttgtcaaatctttaaataaacagatgaatccttttatagaagatatcctgaaccgcattcaggatttactcgaactaagccctccggagaacgggcaccagtctcttctctcgtcggatgaccaactgtttatatacgagactgcaggtgttctgatcgtgaattctgagtaccccgcagaacggaagcaggcccttatgcggaatctgctgacacctttgatggagaagttcaagatccttttagagaagctcatgctggcgcaggatgaagagcgtcaggcgtccctggccgactgtctcaatcatgcagtcggattcgcttcccggacctccaaagccttcagcaacaagcagaccgtgaagcagtgcggttgttccgaagtgtaccttgattgcctccagactttccttccagctttgagttgcccactgcagaaggacatcctgcgatccggtgtccgaacctttttgcatcgaatgataatctgcctggaagaggaagttctgcccttcattccttctgcttccgagcatatgctaaaagattgtgaagccaaggacctgcaggaattcattcctctgataaaccaaatcacggccaagtttaaaatccaggtgtcaccattcctgcaacagatgttcatgccgctgctgcatgccattttcgaggtgctattgcgaccagcagaggagaacgatcagtccgcagctcttgaaaagcagatgttgcgtcggtcatactttgcgtttttgcagacagtgacagggagtggcatgagcgaggtgatagctaaccagggcgctgaaaatgtagagcgagtcctggtgacagtgattcagggagctgtggaatatcctgacccaatagcacagaaaacttgtttcatcatactcagtaagctcgtggaactgtgggggggaaaagacggtccggttggttttgctgatttcgtatataagcacattgtccctgcgtgctttctggcccctctcaagcagacatttgatttggccgacgcacagactgtcctcgcattatcagagtgcgcggttacacttaagaccattcatctcaagagagggccagaatgcgttcagtacctccagcaggaatacctgccttctctccaagttgctcctgagataatacaggagttttgccaggctctccagcagcccgacgcgaaggtattcaagaactatctcaaggttttctttcaacgtgccaagccttag

SEQ ID NO: 28144 - DNA, 2976 bp, Artificial Sequence
  Description of Artificial Sequence: Synthetic coding sequence
atggccgaatccttcttttctgactttgggttgctgtggtatctcaaggagttaagaaaggaggagttctggaaattcaaagagctgttgaaacagcccctggaaaaatttgagctaaagccgattccttgggcggaactgaaaaaagcttccaaagaggacgttgctaaattgctggataaacactacccagggaagcaagcctgggaagtcaccctaaatctgtttctgcagattaacaggaaagacttgtggacgaaggcccaggaagaaatgcgtaacaagctcaacccatatcgtaaacatatgaaggagactttccaactgatttgggagaaagagacatgtttacacgtgccagaacacttttataaagagacgatgaaaaacgagtacaaggaactgaacgacgcctacactgctgccgctcgtaggcatacagtggttctagagggtcccgacggaatcggtaaaacaacgctcttgcgcaaggttatgctagattgggctgagggcaatctctggaaggaccgattcacattcgtgtttttccttaatgtctgtgagatgaatggcatagctgagacctccctgttggagctcctgtcacgagactggcccgaaagttccgaaaagatcgaagatatcttctcacagcccgaacgtatcctctttatcatggatggctttgagcagttgaaattcaaccttcagttgaaagctgacctgtctgatgactggcggcagaggcaaccgatgcccattatcctcagttcactgcttcagaagaagatgttgcctgaatccagcttactcatcgctctcggaaagctggcaatgcagaagcattatttcatgctccgccatcccaaactgattaagctgctcggattttcagagtccgagaaaaagtcctatttctcctacttcttcggggagaagtccaaggccctcaaggtcttcaactttgtaagagacaacgggcctctgttcattctctgtcataacccctttacttgttggctggtatgtacatgcgttaaacaacgcttagaacgcggtgaagacctggagattaacagccagaataccacctatctctacgctagcttcctgacaacggtatttaaggcaggcagccagagttttccacctaaagtcaatcgtgcaaggctgaagagcctgtgtgctctggcagccgaagggatatggacctatacattcgtcttctcacatggtgatttgaggcggaacggcctctcggagagtgaaggggtaatgtgggtgggaatgcgactcctccagaggaggggtgattgcttcgccttcatgcatctgtgcattcaagaattctgtgctgcgatgttttatctcctgaagcggcctaaggatgacccaaatccggctatcgggtcaatcacgcaactggtgagggcttccgtggtccagccccagactctattgactcaggtcgggattttcatgttcggcattagcaccgaggaaatcgtcagcatgctcgagacttctttcggttttcccctgtctaaggatctgaaacaggagattacacaatgcttagagtcgctgtctcagtgcgaagctgaccgcgaggcgatagcattccaagagctgtttatcggccttttcgagacccaggaaaaagagttcgttacgaaggtgatgaattttttcgaggaggtgttcatctacattggaaatatcgagcacctggtgatcgcctctttttgcttaaaacattgccagcatttaacaaccctccgcatgtgcgtggagaatattttccctgacgactcaggctgtatctccgactataacgaaaaacttgtttactggcgagagctgtgctccatgttcatcaccaacaaaaactttcagattcttgatatggaaaacacctcactcgatgacccatcactcgccattctgtgtaaggctctcgcccagcctgtttgtaagcttagaaaacttattttcacctccgtgtatttcgggcatgattccgagttgttcaaggctgtgttacacaaccctcaccttaagctgctgtctctctacggcacatcgctgagtcaaagtgacattcgtcatctttgtgaaactttgaaacaccctatgtgcaagatagaagagctaattctgggtaagtgcgacattagctccgaagtgtgtgaggacatcgcaagcgtactggcctgtaattccaagctgaaacatctgagtctcgtcgagaacccactccgggacgagggcatgacactgctctgtgaggctctaaagcactcacactgcgccctggagagactgatgcttatgtattgctgtctgacatccgtgtcttgtgattctatttcagaggtgttactatgctccaagtctctgtcactgcttgatctcggttctaatgccctggaggacaatggcgtcgcatccctctgcgccgctctgaagcatcccggatgcagtatccgggaactttggctgatgggctgcttcctcacatctgactcctgtaaggatatcgccgcagtgctgatctgcaacggcaagctgaaaacgctcaagctgggccacaatgagatcggagatacaggggtgaggcagctgtgtgctgctctgcaacaccctcactgtaagctagagtgtctaggtctgcaaacatgcccgattactagagcttgttgtgatgatattgcagcagccctgatcgcatgcaaaacccttcggtcactgaatctagactggatagctctggatgccgatgcagtggtggtgctgtgtgaggcactctcccatccggattgcgcattgcagatgctcgggttacataagtcagggtttgacgaagaaacacagaaaatactgatgtcagtggaggaaaagatcccgcaccttacaataagtcacggtccttggatagacgaagagtataagatccggggtgtccttctgtag

SEQ ID NO: 28145 - DNA, 534 bp, Artificial Sequence
  Description of Artificial Sequence: Synthetic coding sequence
atggctgcagtaaaagcatcaacgtcaaaagctacgaggccatggtactcacatcccgtgtatgctcgctattggcaacactatcaccaggctatggcctggatgcagtcccaccacaatgcttaccgaaaggctgtagagtcctgcttcaatctaccttggtacctaccttctgctcttttgcctcaaagctcatacgataacgaagcggcttatccccagagtttctacgatcaccacgtggcgtggcaggattacccatgtagctcctctcattttaggcgcagtggacagcacccacgctactcttctaggattcaggcttcgactaaagaagaccaggccctgtcaaaggaggaagaaatggagaccgagtccgatgcggaagtggaatgcgacttgtctaatatggagattactgaggagctgcggcagtacttcgcagagacagagcggcatcgcgaagagaggagacgccagcagcagcttgatgccgaacgcctggacagctatgtgaacgccgatcatgactag

SEQ ID NO: 28146 - DNA, 1503 bp, Artificial Sequence
  Description of Artificial Sequence: Synthetic coding sequence
atggttggcaggagctgcggggtcgccacgcaaaggcaggggggtggacagaggcctaccaatctggctcttacactgagctcttccccagcgcactctaccgccctcccctggttgcccccacgctcactgcagctactgagcgggcacagtgtaccagcacagccaacacctcacctgcctagcgcctgtggcggtcctacaagggtgactttgggagaggagcgggcatggcggtctcacggatccaatgcgggagggcacacatgcctgcccagaaggaccgcaggagcgggaagcttgacgcctggcggtgagagaggaggcaacaacgccggtcacaccgtggttgtggatggcaaggaatacgacttccacctgctgccttctggtatcattaataccaaagccgtgtccttcatcggtaatggagtcgtgattcatctgcccggactctttgaggaggcggaaaagaatgaaaaaaaaggcttgaaagattgggagaaacggttgatcatctccgatcgggcacatctggtgtttgattttcaccaggcagtggatggactccaggaagtgcagagacaggcacaagaaggaaagaacattggcactaccaagaaaggtatagggccaacgtatagcagcaaggccgctcgaacaggcttgagaatttgtgacctgttgagcgatttcgatgagtttagctctcgattcaagaacctggcccaccagcaccagtctatgttcccaaccctggagatcgatattgagggtcagctgaagagactaaaagggttcgcagagaggatccggccaatggtgagggacggcgtgtattttatgtatgaagccctgcacggccctccaaagaaaatccttgtggagggagcgaacgcagctctgctggatattgacttcggaacataccctttcgtgacctccagtaactgcaccgtagggggagtatgtaccgggctaggcattccaccccaaaatattggtgatgtttacggtgttgtcaaggcatacacgacaagggttggcataggagcatttccaacggagcaaataaatgagattggagggctgctgcagaccagggggcacgagtggggggtgactaccggtagaaagagaaggtgtggttggctggacttgatgattctcaggtacgcgcacatggtcaacggcttcacggccctcgcgctgacgaagctggacattctcgatgtactaggcgaagtgaaggtgggcgtgagttacaagttaaatggaaaacggataccatactttccagcgaaccaggagatgcttcagaaagtagaagtggaatacgagactctccccggttggaaagcggacacaactggggctaggcgctgggaagatctgccgcctcaggcccagaattacatcagattcgtagagaaccacgtcggagtagccgtaaaatgggttggcgtggggaagtcccgcgaatcaatgatccagttgttttag

SEQ ID NO: 28147 - DNA, 468 bp, Artificial Sequence
  Description of Artificial Sequence: Synthetic coding sequence
atggtcaacagctgctgtggatccgtgtgcagtgatcagggctgtggccaggacctatgtcaagaaacatgttgctgtccttcatgctgtcagaccacctgctgcagaacaacttgttaccgcccatcttattcagtgagctgctgttgtcggccacagtgctgtcagtccgtatgttgtcagccgacgtgctgtcgacccagttgctgcgtgccaacctgttgccacccttcgtgttgcatttcaagctgttgccgacccagctgctgtgtgtctagctgttgtaaacctcagtgctgccagtctgtgtgctgccaacccaattgctgccggcctagttgctgtcgcccttgctgttgtcttcgccctgtatgcggccgagtctcatgtcatactacgtgttacaggccagcctgtgtaatttccacctgtcctagacccgtgtgttgtgctagctcctgttgctag

SEQ ID NO: 28148 - DNA, 2124 bp, Artificial Sequence
  Description of Artificial Sequence: Synthetic coding sequence
atggccgctgaggcgttagccgcagaggctgtcgcgtcacgattggagcgccaggaagaggatatcagatggctgtggagtgaggtcgagaggctgcgagacgaacagctaaacgccccttacagctgccaagcagaagggccttgtttgacccgtgaagttgcccaactgagggcagaaaactgtgaccttaggcacaggctctgctcgttacggctctgtctcgcggaggaacgctctcggcaggccacactggaaagcgccgaactagaggcagcacaagaagcaggagcccagccccctccctcccagtctcaggataaagacatgaagaagaagaaaatgaaggagagcgaagctgattcggaagtgaagcatcagcctattttcatcaaggagcgcctgaagttgttcgagattctaaaaaaggaccaccagctgctcctcgctatctacggcaaaaagggagacacctcgaatatcattacagtaagggttgcagacggccaaaccgtgcaaggcgaagtatggaaaacaaccccctatcaagtggctgctgagatttctcaagagttagccgagagcactgtgatcgctaaggtaaacggagagctctgggatctagatcgacccctggagggggattccagcctggagcttctgaccttcgataacgagaaggttaacacggccaccacaacagtgtataggtgcgggcctctgatagatctctgcaagggaccacatgtccggcacactggcaaaatcaagactattaagatattcaagaatagctctacgtattgggaggggaatcctgaaatggaaactctgcaaaggatctatgggatttcatttccggacaacaagatgatgagagactgggaaaagttccaggaggaagctaagaatcgggatcaccgtaaaatcgggaaagagcaggaactgtttttttttcacgatctgtccccagggtcatgtttctttttacctcggggtgcatttatatacaatacacttacagattttatccgagaggagtaccataagcgcgactttacagaggttctgtcccccaatatgtataattctaagctgtgggaggctagcggccactggcagcactattccgagaatatgtttacgttcgagatcgaaaaagacacttttgctctcaagcctatgaattgtcccggacattgccttatgtttgcacataggcctcgcagctggagagagatgccaattcgcttcgccgactttggggtgctccaccgcaacgaactatccggaaccctgtccggattaacccgagtccgcagattccagcaggatgacgcgcacatattttgtacagtcgaacagattgaagaggagataaagggctgtctccagtttctgcagtcagtttactcaacattcggctttagctttcagctcaatcttagtacacggccagagaacttcctgggagaaatcgaaatgtggaatgaggcggaaaagcagttacagaattccctcatggattttggcgaaccctggaagatgaatccgggtgacggggctttttacggtcctaaaatagacatcaagattaaagatgccatcggaaggtaccatcagtgtgcgaccattcagctggattttcaactgcctatcaggttcaaccttacctacgtatccaaagatggcgatgataagaaacggccagtgatcattcaccgggctattttgggatccgttgagagaatgattgcaatcctgtcggagaattacggcggaaagtggccattctggctcagtcctcggcaggttatggttattcccgttgggccaacatgcgagaagtacgcactccaggtgagttccgaattctttgaggagggctttatggccgacgttgatctagaccacagctgcaccctgaacaaaaaaatcagaaacgcacaactggcacaatacaacttcatcttagtggttggggagaaggagaagatagataacgcggttaacgtcagaacccgagataacaagatacacggcgagatccttgtgacaagtgcgatcgacaaactgaagaatttgcgcaaaaccagaaccttgaatgctgaagaggccttttag

SEQ ID NO: 28149 - DNA, 816 bp, Artificial Sequence
  Description of Artificial Sequence: Synthetic coding sequence
atggctggtctggaagtgctgtttgcctcagcggcacccgctataacatgccgccaagatgctctcgtctgttttctgcactgggaagtggtaactcatggctacttcggcctcggggtgggtgaccagcccggtcccaacgacaaaaaaagcgagttgctccctgccggatggaataataataaagacctctacgtgctgcgatacgagtataaagacggttcccgaaaactgctggtcaaggcgataaccgttgagtcatcgatgatcctgaacgtgctggaatatggaagtcagcaggtagccgatctgaccctcaacctggatgactatatcgatgcagagcatctgggtgatttccacagaacctacaagaacagcgaggaactgcgaagccgaatcgtatccgggataatcacgccaatccacgaacagtgggagaaggccaacgtgtcaagcccccatcgagaattcccaccagctaccgcacgcgaggtggacccgctgagaattccccctcatcacccccacacgagccgccagcctccttggtgtgatccactgggacccttcgtagttggcggagaagatctggacccctttgggccaaggcgaggtggtatgatagtggaccctctgcggagcggtttccctagagcgctgatcgatccttcctctggccttcccaatcggctgccacctggcgcagtaccaccaggggctagattcgatccattcggccctattggcaccagtcccccaggtcctaaccctgaccacttacccccacccggatatgacgacatgtatctatag

SEQ ID NO: 28150 - DNA, 474 bp, Artificial Sequence
  Description of Artificial Sequence: Synthetic coding sequence
atggcaaccccgcctaaacggagggctgtcgaggcaacgggggaaaaggtactgaggtacgaaacctttatatcagacgtacttcagagggatcttcgcaaggtgctggaccatcgagacaaggtgtacgagcagctcgccaaatacctacagctgaggaatgtgatagagaggctccaggaagctaaacattctgaactgtatatgcaggttgatctgggttgcaacttttttgttgataccgtcgtcccggacaccagccgcatttacgtggccctgggatacggcttttttctcgagctcacccttgccgaagcccttaagtttattgatcggaagtcctcactgctgaccgagctgtctaactcacttactaaagattcaatgaatattaaggcccatattcacatgctgctggaaggtctaagagaacttcagggtctccagaatttccctgaaaaacctcatcactag

SEQ ID NO: 28151 - DNA, 543 bp, Artificial Sequence
  Description of Artificial Sequence: Synthetic coding sequence
atgcaggctgaaggtagaggaacggggggttcaacaggcgatgccgatggcccaggcggtccaggcatacctgatggacctggaggcaatgccggtgggcctggcgaggctggcgcaaccggcggacgtggacccaggggagcaggtgccgctagggctagcggccctggtggcggtgccccaagaggacctcatggcggtgcggcaagtgggcttaacggctgctgccgatgcggtgctagggggcctgagagccggctgcttgaattttacctggccatgccttttgccacccctatggaagccgagctagcgcgtcgctcactggcccaggatgctcccccattacccgttcccggagtactgctaaaagagttcacagttagcgggaacatcctgaccattcggctgactgccgctgaccacagacagttacaactttcaatctctagttgcttgcagcagctgagtttactgatgtggattacccagtgtttccttcccgtttttctggcccagcccccttccggtcagcgccgatag

SEQ ID NO: 28152 - DNA, 621 bp, Artificial Sequence
  Description of Artificial Sequence: Synthetic coding sequence
atgaccgccagcgtgctccgaagcatctccctggctctgaggcccacctcaggtcttttaggcacctggcagactcagttacgcgagacccatcagcgcgcttccttgctgtcattctgggagttgattcctatgcggtctgagccactaagaaaaaaaaaaaaagtggatccaaagaaggatcaagaagcgaaagaacgtctgaaacggaagattcggaagctggaaaaggccacccaggaactgattcctatcgaagacttcataactcccctcaagtttctcgataaagcgcgagaacgccctcaagtggagctcaccttcgaagagacggagcggcgagcactattgttaaaaaaatggtcactctacaaacagcaggagcgcaagatggaacgggacacaattcgagcaatgctggaagctcagcaggaagctcttgaggaactgcagctcgagtctcctaaattgcacgccgaggccattaaacgcgatcctaaccttttcccattcgagaaagaaggtccccactatacaccccctatccccaactaccagcctcccgaaggtcgctataacgatattacaaaggtctacacccaggtggaattcaagcgatag

SEQ ID NO: 28153 - DNA, 6962 bp, Artificial Sequence
  Description of Artificial Sequence: Synthetic coding sequence
atggcggagccaagttcagcgagacggccagtgcctctgatcgaatccgaattgtactttctcatcgcccgatatctgagtgcaggcccttgccggagagccgcacaggtgctagtccaggagctcgagcagtaccagcttttgccaaaacgtctggactgggaaggcaacgaacataacagaagttacgaggaactggtcctctctaacaaacacgttgctcctgaccacttgttgcagatctgtcagcggattggccctatgcttgacaaggagatacccccatcgatttctcgcgttaccagcctccttggcgcaggtagacagagtctactgagaaccgccaaggattgccggcataccgtgtggaaggggtccgccttcgccgcactgcaccggggacgccctcctgagatgcccgttaactatggatctccacctaatcttgtcgaaattcatagggggaagcagctcacagggtgctcaaccttttccaccgcgttccctggcaccatgtatcaacacattaagatgcaccggaggatcctgggccacctgagcgcggtgtattgcgtggcctttgaccgcactggccaccggatcttcaccggatctgacgactgtctcgttaagatatggtctacccacaacgggcgtctgctttctactctgcgcggacattctgccgaaatatcggatatggccgtaaactatgaaaataccatgatcgccgctggaagttgtgataagatcattagggtgtggtgtttaaggacatgcgcccctgtcgcagtgctccaggggcacaccggttcaatcaccagcctgcaattttcgcccatggcaaaggggtcccagcggtacatggttagcacaggggctgacgggactgtctgtttttggcagtgggatctggaaagcctgaagttttctccgcgtcctctgaagttcaccgaaaagcctcgacccggagtgcagatgctgtgttcttctttctccgtcggcggaatgttcctcgccactggcagcaccgatcatgttattaggatgtacttcctcgggtttgaagcccctgagaaaattgccgagttggaatcccacactgataaggttgattcaatccagttctgtaataatggagatagattcctatccggatcacgcgacggaactgccagaatatggagattcgagcagctggagtggcgcagtatattgctggatatggccacaagaatatctggcgatctgtctagcgaggaagagcgctttatgaagcctaaagtgacaatgatcgcctggaatcagaatgattccattgtcgttacggctgttaacgatcatgtcctgaaggtgtggaactcatacacgggtcaactgctgcacaacttaatgggtcacgccgatgaggtgttcgtactggagactcatcctttcgattcccgcatcatgctttccgccggacatgatggcagcatctttatctgggatatcacgaaaggtactaagatgaagcattacttcaacatgattgaggggcagggccatggcgcagtgttcgactgcaagttctcacaggacgggcaacattttgcatgtactgactctcacggccatctgctcattttcggattcggttgcagcaaaccgtatgagaaaatccctgaccaaatgttctttcataccgattacagacctttgatacgggattccaataattatgtcctggacgaacagacccagcaagcaccacaccttatgccgccacctttcctcgtggatgtggacgggaacccccaccctaccaagtatcagcggctggtgcctggcagagagaacagtgcagatgaacaccttattcctcaattggggtacgttgcaacctcagatggggaagtgattgagcagattataagtcttcagacgaacgacaacgatgagagaagccccgagtcctcaattctcgacggtatgatccggcagcttcagcaacagcaggatcagcgcatgggtgccgaccaggatacaattccacggggtttaagcaacggggaggaaactcccagacggggattccggaggctgtctttggacatccagagtccccctaacattggactgaggaggtccggacaggttgagggcgtgcgccaaatgcatcagaatgccccacgaagccaaatcgcaaccgaacgcgatctgcaagcctggaagagacgggtggtggtgcccgaagttcccctgggaatatttaggaagctcgaggactttcgcctggagaaaggtgaagaagagaggaacctgtacatcatagggcgtaagcgaaagaccctccaactgagccataagtccgattctgtcgtcttggttagccagtcaaggcagagaacttgtcgtaggaagtaccccaactatggcagaaggaaccgtagctggcgcgagttaagcagcggcaatgagagctcctcaagcgtgaggcacgaaacctcttgcgatcaatccgagggctcaggttcgtcagaagaggacgagtggcgctctgacaggaaatcggaaagttattccgagagcagcagcgacagctcttctagatatagcgactggacagccgatgctggcatcaatcttcaaccaccattgcgtacatcttgccgcagaaggatcaccaggttttgttcatcctccgaagacgagatttcgacagaaaacctgtctccacccaagcggagaaggaagagaaaaaaggaaaacaagcccaagaaggagaacctgcgccgaatgacaccagccgaactggccaacatggagcatctgtatgaatttcatccacccgtctggattaccgatacaactctccggaagagccctttcgtgccacagatgggagacgaggtgatttactttaggcaagggcacgaagcttacatagaagccgtgagacgaaataacatctatgaactcaatcccaacaaagagccatggcggaaaatggatctcagggaccaagaactggtgaagattgttggaatccgatacgaagtgggacccccaacactctgctgtcttaaattggcctttatcgatcccgctaccgggaaactcatggacaaatcatttagcattcgctaccacgatatgccagatgtgatcgatttcttggttctccgccagttctacgatgaagcgagacagagaaactggcagtcttgtgataggtttaggtcaattattgacgatgcatggtggtttggaaccgttctgtcacaggagccctaccagccacagtaccctgactctcacttccagtgttacatagttaggtgggataatacagaaattgagaagctgagcccttgggacatggaacctataccagataacgtcgacccaccagaagaacttggggcttcaatctcggtgaccaccgatgagttggagaagctgctgtataagccgcaagccggagagtggggacagaaaagccgggacgaggaatgtgatcggatcatctctggaattgaccagttgctcaatctggatattgcagccgctttcgctggtcccgtggacctgtgtacatatcctaaatattgcacggtagttgcttatccaacagacctctacactattagaatgcggctagtaaaccggttctaccgcaggctctcagccctggtgtgggaggtgaggtatatcgagcacaacgctagaaccttcaatgagcccgaatcagttatcgccaggtctgcaaagaaaataacagaccaacttctgaaatttattaagaatcagcattgcactaacattagcgagctctctaatactagcgagaacgacgagcagaacgccgaggaccttgacgactctgatctccctaagacatcctcaggcagacgaagagtccacgacggaaagaagtcgattcgtgcaacaaattacgtcgaatccaactggaagaagcagtgtaaagaactggttaacctgatcttccagtgcgaggattctgagccttttaggcagcccgtggacttggtcgagtatccggattatcgagatatcatcgatacaccgatggattttggaaccgtccgggaaaccctggacgccggaaattatgactctccactggagttctgcaaagacattagactgattttttcaaacgcgaaggcttatactcccaacaagcgatccaagatttacagcatgactctccgcctatctgccctgtttgaagaaaaaatgaaaaagatatctagcgatttcaagattggtcagaagtttaacgaaaagttgcggaggtctcaaagattcaagcagcggcagaactgtaaaggcgactcacagcctaacaagtcaatcaggaacctgaagcctaaaagactgaagtcacagacaaagataatccctgagttagtcggcagcccaacccagagtacaagctcccgtaccgcctatctcggtacacacaaaacctccgccggaatcagcagtggagttactagtggagattcctcagattcagccgagagctcagagaggagaaagagaaataggcctatcacaaacggttcaacattgtctgaatctgaggttgaagattctttggcaactagcctgagctcatcagcctcttcttcctccgaggagagcaaagaaagttctagggctcgcgaatcctcatccaggtctggactgtcaagatcttccaacctaagagtgacccgaaccagagccgctcagcggaagacaggacccgtttcactcgctaacggatgcggtcgaaaggcaacacggaaaagagtgtacttgtccgactccgacaataattctttggagacgggtgagatcctgaaggccagggccggtaataatcgcaaggtgctcagaaagtgcgccgctgtcgccgctaacaagattaaactcatgtcagacgttgaggagaattcctcctctgagtctgtttgcagtggcagaaaactgccccataggaatgcatctgctgtggcacgtaaaaagctcttacacaactccgaggatgagcaaagcctcaagtctgagattgaggaagaggagttaaaggacgagaaccagcttctgcctgtgtcatcctcgcataccgcgcagtctaatgtggatgaatctgagaaccgagattccgagagcgagtccgacttgagggtagctaggaaaaattggcatgctaacggttacaagtctcatacccctgccccttctaagactaagtttctaaagattgagtcctccgaagaagatagcaagagtcacgactcagatcacgcctgcaacaggactgccggaccctcgacctctgtccagaaactaaaagccgagtctattagtgaggaggctgacagcgagcccggacggagcgggggtcgcaaatataacacgtttcacaagaacgcctccttcttcaaaaagaccaaaattctgtcggactcagaagacagcgagtcagaagaacaggatagagaagacgggaagtgccataagatggaaatgaaccccattagtgggaatttaaattgcgatcctattgccatgagtcagtgcagttccgatcatgggtgcgaaacagatctggactctgacgatgataagatcgagaagccaaacaattttatgaaggattccgcgtctcaagacaatgggctgtctcgtaagatttcaaggaaacgagtatgctccagcgactctgactcctctcttcaggtggtgaagaaaagcagcaaagctcgcactggcttactcagaatcacacgcagatgtgccgcaactgcagccaacaagattaagctgatgagtgacgtggaagacgtttcactggagaatgtgcacaccagatccaaaaatgggagaaagaagccattacacttggcctgcaccactgctaagaaaaaattgagtgattgcgagggcagcgttcactgcgaggtgcccagtgagcaatatgcctgcgaggggaaaccgccagaccccgattctgaaggctcaaccaaggtactcagtcaggcccttaacggcgacagcgattcagaggatatgcttaactcagaacataagcatagacacacaaacatccacaagatcgatgcacccagcaagagaaaatctagctccgttacaagttccggggaggacagcaagagtcatatccccggatcagaaacagatcgcacattcagttcagaaagcacgctggcacaaaaggctaccgctgaaaacaacttcgaggtcgaactaaactacggacttcgcaggtggaacgggagaagactgcggacctacgggaaggcccctttctctaaaacaaaggttatccatgactcccaggagacggctgaaaaggaggtaaagcgaaaacggtcccatccggagctggaaaacgtgaagatttccgagactacaggaaacagcaagtttcgcccagatacgagcagcaaatcctctgacttggggagtgttacggaaagtgatattgactgtacggataacactaagaccaaacggaggaaaacgaagggcaaagctaaggtggtgagaaaggagtttgtacctcgcgaccgcgaaccaaacactaaagtgaggacatgtatgcataaccagaaagacgcagtgcagatgccctctgaaaccctgaaagcaaaaatggttcccgaaaaagtgcccagacggtgtgccaccgtcgccgctaataagatcaagataatgagtaatttgaaggagaccatcagcggccctgaaaatgtgtggattagaaaaagcagcaggaagctcccacaccgcaatgcttctgccgcagccaagaagaaactccttaacgtgtataaagaggacgataccacaatcaacagcgaatcagagaaggagctcgaggacattaaccgcaagatgctctttctgagaggatttcgtagctggaaagagaatgctcagta

SEQ ID NO: 28154 - DNA, 2961 bp, Artificial Sequence
  Description of Artificial Sequence: Synthetic coding sequence
atggccgagagtttcttttcggattttggccttctgtggtatctgaaagagttacggaaggaggagttctggaaattcaaggagctgctgaaacagcctttggaaaaattcgagttgaaacctatcccctgggcagagttgaagaaagccagtaaggaggatgtcgctaagctgttggataagcattacccgggtaagcaggcttgggaagtgaccctcaacctcttcctccagattaacagaaaggacctgtggacaaaagcacaagaggaaatgaggaataaattaaatccataccgcaaacacatgaaagagacgttccagcttatttgggaaaaggaaacctgcctccatgtgcccgagcatttttacaaagagaccatgaaaaacgaatataaagagctcaacgacgcatacactgcagccgctcggaggcataccgtggtgctggaggggccagatggcatcgggaaaactacccttcttagaaaagtgatgctggactgggctgaagggaatctttggaaggatagattcacttttgtgtttttccttaatgtctgcgagatgaacggaatagcagaaacaagcctgttggagcttctgagtcgagactggccagagagttctgaaaaaatcgaggatattttctcgcagccagaacgaatcttgttcattatggacggattcgaacagctgaagttcaacctgcagctgaaggctgatctgagcgacgattggcgacagcgccaacctatgcctatcatcctgagcagccttctacagaagaagatgttgccagagtcctccctgctgatagccctgggaaaactggccatgcagaagcattacttcatgttacggcaccccaagttgatcaagctgctgggattttcggaatctgaaaagaagagctatttctcttatttcttcggggagaaatctaaagcattaaaagtctttaacttcgttagggataacggccctctgtttatcctctgtcataaccctttcacatgttggctagtgtgtacttgcgttaagcagcgactagaaaggggggaagaccttgagattaacagccagaatactacctatttgtatgcgagcttcttaacgaccgtgtttaaggccggaagtcagtcgttcccacctaaagttaaccgggcacggcttaagagtctctgcgccctggctgcagaggggatttggacttatacctttgtgtttagccacggcgatcttaggcggaatggtctttccgaaagcgaaggcgtcatgtgggtgggcatgcgacttcttcagcgaaggggagactgctttgcctttatgcacctgtgcattcaggaattttgcgcggctatgttttacctgctcaagaggcccaaggacgaccccaatcccgcaatcggctctatcacccagttggtgcgcgctagcgttgtacagccacagactctgctgactcaggtagggatttttatgtttggcatatcaacggaagagatcgtgtccatgctcgagacaagttttggattccccttgtctaaagacctcaagcaagagattactcaatgcctggaaagtttgagccagtgcgaagctgaccgagaggcaattgcgttccaggaactgttcatcgggctgtttgagacccaagaaaaggagttcgttaccaaagtaatgaacttcttcgaagaggtgttcatctacatcggcaacatcgagcacctcgtgatcgcaagcttctgtcttaaacactgccagcacctcaccacgttgagaatgtgcgtggagaacatcttcccagacgatagcggttgcatctcggattacaatgagaaacttgtctactggcgggagttgtgttctatgtttatcacgaacaagaatttccaaatattggacatggagaacacctctcttgatgacccctctctggccatcctgtgcaaagctctggcacaacctgtatgcaagctgcgaaagctgatatttacctcagtttactttgggcatgactctgaactcttcaaagcggtactacacaatcctcacctgaagctgctgtctctgtatggcacgagcctatctcagtctgatatcaggcacctctgcgaaacgctcaaacacccaatgtgcaagattgaagagctgatactgggtaagtgcgacatctcttccgaagtttgtgaggatatcgcaagcgtgctggcatgcaattccaaactgaaacacctttcactggtggaaaaccccctgagggacgaaggaatgacactcctgtgcgaggcccttaaacattcccactgtgctcttgagagattgatgctaatgtattgctgcctgacttctgtgtcgtgcgacagcatctcagaagtactgctctgctcaaaatcactgagtcttttggatctgggatccaatgctttagaagataacggtgttgcgtcgctgtgtgctgccctgaagcatccaggatgcagtataagggagctctggttgatgggatgcttcctgactagcgattcatgcaaggacattgccgctgtgctgatttgtaacggaaagctgaagacccttaaactgggacacaacgaaataggtgacacaggagtgcggcagttgtgcgctgcattgcagcaccctcattgcaagttagaatgcctcggcctccagacttgccccatcacaagggcctgctgtgacgacatcgccgcagccctgattgcctgtaaaacgctcagaagcttgaacctagactggattgctctggacgccgacgcagttgtagttctgtgtgaagctctgtctcaccctgactgtgcccttcaaatgctgggaaactgtcaaaagtcactgggggataccgttgcccctggggaaaaccattgcagcatcaagcacctcctacttaccctgcctatcaacatgcagagacagctgaggctacagaagtag

SEQ ID NO: 28155 - DNA, 3039 bp, Artificial Sequence
  Description of Artificial Sequence: Synthetic coding sequence
atggacgcattagatgctagcaagctactggacgaggaactctacagccgtcagctctacgtgctcgggtccccagccatgcaaagaattcagggtgctagggtgttagtctccggattgcagggacttggcgctgaagtcgcaaagaacctggttcttatgggggtaggttctttgaccctgcacgatccacacccgacatgttggagcgacctggccgcacagtttctactgtcagaacaggatctcgaacggtcacgcgcagaggcttctcaagagctcctcgctcagctgaaccgggcagtccaggttgttgtgcataccggagatatcacagaagacctgcttctcgatttccaggtcgttgttttgacagctgcaaagctggaagaacagttgaaagtcggcaccctgtgccataaacacggcgtgtgtttcctggccgctgacactagggggttggttggtcagctattttgtgactttggcgaggacttcaccgtgcaggatcccactgaagcagagcctctgaccgctgctattcagcatatttctcagggatctcccggaattctgacgcttagaaagggagcaaacacccattactttagagatggcgatctagtgacattttccggcatagaaggcatggtggagctcaacgattgtgatccaaggtcaatccatgtgagggaggacggtagcctggaaattggagacactacaacattttcacgataccttcgcggaggggcaatcaccgaagtgaaaaggcccaaaacagtacgccacaagagcctcgacacagccctcctgcaacctcacgtggtggcccagtcctctcaggaggtccatcacgcacactgtcttcatcaagcattttgtgcattgcacaagttccagcatcttcatgggcgtcctccgcagccttgggatcccgttgacgcagagacagtcgttgggcttgccagagacctcgaacctctgaaacgcaccgaagaagaaccacttgaggagccgttggacgaggctttagttagaacggtcgcactgtcctcagccggagtgttgagcccgatggtggccatgctcggggcagtggcagctcaagaggttctaaaggccatctcccgtaagttcatgccgctggatcagtggctttattttgatgctttggactgcctgcctgaggacggggagctgcttccatctccggaagactgtgcactccgtggtagccggtacgacggacagattgccgttttcggcgctggctttcaggagaaactaaggagacaacattacttactagtgggcgctggcgcaatcggctgtgagctgctcaaggtttttgccttagtcggtctcggtgctggcaactctgggggtcttaccgtcgtggatatggatcacatcgaacggagcaatttatcccgccagtttttatttaggtctcaggatgtgggaaggcctaaagccgaagtggccgctgccgcagcgagaggcctaaatcctgatcttcaggtaatcccacttacttaccccctagatccaacgactgagcatatatacggggataacttttttagtagggtcgatggggtcgccgctgccctagactcgttccaagctcgcaggtatgtggcagctcgatgtactcattacctgaaacccttgctcgaagcaggcacctcgggaacatggggttctgccacagtgttcatgcctcacgtgacagaagcttacagagccccagctagcgccgcagcctcagaggatgccccatatccggtctgcactgtgcggtatttcccaagtacagcagagcatacacttcagtgggctaggcatgagttcgaagagctcttccggctctcagccgaaactattaatcatcatcagcaggcacacacatcgcttgcggatatggatgaacctcagaccctgacattactgaaaccagtgttgggcgttcttcgcgtgagaccccagaactggcaggattgtgtcgcctgggctcttgggcattggaaactgtgttttcattacggcataaagcagctgttaaggcatttccccccaaataaagttctggaggacgggactcccttttggagcggacctaagcaatgcccgcagcctctggaattcgataccaatcaggacacacatttactgtacgtccttgccgctgccaatctttatgctcagatgcatggccttcccggatcccaggattggaccgccctgagagaactgctgaaactgttgcctcaacctgacccacaacagatggctcccatctttgcatccaatctagaattggcttctgcgtccgcagaatttgggcctgagcagcagaaggaactgaacaaggcactcgaagtgtggagcgtcgggcctccactgaagcctttgatgttcgaaaaagacgacgacagcaatttccatgtagatttcgttgtggctgcagcatcactgcggtgtcagaactatggcatccctcctgttaaccgcgctcagagtaagaggatagtgggccagatcattcccgcaatcgcgaccactacggccgcagtggcaggcctgctcggccttgaactctataaggtcgttagtgggcctcgtccaaggagcgccttccgccattcctacctgcacctggcagagaactacctgatcagatatatgccttttgcacccgctatccaaacatttcaccatttgaagtggacttcatgggatcggctcaaggtgccagcaggccagccggaaagaactctcgagagcctcctggcacacttacaggaacagcacggattacgggtgcgaattcttctccatgggagcgccctactgtacgccgcaggctggtctccggagaagcaggcccagcatctgcccctgcgtgtcacggaactggtccagcagctgacgggtcaggccccagcccctggccaacgtgtattggtgttggagctgagctgtgagggagacgatgaggatactgcattccctccactacactatgagctgtag

SEQ ID NO: 28156 - DNA, 360 bp, Artificial Sequence
  Description of Artificial Sequence: Synthetic coding sequence
atggttaggacaaaaacctggactttgaaaaagcatttcgtaggatatccaacaaattccgactttgagctaaagaccgccgaacttcccccacttaagaacggcgaagtgctcctagaggctctctttctgacagttgacccttacatgagggtggtggagagtaagaatgtcgctctgcccaaaggtaccatcgtactggccagtccgggatggacgacgcactccatctccgacggcaaggacctcgagaagctactgactgaatggcctgatacaattccgttgtccttagccctcggaaccgtgggaatgcctgggctgactgcctattttgggcttctcgagatctgcggatag

SEQ ID NO: 28157 - DNA, 1797 bp, Artificial Sequence
  Description of Artificial Sequence: Synthetic coding sequence
atgggcggttgctttagcaagccaaaacccgttgagctgaagattgaggtcgttctacccgagaaagagcgcggaaaggaagagctctcagctagtggcaaggggagccccagagcgtatcagggcaatggaacagcaaggcatttccacacagaggagagattgtctaccccgcacccttaccccagtccccaggactgtgtcgaggcggctgtttgtcatgtaaaggaccttgaaaacggacagatgcgtgaagtggaattgggttgggggaaggtgttacttgttaaagataatggtgaatttcacgccctggggcacaaatgtcctcattatggggctccactggttaagggagtactgagtcgtgggcgtgtgcggtgcccttggcacggagcttgcttcaacattagcaccggagacctggaggatttccctggcctcgactctctgcataaatttcaagtgaagatagaaaaagagaaggtgtatgtgagagctagtaagcaggcccttcaactacagcgccgtaccaaagttatggcaaaatgtattagcccctcagcaggctactcttcctctaccaacgttcttattgtaggtgcgggagccgcagggctcgtgtgtgccgagacactcaggcaagagggatttagtgatcgaatcgtgctgtgcaccctggatagacatctgccttacgatcggcctaaactctctaaaagccttgatacacaacctgagcagctcgccttgcgtccgaaagagtttttccgggcttatgggatagaggtgctcactgaggcccaggtggtaaccgttgacgtgaggactaaaaaggtagtgtttaaagacggatttaagttggagtactcaaagcttctcctagctcccggttcatcaccaaaaacgctttcttgtaagggcaaagaggtggaaaatgtgtttacgatccggacacccgaagatgcaaatcgggtggtgcgactggccagaggtaggaatgtggtggtcgttggggctggttttctcggtatggaggtagccgcttacttgaccgagaaagcccattccgtgagcgtggtggaactggaggaaaccccctttagacgattcctgggagagagagtgggcagagctcttatgaaaatgtttgagaacaaccgtgtgaaattctatatgcagacagaggtttcagagctgcgcggacaagaaggcaaattaaaggaggtcgtcctcaagtcctccaaggtggttagggcggacgtgtgcgtggtgggaataggagcagtccctgcaaccggctttctgcggcagagtggcatcggcctggacagtagggggttcatacctgtgaataagatgatgcaaactaatgtgcccggtgtgtttgctgccggtgatgctgtgaccttccctctcgcttggaggaacaataggaaggtgaatatcccccattggcagatggctcacgctcagggcagagtcgcggcacagaacatgctcgcgcaggaggcagaaatgtctaccgtcccatacctgtggactgccatgttcgggaagtccctccgatacgccggttatggagagggatttgacgatgttatcattcagggcgatctggaagagctaaagtttgtggcattctataccaagggcgacgaagtaatcgcagtggcctccatgaattatgatccaatcgtatccaaggtcgctgaggtgctcgcgtccggacgcgctatacgcaaacgggaggtggaaacgggtgacatgagctggttaactggaaaaggtagctag

SEQ ID NO: 28158 - DNA, 1854 bp, Artificial Sequence
  Description of Artificial Sequence: Synthetic coding sequence
atgggctcatacctgtccgtgcctgcctatttcacgtctcgagacctctttcgatgctccgaatgtcaagactcgttgacaaattggtactacgagaaggatggcaagctgtactgcccaaaagattattggggcaaattcggcgagttttgtcacgggtgtagtttgcttatgacaggcccatttatggtcgccggtgagttcaagtatcatccggaatgtttcgcctgcatgtcttgtaaggtcatcatcgaagacggcgatgcctacgctttagtacagcacgccaccctttactgtgggaaatgccataatgaggtagttctggcaccaatgtttgagaggctgtctaccgagtccgtgcaagaacaactaccttattctgtcacactgatatcgatgcccgctacaaccgagggaagacggggtttctccgtctcggtagaaagcgcctgctccaactacgccacaaccgttcaggtgaaagaagtgaaccgaatgcatatctctcccaataacaggaatgcaatccatcctggcgacagaatcttagagatcaatggaactcccgttcggacgctccgcgtcgaggaagtagaagatgccatctctcagactagtcagacactgcagctgctgatcgaacacgatccagtgtcacagcgcctggatcagctccgacttgaggccagactggctccacatatgcagaacgccggtcatcctcatgcccttagcacgctcgacaccaaggagaacctggagggcaccctccggcgtcgatctttacgacggtcgaactcgatttccaaatcccccggacccagttctcccaaagagccattactgttctctcgggacatttctaggagcgaatccctgcggtgttcctcttcttattcacagcagatcttccgcccttgcgatctcatccacggggaggtgcttgggaagggcttcttcggacaggctattaaggtgactcacaaggcaaccgggaaggttatggtaatgaaagaactcatacgatgcgatgaagagacccagaagaccttcctgaccgaggtgaaagtgatgagatccctggatcaccctaatgttctcaagtttatcggggtgctgtacaaagacaagaaactcaacttgctgaccgagtatatcgagggaggaaccctgaaggacttcctgagatctatggatccctttccatggcagcagaaagtgcggtttgctaaaggcattgcttctggtatggcatatttacacagcatgtgcatcatccaccgggaccttaattcccacaattgtcttattaaactcgacaaaacagtcgtagtcgctgacttcggtctgtctagacttattgtggaagaacgcaagcgggctcccatggaaaaggccacaacaaagaagcggacactccggaaaaacgatcggaaaaagcgatacaccgtggttggtaacccttattggatggctccagaaatgctcaacggcaaaagttatgacgagaccgtagatatcttctcctttggcatcgtgttatgtgagattattggccaggtgtatgcggatcctgactgcttacccaggacactggattttggattaaacgtaaagttgttctgggagaaatttgtgcccaccgactgcccccctgccttttttcctctcgccgctatatgctgtagactcgagccagagtccagaccagcattctctaaacttgaagactcattcgaagcactgagtctgtaccttggcgagctgggcattcctcttcctgccgaattggaagagctggaccatacggtttcaatgcaatatggcctgacccgcgatagtcccccttag

SEQ ID NO: 28159 - DNA, 1338 bp, Artificial Sequence
  Description of Artificial Sequence: Synthetic coding sequence
atgcgggaaattgtgcatattcaggccggacagtgcggcaaccaaataggcgctaaattctgggaagtgattagcgacgagcacggcatagaccctacgggttcttaccatggtgattcagacctccagctggaaaggattaatgtctactacaacgaggcagctggcaataagtacgttccgagggcaatccttgtcgatctggaacccggaactatggactctgtgaggtcaggaccctttggacaaatatttcggccagataattttgtcttcggacaatccggagctgggaacaattgggccaaagggcactacaccgagggggcagagctcgtggactccgtccttgacgtcgtgcggaaagaaagtgaaagctgtgactgcctgcagggatttcagctgacccactcccttggcggaggaacggggagcggtatggggacactgctgattagcaaaatcagggaagaatatccagaccggatcatgaataccttctccgtgatgccttcccccaaagtgagcgataccgttgtggaaccttacaacgcaacactgagtgtccaccaactcgtggagaacactgatgagacctacagtatagataacgaggcactttacgatatctgttttaggaccttaaaactgacaacacccacgtatggcgacttgaatcatttggtttcagctacgatgagcggggtgacgacctgtttacgttttccagggcagttgaacgccgatctgagaaagctggctgtgaatatggtgcctttcccaaggctgcatttcttcatgccaggctttgctccactgacttccagagggtcacagcagtatagggcccttacagtacccgagctgactcagcagatgttcgactccaagaacatgatggctgcttgtgatcccagacatgggagatacctgactgtggccgcaatcttcagggggcgtatgagcatgaaggaagttgacgaacaaatgctgaatgtgcagaataagaactcctcctattttgtggaatggatacctaacaatgtgaagacggccgtctgtgatattccgccacggggactgaaaatgagcgcaacgtttattggcaactccaccgcaatccaggagctgttcaagaggatcagcgagcagttcactgctatgttcagaagaaaagccttcctgcattggtatactggcgaaggaatggatgaaatggaatttaccgaagcagaatcaaatatgaatgacctggtgtcggaatatcagcagtatcaggatgccacagccgatgaacaaggtgagtttgaggaagaagagggcgaggacgaagcatag

SEQ ID NO: 28160 - DNA, 2028 bp, Artificial Sequence
  Description of Artificial Sequence: Synthetic coding sequence
atggccaaacatggggctgatgagcctagctcccgatccggctcccccgaccgcgagggcagagcctctgaagatcggtcattgcttcaccagcggctggcagttagggagctcatcgacacggaagtgtcctacctgcacatgctgcagctgtgcgccagcgacataaggagccgcctgcagcagctcccccagggcgacctcgacgtgcttttcagtaatatagacgacattatcaaggttaatagtcgcttccttcacgatttgcaggagacagcgtcgaaagaggaagagcaggttcagctcgtaggaaacattttcctcgagttccaggaggagctggagcaggtctataaagtgtattgtgccagttacgaccaggccctactgctggtggatacgtaccggaaggagccagagctgcagcgccatattcagggcatcgtagaagctgtagtgcctcaggcaggtagcagcggcctcagtttcctgctcgtgattcccttgcagcgaatcactaggtaccctttgttattacagaaaatactggagaacaccgtgcctgacgcttccgcatatcctgttctgcagcgggctgtgtctgccctccaagacgtgaacaccaatatcaatgagtacaaaatgaggaaggaagtcgcttccaagtatacaaaggttgagcaactcactttgagagagcggctggcaaggattaacacacacactcttagtaagaagactacgaggctctcgcagctgttgaagcaggaagctggcttgatccccaggactgaggataaggagttcgatgaccttgaggagcgctttcagtgggtgtctctgtgcgttaccgagctcaagaataacgtggcagcctacttggataatctacaggcctttctgtacttcaggcctcatgagtataacctagacatacctgaagggcctgctgtgcagtactgtaatctcgccagagatctccacttggaggcctttctgaagttcaaacagaggctggaagggctggtgtggcagcctttatgtagcttagcaaaggctttactggggccacagaatctcatcaaaaagagacttgacaaactgctcgactttgagcgggttgaagagaagctgctggaagtgggttctgtgacatatcaggaagaggccgcaagacatacataccaagccctaaattctcttctggttgccgagcttccacaattcaaccagttggtgatgcagtggcttggccagattatgtgtacattcgtcactttacagcgggatctggctaagcaagtgctccaaagagccgaaggatctatggcacagctacctcatcaccatgtgccagaacccgctttccggaagctcgtagaggacgcgttgggacgcacctctaaccagctgaggtccttccaggagacttttgaaaaggtccagccccctcccacgacacagccactcctgccaggaagcgagcgccaggtgcaagccttgctatccagatacggacccggaaaactgtaccaggtaactagtaacattagcggcacaggaaccttagacctgacgctccctcgaggacaaattgttgccatcctgcagaataaggatacaaaaggtaactcagggagatggctggtcgatacgggtggccataggggttacgtgcctgccggtaagctgcagttataccacgtagtgcccagtgctgaggaactaaggcggcaggcaggcctgaacaaagacccaagatgtcttactccagagccttctcctgccttagtgccctccatccctactatgaaccaggtcatcgccgcttatcctttcgttgctcgaagtagccatgaggtgagcttgcaggctggccagcctgtgaccatcctggaagcccaagataagaaagggaatccggagtggtccctcgtcgaagtcaatggtcaaagaggctacgtgccgtcaggcttcctggccagagcgagatctccagtgctgtggggctggagccttccttcgtag

SEQ ID NO: 28161 - DNA, 3399 bp, Artificial Sequence
  Description of Artificial Sequence: Synthetic coding sequence
atggcttctgatggagcctctgctctgcccggtcctgatatgagcatgaaaccatccgccgcacctagcccctccccggctctgcccttccttccacctacgtctgatcctccagaccatccaccacgcgaacctcctccccagcccatcatgccatctgtgttttcccctgacaaccctctgatgctgtcggctttcccctcatctctcttggttacgggggacggcggaccctgcttgagcggagcaggcgcaggcaaggtcatagtgaaagttaagacagaaggtggcagcgctgaaccatcccagactcagaacttcatcctgacacagacagccctgaattccactgctccaggaactccgtgcggcggtttggaggggccagcccctccatttgttacggcttcgaatgttaaaaccatcctaccctccaaggctgtcggggtgagccaggaggggcctcccggactaccgcctcagcctccaccacctgtagcccaactagtgcctattgttccccttgagaaagcgtggcccggaccacacggcacaacgggtgaaggaggccctgtggccaccctgagcaagccaagtctcggcgaccggtccaaaatctccaaggacgtatacgagaacttccgccagtggcagaggtataaggctctggcacgccgacatcttagccagtcccccgatacagaagctctgtcttgctttcttatccccgtcctgcgaagccttgccagactgaaacctaccatgaccctcgaggaagggctgcccctggctgtgcaggagtgggagcacacctctaattttgataggatgatcttctacgagatggctgagagattcatggaattcgaagctgaggagatgcaaatccagaacacccagcttatgaatggatctcaggggctgtccccagccacccccctaaaactggatccactcggacccctagctagtgaggtgtgccaacagcccgtatacattcccaagaaagcagccagcaagaccagggcgcctcgtcggcgtcaacgcaaagctcaacgtccccctgccccagaggcccctaaagagattcctccggaggcagtcaaggagtacgtcgatatcatggagtggctggtaggaacccatctggccaccggcgagtccgacggaaagcaagaggaagagggtcagcaacaggaagaggaaggcatgtatcctgaccctggcctcttatcatatataaatgagttgtgctcccaaaaagtctttgtctccaaggtcgaggctgtgattcaccctcagtttttggcggatctgcttagtcccgagaagcagagagacccactggctctgatcgaagagttagagcaggaggaaggcttgactctggctcagctggtacagaagcggcttatggccttggaggaggaggaggacgctgaggctccacccagctttagtggcgctcagctcgacagcagcccttctggctccgtggaagacgaggacggtgacgggaggttaagaccttcccccggattgcagggagccggaggcgcagcctgcctgggtaaggtgtccagctccggaaaacgagccagggaagtccatggcggacaggagcaggcgctggactcccccagaggaatgcatcgcgatgggaatacgttgccaagcccaagctcatgggaccttcagcccgaactggcagctccccaggggacgcccggacccttgggcgtcgagcgccgtgggtctgggaaggttatcaaccaggtctctcttcaccaagacggacatttaggcggtgcagggccacctggacactgccttgtcgcagaccgcacatccgaggctctccccctgtgctggcagggagggttccagcctgagagcacgccttccttagatgctgggctagcagaactcgccccattgcagggtcaagggctcgagaagcaggtgctggggcttcagaaaggccagcagacgggaggcaggggagtcttgccgcaggggaaggagccactggcggtcccatgggagggttccagtggcgcaatgtggggtgacgatagaggtactcccatggcccagagttatgatcagaatcccagcccccgagccgcaggcgagcgggacgacgtgtgcctgagtccaggcgtctggctcagcagtgagatggacgccgttggtcttgagctgcctgtccaaatagaggaggtgatcgagtcttttcaggtcgaaaagtgcgtcactgagtatcaggagggatgtcaagggctggggagcagaggaaacatatctcttggtcctggcgagactttggtgcctggagacaccgagtcttcagtgataccatgtgggggtacagtggcagccgctgccctggagaaaagaaattattgctccttacctgggccactgcgggctaattctccacctctccgctcaaaggaaaatcaggagcagtcttgcgagactgtgggacatccttcagacctttgggctgagggctgttttcctctcttggagagcggagatagtacacttggtagttctaaggaaaccctgcccccaacctgtcagggcaatctgctaattatggggacggaggatgcttcttccctgccagaggcttcccaggaagctggaagccggggaaatagtttttcacctctgctggaaaccatcgaacccgtgaatattcttgacgtcaaggacgattgtgggttgcaactgagagtcagcgaggatacgtgtcctctcaacgtgcatagctacgatccccagggggagggacgggtagaccccgatctgagcaagcctaagaatctggcccctctccaagagtcacaggaatcatacacaacaggcacgcctaaggcaacaagttcacaccagggcctggggagtacgctgccgaggaggggcacacggaacgcaatcgtacctagagaaacttccgtctccaagactcacagaagtgctgatcgcgctaaaggcaaagagaagaagaagaaggaagcggaagaagaagacgaggaattgagtaatttcgcatacctgctggccagcaaactgtctctctcccccagagaacatccccttagtcctcaccacgccagcgggggacaaggcagtcagcgggcaagccacctcctacccgcaggtgctaagggcccaagtaaattgccctaccccgtagcaaagagcgggaaacgagccttagcgggtggtcccgcacctaccgaaaagactccacactccggagcgcagctaggcgtgcctagggagaagccactggccctcggggttgtccggccatctcaacctagaaaaaggagatgcgactccttcgtaactggcaggaggaaaaaacgcagacggagccagtag

SEQ ID NO: 28162 - DNA, 522 bp, Artificial Sequence
  Description of Artificial Sequence: Synthetic coding sequence
atggctgtagcagtcggcgttcgggctgctccagtgctgggcctcgcaagggccctagtacttggcctgcggggttctcaggccgctaggtggcgcggatggggaacggccgctccaggctctctgtgggcattatgtgagtgtcccgcaggctgtcgagagctctggtttagggggcgtgccgcatgggctgccaggagcgagagactgctgcacccagcccaggactccgatggagaacgtgaggattctgccgctgagagagcacggcagcagctcgaagccctactcaataagactatgcgtattaggatgaccgatggcaggacactggttggatgctttctgtgcacagacagggattgcaatgtcatattaggttccgcacaggaatttctgaagccctctgattcattcagcgcaggagaacctagagttcttggcctcgccatggtacccggtcatcacattgtctctatcgaggtgcaacgggaaagtctgaccggcccaccctatttgtag

SEQ ID NO: 28163 - DNA, 558 bp, Artificial Sequence
  Description of Artificial Sequence: Synthetic coding sequence
atggtgaactcctgctgtggttccgtctgctctgaccagggctgcggtcaggacctctgccaggaaacatgttgctgtccgagttgttgccaaaccacctgctgccgcaccacctgctaccgcccaagttattcggtcagttgttgttgcaggcctcaatgttgccagtctgtgtgctgtcagccaacttgctgtcgcccttcttgctgtgtcagttcttgttgtaaaccccaatgttgccagtccgtctgttgtcagccaacttgctgtcacccaagctgctgtatcagctcatgctgtcgcccttcttgctgtgtgtcctcatgctgcaaaccacagtgttgtcagtcggtgtgctgccaacccaattgttgccggccatcatgtagcatttcatcctgttgccggccatcttgttgcgagtctagttgttgcaggccgtgctgttgcttgaggcccgtttgtggacgggtctcatgccacacaacatgttacagacccgcatgcgtgatttccacgtgccctcgacccgtttgttgcgcctcctcatgttgctag

SEQ ID NO: 28164 - DNA, 252 bp, Artificial Sequence
  Description of Artificial Sequence: Synthetic coding sequence
atgtgttgcaattattacaggaactgttgtgggggttgtggctacggcagcgggtggtcaagtgggtgtggttatggatgtggatacggctgtggttacggttccgggtgcaggtacggctcaggctatggcaccgggtgtggatacggatgtggctatgggagcgggtgcggttacggctgtgggtatagtagttcctgttgtgggtaccgacctctgtgttaccggagatgctattcttcgtgctactag

SEQ ID NO: 28165 - DNA, 993 bp, Artificial Sequence
  Description of Artificial Sequence: Synthetic coding sequence
atgggttcaaggaaaaaggaaatcgcgctgcaggtgaacatatctacacaggagctgtgggaagagatgctgagcagcaaaggcttgacggtggttgatgtttaccagggctggtgtggaccctgcaagccggtagtctctctttttcagaagatgcggatagaggtggggttagacttgttacactttgcactagccgaggccgaccgcctcgacgttctggaaaagtatcgcggaaagtgtgaaccgacttttctgttttacgccggaggcgaactggtagcggtggttcggggtgcaaatgcacctttattgcaaaaaactattctggaccagttagaggccgaaaaaaaagtcttggctgaagggagggagaggaaggtaattaaagacgaggcactgtcagacgaagacgagtgtgtaagccacggcaagaacaacggcgaagacgaggacatggttagcagcgagcggacctgcacgctggctattatcaaacctgacgccgtggcccatggcaagacagacgaaattatcatgaagattcaagaggctgggtttgagatcctgaccaatgaggagaggaccatgactgaggcagaagtgagactattttatcaacataaggccggtgaagaggcctttgagaagcttgtccaccatatgtgctctggaccttcacacttattaatcctaacccggaccgagggcttcgaagacgtggtgacgacctggaggaccgtaatgggacctcgtgatcccaatgtagcacgcagagagcagcccgagagcctcagagcacagtatggcaccgaaatgcctttcaacgcagtccacggatctagagatcgagaagatgcagatcgggaacttgccttgcttttcccgagtctgaagttcagtgacaaagacacagaggctccccagggaggggaagccgaggccacagccggacctaccgaggcactgtgtttccccgaagacgtcgattag

SEQ ID NO: 28166 - DNA, 606 bp, Artificial Sequence
  Description of Artificial Sequence: Synthetic coding sequence
atggtgagctcttgctgcggatccgtttgctctgaccaggggtgtggacaagatctttgccaggagacatgttgtaggccatcttgttgcgaaaccacatgttgtcggaccacatgctgcagaccatcctgctgtgtgtcatcatgttgccgcccacagtgctgccagtccgtgtgctgccagcctacatgcagccggccttcgtgttgtcagactacttgttgtagaactacatgttacagacctagctgttgcgtgtcatcatgttgccggccacagtgctgtcagcctgcttgctgccagcccacctgttgtagaccaccacgctgctgcataagttcttgctgccgaccttcttgttgcgtttcatcctgctgcaaaccgcagtgttgccaatctgtctgctgccagccgaactgctgccgcccaagctgtagtatttcctcttgctgccgcccaagctgctgcgaaagtagttgctgtagaccctgctgctgtgtgcgcccagtgtgcggcagagtctcctgccatactacctgctacaggccaacttgcgtgatctcttcatgccccagaccattatgttgtgcaagctcgtgttgctag

SEQ ID NO: 28167 - DNA, 792 bp, Artificial Sequence
  Description of Artificial Sequence: Synthetic coding sequence
atgggggatattcctgctgtggggctgagctcatggaaggccagccctggcaaggtcacagaggccgtgaaggaggccatcgacgctgggtatcgtcacttcgattgcgcgtatttttatcataacgagcgagaagtgggggctggaattcggtgcaagatcaaggaaggagctgtgcggcgagaggacctctttatcgctaccaagctctggtgcacctgtcacaaaaaatcactggtggagactgcctgtagaaagagcctaaaggccctgaagcttaattatctggacttgtatctgatacactggcctatggggttcaaaccccctcaccccgagtggattatgagctgctccgaactcagtttttgtctctctcatccacgcgtgcaagaccttcccctggatgagtcaaacatggttattccttccgacactgatttccttgacacctgggaggcgatggaggatttagtcatcaccggactcgtgaagaatatcggcgtgtcaaactttaatcatgaacagctggaaaggctcctcaacaagcccggtttacggttcaaacccctgacgaaccaaattctgatccgctttcagattcagcgaaacgtcatagtaatccctgggtccatcaccccttcccatattaaggagaacatccaggtgtttgatttcgagctcacacagcacgatatggataacatcctcagccttaatagaaatcttagattggcaatgtttcctataactaaaaatcataaagattatccattccacattgaatactag

SEQ ID NO: 28168 - DNA, 177 bp, Artificial Sequence
  Description of Artificial Sequence: Synthetic coding sequence
atgaggtactacggatcttactaccgaggtctgggatatggttgtggtggatttggcggactgggttatgggtgcgggtgcggcggttaccggtacgggtctggctacgggggttatagatatgggtgctgcagacctagttgccgcgaaggctacggcttttcaggattctattag

SEQ ID NO: 28169 - DNA, 159 bp, Artificial Sequence
  Description of Artificial Sequence: Synthetic coding sequence
atgtgctatggatacgggtgtgggtgtggaagtttttgccgattgggctacggatgtggctacgaaggatgccgatacggttgtgggcaccgagggtgtggcgatgggtgctgttgcccatcctgttaccggagatatcgcttcaccggcttctactag

SEQ ID NO: 28170 - DNA, 255 bp, Artificial Sequence
  Description of Artificial Sequence: Synthetic coding sequence
atgagctattacggatcgtattataggggcctgggctatggatgtgggggatttgggggattgggctatggatatggttgtgggtgcgggtcattccgcaggctcggctacgggtgcgggtttgggggtaacggctatggctattgtcgcccttcatgttatggcggttatgggttctctatcctcttaaaaagctatcccgaagatacaatatcagaagtaatccgccgtagcttcaatctcactaagtactag

SEQ ID NO: 28171 - DNA, 246 bp, Artificial Sequence
  Description of Artificial Sequence: Synthetic coding sequence
atgtcttattatggcagctactatggaggattagggtatggctgcggaggcttcggaggcctcgggtacgggtatggctgcggctgtggaagctttagaaggttgggctcggggtgcggctatggagggtacggatacgggtccgggtttgggggttatgggtatggatcagggtttggaggctatgggtatgggtgctaccgcccttcttattacgggggatacggattctccggcttttactag

SEQ ID NO: 28172 - DNA, 414 bp, Artificial Sequence
  Description of Artificial Sequence: Synthetic coding sequence
atgagttacaactgtagcagcggaaactttagctcctgctgttttggcagctacctacgatacccggtttccacctataatcttttctatccctccaacgctatctattctcccaacacgtgccagttaggttcgtctctgtacaatggctgccaagagacttactgcgagccaacatcctgtcagacctcatgcactctggccagatcataccagacatcatgttactgccccaaaaattcaattttttgcagtccgcgacaaactaactatatcaggagtttgggatgcggcaacacgggcctcggcagcctgggctgcggcagtaccgggtttcagagcttggattgcggtagctccttctaccacccaactacattctcctcaaggaattttcaggctacatgctactag

SEQ ID NO: 28173 - DNA, 483 bp, Artificial Sequence
  Description of Artificial Sequence: Synthetic coding sequence
atgagctataactgctgtagtaggaacttcagcagccgctcattcgggggatatctgtattatcccggatcatacccaagtagtctggtgtattccaccgcattatgctccccctctacatgccagctcagaagcagcttgtaccgggattgtcagaaaacttgctgggaacccgcaagctgtcagaaatcctgctataggccgcgtacctctatcttgtgttgtccttgtcaaactacgtgtagtggcagcctgggtttcagaagctcgagctgccgctcgcaggggtacgggagtcggtgttgctatagccttggaaatggttcatcgggattcagattcctaaagtacgggggatgcgggttcccttccctgtcttacgggtcccgcttttgctaccccaattatcttgctagcggcgcatggcaaagctcttgctacagaccaatttgtggatccagattttaccagtttacctgctag

SEQ ID NO: 28174 - DNA, 684 bp, Artificial Sequence
  Description of Artificial Sequence: Synthetic coding sequence
atgctgaaccccgacggcgtgtatcttggcaattataggtgtagcctcatgggatttgacctgaacagacattggctcgacccgagtccctgggtgcaccctactctgcacggagtgaagcagctgatagttcagatgtacaatgaccccaaaacaagtctcgagttctacatcgacatccacgcgcactctacgatgatgaatggtttcatgtatggaaatatctttgaagacgaggagagatttcagagacaggccatttttccaaagctgctatgccaaaatgccgaagacttctcctactcgtcaacctctttcaatagagacgccgtgaaggctggcaccggaaggaggttcctgggaggactgctggatcatacatcttattgttacaccctggaagtgtcattttacagctatattatttcagggacaacagctgcagtcccctacactgaggaggcctatatgaaattgggtcggaacgtggccaggacattcctggactattatcggctaaacccagttgtggagaaggtggcaatccctatgccacgcttgcgcaaagaaaaatctccaccatataaacatccccttttgaggggacccgctagcaactatcctaactcaaaaggagataaaaaatcttctgttaatcacaaggacccttctaccccattttag

SEQ ID NO: 28175 - DNA, 465 bp, Artificial Sequence
  Description of Artificial Sequence: Synthetic coding sequence
atgacccattgctgttcgccatgctgccaacctacatgctgtcggaccacctgctgtcggacgacatgttggaagcccactacagtgaccacatgcagcagcactccttgttgccagccaagctgttgcgtgtcctcctgctgtcagccctgctgccgtcccacctgttgtcagaacacctgctgtcagcccacgtgcgtgaccagctgctgtcagccttcgtgctgctccacaccatgctgccagcctacctgttgtggcagtagttgtgaccagagctctagttgtgcgccagtgtactgccgccgaacatgctattatcccacaaccgtgtgccttccgggttgtttgaaccagagctgtggctccaattgttgtcaaccctgctgccggccagcctgctgcgagactacttgcttccagccgacctgtgtgtcctcctgttgtcagcctttctgctgttag

SEQ ID NO: 28176 - DNA, 7061 bp, Artificial Sequence
  Description of Artificial Sequence: Synthetic coding sequence
atgaagcaacggaagggtcaaggaagcgggggaagccggggtagaaagaaaaggggtttgtcagatatttctccatccacttcgctgccaccactggtggagggccagctgagatgctttctcaagctgacagtgaatcgagtgatctggaaaatcgctaagcccccaacctgcgttttagtccgggttcggtggtggggcgagacgagcgacggcactctcttctgtccccgtgatgccctgcagaccgaaccgaaagcagtgagaacaacaaccagatatgccatacggtgtggacccaagcagtttaccagctacctcaccgatatggctgtgctggtgctcgaagtcataacaaagctggacggactccccattggacgggtccagataaatggtcttgcgcagctgagccctactcatcagattaacggcttcttcaccatagtgtcttcaacatctaaaaagttaggggagctacaggtgagtctcgcattagagcccctgagcgaaacctacgactcgtaccacccattaccgacaaccgacatgaccgaaaacgtgctactgtctaagcaaggttttcgtgaaaatactgagccttccagcacacagttccaggtgccaagtaggccccgagacatccacaccattaagatcgacggtaaagagctagccgctaatagctccaggagcaccacgcccaggggaaaggatcacgtatgcttcgctgagaaccccgatacaatcaaagacagctccttcgggctgcagcattcactgaactcggggcagtcccttgaaagcgtaaccttaaaaggaagggcgcctagaaaacagatgtccctgctcaacagctctgagtttcaaccccaaattagaacagtggccaagtctcattctgattcatgcatcctgtcatctaacaacctcccaaccaaagacctgctgagtgcactgctagaacagggtaataagctgagaaatgccatggtaatatctgcgatgaaaagtagcccagaaactagtatgctcctggaccaggtgcaccctcctatcaatgaagattcccttagggccagtactcaaatccgagccttcagcagaaatagattcaaagaccacatcgaagaccatctgctcccctcgactgaaaacacattttggcgccacgatacaaaggctgacacaagggccattcagctgctcctggggtcagcagaactctcacagggtaatttctgggacggccttggtagtcccccagattccccatctcccggttcagatgtctactgcatctctgagttaaacgatcctcagtatgaccagagtttattagagaatctattctacaccgcgcctaagtctgatacatccatatccgatttcctatccgaggaagacgacattgtcccaagcaagaagatctcacagtccaccgccctcgccaggtcctctaaggttctggagtcaagtgaccacaaactaaagaaacgctcggccggtaagaggaatcgaaatctcgtcgaacaacaaatgttatcagagacacccgaggatgcccagactatgaccttatccgtggatcggctcgccctgctcggcaggactcactctgttagaattatcatcgagaccatgggggtgccaccagattcgcctcagatgacgcctggtaagaagtcttacgcaggaccccctcctaaggtgactactgctaagaagagaacattcttcgtggaatatcatttcccagtggggttcagtgaatcaggccttggtaaaacagccttaataaccgaagtggtcaggctagccagctccaagatcactgatggcaaggtgaagtttcagcaacgttttgtgtttccagtccaattcgggggacccatgatagaacattggtggaattccaatttgacatttcagatttatgtaaagaagacaccacagaagaaaccagaggtgatcggatcagtgagcttgagtttgcgggctgttatccaatccgagctcctgagtttttccgatcagctgcctgttcagcaggagaatggacagtctcctttcgggcctctcaaagttaccatggaattgatcactgacaataaggattttacaggtattaacacaaagctgtccggcaacacccattataccccgttgtgcgcgccaacttccccaaacaaggctcttcccgagctgaaccaggatatgacatgcaccaagaatccccagaatttaaatcaaatccatgaggagacggccaagaaagctcagaatctggtcctgcctaataggaaatcgccatcaccagtggcgccacacccaagcacatttgtggctactcctgcctctcacaatctagtcaaccaaaccaacggcaccaccaaagaatcggccttactactccatgtgctactcatggtgcccgatggtaaagattttatttccggcgagtctgagaaacagagtccctgcaatgtgtacctgaactgtaaattattctccaccgaagaggtgactcgatccgtgatcgcctggggtacaacccaaccagtgttcaatttctcccaggtgatccccgtctcattgtcctctaaataccttgagcgcctcaaaaataatgtgatggttatagaaacgtggaacaaggtgcggagccccggtcaggacaaactgttgggcctggttaagctcccattgcaccagttttatatgtccttcaaggacgccaagatctctcggctgttgttggatgcacagtaccccgtggttgctgtggattcctacatgcctgttattgacgtctttagtggccatcagaacggttctctgagagtcttcttagccatggggagttccaatcagatcatggcactgcagcgacttaaaaacgaggaggggactctgccaccattttctccccgacctgctcattttctcgaccagcctacagctgcatccgtcgccatggcagaggatcgcggtaatggcttaatggagcactgttttgaaatccatatcgaaatggtgaaaggacttgcaccactgcaagctaccgtctggggagaagcagattgctatgttcagtactactttccagttcagcattctcagtcgagtgttctcaagggaccagagttcttggaaaacggaatcacgcttaagcccttcagaaccgccacaactctttgcgtcccagacccaatattcaattccgagcaccatcattccctcctgcttcccgcagaagttcctgtccagagactacttctttcggctttcagtgctcagggcctcgtccccggtggcggagtccagtttgagatatggtgtcgctattactacccaaatgtaagggaccagaaagtcgccaaagggaccctgcctctcagccgcatttgtgcaatggtcaccactcagcatagagaggacgtggggatccaaacatttaatttgcctctgaccccccgtatagagaatagaaaagagctgagaaaccagtcttcaggcctgttggatgtcgggttacggtaccgtagaagccctcgaacagcggagggcgtgcttgcagctcgcactgtctctatcagcgtccagattatccgggcatgcggtctgcaggctgccgcaaaagctctagctgagcgcgagccggcactgcagttctcagccactgtgggcgttaatgcgtccgttacaacacacctgtcgtttctcccacaaggcgagcagaggcgtactcatcccgtggcttgttctttttgccccgagttcagtcatcatgtagagtttacttgtaaccttgtcactcagcattgctcaggagaggcatgtttcctagcagaactattagagttcgcagaggtgatattcgctgtttatcacgaaaatacaaagtcagcctccgacatcattagtatcgaatcctgcaaagagtatctgctcggggtggtcaaggtgcctaccaaagaattactgataaaacggagcggcataacggggtggtatcctatcattctgcccgaggatgggggactgccacacggacttgaactcatgcagaagatcgtgggtggtttagaattaagtatcagcttcactcatcggggagatagggagagagtactcgaggctgcagagcacctgggctggagcttcgaaaatagcctcaaagatttcgtgcgcatggatgagggggagcccgctacagttacaatctctacgcctcggctttggctgcccatccactgtgtcctcctggcagggcataatcatatccataagaacacctattgttacctgagatacaagttttatgaccacgaggctttttggactccgttgaagaaacccaaagagtccgtgaataaaaagcaaatcatggtgacattcaaggcttcaaaaagagccgaagtgactcggggaccttccttgttatggtacttcagagaggaacgcttggagattcaggtatggagggcatacgggaatgattctgtggagcgaccccatcagactgacagttggataggatctgcttacgttgatttggcgagacttggggagagatccgcgcgtaccctcacggtgtcaggagtttatccgttgtttggtcgcaatgccagcaatttatcaggagcagccctgcgtgtgcacgttgttttgagcagtctatcctcgcatctggagcccacccacgagctcgattccatggattgctcatctcattccgagagtgaacagttacccaggcgtaatgatgaggtgcagctgtcgccaccagaggtgattagttgtcaccaaaaatcccctgccagcacccaggtcccatgttcctctacaaccgcagaggtgcgacttacacaggaaggaccggctgaccttgatggaacgtttgccgtcagcatcctggtggaaagggcaatgcatctaagtctcaagggttccccgctgacagagaggaaggtgtcaattcctagctgttgtgtgtctttcgccaccgctgacgaatcaagcccggtgtacacacaagtggtggagaatactgattctccaatttggaattttcaacagcagtctaggctctccaaagaactgctgttggatcctcaacagacattagtgttcaaggtctggcacaaaggcgatgaagagagagttataggcttcgctagcgtcgacctcagtcccctgctgtccggatttcagtttgtttgtggctggtacaacattactgatttttcgggagagtgtcaagggcaaatcaaagtggccgtgagccccctggagtctctgattcatttcaaagaagagaggcaggctagaagaggcgttgagaccagcaaatcactcataccaatttactcacccttctccttccccgcttctgacacatatgcagccttctccagtcacatggcaagacaaacactggatcagttagctcatgcttcaagcaaggagttggatttctcttcccctggacggagcgacaccacaaggagccaggcatcccgtcacgaagaacacgtccaaaatattaggcgttttcacgagtctctgcacctccagggcgaagcgccactcccgtgcgacgacaagcttactacatctccgctgagcagccagacgtccatactcacttcactgaggaaaaacttgagcgagctggatcaaattcaaaggtatttccggcagaaactaacgaagccctttttgccactcagcccacagacccagacggctatttcccagcaccaggagagttgtagggaccatctcggtcccggtgccagttctcttgaccccggtagccagtgtatcctggagaagtcctcgaatttagtactgcaagtttcctctttaatcacggacctccaaactatcacccgcgattctcaagcagccctgtcttctcaccgagcccgatcccgcagcaacaaagccacgactttgccagacgctcaagataccgaagcgttgcaggagcggtgcactatgccagacgagcccttggttagagccccagacaagggaacagatagtccaagtccccctccattggaggaaaccagcaacggcggtcggatgctccatgagtccctgcggcatgccgtgcccattacgaggatgcagtccagcgaggacacggaggccggtccagcctattcagacgaagactatgaagaggacattattgagccacggacattgaatgagattacgaccgtgacggataaaacctctccttggagttcggtcatttccgatacttctgaggtaatttctcctcagccggacgaagttcagagagaagggcctagctgcccctctccaggaccgttttgccgtgaggagctcatggttaaatcaagctttttgagttcacccgagcgcgctgtgaacccacatttgcccagacagggaagtccttcgcaatccctcgttgcctgcgagtgtgaagcatccaaggccagggtcggtggggagtctgcctcagccaacccacagcccataccttgcccaactctcagcggggctcagcagagctcgaccttcgtcggctggagcagtcctcagactgaccaaaataaggagccaaagtcagaggccccagcggaaaacgaagccgcaactagtgaacttggcgatagcgccgatagcttcaagaaactgccgctgaacctggccagccagtcgcgcagagaaaatcacaaggggcctcctatcgatagttccgatattaggcagcggcaagtcactactggttctgagaccagcaccaaacaaagcctgctgctcccaggcccaattgtggtcccaaatttctttcttcctccccagcaactggaggcaagcctgcggatgttgagtctgtctgccaccttgccacccgctgccacaaccgaccaggacaagtctgaagctactaggggcgctttgtcccaaagaccctgtagacccagaccaaactccctgcctctgaacttgccagaagaggagactctccggatagccaggatatttagctcccaatatagccagaaggacta

SEQ ID NO: 28177 - DNA, 219 bp, Artificial Sequence
  Description of Artificial Sequence: Synthetic coding sequence
atgaactactatggaaactactatggagggttggggtatgggtacggtggatttgacgacctgggctacggctatggctgtgggtgtggatcttttcggagactgggatatggaggcggatatggcggttacggttatgggagtgggttcggcggatatggttaccgcagctgcagaccctcctgttacggcggttacggcttcagtgggttctactag

SEQ ID NO: 28178 - DNA, 198 bp, Artificial Sequence
  Description of Artificial Sequence: Synthetic coding sequence
atgagctataattgctgctgcggtaatttttcatcccactcttgtgagggctatctttgctactctgggtattcaagaggcggtagcagttatccctctaatttggtgtactcaaccgaacctctgatctcacaacatctgcccgctggcttcctctcacttcaaggcctctctggcgacctgctgggcaatccatag

SEQ ID NO: 28179 - DNA, 384 bp, Artificial Sequence
  Description of Artificial Sequence: Synthetic coding sequence
atggtaaatagttgttgcggcagtgtgtgcagcgaccaagggtgtgaccagggcctgtgccaggagacctgctgtcgcccttcatgttgtcagacgacttgctgctgtccctcatgcgtcgtgtcatcttgttgtaggccctcttgttcacagactacatgttgccagacaacatgctgccgaccctcctgctgccacccggtgtgctgtcaaacaacctgccggccatcctgtggcgtatcgtcatgctgtcgccctctgtgttgccagacaacttgtcgtccctcttgtggagttagtagctgttgccggccactgtgttgtcagacaacctgttgcagagcaacatgttgcagaccttcttgctgcggttcttcctgctag

SEQ ID NO: 28180 - DNA, 318 bp, Artificial Sequence
  Description of Artificial Sequence: Synthetic coding sequence
atgggctgctgcccaggagattgttttacctgctgcactcaagagcagaattgctgtgaggagtgctgttgccagcccggatgctgtggttgctgcgggagctgctgtgggtgtggcggttctggttgtgggggtagcggctgcggcggttcctgctgcggcagctcatgctgcgggagcggctgcggaggctgcgggggatgtggcggatgcggtggtggttgctgcggatcttcgtgctgtggaagctcctgctgcggctcaggctgttgtggcccagtttgctgtcagcctacacccatctgcgacaccaaatag

SEQ ID NO: 28181 - DNA, 3915 bp, Artificial Sequence
  Description of Artificial Sequence: Synthetic coding sequence
atggaggagatccctgtgaaggtggccgtaaggattcgtccactgctctgcaaggaagcattgcacaatcatcaagtatgtgttagagtgatacctaacagccaacaggtcattataggccgtgaccgcgtgttcaccttcgattttgtttttggtaagaatagcacccaggatgaggtttacaacacctgcatcaagcccttggtgctatcactgatcgaaggatacaacgcaactgtcttcgcttatggccagaccgggtctggcaagacttatacaatagggggtgggcacatagccagtgtggtggaaggacaaaaagggatcatcccaagggccattcaggagattttccagtcaatctccgaacacccatccattgactttaatgtaaaggtgagctatatcgaggtgtataaggaggatttacgggatctcctggagctggagacctcaatgaaagatctgcacatacgcgaagacgaaaaaggaaatacagtgatcgttggtgctaaagaatgtcatgttgaaagcgccggtgaggtgatgtctctactggagatgggtaacgctgcacggcatacaggcaccacacagatgaatgaacactcctcaaggtcacatgcaattttcaccatctcgatttgccaggttcacaaaaacatggaggctgccgaggacgggtcctggtatagccctcggcacattgtctccaaatttcactttgttgaccttgcaggatctgaacgggtcactaagactggaaacaccggagagcggttcaaggagtcgattcagataaattcagggcttttggcattggggaacgtgataagtgcccttggggatccacgtcgcaagtcttcccacattccataccgagatgcgaagataacccggttgctcaaagactccctgggcggttcagcgaagacggtgatgataacgtgtgtgtccccctcctctagcaatttcgacgaatctctgaacagtctgaagtacgctaaccgagcgcgtaatatcagaaataaacctacggtcaactttagtcctgagtcagataggattgacgaaatggagtttgaaattaaattgctgcgtgaggccctgcagtctcagcaggctggggtctctcagactacgcagataaacagagagggcagtccagatacaaatcggatacactccttggaagaacaggtggctcagctccagggcgagtgtctcggttatcagtgttgcgtcgaggaggcgtttaccttcctggtggatctgaaggacaccgtccggcttaatgaaaagcagcaacacaaactgcaagagtggttcaatatgatccaagaggtgcggaaggcagtgctgacttcatttcgaggaattgggggtaccgcctcgttagaagagggcccacagcacgtcaccgttctgcagcttaaacgggagttgaaaaaatgccagtgcgtgctggcagcagacgaggtggttttcaatcagaaggagttagaggtcaaagaacttaaaaaccaggtacaaatgatggtgcaggagaataaggggcacgccgttagcctcaaggaggctcagaaagtcaatagactgcagaacgagaagatcatcgaacagcagctacttgttgaccagctcagcgaggagctgacaaaacttaacctgtcagtgactagtagcgccaaggagaattgcggagatggccctgatgccaggattccagagaggcggccttacacggtgccttttgacacgcacctcggccattacatctacatcccctcaagacaggactcgcggaaggtccacacgagcccacctatgtactctctggatagaatctttgctggcttcaggactcgctcacagatgctgttaggccacattgaggaacaggacaaggttctgcactgtcagttcagtgacaacagtgacgatgaagaaagcgagggtcaggaaaaatcgggcaccaggtgcaggtctaggagttggattcaaaaacctgactcagtctgcagtctggtggagcttagcgacactcaggatgagacccaaaaaagcgatctcgagaatgaggatctcaagatagactgcctccaggaatcccaggagctgaacctgcagaaactcaagaacagcgaacgtatcttgactgaagctaaacagaaaatgcgagaactgacaatcaacattaagatgaaggaggatctgattaaagagctgattaaaaccgggaatgatgccaagtcggtgtccaagcagtacagcctgaaagtgaccaagctggaacacgatgctgagcaggcaaaagtggaactgatcgagactcagaaacagctccaggaactggaaaacaaagatctgtctgatgtggccatgaaggtgaaactccaaaaagagttccgaaagaaaatggacgctgcaaaactgagggtccaggtgcttcaaaaaaaacaacaggacagtaagaaattggcctctctctcgatacagaatgagaaacgcgcaaacgagttggaacagagtgtggatcacatgaagtaccaaaagatccagctgcagcgcaaactcagggaggaaaacgagaaacgcaagcaattggatgcggtgatcaagcgcgaccagcagaagattaaggctctgaatacagatagtcttaaaatctccacacgcctcaatctcctggaacaggaacttagcgaaaaaaatgtccaactgcaaacaagcacagctgaggaaaaaactaaaatcagcgagcaagtggaggtgctccagaaggaaaaagaccaactgcagaaaaggagacataatgtagatgaaaaactcaaaaatggcagggtactcagcccagaggaggagcacgtgctcttccaattagaggaagggatcgaagccctcgaggcggcaattgaatatagaaacgagagcattcaaaaccgtcagaagtcactgagagcttcttttcataacctctcgcgcggagaagccaacgtgttagagaaactcgcctgcttaagtcccgtcgaaatacgcactatcctgtttcgctacttcaataaagtggtgaacttgcgtgaagcagaacgcaaacagcagttgtacaacgaggagatgaagatgaaagtgctcgagcgcgacaacatggtcagagagctcgaatcggctttggaccatctgaaacttcagtgcgatagaagactgacactgcagcagaaagagcacgaacaaaagatgcaactcctgctgcaccattttaaggaacaggacggcgaaggaataatggaaaccttcaagacctacgaggataagattcagcagctggaaaaggatctgtatttttacaaaaagaccagtcgtgaccacaagaaaaagttaaaagagcttgtgggagaggcaattcgcaggcagctggccccttcagagtaccaagaggcaggcgatggagtgctgaagcccgaggggggaggcatgcttagcgaggaactgaaatgggcttcaaggccagagagtatgaaactgtctggcagggagcgcgaaatggactcaagtgcttcatctttacgtacccagccaaaccctcagaagctctgggaggacataccagagctaccccctatacactcgtccctcgccccacctagcggccatatgctgggcaacgagaataaaactgagacggacgacaatcagttcacaaagagtcacagcaggctgagttctcaaattcaagtcgtcgggaatgtcgggaggttgcacggtgtcactccagtgaagctctgtcgcaaggagcttcggcagatcagcgccttagagctatcattgcgcagaagctccctcggtgtgggcattggcagtatggctgctgactccatagaggtgtcccggaaacccagagacctgaagacctag

SEQ ID NO: 28182 - DNA, 903 bp, Artificial Sequence
  Description of Artificial Sequence: Synthetic coding sequence
atggaggaagaagccagttcacccggactgggatgctcaaaaccccatttggagaagctcacattgggtattaccaggatactcgagtcatcacctggggtcacagaagtgacgattatcgaaaagccacctgccgagaggcacatgatctcttcctgggagcaaaagaataactgcgtgatgcccgaagacgtaaagaacttctacttgatgaccaatggattccatatgacctggagtgtgaaactggatgagcatattattcccttgggatcgatggcaattaatagtatctctaaactgacacagcttacacagtcttccatgtattccctgcccaacgcacctacactagctgacctggaagatgacacccatgaggccagcgacgaccagcctgaaaagccccactttgactctcgttcagtcatcttcgagctggactcctgcaacggctccggtaaagtatgcctcgtgtataagtccggtaagccagcccttgcggaagacactgagatatggttcctagaccgcgctctgtactggcactttctgactgacacctttaccgcttactaccgcctgttgattacccacctaggtctcccacagtggcaatacgcctttacaagttacggtatttccccccaggcaaaacagtggttcagtatgtacaaacccattacctataacaccaacctcctgacagaagagaccgactcattcgtgaacaaactggacccatcaaaagtcttcaagtccaagaataagatagtgattcctaagaaaaaaggtcccgtgcagcccgctggcggacagaaaggccctagcggtccctccggaccatccacatctagcacctctaaaagctcaagcggatccggaaaccccacccgtaaatag

SEQ ID NO: 28183 - DNA, 390 bp, Artificial Sequence
  Description of Artificial Sequence: Synthetic coding sequence
atgatgacagatttgaagcagtctcacagtgtgcggctcaacgatgggccatttatgcccgtcttgggctttggcacttacgccccagaccacacccctaagagtcaagccgctgaagccaccaaagttgccatcgatgtggggtttagacacattgatagcgcttatctgtaccaaaatgaagaagaagtcggtcaggccatttgggaaaaaatcgcggacgggactgtgaagcgcgaagagattttttacaccatcaaattatgggcgacattcttccgagctgagctcgtgcatccggctctcgaaagatctctcaaaaagctgggcccagactatgtagacctgttcatcatacacgtgccattcgccatgaagggtagcagctag

SEQ ID NO: 28184 - DNA, 1257 bp, Artificial Sequence
  Description of Artificial Sequence: Synthetic coding sequence
atgcatcccgaaccaagcgagcccgctaccggcggtgcggcagaattagattgcgcgcaagaaccgggagtagaggagagcgcaggagaccacggtagcgctggcaggggcggatgtaaagaggaaattaacgatcccaaggagatctgcgtgggaagtagtgacaccagttaccatagtcaacagaaacaaagtggggacaacgggagtggagggcacttcgcacatccgcgagaggacagggaggacagaggacctaggatgacgaagtcaagtttacaaaagctgtgcaagcagcacaaactttacatcacgcccgctctcaacgatactctctacctgcactttaaaggcttcgatcgtatcgagaatttggaagagtacacaggactcaggtgtctttggttacagtctaacgggatccagaaaatcgagaatctcgaggctcagacggagcttcggtgtctgttcctgcagatgaacctccttaggaagattgagaacctggagcctttacagaaactggacgcacttaacttaagtaataactatattaagacaatcgaaaacctgagctgcttgccagtgctgaacacactacagatggcccacaaccaccttgagacggtcgaagacatccaacacttgcaggagtgccttaggctttgcgtactagacctgtcccataataagctgtctgacccagaaattcttagcatactggagtcaatgccagacctgcgcgttctcaaccttatgggaaaccctgtgatcagacaaattcccaactaccgaagaactgtcaccgttcgcctcaaacatctcacatatttagacgatcggccagtgttccctaaagatcgggcatgcgcagaggcctgggcaaggggtggatacgctgccgagaaggaggagcggcagcagtgggagagtagagaaagaaagaagatcactgattctattgaggcgctcgctatgatcaagcagcgggcagaagagcgcaagcgccagcgagaatcgcaggaacgtggagagatgacaagctcagatgatggcgaaaatgtaccagcatctgctgagggcaaagaggagccgccaggtgacagggagaccaggcagaagatggagctgttcgtgaaggagtctttcgaggccaaagatgaactatgtccagaaaagccaagtggggaagagcctccggtcgaggcgaaaagggaggacggagatcccgcaactgtcacggcatgtgagggctag

SEQ ID NO: 28185 - DNA, 2472 bp, Artificial Sequence
  Description of Artificial Sequence: Synthetic coding sequence
atgggcaagaagagaaccaaggggaagaccgttcctatcgacgacagcagtgagacccttgaacctgtgtgtagacacattcgcaaggggttggaacagggcaacttgaaaaaagccctggtaaatgttgaatggaacatatgtcaggactgtaagactgacaataaggtgaaagataaggcagaagaagaaaccgaggaaaaaccttctgtgtggttgtgcctgaaatgtggccaccagggatgtggcagaaatagccaagagcagcatgctttgaagcattacctgactcctaggtcagaaccacactgcttagttctgagcttggacaactggagcgtttggtgttatgtatgtgacaatgaagtacagtactgctcttcaaatcagctggggcaggttgtggactacgtgcgcaagcaagccagcatcacaacacccaaacccgctgagaaggacaacgggaatatcgaactcgaaaataaaaaactcgagaaggagtcgaaaaatgaacaggagagagagaaaaaggaaaacatggctaaggaaaatcctcctatgaactctccctgtcagattactgtgaagggcttgagcaacctcgggaacacatgctttttcaatgctgtgatgcagaatctttctcagactcctgtgctccgggagttgctgaaggaggtgaagatgagcggtacaatagttaagattgagccacctgacctggccttgaccgaaccactcgagatcaacctggagcccccaggacccttgacactcgcaatgtcacagtttttaaacgagatgcaggaaactaaaaaaggagtcgtgacaccaaaggagctgtttagccaggtctgcaagaaggcggtgcgtttcaaaggctatcaacagcaggattcccaggagctgttgagatacttgttggacgggatgcgcgcagaggagcaccagagagtgagcaaaggaatcctgaaggcctttggaaattctacggaaaagcttgatgaagagctgaagaataaagtgaaggattatgagaaaaagaagagtatgccatcattcgtggaccgaattttcggaggtgaactcacctctatgataatgtgcgaccagtgccgcacagtaagtctagtgcacgagagttttctcgatctctccctcccagtcctggacgaccagtccggcaaaaagtctgtgaacgataagaatctgaagaagactgttgaagacgaagatcaagattccgaggaagagaaggataatgattcctatattaaagagcgtagcgatattcccagcggaacttcaaaacacctccaaaagaaagccaaaaagcaggctaaaaagcaggcaaagaaccagcggagacagcagaaaattcaaggaaaggttcttcacctgaacgatatctgcaccattgaccaccctgaggactccgaatacgaggctgagatgagccttcagggggaagtaaacataaaaagcaatcacatctcgcaagaaggggtgatgcataaagaatattgtgtgaatcagaaagatttaaatgggcaggcaaagatgatcgaatcagtcaccgataaccagaagtccaccgaggaggttgatatgaagaacatcaatatggataatgatcttgaagtgctgaccagcagcccaaccaggaatctgaatggggcatacctgaccgaaggtagcaatggcgaagttgacatatccaacgggttcaagaacctgaacctaaacgccgctctccaccccgacgagataaatatcgagattctgaacgactcacatactcccggtaccaaggtttacgaagtcgttaatgaggatcccgaaacagccttctgtaccctggctaacagagaagttttcaacacagacgagtgttccatccaacactgcttataccaattcacaagaaatgagaagttaagagatgccaacaagctcttatgcgaagtgtgcacgcgcaggcaatgcaatggccctaaggcaaacataaagggggaacggaaacacgtatatacaaatgccaaaaaacaaatgcttatatcactggcgccacctgtgctaacgctgcacctgaagcggtttcagcaggcaggatttaaccttcgaaaagtgaacaagcacataaagttcccggaaatcctggacctggctcctttttgcacccttaaatgtaaaaatgtcgctgaggagaatactcgtgtgctctattcactttatggcgttgttgaacactccggaacaatgcgatccggacattacactgcgtacgctaaggctcgaactgcgaactcccacctatctaacctagtgttgcatggagatatcccgcaggacttcgaaatggaaagcaaaggccagtggtttcatatttctgacactcatgttcaggctgtacccaccactaaggttctgaactctcaggcatacctcctgttttatgagagaattctgtag

SEQ ID NO: 28186 - DNA, 3204 bp, Artificial Sequence
  Description of Artificial Sequence: Synthetic coding sequence
atgaattccatggaccgacacattcaacaaacgaacgatcgcctgcagtgtataaaacaacacttacagaatcctgctaattttcacaacgctgcaacagagctgcttgactggtgtggtgaccccagggcctttcagagaccgtttgaacagagtctaatgggctgcctgactgtggtgagtcgcgtcgcagcccaacagggatttgacctcgatctgggatacagactgctcgcagtgtgtgccgctaatcgcgataagttcactccaaagagcgctgcgttactttctagctggtgtgaggagcttggcaggctcctgttgctcagacaccagaagagccggcagagcgatccaccaggaaaattgcccatgcaacccccactgtcaagcatgtcgagcatgaaacccacattgagccactcagatggttcttttccatacgatagcgtcccgtggcagcaaaataccaaccagccgccagggagtctcagcgtggtcacgactgtgtggggcgtgacgaacacctcgcaaagtcaggttctcgggaacccaatggcgaacgctaacaatcctatgaatcctggcggaaacccaatggctagcggtatgactacatccaaccccggattgaacagtccccagtttgctggccagcagcagcagttctccgctaaagcaggtccggcacagccttatatccagcagtctatgtatggaaggccaaattacccgggaagcggcggatttggtgcttcttatcccggagggccaaacgcacccgctggcatgggcatcccaccacacacccgccctcccgcagactttacacagccggcagccgcagccgcagcagctgccgtggcggcagcagctgcaacagccaccgctactgcaaccgctactgttgccgctctccaggagacccaaaataaggatatcaaccagtatgggccaatgggacctacccaggcatataactcccagttcatgaaccaacctggccctcgagggcctgcctccatgggaggcagtatgaaccccgcaagtatggccgctggcatgacgcccagcgggatgtcagggcctcctatgggcatgaaccagccacggcctcccggaatcagtccttttggaacacacggccagcgaatgccacagcaaacgtaccccggacctcgacctcagtccctgcctatccaaaacattaaaaggccatatcccggagagcccaattatgggaatcaacaatatggccctaattcccagtttcctacccagccagggcagtacccagctccaaatccacctcgcccacttacttccccaaactatcctggccagaggatgccctcccaaccttcctcaggccaataccctcctcctactgtgaatatgggccagtactacaaaccagaacagttcaacggccagaataacacattttccggttccagttacagtaactatagtcagggcaatgtgaatagaccccctcgccctgtgcccgtcgctaattacccccactctccagtgcccggtaacccaaccccccctatgactcccggtagcagcatccccccttacctttccccttcgcaagatgtgaaaccgcctttcccgccagatatcaaacccaatatgtccgccttgcctccacctcctgccaaccataacgatgagcttagactgactttcccagtgagggacggcgtggtcttggaaccctttcgcctggagcataatctggccgttagcaatcacgtgttccatctgagacctacagtgcaccagacgcttatgtggcggagcgatttggaactgcaattcaagtgctaccatcacgaagaccgacagatgaacactaattggcccgctagcgtgcaggtgtccgtgaatgccaccccgctcacaatcgaacgaggcgacaacaagacatcccacaaacccctgcatctaaagcatgtttgtcagcccggaaggaacaccatccagattactgtgaccgcatgctgctgctcccacctgttcgtactgcagctcgtgcacaggcccagtgtgaggagtgtccttcagggtttgcttaaaaagcgactgcttccggctgagcattgtatcaccaagatcaaaaggaatttctcaagtgtggcagcttcctctgggaacactaccctgaacggtgaggacggggttgagcaaaccgcgatcaaggtctcacttaagtgtcctataacctttcgcaggatacagctacctgccagaggacatgattgcaaacatgtccagtgtttcgatctggaatcctacctccagttgaattgcgaacgaggcacatggagatgtccagtgtgtaataagaccgccctgttagagggcctggaggtggatcagtacatgtggggaatcctgaacgctattcaacactccgagtttgaggaggtaaccatagaccctacatgcagttggcgcccagtaccaattaagagtgatctacacataaaggacgatccggacggtattccgagcaagcggtttaagacaatgtctccgtctcaaatgatcatgcctaatgttatggaaatgattgccgctctcggtcctggccctagcccataccctctcccccctcctccaggaggaacgaattccaatgactatagttcccagggcaacaattaccagggacacggaaacttcgatttcccacatggaaaccccggtggcacgagcatgaacgactttatgcatgggccaccccagctatcccatccccctgatatgccaaataacatggctgcccttgaaaagccactttctcacccaatgcaggaaacaatgccgcacgcagggtcgagcgaccaacctcatcctagcatccaacaggggctgcatgttccccacccttctagccaatctggccctcctctgcatcatagcggcgctccaccacccccacccagccagcctccaagacagccccctcaggctgcacccagcagtcacccacacagtgatctgacttttaaccctagctcggcactggaggggcaggcaggcgctcaaggtgcaagtgacatgcctgagcctagcttggatctcctgcctgagttaacaaaccccgatgaactcctgtcatacctggacccacccgatctgcctagcaatagtaacgatgacctcctgtctctgttcgagaataactag

SEQ ID NO: 28187 - DNA, 1038 bp, Artificial Sequence
  Description of Artificial Sequence: Synthetic coding sequence
atggacggggaagatatcccggacttcagttcactcaaggaggaaaccgcttattggaaagaactgtccctgaaatacaaacaaagtttccaagaggctagagatgagctggtcgaatttcaggaagggagccgcgaactcgaagccgaactggaggctcagttggtccaggctgagcagaggaatcgggacctacaggcggacaatcagaggctgaagtatgaggttgaggcactgaaagagaagttggaacaccagtatgcccagagttacaaacaggtaagtgtgctggaagatgatctgtctcagacccgtgccattaaggaacagctgcacaaatacgtgagagagttggaacaggccaatgacgatcttgaaagggccaagcgcgcaactattgtgtcgctagaggacttcgagcagcgcctgaatcaagctattgagagaaacgccttccttgagtcagagctcgatgagaaggagtccttgttagtttccgtgcagcggctgaaagatgaagctcgcgacttaaggcaagaactggcagtgagagaaaggcaacaggaggtcacccgcaaatctgcacctagctctcccacacttgattgtgaaaaaatggatagtgcggtgcaggcatccctgtcattacctgctacccccgtaggcaaggggactgaaaataccttcccttctcccaaagccatccccaatgggtttggcacttccccgctgacaccgagtgcgaggatttcagccttgaatatcgttggcgacctgttgagaaaagtaggcgctcttgagtctaaactcgcagcctgtagaaatttcgccaaggaccaggcaagcaggaaaagctacatttccggcaacgtgaactgcggcgtcctgaatgggaatgggaccaagttcagtaggtccggacatacaagtttttttgataaaggtgcagtgaacgggtttgatcccgctcctccaccccctgggctaggcagctcccgtcccagctccgccccagggatgcttccgctctccgtctag

SEQ ID NO: 28188 - DNA, 588 bp, Artificial Sequence
  Description of Artificial Sequence: Synthetic coding sequence
atgggttcgcgagcgagtacactgctcagggatgaggaactcgaggagattaaaaaggagacgggtttcagtcacagccagatcacacgcttgtactcacgcttcactagccttgataaaggcgagaatggcactctatctagggaggacttccagcggattcccgaacttgctatcaaccccctgggagaccgcatcatcaatgcctttttccctgagggtgaggatcaagtgaactttcggggattcatgcgcactctggctcacttcaggcctatcgaggacaatgaaaagtcaaaggatgtaaatggtcctgagcccttgaattctaggtctaacaaactgcatttcgctttccgcctgtacgacctggacaaggatgagaagatctctagggatgaactgctgcaagttctgaggatgatggttggcgtgaatatttcagacgagcaattgggcagcatagctgaccgaactatacaggaggccgatcaggacggcgattcagcgataagtttcaccgagtttgtcaaggtgctagaaaaagtggacgtggagcagaagatgagcatcagatttctacattag

SEQ ID NO: 28189 - DNA, 780 bp, Artificial Sequence
  Description of Artificial Sequence: Synthetic coding sequence
atggccgacgcttgctgcacgaggacttatgttatcgccgcatccaccatgtccgtatgcagctctgatgtgggacacgtgtctcgcgtgtcctctccctcaacctgcactggctcatcttggcaggtggacaactgccaggaaagctgttgtgagccccgatcctgtgcctcaagctgttgcaccccttcctgctgcgccccagctccctgcttggcgctcgtgtgcgctcccgtttcatgcgaacccagcccgtgtcaatctgggtgtacggactcgtgcacgccctcgtgttgccagcaatccagttgccagccggcatgctgcacctcaagcccctgtcagcaagcctgttgtgttcccgtgtgctgtaagtcaaactgctgtaaacccgtatgttgtgtctctatctgctcaggagcgtccagcccttgttgtcagcagagttcctgtcagagcgcttgctgcaccttttctccttgccagcaagcctgttgcgtgccaatctgctgtaagcctatttgctgtgtgcccgtgtgctctggggcatcgtctctgtgctgccaaaagtcttcctgccagccagcgtgctgtaccacatcctgctgccgaccctctagcagcgtgagcctgctgtgccggcctgtctgccgacccgcatgttgtgtgccagttccctcctgctgcgtccctgcatcatcatgtcagccctcctgttgtcatccagcttcatgcctgagttttctctgccgcccagcctgctcccgcttggcttgctag

SEQ ID NO: 28190 - DNA, 171 bp, Artificial Sequence
  Description of Artificial Sequence: Synthetic coding sequence
atgatttattacagcaactactacggcggatacgggtacggtggactgggctgcgggtacggttgcggttatcgcggatatggatgcggctacggcggatatgggggttacggcaacggctactactgcccatcttgctatggtaggtactggagttacggattctactag

SEQ ID NO: 28191 - DNA, 897 bp, Artificial Sequence
  Description of Artificial Sequence: Synthetic coding sequence
atggcagcttctactatgagcgtttgctcttctgcatattctgatagctggcaggttgacgactgtccagagtcgtgttgcgagcccccttgttctgccccaagctgctgcgccccagcaccttccctatccctagtgtgtacacctgtgagctgcgtgtcaagcccttgctgccaggctgcgtgtgaaccttcggcatgtcagtctggatgtacttcttcctgtacaccaagctgctgccaacagtccagctgccaacccgcttgctgtacctctagcccttgccagcaggcatgctgcgtcccagtgtgttgtaagactgtgtgctgtaagcccgtctgttgtgttcccgtctgttgtggggcagcctctagttgctgtaggcagtctagctgccagccggcttgttgtgctagctccagctgtcaacctgcatgctgtgtgcctgtgtgttgcaaaccggtgtgttgtgttagcacatgctctgaggacagttccagctgctgccagcaatcttcatgtcagcctgcttgttgtacctcaagctcttaccagcaggcttgttgtgtgcctgtctgctgtaaaaccgtgtactgcaaacccatatgctgtgttccagtctgtagccgagccagctcaagcaggtgtcaacagccctcctgccagccagcatgttgtacgacatcgtgttgtaggcccagctctagcgtgtctcttctctgtcaccccgtctgccggtccacatgctgtgtgcccgtgagctcatgttgtgctccaacttcatcttgccagagttcctgctgtcgccctgcctcctgcgtgtccttgctgtgtaggccagcctcaagccggttggcatgttactcattgtgcagcgggaagaaatccagttgttag

SEQ ID NO: 28192 - DNA, 567 bp, Artificial Sequence
  Description of Artificial Sequence: Synthetic coding sequence
atgactgctccatcatgcgcgtttccagtgcagtttcggcagccatccgtgtctggtctttcacagatcaccaagtccttatatatttccaatggcgtcgctgccaacaacaagctgatgctgtccagcaatcagataacgatggtcattaatgtgtccgtggaagttgtgaacactctctacgaagacattcagtatatgcaggttcctgttgccgactcccctaattcgaggttgtgcgactttttcgaccctatcgcggatcatatccactcggtggaaatgaagcagggacgaaccttgctgcactgtgcagcaggtgtcagcagatccgccgctctctgtctcgcatacttgatgaagtaccatgccatgtccctgctggatgcacacacttggacaaaatcatgtcgaccaattatacgacctaactccggattctgggaacagctgatccactacgaatttcagcttttcggtaaaaacaccgtacatatggtctcttcccctgttggaatgatacctgatatatacgagaaggaagtccgcctaatgattcccctctag

SEQ ID NO: 28193 - DNA, 147 bp, Artificial Sequence
  Description of Artificial Sequence: Synthetic coding sequence
atgagcttcgacaacaactaccacgggggtcagggttacgctaagggcggattaggctgctcatacggatgcggccttagcggctatggctatgcgtgctattgcccctggtgctacgagcgatcctggttctccgggtgcttttag

SEQ ID NO: 28194 - DNA, 192 bp, Artificial Sequence
  Description of Artificial Sequence: Synthetic coding sequence
atgagctattctggatcatattacggtggcctggggtatgggtgcggaggattcggaggacttggttacggctactcctgtggttgtgggtccttcagaagactgggttacggctgcgggtacgggggttatcgctacagctgctgccatccatcatgctatggcggatattggtcttccgggttttattag

SEQ ID NO: 28195 - DNA, 189 bp, Artificial Sequence
  Description of Artificial Sequence: Synthetic coding sequence
atgtgtggaagctattatggtaactactacggagaccatggctacgggtgttgtggctacgaggggctcggatatggttacgggtccctcaggtgtggatattctagctgctgtggctacggccatggatacggctctaggtttttctgtggatgcggatacgggtgtggatcgggctattactactag

SEQ ID NO: 28196 - DNA, 4227 bp, Artificial Sequence
  Description of Artificial Sequence: Synthetic coding sequence
atgtggtcccttaccgcctccgaaggggaaagcacaactgcgcacttttttctcggcgcaggcgatgaggggctcggaacgagggggatcggcatgcgcccagaggaatctgactcggagctgctcgaagatgaagaggacgaggtaccgcctgagcctcagataattgttggaatatgcgccatgacaaagaaatccaagtcaaagccgatgactcagatcttagagagactctgtcgcttcgactatcttacagttgtaatcctcggagaagacgtgatcttgaacgaacctgtcgagaattggccttcctgccattgtctcatttcttttcacagtaagggcttcccgttggataaagctgtcgcctacagtaaactgcgaaatccttttttgatcaacgacctggccatgcagtattatatccaggaccgcagagaagtttatcgtatcttacaagaggagggcatcgacctccctcggtatgccgtgttgaaccgcgacccagctagacccgaagagtgtaacctgatcgaaggcgaagaccaggtcgaggtgaatggggctgtgtttccaaagcccttcgtcgagaagcccgtgtcagctgaagaccataatgtctatatctactatccaagctcagctgggggaggctcccagagactgtttcggaagattggatccagatcaagcgtatatagtccagaatcatcagttaggaaaaccggaagttacatctatgaggagtttatgcctacagacggaactgacgtgaaggtgtacaccgtcggccctgactatgctcatgctgaagcgaggaagtcccctgctctggacggaaaggtggagcgcgatagtgagggcaaggagataagataccccgttatgttaactgcaatggaaaaacttgtcgcacgcaaagtgtgcgtagccttcaaacagacagtctgcggattcgacctgctccgtgctaacggtcactccttcgtgtgtgatgttaatggattctcctttgttaaaaacagcatgaagtactatgacgactgcgcgaaaatactcgggaatacaatcatgagggaactcgctccccaatttcagattccttggtctatccccactgaagccgaagatatccccattgtgccaacgacatctggtaccatgatggaactacgctgcgtaattgctataattcgccacggtgaccgcactcctaaacagaagatgaagatggaggttaaacatccgagattcttcgcactgtttgagaaacatggcggatataaaacaggcaagctgaaactgaaacgaccagaacaactccaggaggttttggatataacccgcctgcttcttgccgaactagaaaaggagcctggcggagaaatcgaagaaaagaccggcaagctcgagcaattgaaaagcgtgctggagatgtacgggcatttctccggaataaaccggaaggtgcagctcacctattatcctcacggtgtcaaggcctcaaatgaaggccaagacccacagagagagactttggccccttcactgctgctcgttctgaaatggggtggtgaactgaccccagctggccgagtgcaagctgaggaactgggccgagcatttaggtgtatgtatcccggagggcagggagactatgcaggatttcccggttgcggactcctgcggctgcatagcacattccggcacgatctcaagatttacgcgtcagatgaaggcagggttcagatgacagccgcagcctttgccaagggtttgctggctctggaaggggaattgacgccaattttggtccaaatggtgaagagcgcaaacatgaacggccttctggatagcgacggggatagcttgtcctcatgtcagcatcgggtgaaagcaagattgcatcatattttgcagcaggatgccccttttgggcctgaagattacgatcagctcgcccctactcggtccacttctctgctgaacagcatgacaatcatccagaatccagttaaggtttgcgaccaggtgtttgcactaattgagaatctgacccaccagatcagagaaaggatgcaggacccccgatctgtcgacctgcagctgtaccatagtgagaccctagagctgatgcttcagcgctggtctaagctggaaagggatttccggcagaaatccggaagatacgatatttctaaaatccccgatatctacgactgtgtcaagtatgatgtgcagcacaatgggagtttaggactccagggcacagctgagctgttacggttgtcaaaggccctggccgacgtcgttatcccacaggagtacggcattagtcgcgaggaaaaattagagatcgcggtggggttctgcctccccctgctacggaaaattctgttggatctgcaacggacacatgaagacgagtcagtcaacaaactccatcctctgtactctcggggagtgctctctccgggtaggcacgtgcggacccgcctttactttaccagtgaatcccacgtccattccctcctaagtgtctttagatacggaggcctgctggacgaaacacaggacgcacagtggcagcgggcactcgattacctttcagccatctcggaactgaattacatgacacagattgttatcatgctctacgaagacaatactcaggatccactgagtgaggagaggtttcatgtcgaactccattttagcccgggagtaaaaggtgtcgaggaagaaggcagtgcccctgccggttgcggattcaggccagcgtccagcgagaacgaggaaatgaagacaaaccagggatctatggagaacctctgccccggtaaagctagtgacgaacctgacagagccctccagacatctccgcagccacccgagggcccaggtttgcccagaagaagcccgctgatcaggaataggaaagccggatccatggaagttctgtcggagacatcatcttctaggcccggagggtatcgcctgttctcctcttccaggcccccaaccgaaatgaaacaatccgggctggggagccaatgcaccggcctcttttccacaactgtcttggggggatcatctagcgcgccaaacctgcaggattacgcgcgaagtcacgggaagaaactgccaccagccagccttaaacaccgcgacgggtttgagggctgttcaatggtcccaactatttatcctctggagacacttcataatgctctgagtctgcgtcaggtgagcgagttccttagcagagtctgccagcggcacaccgacgcccaggcccaggcgtctgcagctttgttcgactccatgcatagcagtcaagcttcagacaatccttttagcccaccacggaccctgcacagccctcctttacagttgcaacagcgcagtgagaagcccccatggtactctagcggtcctagcagtaccgtcagcagtgcaggtccatctagccccaccaccgtcgacggcaattcccagtttgggttctcagatcagccctctttgaactctcatgtggctgaggaacatcagggcctgggcctgcttcaggagacgcccggtagcggagcccaggagctctcaatcgagggggaacaggagttattcgagcccaaccagtcgccccaggtccccccaatggagacctcacagccctacgaggaagtgtcccaaccgtgccaggaagtacccgacatcagtcaaccatgccaggacatctcagaggcactgagccagccatgccaaaaggtgccagacatcagccagcagtgtcaggagaaccacgacaacgggaaccacacatgccaagaggtgccccatatctcccagccatgtcaaaaatcttctcagctgtgtcagaaggtttctgaagaagtgtgccagctgtgccttgagaactcggaagaggtgtcccaaccctgccagggggtctcagtagaggtcggaaagttggtgcacaagtttcacgtcggtgtcggctcattagtgcaagagactctcgtcgaggtgggatctccagcagaagaaatcccagaagaggtgatacagccctaccaggaattttcagttgaggtgggacggcttgcccaggagactagcgcaatcaaccttctgtcccaggggatacctgaaatcgataaaccttcccaagagttcccagaagaaatagatctgcaagcgcaggaggtgcccgaagaaattaactag

SEQ ID NO: 28197 - DNA, 705 bp, Artificial Sequence
  Description of Artificial Sequence: Synthetic coding sequence
atggagggcgcttcccgcaaccttgcttccactccacgggtgcacgccaaggtcatgatgtacagaaaggaacagtacttggacgtgctccacgccctgaaagtggtgagattcgtgtccgacgccactccccaggcggaagtttacctgagaatgtaccagctggagtccgggaagctgcctcgttctccttccttccccctcgagcctgacgacgaggtgttcctggccatcgcgaaggcgatggaggagatggttgaagattccgtggattgttactggatcacccgcaggtttgtcaaccagcttaacaccaagtaccgcgactccctgccacagttaccgaaggctttcgaacagtacctgaacctcgaggatgggagactccttacccatcttcgcatgtgttctgcagctccaaaattaccctatgatctgtggttcaaacgctgctttgccggttgcttacccgagtcatcactccaaagagtctgggacaaagtggtgtctggcagttgtaaaattttggttttcgtggctgttgagatcctactgacttttaagataaaggtgatggcactgaatagcgcagaaaagatcacgaaattcttggagaacattccccaagactctagcgatgccatagtgtcaaaggccattgatctctggcacaaacactgtggcactccagtccattcaagctag

SEQ ID NO: 28198 - DNA, 537 bp, Artificial Sequence
  Description of Artificial Sequence: Synthetic coding sequence
atgaccacactgcgcgctttcacgtgcgacgacctatttagatttaacaatattaatctcgatcccttaaccgagacatacggcattccattttatctgcaatatcttgcccattggcctgaatacttcatcgtcgcagaggcacccggtggggagctcatggggtacattatgggtaaggccgagggatctgtggctagagaggaatggcatggtcacgtaaccgctctatcagtggcccctgaatttcggcgactcggcctagctgctaagctgatggaactgctagaagagatcagtgagaggaaaggtgggttcttcgttgatctctttgttagggtgagcaatcaggtcgccgttaacatgtacaagcagctaggatactccgtctaccgtacagtcatcgagtactatagcgcctccaacggggaaccagacgaggacgcctatgatatgaggaaggccctctccagagataccgaaaagaaatcgatcatcccccttccacatcccgtgcggcctgaggatatcgagtag

SEQ ID NO: 28199 - DNA, 2373 bp, Artificial Sequence
  Description of Artificial Sequence: Synthetic coding sequence
atgggaacgaggaaaaaggttcatgcatttgtgagggtgaagccaactgatgattttgcccatgaaatgattagatacggagatgataaaagatccattgacatccatctgaagaaggatattaggcgcggagtcgtgaacaatcagcagacggactggagctttaaattagacggtgttctgcatgacgccagccaagatctcgtgtacgagaccgtggctaaggacgttgtgtctcaagcgttggatggttacaacggaaccataatgtgttacggtcaaactggtgctggaaagacctatacaatgatgggcgcaacggagaattacaagcatcggggaattttgcctcgggctctccagcaggtgtttagaatgattgaggagagaccaacccacgcaattacggtgagagtgagttatctggagatctacaatgagagcttgttcgatttacttagcactctgccttacgttggtcctagtgtgaccccgatgaccatcgttgaaaatccacagggagttttcataaagggattatcagttcatttaaccagtcaggaagaagacgcattctccctgttattcgagggtgagaccaaccggattatcgcctcgcacacaatgaataagaatagcagccgatcacactgtatattcaccatatacttggaggcacattcgaggactctatctgaagagaagtatattacctctaagatcaacctcgtggatctggctggatcagagcggctcggcaagtccggctccgagggacaggtcctcaaagaggcgacctacatcaacaagtccctgagctttctggaacaggcgattatcgcattaggagaccagaaaagggatcatataccattcagacagtgcaagctaacacatgctttaaaggacagcctgggcggaaattgtaacatggtactggtaaccaacatttacggagaggctgcacagctcgaagagactctgtcttctttgaggttcgcctcaagaatgaaattggtgaccaccgaaccagctatcaacgaaaaatacgacgccgagcgcatggtgaagaaccttgaaaaggaactggctctcctcaaacaagaactggccatccatgattctcttaccaacagaacattcgtgacttacgatccaatggacgaaatccagatagctgagatcaactcgcaggtgcgaaggtatcttgaaggaacacttgacgaaatcgacattatttctctgaggcagattaaagaggtcttcaatcagtttagggtggtgctgagccagcaggagcaggaagttgagagcactctcaggcgcaaatatacactcattgatcgtaacgactttgcagctattagcgcaattcagaaggctggtctggtcgacgtggacggtcacctggtgggcgagcccgagggtcagaatttcgggcttggcgtggccccattcagcaccaagcctggaaagaaggccaagagcaaaaaaacgtttaaagagcctctgagctcactagcccgtaaggagggcgcaagtagcccagtgaacggaaaagatttagactatgtctccaccagcaaaactcagctggtgccttctagcaaggacggcgatgttaaagacatgctgtctcgtgaccgcgagaccagttcaatcgagccattgcccagcgatagtccaaaagaggagctccgcccaatccgcccagataccccccctagcaaacccgtggcctttgaggagtttaagaatgaacaaggttcagaaattaataggatcttcaaagagaacaagagcatactgaatgaacgccgtaagcgtgccagcgagactactcagcatataaatgcaatcaaacgagaaattgatgtgaccaaagaagccctgaacttccagaagagcctgagagagaaacaaggcaagtacgaaaacaaagggctgatgatcattgatgaagaagaattcctccttatcttaaagctgaaggacctgaagaagcaatatcggagcgagtatcaagacctcagagacctgcgcgcagagatccagtactgccagcaccttgtggaccagtgtagacaccgcttgctcatggagttcgacatttggtataacgagagcttcgttatcccagaggacatgcagatggcactgaagcccggaggatccatcagaccaggcatggtacccgtaaaccgtatcgtctctctcggggaagacgatcaggacaaatttagccagctgcaacaaagagtgttgccagagggtccagactcaatctcattctataacgctaaggtcaagattgagcagaagcacaattaccttaagaccatgatgggcctgcagcaggcacatcgaaagtag

SEQ ID NO: 28200 - DNA, 3588 bp, Artificial Sequence
  Description of Artificial Sequence: Synthetic coding sequence
atgtggtccctgaccgccagtgaaggggagtcaactaccgctcacttctttctgggagcgggagacgagggtctggggacccggggtatagggatgcggcctgaagaaagtgactcggaacttctggaagacgaggaggacgaggtgccacctgagccacagatcatcgtgggaatttgtgctatgacgaagaagtcaaaaagtaagccaatgacgcagatcctagagcggttgtgtaggttcgactacctgaccgtggtaattcttggcgaagatgttatccttaacgagcccgttgagaactggccaagctgtcactgcctgatcagcttccacagcaaaggctttccattagacaaggctgtggcctactcaaaactgagaaatccctttctgataaatgacctggctatgcagtactacatacagggtgaccgccgtgaggtttaccggatattgcaagaggaaggcattgacctgcctcggtacgccgtgctgaatcgagatcccgcacgtccagaagaatgtaacctcatcgaaggggaagatcaggtggaggtgaatggagcggtattcccaaagccctttgtggaaaagcctgtcagcgccgaagaccataatgtgtacatttactatccctctagcgccggtggtggctcacagcgtctgtttcgaaagataggctcacgaagttcggtgtattcaccagaaagctccgtgagaaagaccggaagctacatttacgaggagttcatgccaactgacgggacagatgtgaaggtctacaccgtgggccctgactacgcccacgccgaggctcggaagtcgcctgcactcgacggaaaggttgagcgagatagtgaagggaaggaaatcagatatcccgtgatgctcactgccatggaaaaacttgtggccaggaaggtgtgcgtcgcattcaaacaaaccgtctgtggctttgaccttttgagggctaacggccattccttcgtatgtgacgtcaacggattctcttttgtgaaaaactccatgaaatattatgacgattgcgccaagattctcggcaacactattatgcgggagctggctccacaatttcaaattccttggtccatccccaccgaggcagaggacatccctattgtgcccacaacatctggaacaatgatggagcttagatgtgttatagcgatcatccgtcatggtgaccggaccccaaaacaaaaaatgaaaatggaagttaaacatcccagattcttcgccctttttgaaaagcacggcggttacaaaaccggtaaattaaaactgaaacggcctgaacagttgcaggaagtgctggacatcaccaggctgctgctggccgagctcgaaaaggagccaggtggagaaatcgaggagaagacagggaaattggaacagcttaaatctgtgctggaaatgtatggccacttttctggcatcaatcgcaaagtccagctcacctactacccacacggcgttaaggccagcaatgagggccaggatcctcagagagagacacttgcaccatcactactcctggtcttaaagtggggtggcgaactgacgcctgctgggagagtgcaggcggaagaactcggacgggctttccgatgtatgtatccaggaggccaaggagattatgccggattcccgggatgcggattactgcgcctccactcaaccttccgtcacgaccttaaaatttacgcaagcgatgaagggagagtgcaaatgaccgcagccgcatttgctaagggcctcctggccctggagggggaattgacacctatcctagtgcagatggtgaaaagcgcaaacatgaacgggctgcttgacagcgacggcgacagcttatcaagttgccagcaccgggtaaaggccaggttgcatcatatccttcagcaggatgccccattcgggccagaggactatgatcagctggccccaacacgctctacctcactactgaattctatgacaattatacagaacccagtcaaagtctgcgaccaggtgttcgccctgattgaaaacctgactcaccagattagagagaggatgcaggaccctagatctgtggatctgcagctgtaccattctgagacactggagctgatgcttcagaggtggagcaaactggagagagacttccgacagaaatcaggccgatatgatatcagcaagatccctgatatctatgactgcgtgaaatatgacgtgcagcacaacggcagcttgggattgcagggcacagccgaactgctcaggctgtccaaggctctagccgacgtcgtaataccacaggaatacggcatctcacgagaagagaagttagagattgcagtgggcttttgcctcccattgctacggaagattctgctcgaccttcagaggacccacgaagatgagtacagccggggagtcctctcccccggacgacatgtgcgcacgcgtctatactttaccagtgaatcccacgtgcactccctgttgtctgtctttcgctatgggggtctgttggatgaaacccaagatgccgaccgggcactgcagacctctcctcaaccccctgagggacctgggttgcctcggaggagcccattaatacgcaacagaaaggctggcagcatggaagtgttgagcgaaacgtcgtcatcccgacccggagggtatcggctcttttcctccagccgcccaccaacggagatgaaacaatcgggcctgggcagtcagtgcactggcctgttcagcactacggtgctagggggtagttcgagcgcacccaacctgcaggattatgcgcgttcgcatggcaagaagcttccgccagcctccctcaagcaccgggatgaacttttgttcgtgcccgctgtgaagagattctcggtgtcattcgcgaaacacccgacgaatggctttgaaggctgctcaatggttcctacaatttatccacttgaaaccttgcacaacgccctcagtctgcggcaggtgccccctatggaaacctcccagccctatgaggaggtgagtcagccatgtcaggaagtgcccgacatctctcagccttgtcaggatatctcagaggctctttctcagccgtgccagaaggtccctgatatttcacagcagtgtcaggaaaatcacgataatggtaaccatacctgtcaggaagtgccacacatttctcagccctgtcaaaaaagctcacaactgtgccagaaagtgagtgaggaagtctgccagctctgcctggagaactcagaagaagtttcccagccgtgtcagggagtcagcgtggaggtggggaaactggtacataaatttcacgtaggcgttgggagcctcgtgcaagagaccctggtagaagtgggaagtccagccgaagagatccccgaggaagttatccagccttatcaggagttttctgtcgaggttgggcgattggcacaagagacaagtgctatcaatcttctgtcccaaggtatacccgagatcgataagccaagccaggagtttccagaagaaatcgatctccaggctcaggaggtgccagaagaaattaactag

SEQ ID NO: 28201 - DNA, 240 bp, Artificial Sequence
  Description of Artificial Sequence: Synthetic coding sequence
atgtgctgtaactactacgggaatagctgcggatacgggagtggatgtgggtgcgggtatgggagtggtagcggttgcgggtgtggctatgggactggatacgggtgtggatatggttgtggattcggatcccattacggctgcggctatggaacaggttatgggtgtggctatgggtcaggaagcggttattgtgggtatcgtccattttgctttagacgctgttacagtagttgctag

SEQ ID NO: 28202 - DNA, 1767 bp, Artificial Sequence
  Description of Artificial Sequence: Synthetic coding sequence
atgaagctcgagtttaccgagaaaaactacaattccttcgttttacagaacctcaaccgccagagaaaacggaaggagtactgggatatggcactgagtgtggataatcacgtctttttcgcccataggaacgtgctggccgcagtaagccccctggtacgatccttgatctcctctaatgacatgaagactgctgacgagttgttcataactatagacacgtcttatctgagccccgtgaccgttgatcaactgctagattacttttattccgggaaagtcgtgatctctgagcagaatgtcgaagagctgctgcgaggcgcacagtactttaacactcccaggctccgcgtccactgcaatgatttcctgattaaaagcatttgtagggccaattgtttgcgctatctctttctcgcagaactcttcgaactaaaggaagtctcagatgtggcctatagcggaatccgcgacaactttcattattgggctagtcctgagggatcaatgcatttcatgcggtgtcccccagtgatatttggccgactcctgagggatgagaatctgcacgtgcttaatgaggatcaagccctctccgcactgatcaactgggtgtactttcgaaaagaggacagagagaagtactttaaaaaattctttaattacataaacttgaacgctgtaagcaataagacgctggtgttcgcttcaaacaagctggtgggtatggagaatacctcatctcatacgacgcttatcgaatctgttctcatggatcgcaagcaggagcgaccgtgtagcctgctggtgtaccaaagaaaaggcgcactcctagattccgtggtgattctgggaggtcagaaggcacacggccaattcaatgacggagtcttcgcttatatcatccaagagaatctgtggatgaagctcagtgatatgccctaccgcgctgctgctctatccgccactagcgccggacggtacatttacatcagcggagggacaaccgagcagattagcgggcttaagaccgcgtggagatacgatatggatgacaactcatggactaagctgcctgacctcccgatcggtttggtgttccatacgatggtgacctgcggtggaacagtctacagtgtgggtggctctatagccccacggcgatatgtctcaaacatatacaggtacgacgaacgcaaggaagtctggtgtctggccggaaagatgtccattcctatggacggaaccgccgtgatcacaaaaggggaccgccacctgtatattgtgacaggacgctgtttagtgaaagggtatatcagtcgggtcggagtggttgattgcttcgacacaagcacgggcgacgttgtacaatgtattacttttcctattgaattcaaccataggcccctgctgagttttcagcaggacaatattttatgtgtgcacagtcatagacaaagtgtcgagataaatctgcagaaagtgaaagcttcaaagaccacaacgagcgtccctgtgctgccaaactcttgccctcttgatgttagccacgccatctgctctatcggcgattctaaggtgttcgtctgtggcggagtgacgacagcgagcgatgtccagactaaggactatacgattaacccaaacgccttcctcttggaccagaaaacaggcaaatggaagactttagctccgccacccgaggccttggactgccctgcctgctgtctggcgaagctgccttgcaaaatcctgcaaaggatctag

SEQ ID NO: 28203 - DNA, 2208 bp, Artificial Sequence
  Description of Artificial Sequence: Synthetic coding sequence
atgattccccctcaggaagctagcgccaggcgccgtgagatcgaagacaaattaaagcaggaggaggagaccctgtctttcatcagggattccctggaaaaatctgatcaactgacaaagaacatggtctcaatccttagcagctttgaaagcaggctaatgaaactggaaaattcaatcattcccgtccataagcagaccgagaaccttcagaggttgcaggaaaacgttgagaagacactttcgtgccttgaccatgtgatcagttattaccacgttgctagcgataccgaaaaaattattcgcgagggtccgaccggtagactggaggagtatttgggctctatggccaagatccagaaggccgtggaatattttcaggataattcgcccgactcacctgaactcaacaaagtgaagctgctgtttgagcgcggaaaggaagcgctggagtctgagtttcggagcctgatgacacgtcacagcaaggtggtttccccagtgttgattctggacctaatcagcggagacgatgacctggaggcacaggaggatgtaaccttggagcaccttcctgagagcgtcctgcaagacgtcatcagaatatctaggtggcttgtggagtacggtcgaaaccaagattttatgaatgtttattaccaaatcaggtctagccagttggatcgcagcattaaagggttgaaagaacactttcacaaatcgtcttcctcatcaggggtgccatactcgccggctattcccaataagcgcaaagatacccctaccaagaagcccgttaaacgtcctggaacgatcagaaaagcgcagaatttactgaagcaatactcccagcacggcctggatggtaagaagggtggctcaaacctgattcccctcgaggggctgctcccctgcacccctagaggagggctgcccggaccgtggatcaatgccgcatgtgtgtgcgcagctgatatctctcccggacacgagcatgattttagggtaaaacacttatcagaagctctcaacgataagcacggcccacttgctggacgcgatgatatgctcgatgtcgagacggacgcatatatccactgtgtgtcggctttcgtaaagttagcacagagtgaatatcagcttctggccgacatcatccctgagcaccaccagaagaagacctttgacagtctaatccaggacgcgctcgacgggctgatgcttgaaggagaaaacattgtgagcgccgctcgaaaagccatagttcgacacgacttttcaaccgttctcacagtgttccccatcttgagacacctgaagcaaaccaagcctgagtttgatcaagtcttgcagggcaccgcagcctctaccaaaaataaattacctggcttgatcacaagcatggagacaataggtgccaaggccctggaggatttcgccgacaatataaagaatgatccggacaaggagtacaacatgcccaaggacggaactgtgcacgagctgacctctaacgccatcctgtttttacagcaactgttggattttcaagagactgccggagcgatgctggcctcacaggagacatcaagttcggctacctcgtattcaagcgagttctcgaagcgtttactatccacctacatatgcaaagtgctgggtaacctgcagctgaacctcctaagcaagtccaaggtgtacgaggatccagctctgtctgcaatctttcttcacaacaactataactacatcctgaaatcactggaaaagagcgagctaatccagctggttgctgtgactcagaagacagcggagagaagttaccgagagcatatcgagcagcagatccagacgtaccagaggagttggctgaaagttaccgattatattgctgagaagaatctgcccgtgtttcagcccggtgtcaagttgcgcgataaagaacggcagataatcaaagaacggtttaagggattcaatgacggtctggaggaactgtgtaagatccaaaaggcttgggccatcccggatacggaacagagagaccgtattagacaggcacagaaaacgattgtgaaggagacctacggagcctttctgcaaaagtttggcagtgtgccattcacaaagaacccagaaaagtatattaagtatggtgttgaacaggtcggtgatatgattgacagacttttcgacacttctgcctag

SEQ ID NO: 28204 - DNA, 378 bp, Artificial Sequence
  Description of Artificial Sequence: Synthetic coding sequence
atggccggtgccggacctactatgcttctgagagaagagaacggctgctgctcaaggaggcagagcagcagtagcgccggagattctgacggcgaaagagaggattctgcggcagagagagctcgtcagcagctcgaggccctgctgaacaagaccatgcgcatacgtatgacagacggacgaaccctggtaggatgcttcttatgtactgacagggactgtaatgtgatcctgggttcagcccaagagttcctgaagccaagcgactctttctccgcaggagaaccccgtgttcttggcctggccatggttcccggacatcatatagtctctatagaagtgcaacgggagtcacttactggtcccccatacctgtag

SEQ ID NO: 28205 - DNA, 477 bp, Artificial Sequence
  Description of Artificial Sequence: Synthetic coding sequence
atgcttctgttggattgtaatccagaggtcgatgggttgaagcaccttctggaaaccggagccagtgttaatgcacccccagacccatgtaagcagtctccggtacacctggcggctggcagcgggctcgcttgtttcctgctttggcagctccaaacgggcgctgacttgaatcagcaggacgtcttgggtgaagccccactgcacaaggctgcaaaggttggctccctcgagtgcctttctctcctggtcgcttcggacgcccaaatcgatctgtgcaataagaatgggcaaacagccgaggacttagcttggtcgtgcggcttcccagactgtgctaaattcctgaccactataaagtgtatgcagactatcaaagcgagcgaacatcctgatcgcaatgattgcgttgccgtgctcagacagaagcgttctttgggctctgtagagaacaccagcggtaaacgcaagtgttag

SEQ ID NO: 28206 - DNA, 8711 bp, Artificial Sequence
  Description of Artificial Sequence: Synthetic coding sequence
atgcgcggtcgacgaggcagacctcccaagcagccagccgctcccgctgctgaaagatgtgcacctgcacctccaccaccaccgccaccgccaacctctggacctatcggtggcctaaggtcccggcacaggggctcaagtagaggaaggtgggcagcagcccaggccgaggtggcccctaagacacgattatcaagtccccgaggcggttctagcagccggcgtaagccacctcccccaccccctgctccaccttctacatctgccccaggaagaggcggacgtggcggaggcggtggacgtacggggggtggcggtgggggtggacatctagcaagaactaccgctgccagaagggccgttaacaaggttgtgtacgatgatcatgagtccgaggaagaagaggaggaagaggacatggtgtccgaagaagaagaggaagaagacggagatgccgaagagactcaggattcggaggacgatgaggaagatgaaatggaagaggacgatgacgattctgactaccccgaggagatggaggacgacgacgacgacgcatcctattgcaccgaatccagctttcgatctcattccacttactcgagcacccccggaagaagaaaaccaagggtacatcgacccagatcccccatactggaggagaaggatataccccctcttgagttcccgaaatccagcgaagatctgatggtcccgaacgagcacattatgaacgtgattgccatttatgaagtgctgcgcaacttcggaactgtactgcgcctgtccccattcaggttcgaagacttttgcgctgcgctcgtttcccaggaacagtgcacgttaatggcagaaatgcatgttgtgttgctaaaggccgtcctgcgcgaagaggatacatccaacaccacgtttggtcctgcagatctaaaggatagcgtgaactccaccctgtattttattgacgggatgacttggccggaggtattaagagtgtactgtgagagcgacaaggagtaccaccacgtactgccctaccaggaggctgaggactacccttacggacccgttgagaataaaattaaagtactgcagttcctcgtggaccagttcctgactactaacattgcaagagaggagctgatgagtgaaggggttatccagtatgatgatcattgtagagtctgtcataagctgggcgatctgctatgctgcgagacatgtagcgccgtctaccacctggagtgcgtcaaaccgcctctggaagaagtccccgaggatgagtggcagtgcgaagtttgtgtcgcccacaaggtgcctggagtgaccgactgtgtggccgagatacagaaaaataaaccctacatcagacatgaacccatcggttatgacagaagtcggaggaagtattggtttctgaacagacgcctgatcatagaggaggatacagagaacgagaacgaaaagaaaatctggtattactctactaaagttcagcttgctgaactgattgactgcctggataaagactattgggaagccgagctatgcaagatactggaggagatgcgggaggaaattcacaggcatatggacattacagaagacttgacgaataaagctcgagggagtaacaagtcatttctggctgctgcaaatgaggaaatattagagagcattcgcgctaagaagggggacattgataacgtcaagtctcctgaagaaaccgaaaaagataagaacgaaaccgagaacgatagcaaggacgccgagaaaaacagagaagaattcgaggatcagtccctggaaaaggactcagacgacaagacacctgatgatgatcctgagcagggtaagtccgaggagccaaccgaagtcggggacaaggggaattcagtgtcagcaaacctgggggataacacaacaaacgcaacctctgaggagacttcaccatccgagggaaggtccccagtgggctgcctgagcgagacccctgattcatcaaatatggctgagaaaaaagtcgctagtgagctgccccaggatgtgccggaggagcccaataagacctgcgaatctagcaatacaagtgcaactacaactagcatacagcccaacctcgaaaattcaaacagcagctctgagctgaactccagccaaagcgaaagtgctaaggctgctgacgatccagaaaacggggaacgcgagtcacacacacccgttagcatccaggaggaaattgtcggagactttaagagcgagaagtcaaatggagagctgtccgagtccccgggtgctgggaagggtgcctccgggtctaccaggattatcacccggctgcgcaacccagactccaagctgtcccagttaaagagccagcaggttgccgctgccgcacatgaggccaataagctgttcaaagagggaaaagaagtgctggtggtgaactctcagggcgaaataagtaggttgtcaaccaagaaggaggtaattatgaaggggaacataaataattactttaaactgggccaggaagggaagtacagggtgtatcacaaccaatactccacaaattcattcgcactgaacaaacaccagcaccgggaagaccacgacaaacgacgccatctggcccacaagttctgcctgaccccggctggcgaattcaagtggaacggatcagttcatggatcgaaagtgctgacaatctccactctccgactcaccataacccagctggagaacaatatcccttcatctttcctccatcccaactgggcatctcatcgcgctaactggataaaggcagtacagatgtgctccaagccaagagagtttgcattggccctggctatactggagtgcgccgttaaacccgtggtaatgctccccatctggcgggagtctctgggacacactagactccatcgtatgacctcaattgagcgggaagaaaaggaaaaagttaagaaaaaggagaaaaaacaggaggaggaggagactatgcagcaggcgacctgggtgaagtataccttcccagtcaaacatcaggtgtggaaacagaaaggcgaggagtacagggtcactggctacggcggttggtcctggatcagcaaaacacatgtctacagattcgtgcctaagctccccggtaacacaaatgtaaactatcgcaagtctctggaaggaactaagaacaatatggacgaaaacatggatgagtccgacaaacgaaaatgctccagaagcccgaagaagatcaagatcgaacctgattccgaaaaggatgaggttaaggggtcagatgcagcgaagggggctgaccaaaacgaaatggacatcagtaagattacagagaagaaggaccaagacgtaaaggaactgctcgactctgactccgacaagccctgtaaggaagagccgatggaagttgacgatgacatgaaaacagagagccacgtgaactgccaggagtccagccaggtggatgtggttaacgtgtccgagggtttccacctgcggaccagttataagaagaaaaccaagtcgtcaaagctggatgggctcctggaaaggaggatcaaacagttcaccctcgaggagaaacagcgactcgaaaaaattaagttggaggggggaatcaaaggtataggaaaaactagcaccaacagttccaaaaatctttcagagtcgcctgtgatcacaaaggccaaagagggttgccagtctgatagcatgcgtcaagagcagtcccctaacgccaacaatgatcaacccgaggatctgattcagggttgtagcgagtcggactcatccgtgctacggatgtcagacccaagtcacaccacaaacaagctctacccaaaagatagagtgcttgacgatgtgtccatccgctcaccggaaactaaatgccctaaacagaatagtattgaaaatgatatagaggagaaagtctcagacttagcgtcgcgcggtcaagagccttcaaagtcaaagaccaagggcaatgatttttttattgatgattcaaagctcgcaagtgctgatgatattggtactttgatttgcaaaaacaagaaacccctgatacaggaggaatccgatacgatcgtgtcatcctccaagagcgccctgcattcatctgtgcccaagtccacaaatgaccgggacgctactcctctttcccgggcaatggactttgaaggcaagttaggctgtgatagcgaatcaaacagcaccctcgagaacagcagcgacactgtctctatccaagactcctctgaggaggatatgatagttcagaacagtaatgaaagcatctcagagcagttccgtacgcgcgagcaggacgtggaggtgctggaaccacttaagtgtgagctggtgtctggtgaatctacagggaactgtgaggatcgcctgcctgtgaaaggcaccgaggccaacgggaaaaagccgtctcagcaaaaaaaactagaggaaaggccagtgaacaagtgcagtgatcaaatcaagctaaaaaacactaccgacaaaaagaacaatgagaaccgagagagtgagaagaagggacagcggacttctacattccagataaacgggaaagataataaaccaaaaatctatttaaagggtgagtgcctaaaggaaatcagcgagtcccgcgtcgtttccggcaatgtggaaccgaaggttaataacattaataaaatcattcctgaaaacgacattaaaagcctaaccgtaaaggagagcgctattcgaccattcatcaacggtgacgtcatcatggaagatttcaacgaacggaatagctccgagactaaatcacatttgctgtccagctcagatgccgaggggaattacagagatagcctcgagaccctaccatccacaaaggagtctgattcaactcagactaccacaccatcagccagttgtccggagtccaatagcgtgaaccaggtagaagatatggagattgagaccagcgaagtgaaaaaagtgacatcttcccccatcacctccgaagaagagtctaacttaagcaacgacttcatagacgagaacgggctcccgattaacaaaaatgagaacgttaacggtgagtccaaaaggaaaaccgttattaccgaagttacaaccatgacttctactgtggccactgaaagtaagaccgttattaaggtggagaagggtgataaacaaactgtggtgagttctacggaaaattgcgcgaaatccacagtgaccaccacaaccactacagtaaccaagctttcaacaccctcaactgggggttctgtcgatatcatttcagtgaaggagcagtccaaaactgtggttacaacaaccgtcacagatagcctgactaccacaggcggtacgctggtcacttccatgactgtcagtaaggagtacagcaccagagacaaggtgaaattgatgaaattctcacgaccaaaaaaaacacggtctggcactgccttgccgagctacaggaagtttgtcaccaaatcctctaagaagagtatattcgtgctcccaaacgacgatttgaagaagctggccagaaaaggcggtatccgggaagtcccctatttcaattacaacgcaaagccagctctcgacatttggccttatccctccccacggcctaccttcggaattacctggaggtatcgcttgcagaccgtaaagtctctggccggagtctctctgatgctgcgcctcttgtgggcctccctgagatgggatgatatggcggctaaggcacctccagggggaggtactacgaggacagaaaccagcgaaacagagattacgaccactgaaataataaaacgcagggacgtgggcccatacggaattcggagtgaatactgtattcggaaaattatctgtcccataggcgtaccagaaacccctaaagagacgcccacacctcagcggaagggcctgcgcagctcagccttgagacctaaacgcccagagacgccgaagcaaaccggccctgtaatcatagaaacgtgggtggccgaggaggagctcgaattgtgggaaataagagccttcgccgagcgcgtagagaaggaaaaagcccaggcagtggaacaacaggccaaaaagcgccttgagcagcagaagccaacagtgatcgccacatctaccacttcccccacaagtagcaccacatccacaatctccccagctcagaaggtaatggtcgcgccaatttctggctcagtaactactgggacaaagatggtacttacaacaaaggtgggcagtccagccaccgtgaccttccagcaaaataagaacttccaccagacttttgctacttgggttaaacagggccagtctaattcgggagttgtgcaggtccaacagaaggtgcttggtattataccgagctctaccggcacctcccagcaaaccttcacttcctttcagcccagaacagccactgtgaccataagaccgaataccagcgggagcggcggaaccacaagtaacagtcaagtgatcaccggaccgcagatacgcccagggatgaccgtgattaggaccccgctccagcagagtactcttgggaaagccatcatcaggactcccgtgatggtgcagccgggtgcaccccaacaggtcatgacccagatcatacggggtcagcctgtatcgacagccgtgtctgcaccaaacacggtgagctctacccctggccagaagtccttaacatccgcgacaagcacaagtaatattcaaagctcagccagtcagcctcccagaccccaacaaggacaggttaaactcaccatggctcagttgacccagctgacacaggggcacggagggaaccagggcttgacagtggtcattcagggtcagggtcagaccaccggccagctgcagcttatacctcagggcgtgacggtgttacctggccctggccagcagttgatgcaggccgcaatgccaaacggaaccgtacagaggttcttgttcaccccccttgcgaccacagcaacaactgccagtactacaacaacgacggtttccacaactgccgctggcactggagaacaacgtcagagcaaactgtctccgcagatgcaggttcaccaggataagactctgcccccagcacaaagctctagtgttggcccagccgaagcacagccacagactgcccagccttccgcacaaccacagcctcagacacagccccagtcgcccgctcagccagaagtgcagactcaacctgaagtgcagacacagacaaccgtgtcctcccatgttccatccgaagcccagcccacccacgcccagtcttctaagccacaggtcgcagcccagagtcagccacagtctaatgttcagggacagtccccagtgcgggttcagagcccaagtcagactcggatccgaccatcaactccatcacagttaagccccggacagcagtcacaagtgcaaactactaccagccagccaatcccgatccagccccataccagcctgcagatccctagccagggccagccccagtcacagcctcaggtggtgatgaaacacaatgcggtgattgagcatttaaagcagaaaaaatctatgaccccagcagaaagggaagagaatcagcgcatgattgtatgcaaccaggtgatgaaatacattctggacaagatagacaaagaggagaaacaggcagcaaagaaacgtaagagggaggaaagcgtggagcagaagagatctaagcagaacgccacaaaactctccgccctgttgttcaagcacaaagaacagctgagagctgagatccttaagaaacgggcactcctggacaaggaccttcaaattgaggtgcaagaagaacttaaaagagatttgaaaattaagaaggaaaaggatttaatgcagcttgcccaggctacagctgttgccgcaccttgtcccccagtcaccccagctccccctgctccgcctgccccacctccaagcccccctcctccccctgcagtccagcacacaggattgcttagcacgcctaccctgccagctgcatcacagaaaagaaagagggaggaggagaaagactcctcatccaagtctaagaaaaagaagatgatcagcaccaccagtaaggagacaaagaaggacacaaaactgtactgtatctgtaagacaccatacgacgagtctaagttctatatcggctgcgaccgatgccagaactggtaccacgggaggtgtgtaggcatccttcaaagcgaggccgagttaattgatgaatacgtgtgcccacaatgccaatccactgaggatgctatgacggtcctgactcccctgaccgagaaggattacgaaggactgaagcgggtattacgctccctgcaggcacataagatggcatggcccttcctcgaaccagttgatccaaacgatgcacccgattattacggagtgatcaaagagcctatggaccttgccacaatggaggaaagagtgcagaggcggtattacgaaaaattaacagagtttgtggcggatatgacaaagatcttcgacaactgccgctattataatccgtcagacagcccgttctatcagtgtgcggaggtgcttgaaagtttctttgtccagaagctgaagggatttaaggcctcacgctcccacaataacaaattgcagagcacagcctcata

SEQ ID NO: 28207 - DNA, 2628 bp, Artificial Sequence
  Description of Artificial Sequence: Synthetic coding sequence
atgaacttccaggcaggcggaggccaatccccacagcagcagcagcagctggctggtggacccccacagcagttcgcccttagcaattctgccgctattagagcagagatccagcgatttgagtctgtgcaccctaatatctatgctatctacgacttgattgagcgcatcgaagatttggccttacaaaatcaaattagagagcacgtgatcagtatcgaggactcctttgtgaattctcaggaatggacactcagtagatccgtgccggagctcaaggtgggcatagtaggaaacctatcatctgggaagtcggcactggtacaccgatacttgacagggacttacgtacaggaggagagccctgaaggcggacggttcaagaaggaaatagtagtcgatggtcagagctacctgttgctcatcagagacgaaggtggtccccctgagctgcaattcgccgcttgggtggatgccgtggttttcgtgttttccttggaggacgagatctcattccaaacagtatacaactatttcctcaggctgtgttcattccggaatgccagcgaggtgccaatggtcctcgtcggcactcaagatgctatcagtgcagctaacccaagggtaatcgatgacagcagggccagaaagctctccacagacttgaaacggtgcacctattatgaaacctgcgccacctacgggctcaatgtggagagagtgttccaggatgtggcccagaaggtggtcgctttgagaaaaaaacaacagctcgccattggcccttgtaaatcacttcccaactctccctcacattctgctgtatctgctgcttccattccagctgttcatataaatcaggccaccaacgggggaggctccgccttctcagattattcttcaagcgttccaagcactccctctattagccagcgggagctacgtatcgaaacaatcgcagcttcctccacgcccacccctattaggaaacagagcaagagacggtccaacatcttcacctcgcgaaagggcgcagatctcgaccgggaaaagaaagccgcagaatgtaaggtggattcaattggttccggcagagctataccaatcaagcagggaattctgttaaagagaagcggcaaaagcttaaataaggagtggaagaaaaagtatgtgacgttgtgtgacaatggcctgctgacgtatcacccatcattgcacgactatatgcagaacattcacggtaaagaaatcgatttgcttagaacaactgttaaggttccagggaagagacttcccagagccactcccgcaactgcccctggcacatcccctagagccaatgggctttccgtcgaacgcagcaatacgcagttaggagggggaacaggcgcaccccactcggcatcctcagcttcccttcacagcgagcgacctctaagttccagcgcatgggcaggtccccgacctgaaggcttacatcaacgttcctgttccgtgtctagcgcggaccagtggtcagaagctacaacctccctccccccaggaatgcagcatccagcaagcggtcccgcagaagtgcttagctcttctcctaaactggatccaccacctagtccacattccaataggaagaaacacaggcgaaaaaagagcacgggcacgcctcggcctgatggtccttcttctgccaccgaagaggctgaggaaagttttgagttcgtcgtggtaagtcttactggacaaacttggcactttgaggcttcgacggctgaggagcgcgagctctgggtgcagtccgtacaggctcaaatcctggcgagcctgcagggctgccgatctgctaaggataaaacccggctaggaaaccagaatgccgcactggcagtgcaggccgttaggactgtacgcggaaatagtttttgtattgactgcgacgctcctaatccagattgggcatcactcaatctaggggcattgatgtgcattgaatgctcagggattcaccgccacctgggagctcaccttagcagagtccgctccctggatttagacgattggccgccagaattattggccgtcatgaccgcgatgggcaatgccctggctaattctgtctgggagggcgctctggggggttattcaaaacctggaccggacgcttgtcgggaagagaaagagagatggattcgggcaaaatatgagcagaagctgtttctcgctcccctgccctcttcggacgtcccactcggacagcagctcctcagagctgtagtcgaagacgatctccggctactggttatgctgctcgctcatgggagcaaggaggaggtaaacgagacatatggggatggagacggcagaaccgcactgcacctgagctcagccatggcaaatgttgtgttcacccagctgcttatctggtacggcgttgatgtcagatcccgagacgcacgcggactgacccccctggcatatgcgcgtcgtgcaggcagccaagaatgcgccgatatcttgatccagcatggctgtcctggcgaaggatgcggactggcccctacccccaaccgtgaacctgcgaacggtaccaatcctagtgctgagctccataggtcgccaagccttctctag

SEQ ID NO: 28208 - DNA, 1761 bp, Artificial Sequence
  Description of Artificial Sequence: Synthetic coding sequence
atgggtggtgcattaggacttaggcagctgcccatttgcgctccggcttgccgccctagttccggacatagcccctgggccgctgcgtctcctaaccccaaccagtggagtagccgctcccgctggtgttgcttgcggagaagtgaagctcgtagatcctgccgacccgtgggtagagccgcacctggcccaacccgcgctatggccaggcctgctacctctactcgtaggagcgcctgccccccactcactcccactcctgccctgcgcatagcatggaggctgctgtcagccaccagcagaactagtcgcatggcatccgttttatcacgcggtagggtcagatgcccatggcacggggcttgctttaacatcagcacaggagatcttgaagattttcctggacttgattcattacacaaattccaggtgaagatcgaaaaggagaaggtgtacgtgagggcctctaagcaggcactgcagctacagagacgaactaaagtgatggcaaaatgcatatccccatccgccggatattccagctccactaacgtgttgatcgtgggtgccggtgctgcaggtttggtgtgcgcggagactctgcggcaggaaggctttagcgataggatcgtcctttgtacactggatcgtcatcttccgtacgaccgacctaagttgagcaagtctttagatactcagcccgagcagcttgcactgcggccaaaggagttctttagagcctacggcattgaggtgctcactgaagctcaggtggtgaccgtggacgtaagaacaaagaaagtggtgtttaaggatggctttaagctggagtacagcaagctgcttttggccccaggaagctcacctaagactctctcgtgcaagggcaaggaggttgaaaacgtattcactatccgtacccccgaagatgccaaccgggtcgtgaggttggctaggggtcggaacgtagtggtggtgggtgccggattccttggtatggaggtggctgcttacctcaccgaaaaggctcacagcgtaagcgtcgtggagctggaagaaacaccattccggaggttcctgggtgagagggttgggagagcactgatgaaaatgttcgagaataacagagtaaaattttacatgcagacagaggtgtcggagctgcgaggtcaggaggggaagctaaaggaggtggttctcaagtccagcaaggttgttcgcgcagacgtttgcgtagtcggaatcggagctgtgcctgctaccggcttcttgcgacaatcaggtatcggccttgattctagaggcttcataccggtgaataaaatgatgcagacgaacgttcccggtgtttttgctgcaggtgatgcagtcacatttcccctcgcatggagaaataacaggaaagtcaacatcccccattggcagatggcacacgcacaggggagagtggcggcacagaacatgttagcacaggaggcagagatgagcactgtgccgtacctgtggactgcaatgtttggtaaaagtttgagatatgctggctatggcgaaggctttgatgacgtgatcattcaaggcgatctggaagaacttaaattcgtggccttttacacaaaaggggacgaggtcatagccgtcgcctctatgaattatgaccccatcgtgtcgaaagttgcagaggttcttgcctccggccgtgccatacgcaaacgagaggtcgagaccggcgatatgagctggctgacaggcaaggggtcctag

SEQ ID NO: 28209 - DNA, 1521 bp, Artificial Sequence
  Description of Artificial Sequence: Synthetic coding sequence
atgccagtgcaagctgctcagtggactgagtttctttcctgtcccatctgttataatgaattcgatgagaacgttcataagcctatctccttaggttgctcacataccgtgtgtaagacgtgcctgaacaaattgcacaggaaagcgtgccccttcgaccaaactgctattaacaccgatatcgatgtgcttcctgttaatttcgctctgctgcagctcgttggagctcaggtgcctgatcatcaaagcatcaagctcagtaatcttggagaaaataaacactacgaagtagccaagaagtgcgttgaggacttggctctctacctgaagccactgtccgggggtaagggcgtggcaagccttaatcagagtgccctgtcgcgccctatgcaaaggaaactagtgacactcgtgaactgccagctcgtggaggaggaggggcgagtgcgggctatgagagcagcccgtagtttgggagaacggactgttaccgaacttatcctgcagcatcaaaatccccagcaactgtctgctaatctgtgggccgctgtgcgagcgaggggatgtcaatttctggggcctgctatgcaagaggaagccctaaagcttgtgttactggctctcgaggacgggtccgcgttatccaggaaagtgctagtactcttcgtggtgcagagactggaacctcgcttcccgcaggcgagcaagacctctatcggtcacgtggtgcaattgttgtaccgtgcttcatgcttcaaagtcacgaagcgcgatgaggactccagcttgatgcagttaaaggaggagttccggtcttacgaggccctccgcagagagcacgatgctcagatagtgcatatagcaatggaagctggactacggatctctcctgaacagtggagttctctgctgtatggcgatctggcacacaaaagccacatgcaaagtatcatcgataagttacagagtcccgagagttttgcaaaaagtgtacaggagctcacgatcgtcctgcagagaacaggcgatcccgctaacctaaaccgattgcggccacatctcgaacttctcgccaatatagacccgaaccctgacgccgtaagtccaacctgggaacaactggagaatgccatggttgctgttaagaccgtcgtgcacgggctcgtggatttcattcagaattacagccgaaaggggcatgaaaccccccagcctcaacctaactctaagtacaaaacttcaatgtgtcgcgacctgcggcagcagggtgggtgcccacggggaactaattgcaccttcgcccacagccaggaagaactggaaaagtgcaatcccagaggcctgtaccttcattgctgccttttatcatccgtggctagtttgggaacagttcacaacgagctgtacaaacagcagcactgcgaccgggagaaaatatccgtctgtgccgtgaagcgggctgaaacctgcttctccagccaattcttctcccctcttgaagtcccccgagaagaggactag

SEQ ID NO: 28210 - DNA, 783 bp, Artificial Sequence
  Description of Artificial Sequence: Synthetic coding sequence
atgccaagagcccgatctggacgaaggagtaggggcgcaggcggtcgggaggagacttttctgcgggtcagggctaatcgacaaacacggctgaacgcccgtattggcaaaatgaaaagacgcaaacaggatgaggggcaggtctgcccactctgcaataggcccctcgccggaagcgaacaggagatgagcaggcatgtcgaacattgcctaagcaagcgtgaggggtcgtgcatggccgaggatgatgcggtggatattgagcacgagaacaataaccggtttgaagagtatgagtggtgcggacagaagcggattcgcgctacgactctgttagagggtggatttcgtggcagtggcttcatcatgtgttctggaaaggaaaacccagattctgatgcagacctggatgtggatggggacgacaccctcgagtacggaaaaccccagtatacagaggcggatgtcatcccatgcaccggtgaagagccaggggaggcgaaggaacgagaagcactcagaggtgccgtccttaacggcggacccccaagtaccagaatcaccccagaattctcaaagtgggcgtcagatgagatgccgagcaccagcaatggagaaagctctaaacaagaagcaatgcaaaaaacttgtaagaactccgacatcgaaaagatcacggaagactccgctgtcacaaccttcgaggcattgaaagcccgagttcgcgaactcgagagacagctttccagaggagatcgatataagtgcctaatttgcatgtag

SEQ ID NO: 28211 - DNA, 1461 bp, Artificial Sequence
  Description of Artificial Sequence: Synthetic coding sequence
atggctgcggttaaaacgctgaaccctaaagctgaagtcgctagggcccaggcagcccttgctgttaacatctcggctgctcgcggtctgcaagacgtgctgcgcacaaacctgggacccaaaggaaccatgaaaatgcttgtgtccggcgcaggagatattaaactgaccaaggatgggaacgtcctgctccacgaaatgggtcttcaccctcggatcatcactgaggggttcgaggccgcaaaggagaaggcactccaatttctggaggaggtaaaggtctcaagagaaatggacagagagaccctgatagacgtggcccgaacatcattaaggacaaaagtccacgctgagctagccgatgttctgactgaggccgttgtggactctattcttgctatcaaaaaacaggacgaaccaattgatttattcatgatcgagatcatggagatgaaacacaagtctgaaacagatacaagcctcataaggggactggttctcgaccacggagctaggcatccagatatgaagaaacgtgttgaggacgcatacattctcacatgtaatgtgagtctggagtacgagaagacagaggtcaattcagggtttttttacaagagcgccgaggaacgtgagaaactcgtaaaggccgagcgcaagttcatcgaggaccgcgtgaagaaaatcatcgagttaaagcgcaaggtatgtggcgatagtgacaagggatttgtggtaatcaatcagaagggtatcgaccctttcagcctggacgctttgtcaaaggaggggatcgtagccctccgcagggctaagagaagaaacatggagcggctcaccttggcttgtggaggagtggctctgaattcattcgacgaccttagcccggactgcctggggcacgctgggctggtctacgagtacactttaggagaagagaagttcacctttattgaaaagtgcaacaatcctaggtctgtgactctcctgataaaagggccaaacaagcacacattaactcagattaaggatgctgtaagagatgggctgcgggcagtaaagaacgccattgatgacggatgcgttgtgccgggagctggcgctgttgaggtggctatggccgaggcactaatcaagcataagcccagcgtcaaaggcagggcacagctgggtgtgcaggcgtttgctgacgcactgcttatcattccaaaggtactcgctcagaattctgggtttgatctgcaggaaaccctagtgaaaatccaagctgaacattccgaatctggacaacttgtgggggttgatctcaacacaggggaacccatggtagctgctgaagtcggcgtgtgggacaattactgcgtcaagaagcagctgctgcactcttgcaccgtgattgcgacaaacatcctgctggtagatgagattatgagggccggtatgagctcactgaagggttag

SEQ ID NO: 28212 - DNA, 1407 bp, Artificial Sequence
  Description of Artificial Sequence: Synthetic coding sequence
atgtcatttagactttctggaggttcacgcaggatatgctccaggacaggcagcggtcggttgtcgggaggaggcaccggctttgtcgctggtaatgtctgcgtggggtctggtgcccgaagctcattcagctgtaccttggaaggcatatccagcggtggaagcttctgcaactcaggaggcggactgggctcaggggcttgcgcaggcttcctcggaaatgaacattcactgctgtccgggaacgaaaaggtcacaatgcaaaatctgaacgaccggctggccagctatttagatcacgtgcacgctttagaagaggctaatgctgatttggaacagaaaattaaagggtggtacgagaaatgcgagccaggatcttcaagggagcacgatcacgactattctcggtactttagcgtgatcgaggacttgaaaagacagattatctctgctacgatctgcaatgcgtccattgtgctccagaatgacaacgccagattaactgctgacgacttccggttgaagtacgagaacgaactggcccttcaccattctgtggaagccgacaccagtggcttgcgccgtgtgttagacgaactgacgctctgtacgaccgacttggaaatccaatgcgagaccttgtccgaggaactgacctacctgaaaaagagccacgaggaggaaatggaggttctgcagtataccgccggaggcaacgtcaacgtggaaatgaacgccacacccggagtggatttgaccgtccttttaaataacatgagagccgaatatgaggatctggcagagcagaaccggaaagatgccgaagcctggtttaacgaaaggagcgccaccctgcaacaacagatctcagaccatgaaggggcagccacagccgctcgaaatgagctgaccgagctaaagaggaatctgcagacattggagatcgagctacaatctctcatggccgtaaaacacagctatgagtgcagcctggctgagacagagggcaactactgtaaccagcttcagcagatccaggatcaaatcggcgtcatggaagaacagctgcagcagatcagaacagagaccgagggacagaaactggagtacgagcagctgctggatgttaaaatctttttggagaaagagatcgatatctactgtaacctgctcgatggcgaggaacgtaagtccaagagcacttgttataaaagtaagggctatagaccagtcaactcaggaaatcaggcaaaagactcgactgaggagaccattgtgaaaacagtagtcgaagagctggaccagatcggtaacttgctctctctgcgagtgcactcggttgaggagaagtcatcaaagatttcaaacattacagttgaacagcgggtgccctctaaagctccatag

SEQ ID NO: 28213 - DNA, 816 bp, Artificial Sequence
  Description of Artificial Sequence: Synthetic coding sequence
atggcgggtctggaggtccttttcgccagcgccgctccagcgattacctgtagacaggacgcgctcgtctgtttccttcactgggaagtggttactcatggatattttggactgggagtgggcgaccaaccaggcccaaacgataagaagtctgagttgcttccagctggttggaacaacaataaagatttgtacgtattgcgttacgagtacaaagacggctccaggaaactgttggtgaaagctattacagttgagtcatcaatgattttaaatgtactggaatatgggagccagcaggttgctgaccttactttaaatctcgatgactatattgacgcagaacacttgggcgactttcacaggacctacaaaaactcagaagagttgaggtcaaggatcgtcagtggaatcattacccctattcacgaacagtgggaaaaggctaatgtgagctccccccatcgcgagtttccaccagcaacggcacgcgaagtggatccactcaggatcccccctcatcatccacatacgagccgccagcctccatggtgtgaccctctcggacctttcgtggtgggaggcgaagacctggatcctttcggaccacggagagggggaatgatagtagaccctcttcggtctggtttccctcgcgcactcattgaccccagtagcgggctgccaaaccgactgccgcctggtgccgtgccccctggagctcgatttgatccgttcgggcctataggtaccagcccccctggccctaacccagaccacctgcctccgccaggttatgatgacatgtatctctag

SEQ ID NO: 28214 - DNA, 753 bp, Artificial Sequence
  Description of Artificial Sequence: Synthetic coding sequence
atgtctgaaaacgcggcacccgacttttactacgtggcgatggatttcggtgggcacgggctgtcgagtcattatagtccaggcgttccctactacctccagaccttcgtgtccgagatccggcgtgtggtcgcagggggagtggtagggggaatgtttttctgtaccttcccagaaatggtcgacaagcttatcttactggacacacccttatttctcttagagtctgacgagatggagaatctcctgacctacaaacggcgagcaattgagcacgtgctgcaggtggaagccagtcaagagccttcccatgttttcagcctgaaacaactcctgcagcgccttttgaagagtaattcacatttgagtgaggagtgcggcgagcttctcttgcaaagaggcactacaaaagttgccaccgggttggtgttgaacagggaccagaggcttgcttgggcagagaactctatagacttcatctctagagagctgtgcgcacacagcatccgtaaactgcaggctcacgtactcctgatcaaagcggtacatgggtactttgatagccggcagaactactcagaaaaagagtccctgtccttcatgattgacaccatgaagtctactctgaaagagcaatttcagtttgtggaagtacccggtaatcactgtgtacacatgtctgagcctcaacatgtagcttctataatatccagcttcctgcagtgtacgcacatgcttcccgctcagttgtag

SEQ ID NO: 28215 - DNA, 510 bp, Artificial Sequence
  Description of Artificial Sequence: Synthetic coding sequence
atggtctttccacttcccaccccgcaggaaccgatcatggctaccccaccaaagagacgggctgtggaggctactggggagaaagtactgaggtacgagacattcatcagtgatgtcctgcagagagacctacggaaagtccttgatcatcgggacaaggtttatgaacaactagcaaagtatctccagctgagaaacgttatcgaacgcctacaggaggctaaacactctgagctttacatgcaggtggacttgggttgcaacttctttgtggatacagtcgtgccagacaccagtcggatctacgtagccctaggttatggtttcttcctggaactgactttggctgaggcactgaaattcattgatcgtaaaagtagcctcctcaccgagctgtctaattccctgaccaaggactctatgaacatcaaagcgcatattcacatgctgctcgaaggtctgcgcgaactgcagggattgcagaacttcccagagaaacctcatcattag

SEQ ID NO: 28216 - DNA, 3177 bp, Artificial Sequence
  Description of Artificial Sequence: Synthetic coding sequence
atgacaacggtggtggtacatgtagattccaaagcagagctcacaaccctgcttgaacagtgggagaaagagcatgggagtgggcaggatatggtccctatcctgaccaggatgagtcagcttatcgaaaaggagacagaagagtatcggaaaggtgatccggacccgttcgatgaccggcacccaggcagggcagaccctgagtgtatgctgggccacttgctacgaattttgtttaagaacgacgattttatgaatgccctggttaatgcatatgtgatgacatcccgcgagccccctctgaatactgcggcttgccggctgctgttggatatcatgcctggcctggagaccgctgtggtgtttcaggagaaggaaggcatcgtggagaacctgttcaaatgggcgcgagaggctgatcaacctcttaggacctattccacagggttacttggcggagcgatggagaaccaggacattgcagccaactatagggacgaaaacagtcagctggtcgctatcgtcctgcgacggcttcgagagctgcagctccaggaagtggccctgcggcaagagaacaaacgacctagccctaggaagctgtccagcgagccacttcttcccctggatgaagaagcagtcgacatggactatggggacatggcggtggacgacgctgaaatacagaaatcagccttgcagataataataaattgcgtctgtggccctgacaataggatatcctcaattggtaagtttattagcggcacaccccgtcgcaagctgcctcagaatcccaaaagcagtgagcacaccctcgcaaagatgtggaatgtggttcagtccaataatggaatcaaagtattgttgagcctgctgtcgatcaaaatgcctattaccgacgctgaccagattcgcgctttggcatgtaaggccctggtagggctgagtcggtcctcgaccgtgcgccaaattatctctaagctgccattattcagtagctgtcagatacagcaactgatgaaggaaccggtcttgcaagacaaaaggagcgaccatgtgaaattctgcaagtacgctgccgagctcatagaaagggtcagcggtaagcccctcctcatcggtaccgacgttagtctggccagactgcagaaagccgacgtcgtggcacagagtaggatctcttttcctgaaaaggagttactgctgctgatacgcaatcatcttattagcaagggactgggggaaacagctacagtcttaaccaaagaggcagatctcccgatgaccgccgcaagtcactcatctgcgttcacccctgtcacagctgccgcatctcctgtgagcttgccgagaacccctaggattgctaatggaatcgctactagactgggcagccacgcggctgtgggtgcaagtgctcctagtgccccaaccgcccatccccagcctagacctcctcagggcccactagcgcttcctggcccaagttacgccggaaattctcccttgatcgggaggatctcctttatccgggaacggccttctccgtgtaatggacggaagatccgagtgttgcggcagaagtccgatcatggcgcttacagccagtcaccagccataaagaaacagctcgataggcatctcccaagtccccctactctggatagtattatcaccgagtatctacgtgaacagcacgctaggtgcaaaaacccagttgccacctgcccaccatttagcttatttaccccacatcagtgtcccgaacccaagcagcgccgacaggctcctattaacttcacatcgcggctcaatcgcagggcttcgtttccgaagtacggtggcgttgatggcggatgctttgaccgccacctcatcttctctcggtttaggcctattagtgtctttagagaggctaacgaagatgagagcggttttacctgctgcgcattctccgctcgagagcggtttctgatgcttggcacctgtacaggacaacttaaactgtacaatgtcttttccggccaagaggaggcctcttacaattgtcacaatagcgccatcacacacctcgaaccgtccagagatggaagcttgctgctgactagtgcgacatggtcacaacccctaagtgccctgtggggaatgaaaagtgtctttgatatgaagcattcattcaccgaggatcactacgtggagttctctaaacattcccaggatagagtcatcgggaccaaaggtgacatagcccacatttacgatatacagactggcaacaagctcctgacgctcttcaaccctgacctcgctaacaattataaacgcaattgtgccactttcaatcccacagacgacctggtgctgaatgacggagtgctatgggacgtgagatccgcccaggcaatccacaagtttgataagtttaacatgaacatctcaggcgtattccaccccaatggtttggaggtgataatcaacaccgaaatctgggatcttaggacattccacttgctgcataccgtccccgcactggaccagtgtcgagttgtgttcaatcatacaggcactgttatgtacggtgccatgctccaggccgatgatgaggacgacctgatggaggagagaatgaaatccccgtttgggtcctcatttcgcactttcaacgcaacggattacaagcccatcgcgactatcgacgtgaaaaggaatatttttgatctgtgcaccgatacaaaagattgttatctcgccgtgattgagaatcaaggttcgatggacgcactcaacatggacacagtatgtaggttatacgaggtcgggcgacagaggctggctgaggacgaggatgaagaggaggatcaagaggaggaagaacaggaggaagaagatgacgacgaagacgatgatgacaccgacgacctcgacgagctggacactgaccagctcctggaggcagagctcgaggaggacgacaacaatgagaacgccggagaagatggcgataacgacttttctccgtctgatgaagaacttgctaacctgctggaggaaggggaggacggtgaagatgaagacagtgatgccgatgaagaggtggagctgatactgggggataccgacagctccgacaattcagatctggaagatgacattattctgtctctcaatgagtag

SEQ ID NO: 28217 - DNA, 2409 bp, Artificial Sequence
  Description of Artificial Sequence: Synthetic coding sequence
atggccgctgaggcactggcggcagaggccgtagcctcccggctggaaagacaggaagaggatataaggtggctatggagtgaagtcgaaaggttgagggatgagcaactgaacgcgccttattcctgccaggctgagggtccttgtctgactcgagaggtcgcgcagttacgcgctgagaattgtgatttgagacaccggctgtgctctctaaggctctgcctggcagaggagcgaagcaggcaggcgaccctggagtccgctgagttggaggcagcccaggaagcaggcgctcagcctcccccatcgcagtctcaggataaagatatgaaaaagaaaaagatgaaggaatccgaggctgactcagaagtgaagcaccaaccgatttttatcaaggaaagattaaagctgttcgaaattctgaagaaagaccaccaactgcttctagctatctacggtaagaagggcgacaccagtaatattattaccgtgcgggtggcagatgggcagacagtgcagggtgaggtttggaagaccaccccttaccaggtagcagcagaaattagtcaggagcttgccgagtccactgtgatcgccaaggtgaatggcgagctttgggacctggacaggccgctggagggagacagttcactggaactcctgactttcgacaacgaggaggcacaggcagtgtactggcattctagcgcccatatcttgggcgaggcaatggaactctactacggcggacacctttgttacgggccaccaatagaaaatggattttattacgacatgttcatagaggacagggccgtgtcctctaccgaactgtctgcactagagaatatctgcaaagccatcattaaagaaaagcagcccttcgagaggctggaggtgtctaaagaaattctactggaaatgtttaaatacaataaattcaaatgccggattctgaatgaaaaggtcaatactgcaaccactacagtgtacaggtgcggaccgttgatcgacctatgcaaaggtccacatgttcggcatacagggaagattaaaaccatcaaaatcttcaaaaactcctctacatattgggaggggaatccagagatggagaccctacagaggatctacggtattagctttccagataataaaatgatgcgtgactgggagaagtttcaggaggaggcgaagaaccgagaccaccgcaaaatcggtaaagaacaggagcttttcttctttcacgacctttcaccaggaagctgcttcttcctgccccgtggggcatttatttacaatacactgacggactttattagagaagagtatcacaagcgagacttcaccgaggtattatcccccaatatgtataactctaaactgtgggaagctagtgggcattggcagcattactccgagaacatgtttaccttcgagatcgaaaaggatacctttgcgctgaagccaatgaactgtccaggacattgtctgatgtttgctcacagacccaggtcctggcgggagatgccaatcaggtttgctgactttggcgttctgcacaggaacgagctaagcggcacactgtccggcttgacccgtgtgcggaggtttcagcaggatgacgcccacatcttttgtactgttgagcagattgaagaagaaatcaaaggctgcctgcagttcctgcaatctgtgtattccacttttgggttcagctttcaactgaacctgagcactcgcccagagaacttcctgggcgagattgaaatgtggaatgaggctgagaaacaactgcagaattcccttatggatttcggggaaccttggaagatgaatccaggcgatggcgctttctatggcccaaagatagatattaagattaaagacgccatcggacgctatcatcagtgcgccacaattcagctggactttcagctccctattcgcttcaatttgacgtacgtgtccaaggacggggacgacaaaaaaagaccagtcatcatccatagagcaattctcggtagcgtggaaagaatgatcgctatcttgtccgagaactacggcggtaaatggcctttttggctgagtccaagacaagtgatggttattccggtcggcccaacttgtgagaagtacgccctgcaggtgtcaagcgagttcttcgaggaaggcttcatggctgatgtggatctggatcatagttgtacgttgaataagaagatcagaaacgcccagttggcgcagtacaacttcatcttagtggtgggggaaaaggaaaaaattgacaatgcagtaaatgtaagaacccgggataacaaaatccacggggaaatcctcgtgacctcagcgatcgacaaactgaagaaccttcgtaaaacgagaacgcttaacgctgaggaggctttttag

SEQ ID NO: 28218 - DNA, 1149 bp, Artificial Sequence
  Description of Artificial Sequence: Synthetic coding sequence
atgttcaagatccaactggaaccgctgaagctgcgcgcatggactctcaacggttttgtgaagtttcgaaataaggagacctctgcagggccagtcgccgttatgggcaaggattattacaagatactaggtatcccatccggcgctaatgaagatgagatcaaaaaggcatacagaaaaatggctctgaaataccatccagataaaaataaagaacctaacgcagaggaaaaattcaaggagatcgccgaggcatacgatgtcttaagtgacccaaagaagcgcggtctgtacgaccaatatggcgaagagggcctaaagactggcggtggcacgtcgggaggttcgtccggatccttccactacacatttcacggagacccgcatgctactttcgctagtttttttggagggtcaaatccattcgatatattcttcgccagtagtcgctcgacacgtcccttctccgggttcgatcctgacgacatggatgtggatgaagacgaagatcctttcggtgccttcgggaggtttggcttcaatggcctaagtcgcggtcctcggagggcacctgagccactatatcctcgtagaaaagtgcaggaccctcccgttgtgcacgagttacgcgtttccctcgaggagatttatcacggaagtaccaaacgcatgaagatcacccggcgtcgcttaaatcccgatggcaggaccgtgcgaacggaagacaagatactacacatcgtaattaagagaggctggaaggagggtacaaaaatcacattcccgaaggagggagacgccacccccgataatataccagccgacattgtatttgtgcttaaggataagcctcacgcccattttagacgcgacgggactaatgttctatactcagctctgatcagtctgaaggaagccctgtgtggctgcaccgtcaacatccctacaattgacggtagagtcattccactcccttgtaacgacgtgattaagcccggtaccgttaaacgcctgaggggtgaagggctaccattccccaaagttcccacccagcgcggagacttaattgtcgagtttaaggtcaggttccccgatagactgacacctcagactaggcagattctaaaacagcatctcccttgctcctag

SEQ ID NO: 28219 - DNA, 1356 bp, Artificial Sequence
  Description of Artificial Sequence: Synthetic coding sequence
atgcgggaatgcatctccattcatgtcggtcaggccggagttcagattggcaatgcctgttgggagctttactgtctggaacacggcattcagcctgacggacagatgcctagcgataagaccattggcggaggagacgattcgttcaacacctttttctctgagacaggagcagggaagcatgtgcccagagcagtatttgttgacttggagccgactgtcatcgacgaagtcaggacaggcacgtaccgccagctctttcaccccgaacaattgataaccgggaaagaggacgcagcaaacaattatgcccgagggcactatacaatcggcaaagaaatcatagatcttgtcctggaccgaattcgcaaactggcagaccaatgtacaggcctccagggattcctggtattccacagtttcgggggaggaaccgggtccggattcacatcactcctgatggaaaggttgagcgtggactacggcaagaaatccaagttggaattttcaatctatcccgcaccccaggtgagcaccgcggttgttgaaccttataacagcatcctcacgacccatacgactctcgagcattcagactgtgcatttatggtggataatgaagctatctacgacatatgccggcgaaaccttgatatcgagcgacccacatataccaacctcaatcggctgatatctcaaattgtctcatcaataactgcttccctgaggtttgacggtgctctcaatgtcgacctcactgaattccagactaatttagtcccttaccctaggatacattttccactggccacatatgccccagtgatctccgcggagaaggcctaccacgaacagctgtcggtcgccgagatcaccaatgcctgcttcgagcccgctaatcaaatggtgaaatgtgatcccaggcacggcaagtacatggcatgctgtttgctgtaccggggagacgtggtgcccaaggatgtcaatgccgctatcgccacaattaagaccaagcggtccattcaattcgttgattggtgcccgactggcttcaaggtcgggataaattatcagccacctaccgtagttccgggtggggatttagccaaagtacagcgtgcggtatgcatgctcagtaatactacagctattgctgaagcttgggcaagactggaccacaagttcgatctgatgtatgcaaaaagggctttcgtgcattggtatgtgggagagggaatggaggaaggggagttttccgaagcccgagaggacatggccgcactggaaaaagattatgaggaggtcggggtcgactccgtcgagggcgaaggtgaagaggagggagaggagtactag

SEQ ID NO: 28220 - DNA, 444 bp, Artificial Sequence
  Description of Artificial Sequence: Synthetic coding sequence
tgaactgcgaggggaccagaacctgagcagatgggacttgctccctgttgtactcaagccctctgtggcctggcacttcgacatcacagccacctccagcagattcggctcgagttccaccgtctgtcagaggaaaacacgcttctcaagaacgatcttggcagggtacgccaggaactagaggccgcagaaagcactcatgacgcccaacgcaaggagattgaggttctaaagaaggacaaggagaaggcatgttctgagatggaagttttgaatcgccagaaccagaactacaaggaccaacttagtcagctaaacgttcgtgtgctgcaactgggacaggaagccagtacccaccaggctcaaaatgaggagcacagggtaacaatacagatgctgacgcagagtctcgaagaagtggtgagatccggccagcagcaatag

SEQ ID NO: 28221 - DNA, 771 bp, Artificial Sequence
  Description of Artificial Sequence: Synthetic coding sequence
atggccacccagcgcaagcatttggttaaggattttaatccctacattacttgctatatctgcaaagggtacctcataaaacccacaacagttacggagtgcctacacactttctgcaaaacatgtattgttcagcattttgaagacagcaatgactgcccacggtgcggaaatcaggtccacgagaccaaccctctggagatgctgaggcttgacaacaccttggaggagataattttcaaactggttcccggactgagagagcaagaattggagagggaatccgaattttggaagaaaaacaaaccccaagagaacggccaggatgacacgtctaaagctgataaaccaaaggtcgatgaggaaggcgatgagaacgaggacgataaagattatcacaggagcgatcctcagattgccatttgtttagattgcttaaggaacaatggacaaagcggtgataacgtagttaaaggcctcatgaaaaagttcatccgctgttctactcgcgtgacagtgggcacgataaagaaattcctttccttgaaactgaaactgcccagctcatatgaactcgatgtcctgtgcaacggggagataatgggcaaagaccataccatggagttcatttatatgactcggtggcggctccgcggtgagaacttccgatgtctcaactgcagcgcatcacaggtctgtagccaggatggaccactctatcagagctacccgatggtgttgcaatataggccacggatcgacttcgggtag

SEQ ID NO: 28222 - DNA, 6671 bp, Artificial Sequence
  Description of Artificial Sequence: Synthetic coding sequence
atggctcctaagaaggaaaagggaggaaccgtgaatacctcttcaaaaatttgggaaccttccctcattgctgcccagtttaaccagaacgactggcaggcatctattgcgttcgtcgttggcaatcaaatcgaggacgatctcctgattcaggctctaacagtggccgtccaggtcccccagcgcaagctgttttccatggtcagttggcaagacatcctgcagcaaattaatgagataaacacactagtaggcagtgcatcttcaaagaaggccaaaaagcccgtgggcggtaacgccccactgtattatgaggtgctgaccgccgctaaagctattatggactcaggggagaaactcactcttccactgatcgggaagctgctgaaatttcagctgctccaaatcaagttcaaagatcaacagcgcagggaaaatgagaagaaggtgattgaggataagcccaaactagagaaagacaagggcaaggccaagtcgccgaaggaaaaaaaagctccatccgccaaacctgccaaggggaagggcaaagatcagcctgaagccaatgcacctgtgaaaaagacaacccagcttaagaggcgcggagaggatgaccatacaaatagatacatcgacgatgaacccgatgacggagctcagcattacattatcgtggtcggcttcaataacccacagcttttggctatcatggctgaattaggcattccaattacttctgttattaaaatctcatctgaaaactatgagccactgcagactcacctggccgcagtgaaccaacagcaggaggtgctgcttcagtccgaggatcttgaggctgagaagctgaaaaaagaaaacgcaatcaaggagttaaagactttttggaagtatctggagcccgtgttgaataacgaaaaaccagaaaccaacctgttcgatgtggccaggctggagtacatggttaaggccgcagacttcccctccgattggtcagacggggaaatgatgttaaaattgggcacagatatcttcgagaacatcgcttgccttatgtacgacattctggattggaaacgacaacaccagcattacttagagtctatgcagttgatcaacgtgccacaggtagtaaacgaaaagcccgtcttagaggcaatgccgacctccgaggctcctcaacccgctgttcccgcacctggcaagaaaaaagctcagtacgaggagcctcaggcccctcctcctgtcacaagcgtgataactacggaggttgatatgaggtattacaattacctactaaacccaatacgcgaagagtttatctcggtcccgctgatcctgcattgtatgcttgagcaggttgtggccactgaggaggatttagttccaccctctctccgcgaaccttcccctcgtgccgacggcctcgaccatcgaatcgctgcccacatcgtgagtctgttacccagcctatgtctgtcagagagagagaagaaaaatctgcatgacatctttctttccgaggaggagaacgaatctaaagcagtgccaaagggtccccttctactgaactaccatgacgcccacgcccacaaaaagtacgcgttacaggatcagaagaactttgatccggtacagatcgagcaggagatgcagtcaaagttgccactgtgggaattcttacaatttcctctaccccctccttggaacaacaccaaacgcctggcgacaatccacgagcttatgcacttttgtacatctgatgtactgagttggaacgaggtggagagagcgtttaaggtattcacgttcgagagtctaaagctgagtgaggtcgacgagaagggcaagctcaaacccagtgggatgatgtgcggcagtgactcagaaatgttcaatatcccttgggacaatcccgctcgattcgccaaacagatccggcagcaatatgtgatgaagatgaatacacaggaggctaagcaaaaggctgacatcaaaatcaaagataggaccctgttcgtagaccagaacctttcaatgtccgtacaggacaacgagtccaatagggaaccttctgaccccagtcaatgtgacgccaataatatgaagcactcagaccttaacaatttgaaactatccgttcccgataatcgtcagttacttgaacaggagtccatcatgaaggctcagccacaacacgagagcttggaacagacgactaacaacgaaattaaagatgatgcagttaccaaagccgactcccacgaaaaaaagccgaaaaaaatgatggtggaggctgacctcgaggacatcaaaaaaactcaacagcgttcccttatggattggtcttttacagagcactttaaacccaaagtcctcctccaggttctccaggaggctcacaaacagtaccgttgcgtggactcatattaccatacacaggataatagcctgctattggtcttccataaccccatgaaccgacagcgattgcactgcgaatactggaatattgccctccatagcaacgtgggttttagaaactacctcgagctcgttgccaagtcaatccaagactggataaccaaagaggaggccatttaccaggaatcgaagatgaacgaaaagataatccgtacacgggcagaattggagctcaaaagcagcgctaacgccaagctcactagtgcatctaagatctttagtataaaagagtcaaagtccaacaaaggaataagcaagaccgaaatcagcgatcaggaaaaggaaaaagagaaggaaaaaatacctttcatactggagggatcactaaaggcatggaaggaggagcagcacaggctggctgaagaggagcgactccgagaagaaaaaaaggcagagaagaaaggcaaggaagctgggaaaaagaaaggtaaagataatgctgagaaggaggacagcagatcactgaagaagaaatccccttataaagagaagagtaaggaggagcaggtcaaaatccaagaagtgactgaggagtcaccacatcagccagagcccaagataacctacccctttcacgggtacaacatgggcaacatcccgacccagattagcggatccaactactatttgtaccccagtgacgggggtcagatagaggtggaaaagaccatgttcgagaagggccctaccttcatcaaagtgcgcgtggtgaaggataaccacaacttcatgatccacttgaatgaccctaaagagattgtaaaaaaagaagagaagggagactactatctggaagaggaagaggaaggcgatgaggaacagtctttggaaacagaagtatctgatgccaaaaacaaagctttcagcaagtttggtagctttagtgcaacgcttgagaatggaatctgcctctcaatatcctattatggaagcaatggaatggcccctgaggataaagatcccgacttggagacaatactcaatatcccctccgcgctgacccccaccgtggtgccagtcatagtaactgtgccccagagcaaggccaaagggaaaatcaaggggaaggagaaacctaaagaatccctcaaagaggaggagcaccctaaagaggaagagaagaaggaagaagaggtagaaccagaacctgtgcttcaagagacattggacgtaccgacatttcagtcacttaacgtcagctgcccttctggattgctccttactttcatcggtcaggaatcaaccggacagtacgtcatcgatgaagagccaacttgggatatcatggtcagacagtcctatcctcaaagagtaaagcactacgagttttacaagactgtcatgcctcctgcggaacaagaagcaagccgcgttattacaagccaggggaccgtagtaaagtatatgttagatggatcaacccaaatccttttcgcagacggcgcagtgtcacgctcgccaaactccggactgatctgtcctcccagtgaaatgcctgctactccacactcgggggacctgatggattccatcagccaacagaagagcgagactataccaagcgaaattacgaacacaaagaagggcaagtcacacaagtcccaatcttccatggcacacaagggagaaatccatgacccaccccctgaagcagtccagacggtaactcctgtcgaggttcacataggaacctggtttacaaccacccccgaagggaatagaataggcaccaaggggctcgagcggatcgctgatctcaccccactgctgtcctttcaggctacggatccagtcaacggcactgtcatgaccacaagggaagacaaagtggtgatcgtcgaacggaaagacgggacaaggatagttgaccacgcggacggcacgagaataacgacattctatcaggtgtacgaggaccagattattctcccagacgaccaagagacaactgagggcccaagaaccgtgaccagacaggtaaagtgcatgagggtggaatcttctcgttacgccaccgtgatcgcaaactgcgaggattcctcctgttgtgccaccttcggtgatgggacaacaatcatcgcaaaaccacaggggacctaccaggtcctgccacctaataccggaagcctttacatcgataaggactgtagcgcggtgtactgtcacgaaagcagttcaaatatatattacccgttccagaaaagagagcaattacgcgcaggtaggtatataatgaggcatacgtcagaagtgatctgcgaagttctggatcccgaaggaaacaccttccaggtgatggccgatggaagcatctctaccatcctgcctgaaaagaagctggaggatgacttgaacgagaagacggaaggctacgatagcttatcaagtatgcacttggagaaaaaccatcaacaaatctacggtgaacacgtgcccaggttcttcgtgatgtatgcagacgggagcggaatggagttgctgcgggacagtgacatcgaggagtacctctccctcgcttataaggagagtaatactgtcgtgctccaggaacccgtccaagagcaaccaggcactctgacaataacagtgctccggccatttcacgaggcaagtccctggcaggtgaagaaagaggacaccattgtgcctcccaacctgagatcacgaagctgggaaacattcccaagcgtcgagaaaaagaccccagggcctccattcggtacccagatctggaaaggcctctgtatcgaaagtaagcagctagtgtcagctcctggagctattctgaaatcacctagtgtgttgcagatgaggcagtttatccaacacgaagtgatcaaaaacgaagtgaagctgcgcttgcaagtcagccttaaggactatataaattacattctcaaaaaggaagacgagcttcaggaaatgatggttaaggactctagaaccgaagaggagcggggaaacgccgcagacctgctcaaactggtgatgtcattcccaaaaatggaagagactaccaaaagtcacgtgacagaagttgccgcacatctaactgacctgtttaagcagagtctggctactcctccaaagtgtcctccggacacgtttggcaaagattttttcgagaagacttggcggcacactgcctcaagcaagagatggaaagagaagattgacaagacccgcaaggaaattgagacaacacaaaattatttaatggatatcaaaaaccgtataattccccctttttttaaaagcgaactaaaccaactgtaccagagtcagtacaatcacttggacagcctcagcaaaaagctgccttcattcaccaaaaaaaacgaggacgccaacgagacagccgtgcaggatacttcagacttgaatctggacttcaagccccacaaagtgtcggaacagaagtcctcctcagtgccctccttacctaagccagaaatctctgccgataagaaagactttactgcccagaatcagaccgagaaccttacaaaatcccctgaggaagcggagagctatgagcccgtcaaaatccctacccagagcctgctgcaggacgtcgcgggacaaacaaggaaagagaaagtgaagctgcctcattatcttctctcatctaaacccaagagtcagcctctggcaaaagtgcaggacagcgtgggcggaaaggtcaatacctcttcagtggcaagcgccgctattaataacgccaaatcatccctcttcggcttccacctgctcccctccagtgttaagttcggtgtcctgaaggaaggtcacacctacgcgaccgttgtgaaattgaagaatgttggtgtggacttctgtcgatttaaggtgaagcaacccccaccatccaccggcctgaaagtcacctataaaccgggacctgtcgccgcaggcatgcagaccgaactcaacatagagctatttgccaccgctgtgggtgaagacggggcaaaaggcagcgcccatatcagtcataacattgaaatcatgacagaacacgaggttttgttcctacccgtagaagctaccgtcctcacaagttcaaactacgacaaaaggcccaaggatttcccacaaggtaaggagaatcctatggtgcagaggacgagcaccatttattcttccactctgggcgtcttcatgagtagaaaagtctccccacatta

SEQ ID NO: 28223 - DNA, 2337 bp, Artificial Sequence
  Description of Artificial Sequence: Synthetic coding sequence
atgccggctttcctgggactcaagtgtttgggaaagttatgcagtagcgagaaaagtaaggtgacctcgagcgagaggacctccgcgagaggcagcaaccggaaacggctgattgtagaggaccgcagggtttccgggacaagctttaccgcacataggagggccactattacacacctgctgtatctatgtcctaaggattactgcccaaggggcagagtttgcaatagcgtggatcccttcgttgcccatccccaggaccctcaccatccaagcgagaaaccagttattcattgtcataagtgcggagagccctgcaagggggaagtcctaagagtgcagacaaagcactttcacatcaagtgtttcacctgtaaagtgtgcggatgcgacctggcccagggaggcttttttattaaaaacggcgaatatctatgtacattggactaccagcgcatgtacggaactcgatgtcacggctgtggagaattcgtggagggcgaagtagtgacggctctgggaaagacctaccaccccaattgttttgcctgtacgatctgcaaacgcccattccctcctggagaccgcgttacctttaatggtcgcgactgcctttgccagctgtgcgctcagcctatgtcctcttcacccaaagaaaccacattcagctcaaattgtgccggatgcggcagggacattaagaatggccaagccctgctcgctctagacaagcaatggcaccttgggtgctttaagtgtaaatcatgtgggaaagtcctgaccggtgagtatatcagcaaagatggtgcaccctattgcgaaaaagattaccaggggctgttcggagtgaagtgcgaggcttgccaccaattcattaccggaaaagtgctcgaggctggcgacaagcactatcatccttcctgtgctaggtgctccagatgtaatcagatgtttacagagggggaagaaatgtacctgcaagggtccaccgtgtggcacccagactgcaaacagtctaccaaaactgaggagaagctcagacctactagaacaagttccgagtcgatttacagccgcccaggatcatcgatccctggtagtcccggacatactatctacgcaaaagtagataatgagatcctagactacaaggacctggctgcaattcctaaggttaaagccatatacgatattgagagaccagacctcatcacctatgaaccattctacacaagcggatatgacgataagcaggagcgccagtcactgggtgagtcaccaagaacattgtcaccaacgccatccgccgaaggctaccaagacgtacgggacaggatgatccacaggtctacaagccagggttcgattaattccccggtgtatagccgccattcctacactccgacgactagtcgttccccgcagcacttccaccgccctggtaatgaaccctcctccgggaggaacagcccacttccctataggcccgatagtcgccctttgacaccaacttatgcacaagccccaaagcacttccacgtccccgatcaaggcatcaatatttatagaaaaccacctatatataagcagcatgccgctttggccgcacagtctaaaagctccgaggacataatcaagttctccaagtttccagccgctcaggcaccagatccgtcagagactcctaagattgaaaccgaccactggccgggtccaccatcttttgctgtagtgggcccagacatgaagcggcgttcttccgggagggaagaggacgacgaggagctgctcagacggaggcaactgcaagaagagcagctgatgaaactgaactccggtttgggtcagttaattcttaaagaagagatggagaaggagagtcgcgagagatcatcgctgctggcttccagatatgattctccaattaacagcgccagccatataccatcatctaagactgccagtctccctggctatggcagaaatgggctgcatcggccagtcagcactgatttcgcgcagtacaatagttatggcgacgtgagtgggggagttagggactaccagaccctccccgatgggcatatgcctgctatgcgaatggacaggggagttagcatgccgaacatgctagaacctaaaatctttccctacgaaatgttaatggtaaccaatcgcggaaggaataagatcctgagagaggtggatcggacgagactcgaaaggcacttggcacccgaggtcttcagggagattttcggcatgtccatccaggagttcgaccgactccccctgtggcgcagaaatgatatgaagaaaaaggccaaactgttttag

SEQ ID NO: 28224 - DNA, 1689 bp, Artificial Sequence
  Description of Artificial Sequence: Synthetic coding sequence
atgaacccactgtttggccctaatctgttccttctccagcaagagcaacaagggctggcaggaccactgggtgactcattaggtggggaccatttcgcaggcggtggagacctgcctcctgcccctttgtccccagctgggcctgctgcttactcccctcctggaccgggtcccgctccacctgcagctatggctttgagaaacgatttggggagcaacatcaacgtcctgaagacgctcaatctgcgcttccgttgttttctcgccaaagtgcatgaactcgaaaggcgcaaccgcctgctagaaaaacaactgcaacaggccctggaggagggtaaacagggacgacgcggactgggacgtagggaccaggccgtccagactggcttcgtgagtcccattcggccattggggctccagttgggcgcaagaccagctgcggtctgcagcccctccgcaagagtgctgggatcccccgctaggtctcccgctgggccactagccccttcagccgcttctctgagttcttcttccacgtccactagtaccacttattcttcctccgccagattcatgccaggtactatctggagtttcagccatgccaggcggttgggtcctgggcttgaacctactcttgttcagggcccaggcctatcttgggtgcatcctgacggcgtgggggtgcagattgacaccattaccccagaaataagggcactttacaatgtgctggcgaaagtcaagagggaaagggatgagtacaaacgaaggtgggaagaggaatacacggtgcggatccaactccaagatcgggtgaacgagcttcaggaggaggcccaggaggccgatgcttgccaagaggaactggcacttaaggtggaacagctcaaagcagagctcgtggttttcaaaggcctgatgagcaataacctatccgagctcgacactaagatccaggaaaaggcaatgaaagttgatatggatatttgcaggcggattgatattaccgccaaattgtgtgatgttgcccagcagcggaactgtgaggacatgatccagatgttccaaaagaagctggtcccctccatgggtgggagaaaaagggaaaggaaggccgcagtagaggaggacacatccctgtcagagagcgaaggtcctcggcaacctgacggcgacgaagaggaatccactgcacttagtataaatgaggagatgcagcgcatgctcaaccagctgcgtgaatacgacttcgaagacgattgtgattctcttacttgggaggaaactgaagagaccctgctgctgtgggaggatttctccggctacgccatggctgccgctgaggcccaaggggaacaagaggattccctggaaaaggtgattaaggatacagagtccctgtttaagactagggagaaagagtatcaggagaccatcgaccaaatagagctcgagctggcgaccgcgaaaaatgatatgaacagacatctgcacgagtacatggagatgtgttccatgaaacgcggtctggacgttcaaatggaaacgtgtcggagactaattacccaatctggggatcgcaagagccctgcattcactgccgttcctctttctgacccccctcctccaccttcagaggcagaggactcagaccgagacgtgagcagcgatagttccatgaggtag

SEQ ID NO: 28225 - DNA, 2415 bp, Artificial Sequence
  Description of Artificial Sequence: Synthetic coding sequence
atgaactaccagcagcagctggctaatagcgccgcaattagggctgagatacaaagatttgagtctgtgcacccaaacatttactccatttacgagctcttggagcgcgttgaggaaccggtcttacagaaccaaattagagagcacgtaatcgccattgaggacgcgtttgtgaattcgcaggaatggactttgagtagatcagtgcccgagctcaaagtgggcattgtggggaacctggcatctggaaagagcgccttggttcaccgatatctcaccggaacctatgttcaggaggaatctccagagggaggccgattcaagaaagaaatagttgtggacggtcagtcctatctgttgcttatccgcgacgagggcggacccccagaggcacaattcgctatgtgggtggacgcagtcatcttcgtgttttctctggaggatgagatcagctttcaaactgtgtaccactactattcaaggatggcaaattatcggaacaccagtgagattccactggtgctggtggggacccaggatgccatttccagcgccaatcccagagtgattgacgacgcccgtgccagaaagttaagtaacgacttaaaacggtgtacctactacgaaacctgcgcaacctatggcttgaacgttgagcgcgtatttcaagacgtggcacagaagatcgtagccacacgcaagaagcagcagctgtccatcggtccttgtaaaagtctgcccaattccccctcacactcatccgtgtgttccgcacaggtctctgccgttcacatcagccagactagcaatggagggggatcactgtcggattactcatctagcgtgccaagcacaccttccacatcacagaaggaattacgcatcgacgtgccccctaccgccaatacccccacaccggtgagaaagcaatctaagcggcgtagcaacttatttactagtcgtaagggctctgatcctgacaaagaaaagaagggcctggaatccagggcagactcaattggaagcggccgtgctatccctataaagcagggcatgttactcaagcgcagcggaaaaagtcttaataaggaatggaaaaagaagtatgtgacgttgtgcgacaatggtgttctgacctaccatcccagcctccatgattatatgcagaacgtacacggtaaagaaatcgacttacttcggactactgttaaagtccctggaaagagaccgccacgcgcaacctcagcttgtgcacccatttcgagccctaagaccaacggactgagcaaggacatgtcaagtctgcacatttctcccaactctgatactggtctgggcgacagcgtttgtagcagccctagcatcagcagtacaaccagccccaagttggatcctcccccttcccctcatgcaaacagaaagaagcacagaagaaaaaagtccacttcaaatttcaaggccgacgggttgtctgggacagcggaagaacaggaggaaaacttcgagtttatcatcgtgtccctcactgggcagacatggcacttcgaggcgacaacatatgaagagagagacgcatgggtgcaggccatcgagtcacaaatccttgcctctctgcagagctgcgaatcctcaaagaacaaatctcggttaacaagccagtccgaggcaatggccttgcagtcaatacgcaatatgagaggaaactcacattgtgtggattgcgagacccagaaccctaattgggcatccctcaatctgggagcactgatgtgcatcgagtgtagtggcatacatcgaaatctagggacccacctgtccagggttcggtccctagacctggatgactggccagtcgagcttattaaggtgatgagctctattggtaacgaacttgccaattcagtctgggaagaaagttcccagggcaggactaagcccagtgtggattcaactcgcgaagagaaggagcggtggataagggcaaagtacgagcaaaagctgtttctggccccactcccatgcaccgagctgagtttgggccagcacctcctcagggccactgctgacgaagacctgcggaccgctatcttgctcctggctcatggcagcagggatgaggtcaacgagacctgcggcgaaggcgatggcagaacagccctccacctggcatgccgcaaagggaacgtcgtcctggcacagctgttgatatggtatggagtggacgtgaccgctcgtgacgcccacggcaacacggccctggcttacgctcgccaagcatcctcccaagagtgtatagacgtgctgttacaatatggctgccccgacgagaggttcgtcctgatggccacgccgaatctcagtcgtaggaacaataacagaaataattcgtctggcagggtgcctaccatcatctag

SEQ ID NO: 28226 - DNA, 2712 bp, Artificial Sequence
  Description of Artificial Sequence: Synthetic coding sequence
atgcccgagcagtttagcgtcgctgagttcctggccgtgaccgcagaagatttgagttcccctgcaggcgctgctgcctttgccgctaagatgcctaggtatcgcggagccgctttggcccgagaggagatcctggagggagatcaagcaatattacagcggattaaaaaggccgtgagagcaatacatagctcaggtctgggccatgtcgaaaacgaggaacaatacagggaggcggtggagtccctgggcaatagccatctttctcaaaatagccatgagttgagcactggcttccttaatttagccgtattcactcgggaagtggctgctctgttcaagaacctgattcagaacttaaacaacatcgtcagttttccactggattccctaatgaaaggccaactcagggacggtagacaggactctaagaagcagctggagaaggcctggaaagactacgaggcaaagatggctaagctcgagaaggaaagggaccgcgctagagtcacaggaggcatccccggagaggttgcgcaggatatgcagcgcgaacggcgaatcttccaactccacatgtgcgagtatctcctgaaggctggcgagtctcagatgaagcaggggcctgattttcttcaatctctcattaaattcttccacgcccagcacaatttcttccaagacggctggaaagccgcacaaagtttgttcccattcatcgaaaaactagccgcatcagtgcacgccctccatcaagcacaagaggacgaactgcaaaaactgactcagctgagggactccttgagaggtacactgcagctggaatccagagaagagcatctaagccgtaagaactccggttgtggctactcgatccaccaacatcaggggaacaaacagttcgggacagagaaggtgggcttcctctataagaaatcagacgggatcagacgtgtctggcagaaacgcaagtgcggggtgaagtatgggtgtctcaccatttcgcactctacgatcaatcggccacctgtcaagctcactttgctcacgtgccaggtcagaccaaacccggaagagaaaaagtgtttcgaccttgtgacccacaacaggacatatcattttcaggctgaggacgaacacgagtgcgaagcctgggttagcgtgctacagaacagcaaagacgaggcactgtctagtgcctttctaggggagccaagcgctggaccgggaagctggggctccgccggtcatgacggagaacctcacgacctgacaaaactgttaatcgccgaggtaaaatcacggcctgggaactcccagtgctgtgattgcggagccgctgaccccacctggctgtccactaatcttggggtgttgacatgcattcaatgctctggagtccaccgcgagctcggcgtccgtttttcacgtatgcagtctttaaccctggatttactgggcccttctgaactgctgctggctctgaacatgggcaatacatctttcaacgaggtgatggaggcacaacttccaagtcacggtggcccaaaaccttcagccgaatccgatatggggacccgacgggactacatcatggctaaatatgttgaacacaggtttgccagaagatgcactcctgagccacagaggctctggacagcaatctgtaaccgagatttgctgtccgttttagaggcctttgccaacggccaggatttcgggcagcccctacccggtccggatgctcaagctcctgaggagctggtcctccatctggcagtgaaggttgcgaatcaggcctcactccctctggtggattttattatacagaacggcggacaccttgacgcaaaagctgctgatggaaacactgcactgcactatgccgctctttacaaccagcctgactgtctcaagctgttgctcaaaggacgcgctttggtgggaacagtgaatgaggcaggagaaactgcccttgacatcgcaaggaaaaaacaccataaagagtgtgaggagctgctcgaacaagcacaggcgggtaccttcgcctttccactgcatgtggattactcttgggtcatttctacagaacccggttctgattcagaagaagacgaggaggagaaaagatgtttgctgaagctcccagctcaggcccactgggcgagcggtaggcttgacatcagtaacaagacctacgagaccgttgcaagtctcggggcagcgacaccccaaggcgaatctgaggattgtccaccaccactccctgtcaagaacagtagtaggaccctggtgcagggatgtgccaggcacgcatctggcgaccggtcggaggtctcatccttgagttcggaagccccagagactcctgaaagccttggcagccccgcaagctcaagctcgctcatgtcacctctggaacctggtgatcctagccaagcccctcctaactcagaggaagggctccgggaacccccagggacctctcgtccatctttaactagtggaacaacaccctcggagatgtatttaccagttcggttttcttctgagagtactagatcatatagaaggggagcgagatcccctgaagacggcccatccgccaggcagccactcccacgcagaaatgtccctgttggcatcactgaaggcgacgggtcccggacaggatctttgcctgccagctccgtgcagctgctccaggattag

SEQ ID NO: 28227 - DNA, 1359 bp, Artificial Sequence
  Description of Artificial Sequence: Synthetic coding sequence
atgatgaagcgccagctgcacagaatgcggcagctggcccagaccggctcactgggccgtactccagaaactgccgagttcctgggcgaagatctgctgcaggtggaacagaggcttgagcctgccaagagagccgcacataacatccacaagcgactgcaggcctgtctccagggtcagagtggtgctgacatggacaagcgggtgaaaaagctgccactgatggcgctctccacaaccatggcagaatccttcaaagaactggacccagatagctcgatggggaaggcactggagatgtcctgcgcaattcagaaccagctggctagaatcttagccgagttcgaaatgaccctggagagggacgtgttgcagccactgtcacggttatccgaggaagagttgcccgcaatcctgaagcacaagaaatctcttcagaaactggtgagtgattggaatacgctcaaatctaggcttagtcaggccactaagaactctggcagctcacaaggactgggaggcagcccagggtcacactcccacacaacgatggctaataaggttgagaccttgaaggaggaagaggaggagctgaaacggaaagttgagcagtgtcgtgatgaatacctggcagacctctaccatttcgtaaccaaagaagactcttatgccaattacttcattcgcctactggaaatacaggccgactaccataggagatccctgtcttccttagacactgccctcgctgaactaagggagaaccacggccaagcagaccatagccccagcatgacagccacacactttccacgtgtttacggggtctcactggctactcacctgcaggagctcggcagagagatagcgctccctatagaagcctgcgttatgatgctgctgagtgagggaatgaaggaggagggcctgtttagacttgctgctggtgcgtctgtgctgaagcggctgaagcagacaatggccagcgatcctcatagtcttgaggagttctgctctgatccccatgccgtcgcaggggcactgaagtcatatctgcgagagctgcccgaacccctcatgacttttgacctgtatgacgattggatgagggccgctagcctgaaggaaccgggtgccaggctgcaggccttgcaagaggtgtgttcgcgcctgccccctgaaaatctctccaacttgaggtaccttatgaagttcttggcacgtttggctgaagaacaagaggtcaacaagatgacacccagtaacatagctatcgtcctcggaccgaatttattatggccacctgagaaggagggtaccgaacccgctcgggaactgggctctcagactctatgctag

SEQ ID NO: 28228 - DNA, 1137 bp, Artificial Sequence
  Description of Artificial Sequence: Synthetic coding sequence
atgaataatagcggtgcagatgagattggcaagcttttcgtgggcggtttagactggtctaccacacaagaaacactgcggtcttacttcagccagtatggagaggtcgtggattgcgttatcatgaaggataaaacaacaaatcagtctcgcggattcggctttgtcaagttcaaagatcctaactgtgtcgggacagttttggcctccaggccccatactctggatggaaggaatattgatcccaaaccctgcactcctcgcggaatgcagcctgagagaacccgaccaaaggagggctggcagaagggtccaaggtctgataactccaagagtaacaaaatttttgtgggcggaatcccacacaattgcggtgaaacagaacttcgtgaatacttcaaaaagttcggcgtcgtcacagaagtggtgatgatttacgacgcagagaagcagcgcccaagaggatttggtttcatcacattcgaagacgagcagagcgtcgaccaggccgttaacatgcactttcatgatataatgggcaagaaagtggaggtgaagcgcgctgagccacgagactctaagtctcaggcacccggacagcctggtgcctcgcagtggggatctcgggtggtgcccaacgctgccaacggctgggccggacagcccccaccgacctggcaacagggctacggcccacaggggatgtgggttccagccggacaagctatcggaggctacggccctccccctgccggtaggggggctccgcctccacctcctccattcaccagttacatcgtgtcgactcctccgggaggatttcccccaccacagggatttcctcaaggttatggtgctcctccgcagtttagtttcgggtacggtccacccccaccgccaccagatcaatttgctcctccaggggtcccccctcccccagcaacccctggagcagccccactggcattccctccaccaccatcccaagctgcccctgatatgtcaaagcctccaactgcacagccagacttcccgtatggtcagtatgggttgggatcctatagtcccgctcccccaggttgcggaccccacttcgtttattctttgatggtgagactgtcttctgacgtcgcatag

SEQ ID NO: 28229 - DNA, 2430 bp, Artificial Sequence
  Description of Artificial Sequence: Synthetic coding sequence
atggaggtgctgcgggagaaagttgaagaggaggaagaggctgagagggaggaagcagcggagtgggctgagtgggcccgtatggagaaaatgatgaggcctgtggaagtacgcaaagaggagattactctgaaacaggaaaccctgcgggaccttgagaaaaagctgagcgagattcaaatcacagtttctgccgagctccctgcattcactaaggacactattgacatcagcaagctccccatcagctacaagaccaacactcctaaagaggagcatttgttgcaggtcgctgacaacttctcaaggcagtactcccacttgtgcccagaccgggtgcctttattcctccaccctttgaatgaatgtgaagtacctaagttcgtatcaacaaccctgcgcccaacgcttatgccttacccagaactatacaactgggactcttgtgcacaattcgtgagtgactttctaacaatggttcctcttccagacccactgaagcctactataaagaaggaagagaaggttctgcccaagaaatacacaattaaaccacccagagatctttgttcccggttcgaacaggagcaggaggtgaagaagcagcaggagatccgcgctcaggagaaaaagagactaagagaggaggaagagcgattgatggaggccgaaaaggcaaaacccgatgctcttcatgggctgcgcgtgcactcttgggtacttgtgctttcggggaagcgcgaggtccctgagaacttcttcattgatccctttacaggacactcatattcaacacaagacgagcactttctcggtatcgagagcctctggaaccataagaactactggatcaacatgcaagactgctggaactgctgtaaggatctgatctttgacctcggagatcctgtccggtgggaatatatgcttctcggaactgacaaatcgcagttgtcactcacagaagaggatgacagtgggattaacgatgaggacgacgtcgagaatctgggaaaggaggacgaggataaatcgttcgacatgcctcattcttgggttgagcaaattgagatctcacccgaggctttcgagacaaggtgtccaaacggaaagaaagtcatccagtacaagagagctaagctggagaagtgggccccttacctgaacagcaacggactggttagcaggcttactacatatgaggatttacagtgcacaaatattttagagattaaggaatggtaccaaaatagggaggatatgctagaacttaaacacattaacaaaacaaccgaccttaagaccgattattttaagccgggtcatccccaggccctgagagtccacagttacaagtctatgcaacccgaaatggatagagtgatcgaattttatgaaaccgcacgggtagacgggctgatgaagagggaagaaactccaaggacaatgacagagtattaccagggacggcctgattttctttcatacagacacgcttcctttggcccaagagtcaagaaactaacacttagctctgctgagagcaatccccgaccaatcgtaaagattaccgagagattctttcgcaatccagctaagcccgctgaggaagatgtggctgaacgtgtttttttagtcgcagaagagcggatacagttgcgataccactgtagagaagaccacattaccgcctcaaaaagggagttcctccggaggacggaagtggactcaaaggggaacaaaattatcatgacacccgatatgtgcatctcttttgaagttgaaccaatggaacataccaagaagttattgtaccaatacgaagctatgatgcatctcaagagagaagaaaagctgtctcgccatcaggtatgggagagcgaactggaggtgctagaaatcctcaaactgcgcgaggaagaggaagctgcacacacactgaccatttcaatatatgacacaaagcggaacgagaagagcaaggagtaccgggaggcgatggagagaatgatgcatgaagaacacctccgccaagtcgagacacaattggattacttggctcccttcctggctcagctgcctcccggagagaagctgacctgttggcaggccgttcgcctgaaagacgaatgcttatctgatttcaagcagcggctgatcaacaaggctaatttgattcaagcaaggttcgaaaaggaaacccaagagcttcaaaaaaagcagcaatggtaccaagaaaatcaggtcaccctgaccccagaagatgaagatctatatctgtcatattgtagccaggccatgtttcgaatccgaattctggagcagcggttaaacagacacaaggagctggccccactcaaatacttagccctggaagaaaagctatacaaggatcccaggctgggcgaattgcaaaagatcttcgcttag

SEQ ID NO: 28230 - DNA, 828 bp, Artificial Sequence
  Description of Artificial Sequence: Synthetic coding sequence
atgtggcctctgaccgcactactgcttctagtgcctagtagcggccaggctgccaccctggagaagccaattctaagtctgcaccctccttggaccaccatcttcaagggagagagagttacattgaaatgtgatggatatcacccactcctgcttgaactacagcctataagcactctttggtaccttggccacttactattgccatcccataagaaatcgatcgaggttcagacccctggagtttatcggtgccagactagaggggctccagtgtcagatcctatccacctttccgtgtcaaatgactggttgattctccaggtgccgtatgcgcctgtgttcgaaggagaaccattggtccttcgctgtaggggctggtacgataaggtcgtgtataaattgcactactaccatgacggccaggcagtgcgctattttcatagttctgctaattacacagtgctgcaggccagagcctctgatagcggcaggtaccagtgctcggggaccatgagaatcccagtggaatccgctccgatgttcagtgcaaaggtagccgtcaccgtgcaagaggcccgtcatgccgcagccgttagagtgttgcaggtgcagccccgaggcgctccgctccggctcggtcgacgggtgcatagtccaggagctagggggaggggcgcaagaatcgtgctcgttcgtggcggttataggcatcctcagtgtcctgaaacccaaagcgtggccgctgccccaggcgcaggtttctcccccggaccgggactccaccatcgtccctccagcatgggtcgtagtctcggcagttggtag

SEQ ID NO: 28231 - DNA, 657 bp, Artificial Sequence
  Description of Artificial Sequence: Synthetic coding sequence
atgaattgtagatcagaggtgctcgaagtgagcgtggagggacgacaggttgaagaagctatgctggctgtgcttcataccgtgctgctgcacaggagcactggaaaattccactacaagaaagaaggcacgtatagcattggaaccgtgggcacacaggacgtggactgcgattttatcgactttacgtatgtgcgcgtgagttcagaggaattggacagagcgctgcggaaagtggtgggcgaattcaaagacgcactgcgaaattctggtggcgacggactggggcagatgtccctggaattttaccaaaaaaaaaaatctaggtggccatttagcgacgagtgcataccttgggaggtttggaccgtgaaggtccatgtggtcgccttagccacagagcaggaaagacagatatgccgggaaaaggttggcgagaagctctgtgaaaaaatcatcaatattgtggaagtcatgaaccggcacgaatatctacccaaaatgcctactcagagcgaagtcgataacgtgtttgacactggactgcgagatgtgcagccctacctctataaaatcagctttcagataactgatgccttgggcacttcagtgacaaccacaatgcgcagattaatcaaggacactcttgcattatag

SEQ ID NO: 28232 - DNA, 552 bp, Artificial Sequence
  Description of Artificial Sequence: Synthetic coding sequence
atgatgcaaatctgtgatacatacaatcaaaagcattctctgttcaatgccatgaaccgtttcataggcgcagtcaacaatatggatcagacagtaatggttcccagcttgctccgtgatgtgcccttggccgatcctggcctggataacgacgttggtgtcgaagtcgggggatccggaggctgtctcgaggaaaggacccctcccgttcctgattctggctccgccaatgggtcattttttgctcctagccgggacatgtacagccactacgtgctgctgaagagcataagaaatgacatcgagtggggggtcctgcaccagcccccaccgcctgctggtagcgaggaagggagtgcgtggaagtctaaagatattctggtcgacctaggacacctcgagggtgccgacgccggagaagaggacctggagcagcagttccactatcacctacgcggtctgcatacggtactgtccaagctgacacgcaaggccaacatcctcaccaataggtacaaacaggaaataggtttcgggaattgggggcattag

SEQ ID NO: 28233 - DNA, 369 bp, Artificial Sequence
  Description of Artificial Sequence: Synthetic coding sequence
atgctgttcgccccatgctgtcatcagtgtggagagttcataatcgggcgtgtgattaaagccatgaacaattcctggcaccctgagtgttttaggtgcgatctgtgccaggaggtgctcgcagacataggatttgtgaagaatgccggaagacacctgtgcagaccatgtcacaatagagaaaaagctcgtggactgggaaagtatatctgccaaaagtgtcatgctattatcgacgagcaacccttgatttttaaaaatgatccgtatcatcctgaccacttcaattgtgcaaattgtggccaagagggatcagattgcaggtgtaccggagcggagcgcggtgctattctgccagccatgccgtag

SEQ ID NO: 28234 - DNA, 1083 bp, Artificial Sequence
  Description of Artificial Sequence: Synthetic coding sequence
atggacagcgaacttatgcacagtatcgtaggcagttaccataagcccccagaacgtgtgttcgtgccttcctttactcagaacgagcctagccagaactgccatccagcaaatcttgaagtgacatcccccaagatccttcactccccaaattcccaagagaagcaattagagtatacaaagcgcatggtgttgaatgtggagcgcgagaagaatatgatactggagcagcaggcccaactgcagcgtgaaaaggagcaggaccaaatgaaactgtatgccaagctcgagaagctggatgttttagagaaagaatgcttccgccttacaaccacacagaaaaccgcagaagacaaaattaagcatctcgaagaaaagcttaaggaagaggaacaccaacgaaagctattccaggacaaagcttcagagcttcagaccggattggagatcagcaaaatcattatgtcatccgtgagtaacctcaagcacagtaaggaaaaaaaaaaatcgagcaagaaaactaaatgtatcaagagacgacccccatggcagatatgcagcaaatttggtgccctgcccttcgtggctgaaaaaccatccaggaccacctcctggtgtaaagcgataccgccagatagtgaaaagagcatttctatctgcgacaacctttctgaactgcttatggcaatgcaggacgagctcgatcagatgtcaatggaacaccaagagttgctgaaacaaatgaaggaaactgaatctcactccgtgtgtgatgacattgagtgtgagctggagtgtctgctcaagaagatggagattaagggcgaacagatcagtaaactgaagaagcaccaggattccgtctgtaaactgcagcaaaaagtccaaaattctaagatgtctgaagcgagcggaattcagcaggaggactcatatccaaaaggctccaaaaatatcaagaactctcctcggaaatgcctgaccgatacaaacctgtttcagaaaaatagttcattccatccaattcgcgttcataacctgcagatgaagctgcgacgtgacgacatcatgtgggagcagtag

SEQ ID NO: 28235 - DNA, 1758 bp, Artificial Sequence
  Description of Artificial Sequence: Synthetic coding sequence
atgagcggcagcactccatttcagatgcggctggtacatctagacctgaagggcgcaccgccaaaggtgtcatacctttcagagattttcccactcttcagagcgctgggagcaaacgggctgttgatcgagtacgaagatatgttcccttacgagggcccattgcgcctgcttcgagcaaagtacgcctattcaccttccgagattaaagagatcctgcatttagctggacttaatgaactggaggttattcctctcgtgcagacatttggacatatggagttcgtacttaaacatacagcatttgctcacctgagggaggtgggatcttttccatgtactctcaacccacatgaggcggagagcctggcgttggtcggagcaatgatcgatcaagtgctcgaattgcatccaggagcccaaaggcttcatatcggctgtgacgaggtatattatcttggcgagggcgaggcctcccggcgatggttgcagcaggagcaaaactcgaccgggaagctttgcttgtctcatatgagggcagtagctagcggggtaaaggccagaaggccctctgtaaccccgctagtttgggacgacatgctgagggatttgcctgaggaccaattggcggcttcaggggtgcctcagctggttgaaccagtactttgggactataccgccgatctagatgtgcatggcaaggtgctgctgatgcagaagtatcgacggtgcggcttcccccaactctgggccgcatctgctttcaaaggggcaactgggccttcacaagccgtgcctcccgttgagcatcacctccgcaatcacgtgcagtggttgcaggtcgctgggagcggacccaccgattccctgcaggggataatcctgaccggttggcagcgatacgatcactattcagtgctctgcgaactgttaccggcaggggttccctcactggccgcatgcctgcagctgcttcttcggggaggatttgacgaagacgttaaggcgaaggtggagaacttactcggcatatcttccttagagaagacagaccctgtgcggcaggcaccatgcagtccaccttgcccactactgccgttaccttttcccagaccttggcgacagctgttctccgcaggtctttcagccggtcgcggacccgctccatcgctggcagccacctctcttccactctcacacaagtctgccagcatctgcgccgcactgtggatgcgctgttggagggcgacggggatgtctctcgctggttccgcgccaactacggccagtgggtctagctccacacgatcatggttctcaactagttccccccagcggtcggcttcttggcatagcggcgctccatcttgcagatcgtggagacttccatgctcttggctgtccactaggatgccttggcggtctgggtggcggaaaacgtgtactcctgcatgtagcggctgtaagctgtgctgccgaacatccgctcggtgcctccccccacggtgtcatccacctgctctggcaggcacactcctgagaacacccgagggaagggcacacgccaggggcctgcttctggaagccggtggcgcactgcattgccagatggcctgggctattagagctcacgttggtgtcgtgcctagcggcccagcagtaagttgtccccatagcgtacccgagggccctggccaacccttaggggagcggcttgagaacaccgaaggctcaagtacaggaaggccagccctttag

SEQ ID NO: 28236 - DNA, 2112 bp, Artificial Sequence
  Description of Artificial Sequence: Synthetic coding sequence
atggaagcactgttagaaggtattcagaacagaggccacggcggaggtttcctgaccagttgtgaagccgaactgcaagaactcatgaagcagattgacattatggtggcgcataaaaaatctgagtgggagggacgtacgcacgcactggagacgtgtttgaagataagggaacaagaactgaaatcactgcggtcccagcttgatgtgacacataaagaagtggggatgctgcaccaacaggttgaagaacacgaaaagattaaacaggaaatgactatggagtataagcaggaattgaaaaaactgcacgaggaactgtgcattctgaaacggagttatgaaaaattgcagaaaaagcagatgagggagtttcgtggcaacaccaagaatcatagggaggaccgctccgagatagagagactgactgccaaaatagaggagtttaggcagaaaagcctagactgggagaaacagcgcctcatatatcagcagcaggtttcatcgctggaggctcagaggaaagccctcgccgaacagagtgaaattatccaggcccagctcgttaacagaaaacagaagctggagtcggtagagctgagcagccagagtgagattcagcatctgagcagcaaactggagcgagctaacgataccatctgcgccaatgagctagagattgaaagactgaccatgagggtaaacgatttagtgggcactagtatgacggttctgcaagaacagcaacagaaggaggagaaactcagggaaagcgagaagcttttagaagcattacaggaggaaaagcgtgagctgaaggcagctttgcagagccaggaaaatttgatccacgaggccagaatacagaaggagaagctgcaggaaaaagtgaaagctaccaacacacagcacgccgtcgaagctatccggccacgcgaggaatctcttgccgaaaaaaagtacaccagccagggacagggggatctggactccgtcttatcacaactgaatttcacccataccagcgaggacttgctacaggccgaagttacctgcctcgaggggagtttagaatcggtttccgcaacctgtaagcaattgagccaggagttaatggagaaatatgaggagctgaaaaggatggaggcccataacaacgaatataaagccgagattaagaagctgaaggaacagattctgcagggtgaacagagctacagctccgccttggagggaatgaaaatggaaattagccacctgacccaggagctgcaccaaagagacatcacaatagcaagtaccaaagggtcatccagcgacatggaaaagcgactgcgcgcagagatgcagaaagccgaggataaagctgtggaacataaggaaattctcgatcagctcgagtctctgaaactcgagaaccggcacctttccgagatggtgatgaagttggaactgggcctccatgaggccaaagaaatttccttggcagatttacaggaaaactacattgaagcactcaataaattagtgtccgagaatcagcagctccagaaggacttgatgaatacaaagagccagctggagatcagcacacagatgtgcaaaaaacagaacgataggatatttaaaccaacacattccagaactacagagttcaaaaacaccgaattcaagccaacccatgggcaacataggcacgatgggatcaaaactgagcattacaaaacggatctacacagcccacgaggccaggcttctgacagcatcaatcccatgtcccgggttctgtcacccctcagtccccagatttctccttgcagctccacaaggtctctaactagttacagcctgtgtaagacacattccctgccttctgctctcgacaccaacgaggcaaacttctctgacacgatgagcgagagtatgaatgaccaagaggagtttatttcgtcttgcagtctgcccgtcagccccctcggtagcattgccacacggttcttagaagaagaagaactgcgatcacaccatatcctcgagagactggatgcacatattgaagagcttaagagggagtccgaaaagactgtgcgccaattcactgccctgaagtag

SEQ ID NO: 28237 - DNA, 1626 bp, Artificial Sequence
  Description of Artificial Sequence: Synthetic coding sequence
atgtcctcctgcgtgagcagccaaccctcaagtaatagagcggctccccaggacgaattaggtggtcgtgggagtagctcatctgagtcacagaagccctgtgaggccctccgaggactcagctcgctgagtatacacttgggtatggagtccttcatagtagtgaccgaatgtgagcccggatgcgccgtcgacttgggtctggccagagatagaccacttgaggccgacggccaggaggtgccgctggataccagtgggagtcaggctcgcccacatttgtcgggaaggaagctgtccttgcaagaacgcagtcagggcggtctcgcggctggcggatccctggatatgaacgggagatgcatatgccccagtttgccctattctcccgtgtcctccccgcagagctctcctcgactgccccgacggcctactgtcgaaagccatcatgtctctattaccggcatgcaggattgcgtccagcttaatcagtacaccctgaaagacgagataggtaagggctcgtacggagtggtgaagctggcctataacgaaaacgacaacacgtactatgcgatgaaagtcctgagcaaaaagaagctaatccgccaagctggttttccaaggcggccacctccgaggggtacccggcctgcccctggcggttgtattcaaccccgtgggccaatcgaacaggtgtaccaggaaattgctattttgaagaaactcgaccatccgaacgtggtgaaactcgtggaggtgctcgacgaccccaatgaggaccatttatatatggtgtttgaactggtcaatcagggaccagtgatggaggtcccaacgctcaaaccgttaagcgaggatcaggcacgcttttatttccaggacctcataaaggggatcgagtacctccactaccagaagataatacatagagatatcaaaccttccaacctcctggtgggcgaggacggtcacataaagatcgccgatttcggtgtgagcaacgagtttaagggttcagacgccctgctgtctaatactgtggggacccctgcctttatggcccctgaatccctctcagaaacccggaagatcttttcagggaaagcactggatgtgtgggccatgggagtaacactgtactgctttgttttcgggcaatgtccctttatggatgagcgcattatgtgtctccactccaagatcaaatctcaggccctggagttcccggatcagcccgatatagctgaggaccttaaagaccttatcaccagaatgctcgacaaaaatccagaatcccggatcgtcgtgccggagataaagctgcatccgtgggtgacccggcacggagccgaacctctgccctctgaagatgaaaattgtactcttgttgaagtcaccgaagaggaggtggagaacagcgttaaacacatcccgagtttagcaaccgtaattctcgtaaaaactatgattcggaagcggtcattcggaaacccctttgagggatcccggcgagaagagcgctccttgagcgctcccggtaatcttctgaccaagcagggatctgaggataatctgcaagggaccgaccccccaccggtcggcgaggaggaggtcttgctttag

SEQ ID NO: 28238 - DNA, 2463 bp, Artificial Sequence
  Description of Artificial Sequence: Synthetic coding sequence
atgacagacaccagacgacgggtgaaggtgtacacactgaacgaggaccggcagtgggatgatagaggaaccggccatgtcagctcaggatatgtggagcgactcaaaggaatgtccttgctggtaagggccgagtctgatggaagcctgctgctggaatctaagattaatccaaacactgcatatcaaaagcagcaagatactctcatagtatggtctgaagccgaaaactacgatctggccttaagtttccaggaaaaggcagggtgtgatgagatatgggagaaaatctgtcaagtacaagggaaagatccatcagtggatatcactcaagacctggtggacgagtccgaggaagagcgcttcgatgatatgagtagccccggattggaactcccttcatgtgagttgagccgacttgaagagattgcggagctggtggcttcctccctgccttccccactgcgccgtgagaagcttgccctcgctttggaaaatgaaggctacattaaaaagctgctggagctctttcacgtgtgcgaggacctggaaaatatcgaaggcctgcatcacctgtatgaaataataaagggtattttcctcctcaataggacagcacttttcgaggtcatgttttctgaagaatgcatcatggatgtgatcggttgcctcgagtacgaccctgcactgtcacagcctagaaaacacagggaattcttgaccaagaccgccaaatttaaggaggtgattccaattagcgatccggagctcaagcagaaaatccaccagacttatcgcgtccagtatattcaggacatggttctgcccacaccctccgtgttcgaggaaaacatgttgtccaccctgcacagttttatattttttaataaagttgagattgttgggatgcttcaggaggatgaaaaattcctgaccgacctgttcgcgcaactgactgacgaagccaccgatgaggaaaagcgacaggaactggttaattttctgaaggagttttgcgctttttcccagaccctccaaccccagaatcgagatgccttcttcaagaccctcagtaatatgggaattcttcctgcactagaagtgatcctgggcatggatgacactcaagtcagatccgctgccaccgatatcttctcttatctggttgagtataatccttccatggtgagggagttcgtcatgcaggaagcacagcagaacgacgacgacatactcttgatcaacctgataattgaacatatgatctgtgatacagatcctgagctgggaggagcagttcagcttatggggctgcttagaaccctggtcgatccagaaaacatgcttgccactgcaaacaagacagagaagactgaatttctagggttcttttataagcactgtatgcatgtgctgaccgctccccttcttgccaacaccacagaggacaagccttcaaaggatgactttcagaccgcccagctgctggccctggtactggagttgttgaccttctgtgtggagcatcacacgtatcatataaagaactacatcatcaacaaagatatcctgaggcgtgttcttgtgctcatggcaagcaaacatgcctttctcgcgctatgcgcactgagattcaaacgcaagatcatcggattaaaggacgagttttataatcgctatataatgaagagcttcttgtttgaaccagtggtgaaagctttccttaataatggcagtcggtacaacctcatgaactcagctatcatcgagatgtttgagttcatccgggtcgaagacatcaagtccctaacggcccatgtgatagagaattattggaaagccttagaagatgtagattatgtgcaaaccttcaaagggctgaaactgcgtttcgaacagcagagggaacgccaggataaccctaagcttgattcaatgcggtctattctgcgcaaccaccgttaccgcagggatgccaggacactagaagacgaggaagagatgtggttcaacactgatgaggatgatatggaggacggagaagccgtggtctctccatccgacaaaaccaagaacgatgatgacattatggacccaatttcaaaatttatggaaagaaaaaagcttaaagaaagcgaggaaaaggaggtgctcctaaaaacaaacttgagcggcagacagagtccttcattcaagttatctttatcctcgggaaccaagactaaccttacctctcaatcgtcaacaacaaaccttcctgggagtcccggtagtcccggaagccccggatctcctggatcgcctgggtctgtgcccaagaacacctctcagaccgccgctatcacgacaaagggcggacttgtggggctggtcgactaccccgatgatgacgaggatgacgacgaggatgaagataaggaagatactctacctttgtccaagaaagcgaaattcgacagctag

SEQ ID NO: 28239 - DNA, 2382 bp, Artificial Sequence
  Description of Artificial Sequence: Synthetic coding sequence
atgagtgaacagggcgacctgaatcaggccattgccgaagagggaggaactgagcaggagaccgccactcctgagaatggtattgtcaagtccgagagtctggatgaggaagaaaaactggagttacagcgccgtctggaagcgcagaatcaagagagaagaaaaagcaagagtggagccggaaaaggcaaattgacccgatcactggcagtatgcgaggagagtagtgcccgacctggaggagagagtctccaggatcaggaatctatacacctacagctgagctcatttagcagtctccaggaagaggacaaatcacggaaggatgattctgagagggagaaggagaaagacaagaacaaagataaaaccagcgagaagcccaagatccgcatgcttagtaaagattgttcccaggagtacacagattcaaccggaatcgacttgcatgaattcctgattaataccctgaagaacaacagcagagatcgtatgatcctgctcaagatggagcaggagattatagactttatcgcagataacaataatcactataaaaagtttccacaaatgagtagctaccagcgtatgctggttcatcgggtggcggcatacttcgggttggaccacaatgtcgaccagaccgggaaaagcgtgataattaacaaaacttcctccacccgcatcccagaacagaggttctgtgaacatttaaaagatgagaaaggcgaagaaagccagaaacgttttatccttaagagagataactctagcatcgacaaagaagacaaccaaagcgtctgctctcaggagtcactctttgtagaaaacagaggcaacagggacggttccggtaggacatctggcagtcgacagtccagctccgaaaatgagcttaaatggtccgatcatcaacgggcatggtcttccactgactcggattcaagcaataggaacttgaagccagccatgacaaagactgcttcctttggcggaatcaccgtcctgacccggggagacagtactagctccactcgttcaacaggcaagctgtccaaggccggaagcgaaagttcttctagtgccggttccagcggatcactctcccggacccatccgccactccagagcaccccccttgtttcgggagtcgccgcaggttccccgggatgtgtgccttaccctgagaatgggatcggaggacaggtggcgccaagcagcacctcctacatacttctgccacttgaagcggctactgggataccacccggttcaattcttcttaatccccacactggacaaccttttgttaatcctgatgggacacccgcaatctacaatccacctacaagccagcagccccttcgcagtgccatggtggggcagtctcagcagcagccgccacagcaacaaccatcaccacagccccaacagcaggtacagcctcctcagccacaaatggcgggtcctttagtaacgcagtccgtgcaggggcttcaggcatcttcccagtccgttcagtaccctgcagtctcatttccgccacagcacctgctgccagtgagccccacccagcatttccctatgagagatgatgtagccacacagtttggccagatgaccctgtcccgacagagttctggcgagacccccgaacctccaagtggtcccgtttatccgtctagcttgatgccgcaaccagctcagcagccaagctacgtgattgccagtacaggccagcagttgcctactggcggattcagtggctcaggccctcccatctcacagcaggtgctccagccacccccatctccacagggtttcgtccagcagccaccaccagctcagatgcctgtttattattatccctccggtcagtaccccacgtccactactcagcaatatagaccgatggcaccagtgcagtacaatgcacaaagatcccagcagatgccccaggccgctcagcaggccggataccaacctgtactgagtggccagcaggggtttcaaggcctgatcggcgtacagcagccccctcagtcacagaacgtgatcaacaaccagcagggtacacctgtgcaatctgtgatggtgtcttatcccactatgtcctcttatcaggtgccaatgactcagggatctcaaggcctgccccagcagagctatcaacaacctatcatgcttcccaaccaggccggtcagggaagtctgccagctaccggcatgccggtctactgcaacgtgactcccccaacccctcagaataatctgcgattgattgggccacactgtccaagtagcacagtccctgtgatgtcagcctcctgccgtacgaactgcgcatcaatgagtaacgcgggttggcaggtgaaattttag

SEQ ID NO: 28240 - DNA, 1467 bp, Artificial Sequence
  Description of Artificial Sequence: Synthetic coding sequence
atgagattccactggctgcctaccctgtccgaacccttcgataggaatcaggaattggaaacatgcatcagaccattgtggacccccagtggctcagcatgcgagaccgagcacaataaaagtatggatatgggtaaccagcacccttcgatttcacgcttgcaggaaatacagaaagaggttaagtcggtcgagcagcaagtcattgggtttagcggactgagcgatgataagaactataagaaattggaaaggatactcacaaagcagctattcgagatcgatagtgtggatacagaagggaagggcgacattcaacaagctagaaaacgcgcagctcaggagaccgaacgcctactgaaagaactcgaacagaatgccaatcatcctcacagaattgagattcagaacatcttcgaagaggcccagagtctggtgagagagaagatcgtccccttttataacgggggaaactgcgttacagacgagtttgaagaggggatccaagatatcatcttgcgcctcactcacgttaaaactgggggtaaaatcagcctgaggaaagccagataccatactctcaccaagatttgcgcagtgcaagagatcattgaggattgcatgaaaaagcagccatctttgccactgtcagaggacgcacacccctccgtggctaaaataaactttgtgatgtgcgaggtgaataaagctcgtggcgtgctgattgccttactcatgggagtgaataacaacgaaacgtgcaggcacctgtcttgtgtgctgagcggtctgatagccgatctagacgccctggacgtgtgtggacgcactgagattaggaactacaggcgtgaggtcgtggaagacatcaacaagcttctgaaatacctggatctggaggaagaggccgacacaaccaaagctttcgatcttaggcagaatcattccatcttgaagattgagaaagtgctaaaaagaatgcgggaaattaagaacgagctgctgcaggcccagaacccctcagagttgtacctgagtagcaaaacagaacttcaaggcttgatcggacagctggatgaagtcagcctcgaaaaaaacccatgcattcgcgaagcgaggagaagggccgtgatagaggtgcagaccttaattacctacattgatctgaaagaagcactggaaaagaggaaactattcgcttgcgaagagcatcccagccacaaagctgtgtggaatgtcttgggaaatctgtctgagattcagggcgaagtgctgtctttcgacggtaaccgaactgacaaaaattacattcggcttgaggagttgctaacgaagcagctgctggccttggacgccgtcgatccacagggcgaagaaaagtgcaaagccgcacgcaagcaggccgtgcgtctcgctcagaacattttaagctacctggatctcaaaagtgacgagtgggagtattag

SEQ ID NO: 28241 - DNA, 978 bp, Artificial Sequence
  Description of Artificial Sequence: Synthetic coding sequence
atggggaagatggtaagtgtgattaacaccgtcgacacctcacacgaggatatgatccacgacgcccagatggattattacgggactcgcctggcaacttgttccagcgacagaagcgtgaagatttttgacgtgagaaacggagggcagatcctgatcgcagacctgagaggccatgagggcccagtttggcaagtggcctgggcccacccaatgtacggaaatatcttggcaagttgcagttacgaccgaaaagtgatcatctggcgtgaagagaatggcacttgggaaaaatctcacgaacacgcaggccacgactcgagcgtgaactccgtctgctgggccccacacgactatgggctcattctggcttgtggcagctctgatggcgcaatcagcctgctgacctatacaggagagggccagtgggaggttaagaaaattaacaatgcacatactattggctgcaatgctgtgagttgggcgcctgccgtggtgcctggttcgctgatcgaccacccttctggtcagaagccaaattacatcaagcggttcgcgagtggcggttgtgacaatctgattaaattgtggaaggaagaggaggacggtcagtggaaggaggagcagaaactggaggcccactcggactgggttagggacgtggcatgggcccctagcatcggcctgccaacatctactatagccagctgctctcaggatggacgcgtgtttatttggacttgcgatgatgcctcaagtaacacctggtcccccaagctactgcataaatttaatgacgttgtgtggcacgtcagttggagcatcactgctaacatcctggccgtgtcggggggagataataaagtcaccctatggaaggagtccgtggacggtcaatgggtctgtatctcagacgttaataaaggacagggaagtgtctcagcctccgtcacagaaggtcagcagaatgaacagtag

SEQ ID NO: 28242 - DNA, 846 bp, Artificial Sequence
  Description of Artificial Sequence: Synthetic coding sequence
atgctctttatcttccccctttcgctgccatggcggccttcatgttggaaggaatcatgctcaacaggccagaggcaggcaggacggtcgcgagaagactctgttacccccccacctagctccccgtggcctacgccacctgctggagccatgtccacaaaacaggaggccaggcgggatgaaggcgaggccagaacacggggacaagaagcccagctcagggatcgcgcacacctgtcccagcagcggagactcaaacaggctacacagttcttgcataaggacagcgcggatctcctgcccctcgactctctcaagcggctgggcacgtctaaagacctacagccacgatccgtaatccagcggagactggtggaaggtaaccctaactggttacagggcgaacctccacgcatgcaagatctgatacatggacaggagagccgaagaaagacatcccggactgaaatccccgcactcctggtgaactgtaagtgccaagaccaacttttgcgcgtcgctgtcgacaccggaacacaatacaataggatttctgcgggatgcttgtccagactagggctagaaaagcgggttcttaaggcctcagctggggacttagcgcctggcccaccaacgcaagtggagcaacttgagctgcagctgggacaagaaacagtggtttgcagtgcccaggtggtggacgccgagtcgccagagttttgcctaggtctgcaaacactgctgagcctgaagtgctgcatcgatctggagcacggagtcttacgactcaaagccccattctccgaattgccatttctgcctctgtaccaggagcctggccaatag

SEQ ID NO: 28243 - DNA, 1533 bp, Artificial Sequence
  Description of Artificial Sequence: Synthetic coding sequence
accgggggaggtgtagcccctgctggacaagtgaggaccgctacttgggccagacgggctaggccataccggaaaatggccgctcgcacggggactgagttggcttctgccgctagtaccacggccccaggaagcagtaaacgcaggaaaagacacccatggcacactgtgtctagaagacccggtaggactcctaaatggcgcctaccccgtatctcagcaagggctccatatcggctgaggaggcttcggagacacacatattggcctccaagacgaccagtggctgccagccgatgctggcccgtgggtgcaactccgttgggctccgtgggtggtcgcaccgggaagatggatgccgctacccttacttacgacactctgaggtttgccgagttcgaggacttcccagagacatcggagcctgtgtggatcctaggacggaaatactctatcttcaccgagaaggacgagatcctgagtgatgtggccagccgcctttggttcacctacaggaagaactttcctgcaattggcggaaccggaccaacttcggataccgggtggggttgcatgctcaggtgcggccagatgatctttgcccaggctttggtttgccgccaccttggcagggactggagatggacgcaaaggaagagacaaccagacagttatttttcagtacttaatgcttttattgacaggaaagacagttattatagtatacatcagatcgcccagatgggcgtgggtgaaggcaagagcatcgggcagtggtacggcccaaataccgttgcccaggtcctgaagaaattggctgtgttcgacacctggagtagcttagcggtgcatatcgctatggacaacacggttgtgatggaggagattcggagattgtgccggaccagtgtgccatgtgccggagctaccgcttttccagccgattcagaccgacactgcaacgggttcccggcaggagctgaagtgaccaatcgaccatctccatggaggccactggtgcttttaataccccttcgactcgggcttactgacatcaacgaagcatatgttgaaacactgaaacactgcttcatgatgcctcagtcactgggcgtcatcggagggaagcccaacagcgcacactatttcataggctacgtcggggaagaactcatatacctggacccacacacaacccagcctgcagttgagccaacagatggttgcttcatcccggacgagtccttccattgccagcacccaccttgccggatgtctatcgcagaactggatcctagcatcgctgtgggcttcttttgcaaaacagaggatgattttaatgattggtgccagcaggtcaagaaactttctctcctggggggagccctcccgatgtttgagctcgtagaactgcagccttcccacctagcctgccctgacgtcctgaacctcagtctggattcatcagacgtcgagcgacttgaaagattttttgacagcgaagacgaggacttcgagatcctgagtctttag

SEQ ID NO: 28244 - DNA, 552 bp, Artificial Sequence
  Description of Artificial Sequence: Synthetic coding sequence
atggcgtcaaataagacgactcttcagaaaatgggaaaaaagcagaacgggaagagcaagaaggttgaagaagccgagccggaggaattcgtggtggagaaggtgctcgacaggcgagtggtgaacggcaaggtggaatatttcctgaagtggaagggattcaccgatgccgacaacacttgggagccagaggagaaccttgactgtccagagctgatcgaggcgttcttaaactcacagaaagcagggaaagagaaggacggcacaaagcggaagagcttgtccgattctgagagtgatgactcaaagtccaaaaagaagagggacgctgccgataagcccagaggcttcgcacgcggtttggatcccgaacgcatcatcggagcaactgatagctccggtgaattaatgttcttaatgaaatggaaagattcggacgaagccgatctggtgcttgccaaagaagccaatatgaaatgtccgcagattgtgattgccttttatgaggaacggcttacctggcactcctgtcccgaggatgaggcccaatag

SEQ ID NO: 28245 - DNA, 1464 bp, Artificial Sequence
  Description of Artificial Sequence: Synthetic coding sequence
atggagcgaagcggacaaagggtaactacgtgggattgcgatcagggtaagcattccgattcagactaccgggaggatggtatggatcttggctctgatgcaggctccagcagcagctcatcacgggcttctagtcagagcaattctaccaaggtcacaccttgctcggaatgcaaaagtagctcctccccagggggttcccttgacctagtgtccgcactggaagattatgaagagccttttcccgtttatcagaaaaaagtgatcgacgagtgggctcctgaggaagacggagaagaagaggaggaggaggatgagcgagatcagagagggtatagggatgatcgatccccggcaagagagccgggagacgtgtcagcaaggactcgatcgggcggtggaggtggaagatcggctaccactgcgatgcctcctccagtccctaacggaaacctacatcagcatgatcctcaggacttgagacacaatgggaatgtggtcgtcgcgggtcgcccatcctgcagcagaggaccgcgacgggcaattcagaagccccagccagcaggcggaagacggtctgggagggggccagccgctggtggactctgtcttcagcctcccgacggtggaacctgtgtgccagaggagcctccggttcccccaatggattgggaagctctcgaaaagcacctagcaggcttacagttccgagaacaagaagtacggaaccagggtcaagcgagaactaatagtacttccgctcagaagaatgagcgagagagcatccgccagaagctggcactgggcagcttcttcgatgacggtcccggaatatacacgtcttgttcaaagtcaggcaaacccagcctctcctcccgcctccagagcggcatgaacttacagatctgcttcgtaaatgacagcggcagtgacaaggactctgatgccgacgacagcaagactgagacttccctagacacgcctcttagccctatgagtaagcaatcaagttcatactcagacagggatacaacagaggaggaaagcgagtcactagacgacatggacttcctgacccgacagaagaagctccaggccgaggcgaaaatggcattggccatggcaaagcctatggccaaaatgcaggtcgaggtggaaaagcaaaaccgtaagaaatcccccgtagctgatctgctcccacatatgccacacatttctgaatgtctgatgaaacggtcactgaagcccactgacttgcgggatatgaccatcggccagctgcaggtgatcgtaaatgatctccatagccagattgagagcttaaacgaagagttagtgcaactcctccttatacgcgacgaactccatacagagcaggacgctatgctggtggacattgaggacctcacacggcacgcagaatcacagcagaaacacatggctgagaaaatgccagccaagtag

SEQ ID NO: 28246 - DNA, 927 bp, Artificial Sequence
  Description of Artificial Sequence: Synthetic coding sequence
atgaaacgcgcacatcctgagtattccagcagcgatagtgaactggacgaaacgatcgaagtagaaaaagaaagcgcagatgagaatggaaacctgtccagtgctcttggctcgatgtctccgaccacatcctctcaaatcctggctcgaaagcgcaggcgtgggattatcgaaaagagacgtcgggataggattaataactctctcagtgaattgcggagactggtcccatccgctttcgaaaagcaggtgatggagcagggctccgctaaacttgaaaaggctgagatcctgcagatgactgtcgatcacctcaagatgctccatacagcaggaggaaagggatatttcgacgcgcacgcactggccatggactatagaagtttggggtttcgagagtgtctcgccgaggttgcgcgatacctgtcaatcatcgaaggtctggatgcatctgacccgctgcgcgtcagacttgtctcccacttgaacaattacgccagccagagggaggctgcttctggggcacatgccggactcggtcacattccttggggtaccgtctttggccaccacccgcacatcgcccaccctctattactcccccagaacgggcatggaaacgctggtacaaccgctagtccaaccgagccacaccaccagggccgtcttggcagcgcccaccccgaggccccagctctgcgcgctcccccttctggttctctgggtccggtgctacctgttgtgacctctgcctccaaactaagtcccccattactgagcagtgtcgcgtctctgtcagcgtttccattcagcttcgggtcttttcatcttctgtcccctaacgccctgtccccatcagctcccacgcaggctgcgaatcttgggaagccttaccggccatggggaaccgagataggtgccttttag

SEQ ID NO: 28247 - DNA, 1338 bp, Artificial Sequence
  Description of Artificial Sequence: Synthetic coding sequence
atgagtgtcacatacgatgactccgtcggagttgaggtgagctctgactcgttctgggaagtcggtaactataaacggacagtgaaaagaatcgatgacggtcataggctgtgttcggacctcatgaattgtctacacgaaagggcgaggatcgaaaaagcctacgcccaacagttaaccgaatgggcacgtcgctggaggcagcttgtggagaaaggccctcagtacggaaccgtggaaaaagcttggatggctttcatgtccgaggcggagcgggtgagcgaattacacctggaagtgaaggcgtccctaatgaacgacgactttgaaaaaatcaaaaactggcagaaagaggcatttcataaacagatgatgggcggattcaaggagaccaaggaggccgaagacggctttaggaaagcacagaaaccctgggccaaaaagctaaaagaagtggaggccgcaaagaaggcccaccacgcggcttgcaaggaagagaaactcgccatatcacgggaagctaacagcaaggccgatccaagtttgaaccctgagcagctcaagaaactgcaagataaaattgagaaatgcaaacaagatgtcctgaaaacaaaagaaaaatacgaaaagtccctcaaggaactggatcagggcacccctcaatatatggagaatatggagcaggtgttcgaacagtgccaacagtttgaggaaaagcggttaagattttttagagaagtcctattggaggtacagaagcacttggacctctcgaatgtggcaggatacaaggccatttaccatgatcttgaacagagcattcgcgcagccgacgcagttgaagacctccgttggtttcgtgccaaccacgggccagggatggcaatgaactggccccagttcgaagagtggagcgctgaccttaatcggaccctctcacggcgtgagaagaaaaaggcgaccgatggagtgactctgactgggattaaccagacaggcgaccagtcgctgccttccaagccctcttctgtatcatcatacgagaagactcagtcgtacccgacagactggtctgacgacgagagtaacaatcccttttcttcaacagatgcaaatggcgattctaacccttttgatgacgacgcaacttcaggaactgaagttcgagtgcgggctttatatgattatgagggacaggagcatgatgaattgtctttcaaagctggagatgagttaacaaaaatggaggacgaagatgagcaagggtggtgtaaagggaggctagataatggccaggtagggctgtatccagccaattatgtcgaggcgatacaatag

SEQ ID NO: 28248 - DNA, 1248 bp, Artificial Sequence
  Description of Artificial Sequence: Synthetic coding sequence
atgatgctcggccctgaggggggtgagggtttcgtcgtaaagttgcgtggcctgccgtggtcatgttcagtcgaggatgttcagaactttttgtccgactgcaccatacatgatggagcagctggggtccatttcatttatacccgcgagggacggcaatctggcgaggcatttgtagaactcggaagcgaagacgatgtgaagatggcccttaagaaagatcgggaatcaatgggtcatcggtacattgaggtgtttaagagtcacagaaccgaaatggactgggtgctgaagcattctgggccaaatagcgctgactccgcaaacgatgggtttgtgagattacggggtcttccattcgggtgtaccaaggaagaaatcgttcagttcttcagcggactcgagatcgtgccgaatgggataactctgcctgtggatcctgagggaaagatcaccggtgaggccttcgtccagttcgcgagccaggagctggctgagaaagcgcttggaaaacacaaggagcgcatcggacacaggtatattgaggtgttcaaatcttcccaggaggaagtgcgttcctactcggatccccctctgaagttcatgagtgtgcagcgcccagggccttatgatagaccgggaaccgcccgaaggtacattggaattgtgaaacaagccggattagagagaatgagacccggagcttacagcaccggatacggcggatatgaggagtattctggtctctctgatgggtacggctttacgacagaccttttcggaagggaccttagttattgcctgagtggtatgtacgaccataggtacggggatagtgagttcacagttcagtccactacaggccactgcgtacatatgcggggtctgccttacaaggctacggaaaatgacatatacaattttttttcccccctcaatccggttagggtgcatatcgagataggccctgacggaagagtcaccggtgaggccgatgtcgagtttgctactcacgaggaagctgtggcagcaatgtccaaagatagggcgaacatgcagcatcgatacatcgaattatttctgaatagcacaaccggcgcatctaacggggcatacagtagtcaagtcatgcaggggatgggtgtctccgctgcccaggctacttactccggccttgaatcccagagtgtctccggctgttacggggcaggatatagtggtcaaaattctatggggggttatgattag

SEQ ID NO: 28249 - DNA, 1770 bp, Artificial Sequence
  Description of Artificial Sequence: Synthetic coding sequence
atgagtgtttctgtccatgaaaccaggaaaagccggtctagcactggctccatgaatgtcacactcttccacaaggcctctcaccccgattgtgtattagcgcacctcaacacactcagaaagcactgcatgtttactgacgttactctttgggccggtgaccgggcttttccatgccatagagctgtactggcggcatcgtctaggtatttcgaggccatgttcagccacggtcttagggagtccagagatgacaccgtgaactttcaggacaacctgcatccagaagtgcttgaactcctgttggatttcgcctatagcagccgcatagcaatcaatgaggagaacgccgagagtctgctagaagccggtgacatgctccagttccacgacgtgcgtgatgccgcagccgaatttctggagaagaacctttttccatccaactgcttgggaatgatgttactgagcgacgctcaccaatgtaggaggttgtatgagttcagttggagaatgtgcctggtacatttcgagacagtgcggcagagtgaggattttaactcgctgtctaaggacaccctgttggacttgatctcctccgatgaactcgagacggaggatgagcgggtggtgtttgaggcgattctgcagtgggtcaaacacgatcttgaaccacgtaaagttcacctgcccgagcttctgcgctccgtgaggctggcgctcctgccttctgactgtctacaggaagcggttagttccgaggctctattgatggccgacgagcggaccaagctcattatggatgaggcactgagatgtaaaacccggatcctgcagaatgacggcgtggttaccagtccctgcgctcgccctcgaaaggccggtcacacactccttatcttgggagggcagacattcatgtgtgataagatctaccaggtggaccataaggcaaaagaaattatccctaaagctgatctgccgtcaccccgtaaagagttttccgcttcagctatcgggtgcaaggtgtacgtgacgggaggccgtggatctgagaacggggtgtccaaagacgtgtgggtatatgataccgtgcacgaggagtggtctaaagccgctccaatgcttattgcaagattcggccatgggtccgcagaactcgaaaactgcctgtacgtcgtgggaggccacacttctctggcaggagtgttccccgcatctccttccgtgtccctgaagcaagtcgaaaagtacgatcccggtgctaataaatggatgatggtcgcaccactcagagatggcgtctcgaacgcagcagttgtcagcgcaaaattgaaacttttcgtctttgggggaacatcgatccatcgggatatggtatcaaaagtccagtgctacgatccctcggagaacagatggacaataaaggccgagtgccctcagccctggcgctataccgcggcagccgttctgggcagccagatattcattatgggtggcgacactgagttcacagccgctagtgcttatcgttttgactgtgaaaccaatcagtggactcgaattggcgacatgaccgccaagcggatgagctgtcacgcactagcatcaggtaacaaactatatgtggtcggtggctatttcggaactcaacggtgcaaaaccttggactgttacgatccgacttcagacacatggaattgcatcaccaccgtgccctattctcttattcccaccgcatttgtgtcaacctggaaacacctccctgcttag

SEQ ID NO: 28250 - DNA, 1311 bp, Artificial Sequence
  Description of Artificial Sequence: Synthetic coding sequence
atgatgggagaagctgcagtggccgcagggccttgcccacttagggaggacagctttactcggttctccagtcagtctaacgtgtacgggctggccggaggagctggaggtcgcggagagctactggccgctacactcaaggggaaggtgttaggcttccgttaccaggacttgagacagaaaatacgacctgtggctaaggaacttcagtttaattatataccagtcgacgccgagattgtaagcatcgacaccttcaacaagagcccacccaagcggggattggtagtgggcataacctttattaaggattctggcgacaagggaagcccctttcttaatatttactgtgattacgagccaggatcagaatacaatctggattccattgctcagtcatgtctgaacctggagttacagtttaccccctttcagttgtgtcacgccgaggtgcaggttggggatcagctggagaccgttttcttactgtccggcaatgaccctgccattcatttgtataaagagaacgagggccttcatcagtttgaagagcaaccagtggagaatctgtttccagaattaacaaacttgacctccagtgtgctttggctcgatgtccacaattttcccggtaccagccgtaggctgagtgctttgggatgtcagtctggctatgtccgagtggcacacgtcgaccaacgctcccgggaagtattgcagatgtggtccgttctacaggatggccctatctccagggtgattgtgtttagcctgagcgccgctaaagaaacgaaagacagacctctccaggacgagtacagtgtgctcgtggcttcaatgctggaacctgcggtggtgtacagggatctgcttaatagggggttagaggatcagctgctactgcccggttcagatcagtttgactccgttctatgcagtttggtcacggacgtcgacctagatggtcgccctgaagtgctggtagcaacctatgggcaggagctcttatgttataagtatcgaggccctgaaagcggactcccagaggcacaacacgggtttcacttgttgtggcagagaagcttttcatctcccctgctggctatggcccacgtagacctcacaggcgatggcctgcaggagttggcagtggtgtctttgaaaggcgttcatatcctgcagcactctctaatacaggcgagcgagctggttctcactagattgcggcaccaagtcgaacaacggagaaggaggttgcaaggattagaggatggcgcaggagccggtcctgctgaaaatgctgcttcgtag

SEQ ID NO: 28251 - DNA, 642 bp, Artificial Sequence
  Description of Artificial Sequence: Synthetic coding sequence
atgcttcttccgttcatcagaaccctcccgcttctctgctataatcaccttctggtgtcaccagattccgctacactctcccccccttattctttggagaagatgaccgacctcgtggcagtctgggacgttgcactttctgatggagtccataaaattgagttcgagcacggaaccacaagtggcaagagggtcgtctacgtggatggcaaagaagagatacggaaagagtggatgtttaagctcgtgggaaaggaaacgttttacgtaggggctgccaagactaaagcaactatcaacattgatgcaatatcagggtttgcttatgaatacactttagaaattaacgggaaatcactgaagaaatacatggaagatcggtcaaaaacaaccaacacctgggtactgcatatggatggggagaacttcaggatcgtcctcgagaaggatgctatggacgtatggtgtaatggtaagaagctggagacggccggtgaatttgtcgacgacggcactgaaacccacttcagtataggtaatcacgactgctatataaaggctgtctcatccgggaaacgtaaggaaggcattatacacactctcatagtggataaccgggagatcccagaaattgcatcttag

SEQ ID NO: 28252 - DNA, 663 bp, Artificial Sequence
  Description of Artificial Sequence: Synthetic coding sequence
atgacatcaggtgaagttaagacatccttgaagaacgcttactccagcgctaaacgcctatctccaaagatggaggaagagggggaagaggaagattattgcactccaggtgcgtttgagttagaaagactgttttggaagggcagccctcagtacactcacgttaacgaagtctggccaaaactctacataggggatgaagcgaccgctctcgacagataccgcctgcagaaggccggatttacccacgtcctcaacgccgcacacgggagatggaacgtggataccggccctgactactatcgggacatggatattcagtaccacggggtggaggccgatgacctgcctacgttcgatctgtctgtcttcttctatccagctgccgctttcatcgatagagctctgtctgacgatcactccaaaatcctggtgcattgcgtcatgggtaggtcgaggtctgccacactggttctggcttatctgatgatccataaggacatgacactggtagacgccattcagcaggtagcaaagaatcggtgtgtacttcccaaccggggattcctaaaacagctgagggagctggataagcaactggtgcagcaaaggcgcaggagccagagacaggacggggaggaggaagacggtagggagttatag

SEQ ID NO: 28253 - DNA, 1845 bp, Artificial Sequence
  Description of Artificial Sequence: Synthetic coding sequence
atgtcacccgctgatcggtgccgcagcgctaatactatcgaacctgccaccacgtccagcctggccttgttccttctgctgcagcgagaccagtccagcaggactcgcggtctgcctgaggagaaggaggaagtaactatggacaccagcgagaaccggccagagaacgacgtgcctgaaccacccatgcctattgcggatcaggtcagcaatgatgaccgcccagaagggtccgtggaggatgaagaaaaaaaagaaagctctctacccaagtcattcaaacggaaaatctcagtggtctccgctacaaaaggcgtccccgcaggcaactcggacaccgaaggcggacagcctggcagaaagaggcgatggggtgcatctaccgcaacgactcagaaaaagcctagtatctctataactacggagagcttaaaatcactcataccagatattaaaccattggctggccaggaggcagtggtggatctccacgcggatgacagccggatttccgaggatgagacagaaagaaacggagatgatggcacacacgacaagggattaaaaatatgccgaacggtgactcaggtagttccagctgagggccaggaaaacggccagcgagaagaagaggaggaggaaaaggaacctgaggccgagcctcccgtcccacctcaggtgagcgtcgaggttgccctgccaccccctgccgagcacgaggtcaaaaaggtaacactcggcgataccctgactaggaggtctatcagtcagcagaagagcggggtgagtatcacgattgacgatcctgtgcgtaccgctcaagttccatccccgcctaggggaaaaatctccaatatcgtgcacatctccaatctcgttcgtccgtttacactagggcagctgaaggagctgctcggcagaacagggaccttggtggaagaggccttttggattgataaaatcaaatcccactgttttgtaacgtacagcactgtggaggaggcagtggctactaggactgctctccacggagtgaagtggcctcagtcaaatccgaagtttctatgcgctgactacgcagagcaggatgagctggactaccataggggactccttgttgataggccttcagaaactaagaccgaggaacaaggcatccccaggcccttgcaccccccaccaccaccacccgtccagccaccacagcatccccgagccgagcagcgcgaacaggaacgcgctgtacgggaacagtgggcagaacgagagcgcgaaatggagcggcgagagcgaacccgttcagaacgagagtgggatagggacaaggtgagagagggtccacgttcccgatcccgctccagggacaggagaaggaaagaaagagctaaaagcaaagaaaagaagtccgagaagaaagagaaggcacaggaggaacctcccgcaaagctgctcgacgacttgtttcggaagacaaaggctgcaccctgtatatactggctgccgctaacagatagccagatcgtgcagaaggaggccgaacgcgcagagagagccaaggaacgggagaaacgcagaaaggaacaagaggaggaagagcagaaggaaagagagaaagaagccgagcgggaaagaaatcggcagctcgaaagagaaaaaagacgggaacactccagggaacgggacagggaaagagagagagaacgagagagagacagaggggaccgagaccgggacagggagcgcgaccgagagcggggtagagaacgagatagacgggacactaagcggcactctagatcacggtctcggtcgaccccagtgcgagataggggaggcagacgctag

SEQ ID NO: 28254 - DNA, 1203 bp, Artificial Sequence
  Description of Artificial Sequence: Synthetic coding sequence
atgaagaacgagccgctcactcctggttatcatggatttccggctagagattcacagggaaaccaggagccaactacaactcctgatgccatggtacagcctttcaccactatcccctttccaccccctccccagaatggcattcccacagagtacggggttccacacacccaagactacgccggacaaaccggtgaacacaacctcaccctttacggaagtacccaggcccacggtgagcaaagctcaaatagccctagtacgcaaaatggttctcttactactgaagggggtgcccaaaccgatggccaacaatctcaaacacagtcctctgaaaatagcgagagtaagtccacacccaaacgtttgcatgtgtccaacattccgtttcggttcagagaccctgatctgagacaaatgttcggccaattcggtaagattctagacgttgaaatcatattcaacgagagaggtagtaaggggtttggctttgtcactttcgagaattccgccgatgctgaccgggctagagagaaactgcatggcaccgtcgtggaaggtagaaagatcgaggtcaacaacgctactgctagagtcatgaccaacaaaaagatggttactccatacgctaacggatggaaactgtcccccgtggtgggcgctgtatatggccctgagttgtatgcagcaagttctttccaggcggacgtctcactgggcaacgacgctgcggtgcctctctctggcagggggggaattaatacctatattcccctcatcattcctgggtttccataccccacagccgcaaccactgcagccgcttttcggggtgcccacctgagaggcagaggccgtacggtctacggggctgtgagggctgtaccacctaccgccattccagcctacccaggcgttgtgtaccaggacggcttttatggggctgacttgtatatcgagagtgctaattgctttcggagcaacagagttgatatgcagccaactgacatgcattctctactgttgcaaccgcagcctcctctcctccagcccctgcagcccctgacagtgaccgtgatggcagggtgcacccaacctacacctaccatgcccctgccactgccgcttgcaatggagctagcactgtggcgggtttacaccgaggttgcaacagctgatctccctcccactgaggtgacgtag

SEQ ID NO: 28255 - DNA, 1545 bp, Artificial Sequence
  Description of Artificial Sequence: Synthetic coding sequence
atggatgagggaatggaaattagcagtgaaggaaacagtctgataaaggccgtccatcagtcccggttgcgcctgaccaggctgctcttggagggaggagcctacattaacgagtcaaatgataggggcgagacccccctgatgatagcctgtaaaactaagcacgtggaccaccagagtgtttctaaggctaaaatggtgaaatatctgttggagaataatgccgaccctaatatacaggataaaagtggcaaaactgccctgatgcatgcttgtctagagaaggcaggccctgaggttgtgtccctgctgttgaaatcaggggctgatctgtcacttcaggaccacagctcttactccgctctggtctacgctattaatagcgaagataccgaaaccctcaaggtcttgctttccgcttgtaaagccaaagggaaagaggtcattatcatcaccaccgccaaactgccatgtggcaagcacaccaccaagcagtacctgaatatgcctcccgtagatattgacggatgccactctcccgcaacatgcaccactccatccgagatcgatataaagacagcttccagtcctctgtcccacagtagtgagaccgaactgaccctttttggttttaaagatttggaattagccggaagcaacgacgacacctgggatcccggatcacccgtccgcaagccagccctagccccaaaaggcccaaaactgccacacgcccctccttgggtcaagagccccccactgttgatgcaccagaacagagttgcaagtctccaggaggagttgcaggacatcactccagaagaggagctcagttacaaaactaacggccttgcattgagcaagcgctttattaccaggcatcagagcattgatgtcaaggatacagcccacttactgagggcgtttgatcaggcaagcagtcgcaagatgtcctacgacgagattaattgtcagtcctacctgtcagaaggaaatcagcagtgcattgaggttcctgtagatcaagatccagactcaaaccagacaatttttgcaagcactcttcggtccatcgtccagaagagaaacctcggcgctaatcattacagttccgacagccagttgagcgccggtctgaccccgcctacatccgaagacggcaaagccttaattggtaagaagaaaatcctgtctccctccccctcccagttaagtgagagtaaggaactgctcgagaacatacccccaggaccactaagccgacgtaaccacgctgtgcttgagcgaagaggctccggggctttccccctcgaccacagcgtgacccagaccagacagggtttcctgcccccactaaatgtgaattctcatccacccataagcgacatcaacgtcaacaacaaaatatgcagcctgctgagttgcggtcagaaggtccttatgcctaccgtgcctatcttcccaaaggagtttaaaagtaagaagatgctgctgaggcgccaatccctacaaactgaacaaattaaacaactggttaatttttag

SEQ ID NO: 28256 - DNA, 1674 bp, Artificial Sequence
  Description of Artificial Sequence: Synthetic coding sequence
atggaccaaagcagggtgttactctgggttaaggcagaacctttcatcgtcggcgctctgcaggtcccccctcccagtaaattcagtttacactacttaaggaaaataagtacatatgttcagatcagggccactgagggagcctaccctcgcctctactggtccacatggcggcacatcgcttgcggcaagttgcagttggcaaaggacctcgcttggctctacttcgaaatcttcgactcattatcaatgaagactcctgaggaaaggttggaatggagcgaagtcctctcaaactgcatgagcgaggaagaagtagaaaaacaaaggaaccaactatccgtcgataccctgcagtttcttttgttcctttatatccagcagcttaacaaagtgtctctgcgcaccagcttaattggcgaggaatggccctctccacggaacaaatcccagagtcccgacttgacagaaaaaagtaattgtcacaacaagaactggaacgattatagccaccaagccttcgtttacgaccacttgtccgacctgctagagttacttttggacccaaaacagttaacagcctcatttcattctacgcacagctcgctcgtgtcccgcgaggccgtggtggccctgagctttctgatcgaaggaactatctcaagagcccgtaagatttaccctctccacgagctagcgctttggcaacccctgcatgctgactccggcttcagcaagatttcaaagaccttctccttctataagctagaaacatggctgagatcctgtctgactgggaatcctttcggaactagcgcctgcctaaagagtggtaaaaaattggcttgggctcatcaggtggagggtactaccaagcgggctaaaatcgcatgcaatacccacgtggcacctcgaatgcaccggctagtggtgatgtcacaggtgtataagcagacattggcgaaatcgtctgataccttggccggagcccatgtcaaaatccaccgttgcaatgaaagcttcatatatctgctctctccattgcgatctgtcactattgagaaatgcagaaattccatattcgtgcttgggcctgttgggaccacactgcatttgcacagttgcgacaatgtgaaagtaatagccgtgtgtcaccggttatctatttcttcaactaccggatgcatcttccacgtcctgactcccacacgccctctgatcctgtctggaaatcagactgtgacctttgcgccttttcatactcactatcccatgctggaagaccatatggcccgtaccgggctcgccaccgtacccaactactgggataatcccatggtggtttgccgggagaactctgacacccgggtcttccagctactcccgccttgcgagttttacgtatttatcattccatttgagatggaaggtgatacgactgaaatccccggtggactcccttcggtgtaccagaaggctctgggacaacgagaacagaagattcaaatttggcaaaagaccgtgaaggaggcacatcttactaaggaccaaaggaaacagtttcaagtgctggttgagaacaagttttatgagtggctaatcaacaccggacatcgccagcagctcgactccctcgtgcctcctgcagccggatcgaagcaggctgctggctag

SEQ ID NO: 28257 - DNA, 648 bp, Artificial Sequence
  Description of Artificial Sequence: Synthetic coding sequence
atggttttccggaggtttgttgaagtcgggagagtcgcctacgttagtttcggaccacatgcgggaaaactggtggccatcgtggatgttatcgaccaaaatagggccctcgtcgatgggccttgcacccaggttcgacggcaggccatgccttttaaatgtatgcagttgactgattttatcttgaagttcccacacagcgcccatcagaaatatgtcagacaggcctggcaaaaagcggatatcaacacaaagtgggctgccacgagatgggccaagaagattgaagctcgggagcgtaaggcgaagatgacagattttgacaggttcaaagtaatgaaagctaagaagatgcggaatcgtattattaaaaacgaagtcaaaaaactgcaaaaggccgctctccttaaggcctctcccaaaaaggctccgggaacaaagggcactgccgctgcagctgctgctgccgcagcagccaaagtcccagctaagaaaatcaccgctgcctcgaagaaggctccggctcaaaaagtacctgcacagaaagctactggccaaaaagccgcacctgccccaaaagcacagaaaggtcaaaaggcaccagctcaaaaagctcctgcccctaaggcatccggaaagaaggcttag

SEQ ID NO: 28258 - DNA, 888 bp, Artificial Sequence
  Description of Artificial Sequence: Synthetic coding sequence
atggagctgatacaggatacgtctaggccacctcttgagtacgtaaaaggcgtccctctgataaagtacttcgctgaggccctgggtccactacagtccttccaggcaaggcccgacgacttgctgattaacacctacccaaaatctggcactacttgggtgtcccaaatactcgacatgatttaccagggaggcgatttggagaagtgtaatcgggctccaatatacgtgcgtgtgccgtttttggaggtgaacgatcccggagaaccctcgggcctggaaactctgaaagatacacctccccctcgcctgatcaaatctcatttgcctctggcacttctgccccaaacattgctggaccaaaaagtgaaggtagtgtacgtcgccagaaacccgaaggatgtggcggtctcatactatcattttcaccgaatggagaaggcacaccctgagccaggcacttgggacagtttcctggagaagttcatggctggggaagtgtcctatggaagctggtaccagcacgtgcaggagtggtgggaattatccagaacccatcccgtcctgtatctattctatgaagatatgaaagagaatcccaaacgcgaaatccaaaagattctcgagttcgtaggccgaagtctgcctgaggaaaccatggacttcatggtgcagcatacctcttttaaggagatgaagaaaaacccaatgaccaattacaccaccgttccgcaggagctgatggatcactcaatctctccatttatgcggaaaggcatggcaggcgattggaaaacaaccttcactgtagctcagaatgaaagatttgacgcagactacgctgaaaagatggcgggatgcagcctgtctttccgaagcgagctgtag

SEQ ID NO: 28259 - DNA, 1368 bp, Artificial Sequence
  Description of Artificial Sequence: Synthetic coding sequence
atgagctccctgggggctagcttcgttcagatcaaattcgatgatctacaattcttcgagaactgtggcggagggtcattcggatcggtgtacagagccaaatggatttcccaagacaaggaggtggccgttaagaagctgctgaagatcgagaaggaagctgagatcctgagcgtgctttctcatcggaatatcatacagttttacggggtgatccttgagccacccaattacgggattgtcactgagtatgcaagtctgggctccctttacgactacattaatagcaacaggagcgaggaaatggacatggatcacatcatgacctgggctactgacgtggccaaaggtatgcattatctgcacatggaagctccagttaaggtcatccaccgtgaccttaagagtagaaatgtggtgattgccgcagacggagttctgaagatttgcgacttcggggctagccgattccacaaccacactacccacatgagccttgtggggacattcccttggatggctccagaagtgatacagtcactccctgtgagcgaaacttgtgatacctactcctatggggtcgtcttgtgggagatgctgaccagagaggtacctttcaaaggtctcgagggactgcaggtggcctggcttgtggtcgagaagaatgaacggctgaccattcccagctcatgcccccgatcgtttgctgagctgctccatcagtgctgggaggccgacgccaaaaaaaggccctcctttaaacagatcatctccatcctcgagtctatgtccaatgatacatcactgcctgacaagtgcaacagtttcctgcacaacaaggctgagtggcggtgcgaaattgaagccaccctggaaagactgaagaagcttgaaagagacctgtctttcaaggagcaagaattaaaagaacgggagcgcagacttaaaatgtgggaacaaaaattgacggaacagagcaacaccccccttcttcttccgctggcagcaagaatgtccgaggagtcatatttcgagagcaagaccgaggagagtaatagcgccgaaatgagttgccaaatcacggctactagtaatggcgaaggccatggcatgaacccgagcctacaggccatgatgctgatggggttcggagacatattctcaatgaacaaagccggagcagttatgcatagcggtatgcagatcaacatgcaggctaagcagaactcttctaagaccactagtaaacggagaggcaagaaagtgaacatggctttaggcttttctgactttgacctgtctgagggggacgatgacgatgatgatgatggggaagaggaggataatgatatggacaattccgagtag

SEQ ID NO: 28260 - DNA, 423 bp, Artificial Sequence
  Description of Artificial Sequence: Synthetic coding sequence
atgcggtttagattctgcggggatctggattgcccagactgggtcctggccgagatctccaccctggccaagatgtcaagcgttaagctgaggctcctgtgtagccaggttctgaaagaactgctgggccaggggatcgactatgaaaagatcctcaaattaacagcagacgctaagttcgagagcggtgacgtgaaggccactgtggctgtcctaagctttattctatcttccgccgctaagcactccgtcgatggggagtccctcagcagcgaactccagcagttggggctgcctaaagaacatgccgcttcactttgtaggtgctatgaagagaagcagagcccactgcagaagcacctgcgcgtgtgttccttgcggaagttaaagcaggcacagacactcatgtctagtctgggttag

SEQ ID NO: 28261 - DNA, 573 bp, Artificial Sequence
  Description of Artificial Sequence: Synthetic coding sequence
atgaccgcctctgcctctagcttctccagcagtcagggagtccaacagccgagcatttattccttctcacagataacccgcagtcttttcctctcaaacggtgtcgcggctaacgacaaactgctcctatcttcgaatcgcatcaccgctattgttaatgcatctgttgaagtggtcaatgtcttcttcgaggggatacaatacattaaagtgcctgttacagatgctcgggactcaaggctctacgatttcttcgaccccatcgccgatctgattcacactattgatatgaggcagggccgaaccctgttgcactgtatggccggagtcagtcgatctgccagcctgtgcctcgcatacttgatgaaatatcacagtatgtccctcttggatgcccacacttggaccaaatctcggagaccaatcatcaggcccaacaacggattttgggagcagctcatcaattacgagttcaagcttttcaacaacaacaccgtccgaatgatcaatagcccagtcggcaacatccctgatatttatgagaaggatctcaggatgatgataagcatgtag

SEQ ID NO: 28262 - DNA, 3576 bp, Artificial Sequence
  Description of Artificial Sequence: Synthetic coding sequence
atgctcaggaagttaacaatcgagcaaatcaatgactggttcaccataggtaagacggtgacaaatgtggagttactgggcgctccacctgcctttcctgcaggcgctgctcgggaagaagtgcagcggcaagatgttgcccctggggcagggccagcagctcaggcaccagcgttagcccaggcccctgccagaccggcagcagccttcgaaagatccctgtctcagaggagtagcgaagtcgaatacataaacaagtatagacaacttgaggctcaagaacttgacgtgtgtagaagtgttcaaccaacttctgggccaggaccacgaccaagtttggcgaaattgagcagcgtaacatgcatccccggaaccacttataaatatcccgacctgcccatctccagatacaaggaagaagtggtgagcttgatcgaaagcaatagtgtggtgattatacatggggcaacaggctcaggcaagtctactcagctgccacagtacatcctggaccactacgtacagaggtcggcttactgctccattgtagttacgcagcctcgtaagatcggggctagtagcatcgcacgctggatttccaaagaacgagcctggacactaggaggtgttgtaggctatcaggtgggcctggagaagatcgcgacagaagacacccgtctcatatacatgactacaggagtcttacttcagaaaatcgtgtcagccaagtctttaatggagtttacgcacatcatcatcgatgaagtacacgagagaaccgaagaaatggatttcctgctgctggtggtaagaaagctgctgcgtacaaactctcgatttgtgaaagttgttctgatgtcggcgactatctcttgcaaagagttcgcagactacttcgccgtcccagtgcagaataaaatgaaccccgcttacattttcgaagtggaaggcaagccacactccgtggaggagtattacctgaatgatctggaacacatccaccactccaagctcagcccacacctgctggaagaacctgttattacaaaggacatttatgaggtagctgtttcattaatccagatgtttgacgatctcgatatgaaagagagtggtaataaagcttggtcgggggctcagttcgtgctggaaaggagttctgtactggtcttcttaccaggattgggagaaataaactacatgcacgagcttctgaccagcctcgtacataagcgtctgcaggtgtacccactgcacagcagtgttgcccttgaagagcagaataatgtgtttctaagtccggtacctggttatagaaagatcattctgtccacaaacattgccgagagctcagtgaccgtcccagacgttaagtatgtgattgatttctgtctaacgcgcaccctcgtgtgtgatgaagacaccaactatcagagcctgaggcttagttgggcaagtaaaacatcttgcaaccagagaaaaggcagggcagggcgagtgagccggggatattgctataggttagtgcacaaagatttctgggacaactctattcctgatcatgtcgtgcctgagatgttgcgttgccccctgggatcaacgattttgaaggtgaagctcctggatatgggcgagccccgagcccttctggccacagccctgtcccccccaggattaagcgacatcgagcggacaatacttcttttaaaagaggtcggtgccttggccgtgagtggtcagagggaggacgaaaacccgcacgatggcgagctgacttttctcggtagagtattagcccaactgcccgtgaatcagcagttaggaaaactgattgtgctgggccatgtgtttggctgtctcgacgaatgcctgatcattgcagccgcactgtccctgaagaacttcttcgccatgccgttcaggcagcacctggatggctaccgtaacaaggtcaatttctcgggctctagtaaaagcgattgcattgccctggtcgaggccttcaaaacgtggaaggcatgtagacagacaggcgagctccggtaccccaaggatgaactcaactggggaaggctcaactatatacagatcaaacgaatcagagaggtcgcagagctttacgaggagcttaagaccagaatatcccaattcaacatgcacgtggattctagaaggcccgtgatggaccaggaatacatttacaagcagagattcattctccaggtagtgctggccggagcattctatcccaattacttcacgtttggacagccagatgaagaaatggcggtccgtgagctagccggaaaagaccctaagactactgttgtgctaaaacatatcccgccatacggattcctttattacaagcagctgcagtccttgtttcgccaatgcggccaggttaaatcaatagtctttgacggagcaaaagccttcgtggaattttctcgcaatcctacagaacgcttcaaaactctaccggctgtgtatatggccattaagatgagtcagctgaaggtgtccctagagctgtctgttcacagcgcagaagagattgaaggaaaggttcaaggcatgaatgtgagcaaattgcgaaacacccgcgttaacgtggattttcaaaagcagacagtggacccaatgcaggttagcttcaacacatccgatcgatcacagaccgtgacagacttgctcctgaccattgatgtgaccgaggtggtggaggttggccatttctggggatacagaatagatgaaaacaacagtgaaatcctcaagaagctaaccgccgagatcaatcagctcactctggtgcctttacccacccacccccacccagatttagtgtgcctggcgccattcgcagactttgacaagcagaggtatttccgggctcaggtgctttacgtctccgggaatagtgcggaagtgtttttcgtggactatggcaacaaatcccacgtggacctgcatctcctgatggaaattccgtgccaatttttggaattgcctttccaggccctggagttcaaaatctgtaagatgcggccatcagccaaatcactcgtgtgcggaaagcactggtccgatggcgcatcccagtggttcgccagtctcgtgagcggatgcaccctgctcgtgaaagttttctctgtagttcatagtgtgctccacgtagacgtgtaccagtactcaggagtgcaggacgccattaatatcagggacgtgctgatccaacagggctatgccgaactgacagaagagtcttatgagtcgaaagtaaatatattaagagcagcgattaacaagcttgtgtgtgacgggccaaacggttgtaaatgtctgggacctgaaagagttgcccagttacaggatatcgctcggcagaagctgctcgggctcttctgccagagcaaaccaagagagaagatagttcccaaatggcacgagaagccttacgaatggaatcaggtggaccccaagcttgttatggagcaggccgaccgggaaagttcaagaggcaaaaacacgttcctttaccagttgcataagctggttgttcttggcacctag

SEQ ID NO: 28263 - DNA, 906 bp, Artificial Sequence
  Description of Artificial Sequence: Synthetic coding sequence
atgacaagacatggcaagaattgtactgctggggcagtgtatacgtatcacgagaagaaaaaggacactgccgcatctggctacggaacacagaacattcgactcagtcgtgacgccgtgaaggacttcgattgttgctgtctgtcactgcagccgtgtcacgatcccgtcgtaacacccgacggatatctctacgaacgggaggcaatcctggagtacattctccaccaaaaaaaggaaattgccagacaaatgaaggcctatgaaaaacagcggggaacaaggagagaagagcagaaggagttgcaaagagctgcgtctcaggaccatgtcaggggcttcctagagaaggagtccgccattgtttcacgccctctcaacccctttactgcaaaagcattaagcggtaccagccccgatgacgtccaacccggtccctccgtagggcctccaagcaaagacaaggataaagtactaccgtcattctggatccctagtctgaccccagaggcaaaggctacaaagctcgaaaaacctagccgcaccgttacttgtccaatgagcggtaaaccattgagaatgtctgaccttactccagtgcacttcactccactcgactcaagcgttgaccgtgtggggctgattaccaggagcgagagatacgtgtgtgctgtgactcgagattcgttgtctaacgccacaccttgcgcggtactcagacctagcggtgccgtggtgaccctggagtgcgttgagaaacttatacgcaaggacatggttgatccagttacaggggataaactgaccgatagagatatcattgtactgcagcgcggaggtaccggattcgctgggagtggggtcaagctccaggccgagaaatcccggcctgtgatgcaagcctag

SEQ ID NO: 28264 - DNA, 1509 bp, Artificial Sequence
  Description of Artificial Sequence: Synthetic coding sequence
atgcaaagctgtgaatcgtctggggactcagctgatgaccccttgtcccggggactgcggaggcgtggccagccaagagtcgtcgttataggggctgggctggcaggccttgcagccgctaaggcacttctggaacaggggtttactgacgtaaccgtcttggaggcctcttctcatattggtggtagagtacagagtgtgaagctgggacacgcaacattcgagctcggcgctacatggattcatggctctcatggaaacccgatttatcatctggcggaagcgaacgggctgctggaggagactaccgacggtgaacggtccgtcggtaggattagcctatactcaaaaaatggcgtggcctgctacctgactaatcatggaagaagaatccctaaggacgtagtggaggaattcagtgatttatataacgaggtgtacaatctaacccaagaattctttaggcacgacaagcccgtcaatgcagagagccaaaactccgtgggcgtgttcacaagagaagaagttaggaatcgtatccgcaatgaccctgacgaccctgaagccaccaagaggcttaaactggccatgatccaacagtacctcaaagttgagtcctgcgagtctagtagtcattctatggatgaagttagcctgtctgcttttggagaatggacggagattcccggtgctcaccacataattccttctggcttcatgagagttgtggaattgctggctgagggcatcccagctcatgtcatacaactggggaaaccggtccgatgcatccactgggatcaggcctccgcccgtccccgtggcccagagatagagcccagaggagtcctgaaacggcagtatacaagcttctttcgcccaggtctcccaactgagaaggtcgcagcaattcaccgcctcggcattgggaccaccgacaagatcttcttagaatttgaagagcctttttggggccctgaatgcaactcactccagttcgtatgggaggatgaggccgagtcacatactctgacgtatccccctgaactatggtaccgcaaaatttgtggcttcgacgttctgtaccccccagagaggtacggccacgtcctctcgggctggatctgcggcgaagaggcattagtgatggagaagtgcgacgatgaggccgtggccgaaatctgcacagaaatgcttaggcagttcacaggcaacccaaacattcccaagcctagacgaatactgcggagcgcatggggctcaaatccttactttcggggatcatatagctacactcaggtcggatcctctggcgcagatgtggaaaaattggcgaagcctctgccgtatactgaaagctctaagacagctcccatgcaagtgttgttctccggtgaggcgactcaccggaagtactacagtaccacccatggcgcactattaagtggccagcgagaagccgcaaggctcattgaaatgtatagagaccttttccagcaggggacttag

SEQ ID NO: 28265 - DNA, 579 bp, Artificial Sequence
  Description of Artificial Sequence: Synthetic coding sequence
atgggaacattcgatctgtggactgattatctgggcctggcccacctggtgcgtgcactttctgggaaggagggccctgagaccagactatcgccacagccagagccggagcccatgctagaaccagtctcagcactcgagccaatgccagcccctgagtctgtgcctgtgcccggtccgaaagatcagaagcgcagtcttgagtcttccccagccccagagagactgtgttccttctgcaagcacaatggggagagccgcgctatttaccagagccatgtcctcaaggacgaagccggacgggtactgtgcccaatcctgagggattacgtgtgtccacagtgcggagccacgagagagagagcacatacccgtcgattttgcccccttacaggccagggctacacgtcagtctactctcacacaactcgcaattctgctggaaaaaaactcgtgcgacccgacaaagcaaagactcaggataccggccaccggcgtggtggaggtggcggtgcgggattcaggggtgcaggaaagtcagagccatctccctcgtgctctcccagcatgtctacctag

SEQ ID NO: 28266 - DNA, 2568 bp, Artificial Sequence
  Description of Artificial Sequence: Synthetic coding sequence
atggccgttgaggacagtacactgcaagttgtggttagggtccgccctccaacaccgcgtgaactggacagccagaggcgcccagtcgtgcaagtcgtggacgagagggtcctcgtcttcaacccggaggagcccgacggcggttttccagggttgaaatgggggggaactcatgatggtccaaagaagaagggtaaggacctgacgttcgtcttcgacagggtatttggtgaagccgctacacagcaggatgttttccaacatacaacacactctgtactggatagcttcctccaggggtataactgcagcgtgtttgcttacggcgcaactggcgctgggaagactcatactatgcttggcagggagggtgacccaggcatcatgtacttaactacagtggaattatatcggcgactagaggcgagacagcaagaaaaacatttcgaggtcctcataagctaccaggaagtgtacaacgaacagatacacgacctcctcgagccaaaagggccacttgcaatacgcgaagatccagataagggtgtagtggtacaagggctcagcttccaccagcccgcttcagcagaacaactgctcgagattttgacccgcggtaatcgcaacagaacacagcaccctactgatgctaatgcaacgtcttcccgttcccacgccatattccaaattttcgtcaaacagcaggaccgggtgccaggcctcacacaggccgtccaggttgccaaaatgagcctgatcgacctcgcagggagcgaacgggcaagctcaactcatgccaagggagagagactgagagagggcgctaatattaatagatcccttctggccctgattaacgttttgaacgccctggccgacgccaagggacgcaaaacccacgtgccttacagggatagtaagctgacacggctgctcaaggactcacttggcggaaattgcagaacagtcatgattgcagcaatcagtccctctagcttgacctatgaagacacatacaacacattaaaatacgccgaccgcgcaaaggaaatccgcttgagccttaagagcaacgtgacttccctggattgccacatctctcaatacgctacaatatgccagcagctacaggcagaggtggcggcactgcggaaaaagctccaagtatatgagggagggggtcaacctcctccccaagatctccccggaagccccaagtccgggcctccacccgagcacctgccgagctcacctctgcctccacatccaccttcacaaccatgtacaccggagctgcctgccggtccacgcgctctccaggaggagagtttagggatggaggcacaagtggagagggccatggagggcaattcaagcgaccaagaacagagcccagaggatgaggatgagggcccagccgaagaggtgccaactcagatgcccgaacagaatccaacccacgccctgcccgagagccctcgattgaccttacagccaaagcccgtcgtgggccatttttccgctcgtgaattggatggagatagatccaaacaactcgcattgaaggtgttgtgcgtcgcccaaagacagtactcactactccaagcagccaatctcctcactccggacatgattactgaatttgaaaccctgcagcaactggttcaggaggaaaagatcgaaccaggagctgaagccttaagaaccagcgggcttgctaggggtgcacccctcgcccaggagctctgcagcgagagcaaaccccctggctacacgggacctgttacaaggactatggcacggaggctgtcgggccctctccacacgttggggatcccacctgggccaaattgcacgcccgctcagggcagtcgatggcctatggaaaaaaaaagacgcaggccaagtgcacttgaagcagattcaccaatggccccaaagagaggcactaagaggcaaagacagtctttcctcccttgtctgcggaggggtagcttgcccgatacccagcctagtcaggggccatccactccgaaaggagagagagcctcttcaccctgccatagccctagagtgtgccccgcaaccgtgattaagtctagagtacccctcggcccatcagccatgcagaattgcagcacgccactggcgttgccaacacgtgatttaaacgcaactttcgatctttccgaagagcctccctccaagccctcgttccatgaatgcattggctgggacaagattccccaagagctgtccagattggatcagcccttcattcctcgcgctccagtgccgctattcaccatgaaggggccaaagccgaccagttcattgccaggcaccagcgcttgcaagaagaagcgagtggcctccagttctgtatcgcatggaagaagcaggattgcgcgactgcccagcagcactctcaagcggccagctggcccactcgttttacctgaattaccgctgtcacccctttgcccatctaaccgccgaaacggaaaggacttgataagagtgggtagggccctcagcgcagggaacggtgtgacaaaagtgtcttag

SEQ ID NO: 28267 - DNA, 444 bp, Artificial Sequence
  Description of Artificial Sequence: Synthetic coding sequence
atgtggaaatttccaggtgggctgtctgagcccgaggaagatataggggataccgctgttagggaagtgttcgaagagactggtataaaatcagaattccggtctgtcttatccatcagacagcaacacacaaaccctggggcatttggtaaaagcgacatgtatatcatttgccgcctgaaaccttacagctttacaataaatttctgccaggaggagtgcctgcgatgcgagtggatggacttaaatgacctggccaagaccgaaaacacaactcctatcacaagccgagttgctcggctgctgctgtatggctaccgcgaaggattcgacaaaatcgacctcaccgtggaagagctcccggcagtgtacactggcctgttttacaaattataccataaggagctccccgagaattacaaaactatgaagggtatcgactag

SEQ ID NO: 28268 - DNA, 3327 bp, Artificial Sequence
  Description of Artificial Sequence: Synthetic coding sequence
atggccttacgccctggcgcagggtcggggggagggggtgcggcaggcgcaggggcaggtagcgctgggggaggtggcttcatgtttccagttgccggagggattaggcctcctcaggccggtctgatgccaatgcagcagcaaggatttcccatggtttctgtgatgcagcctaatatgcagggaatcatgggtatgaattactcctctcaaatgagtcagggcccaatcgcaatgcaggccggaatccctatgggaccaatgcctgccgcaggaatgccctacttagggcaggcacctttcttaggaatgcgaccccctggccctcaatataccccagacatgcagaagcaatttgctgaagagcagcagaaaaggttcgagcagcagcagaaactactagaggaggagaggaagaggcgccagtttgaagaacagaaacagaagctgagattgctgagctctgtgaagcccaagacaggagagaagtcaagagacgacgcattagaggccattaagggcaacctcgacggctttagtcgggacgccaaaatgcatcctacgcctgctagtcacccgaaaaaacctggggtgggcgtatttccatcccaggacccagcccagcccagaatgccaccctggatttacaacgaaagtctggttccagacgcatacaagaaaatcttggaaactacaatgacccccacagggatagatacggctaagttgtatcccatcctcatgtcgagtggcctgccaagagaaaccctaggacagatttgggccctggctaaccggacaacacctggcaaactgaccaaggaagagttgtacacagtgcttgctatgatcgcagtgactcaggtcgtgaaaccggaggaagacgactttcaggatttccaggacgcctccaaatctggaagcctcgatgattctttctcagatttccaggaactgcccgcatcctctaaaacctcaaacagtcaacatggcaatagcgccccttctctgctgatgccactgcccggaacaaaggccctgccatcaatggacaaatatgctgtgttcaaggggattgcagcggacaaatcgtccgaaaataccgtgcctccaggcgaccccggagataagtatagcgcattcagagaactcgaacagactgcagagaacaaacccctgggagagtcctttgccgagttccggtccgccggaacagacgacggcttcacagacttcaagaccgcagattccgtcagccctctggagccccctactaaagacaaaacctttccaccttcttttccatcagggaccatccagcagaaacagcaaactcaggtgaaaaacccactcaatctggcagatttggatatgtttagttcagtgaattgttccagtgagaaaccgttaagcttttcagctgtattcagcacatccaagtcagtgtccactcctcaatctacaggttcagcggcaaccatgactgctttagcagccactaagacgtcgagtctggccgatgacttcggcgagttttcgctgttcggagagtactctggactggcgcctgtaggggagcaggatgacttcgcggattttatggcattctcaaactcctcaatttcaagtgagcagaagccagatgataaatacgacgcattgaaggaagaagctagcccagtccctctcaccagcaacgtgggaagtacagtaaaagggggacagaatagcaccgccgcttctactaagtacgacgtgtttcggcaacttagcctcgaggggagcggccttggagtggaagatctcaaagacaatacacctagtggcaagtcagatgacgacttcgccgacttccacagtagtaagttcagcagtatcaacagtgataagtccttgggggagaaagccgttgcatttagacacactaaagaggatagtgccagtgtgaaaagcctcgaccttccctcaatcggcggaagcagcgtcggcaaggaagattcagaggacgctctgagcgtccaattcgatatgaagctagcagacgttggtggcgatctgaagcacgttatgagcgactcatctctggatttgccaacggttagcgggcagcatcccccagcggcagccggatcaggttcaccaagtgctacctccattctccagaaaaaagaaacaagctttggcagttcagagaatatcactatgacgagcctgagtaaggttaccacattcgttagtgaggatgctctccccgaaacaactttccccgctctcgccagcttcaaggacacgatacctcagaccagcgaacagaaagagtacgaaaacagagactataaagacttcactaaacaggacctccccactgccgaaagaagccaggaggccacttgtcccagccccgcttcgagtggtgcaagccaggagacacctaacgagtgcagcgatgatttcggcgagtttcagtctgagaaacccaaaatatcaaagttcgatttcctagtagccacttcacagtctaagatgaagagctcagaagaaatgatcaaatctgagttagcaactttcgatctctccgtgcaaggttcccataaaaggagccttagcctgggcgataaggagattagtagaagctcccccagtccggctctagaacagcccttccgcgatcgttcaaacacacttaatgaaaagcctgctctgccagtgattagagataagtacaaggatttgaccggggaagtggaagagaatgaacgttatgcatatgagtggcagaggtgcttgggaagcgctctaaacgtcatcaaaaaagccaacgatactttgaacggcatctccagcagtagcgtgtgtacagaagtgattcagtctgcacagggaatggagtatctcctgggggtagtggaagtgtacagagttactaaaagggtagagctcggtattaaggctacggctgtgtgtagcgagaaactccagcaactgctgaaagatattgataaggtgtggaacaatctgattgggtttatgtctcttgccaccctgacgcctgacgagaattccttggacttctcttcctgcatgctacgcccaggcataaagaatgcccaagaactagcctgcggggtatgtctgctgaacgtagacagccgttctagaaaagaagaaaagccagccgaagaacacccaaagaaagccttcaatagtgaaacagatagttttaagctggcatatggtggccaccaataccacgcgtcttgtgctaatttttggattaactgcgtggaaccaaagcccccaggcctggtgctacccgaccttctgtag

SEQ ID NO: 28269 - DNA, 1257 bp, Artificial Sequence
  Description of Artificial Sequence: Synthetic coding sequence
atggaaacacacatctcctgcttattcccagagctcctggccatgatcttcgggtatctcgacgtgcgcgataaggggcgtgccgctcaggtttgcaccgcctggcgagatgccgcataccataaaagcgtgtggagaggggtggaagccaagctgcatctacggcgagccaaccccagcctctttccatcccttcaggctcgcggaatccgtcgggtgcagatcctgagcctgcggagatccctcagctacgtaatccagggcatggcaaatattgaatctctgaatctgagcgggtgttacaatctgacagataacgggctgggccatgcgtttgtccaggagatcgggagtctaagggccttgaacttatctctatgcaagcaaatcacagactccagtttgggtcggatcgctcagtacctgaaggggctggaggtgcttgagctcgggggatgctctaatatcactaataccggtcttttgctcatagcttggggactacaaagactgaaaagccttaatctccgcagctgcagacatctctcggatgtgggtattggacatcttgcaggaatgacccgatcagctgcggaaggttgtctcggcctggagcaattgactcttcaggactgccagaaactcactgatctgagcttaaagcacatcagtcggggacttacaggattgcgcctgttaaatctgtcgttctgcggagggatctctgacgcgggacttctgcacctctctcacatgggaagccttcgatccctgaacctgcggtcctgtgataacatctccgataccggtattatgcatctcgccatggggtccttacgcctgtcaggactggacgtgtcgttctgcgacaaagttggcgatcagtccctcgcatacatcgcacagggactcgacggcctgaagtctttaagtctttgcagctgccacatatcagacgatggaataaatcgaatggtcagacaaatgcacggtctgcgtacccttaacattggccagtgcgtgagaattaccgataaaggtctggagctaatcgctgagcatctctcccaattgacaggcatcgatttatatgggtgtacacgcataaccaagcggggactggagaggatcacccaacttccttgcttaaaagtactgaacctcggcctttggcagatgacggattcagaaaaggaggcgagaggggatttcagtcccctctttacagtgcgaacaaggggatcctccagacggtag

SEQ ID NO: 28270 - DNA, 1371 bp, Artificial Sequence
  Description of Artificial Sequence: Synthetic coding sequence
atggccgctgccctgaagtgtctgttgaccctggggagatggtgcccaggactgggagtggccccacaggcaagagcactggctgccctagtgcccggagtgactcaggtagacaacaaatctggattcctccagaaacggccacatcgccagcatccgggtatactgaagctgcctcacgtgagactgccccaggccctggctaatggagcgcagctattgctgctgggctccgcgggtccaaccatggagaatcaagtacagacactcaccagctacctttggagtaggcacctgcccgtcgagcctgaagaacttcagagacgggctcggcatcttgagaaaaagtttctggaaaaccccgatctgagtcagacagaagagaagctgcgcggagctgtgctgcacgcactgagaaaaaccacatatcattggcaggaactgtcctacacagagggtctgtccctggtttacatggcagccagattggatgggggattcgcggctgttagccgggctttccacgagatacgagctcgcaatccagcattccagccacagacattaatggattttggatctgggacaggctcagtcacatgggcggctcacagcatttggggacagagtctgcgcgaatatatgtgtgtcgaccggtctgcggctatgctggtgttggcggagaagctccttaagggcggttcagagtcaggcgaaccctacatccccggagtgtttttcaggcagtttctgccagtgagtccaaaggtccagtttgacgttgttgtctcagcgtttagcctcagcgaactcccatccaaggctgatcgtacagaagtggtgcaaaccctgtggagaaaaactgggcactttttggtcctcgttgaaaacggaacgaaggctggccacagtctgctgatggatgccagagacctggtcctgaagggcaaggagaaatccccgttggaccctcggcctggctttgtgtttgccccttgcccacacgaactcccatgtccacaattgacaaacctcgcttgttctttctcgcaggcctaccacccaatacctttcagctggaataagaagcctaaggaagaaaagttctccatggtcattttggcaagggggtcgccagaggaagcccacagatggccccgtataactcagcccgttctcaagcgccctcgccatgtgcattgtcacctgtgctgccccgacggacacatgcaacatgcggtccttaccgctaggcgacatggtcgggatttgtaccggtgtgctcgggtctcttcgtggggcgatctattgcccgttctcacacctagtgccttcccgccaagcacagcccaggacccatcagaatcttag

SEQ ID NO: 28271 - DNA, 756 bp, Artificial Sequence
  Description of Artificial Sequence: Synthetic coding sequence
atggacatgaagaggaggatccaccttgaattaaggaataggacacccgctgccgtgagggagctcgtactggacaattgtaagagcaatgacggcaagatagagggcctcactgcggagtttgtgaacctggaattcctgagcctgattaacgtgggtctaatatctgtatctaacctaccaaagctccccaagttgaaaaaactcgagctgagtgagaatcggatatttggcggactggatatgctggcagagaaactgcccaatctgacacatctaaatctgtccggcaacaaacttaaggatatcagtacattagagcccctgaagaagttagaatgcctgaagagtctagacctgttcaactgtgaggtcactaacctcaatgattaccgggaatctgtctttaagctgctaccgcagctgacttatctcgacggatatgatcgtgaggatcaggaggcacccgacagtgatgccgaagttgacggagttgatgaagaagaggaggatgaagaaggagaggacgaggaggatgaagacgatgaagacggagaggaagaggaattcgacgaagaagacgatgaggacgaggacgtggagggagacgaagacgatgacgaggtaagtgaagaggaggaagagtttgggctggatgaggaggatgaggacgaagatgaagacgaagaggaagaggaagggggtaagggtgaaaagaggaagagagagactgacgacgagggggaagacgattag

SEQ ID NO: 28272 - DNA, 510 bp, Artificial Sequence
  Description of Artificial Sequence: Synthetic coding sequence
atgtccgctccccctgcacttcagatccgggaagccaatgctcacctcgccgcagtccatcggagagctgcagagttagaagccagattagatgccgctgagcggactgtacacgctcaggcagaacggctcgccctgcacgaccaacaattacgcgctgccctggatgaactcggtagagccaaagatagggagatagctacacttcaggagcagctaatgacctctgaggcgaccgttcatagtctccaggccactgtgcatcagcgggatgagctaatccgccagctgcagccccgtgccgaactgctgcaggatatttgccgacggaggcctccccttgctgggctcctggacgcccttgccgaagctgagagattagggcctctacccgcttccgaccctgggcatccacctccaggcggaccaggaccccctttagacaactcaacaggggaagaggcagaccgagaccacctgcagccagccgtgttcggcaccactgtgtag

SEQ ID NO: 28273 - DNA, 2079 bp, Artificial Sequence
  Description of Artificial Sequence: Synthetic coding sequence
atgaaaatcttttgctcccgggcaaaccccacgaccggtagcgtggaatggttggaagaggatgagcactatgattaccaccaagagattgctcgatcatcttatgcagatatgctacacgacaaagaccgaaacgtgaagtactaccaggggatccgcgctgctgtcagccgtgtaaaggacaggggacagaaggcactggtgttggatatcggcacaggaactggactcctgtcaatgatggccgtgacagccggagccgacttctgttacgccatcgaagtcttcaaacctatggccgacgctgccgtgaagatagttgaaaagaacgggttctcggacaaaattaaagtgatcaataaacactcaactgaggttactgtgggacctgaaggtgacatgccatgtagagctaatatactggtgactgagctctttgacacagaactaataggggagggcgctctgccttcgtacgagcatgcccataggcacctggtagaagaaaactgcgaggccgtccctcacagagccactgtgtacgctcagctcgtcgaaagcgggaggatgtggtcctggaataaactgttccccatacacgtgcaaacaagtttgggggagcaagtgattgtccctcccgtcgatgttgagtcgtgccctggagctcctagcgtatgtgatattcagctcaaccaggtctcccctgccgactttaccgtcctgagcgatgtgcttcctatgtttagtatcgatttcagtaaacaggtatccagctccgctgcctgtcactctaggcgttttgaaccattgaccagcggcagggcacaggttgtcttgtcatggtgggacattgagatggatcctgagggtaagatcaaatgcacaatggcgcctttttgggctcattccgaccctgaagaaatgcagtggagggatcactggatgcagtgtgtctattttcttcctcaggaagaaccagtcgtgcaagggtcggccctctacctcgtggcacaccatgacgactactgcgtatggtacagtttgcaacgtacttctcctgagaagaacgagcgggttaggcagatgcgacctgtatgcgattgccaggcccacctcctgtggaaccgaccaaggtttggcgagatcaatgaccaggatcgaactgatcggtacgtccaggctcttcggacagtgctgaaacctgactcagtgtgcctgtgcgtaagtgacgggagcctcctgagtgtcttagctcaccacttaggtgtggagcaggtcttcacggtggagtcctcagccgcaagccataaacttctccgaaagatatttaaagcaaatcaccttgaagataaaatcaacattattgaaaagagacccgaactgttgactaatgaggatctccaggggaggaaagtgagtctgctcctcggagagccattcttcactacatccttgctcccctggcacaacctgtacttctggtacgtccgcaccgccgtggatcaacacttgggccctggggcaatggtgatgccacaggctgccagcctgcacgccgtggtagtggaattccgggacttgtggaggatacgctctccatgcggggactgtgaaggcttcgacgtgcacattatggatgatatgatcaagcgtgctctggatttccgggaatcaagagaggctgagccgcaccccctatgggagtatccttgccggagtctcagcgagccgtggcagattctcacgtttgacttccaacaaccagtgcccctgcagccactgtgtgccgaagggaccgtcgaactacgccgaccaggccaatctcacgcagctgtcctttggatggaataccacctgaccccagagtgtacactgagcactgggctcctggaacccgctgacccggagggaggatgttgctggaacccccattgtaagcaggccgtctacttcttcagcccagctcccgatcctcgggctttactcggcggacccagaacggtgtcctatgcagtcgaattccatccagacacaggggatattatcatggagtttaggcacgctgacactcctgattag

SEQ ID NO: 28274 - DNA, 468 bp, Artificial Sequence
  Description of Artificial Sequence: Synthetic coding sequence
atgaccgtcgaggggcctccccctaaagacaccggcattgcccgtgttcccttggcgggtgcggcaggaggccctgggatcgggagagcagcgggacgtgggattcctgcaggcgtgcctatgccccaggcccctgctggccttgcagggccagtccgcggagttggaggcccaagccagcaggttatgaccccccagggacggggaacagtggccgctgcagccgcagccgcaacagctagtattgctggcgctcccacccagtaccctcctggtagaggaggccctccccctccaatgggtcgaggtgctccacccccaggaatgatgggcccaccacccggaatgagaccacccatgggaccgccaatggggattccaccagggcgaggtacaccgatgggaatgccaccacccggaatgcggccaccccctccaggaatgcgaggcaaatgtctgcaatggtag

SEQ ID NO: 28275 - DNA, 402 bp, Artificial Sequence
  Description of Artificial Sequence: Synthetic coding sequence
atgacgcgaggtaaccaaagggaactagccagacaaaagaatatgaagaaacaaagcgatagcgtgaaaggcaagcgcagggacgacggactgagcgccgctgctcggaaacagagcgcaccctcttcactgcccccaggcacacgacggtcatgctccaggagtagaaaaaggcaaacccggcgtaggcgtaatccgtcctcctttgtcgcctcttgccctacacttctccccttcgcatgcgtgccaggcgctagcccaaccacgctggcattcccacctgtcgtgcttacaggcccaagcactgacggaatcccgttcgctctgtctctgcagcgcgtgcccttcgtcctgccaagcccacaggtagcgtctcttccactggggcattcacgcggatag

SEQ ID NO: 28276 - DNA, 1809 bp, Artificial Sequence
  Description of Artificial Sequence: Synthetic coding sequence
atggccgagttcagggtacgtgtgagtactggggaagccttcggtgcgggaacctgggataaggtgtcagtctcaatagtggggacacgtggcgagagcccccctcttcctctcgataacctgggcaaggagttcaccgcaggggcagaagaggacttccaggtcacattgcccgaggatgtcgggagagtgctcctgctgcgcgtgcataaggcaccacccgtccttcccttactgggaccactcgcccctgatgcttggttttgccgctggtttcagttgaccccgccaagaggcggacacctcctttttccttgctatcagtggttagagggagcaggcaccctcgtgttacaagagggtaccgcaaaggtgagttgggctgatcaccacccagtactccaacagcaaaggcaggaggagctccaagcacgccaggaaatgtaccagtggaaagcctataatcctggatggccccactgtctggacgaaaaaactgtcgaagacctggagttgaacataaaatactcaacagcaaagaacgctaacttctatctgcaggccggttccgcctttgccgagatgaaaatcaagggccttctcgatcggaagggtctgtggcggagtctgaacgaaatgaagaggatattcaattttagaagaacccctgcggcagaacatgcatttgagcactggcaggaggatgccttcttcgccagccagtttctgaatgggttgaaccctgtgctcatccggaggtgccattatttaccaaaaaacttcccagtcacagatgctatggtagcatcggtactaggacctggcacatcactgcaggctgaacttgaaaaggggtctctctttctggttgatcacggtatcctgtccggcattcaaactaatgttattaatggaaagcctcagttttctgcggctcctatgacactcctctatcagtcccccggttgtggccctctcttgcctttagccattcaattgagccagacaccaggtcctaactctcccatcttcctgccgactgacgacaagtgggattggctcctcgctaaaacttgggtgagaaacgcagagttctcatttcatgaggcattgacacacttgctgcactctcacctgctccccgaggttttcactctggctacactgaggcagttacctcattgccatcctctgtttaagtctactggcatcggaatagaagggttttcggagctaatacagcgaaacatgaagcagctcaactacagcctcttgtgcctgcctgaagatatcaggactcggggagtggaggatatacccggatactactatcgtgatgatggcatgcaaatttgggggatcccctcatccctggagacgcgcgaagcgctggtgcagtacgtaactatggttattttcacttgctccgcaaagcacgccgctgtctccgcaggacagtttgactcgtgcgcctggatgcccaatttaccaccatctatgcagctccctccccctactagtaaggggctcgcgacgtgcgaaggttttatcgccaccctacctccagtgaatgctacttgtgacgtgatactggctctgtggctcctgagcaaggagccaggagaccaaagacccctgggcacttacccggatgaacactttaccgaggaagcccctaggagaagtatagctactttccagtctcgtctggcccaaatatcccggggaatccaagaaagaaatcagggtctggtgctaccctacacttacctggacccaccccttattgagaactctgtatccatttag

SEQ ID NO: 28277 - DNA, 3123 bp, Artificial Sequence
  Description of Artificial Sequence: Synthetic coding sequence
atggttagttccgctcagatgggctttaacctccaggcactcctggaacagctttcccaggatgagttatccaagtttaagtatctcataaccaccttttccctggcacacgagcttcagaaaattccacacaaagaggtggacaaggctgacggaaagcagctagtggagattctgaccacccattgcgactcgtactgggtagagatggcttcacttcaggtgttcgaaaagatgcataggatggatctgtctgagcgcgctaaagacgaggtgcgggaggcagccctgaaaagtttcaacaaaagaaaacccctgtcccttggaataactagaaaggaacggcctccccttgacgtggatgagatgctggagcgcttcaagaccgaggctcaggacaaggacaacagatgcaggtacattctaaagacaaaatttcgggagatgtggaagtcctggccaggcgatagcaaagaggtgcaggtgatggccgagcgctacaagatgttaatcccattttccaacccgcgtgtgcttcctggcccattttcttacaccgtggtgttgtatgggcctgcaggtctgggtaaaactactctggcacagaagctgatgttggactgggcggaggacaacctcatccacaagtttaagtatgccttttacctcagttgccgagaattgagccggttgggcccttgttcgttcgccgagttggtgtttcgggattggcccgagttacaagacgatattccccacatccttgctcaggctcgaaaaattctgttcgtaatcgacgggtttgatgagctcggtgccgctcctggagccctgatagaagatatttgtggtgactgggagaaaaaaaaacccgtgcccgtgcttcttggttccctcctgaacagggtgatgctgcccaaggccgcactcctggtgactacgcgccctcgcgctcttcgcgacttgcggatcctggccgaagaacctatttacatcagagttgaggggtttttagaagaagataggcgagcctattttcttcgccactttggggatgaggaccaggcaatgcgcgcttttgagttgatgcgctctaacgcggctttgttccaattgggcagcgcgcctgccgtgtgttggatcgtctgcacaactctgaagttgcagatggaaaagggagaggaccctgtgcccacttgtctgaccaggaccgggttgtttttgcgcttcctgtgttcacgctttccgcagggggctcagctgaggggggcactccggacgctgagtttactggccgctcaaggactttgggcccaaacctctgttcttcatcgggaggacttggagagactgggggtccaggaatctgatctgcgtttgttcttagacggcgacatcctccgacaagatcgcgtttcaaagggctgttatagtttcatccatctgtccttccagcagttcttgacagctcttttctacacccttgagaaagaagaagaggaagatcgcgacgggcacacatgggacatcggcgatgtgcagaaactcctgtcgggagtggagaggctgcgcaatcccgatctgatccaggcaggctattactccttcggccttgcaaatgaaaagagagccaaggagctcgaggccaccttcgggtgtaggatgagtccggacatcaagcaggagctacttaggtgtgacatttcctgcaagggcggtcattctacagtaacagacctgcaagagctgttaggctgcctgtatgagagccaggaggaggaattggtaaaggaagttatggctcagtttaaggagatctctctccacttgaacgccgttgacgttgtgcccagcagcttctgtgtgaagcactgccgaaatctccaaaaaatgtccctgcaagtgatcaaggagaatctgccagagaatgtgacagctagcgaatccgatgccgaggttgagagatcacaggatgatcagcatatgctgcctttttggacggacctttgctccattttcgggtctaacaaggatctcatgggactggccatcaatgattccttccttagcgcctctctggttcggatcttgtgcgagcagatcgctagtgatacctgtcatctgcagagggtggtgtttaaaaacatctcccctgccgacgctcacagaaatctgtgtctcgccctgcgcggtcataaaaccgttacctatttaacactgcaggggaacgatcaagacgacatgttccccgcactgtgcgaggttctgcggcaccctgaatgcaatctgagatacttaggacttgtgtcttgctcagcgacaacccaacagtgggctgatctctctctcgcactggaagtgaatcaatcccttacctgtgtcaatctgagtgataatgagttacttgacgaaggagcaaaactgctttatactactttgagacaccctaaatgctttctgcagcgtctttcgttggaaaactgccaccttaccgaagccaattgtaaagacctggccgctgtgctggtcgtttctagagaacttacccacctgtgcctcgcaaaaaatccgattggaaacaccggagtgaagtttctgtgtgaaggcctgagatatcccgaatgtaaactgcagacactcgtgctctggaactgtgatattacctctgatggttgttgtgatctgaccaagctgcttcaggaaaaaagctccttgctgtgcttggatctgggactgaatcatattggagtaaagggcatgaagtttctgtgtgaggctttgcgaaagcccctgtgcaatttgcgttgcctgtggctctggggatgttctatacctcccttcagctgcgaagatctgtgctccgcactctcatgtaaccagtccctcgtcacgttagacctggggcagaaccctttagggagttccggagtgaaaatgctgttcgagaccctcacatgttcatccggaaccctccgcaccctgaggctgaagatcgacgattttaatgacgagctgaataagcttctggaggaaatcgaggagaaaaacccacaactcatcatcgacaccgagaagcaccacccttgggccgaaagaccttcttcgcatgactttatgatttag

SEQ ID NO: 28278 - DNA, 3864 bp, Artificial Sequence
  Description of Artificial Sequence: Synthetic coding sequence
atggttccaggcgaggaaaaccagctggtgccaaaggaggctcctttggaccatacctccgataagtcactgctggatgcaaatttcgagcccggaaaaaaaaacttcctgcatctgaccgacaaggatggagagcagccacaaatactgctggaagactcatccgctggcgaagattcggtgcacgaccgctttattgggcctctcccacgcgaaggatccggagggagcacatctgattatgtctcccagtcatattcatacagctcaatccttaataagtctgagaccggatacgttggcctggtgaaccaggccatgacttgttacctcaactccctgctgcagactctgttcatgactcccgagttcaggaacgccctctacaaatgggagtttgaagaaagtgaggaggatcccgtgactagtatcccctaccagctccagcgcctgtttgtcctattacagacctcgaagaaaagagccattgaaaccacagatgttacaagaagctttggatgggattccagcgaggcctggcagcaacatgacgtacaggaactttgcagagtaatgttcgatgccttggagcagaagtggaagcaaactgagcaggccgatctgatcaacgagctatatcagggtaaactgaaggattacgtgagatgcctggagtgcggatatgagggttggcggatcgacacatatcttgatattccccttgttatcagaccgtacgggtccagccaggcattcgccagcgtcgaagaggctcttcatgcatttatacagcctgagattctcgacggtccaaaccaatatttctgcgagcgctgcaagaaaaagtgtgatgccagaaaagggcttcgattcctgcactttccctacctgctcaccttgcagctcaaacgttttgactttgattacacaactatgcatagaattaagcttaacgatagaatgactttccccgaagaactcgacatgtccactttcattgatgttgaagacgagaagtccccgcagactgagagctgtactgacagtggcgcagaaaacgagggcagctgccactcagaccagatgagtaacgacttttccaatgatgatggcgtggatgaagggatttgcctggaaactaattctggcaccgagaagatcagtaaatctggcctggagaagaattctctcatttacgagctgttcagtgtcatggtgcacagcggaagcgctgcaggcggtcactactacgcctgtattaagtctttcagcgacgaacaatggtacagcttcaatgaccagcatgtgagccgaatcacacaggaggacataaaaaagacccatggaggtagctccggaagccggggatattactctagtgcattcgcatctagcaccaatgcgtacatgttaatttatcgactgaaggatcctgcacggaatgccaagttcctggaggtggatgagtaccccgagcacattaaaaacttagtccagaaggagagggaactagaagaacaggaaaagagacagagggaaatcgagcgcaatacttgcaagatcaaactgttttgcctgcacccaactaagcaggtcatgatggagaacaagttggaggtccacaaggacaagacactgaaggaagccgtggagatggcttacaagatgatggatctggaagaagtgattcccctcgattgctgtcgccttgttaaatacgacgaatttcacgattacctggagaggagctacgagggcgaggaagataccccaatggggttgcttctcggtggtgtgaagtccacctacatgttcgacctgttactcgaaacaagaaaacctgatcaggtgttccagtcatacaaaccgggagaggtcatggtgaaggtgcacgtcgtggacctgaaggccgagagtgtggcagcccctattacagtgcgggcatatctcaaccaaacagtgacggagtttaagcagcttatctctaaggcaattcatctaccggcagagaccatgagaatagtcttggagcgctgttataacgaccttaggctgctgtcagtcagctcgaagactctgaaggcggaaggctttttcagatcaaataaagtcttcgtggagtcttccgaaacactcgattatcaaatggccttcgctgattctcacctgtggaagctgctggatcggcatgcaaacaccattaggctgttcgtgctcctgcctgagcaaagcccagtgagttatagtaagcggacggcttatcagaaggctgggggagactccggtaatgttgatgacgactgcgagcgcgttaagggacctgttggctcactcaaatccgtcgaagctatactcgaagaatccacagagaaactgaaatccctgtccctgcagcagcagcaggacggagataatggcgatagcagcaagagcacggagactagtgactttgagaatatcgagtcccctctcaacgaaagagacagctccgcaagcgttgacaacagggagttagagcagcacattcagaccagcgaccccgagaattttcagtccgaggagaggagcgactctgacgtgaacaacgatagaagcaccagctccgttgattcagatatcctgagcagctcccatagctcggacactctgtgtaatgccgacaacgcccagattcccctggccaatgggttggacagccatagtattacttcttcaagaaggactaaagccaatgaaggtaagaaggaaacgtgggatactgccgaggaggactcaggaaccgacagcgagtacgacgaatctggaaagtccaggggtgaaatgcagtacatgtactttaaagctgagccctatgctgctgacgaaggtagcggagagggccacaagtggcttatggtccacgttgataagagaatcaccctggcagcgtttaagcagcacctggagcctttcgtgggagtactatcctcccacttcaaggtgtttagagtgtacgcatctaatcaggagttcgagtctgtgcgtcttaacgagaccctttctagctttagcgacgataataaaataactatccggctaggcagagcactgaaaaagggggagtatcgcgtgaaggtctaccagttgctcgtaaacgagcaggagccctgcaaatttctgcttgacgctgtgttcgccaaggggatgactgtgcgccagagtaaagaggaacttatccctcagttacgcgagcagtgtgggttggaactctccatcgatcggttcagactgagaaagaaaacatggaagaatccgggaaccgtctttttggattatcacatttacgaagaagacatcaacattagtagcaattgggaggtctttctcgaggtgctcgacggtgtcgagaaaatgaagagcatgagccagttggcggtgctgtcccgacgctggaaaccgagcgaaatgaagctggaccctttccaggaggtcgtcttggaatcgtccagtgtggacgaactccgggaaaagctaagcgagatttccggcattcctctagatgatatcgaattcgctaaaggacggggaacttttccctgcgacatcagtgtgctggatatacaccaggatttggattggaatccaaaagtttctactctgaacgtctggccactgtacatctgcgacgacggcgcagtaatcttttaccgcgacaagacggaagaactgatggaattgacggatgagcagaggaatgaacttatgaagaaggaaagtagcagactccagaaaaccggccacagggtgacttactctccacgtaaggagaaagcactgaaaatctatttagatggcgcaccaaataaagatctaactcaagactag

SEQ ID NO: 28279 - DNA, 420 bp, Artificial Sequence
  Description of Artificial Sequence: Synthetic coding sequence
atgccctggcgggctggtaatggagtgggccttgaagcccaagctggtactcaggaggcgggacccgaagagtactgccaggaggagcttggtgccgaggaggaaatggcagccagggctgcttggccagtgcttcgcagtgtcaacagcagagagctgagcagaataattatctgcaaccactctccgcgtattgtgctgccagtgtggctgaattactatggcaagctgctgccatatctgacactccttccagggcgagactttaggattcacaattttcgcagccacccctggctgttcagggacgctcgtacccatgataagctgctagtcaatcagactgagttgtttgtcccaagcagtaacgttaacggacagcctgtcttcgctaatattacactgcaatgtattccctag

SEQ ID NO: 28280 - DNA, 582 bp, Artificial Sequence
  Description of Artificial Sequence: Synthetic coding sequence
atggaaggctgtgtatctaacctgatggtgtgcaaccttgcttacagtggaaagctggaggagcttaaggaatccatactcgccgacaagagcctcgccacaagaactgaccaggccggatggagcccactgcacatcgccgctagcgctggccgtgacgagatagtgaaagctttgttgggtaaaggggcacaagtgaatgccgtgaaccagaatgggtgtaccccacttcactacgccgcatccaagaatcgacacgaaatcgccgtgatgctcctcgaagggggtgccaatcccgatgccaaagaccactatgaagccaccgcaatgcaccgggcagcagccaagggaaacctaaagatgattcacattctgctgtactacaaagcatctactaacatccaggataccgagggcaacacacccctgcacctggcatgcgacgaagaaagagtagaagaggccaagttactggtgtcacagggtgcttctatctacatagaaaataaggaagaaaaaaccccactgcaagttgccaaaggaggcctaggtcttatcctgaaaagaatggtggaaggttag

SEQ ID NO: 28281 - DNA, 612 bp, Artificial Sequence
  Description of Artificial Sequence: Synthetic coding sequence
atgagtgagaatgcggctccaggcctcatctccgaacttaagttggcagttccgtgggggcatattgccgctaaggcctggggatctctgcagggcccacctgtcctgtgccttcatggctggctcgacaatgcatctagcttcgaccgactgatacccctgctcccacaagatttctactacgtcgcgatggactttggcggacacggcctctctagtcactattcccccggtgtgccctattatttgcagaccttcgtgagcgagattaggagggtggtggctgcactgaagtggaacagatttagcatcctgggccacagtttcggaggggtggtggggggtatgtttttctgtacatttcctgagatggtcgacaagttgatcctgctcgacactcccctcttcctcctcgagagcgacgagatggagaacctgctcacatacaagcgtcgagccatcgagcatgtgctgcaggtcgaggccagtcaggagcccagtcacgtgttcagcttaaagcagttgctgcaacgccagcggacagcacttacgtcaagtgcgggttcatgcgtgaggattccaagtggatcctgccgacctatgtcatgctag

SEQ ID NO: 28282 - DNA, 765 bp, Artificial Sequence
  Description of Artificial Sequence: Synthetic coding sequence
atgcccgctgggagcatgtctaccacaggctacccaggcgtgtgttccaccacctcataccgaactcattgttatattcccgtaacatctagcgtgactctctcaagctccgatctgtccccaacgttcggacactgcctgcctagttcctaccagggaaacctctggctgttggattactgccaggaaagctacggcgaagccccaacttgtaagagccccagctgtgaacccaagacatgtagcaccaccggatgcgatccttccaactcttcggttccatgtaatagtccctccgccggacaggtgttcagtgtgtgtgaaactactaacgtgtcaccttcgccaagttgttcccctagcacacagacaaacggatacgtgtgcaattgccacattcccacccgcaatgcatctaaggcttgtcagacattacgaaacggctctaattgttttggacagcttaactgcctgtccaaatctttccagactctgaaccactgcaggttgtcaacgctgggctacaagtcttaccaaaacccgtgcttcatacctagctacgtgtctcctctgtgctacatcagcaatagttgccagccacagtcttatcttgtcaggaattatcactattcctcttaccggccaacatcttgccgtcccctctcctatttatcacgctcattccgatctctgtcatatatcccaagcacattcccacctttgcgctacctgtgcagcgggagcagacccctgaagtgctattag

SEQ ID NO: 28283 - DNA, 1338 bp, Artificial Sequence
  Description of Artificial Sequence: Synthetic coding sequence
atgcgggaaatcgttcatctacaggctggtcaatgtggcaatcaaatcggagcgaagttctgggaagtcatctctgacgagcacggaatagatcccacgggaacctatcatggagatagcgacctgcagcttgaacgcatcaatgtttattacaacgaggccactggcggaaaatatgtcccaagagcggtactcgtcgacctggagccagggacgatggactcagtacgcagtggcccattcggtcagatttttaggcccgacaattttgttttcggccagtccggcgcaggtaacaattgggcaaagggacattataccgagggagcagagttggtggatagtgtattggacgtggtacggaaggaggctgagtcctgcgattgtcttcagggatttcagctgacacattcactggggggaggaaccggaagcggaatgggaacacttctaatctcaaaaattagagaagaataccccgatcgaattatgaacacgttttccgtggtgcctagtccaaaggtttctgacactgtggtagagccttataatgccaccctgtctgttcatcaactggtggagaacaccgacgaaacgtactgcatcgacaacgaggcgctatatgatatttgttttcggactctgaagctgactacacccacatacggcgatttgaatcacctggtgtcagccaccatgagtggtgtcacgacatgtctccgattccccggacagttgaatgccgatcttcggaagttggccgtcaatatggtgccattcccaagactgcatttcttcatgcctggttttgcgccactgacaagtcgtgggtcccagcaatatagggctctgactgtgcctgagctcacccagcaaatgtttgacgcgaaaaacatgatggctgcctgcgatccccgtcacggacggtatttgactgtcgcggctgttttccggggacgcatgtccatgaaggaggtcgacgaacagatgctcaatgtgcaaaataagaatagcagctattttgtagagtggattcccaacaatgttaagaccgcggtgtgcgacatccccccacggggactgaagatgtccgcaaccttcataggaaatagcactgctatccaggagttgtttaagcgcatcagcgaacaattcacagcgatgttccggagaaaggccttcctgcattggtatactggtgaagggatggacgaaatggagttcaccgaggccgaatcaaacatgaatgacctggtctccgaataccagcaataccaggacgctacagctgaggaggagggcgaattcgaggaggaagcagaggaggaggtcgcttag

SEQ ID NO: 28284 - DNA, 750 bp, Artificial Sequence
  Description of Artificial Sequence: Synthetic coding sequence
atggcggagaggggcgagctggacctcaccggagccaagcaaaacaccggcgtctggctcgtgaaagttcctaaatatctcagccagcagtgggctaaagcgagcggccgtggcgaagtggggaagctgaggatcgctaagacccaaggacgcacggaggtgagttttacactgaatgaagacttagcaaatattcacgacatcggcggaaagcccgctagtgtttcagcacctcgcgagcacccattcgtgctacagagcgtggggggtcagacccttacggtgtttacagagtcctcctctgacaaacttagtctggagggaatagtcgtccagcgtgcagagtgtcgccctgctgcatctgaaaactacatgcgattaaagcggttgcaaattgaagaatcctcgaaaccggtgcgcctgagtcagcagttggataaggtggtgactacaaactataaaccagtggccaaccaccagtacaacatcgaatacgagaggaagaagaaggaggatggcaaaagagcacgggcagacaagcaacatgtcctcgacatgctattcagtgccttcgagaagcatcagtactataatctcaaagatttggtggatattacaaagcagccagtggtttacctcaaagagatcctgaaagagatcggcgtgcagaatgtgaaaggcatacataaaaacacctgggagttgaagccagaatacaggcactaccagggggaggagaaatctgattag

SEQ ID NO: 28285 - DNA, 2511 bp, Artificial Sequence
  Description of Artificial Sequence: Synthetic coding sequence
atgtggtccttaggatgcgtcatcgccgaattgttccttggttggccactctaccccggtgcatccgaatacgaccagattcgatatatatcccaaacgcagggccttcccgcagaatatctcttgagcgctggcaccaagacgacccgtttctttaaccgagaccccaaccttggttacccattgtggcgtttgaaaacccctgaggaacacgagctggagactggaatcaagtcaaaggaggcgaggaaatacatcttcaactgcctcgacgacatggcacaggtgaatatgtccacagatctggaggggaccgatatgcttgctgagaaagctgaccggagggaatatattgatcttctgaaaaaaatgcttactattgatgccgataagcgtattactcccttgaagactctcaatcatcagttcgtgaccatgactcacctccttgatttccctcattctaaccatgtcaaaagttgcttccagaatatggagatatgtaagaggcgggtccatatgtacgacacggtgtcccagatcaagtcaccattcaccactcatgtcgcacccaacacaagcaccaacctgaccatgtcattcagcaatcaattgaacacagtgcataaccaggcaagcgtactggccagcagcagtaccgccgctgctgcaacattgtcccttgccaactccgacgtatctctgctcaactaccagagtgctttatatccaagctccgccgctcctgtgcccggagtagcgcagcaaggtgtgtccctgcaaccaggaaccactcagatctgcacccagacagaccccttccaacaaacattcattgtgtgtcctcctgcgttccagaccggactgcaagctaccacaaagcatagcgggtttcccgtgcgcatggacaatgccgtgcccatagtgcctcaggcaccggctgcccagccgctgcagatccagagtggcgtgttaacacaagggtcatgtacaccacttatggtggctacccttcatcctcaggttgctaccataaccccccagtacgccgtccctttcactctgtcatgcgctgccggtagaccagccctagttgaacaaaccgccgcagtgcttcaagcctggccaggtgggactcagcaaatactcctccctagcacttggcagcagctccccggagtcgccctgcataactccgtccagccgaccgcaatgatacccgaagcaatggggagtgggcagcagctcgccgactggcgcaatgctcactcacacggcaaccagtatagtaccatcatgcagcagccctccctgttaaccaaccatgtcactttagccactgcccagccactgaatgttggggtagcccatgtggtgcggcagcagcagtcatcttcactccccagcaaaaagaacaagcaatcagctcccgtatcctcaaagtctagcctcgatgtgctccccagtcaggtgtactcactggttggatcaagtccacttcgcacaacatcatcttataattcccttgtccctgtgcaggatcagcatcaaccgatcattattcctgatacacctagccctccggtgtcagtgatcacaatcagatctgacaccgacgaggaggaggataataagtataagcccagctcttcagggcttaaaccaagatccaacgtgatctcatacgttactgtgaacgacagccccgactccgattcctcattgtccagcccctactccactgacacattgtctgccctcagggggaactcgggcagtgtcctggagggacctgggcgtgtggtcgctgacggaaccggtacaagaaccattatcgtgcctcctctgaaaacgcaactgggcgattgcaccgtagccacacaagcgtccgggctactttccaacaagactaagccggtagcctcagtgtcaggtcagagctcaggatgttgcatcaccccaactggatatagagcccagcggggagggacatcagctgcccagcccttaaacttgtcacagaatcagcagtccagcgctgcccctacatcccaagagcggagttctaatcccgcaccacggaggcagcaggcttttgtggcaccactttcacaagctccatatacctttcagcacggcagccctttgcacagtaccggacacccgcatctggcgccagcaccagcgcaccttccaagtcaggcccatctctacacttatgcagcccctacgagtgcagctgctctcggatcaacaagttcaatcgcccatctgttctctccccaaggcagtagtaggcatgctgcagcttacactactcacccaagcaccctggtgcatcaagtgccagtctcagtgggcccatccctgctgacctctgcctccgttgccccagcgcaatatcagcaccaattcgcaactcagtcctacataggttcctctagagggtccactatctacaccggataccccctgagcccaactaagatcagccaatacagttatctgtag

SEQ ID NO: 28286 - DNA, 2352 bp, Artificial Sequence
  Description of Artificial Sequence: Synthetic coding sequence
atgtcccaggtaaaatcttcttatagctacgatgccccatctgacttcattaatttcagcagcttggacgatgaaggtgacacccaaaacatcgactcatggttcgaagaaaaggcgaatctggagaataagctgctaggaaagaatgggacaggcggtttattccaggggaaaacccccctgagaaaagcgaatttacagcaggctatcgtcacccctctcaagcctgtggataacacctattacaaggaggctgagaaagagaacctggtcgaacagtcaattccaagcaacgcctgcagttcactagaggtcgaggccgcaatcagccggaaaactccggcacagccccagagaaggtcgctgcggctgagcgcccaaaaagacttggaacagaaggagaaacaccacgtgaaaatgaaggcaaagaggtgtgccactccagtgatcattgacgagatcctccctagtaagaaaatgaaggtctctaataacaaaaagaagcccgaagaggaaggcagcgcacaccaggacacagccgagaagaatgccagcagccccgaaaaagcaaagggtagacataccgttccctgtatgccacccgctaaacagaaattcctcaaatctactgaagagcaggagttggaaaaaagcatgaaaatgcaacaggaggtggtcgaaatgcgtaagaagaacgaggagttcaaaaagcttgcactggccggtatcggccaacccgtgaaaaagtctgtcagccaggtaaccaaatctgtggactttcattttcggacagatgagagaattaaacaacatcctaagaatcaggaagaatacaaggaagtgaactttacatctgagctaagaaagcatccatctagtcctgccagagtcacaaaaggctgcacgatagttaaaccatttaatctatcccagggtaagaaacggacgttcgacgaaacagtgtcaacctacgtccccctggcgcagcaggtggaagacttccataaaagaacacccaatagataccacctgcggtctaaaaaggatgacataaagacaggaagttgctcagtgactcaagctggagtccagtggcgagaccatggttcgctccagtgccccacccctggactcaaacagagctcttgcctgtctttgccaaacctcctgccttctaagtctagcgtcactaaaatctgtcgcgacccacagaccccagtgctgcagacaaagcaccgggcaagagccgtgacatgcaaatccaccgctgaactcgaagctgaggaactggagaagttacagcagtataagtttaaggctcgggaactggatcccaggatccttgaaggaggccctatcttgcccaaaaagcccccagtgaaaccaccaacagaacctattggcttcgacctggagatcgaaaagcgcatccaagagcgtgaatcaaaaaagaaaacagaagacgaacatttcgaatttcattcacgaccatgtcccaccaagattctcgaagacgtggtcggtgtccctgaaaaaaaggtgttgccgatcacggtaccgaaaagccccgcatttgctctgaaaaaccgcatacggatgcccactaaggaagacgaggaagaagacgaacccgtggtcattaaagcgcagcccgtcccccactacggggtgccattcaaacctcaaatacccgaggctcgaactgtggagatatgcccattcagctttgacagcagggacaaggagcgccagcttcaaaaagaaaagaaaattaaagaactgcaaaaaggggaggttcccaagtttaaggctctccccttgcctcacttcgatacaataaatcttccagaaaaaaaggttaaaaacgtgacacaaatcgagccgttctgcctagagacagataggaggggggcactgaaagcccagacttggaagcatcagctggaagaggagctgaggcagcaaaaggaggctgcttgtttcaaagctcggcctaatactgtgatttcccaggagccatttgtacctaagaaagagaaaaagtcagtggccgaagggctgtccggcagtctggttcaggagcccttccagttagccaccgaaaagagggcaaaggagagacaagagctcgagaagagaatggctgaagtggaagcccaaaaagcccagcagttggaagaggccagactacaggaagaagagcagaagaaagaagagctggcacgtttgcgccgtgagctggtgcacaaagccaaccccattagaaagtaccaaggactggaaattaagagcagcgaccagcctcttacggtacctgtatcccctaaattcagtacgcggttccactgttag

SEQ ID NO: 28287 - DNA, 2061 bp, Artificial Sequence
  Description of Artificial Sequence: Synthetic coding sequence
atgggatcctacttatccgtgcctgcttactttacaagccgagatttgtttaggtgcagcgagtgccaggacagccttacaaactggtactatgaaaaagatggcaagctttactgccctaaggactattggggaaagttcggggagttctgccatggatgttccctgctgatgaccggcccttttatggtcgccggagaattcaaataccacccggagtgttttgcctgcatgtcctgtaaggtaatcattgaagatggtgatgcctacgcactggtgcagcacgctactttgtactgcggcaagtgccacaatgaagttgtgctggccccaatgttcgagcgcttgtcaactgaaagtgtgcaagagcagctaccatacagcgtgactctaatctccatgcctgctacaacagagggcaggcgtgggttcagcgtgtccgtcgagtccgcctgtagtaactatgcaacgactgtgcaagttaaagaggtcaaccggatgcacattagtccaaataataggaatgcaatccaccctggagataggatactcgagatcaacgggaccccagtgcgtacccttagggtggaggaggttgaggacgccataagccagacatcacaaacacttcagcttttaattgagcacgatcccgtgagtcagcgactggatcaacttcgactggaagcaaggctggctcctcacatgcagaacgctggtcatccgcacgccctttctacactcgatacaaaggaaaatctagaagggaccctgaggcggaggtctctgcgtcgttctaatagcattagtaagtcaccgggtccctcgtctccaaaggagcctctcctctttagcagggacatcagccggtcagaaagcctgaggtgttcgtcgtcttattcgcagcagatcttccggccatgtgacctcattcacggagaggtgctagggaaggggttttttgggcaggcaattaaagtgacccataaggccactgggaaagtaatggtgatgaaggagcttattaggtgtgatgaggaaacgcagaagacatttctcaccgaggtaaaggtgatgcgctccctagatcacccaaacgtcctgaagtttatcggggtcttgtacaaggataaaaaactgaatttactcaccgaatatattgagggcggtactctgaaggattttttgagaagcatggaccccttcccatggcagcagaaggtgcggttcgccaaagggattgccagtgggatggcctacctccactctatgtgcattattcatagagatctaaactctcacaattgcctgattaaactggacaagaccgttgtagtcgccgactttgggcttagtcgcctgatcgtggaggagcgaaagcgggcacccatggagaaggcaactactaaaaagaggacactgcggaaaaacgaccggaagaagagatatacagtcgtgggaaatccctattggatggctcccgaaatgctcaacggtaaatcatatgacgagaccgtggatattttttcctttggaattgttctctgcgaaatcattgggcaggtgtacgcagaccctgattgtctgcctaggactcttgatttcggcctgaatgtcaaactgttctgggagaagttcgtgcctacagattgccctcccgctttcttccccctggccgctatttgttgtagactcgaacctgaaagtcgcgcacccccaggagctgccggagaagggcctggctgcgctgacgatgaagggccagttagacggcaggggaaggtcacaataaaatatgatcccaaggagctgcgcaagcatcttaacctggaagagtggatactggagcaactaacaaggttatacgactgtcaagaggaagagatttctgagcttgagatagatgtcgacgaattgttggacatggaatcggacgatgcctgggcgtcgcgcgtcaaagagctgttagtagactgctataaacccacagaagcattcatctcagggctactcgacaagatacgagctatgcagaagctctcgactccgcagaagaaatag

SEQ ID NO: 28288 - DNA, 840 bp, Artificial Sequence
  Description of Artificial Sequence: Synthetic coding sequence
atgcgggctttaacagttcagagagtgaagttcgccatggacctgcccctgctaaaacgcgctggccaggacttagcggaaaaaacaaagaacttcgtgagtagatccctcgtcatcggtgaggtgttgtccatggccgatatggcaacaggcgtgaaatgcggaatcatttactggctgtttggaggagccatccgcaatctaggctctcccgaacatgtgactaagtggtttcagccactgcaggagcagaaatacaccggcatgttcgctatgacagagagaggccacggctcaaacgccagagggattcagactgaggcgacatttgacctgagcgcccaggaatttgtgatagacactccatgcgaaaacgccgagaagatgtatataggcaatgcaatgtacggcaattacgccgctgtgttcgcacagttaattattgatgggagaagccagggtcctcactgtttcatcgtaccagtgcgcgacgagaatggcagcctctatccgggagtgaccgccatagatatgatgtacaaggaaggtctgcacggtgtcgataatgggatcctgatctttgataaggtgcggatcccacgcgagaacctgctcgataaatttggctcggtggctccagacgggcagtaccatagtcccattcggaataaatccgcacgctttaatgccatgttggcagctttaacacctagccgcctagccgttgctttccaagctatgggagctatgaaactggggttaacgatagcgattcgctattctcatcgtagccggataatttcccagaactgctgctccgcccctgctggactgtactag

SEQ ID NO: 28289 - DNA, 597 bp, Artificial Sequence
  Description of Artificial Sequence: Synthetic coding sequence
atgacactgaggtgtctcgagccatctgggaacggtggggaggggacccgtagtcagtggggtacagcaggcagcgcagaagagccttctccccaggcggcacgccttgcgaaagcactgagggaattaggtcagaccggatggtattggggatccatgacagtcaatgaggctaaggaaaagttgaaggaagcccctgaaggaacgtttttaatccgagacagtagtcacagcgactacttgctgacaatttccgtcaaaacttccgccggaccaacgaatctgcggatcgagtatcaagacggcaaattccggcttgatagcatcatttgcgtcaagagcaagctgaaacagtttgactccgtggtgcacctgatcgattactacgtccagatgtgtaaagacaaaagaactggacctgaagctccgaggaacggcaccgttcatctttacctgactaaaccactgtataccagtgcgccatccctgcagcacctctgcagattgactattaataagtgtacaggcgcaatctggggtttgccgctgccaacacgtctgaaggactatcttgaggagtataaattccaggtatag

SEQ ID NO: 28290 - DNA, 570 bp, Artificial Sequence
  Description of Artificial Sequence: Synthetic coding sequence
atggaggcagacggcgacggcgaggaattggccagattacgctcagtctttgccgcatgtgacgctaaccggagcggtcggctagaaagagaggaattccgggcattatgcacggagctgcgtgtgagacccgcagacgcggaggcagtttttcaacggctggatgcagacagggacggtgcaatcactttccaggaattcgccagagggttcctgggttcattacgtggcggtagacggagggactggggaccacttgaccccgcaccagctgtttccgaagctggacctgagacacacgacagtgaggaggacgagggcgatgaggatgccgcagctgccctggccacaagctgcggaccagcctcacctgggcgagcctggcaggatttccaggccaggttgggagacgaggctaagttcattccccgatttgggtacactattagtaaaccagcctttgtatttgtccgacaccttatcactctctgtgccctgagttgggctaaaaaggaggggagggagactctctggaccatcgaagaaggaggcgctaaaatggccgagtag

SEQ ID NO: 28291 - DNA, 300 bp, Artificial Sequence
  Description of Artificial Sequence: Synthetic coding sequence
gcactggacgttgccgtaaaaacattccctccagagcgtcacgtggccgtaaaatgctttgggaaaaagaaggagaaaaagaataatgccaattcccccgcttctgttagcaatcctacagtgaccaagcatgcgttcgggatggaagaggagctccagagagagggatccatagagacattaagcaacagctccggaagtacgtcagggtccatcccacgtaacttcgatgggtatcgctcccccttaccaactaatgagagtcagcccctttccctgtttcctacagggttcccatag

SEQ ID NO: 28292 - DNA, 1170 bp, Artificial Sequence
  Description of Artificial Sequence: Synthetic coding sequence
atggagagaaaggatttcgaaacatggttggataacatcagcgtgacattcctctctcttaccgatcttcagaagaatgaaactctggatcacttaattagtctctccggtgccgtacagctgcgtcatctatcaaataacctggaaacacttttgaaaagggatttcctgaaactgctgccactggagctgtccttctaccttctcaaatggctggatcctcaaacattactcacctgctgcctggtgtctaagcaatggaacaaggtgatctccgcatgcacagaggtgtggcagacggcttgtaagaacctgggatggcagattgacgattccgttcaagatgcccttcattggaaaaaggtgtatctgaaagctatcctgaggatgaagcagctggaggaccatgaagcatttgaaacttcatctcttatcggccactcagcccgagtgtatgcactctattacaaagatggcctgctgtgtacagtgttcagcgtcgattacaacgacgagctggatatactggtctcaggcagcgccgatttcactgtaaaggtgtgggcccttagcgccggaacatgtctgaatacgctcactggccatacagagtgggtgacaaaggtggtccttcagaagtgcaaggtgaaaagcctgttacattcacctggcgactatatactgttgtccgccgacaaatacgaaatcaagatctggcccattggcagagagattaactgtaagtgcctgaagaccctgtctgtctccgaagatagatccatttgcttacagcccagacttcatttcgacggcaagtacatcgtatgctcctctgctctgggcctgtaccagtgggattttgcatcctatgacatcctaagggtgatcaagacccccgaaattgctaatctggctctgctgggcttcggagatatctttgccctacttttcgataatcgatatctgtatattatggatctacgaacagagagtctgatttcccgctggcctctgcctgaatatagaaagtccaaaaggggatctagttttttagcgggtgaggctagctggcttaatgggttagacggtcataatgatacagggctcgttttcgccaccagcatgccagatcatagtatccacctagtcctatggaaagaacatgggtag

SEQ ID NO: 28293 - DNA, 2439 bp, Artificial Sequence
  Description of Artificial Sequence: Synthetic coding sequence
atgaaaaaacaatttaaccgcatgcggcagctcgccaatcagaccgttggtcgggcagaaaagactgaagtgctgtctgaagatttgctgcaggtggagaaacgactggaactggttaaacaggtatcccacagtacacacaaaaagctaaccgcatgcctgcaggggcagcagggcgctgaagccgataagcgtagtaagaaactcccccttaccaccctggcccagtgtctgatggaggggagtgccatcttgggggatgatacactgttggggaagatgttgaagttgtgcggggaaaccgaggataaactggctcaggaactgatccattttgaactgcaggtagagcgagacgtgatcgaaccactgttcctcctggctgaggtcgagattccaaatattcagaagcagcgcaagcatctggcaaaattggtcttagacatggactcatcacgcaccagatggcagcaaacctccaagagttcaggccttagctccagtctgcagcctgctggggctaaggccgacgctcttcgtgaagagatggaggaagcggctaacagagtcgagatttgccgcgaccagttaagtgctgatatgtatagttttgtggccaaggagattgactacgcaaattactttcaaacactgatcgaagtgcaggcggagtatcacagaaagagcctgaccctgctgcaggcagtgctgccccagattaaggcccaacaagaggcttgggttgagaaacccagcttcggaaagcccctggaggaacatctgactatcagcggaagggagatcgcatttccaatcgaggcctgcgtgacaatgctgctggagtgtgggatgcaggaagaggggctgttccgagtagctccgtctgcttctaagctgaagaagttaaaggcagccctggattgttgtgtggtagatgtccaggagtacagtgctgatccacacgccatcgctggggctttgaagtcgtatctgcgggagcttcccgagccccttatgactttcgagctgtatgacgagtggattcaggcttcgaacgtacaggaacaggacaaaaaactccaggcactatggaatgcgtgtgaaaagttgccgaaggcaaatcacaacaatatccggtacctgatcaaatttctctcaaagttgtctgagtatcaggatgtgaacaaaatgaccccctccaacatggcaattgtccttgggccaaatctgctgtggcctcaggccgaggggaacataaccgaaatgatgactaccgtctctctgcagatcgtcgggattattgagccgatcattcagcacgccgactggttttttcccggagaaatcgagtttaatataacagggaattacggctctccagtccatgtcaatcataatgcgaattattcatcgatgccttctccagacatggatcctgccgaccggcgacagcccgagcaggctcgtcgacctttgtccgttgccacggacaatatgatgctggaattctataagaaagacggtatgggtgtgcgggtgatggacaccaactgggtggctcgaagaggcagtagcgcgggtaggaaagtgtcctgcgcgccaccatctatgcaacctccagcgcctcctgctgaattggccgcaccactgccatcccccctccccgaacaaccactagacagtccagccgcaccagcactgtctcccagtggattggggctccagccgggtccagagagaacctctactaccaaatccaaggagctttctcccggatccgcccagaaaggttcacccggatcttcccagggaactgcatgcgccggaacccagcccggagctcaaccgggtgcgcagccaggggcaagtccgtcgccttcacagcccccagcagatcagtctccacatacactgcgcaaagtgtcaaaaaaactcgcccctatcccgcctaaggttccttttgggcagcctggtgctatggctgatcagagtgccggacagccttcacctgtgtctctgtctcccacccccccaagtacacctagcccttacgggctcagctatccgcaagggtacagtctggcctcgggccaactctcacctgctgctgctcccccattggccagcccctcagtctttactagtaccctcagcaaaagccggccaaccccgaagcccagacagaggcctactcttcccccaccccagcccccaaccgtcaatctgtccgcctcttctccgcagtccaccgaggcgccaatgctcgacggaatgtcccccggagagtcaatgagcacagatctggttcattttgatatcccctcaatccacatcgagcttggctccactctgagactgagcccactagagcatatgagacgccattcagtcaccgataaaagagattcagaggaggaaagcgagagcactgcactatag

SEQ ID NO: 28294 - DNA, 1119 bp, Artificial Sequence
  Description of Artificial Sequence: Synthetic coding sequence
atgtccaaaagcgagagtccgaaagagcccgaacagctgcgaaagttgttcatagggggattatcttttgagactacagacgaatccctccggagccattttgagcaatggggtacgctcaccgactgtgtcgtcatgcgcgaccccaacacaaaacgttcccgcggttttggatttgtgacctacgccacggtagaggaggtggacgccgctatgaacgcgcgaccccacaaagtagatgggcgagttgtagagccaaagcgggcagtcagcagagaagattcccagaggccaggcgcacatcttacagttaagaaaatttttgttggaggaattaaagaggacactgaggaacaccatctccgggactactttgagcaatatggtaaaatcgaggttattgaaattatgacggaccgcggaagtgggaagaaaaggggtttcgcatttgtcaccttcgatgatcatgatagtgtggacaaaatcgtgattcagaagtaccacacggttaatgggcacaattgtgaggtacggaaggcactgtccaaacaagagatggcctccgcctcatccagtcagagagggcgatcaggcagtgggaactttggcggaggacggggaggcggatttggcggaaatgataattttgggcgagggggaaacttctccggcaggggcggttttgggggaagtcgaggcggaggcggatacggaggatcaggcgacgggtacaacggcttcgggaacgatggaggctacggaggaggagggccagggtattccggcggatcccgcggttatggctccggcggacaggggtacggaaaccaggggagcggatacggaggctcgggctcctatgacagttacaataatggcggtggaggaggttttgggggaggctccggttcaaactttgggggagggggatcctataacgatttcggtaactacaacaatcagagtagtaattttgggcctatgaagggcggaaattttggtggacgatccagcggtccttacggtggtgggggacagtactttgccaagccccgaaaccaaggcggatacgggggttcctcatcctcttccagctatggatccggtaggagattctag

SEQ ID NO: 28295 - DNA, 1491 bp, Artificial Sequence
  Description of Artificial Sequence: Synthetic coding sequence
atgaaactgggcaagaagcctatgtataaacccgtggacccatacagtaggatgcagtccacctataattacaatatgaggggcggtgcttaccctcccagatacttctacccatttcccgtccctcctctcttgtatcaagtagagctttctgtcggagggcagcagttcaatggcaaaggtaaaaccagacaggccgcaaagcacgacgccgcagccaaggctctgagaatactgcagaacgagcccctccccgagaggctggaagtaaacgggagagagtccgaagaggagaatcttaacaagtctgagataagccaggtgttcgaaatcgccctgaagaggaacctccccgtgaattttgaagttgctcgagaaagcggacccccacacatgaaaaacttcgtgacaaaggtgtcagtgggcgagttcgtgggggagggtgaagggaagagcaagaagatctccaaaaagaatgctgcgattgccgtcctggaggagttaaaaaagctgccccctctccccgcagtggagcgggtgaaacccagaattaaaaaaaagacgaaacctattgtgaagccccagacaagccccgaatatggacagggcatcaaccccatatcaagattggctcagattcaacaggcaaagaaggagaaggaacccgaatacacgctgctgactgagcgaggtctccctaggcgacgtgaatttgtgatgcaggtgaaggtggggaatcacacggctgaggggacgggcactaataagaaggtggcaaaacgtaatgccgcagagaatatgctggagattctcgggttcaaggtgccccaggcacagcccactaagcctgctctgaaatccgaggaaaagactcccataaaaaaacccggagatggccgaaaagtgacctttttcgaacccggaagcggcgacgagaacgggactagtaataaggaggatgaattccgaatgccatatttgtcgcaccagcaattgcctgcaggaatcctgccaatggtgcctgaagtggcccaagctgtcggtgtgtctcaggggcaccacactaaagattttacacgtgctgctcctaatcccgctaaggccaccgtcaccgcgatgattgcccgagagctcctgtatgggggtacgagccctaccgctgaaactattctaaagaataatatcagcagcggacacgtgccccacggacccctcacacggccaagcgagcagctggattaccttagccgtgttcaggggtttcaggtagagtataaagactttccaaaaaacaacaaaaacgagtttgtttctctcattaattgctcatctcagcccccacttatcagccatggcatagggaaagatgtggagagctgccacgacatggccgctctaaacatccttaaattgctatctgagctagaccaacaatccacggaaatgcccagaaccggaaacgggcctatgtccgtgtgcggaaggtgttag

SEQ ID NO: 28296 - DNA, 5834 bp, Artificial Sequence
  Description of Artificial Sequence: Synthetic coding sequence
atgtccaacttttacgaggaaaggaccaccatgatcgctgctagggacttgcaggaatttgttccttttggcagggaccactgcaagcatcaccctaacgccctgaacctccagctcagacagctgcagccagcgagcgagctgtggagtagcgatggcgcagccggactggttgggagtttgcaggaggtcacaatccatgaaaagcagaaggaatcctggcagctccggaaaggcgtgagcgagataggtgaggatgtcgattatgatgaggagctgtatgtggccggtaatatggtgatctggagcaaaggctccaagtctcaagccctcgccgtctacaaggctttcactgtggactcccccgtgcagcaggccctgtggtgcgatttcataataagccaagataaatctgaaaaggcctatagcagcaacgaggttgaaaaatgtatttgcattcttcaatcctcttgcatcaacatgcactctatcgaagggaaagattatatcgcatcattgccgttccaggtggcaaacgtctggcccaccaaatacggcctgctgtttgagcgatcagcgtcttctcacgaggtccccccagggtcacctagagagcctctgcccacaatgttttccatgctgcacccattggatgaaattacacccctggtttgcaagtccggtagtctgtttgggtcatcccgagtacagtacgtcgtggaccacgctatgaaaatagtcttcttgaacactgatcctagcatcgtcatgacctatgatgctgtccagaacgtgcactcggtgtggactttgcggagggttaagagcgaagaagaaaacgtggtcctgaagttctccgaacagggtgggacaccccagaacgtggccaccagctcctcacttactgcccatctgcggtcactttccaaaggagacagccctgtgacaagccccttccagaactactcaagtatccattcccagtctcgatctacttccagcccttctctgcattcccggtcgccaagcattagcaacatggccgcactgagtcgggctcactccccggctctaggtgttcattctttcagcggtgtgcagcggttcaacatctccagtcacaaccagtcaccaaagcgtcattccatcagtcattctccaaatagcaatagcaatggcagcttcctggctcctgaaaccgaacccatagttccagaattgtgcatcgaccacctctggaccgagaccattaccaatatccgcgagaaaaacagccaggcctccaaagtgttcataactagtgatctgtgcggacagaagtttctctgcttcctggtggagtcgcagctgcagttgcggtgcgttaagttccaagagtcaaatgataaaactcaactcattttcggctctgtcactaatatccccgcaaaagacgcagccccagttgaaaaaatcgacacgatgctcgtactggaaggatcaggaaacttagtcctgtatacgggagttgtgagggttggaaaggtgttcatcccaggccttccagccccatcactcacaatgagcaacactatgcccaggcccagcaccccgctggatggagtttcaactccaaagcccctgtcgaagctccttggaagccttgacgaggtggtactgctgagccctgtgcccgaattacgagattcaagcaaattgcacgactccctgtataacgaggattgtacctttcagcaactggggacttacattcattccattagagatccagtgcacaatcgggtcaccctggaactctcgaacggctctatggtgagaataaccattcctgagatcgctacatccgaactagttcagacctgtttgcaggcaataaaatttatattaccaaaggaaattgccgtgcagatgttagtcaaatggtataacgtccactcagcaccaggaggtccttcataccattcagagtggaacctgttcgtaacatgtctgatgaacatgatgggctacaacaccgataggctagcctggaccagaaactttgacttcgagggttcgctttcacctgtcattgcccctaagaaggctaggccatcggaaacagggagcgacgacgactgggagtatttgctgaatagtgattatcaccagaatgtcgaaagccatctgctgaatcgctctctttgccttagcccttcagaagcgtcccagatgaaggatgaggacttcagtcagaatctttccctggacagctctacactgctgttcacgcatatccctgctatattctttgtgctacacttagtgtacgaagagctaaaactgaatacccttatgggagagggaatctgctccctagttgagctactggttcaattggccagggacctgaagctgggaccttacgtggaccattactatagggactacccaactctggtgcgcaccaccggacaggtctgtaccattgaccccggtcagaccggcttcatgcaccatcctagtttcttcacatccgaacctccatccatatatcaatgggtttcctcctgcctgaaaggcgaggggatgcccccatatccctacctgcctggcatctgtgaacgcagccggcttgtcgtgctgtccattgctctgtacattctcggcgatgaaagtctggttagcgatgaatccagccagtacttgacaagaataaccattgctcctcagaagctccaggttgagcaggaggagaacagattcagtttccgccactcgacttcagtgtcctccctggccgaacgcttggttgtgtggatgaccaacgttgggttcacactgagagacctggagacattgccttttggcatcgcactacctattcgagatgccatttatcattgcagagaacagccagcaagcgattggcctgaggccgtttgtctgctcattgggaggcaggatctcagcaaacaggcctgtgagggcaatctccccaaagggaaatccgtactgtcaagcgatgtccccagtggaactgaaaccgaagaagaagatgatgggatgaacgacatgaatcacgaagtgatgtcccttatttggtccgaagatctgcgagtacaggacgtgcgcaggcttctgcagagtgctcacccagtgagagtcaatgtcgtccagtatcctgagctaagcgaccatgaatttatagaggagaaggagaaccggctgctgcagttatgccagcgaacgatggcacttcctgtcgggaggggtatgttcacactgttcagttaccatccggtgcccaccgaacccctccccatccccaagctgaatctgaccggacgagcaccaccgaggaatactaccgtggacctcaactccggcaatatcgacgtgcctcccaatatgacctcctgggctagctttcataacggcgtggcagcgggactgaagatcgccccagcaagtcagatagactcggcctggattgtgtacaataaaccaaagcatgccgaactggcaaatgagtacgcagggttcctgatggcactgggtttaaatgggcacctcacaaagctcgcaactcttaatattcacgattaccttaccaagggccatgaaatgacctcaatcggtcttctgcttggagtaagcgcagccaagctcgggaccatggacatgtccattacgcggttgcttagcattcacatccctgccttactgcctccaacctctaccgagcttgacgtcccccataacgtacaggttgccgcagtagtcgggatcggcttggtttaccagggcacggctcacagacatacagcggaagtcttgcttgcggagatcggaaggccccctggcccagaaatggagtactgcaccgacagagagagctactcacttgccgcaggtttagctctcgggatggtctgcttagggcatgggtccaatctgatcggtatgtctgatctcaacgtccctgagcagctgtaccaatacatggtaggcggacatcggcgtttccagaccggtatgcatagggaaaagcataagtcaccaagttaccagattaaagagggagatacaatcaatgtagatgtgacttgccctggcgctacactagctttggcaatgatttacctgaaaacaaacaaccggtccatcgccgactggctcagagcgcctgatacaatgtatcttctggatttcgtcaaacctgagttccttctgctgaggacgctcgctcgctgtttgatcctctgggacgacatcttacccaactcgaagtgggtggattcaaacgtgcctcagattattcgcgaaaacagcatatcactttctgagatcgaactgccgtgtagtgaggatctgaacctggaaaccctcagtcaggcccacgtgtacatcattgcaggcgcttgcttatctttgggcttcagattcgccggatccgaaaacttgtctgcctttaactgcctccataaatttgccaaggattttatgacgtatctttctgcccctaacgcatccgtgactggtcctcacaacctggaaacctgtctgtcagttgttttgcttagcctcgccatggtgatggcaggttccggcaatctcaaggtgctgcagctgtgccgcttcctgcatatgaagaccggaggggaaatgaactacggtttccatctggcacaccacatggcgctgggcctgctttttcttggaggaggtcggtatagtctgtcaacatccaattcttccatagctgccctgctctgcgcactgtatccgcatttcccggctcactccacggataaccggtaccacctgcaggctctccggcacctctatgtactggctgccgagcccaggctgctagtccccgtagacgtggacaccaacacgccctgctatgctctgctggaggtcacatacaagggtactcaatggtacgagcagactaaagaggagctgatggctcctacactcttgcccgagttacacctgttgaagcaaattaaagtaaagggaccaaggtattgggagctccttattgacctatccaaaggtacacagcatctgaagtccatactgtctaaagacggggtcctgtatgtcaagctccgtgccggtcagctgagttataaagaggacccgatggggtggcagagtctactcgcccagacagtggcgaacaggaatagcgaagccagagctttcaagccagagaccataagcgccttcacctctgatcctgccctgttaagctttgccgagtatttttgcaagcccactgtgaatatgggccaaaaacaagagatcttggacctcttttcgtctgtgctgtacgagtgcgttacccaagagactcccgaaatgttgccagcttacattgccatggatcaggctataagacgtcttggccgtcgagagatgagcgaaacttcagagctctggcagattaaactagtgctggaattttttagcagcaggtcccaccaggaaaggctccagaaccatcccaagagaggtctctttatgaattctgagtttctccccgtcgtaaagtgtacaattgacaatactctcgatcaatggctccaggtggggggtgacatgtgcgtgcacgcatacttgtccgggcaacccctggaggagagccagttatccatgcttgcttgtttcttagtctaccatagtgtcccagcacctcagcatctcccacctattggccttgaaggcagcaccagctttgctgaacttctttttaaatttaaacaactaaagatgcctgtgcgggctttgctccggctggctcccttgctccttggaaatcctcagcctatggtgatgta

SEQ ID NO: 28297 - DNA, 1263 bp, Artificial Sequence
  Description of Artificial Sequence: Synthetic coding sequence
atgttaaaagccgtgattttaatcggcggaccccaaaagggaactaggttccggccactatcgtttgaagttcccaagccactgtttccagttgctggtgtgcctatgattcagcatcacatcgaagcatgcgcccaggtacccggaatgcaggagattcttttaatcggattttatcagcccgacgaacctctgacccagttcctcgaggcggcacagcaggagttcaacctgcccgtccgttatctgcaagagtttgctcctctcggcaccgggggaggcctgtatcattttagggatcagattctcgctgggtcccccgaagcattctttgttctgaacgctgatgtctgcagtgactttcctctttcagccatgctcgaggcgcaccgtcggcagagacatcctttccttctcctcgggaccacagcgaaccgaacacagagtctcaactatggctgcattgtggaaaatccacagacccacgaggtgcttcactacgtggaaaagccgtccacatttatatcagatattattaattgcggaatctatctgttcagcccagaagcactgaaaccgctgagggacgtcttccagcggaaccagcaggatggccagctggaagattcgccgggattgtggccaggggcaggtactattagactcgaacaagacgtgttcagcgccctggcaggtcagggtcagatatacgtgcacctcactgatggcatatggtcgcagatcaagtccgcaggaagcgcactgtatgcgtctaggctttatctgtcccgctatcaggacacacaccccgagagactggctaaacataccccaggtggaccctggatacggggtaacgtgtatatccaccctacggccaaggtcgcccctagcgcggtccttggtccaaacgtatccataggaaaaggggtgactgttggcgagggggttagactcagggaatccatcgtgctgcacggggcaaccctgcaggaacacacatgcgtgctccatagcatagtgggctggggttccaccgtgggcagatgggctagggtggaggggaccccctccgaccccaatcccaatgacccgcgagccaggatggactcagaatctctgttcaaggatggtaaactcttaccagccatcacgattctgggatgtcgggtccgtatccccgcagaggttctgattttgaattctatcgttttaccacacaaggagctgagcaggtcctttacaaatcagatcatcctttag

SEQ ID NO: 28298 - DNA, 1257 bp, Artificial Sequence
  Description of Artificial Sequence: Synthetic coding sequence
atgcgcgaatgcatttcgattcatgtggggcaggccggtgttcaaatcggcaatgcctgctgggaactctactgcctcgagcacggtattcagcccgacggacagatgcccagtgataaaaccattggcggaggcgatgattccttcaataccttcttctcagagaccggcgctggaaaacatgtcccccgagctgtgttcgtcgacctggaacccactgtggtcgacgaagtgcggaccggcacttatcggcaattgtttcatcccgagcagttgattaccgggaaagaggacgccgcaaacaactacgcgaggggacactacaccattggcaaagaaatagtcgatttggttcttgacagaattcgaaaactggctgacctctgcacagggttgcaaggcttcctgattttccacagcttcggtggcggaacaggctcaggatttgcctctctcctgatggagcgtctgagcgtggattatgggaagaagagcaagctcgaatttgcaatttacccagcaccgcaggtatctaccgctgttgtggaaccctataacagcattttaacgactcacaccacactggaacactctgattgtgcgttcatggtggataacgaggccatctatgacatctgcaggcggaacctcgacattgagaggcccacctataccaatctgaatcggctgatcggacaaattgtatcctccattacagctagccttagatttgacggagcgctcaacgtggatttaaccgaattccagaccaatctggtaccttaccctaggatccactttcccctggctacatatgcccctgttatctccgcggagaaggcatatcacgagcagctgtccgtggccgaaattacaaacgcgtgtttcgagcctgctaatcagatggtcaagtgcgatccacggcatggtaagtacatggcttgctgtatgctgtaccgcggtgatgttgtaccaaaggatgtcaacgccgctatcgctacaatcaagaccaaaaggacaatccagttcgtggactggtgccccaccggcttcaaagtgggcataaactatcaaccccctactgtggtgcccggtggcgacctggccaaagtgcaaagggccgtttgtatgttgtcaaatactactgccattgctgaggcatgggcgagacttgacctggcagcactggaaaaggactatgaagaggtaggcgtggattcggtagaagcggaagcagaggaaggtgaagaatattag

SEQ ID NO: 28299 - DNA, 417 bp, Artificial Sequence
  Description of Artificial Sequence: Synthetic coding sequence
atgcagctgcccccattcgatatgtggaaggactatttcaacctaagtcaggtagtatgggcacttatcgcttctcgcggacagaggctagaaacacaggagatcgaggaaccctcaccagggcctcctcttggccaggaccaggggctgggggcacccggtgctaacggcggtctggggacactgtgtaacttctgtaaacataacggggagtccagacacgtatattcatcgcatcagctcaagacccccgatggagtggtagtatgtcccatcctgcgccattacgtgtgccctgtctgcggcgctacaggcgaccaggctcacacactgaaatattgtccccttaacggcggtcaacagtccctctatcgtcggtcaggaagaaacagtgctggcaggagggtcaagagatag

SEQ ID NO: 28300 - DNA, 375 bp, Artificial Sequence
  Description of Artificial Sequence: Synthetic coding sequence
atgagagccagtccttgtatatcccagccagccgctagctggcatccacgcccaagcgcactccgaccaaccgccggaagcgggcctgataccaggacccctgggaccgtggaggatggatcagctccctgtcccgctttccgatccccagctgtctccccatgcggggaagagccctgctgttttcaaatctcaccagccgaagagaccctcgagttggggcgactggtctccccaggaaactgtgataccctgtctcctcgcgctgcgggattctatgcctgccacgtgaggagtttaatcccctgccgctcaactaaagggcgatggcccttgaccgcttctgcggctggtttgtcatcatttagcgggtag

SEQ ID NO: 28301 - DNA, 363 bp, Artificial Sequence
  Description of Artificial Sequence: Synthetic coding sequence
atggccgaacctagcagcgcacgccgacccgtaccactcatcgagtcagagctatactttctaatcgccagatacctgtccgccggaccctgtcgtcgcgctgctcaagtactagtccaggaactggagcaataccaactgctgccgaagcggttggattgggagggaaatgaacataacaggtcctacgaggaattggtgctctccaataagcacgtcgccccagatcatttactgcagatctgtcagcgaattgggcctatgctggataaggagataccaccctcaatcagtcgcgtgacctcgctgctcggggctgggaggcagagcctcctgaggaccgcaaagggcacactgatatag

SEQ ID NO: 28302 - DNA, 2607 bp, Artificial Sequence
  Description of Artificial Sequence: Synthetic coding sequence
atgatacccaagtccctggtccaggccgcagaaacacagcggggactctgtgaacccggaggcaaaggcagagagggaaggtctggcggaaaaggggagactaggcctaggggggttggaacccaggaaggtaaagggaccatacctggctccccgagagagaagcggggagagcgcggagaaggtgatcctgctttgctccccgcagaagacctatggaggctgcctggcagcaaggaccgtctgcgaagctccttgctccctcctccagggccaccctcttctgactcaggccctggccctccgtccagtcacagcggcaaaacggcgcagggccctcgtaccttgaattgggccaggaagcaaagtgcaagaaccagcagcaatctgtgtgcctggagcctggctatggctactaagatggcggagattcctagctccccatatgagccaggccaacgtgggatgaaggacactcagaggggcgacgcaccacaaaggggcagtccggagccaagaatcttgcaactggcaagggtgggaaatgtgtacctgaaagaggagtcatctagaagtggacggctcgaagctaaaaagtggatacccacaaaattcctagagaatctctctgtgccccacgtggatctaggagggaatcaactgtggagcggcggaatggaggcactcactactcagcttggccctgggagagagggtagctcaagccccaattccaagcaggaattgcagccctactccgggtccagcgccctgaaaccgaaccaggtcggagaaactagcttgtatggagtgcccatcgtgagcctggtgattgacggacaggagaggctatgcctagcacaaatttctaacaccctgctcaagaactactcatataacgagatacacaataggcgcgttgctttgggcattacatgcgttcagtgcacacctgtgcaacttgagattctgcggcgtgccggtgccatgccaatatccagcagacggtgcggtatgatcactaagcgggaagccgaacgcttatgtaaatctttcctgggcgaacacaagccacccaagttgccagaaaattttgcttttgacgtggtccacgaatgcgcctggggctccagggggtccttcatacccgcacgctataactcttcgcgtgctaaatgcatcaaatgcggatactgttctatgtacttttctcctaataaatttatattccactcccaccgcacgcccgacgcaaagtacactcagccggacgccgctaattttaattcctggaggcgacacctaaagctttccgacaagtcagcgaccgatgaactgagccatgcttgggaggaccgagggcttggcctggccacaggggcaagcgggccagcaggccctggaggcccagggggaggcgctggagtcagaagctaccctgttatacccgtcccttctaaagggttcggactgttgcagaagttgccaccacctctgtttccacacccatatggatttcccacggcattcggcctttgtccaaagaaggacgatccagtcttaggagcaggagaacctaaaggcggtagctacgtgtctgctttcagacccgtggtgaaggatacagagtctattgccaaactctatggcagcgccagagaagcctacggggctggacccgctagagggccagggcctggagccggaagcggcggatacgtttctcccgactttctatccgagggtagctcctcctacaatagcgcaagccctgacgttgatactgccgatgaacccgaagtagacgtcgagtcaaacagatttccagacgacgaagatgcccaggaggagaccgaacctagtgctccgagtgccggtggcggacccgacgcaggacgtcccgcttttggcgacctggcagcagaggacttagtgcgtcgtcctgagcgcagcccaccctctggaggagggggttatgagctgagggaaccatgcggaccgctcggcggtcctgcaccagctaaagtgttcgccccagaaagagacgagcacgttaaatcagcagcagttgctctgggacctgcagcatcatatgtttgtaccccagaggcgcatgagccagacaaagaggacaatcactcacccgcagacgatctcgagaccagaaaaagctacccggaccagcggtccatctcccaaccaagtcccgctaacacagataggggtgaagatggcctgacgctggacgtgactggtactcacttggtggagaaggatattgaaaatctggcgagggaagagctgcagaagctcttgttagaacagatggaactccggaagaaactggaacgggagtttcagagcttgaaggataatttccaggaccagatgaagcgtgaactggcgtaccgcgaggaaatggtacaacagttacagattgtgcgcgatacgctctgcaacgagttggatcaagagagaaaggctagatacgccatacagcagaaactaaaagaagcccacgatgctcttcatcattttagttgtaaaatgctgaccccacgccactgcacaggtaattgttcttttaaaccaccccttttgccttag

SEQ ID NO: 28303 - DNA, 3585 bp, Artificial Sequence
  Description of Artificial Sequence: Synthetic coding sequence
atgcacgaccttccgccagattcaggagcacggagggggggtagaggactcgccgaccactcctttcccgctggcgctcgcgcacccggtcagcctcctagcaggggggcagcctatcggagagcctgtccgagagatggggaacggggaggcggtggtaggcccaggcagcaggtgagccctccaaggtcaccccagcgagagcctcgcggaggccaactgcgcaccccaagaatgcgcccaagctgctcacgcagtttagaatcgctgcgcgttggggcaaaaccaccaccattccagcgatggccttccgactcatggatcaggtgtggggctcatagggactgggacgagccccctcctagaggcggtcggatggacggctggtccggcgaccgtgctagagcagcggcacccaccggactacaacccccaggctgcaaggaccacggttgctcatctggctcccctttcagagaccctgcgggtagtagtgtgatacgctcaggaaagggggaccgtcaggaaggacccagtttcctgaggccacccgctgtgaccgttaagaagctgcagaaatggatgtacaaagggaggttattgagtcttgggatgaagggccgagcccgagggaccgcccctaaagtgactggtacccaggcggctagtccaaatgtcggtgcgctcaaggtgcgtgaaaaccgcgtcctctcagtgccacctgatcagcgcattaccctaacagacctgttcgaaaacgcctacggaagcagcatgaaaggtagggaactcgaggaactgaaagacaacatcgaatttcgaggacataaacccctgaactccataactgtcagcaaaaagagaaattggctctaccagagcacactgcgccctctgaatctggaggaagaaaacaagaagtgtcaggacaggagccacctgtccatcagtcccgtgagcttgccaaagcatcaactcagtcagtcgtttctcaagagctccaaagagtattgcacgtatgttgtgtgcaatgccacaaactcatcactatctaagaactgtgctctggactttaatgaggaaaacgacgccgatgatgagggggagatctggtataatccaatccctgaagatgatgacttggggatatcatcagctttaagcttcggggaagcagacagtgccgtccttaagttgccagccgttaatctaagcatgctgtctggctccgacctcatgaaagccgaacgtcatactgaagattctctttgtagttctgagcacgcaggcgacattcagaccacaagaagcaatgggatgaacccaattcacccagcccactctaccgagttcgtgcagcagtataaacaaaagctggggcataagacacaggaagggattatggtcgaggatagccccatgctgaaaagtccgtttgccggttctggcatcctcgccgcaaccaatagcaccgaactcggaatcatggagccttcgtctccaaaccctagccccgtcaagaagggatcctctattaattggtcactccctgataagatcaagtcacctaggaccgtgaggaaactgtcaatgaagatgaagaaactgcctgaattcagtagaaaactctcggttaaaggtacactgaactacataaacagccccgataatacaccttccctctccaagtataattgtcgggaagttcatcacactgacattttgccgtctgggaatacgactacagcagctaagaggaacgtgatctcccggtaccatttggatacttccgtaagctcccaacagagctaccaaaagaagaattccatgtcttcaaaatactcgtgcaagggcggatacctgtctgatggggactccccggaactcaccaccaaagctagcaaacacgggagtgagaacaaattcggtaagggcaaggaaatcatttctaactcctgttcaaagaacgagatcgacattgatgcctttcgacattactccttctccgaccagcccaagtgcagccaatacataagtgggctgatgtctgtccatttttacggcgctgaagacctcaagccacctcggattgatagcaaggacgttttctgcgccattcaagtggatagtgtcaacaaagcacgcaccgccctgctaacatgccgcactacttttttggacatggaccacactttcaacattgagatcgagaatgctcagcaccttaaattggtcgtattctcctgggaaccaacccccaggaagaacagagtctgctgtcatgggaccgtcgtgcttccaacgctgtttagagttaccaagacccaccagcttgctgtgaagctggagcctcggggtctaatttatgtgaaggtaaccctcatggagcagtgggagaatagtttgcatggcctcgacatcaatcaggagccaataatctttggcgtcgacattcagaaagttgtggagaaggagaatattggtttaatggtgcctttgctgatacaaaaatgtattatggagattgaaaagagaggctgccaggttgtgggcttgtatagactgtgcggtagtgctgccgtcaagaaagagttgcgggaggcgttcgaacgagatagcaaggcagtaggcctgtgtgagaaccagtaccccgacatcaatgtaattacaggggtcctcaaggattatttgcgagagctgccgtcacccctgataacgaagcagctttatgaagcagtgttggatgccatggccaagtctcccttgaaaatgtcatccaatggatgcgagaatgatcccggtgactctaagtacaccgtggatttattggactgcttgcccgagattgaaaaagccaccctgaaaatgctgcttgatcatctcaaactcgtcgcaagctatcacgaggtgaacaaaatgacttgtcagaacctggcagtctgcttcggccctgtgctgctgtcccagagacaggagcccagcactcataataaccgggtgttcacggactcagaggagcttgcgtctgctctggatttcaagaaacacattgaggttttacactatttgctgcagctctggcctgtgcagcgccttacagtaaagaaaagcacggataatctgtttcctgaacaaaagtcttccctgaattacttgaggcaaaaaaaagaaaggcctcacatgctgaacttaagcggaactgattcctcaggcgtgttacgaccaagacagaacagactggattctcctttaagtaatcgatacgcaggcgactggagcagctgcggggagaattattttctgaacactaaggaaaatcttaacgatgtcgactacgatgacgttccttcagaagaccgcaagatcggcgagaactactcaaaaatggacggacctgaagttatgatcgaacagcccattccgatgagcaaggaatgtacattccagacctacctgacaatgcaaaccgtcgagagtaccgtggaccggaagaataatttaaaagatcttcaggagagtattgataccctgatcggcaacctcgagcgcgaacttaacaaaaataaactaaacatgagcttttag

SEQ ID NO: 28304 - DNA, 1353 bp, Artificial Sequence
  Description of Artificial Sequence: Synthetic coding sequence
atggacccgggaaatgaaaactccgccaccgaagccgcagccatcatcgacttggacccggattttgaaccacagtcccggcctagatcctgtacatggcctcttcctaggcctgagatcgctaaccaacctagcgaaccgcctgaagtcgagcccgacctcggcgagaaagccatcgaaagtgcccctgaaaagaggctcactcttgcccagatatatgagtggatggtgcgcaccgtgccgtatttcaaagataagggagacagcaacagtagcgccggatggaaaaattctattaggcataacctttccctgcatagcaagttcatcaaagttcataatgaggccactggaaagtcgtcatggtggatgctgaacccggagggcggtaaatctggtaaggctcctcgcagaagagctgccagcatggactccagttcaaaacttctgcgcggacgttcgaaggctcccaagaaaaagccttcagtactccccgcacctccagagggcgctacccctacaagcccagtggggcattttgcaaagtggagcggatcaccatgcagtagaaatcgggaggaggctgatatgtggaccacattcagaccaagatcttctagtaacgccagcagtgtgagtaccagactctcccctcttaggcccgaatcagaggtcctcgcggaagaaatccccgctagtgtgagttcatacgccggtggggttcctcctactctcaatgagggactggagctgttagacggacttaacctgactagcagccatagtctcctcagccgctctgggctgtctggattttctcttcaacatcctggggtgacaggccctctgcacacatattcttcctctctctttagtccggcagaggggcctctcagtgccggagaggggtgtttcagcagcagccaggcactagaggccctgttgacaagtgatacccctccacccccagcagatgttctgatgacccaggttgatcctatcctttctcaggcgccaactctgttgctgctggggggtctgccatctagctccaagctggctactggtgttgggctctgtccaaaaccccttgaagctccgggtccgagttctcttgtccctacgctcagcatgatcgccccacccccagtgatggcatccgccccaattcctaaagccctcgggacacctgtcttaactccccctactgaggcagcaagccaggacagaatgcctcaggatcttgatctggacatgtatatggagaatctcgagtgcgacatggacaacatcattagcgacctgatggacgagggagagggcttggattttaacttcgagcccgacccctag

SEQ ID NO: 28305 - DNA, 1125 bp, Artificial Sequence
  Description of Artificial Sequence: Synthetic coding sequence
atggctggttatttatctgaatctgactttgttatggtcgaggagggattctctacgagagatctgttaaaggagctgacactcggggcatcccaggctacgacggatgaagtagccgctttttttgtcgccgatctcggagcaatcgtgaggaaacatttctgctttctaaaatgcctgcctcgggtgcgaccattttacgccgttaagtgcaacagcagccctggagttctgaaagtactggcccagctgggactgggattctcttgcgctaataaggcggagatggagttagtgcagcatattggaattcctgcttccaagattatttgtgcaaatccgtgcaagcagattgcccagattaagtatgccgctaaacacggcatccagctgttgtctttcgacaatgagatggaactggccaaggtggtcaagagccatccttccgccaagtttgtccagcagagagggacagcatgccttatacggatggtgttgtgcatcgcaactgatgattcccacagcctcagttgccttagtctcaagtttggtgttagtctcaaaagctgccgccatctgctggagaacgccaaaaaacaccacgttgaagtcgtcggggtcagtttccacattggcagtggctgccccgaccctcaggcttatgcccagagtatagctgatgccaggcttgtctttgaaatgggcaccgagttgggacacaagatgcatgttctggacttgggagggggttttcctgggacagaaggcgctaaagtgagattcgaagagattgcttccgttatcaactcagccctggatctgtacttccccgagggttgtggagtcgatatttttgctgagctgggaaggtattacgttacatcagcatttacagtggccgtgtctattattgccaaaaaggaagtgctgcttgaccaaccagggagagaggaggagaacgggtccacaagcaagactatagtttatcacctggatgaaggagtatacggaatctttaacagcgtcttatttgataacatttgcccaaccccgatactgcagaaatctaaaaaccattctccgtgctatatgtctctggagtccattcacttcatcgcagtttag

SEQ ID NO: 28306 - DNA, 1629 bp, Artificial Sequence
  Description of Artificial Sequence: Synthetic coding sequence
atggatcgttcaaaacgaaatagcatagctggcttcccaccccgagtagagcgtctggaggagtttgaagggggagggggtggcgagggaaacgtgtcacaggtcggcagggtgtggccaagctcctatcgagcactgataagcgctttttcaaggctgacaaggctggacgatttcacctgtgagaagattgggtctggtttcttttctgaggtcttcaaggtccgccaccgtgcctctgggcaggtgatggctcttaagatgaacaccttaagctccaaccgcgctaacatgctcaaagaagttcagcttatgaatcgcttgtctcaccccaacatactcaggttcatgggggtgtgtgttcaccagggccaactgcacgctcttacagagtacattaatagcggcaacctcgagcagctactggactccaacctgcacctgccctggactgttagagttaagcttgcctacgacatcgcagtgggcctaagttatcttcactttaagggaatctttcatcgcgaccttacctctaaaaactgtctaatcaaacgcgacgaaaatggctactccgcggtcgtggccgacttcggactggcagagaaaatcccagacgtgagtatgggatctgaaaagcttgccgtggtcgggagccctttttggatggcccctgaagttcttcgagacgaaccctacaacgagaaagccgacgttttctcttacgggatcatcctttgcgagatcatagcacggatccaagctgatccagattacctgcccagaacagagatggaccccaagctcaggccatcttttgtggaaattggcaaaaccctcgaagagatcctctctcgtctacaagaagaagagcaggagagggaccggaagctgcaacccaccgccagggggctgctggagaaagcacctggcgtgaaacggctcagtagcctggacgacaaaatccctcacaaatcaccatgtcctcggaggacaatttggctgagccgctctcagtcggacatcttttctcgcaagccccctcgcacagtgagtgtgctcgatccttactatagacccagggacggagccgcacgtacacccaaggtgaatcctttttccgctcggcaggacctgatgggcggaaaaatcaagttctttgatctcccttctaaatcagtcatctcattggtgtttgatctagatgcaccaggacctggcactatgcccctggctgactggcaggaacctctggcccctcctattaggaggtggcggtccctgcctggcagccccgaattcctgcaccaagaggcctgcccattcgtgggcagagaggaatccctttccgacggtcccccacctcgcctgagctccttgaagtaccgcgttaaggagatccccccatttagggcctcggcactgcctgccgcacaggcacacgaggcaatggactgctctatcctgcaggaagaaaatgggttcggtagtcggcctcagggcacatcaccttgtcccgctggcgcttccgaggagatggaagtcgaagaacgtcctgcgggaagcacacccgcaacgttttccacatccgggattgggctgcagactcagggtaagcaagatggctag

SEQ ID NO: 28307 - DNA, 786 bp, Artificial Sequence
  Description of Artificial Sequence: Synthetic coding sequence
atggggagcaggaagaaagaaatcgccctgcaggttaacatcagcacccaggagttatgggaagaaatgctttcttcaaaaggtctcacggtagtggacgtgtatcagggttggtgcggcccatgtaagcctgtcgtgtctctatttcaaaagatgcgaatagaggtgggacttgatctgttgcatttcgccctgatcaaggacgaggctctgagcgatgaagacgagtgcgtttctcacggaaaaaacaatggggaggacgaagacatggtgtcttcagagagaacttgcactctggcgattatcaaaccagatgctgttgcccacggaaaaactgacgaaatcataatgaagattcaggaggctggcttcgagatcctcaccaacgaggaaaggactatgacagaggcggaggtcagactgttctatcagcacaaagctggcgaggaagccttcgaaaaactggtccaccacatgtgctccggaccgagccatctactgattctcacaagaacagagggatttgaggacgtcgtgacaacctggaggacggtgatgggcccaagggacccaaacgttgctagacgagaacagccagaatctctcagagcacagtatggaacggagatgcctttcaacgctgtgcatgggtcaagggacagggaagacgctgatcgggagctggcgctactgtttcctagcctcaagttctccgataaagataccgaggcccctcagggagagtcttcaacacaacccagattaaaaatcactgacctcgactag

SEQ ID NO: 28308 - DNA, 1767 bp, Artificial Sequence
  Description of Artificial Sequence: Synthetic coding sequence
atggaggcagccgacgcgagtcgttcaaacggcagcagcccagaagcgcgagacgctagaagccctagcgggccaagcgggtcccttgagaatggtaccaaggctgacggtaaagacgccaaaactactaacgggcatggcggagaggccgctgaaggaaaaagtctgggttctgccttgaaacctggagaggggagatccgcccttttcgctggcaatgaatggaggcggccaatcatacagtttgtcgagagcggtgacgataaaaattcaaattattttagcatggattctatggaagggaaacgcagcccctatgccggtttacagttgggcgcagctaagaaacctcccgtaacctttgctgagaagggggagctgcgaaagtctatcttctcagagtcccggaagcccaccgtgtccatcatggagcccggtgaaaccagaagaaattcctatcccagggcagacacagggttatttagccgctctaagtccggctcagaggaagttctgtgtgattcatgcatcggtaacaagcagaaggctgtgaagagctgcttagtgtgtcaggctagtttctgcgagctccacctcaagcctcacctcgagggcgctgcttttcgagaccatcagctgcttgaaccgatccgcgattttgaggcgaggaaatgccctgttcacgggaaaactatggagctgttctgccagaccgatcagacatgcatatgttacctgtgtatgtttcaggagcataagaatcactccaccgtcactgtcgaggaagcaaaggctgagaaggagacagagttatcactgcagaaagaacagctccagctcaagataattgaaatcgaagacgaagccgagaagtggcagaaggagaaggaccgaatcaagtcttttacgactaatgaaaaggctattttagagcagaactttcgcgacctggtgagggacctcgagaaacagaaggaggaagtgcgcgctgccctggaacagcgggagcaggacgcagttgatcaggtgaaggtcattatggacgcccttgacgagcgcgcaaaggtgctgcatgaggacaaacagacgcgggagcagcttcacagcatctccgacagcgttctgtttctgcaggagtttggtgctttgatgtctaactattctctgccgccacctctgccgacctatcatgtgctgttggaaggggagggactgggacagtccctcggaaattttaaggacgacctccttaacgtgtgcatgcggcatgtggaaaaaatgtgcaaagccgaccttagcaggaactttattgaaaggaaccacatggaaaatgggggagaccacagatatgtcaataactacaccaattccttcggcggtgaatggtcagcccctgatacaatgaaaagatacagtatgtatctgaccccaaaaggcggagtgcgcacctcgtaccagcctagctccccaggacggtttacgaaggagaccactcagaagaatttcaacaatctgtacgggactaaggggaactatacctcccgcgtgtgggagtattctagctcaatccagaacagtgacaatgacctgcctgtcgtgcaaggtagttcctccttttcattgaaaggctacccctcccttatgaggagccaaagtccgaaagcccagcctcagacttggaagagcggtaagcagacaatgttaagccactaccggcctttctatgtgaacaaaggaaatggcatcggatctaacgaagctccttag

SEQ ID NO: 28309 - DNA, 3567 bp, Artificial Sequence
  Description of Artificial Sequence: Synthetic coding sequence
atgaagaagaaacagacagtgcaaggcaccttcagtaagctgttcggaaagaagcatacaactaccccatccacctctctgtatgccaccaacccaccctggatctttactcaggaagcccctgaagaaggaaccgggggattcgatggaatttactatggagataatcgattcaacacagtcagcgagagcgggacagcgacactcaaggctagacccagagttagaccgctgctgacgttcctccccctaaatgcccaagaaaatcatggactcgccgtacccaccccatctgtgccggacgacttcgctgacaaggaagtcaccgggacaagcagcttggtgaatggaaatctccgcctgtattcttctgttggagatctgcgcccaggacaatacgggcaggacctgctgatcccacctcctccgcctgggccagcccctgggccaccgcaggacatatctgaaccgcctggaggcagcccactgccaagtccaccctccactgccccaccaccgccaccactcctactggagccaccgccacctccgtcaatggcgccaccccctccaccagtcctggaggctttgtcaccccctcacacgctgtcaagcccatcaatacccactccccctgattttattccaccagcccctccacttgcttttctggcacctccacccccaccagtgcccgctccagcgcctcccgctccagcttctccccacacagtgggcacaaggctgttcccacctgggggagttaccaagtggaagagtgatgtggcgctcaacggacggcaagcggaggctacccgggcttctccacccagatctcctgcggaacccaagggttcagctctgggaccaaatcctgagccacacctcaccttccccagatcctttaaggtcccccctccaaccccagtgcggacttccagtatccctgtgcaggaggcccaagaagcccctaggaaggaggagggtgccacgaagaaagccccttctcgcttgccactgccccctagttttcacatacgacccgctagtcaggtctacccagacagggcaccagagccagactgccccggagaactgaaagccaccgccccagccagcccacgtctcgggcagtctcaatcccaggccgacgagcgggctgggacaccacctccagccccacctctgccccctcctgcgcctccgctcccgccacccgcacctcccctgcctcccgcagctccaccactcccttgtgctcagaaggccgcacacccccctgccggattcacaaagacacctaagtcctcctcccccgctctcaaacctaaaccaaacccccctagtcctgaaaacaccgcctccagcgctccggtggactggcgcgacccctctcagatggagaaattgaggaacgagctggcggcttatttgtgcggaagtagacgcgaagatagatttctcagccataggccgggacctactgtggcaccccaatctaaggaaggaaagaagggccctagattacctgagaaagagaccctgctgtcgctcccagctaaggacaccccacccggagtgcctgaaaagtctcttggagggtccagtctaactgagactgaggcagcgccaagcttaaccctaccatccgtcgactatatccctcaggactcaccgaccccctctgtccggcaaatcagaaatgagctggaggctcggttgagctcagcagctgagaaggaggctaagccatctatcggctcccttcctccaaaacctcgtctcgagggcggtcggatatgcgaaaacggcgcagatgacgacaagctctccaagcccgtcgctaaaaacctgccgcctcaaagtaccaccttgctccctaccaccagtttacagcccaaggcaatgctcggcccagcgatcccacccaaggcgactccggaaccggcaatcccccctaaggccacactctggccagccaccccacccaaggcgacgttaggccctgcgaccccactaaaagccacttcagggcctaccacaccattaaaggctacaagcggcccagcaatagccagcactgccaccacgctgccaacaaccactagccagttaatggcagagaaggattcagggccagctgggcagccagaaaagccagccagtcaagaggtctctacaccatctcaggccagaggcgagggctcaccctccgaggccactcggctgcccacccagggcgcaagatcatcagccgcattccctccaaagacgagcccgggaggaggcgaagtgccatgtctttataaacctcattgccatcagtccagccttagcagggaggtcgcagtagtcatgcctaccctggccagagggggtgccgcaggcccaggcgaacctgtggaagtaaaggaaccccctggactgcccgctaagccccctgcaagtgctcaacccaccgatgagttgcttagacatcccgtcactggtgaagtcgttgagcgtggctctccgatggccctgcttttagctgcccgtcagagggcccaaaaaggccgttcagtgggcgcagccttgggcaggtctagtctgccgggatccctgcgggatcattcgcaccaggcagaggccagctccgacagcatcttccatagtcagggaacgcccaattcatttacagttgtgccgaagctgcctaaagaggcggagaaggactcaccactgacgactgagattccgaataagtgggggccacgcctgggaagagatgccgagggtactgagctgagtcggaggcacaactggaccaagccggaaccacaggccccagtggcttgggagcgcgttgccccatctaatctgccacagggtcacccactgccaaagtcatttagttcacctccctctcccagtaacaagagagaggaagaagaggaggagtttaactttgaggtgatcccaccacctccggaattttccaacgatccagagccaccagcacccgctctccagtatttggggaggcaatctagcccgcctcgcaataattattcagatctgcggcagctgccgaatgctggcccaggagccccaccggctctgggcttctcaaggttccctgccggtgcacggtacgcgggagcgggtggcctcgagagattctcagggggagggcgttccctcatcaagaaacgcctatatgtcggcgagcctcacaggggcccaggtctcccacacggagggacaggcaggagtctttcgagccccaattgttttggaccccagccaggaggccctgagatgaggcgggtgaattcagctggaagagctccacctgggggtctacacgcaccaagactctctcttgaaggggcagcccgtggcgcagcggaggcaaagcacaaggctccagggtccgccgattatgggttcgcacctgctgcaggccgtagtccatacaccaccaccaggtacggcagtcccattaacacattcaccgtccgacctggaacacgccaccctatatcctatgtgtgctccggcgctcatcggaaagccacctcatag

SEQ ID NO: 28310 - DNA, 2598 bp, Artificial Sequence
  Description of Artificial Sequence: Synthetic coding sequence
atggccgtggcccgtgtggacgcggctctgccacctggagagggtagcgtagttaactggagtggtcagggactccagaaactcggtccaaatctgccgtgtgaggcggacatacacacactgatcctggacaagaatcagatcataaaactggaaaatctcgagaagtgcaagcggctgatccagctgtccgtggccaataatcgcctggtgcgaatgatgggagtggccaagctcactctcttgagggtgttgaacctaccacacaacagtataggctgtgtggagggtctgaaagagctcgtgcacctagagtggcttaaccttgccggaaataacctgaaagccatggagcagattaattcatgtaccgcactgcaacatctcgatctgagtgacaacaacatttctcaaatcggagacctatccaagcttgtatctttgaaaacactgcttttgcacgggaacataatcacttccctgaggatggctccagcgtacctgcctcgaagcctcgccattctctctctcgccgaaaacgaaattagggatttgaacgagatatcattcttggctagcctgaccgagctggaacagctgagtataatgaacaatccatgtgtgatggcaacgccatcgattcccggtttcgattaccgcccttatatcgtgagctggtgtctaaatttgcgtgtgctggacggctacgtaatcagccagaaggaatcgctgaaggccgagtggctgtacagccagggaaaggggagggcgtataggcccggtcaacacattcaactcgtccagtacctcgcgaccgtgtgtcccctcacctccactctcggacttcagacagcagaagacgcgaagctcgagaagatcctgagcaaacagcggttccaccagcgccagctcatgaaccagtcacagaacgaagagctctcccccctcgttccagtggaaacacgagcgagcttgatccctgaacattcttcccccgtccaggattgccaaatcagccaagaatccgagcctgtgatccaagtgaactcttgggtgggaatcaactctaacgatgaccagctctttgccgtcaagaacaacttccccgcatctgtccacactacccggtacagccggaatgaccttcaccttgaagatatccagacagacgaagacaagcttaactgcagtcttctaagttccgagtccacatttatgcccgtcgcctctggcctgtcaccactctcacccacagtcgaactacgacttcagggaataaacctgggattggaggacgacggggtcgccgatgagtccgtgaagggcttggagtcccaggtccttgacaaggaagaggagcaacctctgtgggccgctaatgaaaactccgttcagatgatgcgcagtgagatcaatacggaagtcaatgaaaaagcgggtttgctcccttgcccagagcctactattatttctgctatcctgaaagatgataaccactccttgacattttttcctgaaagcaccgaacagaaacagtccgatataaagaagcccgagaacacacaacccgagaataaagaaactatttcccaggccacctctgaaaagctccccatgatactcacccagcggtccgtcgctctcggccaggacaaggtggccctacaaaagctgaatgatgcggcaacgaagttgcaggcatgctggcgcggattctacgcacgcaactacaatccacaggctaaggacgtgaggtacgaaattcggcttaggcggatgcaggagcatattgtgtgtctgacagacgagattcggagactgcggaaagaaagagatgaggaacgcattaaaaagttcgtacaagaggaagccttcaggttcttatggaaccaggttagatctcttcaggtgtggcaacagactgtggaccagcgcttgtcgtcttggcacacagatgtgccgccaatcagtagtactctcgtccccagcaagcatccactgtttacccagtcgcaggagagtagctgtgaccagaacgctgattggttcatcgcaagtgacgtggctcctcaggaaaagagtctgccagaatttcctgattctggtttccactcctcattaactgagcaggtacactcattacaacacagtttagacttcgagaaaagttccactgaggggtcagagtctagcattatgggcaattcaatagatactgtgagatatggaaaggaatccgatttaggggatgtgtccgaggagcacggagagtggaataaagagtcttcaaacaacgagcaggacaattctctgctggagcagtacctcacctccgttcagcaactcgaagacgccgacgagagaaccaacttcgacaccgaaaccagagatagcaaactgcacattgcctgtttcccagtgcagctcgacacactgtctgacggtgcatctgtggacgagagtcatgggatttctccccctttacagggagaaattagtcaaacccaggaaaatagtaaactcaatgctgaagtgcagggacagcagcctgaatgcgactcgacctttcaacttctgcatgtcggagttaccgtttag

SEQ ID NO: 28311 - DNA, 1275 bp, Artificial Sequence
  Description of Artificial Sequence: Synthetic coding sequence
atgtccgtgggttgtcccgaacccgaacccccacgaagtctgacctgttgtggtcccggaacagcacccggacctggggcaggagtaccgctcctcacagaggatatgcaggcactcaccttgagaaccctcgctgcgtcggatgtcactaagcattacgaattggtgagagagttggggaaaggtacatatgggaaggtagacctggtcgtgtacaagggcacgggcacaaagatggcactgaaatttgtaaacaagtccaagaccaagctgaagaacttcctacgggaggtatcaataaccaacagcctgtcgagcagtcccttcataattaaagtctttgacgtggtgttcgagactgaggattgttacgtgtttgcccaagaatacgcgcctgcgggtgacctgttcgacattatcccccctcaggtgggcttgcctgaagatacagttaaacgatgcgtgcaacaattggggctggccttagacttcatgcacggaaggcagctggttcaccgggacattaaacccgagaacgttctgcttttcgacagagaatgccggagggtaaaactggctgacttcgggatgacccggagggtgggttgcagagttaagagagtgagtggcaccatcccgtacactgccccagaagtatgtcaggctgggagagccgatggattagcggtggacaccggtgtggacgtttgggccttcggcgtgcttatcttctgcgtgctgaccggtaattttccatgggaggctgctagtggcgctgatgcctttttcgaagagttcgttcgctggcagagaggtagattaccaggcctcccctcccagtggcgtagattcacagaacctgccctgagaatgtttcaacggctgctcgctttggagccagaacgtaggggcccagccaaggaggtatttagattcctgaagcatgaattgacttcagagctgaggcgtagaccctcccacagggcaagaaaacccccaggggatcgacccccagcagcaggccctttaaggctagaagctcctggccctctcaaacgcacagtgctgactgagagtggttcaggttcaagacctgccccaccagccgtcggttctgtaccactgccagtgccagtgccggtaccagtgccagtgcctgtccccgtgcccgaacccggactggcaccacagggacctccgggtcgtactgacggcagagccgataaatccaaaggtcaggtggtgcttgcgactgctatagagatttgcgtgtag

SEQ ID NO: 28312 - DNA, 1632 bp, Artificial Sequence
  Description of Artificial Sequence: Synthetic coding sequence
atggctacccgacgcctgggagtgggggaaaccctgggggcactgaatgccgctctcggccctggtggacccgtgtggatcaaggagacccgcacacgtcatctgcgctctagagacttccttgcacctcacagggctctgcaggcccgattcgatgacggccaggtgcccgagcatttgttgcacgctctagcttgcctgcagggccctggcgttgcacccgttcttcgatgcgccccaactcctgctggcctgtccttgcagctccaacggtccgccgtgtttgaacgggttctctcagctgtcgccgcttacgcgacccctgcttctcccgcttctcttggtcagcgtgtattactccattgccctgcgctaagatctagcccctgcgccctgcggctgtctcaattacggaccgtcttggtggccgatcaccttgcacgggctctgcgagcacatggggtatgcgtgaggctggtgcctgcagtgcgagaccctcacatgctgacttttctccagcaattgcgcgtggattggccagcagcaagtgagagggcaagctcacatactcttaggtcccacgctctggaggagctcacgtcagctaacgacggaaggacccttagcccgggtatcctggggcgactgtgcttgaaggaactcgtcgaggagcagggaagaaccgccggatatgatcccaatctggataattgcctggtgaccgaggatttgctgtccgtgctcgcggagttgcaggaagctttgtggcactggcctgaggatagccaccccggactcgctggcgcatctgacaccggaaccggaggatgtctcgtcgttcatgtggtgagctgcgaggaagaattccagcagcaaaagcttgacctcctttggcagaagctggtcgataaagctcctttacgccaaaagcatctcatctgcggcccagtcaaggtggcaggggcaccagggacgctcatgacagcaccagagtactacgagtttcggcacacccaagtttgcaaggcctctgctttaaagcacgggggagatcttgcccaagacccagcctggacggaaattttcggcgtgcttagcgtggctaccataaaatttgaaatgctctccaccgcaccacagtctcagcttttcctggcacttgctgactccagcataagcaccaaggggacaaaatctggaaccttcgtgatgtacaattgcgcccgtcttgccaccctttttgagagttataaatgtagcatggagcaaggattatacccaacatttccacctgtatccagcctggacttttctctgctccacgacgagggcgagtggcttctacttttcaactctatcctccctttccctgacctcctgtcacgaaccgccgtgctggattgcacggcccctggactccatattgccgtaaggaccgaaatgatctgtaagtttctggtccagctttccatggacttctccagttattataatagagttcacatcctcggagagccaagacctcacctctttggccagatgttcgtgaggctgcagctgctccgggcagtgagggaggtcctgcacacagggctggctatgctaggcctcccacccttatcccacatctag

SEQ ID NO: 28313 - DNA, 1353 bp, Artificial Sequence
  Description of Artificial Sequence: Synthetic coding sequence
atgggcaagtccttcgccaattttatgtgcaagaaagacttccaccccgcttccaaaagtaacattaagaaggtctggatggcagaacagaaaattagctacgataagaagaaacaagaggaattgatgcaacaatatctgaaggagcaggagtcctacgataacagattgttgatgggagacgaacgtgttaagaatggtttgaattttatgtatgaggctcccccaggggctaaaaaagagaataaagagaaggaggagacagaaggggagacggagtataaatttgagtggcaaaaaggtgcaccaagggagaagtatgccaaagatgacatgaacatacgcgatcaaccctttggaatccaggtacgcaacgtcaggtgtattaagtgtcataaatgggggcatgtgaacacggaccgagaatgccccctctttggactttcgggcatcaacgcttcttcagtaccaacagacggatctggacccagcatgcatccctccgaactgatagccgaaatgcgcaattccggatttgctcttaaaaggaatgtgctgggcagaaacttgactgccaacgatcccagccaggagtacgtggcctctgaaggagaggaggatcccgaagtcgagtttcttaagagcctgacgaccaagcaaaaacaaaaattgctgcgaaagctggatagactggagaaaaaaaagaaaaaaaaagacaggaagaaaaagaaattccaaaagtcacggtctaagcacaagaaacataagagcagttcatccagctcttcatcttcctcgtcatccagtagtaccgagacaagtgagagctcgagcgagtcagagagcaacaacaaagagaaaaaaatacagcgcaaaaagagaaagaagaacaagtgtagtggacacaataatagtgatagcgaagagaaagacaagtccaaaaaaaggaaactgcatgaagaattatcgtccagtcaccacaatcgagagaaagcaaaagagaagccaaggttcctaaaacacgagtctagccgagaagacagcaaatggagtcattcggacagcgacaagaagagtcgcacacacaaacattctccggagaagcgaggtagtgagagaaaagaaggctcctcccggtctcatgggagagaggagcgatcccgcagaagcagaagtcgatctccaggctcttataagcagcgagaaacaaggaaacgggctcagcggaatccaggcgaagagcagtcacgcagaaacgattctcgttcccatggcactgacctttacagaggtgagaagatgtaccgtgagcatcctggcggtacacacaccaaagtaacacagagagaatag

SEQ ID NO: 28314 - DNA, 1152 bp, Artificial Sequence
  Description of Artificial Sequence: Synthetic coding sequence
atgagcccagaggtggctctcaacagaataagtcccatgcttagcccgttcatcagttcggtggtgcggaatggtaaggtaggactggacgcgacaaactgccttcgcattacagatctcaagtccggttgcacttcgttgacccccggtcctaattgtgataggttcaaattgcacataccctacgccggagagaccttaaagtgggacatcatttttaatgcacagtacccagaactaccgcctgatttcatcttcggagaagacgctgaattcctgcctgatccgtctgccctacagaacttagccagttggaacccgagtaaccccgagtgtctgctgctggtggttaaagagctggttcaacagtaccaccaatttcagtgcagccgactgagagagtcctcgaggctcatgtttgagtatcagacgctcctcgaggaaccgcagtatggggaaaatatggaaatttatgccggtaagaaaaacaattggacaggagaatttagcgctaggtttctgttgaagttgccagttgatttcagcaacatacctacgtatctactgaaggacgtcaacgaggaccccggagaagatgtcgctctgctctcagtgagctttgaagacactgaggccacacaggtgtaccccaaactttatttgtcgccgcgtatcgaacatgcccttggcggatcatcggcacttcacatccccgctttccctggtggagggtgtctgatagattatgtgccacaggtatgtcacttgttgacgaacaaagtccagtatgtcatccagggctaccataagaggagagagtacatagcggcatttctctcgcattttggcacaggagtggttgagtatgacgccgaaggctttactaagctcaccctcttattgatgtggaaggacttttgctttctagttcatatagatctacccctctttttcccacgagatcagcccactctaaccttccagtctgtttatcatttcactaactctgggcagctctattctcaagctcagaaaaattatccatatagtccgaggtgggatggtaatgagatggccaagagagcaaaggcctacttcaaaacgtttgttccccagttccaagaagccgcattcgctaacggtaaactatag

SEQ ID NO: 28315 - DNA, 675 bp, Artificial Sequence
  Description of Artificial Sequence: Synthetic coding sequence
atgcccaaccggtgcggtatcatccatgtgagaggcccaatgccccctaaccggatcagtcacggggaggttctcgaatggcagaagactttcgaggaaaaacttacgccactgctctccgtgcgcgagtcactgagcgaggaggaggcacagaaaatgggccgaaaagatccagaacaggaggttgaaaaattcgtcacgtcgaacacacaagagctgggcaaggacaaatggctttgtcctctgtccgggaagaagtttaagggccctgagtttgtccggaaacatatcttcaacaagcatgccgagaaaattgaggaggtaaaaaaggaggtggccttcttcaataactttctgaccgacgctaagaggcctgccctccctgagatcaagcctgcacagccacctgggccagctcagattctcccccctggcctgacaccaggtctgccctatccccatcaaacaccgcagggtctgatgccatatggacaaccacgacctcccataggcttatggtcttggtgctgtccaccttgcagtccacaggaggctctccacactcccatgcctaggatggtcctcgtggagggaacaatgatgccttccgaagctcgcgaagtcatcttggggaatctagctaccggctggtttgtggagacccaaggtccttag

SEQ ID NO: 28316 - DNA, 4806 bp, Artificial Sequence
  Description of Artificial Sequence: Synthetic coding sequence
atggaggccggatccgtggttagagctatttttgacttttgcccatccgtgtctgaggaactgccactctttgtgggggatattattgaagtgcttgctgtggtcgatgagttctggctcctgggcaagaaagaagacgtgacaggacagtttccttcgagcttcgttgaaatagtcactatcccctccctcaaagagggtgagcggctctttgtctgcatctgcgaatttacgtctcaggagctggataatcttcctctccaccgcggagatctcgttattttagacgggatcccaacggcgggttggctgcaggggaggagctgttggggcgctcgagggttttttccatcaagctgcgtccgggagctctgcctgtcctcccagtcacgccagtggcacagccagagcgcacttttccagattccagagtactcaatggggcaggctagagccctcatgggcttgtccgcccagttggatgaagagctcgacttcagagagggagatgtcattacaattattggggttccagagcccggatggttcgagggtgagttagaaggcaggagaggcatttttcccgaggggttcgtagagcttctagggcctcttcgcactgttgacgagtctgtatccagcgggaaccaggatgactgtattgtgaatggcgaggtcgacacaccagtgggagaggaggaaatcggacccgacgaggacgaggaagagccaggtacatatggcgtggccctgtacagattccaagccctcgaacctaatgaattagactttgaagtaggggacaagatcaggatccttgcaaccctcgaagacggctggctcgaaggcagccttaagggccgaaccggaatttttccttatcgattcgtgaagctgtgccccgacacccgcgtggaagaaacgatggctctgccacaagaaggtagccttgcgaggatccccgaaacttcattagattgtcttgagaatacactgggggtcgaggaacagagacacgagacatccgatcacgaggctgaggagccagactgcatcatttctgaggcaccaacatctccgctcggacacctaaccagcgaatacgacacagaccgcaattcataccaggatgaggataccgccggaggccctcccagatcgcctggcgtggaatgggaaatgccgttggcaacagattccccgacatcggatccgaccgaggtggtgaacggtatcagcagtcagcctcaggtaccctttcatcccaatctccagaagagccagtactattccaccgtggggggaagccacccccatagcgagcagtacccagaccttttaccactggaagcccgaactcgtgactatgccagcctgcccccaaagcggatgtacagccagctcaagactttgcaaaagcccgtcctgccactgtatcgcggtagctccgtgtccgcctcacgcgtcgttaaacccaggcagtcctccccacagctgcataacctggcttcctacacaaaaaaacaccacacctctagcgtgtacagtatcagcgagcggctcgaaatgaagcctggccctcaggcccaaggattggtcatggaagccgctactcattcacagggcgacgggtctacagacctcgacagtaagttgacacaacagctcattgaattcgaaaaaagcctggcgggtcctgggaccgagccagataagatactcagacactttagcattatggatttcaactccgagaaagacattgtccggggatccagcaagctgatcaccgagcaggagcttccagaacgtcggaaagctcttcggcctccgccacctagaccctgtacccccgtatctacgtcgcctcacctcctggtcgatcagaacttaaagcctgctccaccgctggtggtcagaccctcccgccctgcccctctgcccccatcagcacagcaaagaaccaatgctgtttctccaaagctgctatcccggcaccggccaacctgcgaaaccctggagaaagaagggcctggtcatatgggacgatcccttgatcagaccagcccatgtcccctcgttctggtcagaattgaggagatggaacgggatctggacatgtactcacgtgcgcaggaagaactcaatctgatgttagaggaaaaacaggacgaaagttcaagggccgaaaccctggaggatcttaagttttgcgaatctaacatcgagagcctgaacatggagcttcagcagcttagagaaatgacactactgagcagtcagtcgagctccctggtggcaccctctgggtctgtgagcgccgagaatcccgaacagagaatgttggaaaaacgcgctaaggttattgaggaactgttgcagactgagcgggactacatccgtgatcttgagatgtgcatcgagagaatcatggtgccaatgcagcaggcccaggtgccaaatattgacttcgagggactgttcggaaacatgcagatggtgattaaggtctccaagcagcttttagccgctctcgagatatctgacgccgtgggcccagttttcctggggcatcgcgatgagctggagggaacctacaaaatttattgtcagaatcacgatgaggccatcgctcttctagagatttacgagaaggatgagaaaatccagaagcatctccaggactcgctggccgatcttaaatctctgtataacgagtggggttgtaccaattacataaacctgggcagctttctgattaagcctgtccagagagtgatgaggtacccattactcctgatggaacttctgaattctacccccgagagtcaccccgacaaagttccgttgaccaatgctgttctcgccgttaaggagatcaatgtcaacataaacgaatataaacgaaggaaggacctgggaaaaaactccattatagcagaaaaagagtatgcccacgctgaagagtctgcctttttaacgtactcacttgtgctgaaatataggaagggcgacgaggactccttgatggaaaaaataagtaaactaaatattcacagcattatcaagaaatcgaacagggtctcttcacaccttaagcacctgacagggtttgctccacagatcaaggacgaggtctttgaggagacagagaaaaactttaggatgcaagagcgactaattaagagtttcatcagggacctctcactgtatctgcagcatatcagggagagcgcgtgcgtgaaagtggtcgctgcagtttcaatgtgggacgtgtgtatggaacggggacaccgggatctggagcagttcgagcgagtgcataggtacattagtgatcagctattcaccaatttcaaggagcgcaccgaacgcctggttatttcccctttgaatcagttgctaagcatgtttaccggaccacacaaattggttcagaaacggtttgacaaattactggacttctacaattgtacagaaagggctgaaaaactaaaggacaaaaagaccctggaagagctccagtccgcccgaaacaactacgaggcactgaatgcccaactgctcgacgagctgcctaaatttcaccagtacgcacagggattattcacaaattgcgtccacgggtatgcagaagcgcactgtgactttgttcaccaagcgttagagcagctgaagcctctgctctctctactgaaggtcgctggccgagagggcaacttgattgccatttttcatgaagagcacagtcgcgtactgcagcagctgcaagtgtttactttttttcccgagagcctgccagcaaccaaaaagcccttcgaacgaaagaccatcgatagacaatccgccaggaaaccattattaggcctgccttcttacatgcttcaaagtgaagagctgagagcctccttgctagcacggtacccaccagaaaagctctttcaggccgagagaaacttcaacgccgctcaagacctcgacgtctcgctgttagaaggagaccttgtcggagtgataaaaaagaaggatcccatggggtcccagaacaggtggctcatcgataacggcgtcactaaagggttcgtctattccagctttctgaaaccctacaatccgcgacgctcacacagcgacgcctccgtgggttcacacagcagcactgagtcagagcacggatcaagttccccaaggtttcccaggcagaattctggatcgactctcacatttaatccttcaagcatggcggtgtcatttacgtctggctcctgccaaaaacagcctcaggatgccagtccacctccgaaagaatgtgatcaaggcacactctcagcttccctgaatccctctaattcggagagcagccccagccgctgtccctccgaccccgacagcacttctcagccgagatcgggagatagtgcagacgtcgccagggatgtcaaacagcccaccgctactcctagatcctataggaactttcgccacccagagatagtaggctatagcgtgcctggccgaaatgggcagagccaggaccttgtcaagggttgcgcaagaactgcacaggccccagaggatcgatcaactgaacctgacggctccgaggcagaagggaatcaggtttatttcgccgtgtatacctttaaggcccgaaaccctaacgaattaagcgtgtctgcaaatcaaaaactgaagattctggaatttaaagatgtaactggcaatacagagtggtggttagcagaagtgaacggtaaaaaaggctacgtacctagcaactacatcagaaaaacagaatatacctag

SEQ ID NO: 28317 - DNA, 1596 bp, Artificial Sequence
  Description of Artificial Sequence: Synthetic coding sequence
atgaaatgtcattacgaagctctcggggttaggagggacgcatctgaggaggaactcaaaaaagcataccggaaactcgcccttaagtggcacccagacaaaaatctcgataacgcagcagaggcagcggagcagtttaagctgatacaggcagcctatgacgtgctttccgacccgcaggaacgagcgtggtatgacaaccatcgtgaggccctgctcaagggaggtttcgatggcgagtaccaggatgatagcctagacttgctgaggtacttcacagtgacctgttacagcggatacggcgatgacgaaaagggattttacactgtgtaccgaaacgtgttcgaaatgattgccaaagaggagctggaaagcgtcctggaggaggaagtggacgatttccccacctttggcgactctcagagcgattatgacactgtagtacaccccttctatgcctactggcagtccttttgcacacagaaaaactttgcgtggaaggaggagtacgacaccagacaggccagcaacaggtgggaaaagagggccatggagaaagagaacaagaagatcagggacaaagctagaaaggaaaaaaacgagctggtccgtcagttggtggccttcattcggaaacgtgacaagagagtacaggcccaccgcaagctcgtcgaggagcagaacgccgagaaggctcgcaaggctgaggagatgagacggcagcagaaactaaagcaggccaagctggtggaacaatatagggagcaaagttggatgactatggctaatctggagaaagagctccaagaaatggaggccagatatgaaaaggaattcggtgatggatccgacgagaacgaaatggaggaacatgaactgaaagacgaagaagacggtaaagactccgacgaagctgaggatgcagagctttacgacgacctgtactgcccagcttgcgataagtcttttaagacggagaaggcaatgaaaaatcacgagaaatcgaagaagcatagagagatggtcgctctactcaagcagcagttggaggaggaggaggaaaatttcagcaggccccagatcgatgaaaacccactggatgacaattcggaagaagaaatggaggacgctccaaaacagaagctgtcgaagaaacagaagaagaagaagcaaaaaccagcacagaattatgatgacaactttaatgtgaacgggccaggggagggcgtaaaggtcgaccccgaggacacgaatttaaaccaagattcagccaaagagctggaggattctccccaggaaaatgtaagcgtgacggaaattattaagccatgcgatgacccgaagtccgaagctaagagcgtccctaaaccaaagggtaaaaaaactaaagacatgaagaagccagtgagggtccccgcagagccccagacaatgtccgtgctgatctcctgcacaacgtgtcactctgagttcccaagtcgtaacaagctgttcgaccacttgaaggctactgggcatgcccgtgcaccttctagtagctcgctgaactcagctacatctagccagtccaagaaagagaagaggaagaatagatag

SEQ ID NO: 28318 - DNA, 1353 bp, Artificial Sequence
  Description of Artificial Sequence: Synthetic coding sequence
atggtggtacaagctgcagtggccccaaatcggagccagcgattactgcttaaaattccctatgggtctcttcgcaggaggtctgtggaaaggatgactgaaggcagacggtgccaggtccacctgctggatgatcgaaaattagagctacttgtgcagccaaaactgctggcaaaggagctgctagacttggtggcatcccacttcaacctgaaagaaaaagagtactttggaatcgccttcacagacgaaactggacacctcaactggttgcagctcgacagaagggtgctagagcacgactttcctaaaaagagtggcccagtggtcctgtatttttgtgttcgattttacattgaatcgatcagctatctcaaagataacgccacgatagaattgttcttcctcaatgccaaatcttgcatctataaggagctaatcgatgtggacagcgaagttgtgtttgaactggctagctacatacttcaagaagccaagggcgatttctcgagtaacgaagtggtccggagcgatctgaagaaactccctgcccttcctacccaggccttaaaagagcacccatccctggcctattgcgaggaccgtgtgatcgagcactataagaaattgaatggccagactcgcggacaggctatcgtaaattacatgtctattgttgagagtctgccaacttatggtgtccactactatgctgtgaaggacaaacaaggcatcccttggtggctcggactgagctacaagggaattttccaatatgactaccacgataaggtgaagcctcgtaagattttccagtggcggcagcttgagaacctatactttcgggagaagaagtttagcgttgaggtgcacgaccctcggagagcctcagtgacccggaggacgtttggacactcaggaatagctgtccacacatggtatgcatgcccagcgctgatcaagtcgatttgggccatggccattagccaacaccagttctatctggacaggaaacagtccaagagcaaaatacacgctgcaagatctttatctgagattgccatagatttaaccgagaccggaaccctcaaaactagcaagctggctaacatgggatccaagggaaaaattatcagcggatcatccggctcgctcctgagttcagggagacagagaccggctgggggaacacccccagagcacggttgggatcctcgcggagacccagggagatggggggagctccaacttgggcgacttcaaggaaaattactacagagctggctgtgtttccccgatcagggttgggatccaaatgccaatttgcgaaagctactgccgggtatcaagtag

SEQ ID NO: 28319 - DNA, 1020 bp, Artificial Sequence
  Description of Artificial Sequence: Synthetic coding sequence
atggagggggaaccacctcccgtggaagagagaagacgcctgcaggaagagcttaatgagtttgtggagagcgggtgtcgtacgctcgaggaagtgacagcatctctaggttgggatctagatagcctggatcccggagaggaggaagctgcggaggacgaagtggtcatatgtccttacgattcaaatcaccacatgcccaaatcctcgcttgccaagcacatggcttcatgtcgtctgagaaaaatgggatacacaaaggaagaagaggatgagatgtacaaccccgagttcttctatgagaacgtaaaaattccctctattacactgaacaaggactctcagttccaaattatcaaacaggcaagaacagccgtgggcaaagatagtgattgctacaaccagagaatatactcgagccttcctgtggaagtacctctgaaccataaacggtttgtgtgtgatttgacacaggcagaccgcctggccctgtacgattttgtagtggaggagactaagaagaaaaggtcagactcacagatcatcgagaacgatagcgatctttttgtcgacctggccgcaaaaatcaaccaggacaacagccgaaagtctccaaaatcctatttagagatcctcgccgaggttcgcgactataaacgcagacggcagagctaccgcgcaaaaaatgtccacatcaccaaaaagtcttacaccgaggtgattagggatgtaatcaatgtgcatatggaggagctaagcaaccactggcaggaagagcaggaaaaagccgaagacgatgcggaaaagaacgaggaaaggcgttccgcatccgtggatagccgtcagagcggtggctcctacctggatgctgagtgcagccgacatcgccgtgacaggagtaggagccctcataagaggaagcgaaacaaggacaaggataagaattgcgaatccagacgacgaaaggagagagatggcgagcgtcatcactcccataagcgccgtaagcaaaagatctag

SEQ ID NO: 28320 - DNA, 6809 bp, Artificial Sequence
  Description of Artificial Sequence: Synthetic coding sequence
atggctgagccaagcagcgcacgacgaccggtgccattgattgaatctgagttgtactttttgatcgccaggtacctgagcgcaggcccatgtcgcagagcagcccaagttcttgtccaggagttggagcaataccaactcttgcctaagcggctcgactgggaggggaacgaacacaacagaagctacgaggaactcgtgctatccaacaaacacgtagcaccagaccacctactgcagatctgccagaggatcggaccaatgctggacaaggaaatccctccatcgatttcacgcgtgacctcactactgggggctggtagacagtccctactgcggacagcaaaggactgtcggcatacagtatggaaggggtcggctttcgccgcactgcatcggggaaggccgccagagatgcccgtgaattacggttctcctcccaacctggtggagatccataggggaaagcaattgactggctgttctacctttagcacagcttttcccggaactatgtaccagcatattaaaatgcaccgaaggatcctggggcacctgagcgctgtgtactgtgtcgcttttgacaggaccggacatcggatatttaccggttccgatgactgtctggttaagatctggtccactcacaatgggaggctgctgtccacccttagagggcactcagccgagatttctgatatggcagtcaattacgaaaacacaatgatcgccgcaggtagctgcgacaagattatccgggtgtggtgcctccgcacttgcgcacctgtggccgtgctacaaggtcacactggaagcattacgagtctccagttctcgcccatggccaagggaagccagagatatatggtatctactggagccgatgggactgtgtgcttctggcaatgggacctggagtcactgaaattttcaccccgtccattgaaattcacggagaaaccgagacccggagttcagatgctttgctcttccttttctgttggtgggatgttcctcgctaccggatcgacagatcacgttattagaatgtactttcttggattcgaggctcccgagaaaatcgcagagctcgagtcccacacagacaaagtggattcgatacagttctgtaacaatggcgacaggttcctgagcggctctagagatggaaccgcacggatttggcggtttgagcagttggaatggcgcagtattctgctggacatggccacaaggatctcgggcgatctgagctctgaagaggaaagattcatgaaaccgaaagtcaccatgattgcttggaaccagaacgattcaatcgtggtcacagctgtgaatgaccacgtccttaaagtgtggaacagctacaccggtcagcttctgcataatctaatgggacacgctgacgaagtattcgtgctggagacccatccttttgattcacggatcatgctctccgccggacacgacggctctatttttatttgggacattacaaagggcaccaagatgaaacactactttaacatgattgaaggccagggacacggagcagttttcgactgcaaattctctcaggatgggcagcatttcgcatgtacggacagccacggccaccttttgatttttggctttggctgtagcaaaccttacgagaagattcctgaccagatgttctttcataccgattacaggcccctgatccgcgactcaaacaattacgtgctcgatgaacaaacacaacaggcgccacacctgatgccgcctccttttcttgtcgacgtcgatgggaacccacaccccactaaatatcaaagactcgtgccagggagggaaaactccgcagatgaacacctcattccacagcttggctatgttgctacttctgacggcgaggtgattgagcaaataatctcccttcagacaaatgacaacgatgagaggagtccggaatcgagcatcctggatggtatgatcaggcagttgcagcagcagcaggaccagcgcatgggcgctgaccaggatactatccccagggggctatccaatggagaggaaaccccgaggcgaggctttagaaggctgtcactcgacatccagagtccacccaacatcggcttgcggaggtcagggcaggtggaaggtgttcgccagatgcatcagaatgcccctagatcccagatagctactgaacgggacctgcaggcgtggaagcgtcgcgtggtggtgcctgaggttccgcttgggatttttcgtaagctggaagattttagacttgagaaaggtgaagaggaacgcaatttgtatattatcgggagaaaacgcaaaacgctacagctgtctcacaagagcgattctgtggtcctggttagccagtcccgccaacgtacctgccgccgaaagtatcccaactatggtcgtaggaatcgcagctggagggagctgtcctctggtaacgaaagttcctcctctgttcgtcatgaaacctcttgtgaccagagcgagggcagcggatcgtcagaggaagatgagtggcgctctgacagaaaaagtgaaagctactcagagtcgtcctctgattcatcctcaagatacagtgattggacagccgacgcgggaattaacttgcaacccccactgcgcacgtcttgccgacgaagaattactagattctgttctagctccgaagacgaaatatcgaccgaaaatttatctccgcctaagcgacggaggaagcgaaagaaggagaacaagcctaagaaggagaatttgcgtcgcatgaccccagcagagctggctaacatggagcacctgtatgagttccaccccccagtgtggattaccgacacaacattgagaaagtcccctttcgtgccacaaatgggggatgaagtgatttatttccgtcaaggacacgaggcatatatcgaggccgtgcgacggaataatatctacgaattgaacccaaataaggagccatggcgtaagatggacctccgcgatcaggaactcgtcaaaatagtaggcattcggtacgaggtgggcccaccaacgttgtgctgcttaaagttggcctttatcgacccggctacagggaaactcatggataagagcttctctatcagataccatgatatgcccgatgtgattgacttcctcgtcctgcgccaattttacgacgaggccaggcagaggaattggcagtcttgcgatcgattcagaagcattattgatgacgcctggtggttcggcactgttctgtcgcaggaaccttatcaaccacagtatcctgactctcactttcaatgttatattgtgcggtgggacaatactgagatcgaaaaactgtccccgtgggacatggagccaattccagacaacgtggaccctccagaagagctgggtgcaagcatctcagttactactgacgagctggagaagttgttgtataaacctcaggctggcgaatgggggcagaaatcaagagacgaggagtgtgatcggattatttctggcatcgaccagttattgaatcttgacattgccgcagcatttgctgggcctgtagatctgtgtacttaccctaaatattgtaccgttgtggcgtatccgaccgacctgtacacaataaggatgcggttggtcaacaggttttacaggcgccttagcgccttagtgtgggaagtcagatacatcgagcacaatgccaggacattcaacgagcccgagagcgtgatcgcccgatcagccaagaagattactgaccagctcttaaaattcatcaagaaccagcattgtacaaatataagtgaattatctaatacctctgagaatgatgagcagaacgcggaggatctggacgactcagatctccctaagaccagcagtggtcgccgacgggtgcacgacggcaaaaagagcatcagagcgacaaactacgtggagtctaactggaagaagcagtgtaaggagctggttaatctaatcttccagtgcgaggactcggaacctttcaggcaacccgtggacctggtggaatatcccgattacagagacataatcgacaccccaatggacttcggcacagtgcgggagacgctggacgctggaaattatgactcacccctggagttttgcaaggacatacgacttatattctcaaacgcaaaggcttacacaccaaataagcgctcgaagatatactccatgaccctgcgcctgagtgcgctgttcgaggagaagatgaaaaagatatccagcgactttaagattggccagaagttcaacgaaaagcttagaagaagccagaggttcaagcagcgacagaactgcaaaggtgactcgcaaccgaacaagtcaattcgaaacctcaagccaaagaggctgaagagccagacaaagatcattcccgagttggtgggatctccaacacaatctacaagcagtaggaccgcctacctggggactcacaagacctcagccggaatcagctctggcgtgactagcggcgacagctcagatagtgctgagagtagcgagcgccgtaaacgtaatagacctatcaccaacggatctactctgagtgagagcgaggtggaggactccctggctactagtctgtcttcctcagcttcctcttctagtgaagagtcaaaagagagcagcagggcacgtgagtcttcctccaggtccggtctctcccgcagttccaacctgagagtgactcgcacaagagctgcccagcggaagacaggccctgtgagcttggccaacggctgcggccgtaaggctactcgcaagagggtgtaccttagtgattcagataacaactctctcgaaaccggtgagatactgaaagcgagagccggaaataaccgaaaggtgttgcggaaatgtgcggcagtggccgctaacaagattaagcttatgagcgacgtggaagagaacagcagcagcgaatccgtgtgcagcggccgtaagctgccccaccgcaatgcctccgccgtggccagaaaaaagttgctgcacaacagcgaagacgagcagtctttgaagagcgagatcgaagaagaggaactgaaagatgagaaccagcttttacccgtaagctcatcacatactgctcagtcaaacgttgatgagagcgaaaacagagacagcgaatcagaaagcgacctgagggttgccagaaaaaattggcacgcaaatggttataaatcccataccccggcaccaagcaaaacaaaattcctcaagatcgaatcttctgaggaagacagcaaaagccatgactcagaccatgcatgtaatagaaccgcaggcccaagcacaagtgtgcaaaagctcaaggccgaatccatttctgaggaggctgacagcgagcccggtcgtagtgggggacggaagtataacacctttcataaaaatgcctctttcttcaaaaaaacgaagattctgtccgattcggaggatagcgagtccgaagaacaggatcgagaagacggaaagtgccacaagatggagatgaaccctatttcggggaacctgaactgcgatccgatcgccatgagccagtgctcttctgaccacggttgcgaaacagacctggactccgatgatgataaaatagaaaagcccaacaacttcatgaaggatagtgcaagtcaggacaacggactttcccgaaaaatcagtcggaaacgggtgtgctcctcggactctgattcctcactgcaggtagtgaaaaagagcagcaaggcaaggaccggactcctccggataactcgcagatgcgctgctacggccgcaaacaagattaagttgatgtctgatgtagaggacgtgtcccttgagaacgttcacactagatctaaaaatggcaggaaaaagcccctgcacctggcctgcaccaccgcaaagaagaaattgtctgattgtgagggatccgttcattgcgaggtgcctagcgagcagtacgcctgcgagggtaaaccaccagaccccgactctgaaggcagcactaaggtcctctctcaggcgctgaacggggactcggactcagaggatatgcttaattccgagcacaaacatcgtcacactaatattcacaagatcgatgcacctagcaagcggaaaagctcctccgtgaccagcagcggcgaagactcaaaatctcacatccctgggtccgaaacagatcgcacgtttagctcagaaagcactcttgctcaaaaagcaaccgccgagaataattttgaggtggaactcaactacggcctgcgccgatggaacggtagacggctgcggacctatggaaaagcccctttcagcaagacaaaggtgatccacgattctcaggagacagccgagaaggaagtcaaacgtaaacgaagccacccagagttggagaacgtcaagatctctgagactactgggaactctaagtttcgaccagacacaagctcgaagtccagtgatttaggatcggtgaccgaatcggacatcgattgtaccgataatacaaagactaaaaggaggaagaccaagggcaaggcaaaagtagtccgcaaggggaagacctttaccgcaaacattagtaagactgtccgtcgccaaaggcagtcgaagaggcccaggttgagcgttgatgataacgactgggaggacctcgactatgctaaatctaagcgtgtgctgaggcgtagcaaaattaagaccaggaaccagggcagacgaactgttcggtatcacgatggtgacgacgaccgcagcttggaaaacgtcctggactttaacggctgtactcttta

SEQ ID NO: 28321 - DNA, 492 bp, Artificial Sequence
  Description of Artificial Sequence: Synthetic coding sequence
atgacagccccatcttgcgcattccctgtgcagtttcgccagccaagcgtgtctggcttatcacagataaccaaatcgctttacatttccaacggggttgccgctaacaacaagctgatgttgtcttccaaccaaatcacaatggtaatcaatgtgagcgtggaggtggtcaacactttatacgaggatattcagtatatgcaggtccccgtcgctgatagccccaacagcaggctgtgtgatttctttgatccgattgctgaccatatccatagcgtggaaatgaagcaaggccgaacgctgctgcactgcgctgcaggagtatctcgctcggccgctctttgcctggcttaccttatgaaatatcacgccatgagccttctagacgcacacacctggactaagagctgtcggcctattatacggccaaacagcgggttttgggagcagctgatccattatgagttccaattgttcggaaagaatacttag

SEQ ID NO: 28322 - DNA, 756 bp, Artificial Sequence
  Description of Artificial Sequence: Synthetic coding sequence
atgatctcaacaacttcaaaggaaacaaagaaagataccaaattgtactgtatctgcaagaccccctacgacgaatcaaaattctatattgggtgtgacctgtgtaccaattggtaccacggagagtgcgttggaattaccgaaaaggaggcaaagaaaatggatgtgtatatctgtaacgactgcaagagggcacaggagggatcctctgaagagctgtactgcatctgccgtaccccctacgatgagagtcaattttatatagggtgcgatcggtgtcaaaactggtatcatggacggtgtgtgggaatcctgcagtcagaggcagagttgatcgacgaatatgtgtgtccccagtgccagtcaactgaggacgctatgaccgtgctaaccccgttaacagagaaagattatgaaggcctcaagagggttctgcgctcgttacaggcccacaagatggcttggccatttcttgagcccgtcgaccccaacgatgcacccgactattacggtgtgatcaaagaacccatggatttagctaccatggaggagagggtccagcgaagatactatgagaaactgaccgaattcgtcgctgatatgactaagatctttgacaactgcaggtattacaaccccagcgactctcccttttaccagtgcgccgaggttctcgaatccttttttgtccagaagctgaagggttttaaggccagtcgatcccacaacaacaagttgcagagcactgctagttag

SEQ ID NO: 28323 - DNA, 501 bp, Artificial Sequence
  Description of Artificial Sequence: Synthetic coding sequence
atgtatagcctgaaccaggagatcaaagcctttagccggaataacttacggaaacagtgcacccgtgttactaccctcaccggaaaaaaaattattgagacctggaaggacgctaggatccacgttgtggaggaagttgagccctcctctggcggaggatgcggctacgttcaggacctgtcctctgacctgcaagtgggcgtgatcaagccatggttgctgcttggctctcaggatgctgctcacgatctcgacactttgaaaaagaataaggatggagtagtgctggtgcattgtaatgctggggtgagcagggctgccgcaatcgttattggcttcctgatgaactcagaacagacttcctttacctcagcttttagcttggtgaagaatgcaaggcctagcatttgtcccaactccgggttcatggagcaactgagaacttaccaggagggaaaagagagcaacaagtgtgaccgtattcaggaaaattcgtcatag

SEQ ID NO: 28324 - DNA, 963 bp, Artificial Sequence
  Description of Artificial Sequence: Synthetic coding sequence
atgagcaaaagtgccagcccaaaggagcctgaacaacttcgaaaactgttcattggcggattatcctttgaaacaaccgacgaatccttgagatctcatttcgagcagtggggaacgctaactgattgtgtggtgatgcgcgaccctaataccaagagaagcaggggcttcggtttcgtgacctacgccacagtggaggaagtagacgctgctatgaataccactccccataaagtggacggacgcgtggtcgaacccaaaagggcagtttcccgtgaggacagccagcggcctggcgctcacctgacagtgaagaaaatctttgtgggaggtattaaggaagacaccgaagaacaccatctccgtgattactttgagcagtatgggaagattgaagtgattgagattatgacagaccgaggatccggaaaaaaaagagggtttgcattcgtcactttcgacgaccacgattccgtggataagatagtgatccagaaataccatacagttaaaggccacaactgcgaggttcgcaaggcccttccaaagcaggagatggcttccgcgagtagcagccagcgcggaaggaggggaagtggtaattttggagggggacggggagacgggtttgggggaaacgacaacttcgggagagggggaaacttctctggtagaggcggtttcggcggttcctgcggaggcggtggatacggcggatccggggacggatacaacggctttggaaatgatggttctaattttggcggagggggaagttacaatgacttcggaaactacaacaatcagtctagcaatttcggacccatgaaggggggtaactttgggggacggtcctccgggccatatgggggtggcggacagtatttcgccaagcctcagaatcaggggggttatggcgtgtcttctagctcttctagctatggctctgggagacgcttttag

SEQ ID NO: 28325 - DNA, 357 bp, Artificial Sequence
  Description of Artificial Sequence: Synthetic coding sequence
atgagtctgctaaataagccaaagagcgaaatgacacctgaggagctccaaaaaagagaggaggaggagttcaacactggtcccctgagtgtgctgacacagagcgttaagaataacacccaggttctcattaactgccggaataacaagaaactcctcgggagagtgaaggcctttgaccgtcactgtaatatggtcctcgagaatgtcaaagagatgtggaccgaagtgcccaagagcggaaaggggaaaaaaaagagcaaaccggtcaacaaggaccgttacatctccaaaatgttcttgcggggagatagcgtaatcgtggtcctgcgaaacccattgattgcgggaaagtag

SEQ ID NO: 28326 - DNA, 1179 bp, Artificial Sequence
  Description of Artificial Sequence: Synthetic coding sequence
atgaaagatacactcgggcaggcccagcaaagggtcgccgagttggagcctctcaaagagcaactccgtggcgcacaggagctggccgcttctagtcaacagaaggctaccctgctgggggaggaattggcgtcagcagcagcggcacgtgatcgcactatcgcagagttgcatcgttctagactcgaggtcgctgaagtcaacgggcgtctggccgagctgggattacatctgaaagaagagaagtgccagtggagcaaggagcgggctgggcttctgcagtcagtggaggcggagaaggacaaaatattgaagctgagtgccgaaattctgcgtctcgagaaggccgtgcaagaggaacggacccaaaaccaggtgtttaaaaccgagctggctagagaaaaggacagttccctggtgcagctctccgaatcaaagcgcgagctgaccgaactaaggtcagcattgagggtcctccagaaggagaaggagcagctgcaagaagaaaagcaagagctgctcgagtatatgaggaaacttgaggctagattggagaaagtggccgacgagaagtggaacgaggatgccacgactgaggatgaagaggcggcagtgggtttatcttgccctgctgcactgacagactcagaagatgagagtccagaggacatgagactgccaccttacggcctctgtgaaaggggcgatcctggatcatcccccgctgggcctcgcgaggcaagccctcttgtggttatctcccagccggcaccaatcagccctcacttgagtggaccagcggaagacagctccagtgatagcgaagcggaagatgagaaatccgtgctgatggccgcagtgcaaagcggaggcgaggaggcaaatctgctgttgccagaattgggaagcgccttctacgacatggcttcgaccatcttttgccgggctcagattgcccttttgcctctgtcgcctgctagcaccccatctccgactaccagcggcttcaccgtgggcaccctgagcgagacgtcaaccggcggtcccgctactcctacttggaaagagtgccccatttgcaaggaacggtttcctgcagagtctgataaggatgccctggaagaccatatggatggccatttcttcttttctactcaggatccatttacctttgagtag

SEQ ID NO: 28327 - DNA, 600 bp, Artificial Sequence
  Description of Artificial Sequence: Synthetic coding sequence
atgaccccactggctccgtgggacccgaaatatgaggcgaaggcagggcctaggccggtttggggcgcaaattgctcttctggggcaagtttttcaggcagaaccctgtgccaccccagcttttggccactttatgaagctgcttccggccgagggctgagacctgtggctccagcaacaggccactggaatggccagcaggcccctcctgatgctggattccccgttgtgtgttgcgaagatgtgtttctgtcagacccccttcttcctcgcggacagcgggtccccctttacctcagtaaagcccctcagcaaatgatgggctccctcaagttgctccccccaccacccatcatgagtgcccgagttctcccaagacccagcccctcccggggaccttcaacagcatggttatcaggaccagagctgattgcattgactgggctcttgcagatgtcccagggcgagcccagacctagcagctcggcagtgggccctccggatcacacttcagacccaccatccccctgcggctcaccctccagcagccagggcgcagatctgtcactgccccagacacctgacactcattgcccttag

SEQ ID NO: 28328 - DNA, 1155 bp, Artificial Sequence
  Description of Artificial Sequence: Synthetic coding sequence
atggagggcctgggcagaagctgcttgtggctacggcgtgaactatcaccacctaggccaaggttgctgcttttagactgccggtcacgggagctctacgagtcagcccgaattggcggtgccctgtctgttgcgctgcccgcacttttactgcggaggctgagacgaggctctctgtcggtgcgggcactgctgcccggacctcctctgcagccaccccctccagcgccagtgcttttatatgaccaagggggaggccgtcgcaggaggggagaagccgaggccgaggctgaagagtgggaagctgaatctgtgttgggcaccttattgcaaaagcttcgggaggaaggttaccttgcttattacctgcagggaggattcagccgctttcaggctgaatgcccgcacctatgtgaaacttcactcgcaggccgtgcgggatctagcatggcacccgtaccgggacctgtaccagtcgttggccttgggagcctgtgcctgggaagcgattgctcagacgctgagtccgaagcagacagggacagtatgtcctgtggattggatagcgagggagcgaccccgcctcccgtaggtctccgcgctagcttcccggttcagatcctccctaatttatacctggggtctgcgagagatagtgctaacctggagagcctggctaaattaggtataagatatatcctcaacgtgacccccaaccttcctaacttctttgagaagaatggggacttccattacaagcagattccaatctccgaccattggtcacaaaatctaagccgcttctttcccgaggctattgagtttattgacgaggcactttctcagaactgtggagttctggtgcattgcctcgccggtgtgagtcgctctgtgaccgttacggtagcctatctgatgcagaagctgcacttgtctttgaatgacgcgtacgatctcgtgaagagaaagaagtctaacatctcacctaacttcaacttcatggggcagctgctggacttcgagaggagtctgcgtcttgaagagagacactctcaggaacagggctctggcggacaggcctcagccgcatccaacccaccttccttcttcacgacacccacctccgacggtgcattcgagctcgccccaacttag

SEQ ID NO: 28329 - DNA, 2208 bp, Artificial Sequence
  Description of Artificial Sequence: Synthetic coding sequence
atggctgagcccttgctgaggaaaacattctcccgactcagaggtcgagagaagctacctagaaaaaaatctgacgccaaggagagaggccatccggcacagcgcccagagccttcgcctcccgagccggagcctcaggcacctgagggttctcaagccggtgcggagggcccttcttctccagaggctagtcgaagtcccgcaagaggcgcatatctccagtcccttgaaccctcaagccgacgctgggtgttgggcggagccaagcctgctgaagacacgagcctcggtccgggagtgcccggtaccggtgaacccgctggagagatctggtacaaccctatcccagaggaggacccaagaccgcctgcccctgagccgcctggaccacaacctggttcagccgagtcagagggcctggctccccagggcgctgctcccgcaagtcccccaactaaagccagccgcactaagtcaccaggccctgccagacgactgtctatcaagatgaagaaactccccgaattgcggagaagactgagcctccggggaccgagagccggtcgcgagcgggaaagagccgcaccagccggtagtgtaatttcacggtaccacctggattcctctgtgggtggccctgggcctgctgcaggtccaggaggcacacgttctccacgtgcgggatacttaagcgatggcgatagcccagagagacctgcaggaccaccttctccaacttcttttcgtccttacgaagtcggtccagctgctcgagcaccgccagccgctctatgggggcgtctgtcattacacctgtatggcctggggggattaaggcccgcacctggcgctacgccccgagatctatgttgtctactccaggtcgatggcgaggcccgagcgcgtaccggcccattgagaggagggcctgacttcctccgcctggatcacacgttccatcttgaacttgaagcagcacgattacttagagcactcgtccttgcatgggacccaggagtcaggcggcatcgtccatgtgctcagggcactgtgctactccccaccgtcttcagaggctgtcaggcacagcagttagcggtgcgcttggaaccccaggggctgctctacgcaaaacttactttatctgaacagcaggaggccccagctaccgccgaacctcgcgttttcggcctgcctctcccccttttagttgagagagagaggccacccggacaggttcctctgatcatacagaagtgtgtggggcagattgaacgccgagggttgcgagtcgtagggctgtacagattgtgcggatctgcggctgttaagaaagagctgcgggatgcttttgagagggacagcgctgccgtgtgtctttctgaggatctttaccccgatattaacgtgattaccgggatcttgaaagattatctgagggagttaccaacacccttgatcacacagcctttatataaagtggtcctggaggccatggccagggatccaccaaatcgggttcccccaacaactgaaggaacaaggggcctgctgtcatgtttgcctgacgtcgagcgtgccacactcacgctgctgctggatcatttgagactggtgtctagcttccatgcgtacaacagaatgaccccccaaaacctggcagtctgcttcgggccagtcctccttcccgctcggcaggcccctaccagaccaagagccaggtccagtgggccaggcctggcttcggccgtggatttcaaacatcacatcgaagttctgcactatctgcttcaaagctggcctgatccacgccttccacggcagagcccagacgtggcaccctatctgagacccaaacgacaaccaccccttcacttacctctcgccgatccggaggtcgttacaaggccaagaggcagagggggtccagaatctcctccttcgaatagatacgccggagattggtccgtttgcggccgtgattttcttccctgtggacgagatttcctgagcggccctgactatgatcacgtgacaggaagtgatagcgaggacgaggacgaagaagtgggcgagccaagagtcacaggggattttgaggatgacttcgacgccccattcaatccacacctgaatcttaaagactttgacgcactaatcctggatctcgagcgcgagctgagtaagcagattaacgtttgtctctag

SEQ ID NO: 28330 - DNA, 660 bp, Artificial Sequence
  Description of Artificial Sequence: Synthetic coding sequence
atgccaaggggcagaaagagccgtcgacgccgaaacgccagagccgctgaggagaaccgtaacaacagaaagatccaggcctccgaggcgtcggagacgccaatggccgctagcgttgtggcttcaactccagaagatgacctttcaggcccagaagaagacccgtcaacgcctgaagaggcaagtacgactcccgaagaggccagttcgacggctcaggctcagaagccatctgtcccccgttctaattttcaagggacaaaaaagtctctgttgatgagcattctggccctgatttttataatgggcaactccgccaaagaggctctcgtttggaaagtcctcggcaaactgggcatgcagcccggacggcagcactctatatttggggatcccaagaaaattgtcactgaagagtttgttcgcagagggtacctcatttacaaacctgtcccaaggtctagtcctgtagaatatgaatttttctgggggcctcgggcacacgtggagagcagcaaactaaaggtgatgcactttgtcgctagagtcagaaatcgttgctccaaagattggccatgcaactacgactgggacagtgatgacgacgcggaagtggaggcaatcctcaattcaggggctagaggctattcagctccctag

SEQ ID NO: 28331 - DNA, 702 bp, Artificial Sequence
  Description of Artificial Sequence: Synthetic coding sequence
atgaacttgaacttcacctccccccttcaccctgcctcctcacagcgtccaacctctttcttcattgaagatatactgctgcataaacccaaaccacttcgtgaagtcgccccagaccatttcgcttcaagtctggcttccagagtccctctgctggactatggctatcctcttatgcccactcccacattactggcacctcacgcacaccaccctctgcacaagggagaccaccaccacccttactttctgactactagtggaatgcccgtgccggctctcttcccccatccccagcacgccgaacttcctggcaaacattgtcggagaaggaaggcaaggactgtgttctccgacagccagttaagtgggctggaaaagagattcgagatacagcgctacctttctactccggagcgggtggagctggctaccgcactgtccttgagcgaaacccaggtgaagacgtggtttcagaaccgcaggatgaagcataaaaagcagctgcgcaaatcgcaagatgaaccgaaggcccctgacggccctgagtcaccggagggatctccacgtggttcggaggcggctacagccgcagaggccagactgtcgctcccggcaggccctttcgtattaaccgagcccgaggatgaagtggacatcggtgatgaaggcgagctggggtcagggcctcacgtgctgtag

SEQ ID NO: 28332 - DNA, 873 bp, Artificial Sequence
  Description of Artificial Sequence: Synthetic coding sequence
atggaacttccagctgttggcgagcatgtgtttgcggtggaaagtatcgaaaagaagaggatccgcaaaggcagggtggaatatttggtgaaatggagaggatggtcaccaaagtacaatacctgggagcccgaggagaatatccttgatccaaggctgttaatcgcctttcagaaccgagagaggcaggaacagttaatgggctaccgtaagaggggccctaaaccaaaacctctcgtggtgcaggtgccaacattcgcccgaagaagcaacgttctgaccggcctgcaggatagttcaaccgataaccgagctaagctcgacctgggcgcacaagggaagggccaaggacatcagtacgagctcaacagtaagaaacaccatcatcacgcagtcggactgaacctgagccacgtgagaaagagatgcctgagtgaaacccatggcgagcgggagccttgtaagaaaagactgaccgcacgctccatctcaaccccaacgtgcctgggcggaagtcctgccgcagagcggcctgcggaccttccaccggctgccgcactcccacagccagaagtgatcctgttagattctgacctcgatgaaccgatcgatcttcgctgcgtgaaaacacggtctgaggctggcgaaccaccctcgtccctccaggttaagccagagactccggctagcgctgcagttgcagttgccgctgctgctgctcccactaccaccgccgagaaacccccagcagaagcccaggatgagccagctgagtcgctgtctgaattcaagcctttctttggaaatataataattacggatgtgacggccaactgcttaaccgtgaccttcaaagaatatgtcaccgtctag

SEQ ID NO: 28333 - DNA, 744 bp, Artificial Sequence
  Description of Artificial Sequence: Synthetic coding sequence
atgactgaggacagccagcggaatttccggtccgtctactacgagaaggtgggttttcggggagtggaggagaaaaaatccctcgagattttactgaaagatgaccgattggacactgagaaactgtgtaccttttctcagcgcttcccccttccttcaatgtaccgggcactggtgtggaaggttctgctcgggattcttccccctcatcatgagtctcacgctaaggtgatgatgtatcggaaggaacagtacttggacgtgcttcatgcactcaaggtggtccggttcgtctccgatgcaacaccacaggccgaagtgtacctcagaatgtatcagttggagtctggtaagctgccaaggtctccaagtttccctcttcccaaggctttcgaacaatacctaaaccttgaagacggaagactgcttactcatttacggatgtgtagcgcagcgcctaagttaccttatgacctgtggttcaagcgttgctttgctggatgcttaccagaatctagtcttcaaagagtctgggacaaggtggtgagtgggtcatgcaagatcctagtctttgtggctgtggagatcctgcttacttttaagatcaaagtgatggccctgaacagtgctgagaagattacgaaatttctggaaaacatcccccaggattcatcggacgcaattgtatccaaagctatcgacctgtggcataagcactgcggcactcctgtccattctagttag

SEQ ID NO: 28334 - DNA, 546 bp, Artificial Sequence
  Description of Artificial Sequence: Synthetic coding sequence
atggtcagctcctgttgtggctccgtatcttcggagcagagctgtggacttgaaaactgttgcaggcctagttgttgtcagacaacttgctgcaggacgacgtgttgtcgtccttcttgttgcaagccccagtgttgtcagtccgtatgttaccaacccacctgttgccatcctagctgttgtatttctagctgctgccgcccttattgctgcgaaagctcctgttgccgtccctgctgctgccagaccacatgctgtcggaccacttgttgcagaaccacatgctgttgcccgagttgttgtgtctctagttgttgtcgtcctcagtgctgccagtccgtttgttgtcagcccacctgctgccgaccctcttgctgtatctcctcttgctgccaccccagctgttgcgagagcagctgctgtagaccctgctgctgtgtgcggcctgtttgtggcagggttagctgtcacactacctgctaccggccaacatgcgtgatatcaacttgcccacgacctttatgttgtgcttctagctgctgctag

SEQ ID NO: 28335 - DNA, 1086 bp, Artificial Sequence
  Description of Artificial Sequence: Synthetic coding sequence
atggccctgaatgtggccccagtgcgcgacaccaagtggttgactctcgaggtttgccgccaattccaaagaggaacatgctctaggagcgatgaggagtgtaagttcgcgcaccctcccaagtcgtgtcaggtggaaaacgggcgagttatcgcctgcttcgattctctgaaggggagatgcagccgagaaaactgtaagtacctgcatcctccaacacaccttaagactcaactagagatcaacggaagaaacaacctaatccaacaaaaaacagccgcagctatgttggcccagcagatgcagttcatgttcccgggtacaccgctgcatcctgtacccacttttccggttgggccagcaatcggcaccaatactgctatcagctttgccccataccttgcacccgtcactcccggtgttggtcttgtccccacggagattcttcctaccacgcctgtcattgtgcctggctcccctcctgttacagttccaggcagtacggctactcagaaactcctcagaaccgataaactggaagtgtgcagggagttccagcgaggaaactgtgcacggggtgagactgactgtcgattcgcccatcctgccgactcaactatgattgacaccagcgataatacagtgacggtctgcatggactacatcaaaggtagatgtatgagagagaaatgcaagtacttccacccccctgcacacttgcaggctaagattaaggcggctcagcaccaggctaaccaggctgccgtcgccgcacaagcagccgctgcagctgctacggtaatggctttcccacccggtgccctccaccccctgcccaaacggcaggcgttggagaaaagtaatggaacaagcgccgtgtttaaccctagcgtgctccactaccagcaggctcttaccagcgcccaactgcagcagcacgccgcatttatcccgaccgacaacagcgagataatctcgaggaatgggatggaatgtcaggagagtgcgcttcggatcaccaaacattgttattgtacatactacccagtaagttcctctatagagcttccccaaacggcatgctag

SEQ ID NO: 28336 - DNA, 1017 bp, Artificial Sequence
  Description of Artificial Sequence: Synthetic coding sequence
atgctcaaaaacaaaggacattcttcaaaaaaagacaacctcgcggttaatgccgttgcattgcaggaccatatcttgcacgatctgcagctgaggaatctgagcgtcgcagaccactctaaaacccaggtccagaaaaaagagaacaagtcgttaaagcgtgataccaaggccatcattgacaccggattgaagaagactacccaatgtcccaagctggaagatagtgaaaaagagtacgtgctggaccctaagccacctcccctgactctcgctcaaaaactggggctcattggcccaccccctccgcctctgtcttccgacgaatgggaaaaggtgaagcagagatccttgctacaaggcgatagtgtgcagccttgcccgatttgcaaagaagagtttgagcttaggccgcaggtgttttctattaggggcaagaaccagtatcagacgagagttatccatgatggtgctcggctattccgaattaaatgcgtgaccagaattcaggcttactggcgaggctgcgtcgtgcggaaatggtatcgaaacctgaggaaaacggtacctcccactgatgcgaaactgcgaaagaagttcttcgaaaagaaatttacagaaatatcccatcgaatcctctgctcgtataacacaaacattgaggaactctttgccgaaatagaccagtgtttggcaataaataggagcgtgttacagcaactggaggagaagtgcgggcacgagatcactgaggaagagtgggagaaaatacaggttcaggcgctgcgaagggagactcatgaatgcagtatatgcctagcccctctttcggccgctggcggacagagggttggggctggtcgacggtccagggagatggctctgctgtcatgctcacatgtgttccatcacgcttgtttgctcgctctggaggagttcagcgtaggcgatcgacctccattccatgcctgcccgctgtgtaggagctgctaccagaaaaagattttagaatgttag

SEQ ID NO: 28337 - DNA, 1098 bp, Artificial Sequence
  Description of Artificial Sequence: Synthetic coding sequence
atggccgctgcggcagctggtactgcaacaagtcagagattctttcagagcttctctgacgctctcatcgacgaagatccccaggccgctctggaggagctgacaaaagcactggaacagaaaccagatgacgctcagtattactgccagagggcctactgccatatcctgcttggcaactactgcgtggcagtagccgacgcaaagaaaagtctggagctaaatcccaataatagcactgccatgctgcggaaagggatttgtgagtatcacgaaaagaactatgctgcggcactggagacattcacagagggtcagaaacttgacatcgaaaccggctttcatcgtgtggggcaggcgggtctgcagcttcttacatcttcagaccctcccgcacttgactctcagagtgcaggcattacaggcgctgatgccaacttctccgtgtggattaaacggtgtcaggaagcccaaaatggctcagaatccgaagtttggacccatcagagcaaaatcaagtatgattggtatcaaaccgagagtcaggtggtgatcacactgatgataaaaaacgtccagaagaatgacgtgaacgtggaattttccgagaaagagctctcagccctcgtgaaactgccatctggggaagactataatctgaagctagagctgttgcacccaatcataccggagcagtctacctttaaagtgctctctactaaaatcgagattaagttgaagaaaccagaggccgtccggtgggagaaactggaaggtcagggcgacgtgcccacccccaagcaattcgtggccgatgtaaaaaacctttatccgtcttcctcaccttacacacgaaattgggataaactcgtcggtgaaattaaggaagaagagaagaatgaaaaactcgagggtgatgcagccctgaaccgcctgtttcagcagatctattctgacggctcggatgaggtgaagagggcgatgaacaaaagcttcatggagagcgggggaactgtactttccactaattggtcagacgtgggcaagcgcaaggtcgaaattaaccctccagacgacatggaatggaaaaagtactag

SEQ ID NO: 28338 - DNA, 1389 bp, Artificial Sequence
  Description of Artificial Sequence: Synthetic coding sequence
atggacaaggactcacagggtctgctggattctagcctgatggcaagcgggactgcatcacgaagcgaggatgaagagagcttggctggacagaaaagagccagctcccaggcccttggcaccattccgaagagaaggtcaagctcccgttttattaaacggaagaagttcgacgacgaacttgtagagagctcccttgcaaagagctccaccagggcaaagggcgcaagtggtgtggagccgggacggtgcagcggatcagagccatcatcttcggagaaaaaaaaggttagtaaggctcctagtactcctgtgcccccatctccggcaccggcacccggattaacgaagagagtgaagaagagcaagcagccactgcaggttacaaaggatttgggaaggtggaagcctgccgatgacctcctgctgatcaacgcggttctgcagaccaacgacctgacctctgtacatctgggagtgaagtttagttgcaggtttactctgagggaggtgcaggaaagatggtacgctctgctgtacgatcccgtgatatcaaaactcgcctgtcaggccatgaggcagctccaccctgaggctatcgcggctatccaaagcaaggccctctttagcaaggccgaagaacaactcctatccaaagtgggctcgacaagccagcccacactggaaaccttccaagacctgcttcaccggcaccctgatgccttttacctagctcggaccgccaaggccctacaggcgcattggcagttgatgaaacagtactatctgctggaagaccaaaccgtgcagcccctgcccaagggcgatcaggttcttaattttagtgatgcggaagatctcatcgacgattcgaaactaaaggacatgagggacgaagtcctggagcacgagttgatggtcgccgatagacgacagaagcgtgaaatcaggcagttagagcaagaattacacaagtggcaggtactggtagattccattacgggcatgtcatcaccagacttcgataatcagactcttgccgtactcagggggcgaatggtacgttatttgatgcgcagcagagagatcacccttggtcgggctacaaaggataaccagatagatgtcgacctgagcctagagggacctgcctggaagatctcccggaagcagggcgtaatcaagttgaaaaacaatggagacttctttattgcaaatgagggtagaaggccaatctacatagatgggagacccgtgctgtgtgggtcaaagtggcgcctgagcaacaattcagttgtggaaatcgcatccctgaggttcgtgtttctcataaaccaagacctgattgcccttatacgagcggaggctgcgaagataactccccagtag

SEQ ID NO: 28339 - DNA, 963 bp, Artificial Sequence
  Description of Artificial Sequence: Synthetic coding sequence
atgtccgtcggcttcattggggcaggccaactggcgtacgcactggctagggggttcactgccgctggcattcttagcgcccacaaaatcatcgcgtcctctcccgaaatgaatctgccaaccgtttccgctctgcgcaaaatgggggttaacctcacacggtctaacaaggaaacagtgaagcactccgacgtgctctttctcgccgtcaaacctcacattattccattcatcctcgacgagataggtgcagatgtacaggcacgccacatcgtcgtttcttgtgcagcaggggtcacgatatcgtccgtggagaagaaactcatggccttccaaccagctcccaaagtgatcagatgcatgacgaacacccctgtagttgtccaagaaggggcaactgtctacgcgacaggcacgcacgccttggtcgaggatggccaactcctggaacagctgatgtcaagcgtgggcttctgtaccgaagtggaagaggacctcatagacgccgttaccggccttagtggttcaggtccagcatatgccttcatggctcttgacgccctggccgacggtggcgtgaagatgggtctgccgcgacggcttgctatccagctgggtgcccaggctctgctgggggctgcgaagatgctgcttgacagcgaacaacacccctgtcaacttaaagataacgtttgtagtcctgggggtgcgacaatccacgcactgcatttcctggaatccggagggttcaggagcctgctgataaatgcggtggaggcctcatgtatacgtacacgcgaacttcagtcgatggccgaccaggaaaaaatttcaccagccgctctgaaaaaaactcttctggacagggtgaaattggagtctccaaccgtcagcacgcttaccccctcatcaccgggaaaactattgactcggagtctggctctaggtggcaaaaaagactag

SEQ ID NO: 28340 - DNA, 2370 bp, Artificial Sequence
  Description of Artificial Sequence: Synthetic coding sequence
atggaagacggcccttcaaataatgcctcatgtttccggagacttaccgagtgtttcctgagcccctccctgaccgacgaaaaggtgaaggcctatctttctctgcaccctcaggtgctggatgagttcgtcagtgagtctgtctctgcagagaccgtagagaaatggctgaaacggaaaaataataagagcgaagatgagagcgccccaaaggaggtatctcgatatcaagacacaaatatgcagggggtggtgtacgaactcaacagctacatcgagcaaagactggacacagggggtgataaccagttgttactctatgaactttcaagcattattaagattgcgactaaagctgacggatttgctctttattttttgggcgagtgcaacaactctctctgcatcttcactcccccagggattaaggaaggcaaaccccgactaataccggcagggccaatcacacagggcaccaccgtgagcgcctatgtcgccaaatcacgtaaaaccctgctcgtggaagatatcttgggtgatgagagatttcctcgcggtactggactggagtcaggaacacgaattcagagcgtgctgtgtttgccaatcgttacggcgatcggtgacttgatcggcatcctcgagctgtatagacactgggggaaagaagcattttgcctgtcacatcaggaggtagctaccgcgaacctcgcatgggccagtgtagctatacatcaggtccaggtgtgtcgtggcctggccaaacaaaccgaactcaacgactttctgctggacgtaagtaaaacctactttgacaacatcgtggcaatagatagcctgttggagcatatcatgatctacgctaagaatcttgttaatgctgatcgctgcgctctttttcaggttgaccataagaacaaggagctctacagtgacctctttgacatcggggaggaaaaggaggggaaacccgtgtttaagaaaacaaaagagatccgcttttctatagagaaaggcatcgccggacaagtggcccgtacgggtgaagttctcaacatccctgacgcttatgcagacccaaggttcaaccgggaagtggacttgtatactggctacactacaaggaacatactgtgtatgccaatagtgagccggggatccgtcataggagtggtgcagatggtgaataaaattagcggatccgcattttctaaaaccgatgaaaacaactttaaaatgttcgctgtattttgcgccctggccctacactgcgctaacatgtatcatcgcatccgtcactccgaatgcatttaccgagtgactatggagaagctgagctaccatagtatttgcacctccgaagagtggcagggattaatgcaatttacattacccgtgagactttgtaaggagattgagctgttccacttcgacattggcccatttgaaaacatgtggcctggtatctttgtgtatatggtgcataggtcctgcggaacctcttgtttcgagctggaaaagctgtgtcggtttatcatgtcagttaaaaaaaattatagacgcgtgccctaccataactggaagcatgccgtgactgtcgcccactgtatgtacgctattctgcagaacaaccatacactcttcacagaccttgagcggaagggacttttgatcgcctgtctgtgtcacgatctggatcaccggggattctccaactcatacctgcagaagttcgaccacccattggcagcgctttatagcacatccactatggagcagcatcacttttcccagaccgtatcgatcctgcagctggagggacacaacatctttagtacattatcaagttcagagtatgagcaagtgctcgagataatcaggaaggccattatcgctactgatcttgccctgtacttcggcaaccgaaaacagttggaagagatgtatcagaccgggtcactgaaccttaacaaccagtcacaccgggacagggttattggactcatgatgaccgcttgtgatctgtgttcagtgaccaagctttggccagtgacaaagctcaccgccaacgacatctatgctgaattctgggcagaaggcgatgagatgaagaagctagggatccagcctattcccatgatggatcgcgataaaaaagacgaggtaccccaaggccaactcggattctataacgccgttgccataccctgttatacaactctcacccagatcctgccaccaactgagccactgcttaaagcttgtcgcgataacctgtcacagtgggaaaaagttataagaggcgaggaaacggcaacatggataagttcaccaagcgtcgctcagaaagcggctgcctccgaggactag

SEQ ID NO: 28341 - DNA, 645 bp, Artificial Sequence
  Description of Artificial Sequence: Synthetic coding sequence
atggatgattctgagacaggatttaacctgaaagtggttttagtttcctttaaacagtgtctggatgagaaggaagaagtgttactggacccttacattgctagctggaaaggtctcgtccggttcctgaactccttaggcaccatattttccttcatcagtaaggacgttgttagtaaactccgcattatggagcgcctacgaggaggcccacagtcagagcattacaggtccctccaagctatggtggcccatgagcttagtaacaggctagtcgacctcgagcggcgatcacaccacccggaatcaggttgtagaaccgtgctccgtctgcaccgcgcacttcactggctccagctctttctcgagggattgaggacaagtcccgaagacgcccgtacgagcgccttgtgcgcagattcctacaacgcctccttggctgcttaccacccctgggtggtgagaagggctgtgaccgtcgcattctgcaccctcccaacccgggaggtgtttctggaggcaatgaacgtcgggcctcccgagcaagctgtgcagatgctcggcgaggccctgcccttcatacagcgtgtctataacgtctctcagaaattatacgcagagcattctcttctagatttgccctag

SEQ ID NO: 28342 - DNA, 4293 bp, Artificial Sequence
  Description of Artificial Sequence: Synthetic coding sequence
atgacctccgccgctgaaatcaaaaagccccctgtcgcccctaaacccaagtttgtggttgctaacaataaacctgctcccccacctatcgcccctaaacccgacatagtgatcagtagtgtcccgcagagcacaaaaaaaatgaaacctgccatcgccccaaagcccaaagtccttaagacgagtcccgtccgtgagattgggcagtctccctccagaaaaattatgttgaacctggaaggtcacaagcaagaactggctgagagcacggataattttaattgcaaatacgaaggaaatcagtctaacgattatatttccccaatgtgttcctgtagctcagaatgcattcataagctaggacatcgggaaaatctttgcgtgaagcagctcgttcttgagcctcttgaaatgaacgagaatttggagaactctaagatcgacgaaacactcactattaagaccaggagtaagtgtgacctctacggcgagaaagctaagaaccagggcggagtcgtcctgaaagcctccgtcctggaggaggaattaaaggatgctctgattcatcagatgcctcccttcatctccgcccaaaagcatcgtcccactgactctccggaaatgaatgggggatgtaactcaaacgggcagtttcggatcgaatttgccgatttgagtccttctccaagctcattcgaaaaggtgccagatcaccatagttgccatctgcagctgccctcagatgaatgcgagcatttcgaaacctgtcaagacgattccgagaaatccaacaactgctttcagtcatccgaattagaggcgctagagaatgggaaacgttctacactgatctcctcggatggggtctctaagaaatccgaggtcaaggatctgggtcctctggaaatacatctggtcccttatacccccaaatttccgactccaaagcccagaaagacacgaaccgctcgcctgttgagacagaagtgcgttgataccccatcagaatccacagaggaaccagggaattctgactctagctccagttgtttgactgagaattctctgaagatcaacaagattagcgtgctgcaccagaacgtactgtgcaaacaagagcaggttgataagatgaaacttggcaacaagtcagagcttaatatggagtccaactcggacgcacaagacctggtgaatagtcagaaggccatgtgtaacgagacaacatcctttgaaaagatggctccatcttttgacaaggattctaacttatcctctgattctactacagtggacggcagcagcatgagcctggctgtggatgagggcaccggctttatccgatgcaccgtaagtatgtccttgccaaagcagctgaaactgacttgcaacgagcatctccaatccggccgtaacctaggcgtttccgctccacagatgcagaaggagtctgtcatcaaggaggagaacagtctgagaatcgtgcctaagaagcctcagcgacattcgttgccagctaccggtgtgttaaagaaagcagcctccgaggaattactggaaaagtcttcatacccgtcgagtgaggagaagagcagcgaaaaatctttggagcggaaccatctacagcacctgtgtgctcaaaacagaggagtcagctcctctttcgatatgccgaagagggcctccgagaagccagtctggaagctgccgcaccccatcctcccctttagcggcaaccccgaatttctaaaatccgtcacagtgtcttctaattcggaaccgtctacagctctgacgaagcctagggctaaaagcctgtccgccatggacgtcgaaaagtgtacaaagccatgcaaagacagtactaagaaaaattctttcaaaaagttactgtcaatgaagctcagcatttgcttcatgaagagtgattttcaaaagttttggtcaaagagtagccagctcggcgataccacaacgggacacctcagcagcggagagcagaagggaatcgaatccgattggcaagggctactggtcggcgaggagaagaggtctaaacccataaaggcttacagcactgagaactattctttagagagccagaagaaacggaaaaaatcgagaggtcagacttccgctgcgaatggactaagagccgagagtctggatgaccagatgctctccagggaatcctccagtcaggctccatataaatctgtgacgtccctttgcgcccctgagtacgagaacattcgccattacgaagagataccagagtacgaaaaccttcctttcatcatggccatccgcaagacccaggagctcgagtggcagaactcctcttctatggaggacgccgatgcaaacgtatacgaggtggaagagccatacgaggctcctgacggtcagctccagctcgggcctaggcaccagcacagtagctcaggtgcttcacaagaggaacagaatgatttgggtttgggcgacctgccatccgacgaggaagaaattataaattcctccgacgaggacgatgtgagctctgaatcttcaaaaggcgaacctgaccctcttgaggataaacaggatgaagacaatggcatgaaatcgaaggttcatcatatcgccaaggaaattatgtcatccgagaaggtgttcgtggacgtactcaaactgttgcacattgacttccgcgatgctgtagcccatgcaagcagacagttaggaaagcccgtaatcgaggaccgcatcttaaaccaaatcttatattatctgccccaactgtatgagcttaatcgtgatctcctgaaagagctggaggagcgaatgctgcattggacagaacagcagagaatcgccgacattttcgtcaaaaaagggccttatctcaagatgtactccacatatattaaggagtttgacaaaaatatcgctctgctggatgagcagtgcaaaaagaaccccggttttgcggcagtggtgcgggagttcgagatgtcccctagatgtgcaaatttggccttgaagcactacttgctgaaacctgtgcaaagaatccctcagtaccgcctgctcctcaccgactatcttaagaatctgatcgaggatgccggtgactatcgagatactcaggatgccttagctgtagttattgaagtggctaaccatgccaacgacactatgaagcagggagataatttccagaagttgatgcagatccagtactctctgaacggacatcacgaaattgttcagcctggtcgtgtgtttctcaaagagggtattctcatgaaactttctcgcaaggtgatgcagcccagaatgtttttcttatttaacgacgccctcctgtatactactccagtccagtccggcatgtataagttgaacaacatgctgtctcttgccggaatgaaggtgcggaaaccgacacaggaggcgtatcagaatgagctgaagatcgaatcagtcgagaggtcgttcatcttaagcgccagttctgctaccgagagagatgagtggttagaagccatctctcgcgctatcgaggagtatgcaaaaaagcgaatcaccttttgtccttcacggtctctggatgaagctgacagtgagaacaaggaagaggtctctcctctgggttctaaggccccaatctggattcccgacacgagggcaaccatgtgcatgatatgtacctctgagtttaccctcacctggaggcgtcatcactgtagagcatgtgggaaaattgtatgccaggcatgcagttctaataagtatggcttggactacctgaaaaatcagccagctcgtgtatgtgagcattgcttccaggagctgcagaaactcgaccatcagcactcacccagaatcggctcccctggaaatcacaaatcacccagttctgccctgagctcagtcctgcactctattccttctggaagaaagcagaaaaagattccggcagctttgaaagaggtcagtgcaaacaccgaagattcctccatgtctggatatttgtacaggtctaaaggaaacaagaaaccctggaagcacttctggtttgtgatcaaaaataaagtgttgtacacctatgcagcatccgaagacgttgctgcactggagagtcaacctttgctcggcttcacagtgattcaggttaaggatgagaactcagagtccaaagtgttccagctgctccacaagaacatgctgttctatgtgttcaaagcagaggatgcccactctgcccagaagtggatcgaggccttccaagaaggtacaatcctgtag

SEQ ID NO: 28343 - DNA, 1641 bp, Artificial Sequence
  Description of Artificial Sequence: Synthetic coding sequence
atgggagcctacctatcccagcccaacacagtaaagtgtagtggagacggtgtcggcgcacccagattacctctgccgtatggatttagcgctatgcaaggctggcgcgtcagcatggaggatgctcataattgtatccctgagttagacagcgaaacggccatgtttagtgtttatgacgggcacgggggagaggaggttgcactctactgtgcaaagtatctcccagatatcataaaagatcaaaaagcttacaaggaaggtaagctccagaaagcgctagaggatgccttcctggcaatcgacgctaaactcacaacagaagaggtgatcaaagagctggcacagatcgctggcaggccgacggaggatgaagatgaaaaggagaaggtggctgatgaggacgatgttgataatgaagaggcggcactgctgcatgaggaggcgactatgacaatcgaggagttgctaacccgttacggacagaactgtcataaaggcccacctcatagtaaatctgggggaggtaccggcgaagaacctggcagccagggtctcaatggcgaagcagggccagaggatagcacccgagagacaccgtctcaggagaacggccctactgcaaaagcctacacaggatttagctctaattcggaacgtggcaccgaagcagggcaggtgggggagcctggcatccctactggagaggcgggtccctcatgtagctctgcctctgataaactcccccgagtggccaaatccaagttctttgaagacagtgaggacgaatccgatgaggccgaggaagaggaggaagattcagaagaatgcagcgaagaggaagatggctattcctcggaagaagctgaaaatgaagaggatgaggacgacaccgaagaggcagaggaggacgatgaggaagaggaagaggagatgatggtgcccggtatggaggggaaagaagagccgggttcagattccggaactaccgctgtggtggccctcattcgaggcaagcagctcatcgttgccaacgccggagatagcaggtgcgtcgtctccgaagctgggaaagccctggacatgtcctacgaccacaaaccggaagacgaagtggagttggcccgaataaagaacgctggaggtaaagtgacaatggatgggagggtaaatgggggacttaatcttagccgggctatcggcgaccacttctacaaacgcaacaagaaccttcccccagaagaacagatgatttccgccctacctgacatcaaagtgctgactctaactgatgaccatgagttcatggttattgcttgcgacggtatctggaacgtgatgtcttctcaggaggtggtggattttattcagagcaagattagtcaacgtgacgagaacggagagctcagactactatcaagcattgtggaagaactgctggaccagtgtctggcacctgacacgagtggggacgggactggttgcgacaatatgacatgcattattatctgttttaaacctagaaacaccgcagagctgcagcccgagagcgggaaacgcaagctggaggaagtcctttctacagagggagccgaggaaaacggaaacagcgataaaaaaaaaaaagccaagcgcgattag

SEQ ID NO: 28344 - DNA, 273 bp, Artificial Sequence
  Description of Artificial Sequence: Synthetic coding sequence
atgtcgaccgccatgaactttggcacaaaaagttttcagcctcgccctcccgataaaggcagcttccccttggaccatctgggcgaatgcaagtcttttaaggagaaatttatgaaatgcttgcacaacaataatttcgagaatgcactgtgtcgtaaagaatccaaagaatatctcgagtgccgaatggaacgaaagttgatgttgcaagaaccgttggagaagctgggattcggcgacctgacatccgggaaatcagaagctaagaagtag

SEQ ID NO: 28345 - DNA, 726 bp, Artificial Sequence
  Description of Artificial Sequence: Synthetic coding sequence
atgaattctggcagaccggagactatggagaacttgccagctctgtataccatcttccagggcgaagtcgcaatggtgacagactatggcgcatttattaaaatccccggttgtagaaagcagggcctggtgcaccgaacccacatgtcaagttgtcgggttgacaagccgtccgagatcgtggacgttggggataaggtctgggttaaactgatcgggcgagaaatgaaaaatgatcggatcaaggtgtccctgtcaatgaaagtggttaaccaaggcacaggaaaggacctggacccaaataatgtgattattgaacaagaggaaagacgtagaaggagtttccaggattacaccgggcagaaaattactttagaggcagtgctgaataccacctgtaaaaaatgcgggtgtaaaggccacttcgccaaagattgctttatgcaacccggtggcacgaagtattccctgattcctgacgaagaagaggaaaaagaggaagccaaatcagcggagttcgaaaagcccgatcctactcggaaccctagccgtaagagaaaaaaggaaaaaaaaaaaaaaaaacacagagaccgaaagagttcagactctgacagtagtgattccgaatccgacacagggaagagggcgagacatacctccaaggactccaaggcagcgaagaagaagaaaaaaaaaaagaagcacaagaagaagcataaggagtag

SEQ ID NO: 28346 - DNA, 1758 bp, Artificial Sequence
  Description of Artificial Sequence: Synthetic coding sequence
atggccgctgcagcagctgccgtgggtcccggtgcagggggtgccggttcagctgtcccagggggtgctggtccctgtgctacagtgtccgtattccctggggcacgactgcttacaataggggatgctaacggagagatacagagacacgctgagcagcaggccctccgactcgaggtgcgggctggcccagattccgccggaatcgctctgtattcccacgaagatgtgtgcgtgttcaaatgcagcgtgagtcgggagactgagtgttctcgggtcgggaagcagagctttatcattaccctgggctgtaactccgttctgatacagttcgctacccctaatgatttctgcagcttctataacattttgaagacctgtcgtggacacaccctggagcgtagtgtgtttagcgagagaacggaggagtcatccgcagtgcagtatttccagttttacggatatctatctcaacagcagaatatgatgcaggattacgttcggactgggacttatcagagagccatactgcaaaatcataccgactttaaagacaagattgtgctggacgtcggatgtggaagcggcatccttagcttttttgcagcccaagccggagctcggaagatctatgctgtggaggcctccactatggcccagcacgccgaagtgttagtaaagtcgaataacctgacagacaggatagtggttattcctggcaaggtggaggaggtgagcctgccagagcaggtggacattattattagcgagcctatgggatatatgctgtttaatgagaggatgctcgagtcttacctgcacgcgaaaaagtatttaaagccctccggcaacatgtttcctactataggggacgtccacctggctcccttcactgatgaacagctgtatatggaacagtttactaaggctaacttctggtaccagcctagtttccacggtgtcgatttgagcgcacttcgtggcgctgcggtggatgaatattttcgccagcccgtggtagatacttttgatatacgaattctcatggccaagagcgtcaaatacaccgtgaactttctcgaggctaaagagggcgatttacatagaatcgagatcccatttaaattccacatgctgcactccggactggtgcacggtctggctttttggtttgatgtggcattcataggcagcataatgacggtgtggctcagcacggctccaactgagcccctgacccactggtaccaagtcagatgccttttccagagtcccctttttgccaaggctggcgatacactctcaggaacatgcctgttgattgcaaataagaggcagtcgtatgatattagcatcgtggcccaggtcgaccagactggttccaaatcctccaatcttctggacctgaagaaccccttcttccgatataccgggacaactccatccccccctcctgggtctcattacacttctccatctgaaaacatgtggaacaccgggtcaacctacaacctgtcatctggaatggcagtcgcaggcatgccaacagcttatgacctatcctcagtcattgctagcggcagctctgttggccacaacaacctgattcccctcggctcaagtggagctcaaggtagcggtggcggatctacgagcgcccattacgcggtgaactcccaattcactatggggggacctgctatcagtatggcctccccaatgtccattccaaccaacacaatgcattatggctcctag

SEQ ID NO: 28347 - DNA, 771 bp, Artificial Sequence
  Description of Artificial Sequence: Synthetic coding sequence
atggccagcggcagacctgaggagctgtgggaggccgtggtgggtgccgcagaacgattccgagctaggacagggactgaactggtcttactgaccgccgcacccccaccaccccctagaccaggcccttgcgcatacgccgcacatggacgtggggcactggctgaggccgctcgaagatgcctgcacgacattgctctggcccatcgcgcagccactgctgctcggcctcctgccccaccccctgcccctcaacctccctcaccaacgccgtccccaccacggcctacccttgccagagaggacaatgaggaagatgaggacgagcccacggaaactgagacatcaggggaacagctaggcatttccgacaatggagggctctttgtcatggatgaggatgcgacactccaggaccttcccccattctgtgaatccgatcccgagagcaccgatgatggaagcctgtccgaggagaccccagctggccctccaacctgcagcgtcccccctgcatcagctcttcctacacaacagtatgctaaatccctgcctgtgtccgttccagtatggggattcaaagagaaacgaacagaggccagaagctcagatgaagaaaatgggcctccttcaagcccagacttggacaggatagcagcttctatgcgcgctctagtcttgagggaggccgaggatacgcaggtgttcggagacctgccaagacctcgcctgaatacctccgacttccagaaactgaagcgcaagtactag

SEQ ID NO: 28348 - DNA, 4293 bp, Artificial Sequence
  Description of Artificial Sequence: Synthetic coding sequence
atgtgtctcgaatccaatctgtccagttgtaaacacctgccctgttgtgggaaacttcactttcaaagctgtcatggaaatgtgcataagctgcatcaattccccagccttcagggatgcacgagtgccggttattttccgtgctctgactttacttcgggcgctcctgggcacctcgaggaacacatcagccaaagtgaactcacacctcatttgtgcaccaactctttgcacctaaatgttgtcccacctgtgtgtttgaaggggtctttgtactgcgaggattgccttaataagcccgcaagaaacagtatcatcgacgctgccaaggtttggccaaatatccccccacccaatacccagcctgcaccgctcgccgtacccttatgcaacggttgtggcaccaaggggacgggcaaagagaccacgctactgttggccacaagcctgggaaaggccgcttcaaagtttggctctcccgaagtcgccgtcgcaggacaagttctcgagaacctgccccctatcggggtgttctgggacatcgaaaattgctctgttccctctgggaggtctgcaactgctgtagtgcaaaggattagggaaaagtttttcaaagggcatcgagaggcagagttcatctgtgtctgtgatatatctaaggaaaataaggaagtcatacaggagctgaacaactgccaagtaacagtggcgcatatcaacgctaccgcaaagaatgcagccgacgacaagcttaggcagagtctcagacggtttgccaatacacacactgccccagctactgtcgtactcgtaagcaccgacgtgaatttcgccctcgagctgtccgatcttagacacaggcacggcttccacatcattctggttcacaagaatcaggcttccgaggctcttcttcaccacgctaacgagctcatacgcttcgaggagttcatcagcgatttgccaccccgtttgcccctgaagatgccgcagtgccacactctgctatatgtgtacaatctcccagctaacaaagacggcaagtccgtttcgaaccgcctccgtagactgagcgataattgcggcggaaaagtgctgtctatcactggatgcagcgccattttaagatttatcaaccaggactctgccgagcgggcacaaaagcggatggagaacgaggatgtgttcgagaaaaaagacaaggaagaaactgtattccaagtgtcatacccttcagccttttctaagctcgtggcaagcagacaggtgtcgcccctactggcatcacagagctggtccagcagagcttcgccacttgctttcaatattgctaactcaagctcggaagccgattgcccagatccatttgctaacggcgcagacgttcaggtctcaaatattgactatagactgtcgcgaaaagagctgcagcagctgctgcaggaagccttcgctcgacatggaaaagtcaagtcagtcgagctaagcccgcacaccgattaccagctgaaggcggtggtgcaaatggaaaatctgcaggacgctatcggcgctgttaactctctgcatcgctataaaattggtagtaagaagatactggtcagcctggccaccggagctgccagcaaaagcctgtcactactccgattcgggcacaaactcaatgtgagcgatctttataaactgacagacacagtagctatacgggaacagggcaacggtaggctggtatgcttgttgccatcaagccaggcaagacagtcccctctgggaagcagtcagtcccacgacgggtcctccacgaattgtagccccattatttttgaggagcttgagtatcacgaacccgtgtgtcgccagcattgttcaaacaaggatttcagttttccagactgttacattgccgagttcggcgatttagaagtggttcaggaaaatcagggcggagtgccactcgaacacttcataacgtgcgtccccggagtgaatatcgccacggctcagaatggtatcaaggtcgtaaaatggattcacaacaagcccccacctccaaatactgatccttggctgctgagatccaaatcaccagttggcaatccccaactgatccagttttccagagaggtgatcgacttactgaagtcgcagccaagttgcgtgatcccgatctcccattttattcccagctatcaccaccacttcgccaaacagtgtcgggtttccgattacgggtacagtaagctcattgagctgcttgaagcggtcccccacgtgttgcagatccttggcatgggcagcaaaagactgttaacactgacgcatagagcccaagtgaaacggttcacgcaggaccttctgaaattgcttaaatctcaggccagtaagcaggttatcgtcagggaattttctcaagcttatcattggtgtttcagcaaggattgggacgtgactgagtacggcgtttgcgaattgatcgacattgtctctgagatcccggatacaacaatatgcctgtctcagcaagataatgagatggtgatctgtataccgaagagagagcggacacaagatgaaattgagcggacaaagcagttctccaaggacgtggtcgatctcctacgccatcagccccactttcgcatgccatttaacaagttcatccccagctatcatcaccactttgggagacagtgcaagcttgcatactatggttttaccaagctgctcgaactgttcgaggctattccggatacacttcaggttctggaatgcggggaggaaaaaatccttactctgacggaagtggagcgctttaaagcgcttgcggctcaatttgttaagctgttgcggtcccagaaggataactgtttgatgatgactgacctcttaacggagtacgcgaaaaccttcggctatacatttcgtcttcaggactatgacgtgagctctatcagcgctctgacacagaagttatgtcacgtcgtgaaagttgccgacattgaatccggcagacagattcagctcataaatcgtaaaagcctcaggagtttgacagcccagctcctagtgctgcttatgtcttgggagggtaccacacatttatcagttgaagagctgaagcggcactacgagtccacccacaatacccccttaaatccctgtgaatatggcttcatgaccctgactgagctgcttaagtccttgccctatttggtggagaccgctgccgcatttgacctacaaatcgaacttaagttcgcgggaggatactctctcctgctggaagagatcttggagtacattccccctccttttctgtctcctctccctagcttcctgcctcccccaccctttttcttttttgtgtttttcgtgatctttatttttttcatatttgtttttgtccaatttgtcgtgtttgtgttctttatagtcgtatttgtgttctttattgtcgtttttgtatttacgaatgataagatggaagagtgcgtgaaactgaccagcttatatctgttcgcgaagaatgttcgatccctgctacacacatatcactaccaacagatcttcctccatgaattctcaatggcctacacaaaatatgtgggagagactcttcagccaaaaacttatgggcacagctccgtggaagaacttctcggagccatcccacaggtcgtggtgcagttccttcagaagaatgggaaggaactgtcttgtgagaattacttgaacctgtacgccaaagcaggtcgattaagctccctctcactcagtcctgccaatcatgagaatcagcccagtgagggggagcgaatcttggaagtccccgagagtcacacagctagcgaactcaaactgggggctgacgggagtggtccgtcgcataccgagcaggaattattacgactgaccgacgactcacctgtggatttgctttgcgcaccagtcccatcgtgcctgcctagtccacagttgcggcctgatccagttattcttcaaagcgcagatttaatccagttcgaagagaggccgcaggaaccttctgagatcatgattctgaaccaggaggaaaaaatggaaattcccatccctggcaagtccaagactcttacgtctgattcttccagttcatgcattagcgctgccgttcctgtgcctccatgcccgtcgagtgaaaccagcgagagcctccttagtaaggaccccgtcgagtcacctgccaagaagcagcctaagaatcgggttaagttggccgcaaacttttctctcgccccaatcactaaactgtag

SEQ ID NO: 28349 - DNA, 2346 bp, Artificial Sequence
  Description of Artificial Sequence: Synthetic coding sequence
atgggacagctgcgggactggtttccaaatactcaggatctggctgggaatgaccaagagaacatccgtcacgctgataggaacaactcggacgataaccacctcgcgtctgaagatacttctgctaagcagtcaggcaaacctggcatctatgaagacagggatcccctaagggtgtccatttcgcgtgaacagtccttctttggctcaccgctggcgcacgacccgttttcttgcctgcagttagtcgggcaggagaatgtgtgtggcgacgattatgacgaagcggtcaaactgaaagaatccgttgtcgaaaatcatgctgttctgtcttacgccgtcgaggaggagcacgcctaccttgggcctactgtgaaaccggatgacaaggctaaaactctgagttatgaacctctatcctcggcaaccgtgtctaccggaagtctgttgtcctatgagaacacagatctcagtctaacggatcccgaatcattcagcgagcacatggacgattccaaacaggagagcaccacttcgaaggaggaggagactaatattatcagtagcattgtgccatctacccaagacatctatcagcgtcagaacagcagtgacgtgcataagagccttctccccgctgtagatgagaccacttgcggtcatactcacttccagcagatgatcgacaagtacataaacgaagccaacctcattcctgagaaaaccgatttgcaagagctggaacacattttccctaacttgcaccatcagttatttaagccgctggagcctcaccctgacttcgatctttcaagctcaagctcgggcatatcgcctgacaacagggatttttatcagaggtcagactcaagtagtgagtcccattgtgcaaccgggctctctaagagcacagtctattttaccgcgctccgcaggacaagtatgcattctagtctcaacacctctccaaaccagcagccagacaccaaccttgctcatgtgggggctcatagttttgctacagagaatatcataggagggtctgagcagtgctttgaacagctgcaaccagaatacagcagccaggaggaaagccaacacgcagatctccccagtattttcagtatcgaggctcgcgacagctcacagggcatgaaaaatcaaaactacccgagtgaggaacacactgaaattttgcaaaacaaaaagaaaatcgtgcactttcagctgtcaatcggcaatctttcatccgtctatagcagcagcgacgaagcaaacgtcttcgaccagctgaatgtccagcatagtaccccctgcggaagtaatagttcagagtgctcgacgaaacaccagctggaaagccgtaaggaatctatggggtttgaagagctgtctaagcggggagtggtcactatgttgcagtcccaaggtttgattgaggacaataagaacgagacttgccgggtgctggacatcaatccccaagtggaggagacggacagcagactttgcgtgcggaccgtagaaatgggcacgagcatccaggctccctatagcttgaccacccagaacgagaagtacttcgaaaactccgcagaaacggatatcccaaagatcacaaagaagttgtcccagctcggtgagagcgaactttttgcttccagcggatccttcagtcttcagtctagcattccggtctgggaaactgaaacaggacacggaattatggaagagcctgaactgacactcatctccacaacagacaccagtatcgctgagatggacttcgctaatctgaccttggaagaaaaatccgagaatgaagctaagtgcttctttcaagtttctgagttcctccctcttgtctctgctaccgaggcaagcgactatccagccgtcagcgagttatctatcgagaagccccgaacagcatccacagaaacccccagaaggcttacccccgtccccggatctctgcaggaagccttcattaaaagaaagaagtccttcatggagagaagccaccaacggcagaaggaaatcagaaacaagatacatgttagtgagaattctcaaattaaaacagtgaaagagaaaccctcaattagctccagcgtgtctaggctgaagggagtgaacaaggtgagagcaagttttccggaagataggaagaccactcaagccctacgccaccagcggggactgcggctgtacaaccagctagccgaggtaaaacagcagaaagaagagaaaaccaaacaggaagcctatgcccagaatagagcaagagcaaaggagtttcacaaaaaaacacttgagaagttgagagcaaaaaacacgtgctag

SEQ ID NO: 28350 - DNA, 513 bp, Artificial Sequence
  Description of Artificial Sequence: Synthetic coding sequence
atgggcaagcggtacttttgcgattactgtgatcgaagtttccaggataatttgcacaaccgcaaaaagcacctgaacggtctgcagcacctcaaggccaagaaggtgtggtacgatatgtttagggatgccgctgcaatcttgctggacgaacagaataagaggccgtgtaggaagtttctactgacgggacagtgcgactttggaagtaattgtaggttctcacacatgtccgagcgcgacctgcaggaactgagcattcaggtagaagaagaacggagggctcgtgagtggctccttgacgcccctgaactgccagagggtcacttagaagattggttggagaaacgggctaagagactgtcttccgccccttctagccgcgctgaacccatcaggactacagttttccagtatccagtggggtggcctcctgtacaagaactgccgccaagcctgcgtgctcctccacctgggggatggccgctgcagccgagagtccagtggggctag

SEQ ID NO: 28351 - DNA, 1542 bp, Artificial Sequence
  Description of Artificial Sequence: Synthetic coding sequence
atggcgagcgtgttgtcaagacgcttgggaaagcggtccctcttgggtgccagagtcctcgggccatccgcttctgaagggccatccgcggcaccaccttctgagccgcttctggagggtgctgcaccgcagcccttcacaacatcagacgatacgccatgtcaggaacagcccaaagaagtccttaaggccccatccacatcaggcctccagcaggtggcattccagcccggacaaaaagtttatgtgtggtacggtgggcaggagtgtaccgggctggtcgaacaacactcttggatggagggtcaggtcacagtgtggctcctcgagcaaaagctccaggtctgctgtagggtcgaggaagtttggctcgctgaactgcaagggccatgtcctcaggcgcctcccttggagcccggtgcccaggccctggcttatcgtccagtttcccgaaacatcgatgtgccaaaacgaaagtccgacgccgtggaaatggacgaaatgatggccgcaatggtgctgacttcacttagctgttcacctgtggtgcaatcaccacccggtactgaagctaacttttctgcttctcgtgccgcatgtgacccctggaaggagagtggtgacatctccgactcaggatcttccacgacgtctggccattggagcggatcctcaggtgtgagtaccccctcccctccacatccacaggcatctcctaagtatctgggcgacgcgttcggctctcctcagaccgaccacggattcgagacagaccctgatccctttctgctggatgaaccggctcccagaaagcggaaaaactcagtcaaagtgatgtacaagtgcctgtggcccaactgtggaaaggtgctcaggtcgatcgtgggaattaagcggcacgtaaaggccttgcacctaggagacactgtggattcagaccaatttaagagggaagaggatttttactatactgaggtccagctgaaggaagagtctgccgcagcggctgctgcagcggcagctggaacgcctgtacccggtacgccaaccagcgagccagccccaacccctagcatgaccggcctgccattaagcgctctgccacctccacttcataaggcgcagtcaagcggaccggagcaccctggccctgaatcgtccctgcccagtggcgctctgagtaaaagcgctccagggtccttttggcacatccaggctgaccacgcataccaggccctgccttcctttcagatcccagtttcaccgcatatctacacaagcgtttcatgggcagccgcacctagcgcagcttgctcccttagcccagtgcggtccagatccctatcattctcagagccccagcagccagctcctgctatgaaatcccatctgatcgtgacttctcctccccgagcccaaagcggtgcaagaaaagctaggggtgaggctaaaaaatgccgaaaggtgtatggaattgagcaccgggaccagtggtgcacagcatgtagatggaagaaagcttgccaacggtttttagactag

SEQ ID NO: 28352 - DNA, 555 bp, Artificial Sequence
  Description of Artificial Sequence: Synthetic coding sequence
atgggcaacggcatgaacaaaatcctcccgggactgtatattggaaatttcaaggatgcccgagacgccgagcagctgtcgaagaacaaggtgacccacattctctctgttcacgacagtgccaggcctatgctggaaggtgtcaaatacctgtgtatacctgcagccgattctccctcacagaatttgaccaggcattttaaagaaagcattaagtttattcatgagtgcaggcttcggggagagagttgcctggtacactgtctggcaggagtgtcaaggtccgtcactctagtgatagcctatatcatgactgtgaccgactttggttgggaggatgctctgcatacagtgcgggcagggagatcatgcgcaaacccaaatgtcggtttccagaggcagctgcaggagttcgaaaagcacgaggttcaccagtacaggcagtggctgaaggaggagtacggggagtcccctcttcaggatgctgaggaggcgaaaaatatacttgctgctccgggtatattgaaattctgggcattcctccggagactgtag

SEQ ID NO: 28353 - DNA, 642 bp, Artificial Sequence
  Description of Artificial Sequence: Synthetic coding sequence
atgctgcagctcagggactcggtggatagtgctggaacctctccgacagcagtccttgccgctggagaagaagtgggcgctggtgggggtcctggaggaggacgcccaggcgctggcacgcctctgcggcagacactatggcctttatctattcacgatccaacgcgccgagcaagagtgaaagaatacttcgtgtttaggcccggtagcatcgaacaggccgtagaagagattcgcgtggtcgtgcgacctgtggaagacggagagatacagggagtatggttgttgacagagagggaaggcttcggcatccgcattcagtgggacaaacagagccgcccatctttcataaataggtggaatccttggtccaccaatgtaccatacgcgacatttacggagcacccgatggcaggcgcagacgagaaaaccgcgtccttgtgtcaattggagtccttcaaagcgctgctcattcaggctgtcaaaaaggcacaaaaggaatcccccctgcctggccaggcaaatggggttctgatcctggagcgaccactgctgatagagacttacgtgggactgatgagctttatcaataacgaggccaaacttgggtatagcatgacccgtgggaagattggattctag

SEQ ID NO: 28354 - DNA, 888 bp, Artificial Sequence
  Description of Artificial Sequence: Synthetic coding sequence
atggagctgatccaggatacaagcaggccaccgttggagtatgtaaaaggagttcccctcatcaagtatttcgcggaagccctcggaccgctgcagagcttccaagccaggcctgacgatctgctgatcaacacttaccctaaatctgggactacctgggtttcgcaaatcctggacatgatttatcaagggggtgatctggagaaatgcaaccgcgctcccatatacgtgcgcgtgcctttcctggaggtgaatgacccaggggaacccagtggactggagacattgaaagacacaccccctcctcgactgattaaatctcaccttccccttgcactgttaccccagaccctcttggatcagaaagtcaaggtcgtctatgtcgccagaaatccaaaggatgtggctgtgtcatattaccatttccatcgaatggagaaggcacaccctgagccaggcacctgggatagttttctggagaaatttatggcaggagaggtctcatacggcagctggtaccagcatgtacaagagtggtgggaactgagtagaacgcacccggtgttgtacctgttctacgaggacatgaaagagaatcctaagagggaaattcagaagattctcgagttcgtcggacgtagcctgcctgaggagaccatggactttatggtgcaacatacaagctttaaggagatgaaaaagaacccaatgacaaactacactacagtcccacaggagctcatggatcactcaatttcaccattcatgagaaagggcatggccggagattggaaaaccacatttacagttgcgcaaaacgaacgctttgatgctgattacgctgagaaaatggcaggatgctctctgtccttccgatctgagctgtag

SEQ ID NO: 28355 - DNA, 3867 bp, Artificial Sequence
  Description of Artificial Sequence: Synthetic coding sequence
atgcccagaaaaggtacacagccttcaacagccagaaggagggaggaagggccacccccaccctcgcccgacggcgcttcgagcgacgcagagcccgaacccccaagcgggaggactgagtcacctgccacagctgcggaaaccgccagcgaagaactggataataggtcattggaggagatcctcaacagtattccccctccaccccctcccgcaatgacgaatgaggctggtgcccctcgccttatgatcactcatatcgtgaatcaaaacttcaaatcatatgccggagagaaaattctggggccattccacaagagatttagctgtatcatcggaccaaatggatccggcaagagtaacgtcattgattcaatgctgttcgtgttcggatatcgggctcagaagatccggagcaaaaagctgagcgtactgatccacaatagtgacgagcacaaagatattcagagctgcactgtcgaagtccacttccagaaaattattgacaaggagggtgacgattacgaagtgataccgaacagcaatttttacgtgagccgcaccgcgtgcagagacaacaccagtgtgtaccacattagcgggaagaagaaaactttcaaggacgtagggaacctgttgcgtagccatggaatcgatttggatcataaccggttcttgatcctccagggagaggtggaacagatcgcaatgatgaagccaaaagggcaaacagaacacgatgaaggtatgctcgaatatctggaggacataatcggctgtgggagactgaacgagccgattaaagtgctctgccgacgcgttgaaatactgaatgagcacagaggagagaaactgaaccgtgtcaagatggtggaaaaagagaaagatgctctggagggtgaaaaaaacatcgcgattgagtttctgaccctggaaaatgagatcttcaggaaaaaaaaccacgtctgccaatactacatctatgaactccaaaagcgcatcgcggagatggagacgcagaaagaaaagatccacgaggataccaaggagattaacgagaaatccaacattctgagcaatgaaatgaaagcaaagaacaaggatgtcaaagataccgaaaaaaagttaaataaaatcaccaagtttattgaggagaataaagaaaagtttacccagctggatctcgaggatgttcaagtgcgcgagaaactcaaacatgctactagtaaggccaagaaacttgagaagcagttgcagaaggataaggaaaaggtggaggagtttaaaagcatccctgcaaagagtaataacatcatcaatgagacgacgacccgcaacaacgcgctggagaaggaaaaggagaaggaggaaaagaaattaaaagaggtgatggattctctgaagcaggagactcagggcttgcaaaaggagaaagagtcgcgagagaaagagctcatgggtttctctaagtccgttaatgaggctagaagcaagatggatgtagcccagtccgagctggacatctatctatctcggcacaataccgccgtttctcaactgaccaaagcaaaagaagccctgatcgccgctagcgagactttgaaggagcgcaaagcagccattagagacatcgaggggaaactcccccagaccgagcaagaactcaaagaaaaggagaaagaattacaaaaacttacacaagaggaaactaattttaagtctctggtgcacgatctctttcaaaaggtggaagaagcgaagtcaagtctagccatgaacaggagccgaggcaaagttctggacgccatcattcaggaaaagaaaagtggccgaattccgggtatatatgggagactgggagatctgggagccattgacgagaaatacgatgtcgccattagttcctgctgccatgcgctcgactacatcgtggtagattccatagatatagcccaggaatgcgtcaacttcttgaagagacagaacatcggggtagctacgttcataggactagataaaatggctgtttgggcaaagaagatgacagagattcaaacgccagagaacactcccaggctctttgacttggtaaaggtcaaggacgaaaagattcgccaggctttttacttcgcactccgagatactctggtagccgataacttagaccaggccactagggtagcctaccagaaagatagaagatggcgcgtcgtgaccctgcaggggcagattatcgagcagagcggtacaatgaccggtggcggtagcaaggtcatgaaagggagaatggggagttctctggttatcgaaatctctgaagaggaagttaacaaaatggagagtcagctgcaaaatgactccaaaaaagctatgcagatccaggagcagaaagtgcagctcgaggagagagtggtgaaattaagacactcagagcgggaaatgaggaacactctggagaagttcaccgcctcaatccagcgtcttatcgagcaggaggagtatctgaacgtccaggtcaaagagctcgaagcaaatgtactcgctacagcgccagataagaagaagcagaagttactggaagagaacgtgtctgcctttaagactgagtatgatgcagtcgccgagaaggcaggcaaggtggaggccgaggtgaagcggctgcacaatactatcgttgagatcaataaccacaaattaaaagcccagcaggacaaactagataagatcaacaaacagctggacgagtgcgcctcggcgatcacaaaagcacaggtcgcgatcaagactgcggaccgtaatttacagaaagcacaagacagcgtgctgaggaccgagaaggaaatcaaagacaccgaaaaggaagtggatgatcttacagccgaactgaagtctctggaggataaagctgctgaggtggtcaagaacaccaatgctgccgaggagtccctgcctgaaatacaaaaggaacatcgtaacttgttgcaggagttaaaggtgattcaagaaaatgaacacgccctgcaaaaggacgcgctgagtatcaagctaaagctcgaacagattgacggtcacatagctgagcacaacagtaagatcaagtattggcacaaggagattagtaagatctccctgcacccaatcgaggacaatccaatcgaagagattagcgtgttgagccccgaggacttggaggccattaagaatccagattcaattacgaatcagatcgctctcttagaggccagatgccacgaaatgaagccaaatctcggcgcaatcgctgaatacaaaaagaaggaagagctctacctccaacgcgtagccgagctcgacaagataacatatgagagagattctttccgccaagcttacgaggatctgcgaaaacagagactgaatgaattcatggcaggattttatatcatcacaaacaagctgaaagagaattaccagatgctgactctgggaggagatgcagaactcgaacttgtagattccctagaccccttttcggaaggcatcatgttcagtgttagacctccgaaaaaaagctggaagaaaattttcaatttgtcagggggagagaaaactctcagttcactcgcactggtgttcgcactgcatcactacaagcctacccccctctacttcatggacgagatcgatgcagctctggattttaagaacgttagtatcgttgctttttacatttatgaacaaacaaagaacgcccagtttattattatctctctgcgaaacaacatgttcgaaataagcgaccgactgataggtatatataagacatacaatatcaccaaatctgttgccgttaatccaaaagagattgccagcaagggcttgtgttag

SEQ ID NO: 28356 - DNA, 2856 bp, Artificial Sequence
  Description of Artificial Sequence: Synthetic coding sequence
atgttaggctctatggcaagaaagaagcctcggaacactagccggctaccgcttgcattgaaccccctcaagtctaaagacgttcttgccgtcctcgcagaaagaaatgaggctattgttccagtgggcgcttgggtcgagcctgcctctcctggctcctcggaaatccctgcctatactagcgcttatctaatcgaggaagaattgaaggagcagctcaggaaaaagcaggaggctttgaaacacttccagaaacaggtgaagtaccgtgtcaatcagcagatcagactcaggaagaaacaacagttgcaaaagagttatgagagggcgcagaaagagggatccatcgcgatgcaatcgagcgcaacgcatctgacatccaagcgtacatccgttttccccaataatttaaatgtggcaatcggaagtagccggttgcctccttccctgatgcctggagacggcattgaggatgaggagaaccagaacgagctgttccaacagcaggcccaagccttgtctgaaaccatgaaacaggctcggcaccgcctggcaagctttaagaccgtaatcaagaaaaaaggcagtgtgttcccagacgatggtcgcaaaagtttcctgactcgcgaggaggtattatcaagaaaacctgccagtaccggcatcaacaccggcatccggggagagttgcccattaaggtccatcaaggactgctggcagccgtaccttaccagaactacatggagaaccaggaactggattatgaggagcctgactatgaggagtcatccagcttggttactgatgaaaaaggtaaggaggacctttttggaaggggtcaacaggaccagcaggccatacattctgaggacaagaataaacctttctcgagagtacagaaggttaaatttaagaatcccctgtttgtgctgatggaggaggaggagcagaaacagctccattttgagggacttcaggatatcctgcccgaggcccaggactattttctcgaagctcagggggacctgctggagactcaaggcgatctgacaggaatccaaagcgtgaagcccgatactcaggccgtggaaatgaaagtccaggtgaccgaacccgagggtcaagccatcgaaccggaagggcagcccataaaaacggaaactcagggcatcatgctgaaagcccagagcattgagcttgaagaaggaagtatagtacttaagacccaggattttctgccgacaaatcaggccttgctgaccaagaaccaggacgtcctcctgaaggaccattgcgtgttgcccaaagaccagtcaatcctcctgaaataccaggatcaagactttctgcccagggatcaacacgtcctgcacaaagaccaggacatcttacctaaataccaggaccagaatttcttgccaaaagatcagaatttcctctcaagggatcagcatgtcctgcccaaggaccaagacatcctgcctaagtatcaagaccaaaacttcttgcctaaagaccaaaatttcttgagccgagatcaacacgtgttacccaaagatcagaacattctgcccaagtatcagggacaagatttcttgcctaaggatcaggactttctgagtagagaccagcacgtactgcctaaggactggaatatactccccaagtgtcaagatcaagacttcctgccgagggaccaaggagtgctgccaaaggaccaaaacatccttcccatatgtcaggaccaggacttcctgcccagagaccaggggtacctgccgaaggatcagaatatcctccccatctgtcaggaccgagatttcctgcctcgggatctgcatgtgctgagcaatgatcagaatattctgccaaagtgccaagaccaggatttcctgccgaagtaccaaaaggtgcatttcaaggaaccctactctgacatgactgacgaaaaggggagggaagacttcagcctggcagattatcagtgcctaccaccgaagtcacaggaccaagacgacattaaaaaccagcagccagccagcttcatgagggaggaacgggtccgcgaggagctgcccctcgactatcaccagtacgtggtccctaagattcaggaccaggacagtccacgagagcagaacaaacatatcaagctgccttcttcctttgaaaaatgggagatcgctcgcggaaacacacctggagtcccactagcttatgatcgatatcagagtggactgtccactgagtttcaggcgcctctcgcttttcagtcggacgttgataaggaggaggacaagaaagagcgccagaagcagtacctaaggcaccgtcggctgtttatggatattgagagagaacaggtgaaagaacagcagcgacagaaagagcagaagaaaaaaatcgagaagatcaagaagaaaagagaacaagaatgttatgcagcggaacagcggatcctcagaatgaattttcacgaggatccctactctggagagaagctcagcgaaatcctggcccagctgcagttgcaagagatcaaagggaccagagaaaagcagcagcgggaaaaagagtacctgcgctacgtcgaagctctccgagcccagatccaagagaagatgcagctttacaatatcacgttacctccgctatgctgctgcggtccagacttttgggatgcacaccctgatacctgtgccaacaattgtatcttttacaagaatcaccgcgcatatactcgcgctttgcacagcttcattaactcctgcgatgtccccggtggtaattcaaccctcagagtcgccatccataatttcgcctcagcccaccggagaaccctgaagaatttgtag

SEQ ID NO: 28357 - DNA, 1248 bp, Artificial Sequence
  Description of Artificial Sequence: Synthetic coding sequence
atgagcccagaggttgcactcaataggatctctcccatgttgagcccgttcattagcagtgtggttagaaacggaaaggtgggactggatgccactaactgcctgagaattaccgacctgaaaagtggctgcacatcactgaccccaggcccaaattgcgataggtttaaactgcacatcccatatgctggagagacattgaaatgggacattatcttcaacgcacagtatcccgagctgcccccagacttcatattcggcgaggacgccgagttcctgccagatcccagtgcactgcaaaatcttgcttcgtggaacccttcaaaccctgagtgtctcctcttagtcgtcaaagaactggtgcagcaataccatcaatttcagtgttcgagactacgcgaaagtagtcggctgatgttcgagtatcagacattactcgaggaaccacaatacggcgagaacatggaaatatatgccggtaaaaaaaacaattggacaggcgaattcagcgccagattccttctcaagctgcctgtggattttagtaacatcccaacttatctgctcaaggatgtcaacgaggaccccggagaggatgtcgccctgctcagtgtctccttcgaagacacagaagcgactcaggtgtatcctaaactctacctgtccccccgaatcgagcacgctttaggcggtagctccgcgctgcatattccagccttccccggagggggatgcttaattgattacgttccccaggtttgccacctgttaaccaataaagtccagtacgttatccagggctatcataaaaggcgcgagtacattgcagccttcctgagtcattttgggaccggggtagtcgagtatgacgctgaaggatttactaaactgactctcctacttatgtggaaggacttctgttttctggtccacatcgatttgcccctcttcttcccacgggaccaacctacgctaacgttccaaagcgtctaccactttaccaacagtgggcagttatatagtcaagcccaaaaaaattacccttacagtccccgatgggatggcaacgaaatggccaagcgagcaaaaggctgccagggctcacgcgatgcttgcagcccatgggaacaggtgttggcatttgccgtggccaagactggctgcaagctcctacagcctcaacgcaactggccgtcatcaagaggcccaccatggcgcgcttctgaaggtgagcgaactgcgcagtag

SEQ ID NO: 28358 - DNA, 903 bp, Artificial Sequence
  Description of Artificial Sequence: Synthetic coding sequence
atgctgagcgcagtggcgagaggctaccagggctggttccatccttgcgctcggttgtctgtccgcatgtcgtcaacgggcattgatagaaaaggtgtgttagccaaccgggtggcggtggtaaccggctccacgtctggcatcggttttgcaatagcacgccgtctcgcaagagatggggctcacgtggtgatttccagtcggaaacagcagaatgtagatagagctatggcgaaactccaaggagaggggctgtctgtggctgggattgtgtgccatgttggaaaggccgaggatagagagcagctggtggccaaagcactggagcattgcggaggcgttgatttcttggtgtgctccgcaggtgtgaatccactggtcggctcaactctaggcaccagtgaacaaatctgggataaaattctcagcgtcaatgtgaagagtccggcactccttttaagtcaattgctcccttatatggaaaatcgccgaggcgcagtcatactggtgtcttctatcgccgcatacaaccctgtagtcgccctgggcgtctacaacgtatctaaaaccgcccttttgggactgacacggaccttggccctcgagctggcccctaaggacattagagtgaattgtgtggtgccaggcatcatcaagactgacttttcgaaggtcgttagaataggattcatgggcatgtctctgagtggcagaacatctagaaatattatttcttgccgcggtttgggctctcagcggaccgttcaggaatcatgtccctcttgcgcccttcagatgcccgcaacctccaccggcagaaccctcagatggcaggcaacccctctgggctctgagcgcagcggcggaggatgcgtggctgtcgtcccaggcccaggcgcatag

SEQ ID NO: 28359 - DNA, 1014 bp, Artificial Sequence
  Description of Artificial Sequence: Synthetic coding sequence
atgcggtttgacactctgtgggagaataaactgatgcagagtagggccgtggacggctttcactcagaagagcagcagctgttgcttcaggtgcagcagcagcaccaacctcagcaacaacagcaccatcaccatcatcatcatcaacaggcgcagccccagcagacagtgccccagcaggctcaaacgcaacaggttctgatcccagccagccagcaagccacagccccacaggtaatcgtcccagatagtaaactaatacagcatatgaacgcgagtaatatgtctgcagcggcaaccgccgctacacttgccttacccgcaggagtgacaccggtacagcagatcctgactaacagtggacagctgctgcaagtggtccgggctgcaaacggggctcagtacatcttccagccacagcagagtgttgttctgcaacagcaggttattccccaaatgcagccaggcggagtccaggcccctgttatacagcaggtgcttgcccctctacctggcggtatcagtcctcaaaccggcgtcatcattcagcctcagcaaatcctgttcaccggcaataaaactcaggtaatcccaactaccgtggctgccccaactccagcgcaggcacagattaccgccactggtcagcagcaaccacaggcccagcccgctcagacccaagcgccacttgtgcttcaggtcgacggtacaggggatacctcatccgaggaggatgaggacgaggaggaggattatgacgacgatgaggaagaggacaaagaaaaggacggtgcagaggacgggcaggtcgaagaggaaccgctcaatagcgaagatgacgtatcggatgaggagggacaagaactgtttgacaccgagaacgttgtcgtgtgccagtacgacaagatccaccgctccaagaacaagtggaagtttcacctgaaggacggtatcatgaacctcaacggacgtgactatatcttctctaaggctatcggagacgctgagtggtag

SEQ ID NO: 28360 - DNA, 282 bp, Artificial Sequence
  Description of Artificial Sequence: Synthetic coding sequence
atggcccaatcaggaggcgaagccagaccgggtcccaaaaccgctgtacaaataagagtcgcaattcaagaagctgaagacgtcgacgagttagaagacgaggaagagggggctgagacacgtggggcaggggatcctgccaggtatttatcccctgggtggggttctgcctccgaggaggaaccatcccgaggacatcgaaaccgctcaagcgtaaacagcaggaccatgctggcttcgttcatcgtgagtagcgccccatcaacagccccttctacctag

SEQ ID NO: 28361 - DNA, 255 bp, Artificial Sequence
  Description of Artificial Sequence: Synthetic coding sequence
atgaaagtgaagattaaatgttggaacggcgtggctacctggctatgggtggcaaacgatgaaaactgtggcatttgcagaatggcctttaacggctgctgccctgactgcaaggtacccggagacgattgtcccctggtctggggccagtgttctcattgtttccacatgcactgtatactgaaatggctgcacgcccagcaggtgcagcaacactgtcccatgtgcagacaggaatggaagtttaaagaatag

SEQ ID NO: 28362 - DNA, 612 bp, Artificial Sequence
  Description of Artificial Sequence: Synthetic coding sequence
atggcccacgtctcctcagagactcaagacgtctcccccaaggacgaactcacggcttccgaagcgtccacaagatctcccctgtgcgagcataccttccctggcgattcagacctgcggtctatgatcgaggaacatgccttccaggtgctctcccagggcagcttactcgagtctccatcttatacagtgtgtgtctctgagccagacaaggacgacgactttctttcattaaatttccccaggaaactatggaagattgtagaatccgatcagtttaagtccatcagttgggacgaaaacggaacctgcatcgttataaacgaggaactgtttaagaaggaaatcctcgagacaaaggccccttaccgaatcttccagacagacgccattaaatcttttgtgcggcagctgaatctgtatggttttagtaagatccagcagaattttcagcgatccgcatttctggctacatttctcagcgaggagaaagaaagctcagtgctgtctaaaattaggttcactaaaatgaagctttcccggtcatccacgtacgaaaaccgatatctgtgctgtaatctacatttgaaagacgaaagcaattacagttag

SEQ ID NO: 28363 - DNA, 1794 bp, Artificial Sequence
  Description of Artificial Sequence: Synthetic coding sequence
atgccaagcccacaactgcttgttctgttcggaagtcagacaggtaccgctcaagacgtgtcagagagactgggacgggaggcgcgtcggagacgattggggtgccgcgtccaggcattggactcctaccctgttgttaacctcattaacgaaccattggtcattttcgtttgcgccacaaccggccagggggaccccccagacaacatgaagaacttttggaggtttatctttagaaagaatcttccgtctaccgccctgtgtcagatggactttgccgttctgggattaggtgactcctcctatgccaagttcaacttcgtggccaagaagctccaccgtagactgctgcagttggggggaagcgctttgctccccgtttgcctgggcgacgaccagcacgagctgggccctgacgccgcagtggatccttggctgagggacctgtgggatcgcgtccttggtctctatcctcctcctccagggctgacagaaatccctcctggggtgcctctcccgagtaagttcacccttctgtttctccaggaggctccgtccacgggctctgaggggcagcgtgtggctcacccaggcagccaggaacctccctccgagtctaaaccgtttctcgctccgatgatctctaaccagagggtgaccggcccaagtcacttccaggacgtgcgcttaattgaattcgacatcttgggctctggaattagctttgctgctggcgatgtggtgctgattcagccttcaaacagcgctgcccatgtgcagcgtttctgccaagtcctcgggctcgatccagaccagctttttatgctgcagccgagagaaccagacgtcagtagcccaacccggctgccgcagccctgttcaatgagacaccttgtgtcacattatctcgatatagcctctgttcctcggcgatctttttttgagctgctggcctgtctgagcctgcatgaactcgaacgagagaagttactagagttttcgtctgcgcagggacaagaagaactgttcgagtactgtaatcggccacggagaacaatcctggaagtgctctgtgattttccacacactgccgctgccattccacccgactatctgcttgacctgatccccgttatacgccctagagccttttccatcgcgagctcgcttcttacacatccgagccgtctgcagatccttgtcgctgtcgttcagttccaaacccggctgaaagagccaaggagagggctgtgttcatcatggctggcatccctggaccctgggcaaggacctgtccgggtcccgttgtgggttaggcccggatctcttgcctttcccgaaacacccgacacacctgtgatcatggttggtcccggtactggtgtggcccctttccgcgctgcaattcaagaacgggtggcccaaggtcagaccggtaacttcctcttcttcggttgtcgatggcgtgatcaggatttctactgggaggctgagtggcaagagctggaaaaacgtgactgcctgaccctgattccggctttctctcgggagcaggagcagaaagtctacgtccagcatcggcttagagagttaggctctctcgtctgggagctgttggaccggcaaggcgcttacttttacctggctggtaacgccaaaagcatgcccgctgacgtctctgaggcactaatgtcaatcttccaggaagagggtggtctgtgcagccccgacgccgctgcctacctcgcacgactgcagcaaacaaggcggttccagacggaaacttgggcatag

SEQ ID NO: 28364 - DNA, 1860 bp, Artificial Sequence
  Description of Artificial Sequence: Synthetic coding sequence
atggacgatcagcaggcactgaacagtattatgcaggatttggccgtgctccacaaagcttcacggccagcactgagcctgcaggaaactcgtaaggcaaaaagttcaagtcctaagaaacaaaacgacgtgagagttaagttcgaacacaggggcgagaaacgcattttgcagttccctaggccagtcaaactggaggacctgcggtctaaagcaaagattgcttttggccagtctatggacctgcattacaccaacaatgaactggttattccccttaccacgcaggacgatttagacaaagccgtggagctcctggatcgatccatccacatgaagagcttgaagattctgctggttataaacggctctacccaggccactaatcttgaacccttgccctctctggaggatctagataacacagtattcggggcagagagaaagaagaggctatccatcatcgggcctactagccgcgatagatcatcgcccccaccaggatatattccagatgagctgcatcaggtggctaggaacggctccttcacaagcattaattcagagggcgaatttattcccgagtctatggaccaaatgctcgacccactgtcattgtctagtccagagaattctggaagcgggagttgcccgagtctggactctcccctggacggcgagagctaccctaaatccaggatgcccagagcccagtcttatccagacaatcaccaagagttttctgactacgataatccgatttttgagaagttcggtaagggaggaacgtatccacgcaggtaccacgtatcataccatcatcaggagtacaacgatggcagaaagacgtttcctagggctcggcgaacccagggcacatctctacgatccccagtctctttttctcctaccgatcattccctgtctacatcctctggatcctcaatcttcacccccgaatacgatgactcccgcataaggcgacgcggatccgacatcgataacccaactctgacagtcatggacatctctccaccctccagaagcccacgcgctccgacgaactggcgactgggaaaactgctgggccagggcgctttcggccgagtctacctctgctatgatgttgacactggaagggagctcgccgtgaaacaagtgcagtttgaccccgactctcctgaaacgagcaaggaggtgaatgctctggagtgcgagatccagctactgaaaaacctccttcacgagagaattgtacagtattacgggtgtttacgggatcctcaggagaagacactctctatctttatggagtatatgccaggagggagcatcaaagatcagctgaaagcctacggcgctctcacagaaaacgtcactcgcaaatacacccgtcagattctcgagggagtacactatctacatagcaatatgatcgttcatcgggacattaagggagcaaatatcctgcgagatagcaccggcaacgtgaagctgggagactttggggcttctaaacgcctccagactatctgtctgtccggtaccggcatgaaatctgtgaccggcaccccatattggatgagcccggaggtaattagcggcgaaggatatggtcggaaggccgatatatggtcggtggcatgtacagtggtggaaatgctcacagagaaacctccatgggccgaattcgaagcaatggcagccatcttcaaaatagctacacagcctacaaacccaaaattgccccctcacgtttccgattacactcgggatttcctcaaaaggatctttgtcgaagccaagctcaggccaagcgcagatgaactgctcaggcacatgtttgtgcattatcattag

SEQ ID NO: 28365 - DNA, 828 bp, Artificial Sequence
  Description of Artificial Sequence: Synthetic coding sequence
atgtccacaatcggttcttttgagggattccaggctgtgtctcttaagcaagagggggacgatcagcccagcgagacagatcatctgagtatggaagaagaagatcctatgcccaggcagattagcaggcagtctagcgtgaccgagagcacgctgtacccaaatccatatcatcagccatacataagccgtaaatatttcgccacacggcctggtgcaattgaaactgctatggaagacctcaagggtcatgtagcagaaactagcggcgaaacaattcagggcttctggctgttaacaaagatcgaccactggaataacgaaaaggagagaattctgctagtgactgacaagactctgcttatctgtaagtatgatttcatcatgttatcatgtgtgcagctgcagcggatacccctatcagctgtctacagaatctgcctcgggaagttcaccttccctggaatgtccctggacaagagacagggcgagggactgaggatttattggggttctcccgaagagcagtctctgcttagcagatggaatccgtggtctacggaggtgccatatgctacatttacagagcacccgatgaagtataccagtgaaaagtttttagaaatctgcaagttgtctggtttcatgtccaaactggttcccgcaatccaaaacgcacataagaactctactggctccgggagggggaagaagttaatggtgttgaccgagcccatcctaatcgagacctacaccggcctcatgtctttcattggcaaccggaataaactcggatacagcttggcaaggggatccatcgggttttag

SEQ ID NO: 28366 - DNA, 1629 bp, Artificial Sequence
  Description of Artificial Sequence: Synthetic coding sequence
atggctgcagctgcaggcgcagcggctgccccaggttctcgcgagccccaggacagacctgagtgcggtgcagggcatccaggacccagatattacagacatcctgagaggtggctgttacggcctgaggccttcctagggcctctgcggacgagggcgccatcagccgaagacagccaacgcgagagacccgcagccagatcaggtcctgcaatgtctcgaagagtcgtgcgccaatcaaagtttcgacacgtttttggacaggccgctaaggccgaccaggcatatgaggacattcgcgtgagtaaggtaacttgggactccagcttttgtgccgttaatcctaaatttcttgcaattatcgtagaagctggaggaggtggcgcatttatagttctccctcttgctaagactggcagagtggacaaaaactaccccctggttactggccacaccgccccagtgctggacatagactggtgtcctcacaatgacaacgtgatagcctctgcctcggacgataccaccatcatggtatggcagatccctgattacacccccatgaggaatattacggaacccattattacgctggaaggccactctaaaagagtgggcattctgtcttggcacccaacagctcggaacgtcctgctatccgcaggcggtgacaacgtaatcatcatttggaatgtgggcactggagaggtgcttctgtctctggatgacatgcaccccgatgtgatccacagcgtgtgctggaactcaaacggttctctgctagccacaacttgtaaggataagacattacgaatcatcgatccccgaaagggacaggtcgtggctgagagatttgcggcacacgagggcatgagaccaatgagagctgtcttcactcggcaaggacacatcttcactaccggattcacacggatgtcacagcgagagctcggactctgggatccaaacaatttcgaagagccagtcgcacttcaggaaatggacacttccaatggggtgctgctgcctttttatgacccagattcctccattgtgtacctatgtggcaaaggggattctagcattagatatttcgaaatcactgacgagccaccttttgttcactatctcaatacttttagttctaaagaacctcaaagggggatgggtttcatgcctaaaagaggtctggacgtctctaagtgcgaaattgcaagattctataagctccacgaaagaaaatgtgagccaatcattatgacagtgccaaggaagagcgatctgtttcaggatgatctgtaccccgataccccaggccctgaaccggctctggaggctgacgaatggctgagcggtcaggatgcagaacctgtgctaatttcccttcgggatggatatgttccaccaaagcaccgagagctgcgggtcacaaaaagaaacatacttgatgtacgaccgccaagtggacctcgccgaagtcagagcgctagcgacgccccactgagccagcacactctggaaaccctattggaggaaatcaaggccctgagagagagagttcaggctcaggagcagagaattacagccctcgagaacatgctttgtgagctggtggatggaactgattag

SEQ ID NO: 28367 - DNA, 2550 bp, Artificial Sequence
  Description of Artificial Sequence: Synthetic coding sequence
atgtctgatactaggagaagagtaaaggtgtatacattaaatgaagacaggcagtgggatgataggggcaccggacacgtgtccagcacatacgtggaggagctgaagggaatgtctctgttggtgagggccgaatccgacggatccctgctgcttgagtcgaaaatcaacccaaataccgcatatcagaaacagcaggatacccttattgtgtggagcgaggccgagaattacgacctggcactgagctttcaggaaaaggccggttgtgatgagatatgggagaaaatctgtcaggtacagggcaaagatccctcagtcgaggtcactcaggatctgatcgatgaaagcgaggaggaaaggttcgaggaaatgcctgagacttcccatctgatcgacctacccacatgcgaacttaacaagcttgaagaaattgcagatctcgtaacaagtgtgctcagtagccccatacggcgagagaaactcgcgcttgccctggagaacgagggatacatcaagaaactgctgcagctgtttcaggcctgcgaaaacttggaaaatacagaaggtctccaccatttatatgagataatccgcggaatcctgttcctcaacaaggcaaccctcttcgaggtgatgttctccgacgagtgtatcatggatgtggtggggtgcctggaatacgacccagcactggcgcagcccaaacgacatagagagttcctgaccaaaactgctaagtttaaagaagtcattccgataacggacagcgaattgcgacagaagattcatcaaacgtacagagtgcagtacattcaggacatcattctgcccactccttccgtgtttgaagaaaattttctgagtactcttacatcttttattttttttaacaaagtagagatcgtttctatgctccaagaggacgagaagtttctgtccgaagtgtttgctcagctgacagacgaggctacggacgatgacaagagaagagagttagtcaattttttcaaagagttttgcgcgttttcgcaaacactgcaaccccagaatcgagatgcgttcttcaaaactctcgcaaagctggggatattgccagccctcgaaattgttatggggatggacgacctacaagtgcgcagcgccgctacagacattttttcgtatttggtagaattcagcccaagcatggtccgtgagtttgtaatgcaagaagcccaacagagtgatgacgacatactgctaatcaatgtggtgatcgaacagatgatatgcgacacagatcctgagctggggggagcagtacagctgatgggtctcctccggaccctgatcgaccccgagaatatgctggctacgaccaataagaccgagaaatccgagtttctcaatttcttctacaatcattgcatgcacgtgctcaccgcacctctgctcacgaatactagcgaagataaatgcgagaaggatttttttctcaagcactaccggtacagctggtcctttatttgcacgccatctcattctcactctcattctacaccctcttcctccatcagccaggacaacattgtggggtccaacaaaaataataccatctgtcccgacaattaccagacagctcaactcctggccctgatcctggaactactgacgttctgtgtggaacatcatacataccatattaagaactatataatgaataaggatctcctgcgccgagtgctggtgctgatgaattcaaagcatacttttctggcgttgtgtgcactaaggtttatgcgcaggatcattgggcttaaggatgagttctacaatagatatatcacgaaaggcaatctgtttgaacccgtcatcaatgcacttctcgataatggtacccgctataacttgctgaacagtgccgttattgaactctttgaattcattagggttgaggacattaaatccctaaccgcgcacatcgtcgagaatttttacaaggctttagaatccattgagtatgttcagacgttcaaagggctcaagaccaagtacgaacaggaaaaagaccgacagaaccaaaaactaaatagcgtcccgtcgatccttagaagcaatcggtttaggcgcgacgccaaggcactggaagaggacgaggagatgtggttcaatgaggacgaggaagaagaaggtaaagccgtggtcgcccctgtggaaaagcccaaacctgaggatgactttccagataattatgaaaaatttatggaaacaaagaaggctaaggagtctgaggataaagagaacctgcccaaaagaacatccccaggcggtttcaagttcacattcagtcactccgcttccgcagcgaacggcactaactctaaatccgtcgtggcacagatccctccggctacgtctaacggatcatcaagcaagacaacaaacctgcctacgagtgtgactgcgaccaaaggcagtctggtcggactggttgactacccagacgatgaagaggaagatgaggaggaggagagttcgcccagaaaacgccctcgactcgggtcttag

SEQ ID NO: 28368 - DNA, 669 bp, Artificial Sequence
  Description of Artificial Sequence: Synthetic coding sequence
atgggtgacattcctgccgtgggtctctctagttggaaggcatctccaggcaaagtcactgaagccgttaaggaggctatcgacgcgggttatagacactttgattgtgcgtatttttatcataatgagagggaggtgggcgctggaatcaggtgcaagatcaaagaaggcgcagtgcggagggaagaccttttcatcgccactaaactgtggtgtacctgccacaaaaagagtctggtggaaaccgcatgtaggaagtccctgaaagccctcaaactcaattatctagacctctacctcatccactggccaatggggtttaaaccacctcatccggagtggattatgtcctgcagcgaactctctttctgtctgtcacaccctcgagttcaggacctgcccttggatgaatccaatatggtaattccatccgacactgatttcctggacacttgggagatcctgatcaggtttcagatccaacgcaacgttatagtgattcctgggtcaattaccccctcccatatcaaggagaacatccaggttttcgacttcgagctaacacagcatgatatggacaacatactgtcccttaaccgaaatctaaggctcgctatgtttcccataaccaagaaccataaggactaccctttccacatagaatactag

SEQ ID NO: 28369 - DNA, 1080 bp, Artificial Sequence
  Description of Artificial Sequence: Synthetic coding sequence
atgcctaatccaagctcaacctcaagcccatatcctctgcccgaggaaattcgcaacctgttggctgatgtcgaaactttcgtcgcagacatcttgaaaggggagaatctgtcaaagaaggctaaggaaaaacgagagagcttaattaagaagatcaaggatgtgaagagcatctacttgcaggaattccaggacaaaggggacgctgaagatggggaagagtacgatgatccattcgcaggtccacccgacacaatatccctagccagcgaacggtacgacaaagacgatgaggccccatccgacggggcacagttcccgcctattgccgcacaagatttgccctttgtcctcaaggccggttacttggaaaaacggagaaaagaccattcattcttggggttcgaatggcagaagcggtggtgcgccctcagcaagacagtgttttactattatgggtccgacaaagacaagcagcagaaaggggagtttgccatcgacggatattctgtgaggatgaataacaccctccgcaaagatggtaagaaggactgttgctttgaaatctctgccccagacaagagaatataccagtttaccgcagcctctcccaaggacgccgaggagtgggtgcagcagctgaagttcgtgcttcaagatatggagagcgatataataccggaagattatgacgaacgaggcgaattgtacgacgatgtcgaccatcccctccccatttctaatccactgacctccagtcagccaattgacgatgagatatacgaggagcttcctgaggaagaggaggactcagcccctgtgaaggttgaagaacagcggaaaatgagtcaggatagcgtgcatcacacctccggcgacaaaagtacagattacgccaacttttatcaaggcctgtgggattgcacaggggctttcagcgacgagttgtctttcaagaggggagatgtgatatatattctgtctaaagaatataaccgctacggttggtgggtcggtgagatgaagggagctataggactcgtccccaaggcatacataatggaaatgtatgacatttag

SEQ ID NO: 28370 - DNA, 1227 bp, Artificial Sequence
  Description of Artificial Sequence: Synthetic coding sequence
atgaagtgtgagcactgcacacgaaaagaatgtagcaaaaagaccaagaccgatgatcaggagaacgttagcgccgatgcaccctcaccagctcaggaaaatggagagaaatgcgacaccagcaaacacaaggtgctcgtggtgagcgtgtgcccacaaagtcttccctacttcgccgcaaaattcaacctttcagtaacagacgcgtccagaaggctgtgcggtttcctgaagagcttgggggtgcactatgtgtttgacaccacaatcgccgcagacttctcgattctagagagccaaaaagaattcgtcaggaggtaccggcagcacagcgaggaggaacgcacattacctatgctcacctctgcgtgtccaggctgggtgagatacgccgaaagggtactgggtcggcctataactgcccacctatgtacagccaagagcccgcagcaagtgatgggctcactcgtgaaggactatttcgctcggcagcaaaacctcagtcccgagaagatttttcatgtgattgtcgcgccttgctacgataagaagctcgaagccctgcaagaatcactgccaccggctttgcatgggtcccgaggcgctgactgtgttctaacatctggcgagatcgcacagattatggagcagggcgatctgtctgtccgggacgctgcggtggataccctgtttggggacctgaaagaagataaggtgacccgtcatgatggtgcttcaagcgacggacacctggcccatatctttcggcatgccgcaaaggaacttttcaatgaggatgtggaggaagtcacctacagggcattgcgcaacaaagattttcaagaggtgacactcgagaagaacggcgaggtcgtcctgcggtttgcggctgcctacgggttccggaatatccagaatatgatccttaaattgaagaaaggcaagttcccattccattttgtggaggtgttggcgtgcgcaggcggatgtctgaatggcagaggccaggcccagactcccgatggccacgctgacaaagccctcctgaggcagatggagggtatttatgccgatattccagtgcgccgacccgaatcctccgctcatgtccaagagctctatcaggagtggttggagggcattaattcacccaaggctagagaggtgctccatacaacatatcagagccaggagaggggtacccactccctggatattaagtggtag

SEQ ID NO: 28371 - DNA, 1104 bp, Artificial Sequence
  Description of Artificial Sequence: Synthetic coding sequence
atggccctcaatgttgccccagtcagggataccaaatggctgaccctcgaagtgtgcagacaattccagcggggtacgtgtagtcgcagcgacgaggaatgcaagttcgcccatccccctaagtcttgccaggtcgaaaatggccgtgtgattgcgtgctttgatagtctgaaggggaggtgtagtcgggagaattgtaaatacctgcatccacctacacaccttaaaacacaactggagatcaacggcaggaataacctgattcaacagaaaacagctgctgccatgttagctcagcagatgcaattcatgtttcctgggacacctctacaccccgttcccacgtttcctgttggcccagccattgggactaataccgcaatcagctttgccccttacctggcgccagttacccctggagtggggctagtgcctaccgaaatattacctacgactcctgttatcgtacctggctctccacccgtcacagtgcccggtagcactgctacccaaaagctgctccggaccgataaattagaagtgtgcagggaatttcagcgcggaaactgcgcccgaggcgagactgactgtagattcgctcacccagcagatagcactatgatcgatacctccgacaacacggtgaccgtatgtatggattacatcaagggccgttgtatgagagagaagtgcaaatacttccaccctccagcacatttacaggcaaaaatcaaagccgctcagcatcaggcgaaccaggcagcagtggccgcacaagccgctgctgctgctgctactgtgatggcatttccacccggagccttgcatcctctgcctaagcggcaagcgctcgaaaagtccaacgggacgagcgctgtcttcaacccaagtgtgctgcactaccaacaggccctgacctcagcacagttacagcagcacgccgctttcatccccactggctccgtgctgtgtatgacccccgctaccagcatcgtgcccatgatgcactcagcaacctctgcgactgttagcgctgctaccacccctgcaacgtcggtaccatttgctgccactgccactgccaaccagatcatcctgaaatag

SEQ ID NO: 28372 - DNA, 3909 bp, Artificial Sequence
  Description of Artificial Sequence: Synthetic coding sequence
atggcccttaggcctggcgctgggagcggaggcggtggtgctgccggtgcaggtgctgggagtgctggaggtggaggattcatgtttccggtcgctggtgggatccggccacctcaggcaggcctgatgccaatgcaacaacaggggttccccatggtgtctgtgatgcagcccaatatgcaggggatcatgggtatgaattacagttctcaaatgtcccagggcccaatcgctatgcaggccggtatccccatgggacctatgcccgcagccggaatgccgtatctcggacaggcaccttttctgggcatgcgaccccctggtccacaatatacacccgatatgcagaaacaattcgcagaggagcagcagaaaagatttgagcagcaacagaaattgctcgaggaggagcggaagaggcgacagttcgaggagcagaaacaaaaacttcgcctgctttcctctgtaaagcccaagaccggtgaaaaatctagagatgatgcgttggaggccattaagggaaacctcgatgggttttcaagagatgcgaagatgcaccctacacctgccagtcaccccaaaaaaccaggccctagccttgaggaaaagttcctggtgagctgcgacatttccacaagcggtcaggaacagattaagttgaataccagcgaggtgggccataaggctcttgggcctgggtcctccaagaaatatccatctttgatggcatctaatggcgtggccgtggacggttgcgtgagtggaaccacaacagcagaagccgaaaacacgtcagatcaaaacctgagcattgaggagagcggggtcggagtgttccctagtcaagaccccgctcaaccgagaatgccaccgtggatttacaatgagtctctggtgcccgatgcatacaagaagattttagaaaccacgatgacccctaccggaatcgacacagctaagctataccctattcttatgtcgtcgggcttacccagggagaccctaggccagatttgggccctcgccaatcggaccacccctggtaaactgaccaaggaagaactgtacactgtcctcgctatgattgctgtcacccagcgaggtgtgcccgcaatgtcccctgatgctctaaaccagtttcccgctgctcctattccaactctcagcggcttcagcatgaccctgccaacacccgtttcccagcccactgtgataccttccgggccagctgggagcatgcctctgtcccttggccaaccagtaatgggcatcaacctggttgggcctgtcgggggtgccgctgcccaggcgtcttctgggtttatccccacatacccagccaatcaggtcgtcaagccagaggaggatgactttcaggattttcaggatgcgtctaaatccggttccctagatgatagcttttcggacttccaggaactgcccgcatcttccaagacctcgaattcccagcacggcaatagcgccccttcactgctgatgccgctcccaggcacaaaagcattaccaagcatggacaagtatgcagtgtttaagggaattgcagccgacaagtcaagtgaaaatacggtccctccaggtgaccctggtgataaatacagtgccttcagagaactggagcaaaccgcagaaaataaacctttgggcgagtccttcgcagaatttagaagcgccggaactgacgacggattcaccgattttaaaaccgctgacagcgtaagcccactcgagccaccaaccaaggataagaccttccccccaagttttccttctggtaccatccagcagaagcagcagactcaggtcaagaacccgctcaatctggcagatctcgatatgttttctagcgtgaattgctcatctgagaagcccctatctttctccgccgttttttcaacttctaagagcgtgtccaccccccagagcacagggtcagccgctacaatgacagctctcgccgctactaaaacctcttctcttgcggatgatttcggggaattctccctgtttggcgagtattctgggctcgcgcctgtgggcgaacaagatgacttcgcagactttatggccttctccaatagctccatttcctctgaacagaaacccgacgataagtatgatgccctcaaggaggaggcctccccggttcccttgacaagcaatgtcggctcaactgttaaaggtggtcagaattcgaccgcggcaagcactaagtacgatgtatttaggcagctgagtttagaggggagtggcctgggcgtggaggatctgaaggacaacacgccatcggggaaaagcgatgacgatttcgcagatttccattcttctaagttctccagtataaacagtgataaatctctaggtgaaaaagctgtcgcttttcgccacacaaaagaagattccgccagtgtgaagtcgttggatcttccatccatcgggggaagctctgttggaaaggaagactcagaagacgccttatctgtccagtttgacatgaaactagctgacgtcgggggagacctcaagcatgtgatgtctgattcatctctcgaccttccaacagtttccggtcaacatcccccagcagcggatatcgaagacctcaagtatgctgcctttggtagttactccagtaactttgccgtcagcaccctgacctcttatgactggagcgatcgtgacgatgcaacacagggcagaaaactgagcccatttgtcctttcagcaggttcaggcagtcccagcgccacctccattttgcagaagaaggagacaagcttcggtagtagtgaaaatattacgatgacctcactatcaaaggtgaccacattcgtgtccgaggatgccctgccagaaaccacctttccagcactggcctcttttaaggataccattccccaaacatccgagcagaaggagtacgaaaaccgagattacaaagacttcaccaaacaggacctgccaaccgcagaacgctctcaagaagcaacctgtcccagtcctgccagctccggtgctagtcaggaaactccaaacgaatgttccgacgacttcggtgagtttcagagtgagaagcctaagatttccaagtttgacttcctcgtagccacttcgcagagcaaaatgaagagtagtgaggagatgattaagtcagagctcgctacattcgacctatccgtccaaggcagccacaaacgcagcttgagcctcggcgacaaggagatctccaggtcttcgcctagccccgcactggaacagccctttcgcgatcggtcaaacaccctgaatgaaaagcctgcgttgcctgtgattagggataaatacaaagacctgacgggcgaggtagaggagaacgaaaggtacgcctacgagtggcaaagatgcttgggaagtgccttaaacgtgattaagaaagcaaatgacactttgaacggcatcagcagtagctcagtctgcaccgaagtcatccaatccgcgcaggggatggagtatctgctgggagttgtcgaggtttatcgggtcactaagagagtcgaactgggcatcaaagcaaccgcggtctgctccgagaagctacagcagctgttgaaggatatcgacaaagtatggaacaatctcatcggcttcatgagtctggccacattaacgcctgatgaaaatagtctggatttcagtagttgcatgttgcggccagggatcaaaaacgcccaggagcttgcctgtggtgtgtgcctcctgaatgtggacagtcgttctcgtgccttcaattcagaaacagatagcttcaagctggcgtatgggggtcaccaatatcacgcctcttgcgcaaatttttggataaactgtgtggagcccaagccacccggactggttttacctgacctgctctag

SEQ ID NO: 28373 - DNA, 1011 bp, Artificial Sequence
  Description of Artificial Sequence: Synthetic coding sequence
atggagtccgtcctttccaaatatgaggaccagattacaattttcacagactatcttgaggaatatccagacacagatgagctggtctggatccttgggaagcagcaccttctgaagactgagaaaagtaagctcttgtcagacatatctgcgagactgtggttcacttaccggaggaaattctctcccatagggggtacggggccttctagcgatgccggatggggctgtatgcttcggtgcggtcagatgatgctggcacaggctctgatctgccgccatctcggacgagattggagttgggagaaacagaaagaacaaccaaaggaatatcagcggattctgcaatgctttcttgatcggaaggactgctgttattcgattcaccagatggctcagatgggcgtaggcgaagggaagtctataggtgaatggtttggaccaaatacggtggctcaggtcctgaaaaagttggccttgttcgacgaatggaattcgctcgctgtctatgtgagcatggacaataccgtcgtgatcgaggatattaagaaaatgtgtcgagtcctgcccctttccgctgataccgccggagaccgacctcccgatagcctgacggctagcaatcaatcagacgaattaatttttcttgaccctcacaccactcagacctttgtcgacacggaggaaaacgggactgtgaacgatcagacatttcactgtctccagtctccacaacgcatgaacatcctgaacctcgacccaagcgtggcactcgggtttttttgcaaggaggaaaaggattttgataattggtgttccttagtgcagaaggaaatccttaaggaaaaccttcgcatgtttgagctcgtgcagaagcatcccagtcattggcctccttttgtccctcctgcaaagcccgaggtcaccactaccggcgcagagtttatcgatagcacggaacaacttgaagagtttgacctagaagaagacttcgaaatcttgtccgtttag

SEQ ID NO: 28374 - DNA, 3018 bp, Artificial Sequence
  Description of Artificial Sequence: Synthetic coding sequence
atgctgcgcaccgccggacgcgatggactgtgtcgacttagtacatacttggaggagttggaggcagtggaacttaagaaattcaaactgtacctgggaaccgcgacagaactaggcgagggcaagataccctgggggtcaatggaaaaggccggacctctagaaatggcgcaactcctgatcacccactttgggccagaggaggcttggagactggccctttcaaccttcgaacgaattaaccgaaaggacctctgggagcgaggacaacgtgaggacctagtaagagatactccacccggaggtccctctagccttggaaatcagagtacatgcttgctggaagtgagccttgtcaccccacggaaagacccccaggaaacttacagggactatgtgagacgcaagttccgccttatggaggatcggaatgctaggctcggcgagtgtgtaaacttgtcacaccgctataccaggctcttgctggtgaaggagcatagtaaccctatgcaggtccagcagcaactgcttgatacggggaggggacatgcgagaactgtaggacaccaagctagtcctatcaagattgaaaccctgtttgaaccggacgaggagcggccagaacccccacgtactgtggtcatgcagggcgctgccggaatcggaaaatccatgttagcccacaaggtgatgctagactgggcagatggtaagctgttccaggggagattcgattacctgttctacatcaactgccgtgaaatgaaccagtctgcgaccgagtgtagcatgcaggatctcatttttagctgttggcccgagcccagcgcaccactgcaggaactgattcgagtgcccgaacggctcctattcatcatcgatgggtttgacgaactcaaaccctccttccacgacccccaggggccttggtgcctctgttgggaggaaaagcgacctaccgagctgctactgaacagcctgattcggaagaagcttctgcctgagctttccctgctaataaccactcgcccaaccgccctggagaaacttcaccgtctgctggagcacccaagacatgttgaaatcctgggattttctgaagccgagcgtaaggagtacttctataaatattttcataacgctgagcaggctggacaagtatttaattatgttagagataatgagccactcttcactatgtgtttcgtccccctggtgtgttgggtcgtgtgcacatgcctgcaacagcagcttgagggtgggggattactgcgacagacatctcggaccacaacagccgtgtatatgctataccttctgagcctgatgcagccaaagcccggagcaccacgcctccagccgcctcccaaccagcgaggtctttgctctcttgcagccgacggactgtggaatcaaaaaatactcttcgaggaacaggacttgaggaagcatggactggatggcgaggacgtgtcagcttttcttaacatgaacatctttcagaaagacatcaattgcgagaggtactattctttcattcatctatcttttcaggagttcttcgccgctatgtattatatattagatgaaggggaaggcggagcagggccagatcaggacgtgacgaggctcctgacagaatatgctttttcagagaggtccttcttagcacttacttcccggttcctgtttggcctgctgaacgaggagacacgcagtcatctcgagaagtccctatgctggaaagtgagtcctcacatcaaaatggatctcctgcagtggatccaatccaaagcccaatctgacgggtccactctacagcagggaagcctggagtttttttcctgcctgtatgagatccaagaggaggaatttatacagcaggcgctgtcacatttccaagtgattgttgtttccaacatcgcaagcaaaatggagcacatggtaagctcgttttgccttaagaggtgccgcagtgcccaggtgctgcacctatatggcgcaacatactccgccgatggggaggatcgggcaaggtgcagcgccggagcccatactcttctggttcaactgcgccctgaaaggacagtgcttttggacgcttactcagagcatctggcggcagccctctgtacaaaccccaatctcatcgaattaagcttgtatcgcaatgccttaggctctcgcggtgtcaagctcttgtgtcaggggttgcgacaccctaactgtaaacttcagaacctgagattgaaaagatgtagaatctcatccagtgcttgcgaggatcttagtgcagcgcttatcgctaataaaaatctcacccgcatggatctgtctggaaatggtgtaggatttccaggaatgatgctgttgtgtgagggtcttcggcacccccagtgtaggctgcagatgattcagttgaggaagtgccagctggaaagcggggcatgtcaggaaatggcatcggtactggggactaacccgcaccttgtggagcttgacctgacaggaaacgcgttagaggacctggggttgaggcttctgtgccaaggactgaggcatcctgtatgcagactgagaacgctctggctcaagatttgtcgcctaaccgctgcagcttgtgacgagttggcctccaccctcagcgtaaaccagtcactgagagaactggacctgagccttaatgagttgggagaccttggcgtcttgcttctgtgtgagggcttgaggcaccctacctgtaagcttcagactttaagacttggcatttgtcggctgggatctgcggcatgtgagggccttagtgtggttttgcaggcaaatcacaacttgagagagctcgacctcagctttaacgatttgggcgattgggggctttggcttctggccgagggtctgcagcacccagcatgtcgtctccaaaaattatggcttttcggaatggatctgaacaaaatgactcactcacggctggcagccctgagagtcacaaaaccctacctagatataggctgctag

SEQ ID NO: 28375 - DNA, 618 bp, Artificial Sequence
  Description of Artificial Sequence: Synthetic coding sequence
atggtatcgagctgttgcggatccgtctgttcagatcaggggtgtggtctcgagacttgttgcaggcctagctgctgccagacaacttgctgcagaaccacatgttgtcgcccttcctgttgtgtctcgagctgctgtcgcccacagtgctgtcagtccgtgtgttgccagccaacctgctgtcgaccctcatgctgccctagctgctgccagacgacttgctgccgtactacctgctgtaggccttcgtgctgcgtgagcagctgctgtcgccctcagtgttgtcagtcggtgtgctgtcagcccacatgctgtcgcccatcctgctcgatttccagttgttgcagacctagctgctgcgtttcacggtgctgccgttcgcagtgctgccagtctgtctgctgtcaacccacctgctgtaggcctagctgctgcatatcctcttgttgcagaccaagctgctgtgaaagcagttgttgcagaccctgttgttgtcgcccttgttgttgcctgaggccggtgtgtgggagggtatcgtgccacacaacctgttacaggcctacttgcgttatctcaacctgcccaaggcctctctgttgtgcttccagctgttgttag

SEQ ID NO: 28376 - DNA, 573 bp, Artificial Sequence
  Description of Artificial Sequence: Synthetic coding sequence
atgcaatcatgtgaaagtagcggtgactcagctgacgatccgctctctcgcggtttgcgacggagagggcaaccccgagttgtggtcatcggggctggattggcgggtttggctgcggcaaaagctctccttgagcaggggttcactgatgtcactgttcttgaggcctctagtcacataggcggtcgggtacagtcggttaagctcggacatgctacttttgagcttggagcaacatggatccatggttcccatgggaacccaatctaccacttagcagaagccaatggattgttagaagagaccactgatggggagagatctgttgggagaatctctctgtactcgaaaaacggcgtggcctgctatctgaccaatcatggacggcgtattcctaaggacgtggtcgaggaattttctgatctgtacaatgaaccaatgcaggtgttgttttcaggagaggcgacacatagaaagtactacagtacaactcacggagcgctcctgagcgggcagcgtgaggctgcaaggttgattgaaatgtaccgggatcttttccaacaaggtacctag

SEQ ID NO: 28377 - DNA, 3945 bp, Artificial Sequence
  Description of Artificial Sequence: Synthetic coding sequence
atggctctcaggcccggagctggctccggtggtggtggggctgcgggtgcgggtgctggcagcgccggaggcggtggattcatgttccctgtggccggagggatcagaccccctcaagccggtctcatgccaatgcagcaacaggggttccccatggtcagtgttatgcagccgaatatgcaagggattatggggatgaactactctagccagatgagccaaggacccatcgcaatgcaggcaggaatcccgatgggccctatgccagcggctggcatgccatacctgggccaggccccattcctcggaatgcgtcctccgggaccacagtacaccccggacatgcagaagcagtttgcagaagaacagcagaaacgttttgagcagcagcagaaattgctcgaggaggagcgcaagcgtagacagttcgaggaacagaagcagaaactcagactactgagttccgtaaagcctaaaacaggcgagaagtctcgcgacgatgcactcgaagccattaagggaaatctggatggattttctcgggacgctaaaatgcatcctactccagccagtcaccccaaaaaacccggaccttccctcgaagagaaatttctcgtatcttgtgacattagtacaagcgggcaggaacagattaaactgaacacctctgaggttgggcacaaggcactgggccctggttcctcaaagaaatacccttcactcatggcctccaatggtgtggccgtggatggttgcgtcagtgggaccacaaccgccgaagcagagaatactagtgaccaaaatctttcaatcgaggagagcggggtgggggtttttcccagccaggacccggctcaaccaagaatgcccccatggatttataatgaatcacttgtgcctgatgcctacaaaaaaattctagagaccactatgacccccactggcatcgataccgcaaaactgtatccgattctgatgagttcggggcttcctagggaaactttagggcagatctgggccctagctaatagaaccactcctggcaaactcactaaggaggaactttacactgtgttggctatgatcgccgttacacagagaggagtgcctgccatgtctcctgacgccctgaaccaatttccagccgcaccaatccccaccctttctgggttttccatgacactgccaacccctgtgtctcagccgactgtgattccgagtggaccagctggttcaatgccactgtctctcggtcagccagtgatgggcattaacttggtgggacctgtgggtggcgcagccgctcaggcatcgagtggcttcattcccacctaccctgcaaatcaggtggtgaaacccgaagaagatgacttccaggacttccaagacgcctccaaaagcggatcactagacgatagtttcagcgacttccaggaattaccagcgtccagcaaaacaagcaattctcagcacgggaattcagccccatctctattgatgcccctcccgggtacgaaagctctgccctcaatggataaatatgcggtttttaagggtatcgcggctgataagtcgtccgaaaacaccgttcctcccggagacccaggcgataaatatagcgcattcagagaactagaacagaccgcagagaataaaccactgggggagtcattcgccgagtttagaagtgctggcacagacgacggatttaccgatttcaagacagccgacagcgtgtcccccctcgagccgcctacaaaggataagacatttccgccttcattcccctctggcaccatccagcaaaagcaacagactcaggtgaagaatcccctgaacttagctgacctggacatgttttcaagtgttaactgctcatccgaaaagccactgtcgttctcggccgtcttcagcacttccaagtcggtatcaacgcctcagtcaaccggttccgccgcaacaatgactgcactggcggctaccaagacgtcctccctcgccgatgacttcggagagttttctctgttcggagagtactccggtctagcccctgtgggggaacaggacgactttgctgacttcatggccttttcaaactccagcatatcctccgaacagaaacctgatgacaagtatgacgcactcaaggaagaagcctcccctgtgcctttgacgtcgaacgttggtagtactgttaaggggggacaaaattccactgctgcatcaacaaaatacgacgtgtttaggcagctgagtctggagggttcaggactcggcgtagaagatttaaaagataatacaccctctggtaagagcgacgatgactttgccgacttccactcctccaagttctcttcgatcaatagtgataagtcacttggcgaaaaggcggtcgccttcagacataccaaggaggactcagcgtcagtgaaatccctcgatctccccagtatcggaggatcgtccgtgggaaaggaggactctgaagacgcattatctgtgcagttcgacatgaaactcgctgacgtggggggagacctgaagcatgtgatgtccgacagtagtttagacctgcctacagtctcaggccagcatccccctgcggcagacatagaggacctgaagtacgccgctttcggtagctatagttccaacttcgccgtgagcacacttaccagctacgactggagtgaccgcgatgacgcaacacaggggcgaaagctatctccctttgtcctctctgcagggtccggttcccccagtgcgacgagtatccttcaaaaaaaggagacatcctttggtagcagcgagaacataactatgactagtctaagcaaggtgacgaccttcgtgtcagaagacgcgctacctgagactacattcccggctctggcctctttcaaggatactattccccagacttcggagcagaaagagtatgaaaaccgcgactataaagattttaccaagcaggacctgcccactgctgaaagaagccaggaggcgacatgcccctctccagcctccagcggagcctctcaagagaccccaaacgagtgcagcgatgattttggcgaattccagtccgagaaacctaaaatcagcaaatttgactttctggtggccactagccagtccaagatgaagtccagcgaggagatgatcaaatccgaactggctactttcgatctgtcagtccaaggatctcacaagagaagcctgagcctaggcgataaggagatttcacggtcgtccccctcacccgcactggagcagccctttcgggatcggtcaaacacattaaatgaaaagcctgcgctccctgtgatacgcgacaaatacaaggacctcaccggcgaagttgaggagaacgagaggtacgcttacgaatggcagagatgcctggggtctgcccttaacgtgataaaaaaagccaatgatacgctcaatgggatatcttccagcagcgtctgtacggaggtcatacagagcgcccaaggtatggagtacctgctgggggtggtagaggtttatagggtgaccaagcgggtggagctgggcatcaaggcgacagccgtatgtagcgagaagctccagcagctcctcaaggatattgataaggtctggaataatctgattgggttcatgtcattggcaacgctgactcctgatgagaatagtctagactttagcagctgtatgctgaggccaggaatcaagaacgcccaagagctcgcatgcggagtgtgtctgcttaatgtggatagccggagtcgaaaggaagagaaaccggctgaagaacatccgaagaaagcatttaacagcgagacggattctttcaagctggcgtacggcggacatcagtaccacgcatcctgcgccaacttttggataaactgtgtcgaacctaaaccacccggtctcgtgttacctgacctactttag

SEQ ID NO: 28378 - DNA, 531 bp, Artificial Sequence
  Description of Artificial Sequence: Synthetic coding sequence
atgagtgatgatgactctagagcctctacgtcgtcctcctctagtagctcctcgaatcaacagacagagaaggagactaacacaccaaagaagaaggagtctaaggtaagtatgtcaaagaattctaaactcttgagtactagtgcaaagtccgctggtccaaagggggataacatttacgaatggagatccacaatattggggcctcccggatctgtgtatgaaggcggagtgttttttctcgacataacctttacgcctgagtacccctttaagcccccaaaggtgacctttcgcacccggatataccattgtaatatcaacagccagggcgtcatctgtctggatatcctgaaggataattggagtccagcacttacaatttctaaagtgctgctatctatctgctctctccttactgattgcaaccccgcagatccactggtggggtccatcgctacgcagtacatgacgaacagagctgaacacgatcgcatggctaggcagtggacaaaacggtacgccacctag

SEQ ID NO: 28379 - DNA, 7028 bp, Artificial Sequence
  Description of Artificial Sequence: Synthetic coding sequence
atggacggcgtgtcatcagaggccaacgaggaaaatgacaacatcgaacgtcctgtacggcgaaggcattcatcaatactgaaaccacctagaagccccctccaggacctgcgaggcggtaatgaaagggtgcaagagtctaacgccctgcggaacaaaaaaaactcaagacgggtgtctttcgcggacacaatcaaggttttccagactgaatcccatatgaagattgtcaggaagtctgaaatggaggggtgctccgctatggtgccatcgcagttacagttgctgccccctggattcaaacggttctcttgtctgtccttaccagagacagagaccggagagaacctcctgcttatacaaaataagaaacttgaagataactattgtgagataactgggatgaacaccctgttgtccgctccaattcacacccagatgcagcaaaaggagttctccatcatcgaacatacccgagaacgcaagcacgcaaacgatcaaactgtaatctttagtgatgagaatcagatggacttgacaagttcccacacagttatgattaccaaaggcctgctggacaacccaattagcgagaaatccacaaaaatagatacaacttctttccttgcaaacctaaagctgcacacggaagactctaggatgaaaaaggaagtgaatttctcagtggaccagaatacctcctcagaaaacaaaattgacttcaacgacttcatcaagagactgaaaacaggtaagtgttctgcattccccgacgtcccagataaggagaattttgagatacccatctattccaaggaaccaaacagtgcctcaagtactcatcagatgcacgtgtcactgaaggaggatgagaataacagtaatataacacgcctctttcgcgaaaaggacgatgggatgaactttacgcaatgtcatacggccaacattcagactctgatccccacatcatccgagaccaactcacgtgaatctaaggggaacgatattactatctacggcaacgatttcatggacctgaccttcaaccacacactgcaaatcctgccggctaccggaaatttttcagagatagaaaaccagacacagaacgccatggacgtgactactggctacggcactaaggcatctgggaataagacggtgtttaagagtaagcaaaacactgcctttcaggatctgagcatcaacagtgctgataaaatccatatcacaagatcgcacatcatgggagctgagacccatattgtatctcaaacatgcaaccaggacgccagaattttagccatgacgcctgagagcatttattcaaatcctagcatccaggggtgcaaaacagttttctatagctcctgcaacgatgcgatggaaatgactaagtgtctgtctaatatgagggaggaaaagaaccttttgaagcatgacagtaattatgcaaaaatgtattgcaatcctgacgctatgtcgagcctgacagaaaagactatctacagcggagaagagaacatggatatcacgaagtctcataccgtcgccattgacaatcagatattcaaacaggatcagtccaatgtccagatcgccgctgctcccacccccgaaaaggagatgatgctccagaatttaatgacgacatctgaggatggaaagatgaacgtgaattgcaactcggtaccccatgtttcgaaagagcgcattcagcaaagcctgagtaatccactatccattagcctcacagaccgcaaaaccgaacttctctccggcgaaaatatggatctgaccgaaagccacacaagtaacctgggtagccaagtgcccctggccgcatacaaccttgcgccagaatctacttccgagtctcattctcagagcaagagcagctcagacgaatgcgaggaaattaccaagagccgcaacgagccattccagcggtcagatataatcgccaaaaactctctaacggacacctggaataaagataaagattgggtgctcaagatcctgccttatttggacaaggactctccacaatcagccgattgcaatcaagagatcgctacatctcacaacattgtctattgcggcggagtgctggataagcagatcaccaatagaaacacagtgagttgggaacagagtttattttcaacaactaaaccgctgttctcaagcggccagttctctatgaagaatcatgacaccgctatcagctcacataccgttaaaagtgtgctcggccagaactctaagctggcagagccgttgcggaagagcctgagcaatcccaccccagactactgtcatgacaaaatgatcatttgcagtgaggaggagcagaatatggatttgacaaagtcccataccgtggtgattggctttggcccaagtgagctgcaggagctcggcaagacaaacttggaacacactactggccaacttacaactatgaatcggcaaatagcggttaaagtggagaaatgcggcaagtctcccatagaaaagagcggagtgcttaaatccaattgcataatggatgttctggaggacgagtcggtccagaaaccaaagttccccaaagaaaagcagaacgtcaagatttgggggcgtaaatcagtgggaggccctaaaatcgacaagacaatcgtgtttagcgaagacgataaaaatgacatggacattacaaagtcttacactatcgaaattaatcaccgcccattgctggagaaaagagactgccacctggtgcctctcgccggaaccagtgaaactatcttgtatacctgccgacaggatgatatggagattacaaggtcacacactactgctttggagtgcaagacagtttctcctgatgagatcaccacccgacccatggacaagacagtggtctttgttgataaccacgtggaactggaaatgacagaaagtcacactgtatttattgactatcaggagaaggagcggaccgataggcccaacttcgagctgtctcagagaaaaagtctgggcactcccacggttatatgtacacccaccgaggagagcgtgttctttccgggaaacggcgagtccgaccgcttagttgctaacgatagccagctcacacccttggaggaatggtctaataacaggggccctgtcgaggtcgcagataacatggagttgagcaaatcagccacctgcaagaacatcaaagacgtgcaaagcccgggattcctgaatgaacctctgagctccaagagtcagcggaggaagtcccttaaattaaagaatgacaaaaccattgtattcagtgaaaaccataaaaacgatatggacattacacagagctgcatggtcgagattgacaatgagagcgccctggaagacaaagaagatttccatcttgctggagccagtaaaacaattctctactcttgcggacaggatgatatggaaatcaccaggtctcacactaccgctctcgaatgcaagacactgcttcccaatgaaatcgccatccggccaatggataagactgtgctgtttactgacaattactcagacttagaggtcactgactcccataccgtttttattgactgtcaggctaccgagaagatacttgaggagaatcctaagtttggcataggcaaggggaagaatttgggcgtgagtttccctaaagataattcatgtgtgcaggagattgcagagaagcaggcactggcagtgggcaacaaaatcgtgctgcacaccgagcagaagcagcagctcttcgctgccaccaataggactaccaatgagattatcaaatttcattcggctgccatggatgaaaaggtgatcggcaaggtagtggaccaggcttgtacactcgagaaagcacaggtcgagtcatgtcagctcaataatagagaccggagaaatgtggactttactagctcccacgcgactgctgtatgcggttcgtccgacaactacagctgcctgcctaatgttatttcctgcacagataacctggaaggctcagcaatgcttctgtgtgataaagacgaagagaaagccaactactgcccagtgcaaaatgatctggcttacgctaacgactttgcctcagagtactatttagagtcggagggtcagcccctctccgccccatgtcccctgctggaaaaggaggaggtgatacagacctctacaaaggggcagttagactgcgtcatcaccctgcacaaagaccaagatcttatcaaagacccacgaaatctactagctaatcagactcttgtatattcgcaggatctgggggagatgaccaaactgaactccaaaagagtctcatttaaacttccaaaagatcaaatgaaagtctacgtcgatgacatatacgtcattccccagccacacttctctacagaccaaccacctctgcccaagaagggccagtccagcattaataaagaagaggtgattttaagcaaagccggaaacaagtcacttaacattatcgagaacagcagcgctccgatctgcgagaataagcctaagatcttgaactcggaggagtggtttgccgctgcatgtaagaaagaattaaaagaaaacatacagactacaaactacaatacagcactagatttccactcaaattccgatgtgaccaaacaggttatacagactcacgtgaacgccggagaagcccctgacccagtaatcacgagcaatgttccctgttttcactctattaagcctaaccttaacaatctgaacggaaagactggggagtttctcgccttccaaacagtgcaccttccaccgctgccagaacaactcttggagctgggcaacaaagctcataatgatatgcatattgtgcaggccactgaaattcataatatcaacatcatttcatccaatgcaaaagacagccgtgatgaagaaaacaagaagtcacacaacggtgctgagaccaccagcttacccccaaagaccgtgttcaaggacaaggtacgacggtgctctttgggtatttttctccctcggctgccaaataagagaaactgtagcgtgacaggaatagatgatctcgaacagatccctgcagacactacggatatcaatcatctagagacacagccagtctccagtaaggattctggcatcggttctgtagccggaaagctgaacctgagcccatctcagtacattaacgaagagaatctgccggtgtatccagatgagatcaattcatccgattccattaacattgagaccgaagagaaagccctgattgagacctaccagaaggaaatttccccctatgagaacaaaatgggaaaaacctgcaattcacagaaacggacctgggtacaggaggaggaagatatacacaaggagaaaaaaattaggaaaaacgaaatcaagttcagtgatacgacccaggatcgggaaatatttgatcaccacacggaggaggatattgacaaatctgctaattcggtcttgataaagaaccttagtcggacacccagctcatgttcttcctcacttgattccattaaggcggatgggacgtccctagactttagtacttatcgaagtagccaaatggagagtcagttcctccgagatacaatctgcgaagaaagtctgcgcgagaagctgcaagacggacggattacgatcagagagttttttatcctcttgcaggtgcacatcctgattcagaaacctcggcagagtaacctgcccggtaattttaccgtaaacaccccccctacaccagaagatctcatgctgtcacaatacgtgtataggcccaaaattcagatataccgagaagactgtgaagctcggaggcagaaaattgaagagcttaaactgagcgcttccaaccaggacaagctgttagtggacataaacaagaatttgtgggagaaaatgcgccactgctcagataaagagttgaaggctttcggtatttacctaaataaaatcaagtcttgcttcactaagatgaccaaggtctttacccaccaggggaaagttgcgctgtatggcaaattggtacagtcagctcagaatgagagagagaagcttcagattaagatcgatgagatggataaaatcctgaaaaagatcgataactgtctgacggagatggaaactgaaacgaaaaacctcgaagatgaggagaaaaacaatcctgtcgaggagtgggattcggagatgcgtgccgctgagaaggaactggaacagctgaagacggaggaggaagagttgcaacgaaacctcctggaactagaagtgcaaaaggagcagacgctcgcgcaaatagacttcatgcagaagcaaaggaatagaaccgaagaactgctcgatcaactgagtctaagtgagtgggatgttgttgaatggtccgatgaccaggccgtattcaccttcgtttacgacaccattcaactgacaattacatttgaggagagtgtcgtggggtttccatttctcgataaaagatacaggaaaattgtcgatgtgaactttcagagccttctggatgaggaccaggcacccccaagctccctgctagttcataaactgatctttcagtatgtcgaggaaaaggagtcatggaaaaaaacctgcactacgcaacatcagctgccgaaaatgctggaagagttttccctggtggttcaccattgtaggttactgggggaggagattgagtatcttaagaggtgggggcctaactacaacctaatgaatatcgacatcaataataacgaactgcgcctcctattctcttcaagcgcggcttttgccaaattcgaaataaccctgttcttaagtgcatattacccatctgtcccgttgccttctaccatccagaaccacgtcggcaatacatcgcaggatgatattgctactatactcagcaaggtgcccctggagaacaactacctgaaaaacgtggtgaagcagatctatcaggatctgtttcaggactgtcacttctatcatta

SEQ ID NO: 28380 - DNA, 1638 bp, Artificial Sequence
  Description of Artificial Sequence: Synthetic coding sequence
atgagttcctgtgtttcctctcaaccatcctctaatagagccgcacctcaggatgagctaggcggtagggggtcatcttctagcgagtctcagaagccatgcgaggctctaaggggtttgtcttcactctcaatccatctggggatggagagtttcattgtggtgacagaatgcgagcccggatgtgctgtggacctgggccttgccagggaccgccctctagaggctgatgggcaggaggttcccctggatacgtccggctcacaggccaggccccacctgagtggaaggaaattgtctttgcaggaacgctcacagggtggcctggcggcagggggttccttagacatgaacggccgttgtatctgtcccagtttgccgtatagccctgtgagttcaccccagtcctctcctagattaccaagacggccaaccgttgaatcccaccacgtgtcaattacaggaatgcaggactgcgtgcagttgaaccagtatactctgaaggatgagatcgggaagggctcttacggcgtagttaagctggcctacaatgagaacgataatacatactatgcgatgaaagtgcttagcaagaagaaattaataaggcaggcgggtttccctcggaggccccctccaagagggacccggccagcacccggagggtgtattcagccaagaggccctattgagcaggtttaccaggagattgccatcctgaaaaaactggaccacccaaacgtcgtcaagttggtggaagttcttgacgaccctaatgaagatcatttgtatatggtctttgaactggtgaaccaagggcctgtcatggaagtgcctactctcaaaccactgtctgaggatcaggctcggttctatttccaggacctcattaaggggattgaatacctgcattaccagaagatcatacacagagacattaagccgtccaatctgttggtcggcgaagacggccacattaagatagcagactttggcgtgtctaacgagttcaaaggaagcgacgcactgctcagtaatactgttgggactccagcttttatggcacctgaaagcctgtctgagacaaggaagatcttcagcggtaaggcgcttgacgtgtgggcaatgggggtgacactgtactgctttgttttcggccagtgtcccttcatggacgaaaggatcatgtgcctgcactcaaagattaaatcccaggctctagagtttccagaccaacccgacatcgcggaggacctgaaggatctgatcactcgaatgttagataagaaccctgagtcacggattgttgttcctgagatcaagatcctggtgaaaaccatgatccgaaagcggtcattcgggaatccctttgagggatccagacgagaggaacgttccctatctgcccctggaaacctgctgacaaaaaagcccactcgggagtgcgaatctcttagcgagctgaaggaggccaggcaaagacgtcaaccgcctggccacagacctgcccctcgcggtggagggggatcagcccttgtgcgcggatccccctgtgtcgaatcctgctgggcccctgctcctggttctcctgcacgtatgcacccgctgagacctgaggaagcgatggagcccgaatag

SEQ ID NO: 28381 - DNA, 333 bp, Artificial Sequence
  Description of Artificial Sequence: Synthetic coding sequence
atgccgaagcgctcctgtccatttgcagacgttgccccacttcagttaaaggttcgtgtgtctcagagagagctatctcggggtgtgtgcgcggagcgttactcccaagaagtgttcgatcctagcggcgttgctagcatcgcttgctctagttgtgtgcgggctgtggacggaaaagccgtttgtggacagtgcgagagggccctctgcggccaatgcgtacgcacatgctggggatgcggatcagtggcgtgcacgctttgtggtcttgtcgattgctctgacatgtacgaaaaggtcctctgcaccagttgtgcaatgttcgaaacatag

SEQ ID NO: 28382 - DNA, 2253 bp, Artificial Sequence
  Description of Artificial Sequence: Synthetic coding sequence
atggaggatctgtttgaaacattccaggatgagatgggctttagtaacatggaagacgatggcccagaggaggaggagcgtgttgcagagcctcaagctaacttcaataccccacaggccctgcggttcgaagaactcctggccaacctacttaacgaacagcaccagatcgccaaggaactgtttgagcagcttaagatgaagaaaccaagcgcgaagcaacagaaagaagtggagaaggtcaaaccacagtgcaaggaagttcaccagacgctcatccttgaccctgctcagagaaagcgcctgcagcaacaaatgcagcagcacgtgcagcttctgacacagattcacctgctcgccacgtgcaatcctaacctgaacccagaagcctccagcactcgaatatgtctcaaagaactgggcactttcgcccagagcagtattgcactgcaccaccaatacaatccgaaattccaaacgttattccagccttgtaacctgatgggcgcaatgcagcttatcgaagacttcagcacccatgtctctatagattgcagccctcacaaaactgtaaagaagacggcaaacgagttcccttgcctaccaaagcaggtagcgtggatcctcgccacatctaaagtcttcatgtaccctgagttactgcctgtgtgctctctcaaggccaagaacccacaggataagatcctgttcaccaaggccgaggataacctgcttgccttaggcctcaagcacttcgagggtactgagtttctgaaccccctgatttcaaaatatctgctgacatgtaagactgctcgacaactcacagttaggattaaaaatttgaacatgaatagagccccagacaatattatcaaattttataagaaaacaaagcagctgcccgttctcggcaagtgctgtgaggaaattcagccccatcaatggaagcccccaatagagcgtgaggagcacaggcttcctttctggctgaaggccagcctccccagcatacaggaagaactgcgccacatggctgacggcgctcgcgaggtggggaatatgaccggtaccaccgaaattaactccgaccaaggcctggagaaagataactctgagctcggttccgagactaggtaccccctcctgttgcctaagggcgtggtgctgaagctcaaaccagtagcggatcggttccctaagaaggcatggcgccagaaaaggtctagcgttctcaagccccttctgatccagcccagccctagtctacagccttcattcaacccgggtaagactccagcccagtccactcactctgaggcaccgccatctaagatggtcctgagaattcctcacccaatccagccagccaccgtactgcaaacggtgcccggagtgcccccactgggagtaagtggaggcgagagctttgagagccccgcagccctaccagccatgccccctgaggccagaacatccttcccattgtctgagtcccagacccttttgagtagcgcacctgtccctaaagtcatgatgcctagtccagcatccagcatgtttcgaaagccctacgtgcgccgacgtcctagcaagcgcagaggcgcaagagcctttaggtgcatcaaacctgcccctgttatccatccggcttccgtcatttttactgtccctgctaccaccgtgaaaattgtgtcactgggcggtggttgtaacatgatccagcccgttaacgccgctgtagcacaaagccctcagacaattccgatcgcgacacttctcgtcaacccaactagcttcccttgccctctcaaccagcctttggtggcttcctccgtcagccccctcatcgtctccggtaactcggttaacctcccaattccatctactcccgaggacaaggcccacatgaatgtagatattgcatgcgctgtagcggatggcgaaaatgccttccagggcctggagcccaagttggaaccccaagagctgtctcccctaagcgcgaccgtgttcccaaaggtagagcattctcctggaccacctcctgtggataagcagtgccaggagggcctcagcgaaaattcagcataccgttggacagtggtgaagacagaggaaggcagacaggccttggaacccctgccacagggtatacaagaatccctgaataactctagccccggagacctagaagaagttgtgaagatggaacccgaagacgccacagaggaaatatcgggattcctgtag

SEQ ID NO: 28383 - DNA, 2604 bp, Artificial Sequence
  Description of Artificial Sequence: Synthetic coding sequence
atgcaggctgaagccgcagactggttctccagtatgccttttcagaagcacgtatactacccacttgcctcgggccctgagggaccggacgtcgccgttgccgcagccgcagcaggtgcagccagcatggcctgtgccccacccagtgccgctagcggacccctccctttctttcaattccggcctcggcttgagagcgtggactggaggaggctgagtgctattgacgtcgataaagtggctggggctgtggatgtgctgaccctccaagagaatattatgaacatcactttctgtaaacttgaagacgagaaatgtcctcactgccaaagcggcgtcgacccggtgttgctaaagctgattcgcttagctcagtttaccattgaatatctgttacacagccaagagttcctgacatctcaactgcatacattggaagaacgtctcagactgagccactgcgacggagagcaaagtaagaaactgttgactaagcaggccggagagataaagactctaaaggaggagtgcaaaagacggaagaaaatgataagcacccagcagttgatgatcgaagctaaggctaattactaccagtgtcacttctgtgacaaggctttcatgaaccaagcattcctgcaaagccatatacagagaaggcacaccgaggagaattcgcatttcgagtatcagaagaacgcccagatcgaaaaactccggtccgagattgtcgtattaaaggaggagctccagttgacccgtagtgaactagaagccgcacatcacgcttccgcagtgcgattttcaaaggagtacgagatgcagaagactaaagaggaggactttctgaaactgttcgatagatggaaggaagaagaaaaggaaaagctggtcgatgagatggagaaggtcaaagaaatgtttatgaaggagtttaaggagctgaccagtaaaaacagtgcactggaataccagctgtccgagatccagaagtcaaatatgcagattaagtcaaacattggtacattaaaggacgctcacgagttcaaggaggaccgctccccatatccgcaggattttcataacgtgatgcagctgcttgatagtcaggaaagcaagtggaccgcacgagtccaggcgattcatcaggaacataaaaaggagaagggtagactgttgagccatatcgaaaaactccggaccagtatgatagacgacctgaatgcaagcaatgtattctataagaagcggatagaagaattgggacaaagactgcaggagcagaatgagctgattattacccagcggcagcaaattaaggattttacctgcaatccattaaattcaatctcagagccaaaaggcaaccctctcgcctggcaggcctttgaatcccagccagcagcacctgccgtgcccatgaatgctcccgcacttcatactctagaaactaagtctagtcttccaatggtgcacgaacaagccttttccagccacattctggaaccaattgaggagcttagcgaggaggaaaaagggagagaaaatgaacagaagctcaacaataacaaaatgcaccttaggaaggccctgaaatctaactcatccttaacaaaaggactgcgcactatggtggagcaaaatctgatggagaaactagaaacactgggaattaatgcagatattcggggaatcagtagtgatcagttacaccgtgtgctgaagtccgtagagtctgagaggcataagcaggagcgggagatcccaaacttccaccagatacgtgagttcctcgagcatcaggtcagttgtaagatcgaggagaaagcgcttctttcctctgatcaatgttctgtttcacagatggataccctttccactggcgaggtgcccaagatgattcagcttcccagtaaaaataggcagctgattaggcaaaaggccgtgtctacagaccgaacctccgtccccaagattaagaagaacgtgatggaggacccgttccccaggaaatccagcacaatcactacgcctccattctcttctgaggaggagcaagaggacgacgacctgatccgggcatacgcaagcccaggacctctgccagtgcccccacctcagaacaagggctccttcggaaaaaacaccgttaagtcagatgccgatgggactgagggtagcgaaatcgaagacacagacgatagcccaaagccagcaggcgtcgccgtgaagaccccaactgagaaggtggaaaagatgttcccccacagaaagaacgttaacaagcctgtggggggtaccaatgtgcccgagatgtttatcaagaaggaggagttacaggaattaaaatgtgcggatgttgaagacgaggactgggacatttcttctctggaagaggaaatttccctcggtaagaaatctggcaaagagcagaaagagccccctcctgcgaagaacgagcctcacttcgcccatgtactgaacgcctggggtgctttcaacccaaaaggaccaaaaggcgagggtctgcaggaaaatgagtcttctacactgaaatcttccctcgtgacagtaactgactggagtgacacgtccgacgtgtag

SEQ ID NO: 28384 - DNA, 1860 bp, Artificial Sequence
  Description of Artificial Sequence: Synthetic coding sequence
atgtctggtctcgtcttaggacagcgggacgagcccgctggacacagactgtctcaggaagagatactcgggtccacccgcttggtgtcccagggactggaagcactcaggtcagagcaccaggctgtccttcaaagcctgagccagacgattgaatgcctacagcagggtggtcatgaagagggcttggttcacgagaaagctcgacagctgagacgatccatggagaacattgagcttgggctcagtgaggcccaggtgatgctggcactggcttcccatcttagcaccgtggaaagcgaaaaacagaagttacgcgctcaagtacgtcgtctgtgtcaagagaatcagtggttacgcgacgaactagctggcactcagcaaaggctgcagaggtcagaacaagcagtcgcccagctcgaagaagagaaaaagcatcttgagttcctcggacagctccgccaatatgacgaggacggacacacatccgaagaaaaagagggcgatgctactaaggactcgctggatgacctgttcccgaacgaagaagaggaggacccatccaatggtttgagtagaggtcagggagccacggcggctcagcagggcggatacgaaattccagccagacttcggacgctccataacttggttattcagtatgcagcacagggccgatacgaagtggccgtgcccctgtgtaaacaggcattggaggacctggagcgtacttcaggaagaggccacccagatgtggccactatgctgaatatcctggccttggtctacagggatcaaaacaagtacaaagaagctgcccatcttcttaacgatgccctgtcaatccgcgagtctaccctgggacccgaccacccagccgtggcagccaccctgaataatttggccgtgctgtatggaaaacgtggtaaatacaaggaagccgagccactctgtcagcgggcactggagatcagggagaaggtgcttgggaccaaccaccctgatgtggcaaagcagctgaacaacctggccctcttatgccagaatcaaggcaaatatgaggcggtggagaggtactatcagcgcgcacttgctatttatgaaggtcaactaggccctgacaaccctaacgtagccaggacgaaaaataatctggcctcatgctatctgaaacagggtaagtacgccgaggccgagaccctctacaaagaaattttgaccagggcgcacgtccaggagttcggttcggtggacgacgaccataaaccaatttggatgcacgccgaggagcgggaggagatgtcgaaatcccggcaccacgaaggcggaacgccatacgcggagtacggagggtggtataaagcctgtaaggtctctagccccaccgttaacactaccctccgaaacctgggggcattatatcgcagacaaggaaagctggaggccgctgaaaccctagaggaatgtgccctccgaagccggagacaggggactgatcccatctcccagaccaaagtcgccgaactcctcggcgagagcgacggtcgcaggacatcccaggagggcccaggggattccgttaagtttgagggtggcgaagacgcgtctgtggccgtcgagtggtcaggcgatgggtcaggcactctacagcgttccggaagtctcggcaaaatacgagatgtcctacgcaggtccagcgaacttctggtgcggaagctgcaaggcacagaacctagaccctcctcttccaatatgaagcgggctgcttccctgaactatctgaaccaaccctctgccgctcctttacaggtttcacggggtctaagcgcttctactatggatcttagttcatcctcctag

SEQ ID NO: 28385 - DNA, 1137 bp, Artificial Sequence
  Description of Artificial Sequence: Synthetic coding sequence
atgaaagagcaacttccagatctgcactcccacttcagtgaccttaacctggaggcccacatgtacgcctcacagtggtttctgacactttttaccgctaagtttccattgtgcatggtcttccacatcattgacctactgctgtgcgagggactgaacatcatcttccacgttgcccttgcgctcctgaagacgtccaaggaggatctccttcaggctgacttcgaaggcgcactcaaattctttcgtgttcagctgcccaaaaggtatcgagctgaagaaaacgcaaggaggctgatggaacaggcttgtaatatcaaggtgcctacaaagaagcttaaaaagtacgagaaggagtaccagacaatgagggaaagccagttgcaacaagaagatcccatggatagatataagcgcgaaaaccgacgcctgcaagaagcttccatgcgtttagagcaagagaatgacgacctcgcccacgaactagtgacatctaagatcgcacttcgaaatgacctagaccaggcggaggataaggcagacgtactgaataaggagctgttactgaccaagcagaggcttgtcgagacggaggaggagaaaagaaagcaggaggaggagacggcccagctgaaagaggtcttcaggaagcagctggaaaaagctgagtacgagattaagaagaccactgccattattgccgaatataagcagatctgtagtcaactgtcgacaaggctggaaaagcagcaggccgcttccaaggaggagctggaggtagtcaaaggaaagatgatggcatgcaaacattgttccgacattttcagcaaagaaggcgctcttaagctggccgcaacagggagagaagatcagggcatcgagaccgacgacgaaaaggacagtctcaaaaagcaattacgagagatggaactcgagctggcccagaccaaactccagctggttgaggccaagtgcaagatacaggaattagagcaccagagaggggcactaatgaatgaaatccaggctgccaagaacagctggtttagcaaaacgctcaatagcatcaagactgccaccggcacccagccattgcagcccgctcctgtgacacagccacctaaagagagcacatag

SEQ ID NO: 28386 - DNA, 2631 bp, Artificial Sequence
  Description of Artificial Sequence: Synthetic coding sequence
atgggggattccgacgatgaatacgatcgtcggcgtcgggataaattcagaagagagaggtccgattatgaccgcagccgcgagcgggacgagcgcaggaggggggatgactggaacgaccgtgagtgggacaggggtagagagagacgtagtcgcggagaatacagagactatgatagaaatcgcagggagcggttctccccgccacggcacgagcttagtcctcctcaaaaacgcatgcggagagattgggatgaacatagctctgatccctatcacagtggatatgagatgccctatgctggtggtggcggaggaccaacttatgggccaccacagccatggggtcaccccgatgtgcacattatgcagcaccacgtccttccaattcaggctcggctagggtccatagccgagatcgatttgggtgtgccaccacccgtcatgaagacattcaaagagtttttgctcagtctagatgactcagtggatgagactgaagccgtgaagagatataacgactacaagttagatttccgccgtcaacagatgcaggatttttttctggcccacaaggacgaagaatggttcaggagtaaataccaccctgacgaggtggggaaacgtaggcaggaagccaggggagccttacagaatcgtctccgggtattcctgtcactcatggagacaggctggttcgacaatctgctcctagatatcgacaaagcagacgccatcgtcaagatgctggacgccgcagtgatcaagatggaagggggaacagagaacgatctgcgcatactcgagcaagaagaggaagaagaacaggcaggaaagcccggagaaccaagtaagaaggaggagggaagagcgggagcgggattgggggatggggagcgaaagacaaatgacaaggacgagaagaaggaggatggtaagcaggcggaaaacgattccagcaatgatgataaaaccaaaaaaagcgagggcgatggggacaaagaagagaaaaaagaagattccgagaaggaggccaaaaagtcctctaagaagaggaatagaaaacactcaggcgacgatagcttcgatgagggatccgtatcagaatccgaatcagaaagcgagagcggacaggcagaggaggaaaaagaggaggccgaagaggccctaaaagagaaggagaagccaaaagaagaggagtgggaaaaacctaaggacgccgcaggactggagtgcaagcccagaccactgcacaagacatgctccttgtttatgcgaaatatcgcgcctaatatatctagagccgagatcatttccctctgtaaacgctatcctgggtttatgcgtgtggcactcagcgagcctcaaccggagcgcagatttttccgaagaggatgggtcaccttcgacaggtccgtaaacattaaggaaatttgctggaatctacaaaacatacgtctccgggagtgcgagttgtcccccggagtaaatcgggacctgaccagaagagtgagaaacatcaacggcataactcagcataagcagatcgttcggaacgacattaaacttgctgctaagcttatacatacgttagacgaccgcacgcagctgtgggccagcgagccgggaaccccacccctgcctacatctctcccgtctcaaaatcccattctcaagaatattacagactacctgattgaggaggttagcgccgaagaggaagagctgctcggatcaagcgggggagccccaccggaggaaccccctaaggagggcaaccccgcagagattaacgtggaacgagatgaaaagctgatcaaagtgctggacaagcttctgttatatttgcgcatcgtgcactcattggactactacaacacatgcgaatatcccaatgaagacgaaatgcccaaccgctgcggcattatccacgtgagaggcccaatgcccccaaacagaatatcccacggagaagttctggaatggcaaaaaacgtttgaggagaagctgacgccactgctgagtgtgagggaaagcctcagcgaggaagaggcccagaagatgggtcgcaaggatccggagcaggaggtggagaagttcgttaccagtaatacccaagaactcgggaaggataagtggctatgtccgctgtctggcaagaaattcaaaggcccagaattcgtgcggaagcacatctttaacaagcatgctgagaagattgaagaagtaaaaaaagaggtggcctttttcaataactttttgactgacgctaaacgacccgctctcccagagatcaaaccagcccaacccccaggaccggcacagattttgccacccggtctgacaccaggccttccttaccctcaccagacgccacaaggactcatgccatacggacagcctagaccccctattctgggatatggagccggagcagtgcggcctgcggtcccgactggcggacctccctatccccacgccccttacggagctggcaggggaaattatgatgccttccgaggccaggggggataccctgggaagcctaggaatcggatggttaggggggacccgagggccattgtagagtacagagacctcgatgcacctgacgatgtggatttcttctag

SEQ ID NO: 28387 - DNA, 1491 bp, Artificial Sequence
  Description of Artificial Sequence: Synthetic coding sequence
atgaaacttgggaagaaacctatgtataagccagtcgacccctactctagaatgcaatcaacgtacaactacaacatgcgcggaggcgcataccccccaaggtacttctatcccttcccagttcctccgctgctgtaccaggtcgaattgagcgtaggcggacagcaattcaatgggaagggtaaaacccggcaggccgctaagcacgacgccgctgccaaggcactgcggatcctgcagaatgagcccctgcccgagagactggaagtgaacggcagagaaagcgaggaagagaatctcaacaaatctgaaatttcccaggtctttgaaatcgccctgaagcgtaacttaccagtgaactttgaggtggctcgggaatccggtcctcctcacatgaagaatttcgtcaccaaagtgtcagtgggagaattcgtcggggaaggtgaggggaagtctaagaaaatatccaaaaagaatgcagcaatcgccgtactcgaggaattaaaaaaactgcccccattgccagcggtggagagggtcaagccaaggataaaaaaaaagaccaaaccaattgtaaaaccccagacaagccccgaatacgggcagggtatcaaccccatctcccggttggcacagatccaacaggctaaaaaggagaaggagccagaatataccctccttacggagcgaggtctgcctcgtcgaagagagtttgttatgcaagtgaaggtgggcaatcataccgctgaaggcactggaacgaacaaaaaggttgcgaagcgtaacgccgcagagaacatgttggagatattaggatttaaggtaccacaggcccagcctacgaaacctgctttgaagagcgaagagaagacaccgattaaaaaaccgggagatggcagaaaagtcacgttttttgaaccgggatcgggcgatgaaaatggaacttctaacaaagaagatgagttcagaatgccctatctctcccaccagcaactgccagccggtatcctgcctatggtgcccgaggttgcccaggctgtaggtgtgagccagggtcaccacactaaggacttcacacgcgcagcaccaaatcccgcaaaagcaacagtgacagcgatgatcgccagggaacttctgtatggtggaacctcacccacagccgagacaattctcaagaataacatcagttcggggcacgtgccccatgggcctctgacacggccttcagaacaattggattacctgtccagggtgcaggggtttcaggtggagtacaaagactttcctaagaacaataagaatgagttcgtttcccttattaattgctcttcacagccgcctctgatcagtcatggaatcggaaaggatgtggagtcctgccatgatatggctgccctgaacattttgaagttgctgtcagagttagatcagcagagcactgagatgccgagaaccggtaacggacctatgtcagtgtgtggtcggtgttag

SEQ ID NO: 28388 - DNA, 318 bp, Artificial Sequence
  Description of Artificial Sequence: Synthetic coding sequence
atggcactacggtatcctatggctgtgggcctgaacaagggacacaaggtgacgaaaaatgtatccaagccacggcattccagacggaggggcaggttgaccaagcataccaagttcgtcagagatatgataagagaggtgtgcggcttcgctccctacgagcgtagggctatggagctgctgaaggtttctaaggacaaacgcgctttgaagtttatcaaaaaacgcgtcggcactcacatccgtgccaagagaaaacgggaggagctgtccaacgttctggcggctatgagaaaggctgcggcaaagaaggactag

SEQ ID NO: 28389 - DNA, 3720 bp, Artificial Sequence
  Description of Artificial Sequence: Synthetic coding sequence
atggctaatgactctcccgcaaagtcacttgtcgacatcgacctatcatcgttgagggaccctgcgggaatattcgaactggtggaggtagtcggcaacggcacttatggacaggtttataaagggaggcacgtgaagaccgggcaactggccgctatcaaagtcatggatgtcacggaggatgaagaagaagagatcaagttagagataaatatgttgaaaaaatactcacaccatcggaacattgccacatactacggagcatttattaagaagtcgccacccggtcacgacgatcagctatggctcgtgatggagttctgcggagcgggatcaatcacggaccttgtgaaaaataccaaaggaaacacactgaaagaggattggattgcctatattagcagagagattctccggggtttagctcatctacacatccaccacgtgattcatcgggatattaaaggccagaatgttctgcttacagaaaacgcagaggtgaagctggtcgatttcggcgtatctgctcagcttgatagaaccgttgggaggcgaaatacattcattggcaccccatactggatggcgcctgaggtgatcgcatgcgacgagaatcctgatgctacttacgattatcggtcagatctttggtcatgcggtatcacagctatcgaaatggccgagggagcacccccactgtgcgacatgcacccgatgcgcgcactcttcctgattccacgtaacccccctccaaggttgaagtctaaaaagtggtccaagaaatttttttctttcatagagggctgcctggtcaagaactacatgcagcgaccatcaactgaacagctgttaaaacatcccttcatacgggatcaacccaacgagcggcaggtgaggatccagcttaaggatcatatagatcgaactagaaagaagcgcggtgaaaaggatgagaccgaatatgaatacagtggatcagaggaggaagaggaagaagttcccgaacaggagggagagccatcttcgattgtgaacgtgcccggtgaatctactctccgccgagattttctcagactgcagcaggagaataaggagagatctgaagccctgcgaagacagcaactcctgcaagaacagcaactgagggagcaggaagaatacaaaaggcaacttctcgccgagagacagaagaggattgagcagcagaaagagcagaggcgccgtctggaggagcagcagcgacgcgagagagaggctcggaggcagcaggagagagagcagcggcgtcgggaacaggaggagaaaagacggctcgaggaactggagcgaaggcggaaggaagaagaggaaagacgacgggctgaagaagaaaagcgcagggttgagcgcgagcaagagtacattcgtaggcaactcgaggaagaacagaggcacctggaagtcctccagcagcagctgctgcaggagcaggctatgctgctggagtgccggtggagagaaatggaggagcacagacaggctgaacggctgcagcgacagctgcaacaggagcaggcttatctgttgagcctgcagcatgaccacagacggcctcaccctcagcactcccaacagccccctcctccccagcaggagagaagcaagccgagtttccacgccccagaacccaaggctcactacgaaccggctgatcgggcacgcgaagtagaagataggtttcggaagaccaatcattctagcccggaggcgcaaagtaagcagacagggcgtgtattggagccccctgtcccatcgcgcagcgaatctttttcaaacgggaattctgaatccgtgcaccccgctctgcagagacctgctgagccccaggtgccagtgcgcaccactagtcgttccccggtcttgagccggagggatagcccgctacagggcagtggccaacaaaattcgcaggcagggcagcggaattcaaccagtatcgaacccagacttttgtgggagcgagtggagaaactggtgcccaggccaggatctggctcttcttctgggtctagcaactcggggtcgcagcccggtagtcaccccggatcccaatccgggtcaggagagcgcttccgggtgcgtagcagctctaaatctgaaggtagtccatctcagaggctggaaaatgccgtgaagaagcccgaagacaagaaggaggtgttccgacccctaaagccggctgacctgaccgccctcgcaaaggaacttcgagccgtggaggacgttaggccccctcataaggtgactgactattcaagctcatcagaggagagtgggaccactgatgaagaggacgacgatgtggagcaagaaggggcagatgagtccacctcagggccagaggatacgagggctgccagcagcttgaatctttccaacggcgagaccgaatccgtgaagactatgattgtgcatgatgacgtcgagagtgaacctgcgatgacgcccagtaaagaaggaactctgatcgtccggcagacccaatcggcaagttccacattacagaaacacaaatcctcaagctccttcaccccgttcatagacccacgccttcttcaaatctccccctcttccggcactaccgtgacctctgttgtaggattttcttgtgacggaatgcgccctgaggctatccgtcaggaccctacaagaaaggggtccgtcgtcaacgtgaacccaacaaatacaagaccccagtcggacactccagagatacgaaagtataaaaagaggtttaacagcgaaattctgtgcgcagccctgtggggcgtgaacctgctcgtgggaaccgaatccggtctgatgctgttggaccgatcgggccaggggaaggtataccctctgattaaccggcgacggtttcaacagatggacgttctcgagggcctcaacgtcctggtcaccatcagcgggaagaaagataagctgcgcgtgtactatttgtcatggctcagaaataaaatactgcacaatgaccccgaggtcgagaaaaaacagggatggacgacggtcggagatctcgagggctgcgtgcactataaggtggtgaagtatgaacgcattaaatttctggttattgcattgaaaagctcggttgaggtgtatgcctgggcgcctaagccatatcacaagttcatggcattcaagtccttcggggaattggtacataaacccttgctagtggaccttaccgtggaagagggacaaaggctcaaagtgatttacggcagctgcgctgggttccatgcagtggacgtggatagtgggtccgtgtacgatatttaccttccaactcatattcaatgctccataaagccacacgccataataatcctgcccaataccgacggtatggagctcctagtgtgttacgaagacgagggcgtgtatgtaaatacttacggcagaattactaaggatgtggtcctccagtggggagagatgcccacctcagtggcgtacataagatccaaccagacaatgggctggggggagaaagcaatcgaaatcaggtctgtggagaccgggcacctggacggggtgtttatgcacaagagggcccagcgattgaaattcctgtgcgagcgtaatgataaggttttctttgccagcgtacgcagcggcggtagtagccaggtttatttcatgaccctggggagaacgagcctcctctcctggtag

SEQ ID NO: 28390 - DNA, 2847 bp, Artificial Sequence
  Description of Artificial Sequence: Synthetic coding sequence
atgtacggttcagcacggagtgtggggaaggtggagccctcctcccagtcccccggtagatcaccgaggctgcccagatctcctcgcctgggccaccgcaggactaatagcacgggcggatcctctgggtcgtcagtaggcggaggcagtgggaaaacgctgtctatggagaacatacaaagcctcaacgccgcatacgcgactagtggacccatgtacctcagcgatcacgaaaatgtagggtccgagaccccaaagtccaccatgacacttggcaggagcggcggaagactgccatacggcgtgcgtatgaccgccatgggcagttcaccaaacatcgcttcttccggagtggccagtgatacaatcgcttttggggaacaccatctccctcccgtcagtatggccagcaccgttccccattctctgagacaagccagggataacacaatcatggatctacagacccaattgaaggaggtcctgcgcgagaatgacctgctccggaaggatgtggaggttaaggaaagtaagctgagtagcagcatgaactcaatcaagactttctggtcacctgagctgaaaaaggaacgcgcacttcgcaaggacgaagcatccaaaataactatttggaaggaacaatatagagtggtgcaggaggaaaatcaacacatgcaaatgaccatccaggctctccaggatgaacttcgaattcagagggatttgaatcagctgtttcagcaagattcttcgtcaagaaccggcgagccatgtgttgccgagcttacagaggagaactttcagcgcctacatgctgaacacgaacgtcaggctaaagagctgtttctacttcgcaaaaccctggaagagatggagctgaggatagagacgcaaaaacaaacgctcaatgcgagagacgagtccattaaaaaactgctggaaatgctccagagcaaagggctgagtgccaaagctactgaggaggatcacgaaaggacgcgacgcctggcagaagccgagatgcatgtgcatcatttagaatcactacttgaacagaaggagaaagagaattccatgctccgtgaggaaatgcacagaaggttcgagaatgccccagatagtgccaaaactaaagcccttcagaccgtgatcgaaatgaaagactccaaaatttcttcgatggagagaggcttgagggatttagaggaagagatacagatgctgaagagcaatggggctttatccacagaggagcgggaagaagagatgaagcagatggaagtgtatcgttcccacagcaagttcatgaaaaacaagattgggcaggtcaagcaagagctgtcgcgaaaggatacagagcttttggctctgcagacaaaacttgaaacactgacaaaccagttcagcgactctaagcagcatatcgaggtcctgaaggaatcccttaccgctaaagagcagcgcgctgcgatcctccagactgaagtggacgccctgaggcttagactagaggaaaaggaaaccatgctaaataagaagactaaacagattcaggacatggctgaggagaagggtactcaggctggtgagattcacgaccttaaggacatgttggatgttaaagaacgaaaagtgaatgtgcttcagaagaagatcgaaaacctgcaagagcagctgagagataaggagaaacagatgtcttccctaaaagagcgcgtgaaatctctgcaggcagacaccactaacacagatacagcgctgaccacactcgaggaagcactggctgaaaaagagcggaccattgagcggctcaaggagcagagggacagggacgaaagagaaaaacaagaagagatcgacaattataaaaaggacctgaaggatttaaaagagaaggtgtcattgcttcagggtgatttgtctgagaaagaggcctcgctgttagatctcaaggagcatgcctcaagcttggcatcctctggcctgaagaaggactctagattaaaaacactcgagattgcgttggagcagaagaaggaagagtgcctgaaaatggagagtcaactaaaaaaggcgcatgaggccgcattggaagcccgtgcttcacccgagatgtctgacaggatccagcatctggaaagagagattacccggtataaggacgagagctcgaaggcccaagcggaagtggaccggctgctcgaaatcttgaaggaggtggagaatgagaagaatgacaaagacaaaaaaattgctgagctggagtctctcacttctcgccaggtgaaggatcagaataagaaggttgcaaatttgaagcataaagagcaggtggaaaagaagaaaagtgcgcagatgctcgaagaagccaggcgcagggaggacaatctcaacgacagcagccagcagttgcaggttgaagagcttctgatggctatggagaaggtaaagcaggagttggagagcatgaaggccaagctgagctcaacccagcagtctctggcagagaaggagacacacttaactaatctgcgggctgaaaggcgcaagcatctggaggaggtactggaaatgaaacaggaagctctgcttgcggctatctctgagaaagatgccaatatcgcccttttggaactttcttctagcaagaaaaagacacaggaggaagtggctgcactcaagcgcgaaaaggatcggctcgtgcagcagcttaagcagcagacccagaatcgaatgaaactgatggccgataattatgaggatgaccacttcaagtccagccacagcaaccagaccaatcataagcctagccctgaccaggatgaagaggagggaatttgggcctag

SEQ ID NO: 28391 - DNA, 2733 bp, Artificial Sequence
  Description of Artificial Sequence: Synthetic coding sequence
atggccgctaccgtggaagggcctgaactggaggcggctgctgctgccggagatgcaagcgaagacagtgacgcaggatcgcgggctcttccatttctcggtggtaaccggctgtccctggatttatatccagggggatgccaacaactgttgcacctgtgcgtgcagcaaccccttcagcttctgcaggtggagttcctgcgcctgtcgacacacgaagatccccagcttctcgaggcaactctggcccagctgccgcaatccctgtcttgccttcgatcactcgtcctgaaaggtggccagaggcgcgacactctcggagcatgcttaagaggtgcactaacaaatctgcctgccggtctgagtgggctcgcacatctggcccacctcgacctctccttcaattcactggagacgctgcccgcatgtgtccttcagatgcgtggactcggggcattacttctgtcacacaattgcctctccgaacttcctgaggctttgggagcactgcccgctctcacttttctcacagttacacataaccgcctccagaccttacccccagcactcggcgctctgagcacccttcagcgactggacttgtcccaaaacctcctggacaccctgcccccagaaatcggaggtctgggctctcttctcgagctaaacctggcctctaaccgcttgcagtccctgcctgccagtcttgctgggctaagaagccttcggttgctcgttctccacagcaatttactcgcgagtgtacctgccgaccttgcacgcctccctctcctgacgaggttagacctgagagataaccaactacgcgatttaccaccagaactgctggatgcccctttcgtgaggcttcaggggaatccccttggcgaagcttctcctgacgcaccatcgtccccggtggcggcactaatacctgaaatgccacgattgttcctgaccagtgatctcgacagctttcccgttacccctcaagggtgcagtgtaactctggcatgcggcgtgcgcctccagtttcccgctggggcaaccgctactcctattaccatcaggtacaggcttctactgcccgaaccaggcctagtccctttagggccacacgacgctcttttgagccatgtgctggaactgcaaccacacggggtggcctttcagcaagacgttggcctatggctcctgtttacccctccccaagctaggaggtgccgcgaggtggtggttagaactaggaatgacaactcttggggggatctggagacttatctggaggaggaagcccctcagcgactgtgggctcactgtcaggtcccacacttctcctggttcctggtggtaagtcgccctgtgagcaacgcttgtttggtcccacctgaagggactctcctgtgctcttcaggccatcccggagtgaaggtaatcttcccaccaggcgcaacagaagaacctagacgcgtgagtatgcaggtggttcggatggcaggccgagagttgcaggcactactcggggagccggaggccgcagtaagtcccctgctgtgcctgagccagtcaggaccccctagctttctccagcctgtgactgtacagttgcctcttcccagcggtattactggcctgtctctggaccggtctcgccttcacttattatactgggctcccccagctgccacatgggatgatataacagcacaggtcgtcctggaactcacacatttgtacgctcgttttcaggtgacccacttctcttggtactggctgtggtataccacgaaaaattgtgttgggggtctggcaagaaaggcttgggagagacttcgactgcaccgcgtgaacctgatcgccctgcagcgaagacgtgaccccgaacaggtgctgctccaatgcctgcctcgcaacaaggtagatgcaacgctccggagactcttagagagataccgtggccctgaaccgtctgacaccgtggagatgttcgaaggcgaagagttctttgctgctttcgagagaggtatagacgtcgacgccgaccgtccagattgcgttgaaggtcgcatttgtttcgtgttctatagccacctgaagaacgtgaaggaagtgtacgtcacaactaccctcgaccgggaagcccaagcggtacggggtcaggtatcattctataggggtgcagttcccgttcgcgtgcccgaagaagccgaggccgcacgacagcggaagggagccgacgccctgtggatggctacactgccgatcaaactcccgagactcagaggatccgaaggacctcgcaggggtgccggtctctcgctcgccccactcaatctcggggatgctgaaacaggcttcctgacacagtccaatttgttatcagtggccggaaggctcggactagattggccagctgttgcactacatttgggggtgtcctaccgtgaagtacaacggattcgccacgaatttagagatgaccttgatgagcagattcgacacatgttgttctcatgggcagaacgccaggcgggacagcccggtgctgttgggttgcttgtgcaggcccttgaacaatccgatcggcaagacgtggctgaagaggttagggctgtcttggaattaggaaggcggaagtatcaggactccatacgaaggatgggcttggctccgaaggatccggctctccctggctccagtgcccctcagcctcctgaaccagcccaggcctag

SEQ ID NO: 28392 - DNA, 2961 bp, Artificial Sequence
  Description of Artificial Sequence: Synthetic coding sequence
atgtctcagtggacaccagaatataatgagctgtacaccctcaaagtcgacatgaaatccgagatcccctccgacgcccctaaaacacaggaatctctcaagggaatcttgctgcatcctgaacccatcggcgctgcaaagagctttccagctggagtggagatgattaactccaaagtggggaacgagttcagccacctctgcgatgattctcaaaagcaagaaaaagaaatgaatggaaatcagcaggaacaggagaagagcttagtggtgcggaagaagaggaagtcccagcaagcgggaccgtcctacgttcagaattgtgttaaagaaaatcagggcatcctaggactacggcaacacctgggaactccgtcggacgaagacaatgactcgtccttttctgattgcctgtcaagtccttcttctagtctgcatttcggagattcagacaccgtaacatcagatgaagacaaggaggtgagcgtccgacatagtcaaactatccttaatgccaaatcccgatcgcacagtgccaggtcacataagtggccgaggaccgagacagagagcgtgtctggcctgctgatgaaacgtccctgtctacacggctcctccctgcgcagactcccctgcaggaaaagatttgtgaagaacaattcgagtcagcggacccagaagcagaaggaaaggattctgatgcagaggaagaaaagagaggtgctcgcaagacggaagtatgccctgttgccctcatccagtagttctagtgagaacgatttatcctcagagagtagcagttcctcctccaccgaaggggaagaggatttgttcgtgagcgcctccgaaaatcaccagaataaccctgctgtcccttccggctcaatcgatgaagatgtggtggtgattgaggcctcatcgacaccccaggtcactgccaatgaggaaatcaacgtgacctcaaccgactccgaagtcgagatagttaccgttggggagtcataccgatcacgttcaacattgggccattcacgctcacactggagtcaaggcagtagttcccatgcttccagacctcaagaaccgaggaaccgatcacgcatctccacggttattcagcccctcaggcaaaacgccgcagaggtcgtcgacctgactgtagatgaggatgagcccacagtggtgcccacaaccagtgcccgaatggagtcacaagcaacgagtgctagcatcaataacagcaaccccagcaccagcgaacaggcctctgatactgccagtgccgttacaagcagtcaaccttctactgtgtccgaaacatctgccacgctgacctcaaactccacaactggaacttcgatcggagacgatagtcgaagaaccacatcgagcgccgtgactgagacaggtcctcccgcaatgccacgcctcccgtcctgttgtcctcagcattcaccttgtggcggatccagccagaaccaccacgccctgggacatcctcacacatcctgcttccagcaacatggtcatcatttccagcatcaccaccaccatcatcatacaccacaccctgcggttcctgttagtcctagcttcagtgatcccgcatgcccggtggaacggccacctcaagtacaggccccttgtggggctaactccagctcgggcactagctaccatgaacagcaagcactgcccgtggatctgagcaatagcggaattcggagtcatggtagcggaagcttccacggtgcttccgctttcgatccttgctgtccagtttcaagctcccgggcagctatcttcggtcatcaggctgcagctgcagcaccaagccagcctctcagttcaatcgatgggtatggctcaagtatggtcgcccaaccccagccacaacctccaccacaaccttctcttagcagttgccggcactatatgcccccaccttacgccagtctaactcgccctctgcatcatcaggcgtcagcttgtccccatagccatggaaacccccctccccagacacagccacctccgcaggtggactacgtgattccacacccggtccatgcttttcactcacaaatttctagccacgcaacttctcaccccgtggcaccccctccgccaacccaccttgcgagcactgctgcccctatcccgcagcacctgcccccaactcatcagccaattagccatcatattccagccaccgctcctccagcccaacggctgcacccccacgaagttatgcagagaatggaggtccagcggaggaggatgatgcaacaccccacccgagctcatgaacggcctccaccccaccctcatagaatgcatcctaactatggacacggtcaccacattcacgtgccgcagaccatgtcaagccatcccaggcaggcaccagagaggtccgcctgggagctggggatcgaagccggagtgaccgcggcaacatacacaccaggagctttgcacccccacctggcccactatcacgctccccctagactgcaccatttgcagctcggggctcttcctctgatggttcctgacatggccggttatccacacataaggtatatcagctctggcctggacggcactagctttagaggaccctttcgaggtaattttgaagagctgatccacctagaggagagactggggaatgtcaaccgaggggcatcccagggcacaatcgagaggtgcacttatccacacaagtataaaaagcgaaaattgcactgcaaacaggatggtgaggaaggtacggaggaagataccgaagagaaatgtaccatttgcctcagcattctcgaagagggagaagatgtgcggagactgccttgcatgcaccttttccaccaggtgtgtgtggatcagtggctaatcaccaacaagaagtgcccaatctgtcgggtcgacatcgaggcccaattgccttctgagtcctag

SEQ ID NO: 28393 - DNA, 372 bp, Artificial Sequence
  Description of Artificial Sequence: Synthetic coding sequence
atggctaaaatcaaagccagagatctacgcggtaaaaagaaagaggagcttttaaaacagttagatgacctcaaggtggaattaagccagctcagggtggcgaaggtgactggaggagcagcatccaagctctccaagataagggtggtaaggaaatccatcgctcgtgtgctgacagtcatcaaccaaacccaaaaggagaatctccgcaaattctacaagggaaagaagtacaagcctctcgacctgagacctaagaagaccagagcaatgaggagaagactgaacaagcacgaagagaatcttaagacaaagaagcagcagcggaaggagcgtttatatccactgcgcaagtacgccgtgaaggcctag

SEQ ID NO: 28394 - DNA, 1635 bp, Artificial Sequence
  Description of Artificial Sequence: Synthetic coding sequence
atgaagatcttctgttcccgcgctaacccaaccacagggtcagttgaatggctggaggaagatgagcactacgactaccaccaggagatcgccaggagctcttacgcggacatgctccacgataaagaccgcaacgtgaaatattaccaaggcattcgggctgccgtgtctagggtaaaagaccgcggacagaaggccttagtgctggacatcggaaccgggacagggctgctcagtatgatggcagtgacagccggtgccgacttctgctacgcaattgaggagaattgcgaagcggtccctcaccgggctaccgtatacgcccaattggttgagtcaggcaggatgtggagctggaataaactgtttcctatccatgtacagacatcattgggggaacaggtgatagttccgcctgttgatgtggaatcatgtcccggagctccgtcagtatgtgacatacagctgaaccaagtctcacccgcagactttactgtccttagtgatgttctcccgatgttttccattgactttagcaagcaggtatcatcgagtgccgcttgtcactcaagacggttcgagcctctcacaagtggtcgagcgcaggtcgtactgtcttggtgggatattgaaatggatccagaaggaaaaatcaaatgcactatggctcccttttgggctcacagcgatccagaggagatgcagtggcgcgaccactggatgcagtgcgtgtatttcttaccacaggaagaacccgtggtgcagggaagtgccctctacttagtggcccatcatgacgactattgcgtttggtacagcctacagcgcacatcccctgaaaagaacgaacgagtgcgccaaatgcgaccggtgtgcgactgccaagcccatcttctttggaacaggccgagatttggcgagatcaacgaccaggacaggacagatagatatgtacaggcattgaggaccgtgagcctgcttctgggagaacctttctttactacaagtctgttgccttggcataacctgtatttctggtatgtgcggaccgcagttgaccagcacctggggcctggcgctatggttatgcctcaggcagctagccttcatgctgtggtagtcgaattccgcgatctgtggaggattcgctcaccctgcggcgactgcgagggttttgacgttcatattatggatgatatgatcaagagagccctggattttcgggagagccgggaagcagaaccacaccctctctgggaatatccctgccggagtctgagtgagccctggcagattctgacatttgactttcagcagcctgtccctctgcaacccttgtgtgcagagggaacagtcgagcttcggaggcccggtcagagccatgcagctgtcctgtggatggagtaccatctaaccccggaatgtactctgagtaccggcttactggagccggcagatcctgagggcggatgctgctggaaccctcactgtaagcaggctgtatacttcttttcccctgcacccgatcccagagctctgctcggcggaccacgcactgtctcctatgccgtggagttccacccggatacaggcgatattatcatggagtttcgtcacgctgacactcccgattag

SEQ ID NO: 28395 - DNA, 1131 bp, Artificial Sequence
  Description of Artificial Sequence: Synthetic coding sequence
atgcccctccaggtgtcagactacagctggcagcagactaagaccgccgtgtttttgagcctgccattgaaaggcgtttgcgttagagacaccgatgtcttctgtacagaaaactatttaaaagtgaatttccccccattcctgtttgaggcctttttgtatgcgcctatcgacgatgagtcttccaaggctaaaataggtaatgatacaatcgtatttaccctgtataagaaggaggccgcaatgtgggagactctatccgtcaccggcgtggataaggaaatgatgcagcggattcgggaaaagtccattttgcaggctcaggaacgtgccaaagaagctaccgaggcaaaggccgcagccaagcgagaggatcagaagtacgccctatcagtgatgatgaaaatagaggaggaagagagaaaaaaaattgaggatatgaaagaaaacgagcgcatcaaggctaccaaagccttggaggcttggaaagaataccaaaggaaagcggaggaacagaaaaagattcagcgagaggagaaactttgtcaaaaggaaaaacagatcaaagaggaacgaaaaaaaatcaagtataagtctctgaccagaaacctcgcaagtagaaacctggcgcctaaaggcagaaatagcgagaacattttcacagagaagctgaaggaggatagcatccccgctccccgatctgtgggtagcattaagattaacttcactccgagggtcttccccactgccctcagagaatcacaagtcgccgaggaagaggaatggctgcacaagcaggccgaagcacgcagggccatgaacactgatattgcggaactatgcgatctcaaggaagaagagaagaatcccgagtggttgaaggacaagggcaacaagctgtttgccactgaaaattacttggcagccataaatgcctacaatctcgccattcggttgaataataaaatgcccttgttatacctgaatcgggctgcatgccatttgaaactgaaaaacctccacaaagctatagaagactcgagtaaggcctatcgcatcatgaagaggcatttaagattgatacatcccactaagctgtacaagcttatgttgcgtaggtttgggatgtag

SEQ ID NO: 28396 - DNA, 4221 bp, Artificial Sequence
  Description of Artificial Sequence: Synthetic coding sequence
atgtggtccttgactgcatcagagggcgaatcaacaaccgctcacttttttctgggcgcaggtgatgagggactgggaaccagaggcatcggcatgcgacctgaggaatccgactcagaactgctggaggacgaagaggatgaggtgcctccagagccccaaatcattgtcggcatctgcgccatgaccaagaagtctaagtctaagcccatgacccaaatccttgaaagactgtgccggtttgactatctgacggtcgttattctaggggaggatgtgatcctcaacgagccagtggagaactggcccagttgccactgtctgatcagcttccattcgaaaggctttcctctcgataaggccgtcgcttatagcaagcttcgcaaccccttcctgataaacgaccttgccatgcaatactacatccaggataggcgagaagtgtacaggatcctgcaggaggagggtatcgatcttcccaggtatgccgtcctgaacagagatcctgcaagaccggaggagtgcaacttaatagaaggggaagatcaggtggaggtgaacggtgccgtgttcccaaaacccttcgttgagaagcctgtatccgctgaagaccacaatgtgtacatctattacccaagtagtgcgggtgggggttcacaacgcctgtttcggaagattggcagccgttcttctgtttactcacctgaatctagcgtgagaaaaacaggctcttatatctatgaggaatttatgccgacagacggtaccgatgtcaaggtgtatactgtgggccctgactacgcccacgcagaggctcgtaagagtcctgcacttgacggtaaagtagaacgggactccgaaggcaaagagatcagatatcctgtaatgctgaccgccatggagaaacttgtcgctcgtaaggtatgcgtggcctttaaacagacagtttgcgggttcgatcttcttagggccaatgggcactcattcgtgtgcgacgtcaatggcttttcatttgtgaaaaatagcatgaaatattacgacgattgtgcgaaaatactggggaatactattatgagggagttagcccctcaattccagatcccctggtctattcccaccgaggctgaagatatccctattgtgccgactacgtctggcaccatgatggagttgcggtgcgtcatcgctattattagacacggagataggacacctaaacagaaaatgaaaatggaggtgaagcatccacgcttcttcgcactttttgagaaacatggcggatacaagaccggtaaactgaaactgaagaggcctgagcagctgcaggaagttctggatatcactcgcctgctgcttgccgagctggaaaaggagccaggcggagagatcgaagaaaaaaccggcaaacttgaacagctgaaatcggttctcgagatgtatggccacttcagcgggatcaatcgaaaggttcagcttacatactacccccatggagtgaaggcgtctaacgagggccaggaccctcagagggaaactttggccccttctctgctgctcgttctcaagtggggcggagagctgacacccgctggtcgagttcaggctgaggaactgggaagggccttcagatgtatgtaccctgggggtcaaggagattacgcgggattccctgggtgcggcctcttaagactgcactcaacgtttcggcacgacctcaagatctatgcaagcgatgaaggcagggttcagatgaccgccgcagcctttgccaaggggctgctagccctggaaggcgagctgacaccaatattagtccagatggttaagtccgcaaatatgaatgggttgctggacagcgacggggactcattatctagctgccagcaccgtgtgaaggccaggctgcaccatatcctgcaacaggatgcaccctttggacccgaggattatgatcagctcgcaccgacacggtcaacaagtctgctcaactccatgaccatcattcagaaccccgtcaaagtgtgtgaccaagttttcgcactgatcgagaatctaactcatcagatcagagagagaatgcaggatcctcgctccgtggatctgcagctttaccacagtgagaccttggaattaatgctgcaacgctggtccaaactggagagagactttagacagaagtcaggcagatatgatatctccaaaatacccgacatatatgactgtgtaaagtatgacgtgcaacataatggatcccttggcctccagggaacagccgagctgctgagactaagtaaagctctggcagatgtagtcatcccccaagaatacggcatttctcgcgaggagaaattagaaatagccgtggggttttgccttccgctgctgaggaagatcctgctggatctgcagagaacccatgaagacgagtccgtgaacaaacttcacccactctacagtaggggagtgttgagtcccggaagacacgttcgtacaaggctatactttacatctgagagtcacgtgcattctctcctcagcgtcttccgctatgggggattgctggatgagacccaggatgcccaatggcagcgcgcactggattacctcagcgccataagcgagctcaactatatgacccagattgttattatgctgtacgaggataacacccaagatccattatccgaagagaggttccacgtagagctgcacttttcgccaggcgtgaagggagtcgaagaagaggggtctgctcccgctggttgcggatttcgaccagcaagctccgagaacgaggaaatgaaaacaaaccagggaagtatggagaacttatgtcctggaaaggctagcgatgagccagaccgtgctctgcagactagccctcagcctccagaggggccaggccttccaaggcgctcacccctcatcagaaatcgtaaagcaggaagcatggaggtcctctccgagaccagcagtagccgaccaggcggatataggctgttctcttccagtcgtcctcccactgagatgaaacaatcggggctcggtttcgaaggctgtagtatggttcctacgatctaccctttggagaccttgcacaatgccctctcactcaggcaggtctccgagttcttaagtcgggtgtgccaacgtcataccgatgcgcaggcccaagcatctgcagcgttgtttgacagtatgcactccagccaggcatccgacaacccatttagtccacccaggaccctgcactcccctcctctccagttgcagcagaggagcgagaaacccccttggttggaaacacgtttttgtcatgtaggacaggctggcttggagttgctgaccagtagcgacctgccagccagcgcttctcagagcgcagggatcacaggcgtcagccatcggacgcagcctgattcttcaggtccctcttcaaccgtgtcatccgccggtccgtcttcccccacgacagttgatggcaactctcagttcggcttctctgatcaaccttcgttaaacagccatgtggcagaggaacaccagggcctaggtctactgcaggagacaccagggtcaggggctcaggagctgagtattgagggcgagcaggaattattcgaaccaaaccagagccctcaggtgccacccatggaaacctcccagccctacgaggaggtttcacaaccttgccaggaggtaccagacataagtcagccctgccaggatataagcgaagccctgtcccaaccttgccagaaggttccagatattagccagcagtgccaggaaaaccacgataacggtaaccacacatgtcaggaggtgccacatatttcacagccgtgccagaaatctagtcagctgtgccagaaggtttctgaagaagtctgtcagctatgtctagagaattcagaagaggtttcacagccctgtcagggcgttagtgttgaagtaggaaaactggtgcataagttccatgttggagtgggaagcttggtgcaggaaactctcgttgaggtcggcagcccggcagaggagattccagaagaagtgatccaaccttatcaggaattctccgtggaggtgggacggctggcgcaggagacatcagcaatcaatctgctcagtcaggggatacctgaaatcgataagcctagtcaggagttccccgaagaaattgatctccaggcccaagaggtgccagaggagattaattag

SEQ ID NO: 28397 - DNA, 1338 bp, Artificial Sequence
  Description of Artificial Sequence: Synthetic coding sequence
atggtcttggagggaaatcccgaagtgggatctccaaggacatcagatctgcagcaccgcggaaataaagggagctgcgtgttatcttcaccaggagaggatgcccagccaggagaagagcctattaaatacggtgaactgattgttctcggctataatggctgcctggcttcaggggacaaggggagaagacggtccagactggcactcagtcgcagatctcacgctaacggtgttaagcccgatgtgatgcaccacattagcacacctcttgtgtccaaagccctatccaaccgcggacaacacagcatttcttacacattgtctcgctcgcactctgttatcgtcgaatatacgcatgatagtgacactgacatgtttcagatcgggaggagcaccgagaacatgattgatttcgtggtgactgataccagccctgggggaggcgcagccgaaggtccttccgcacaatctaccatatcccgatatgcttgtcgcatcctgtgtgatcgcaggcctccatataccgccagaatttatgccgcagggttcgacgcgagcagtaacatcttcctgggagagagggccgctaagtggcggacccccgacggtctgatggatgggcttaccactaatggcgttctggtcatgcaccctgccggtggattttctgaagattcagcacccggtgtgtggagggagatcagcgtctgtggcaacgtgtacactctccgagattcacgatcagcacagcagagaggcaagttagtggagaatgagtccaacgtgctgcaggacggctcactgattgacctgtgtggcgcaaccctcctgtggagaacacctgctgggctgctgagggctcctacgctgaagcagcttgaggcacagagacaggaggccaacgccgcacggcctcaatgtcccgtgggtttgtccactcttgcatttccctctcccgctcgcggacgtaccgctccggataaacagcaaccctgggtgtacgtcaggtgtggacacgtccacgggtatcatggctggggatgccgacgggaacggggacctcaagaaagggaatgtcccttgtgtcgtctcgtgggaccttacgtgccgctgtggcttggccaagaggccggtctttgtctggaccctggaccaccatcccatgcattcgccccttgtggccatgtttgtagcgagaaaaccgccagatactgggctcagacccctcttccgcatggcacacacgcctttcatgccgcttgtccattttgcggcgcttggttgactggagagcatgggtgcgtgcgcttgatatttcaggggccacttgactag

SEQ ID NO: 28398 - DNA, 1950 bp, Artificial Sequence
  Description of Artificial Sequence: Synthetic coding sequence
atgggaactgcgcttgtctaccacgaagatatgacagccacccgtctgttatgggatgacccggagtgcgagatcgaacggcctgagagactcacagctgctctggaccggttgaggcaacgcggactggagcagagatgtctgcggctcagcgcacgggaagcatcagaggaggagttggggttggtacactcccctgaatatgtgagcttggtcagggagacccaggtgctcgggaaagaagagctgcaagccttgtctgggcaattcgatgccatatacttccacccctctacatttcattgcgcccgattagccgctggggctggcctgcaactcgtggatgctgtgctcaccggtgccgtccagaacgggctggcccttgtccgcccaccaggacaccacggacagagagcagctgcaaatggattttgtgtttttaataatgtggcgatcgccgcagctcacgctaagcagaaacatgggctccatcgaattctggtggttgactgggacgtccatcacggtcagggcatccaatacctgtttgaagacgaccctagtgtgctctacttttcatggcaccggtacgaacatggtcgcttttggccctttctccgcgagtcagatgctgatgcagtggggaggggtcaagggttgggtttcaccgtcaacctgccctggaaccaggtgggaatggggaacgccgactacgtagctgcgtttctacacctgctgcttcccctggctttcgaaggacagatgcaggcgacaccagagtgttttgctcacttaactcagcttttgcaagtgctcgccggagggagggtttgtgctgtgctagaaggagggtatcatctggaatcccttgctgaatcagtctgtatgaccgtgcagacactgcttggtgaccctgccccaccactttccgggccaatggcgccatgtcaatctgcgcttgagagcatccagtccgccagagctgctcaagcccctcactggaagtctctccagcagcaagatgtgactgccgtcccgatgtcacccagctctcacagtcctgaggggaggcctccccctttgctcccaggcggtccggtatgcaaagccgctgcctctgctccatcttctctgttagaccagccctgcctgtgtcccgcaccttctgtaagaacggccgtggcattgacaacccctgacatcactcttgtccttccccctgacgttatacagcaggaggcttccgctcttcgggaggaaacggaagcctgggctagaccgcacgaatctctggcgagggaggaagccctgacagccttgggcaaattgctttatctgttggacgggatgctggatggacaggttaactcaggcattgccgcaactcctgcctccgctgctgccgctaccctggatgtggcagtgagacggggacttagtcatggagcccagcggctgttgtgtgtagcgttaggacagctcgaccggccaccagacctggcccacgacgggaggtccttatggctgaatattcggggtaaagaagctgccgctctgtctatgttccatgtgtcaaccccactccccgtcatgacaggcggtttcctgtcttgtattttaggcctggttctgccccttgcttatggcttccagcctgacctggtgctggtcgccctgggacccggacatggactgcagggccctcatgccgctcttctggccgcaatgcttagaggccttgctggagggagggttctggcactgctcgaggagaattccacccctcagctcgccggtattctggccagggtgctgaatggcgaagccccaccatccctaggccctagtagcgtcgcctctcctgaagatgttcaggccctgatgtacttacgaggccaattagagccacagtggaagatgctgcagtgtcatcctcacctagtggcctag

SEQ ID NO: 28399 - DNA, 795 bp, Artificial Sequence
  Description of Artificial Sequence: Synthetic coding sequence
atggcaggagagcagaaaccaagcagtaatctgctagagcagtttatcctcctggctaagggcacatcgggcagtgcactcacagctctgattagccaagtgctggaagccccaggtgtctatgtcttcggggagctcctcgaacttgccaacgttcaggagttggccgagggtgccaatgctgcttacctgcagctcctgaacctcttcgcttacggaacatatccagattacatcgcaaacaaggagagccttcctgagcttagtacagcccagcagaataagcttaagcacctgactattgtctctctcgcatcgcgtatgaaatgcatcccctatagcgtccttctcaaagatctcgagatgcggaacctgcgcgagctagaagacctcattattgaggccgtgtatacagacattatccagggaaagcttgaccaaaggaatcaactgctggaagtggacttctgtataggaagagacatcagaaagaaggacattaacaatatcgtgaagactctccacgagtggtgcgacggctgcgaagccgttttattgggaatcgagcaacaggtacttcgtgctaatcagtacaaggagaaccacaaccgcacacagcagcaagttgaagcagaagtgactaacataaagaagacgctgaaggctacagcatccagcagcgcacaagagatggagcagcagctggccgaaagagagtgcccaccccacgccgaacagcggcagccaaccaaaaagatgtccaaggtcaaaggcctcgtgtcctctaggcactag

SEQ ID NO: 28400 - DNA, 726 bp, Artificial Sequence
  Description of Artificial Sequence: Synthetic coding sequence
atgagcgccagcctgaactataaatccttcagcaaagagcagcagaccatggataaccttgaaaagcaactgatttgcccaatttgtctagaaatgtttacaaagcccgtggtgattctaccctgtcagcataacctgtgcaggaaatgcgcctctgacatctttcaggcttctaatccctatctgcctacccggggaggcaccaccatggcctccggaggaaggtttcgctgcccctcatgcaggcatgaagtagtccttgatcgccacggagtctacgggttgcagagaaatctgctggtggagaacataattgacatttataagcaggaatcaaccaggcctgagaagaaatcagatcagcccatgtgcgaggagcacgaagaggaacgcatcaatatctattgcctgaactgtgaggtgcctacttgttccttatgtaaagttttcggagcgcacaaggattgtcaggtggcccctctcacccatgtcttccagagacaaaagagcgaactctctgatgggattgccatccttgtggggagtaatgaccgggtacagggtgtcatttcacagcttgaagatacctgtaagaccattgaaatcggcttcgaagcacctcccctccaggggcaggccgcagcaccagcttcaggttctggagctgactccgaaccagcccgtcatattttcagctttagctggctgaactctttgaacgaatag

SEQ ID NO: 28401 - DNA, 3501 bp, Artificial Sequence
  Description of Artificial Sequence: Synthetic coding sequence
atggccaacgatagccccgctaagtccttagtagacatcgacctgagttcgttgagagatcccgctggtatctttgaactcgtggaagtggtaggcaacggtacttacggccaagtgtacaaaggaaggcacgtcaagacaggacagttggctgccatcaaagttatggacgttactgaggacgaggaggaagagattaagctcgagattaatatgctaaaaaagtactctcaccatcggaatatagccacttactatggggcattcatcaagaagtctcccccaggacacgatgaccagctttggctggtgatggaattttgcggagcgggttctataacggatttggttaaaaacaccaagggcaatacattgaaggaggactggattgcttacatcagtcgagagatcctccgcggactggcgcacttgcatatccatcacgtcatccatagggacatcaagggccagaacgtgttgctgaccgaaaacgccgaggttaaactcgtcgactttggtgtcagcgcccaattagataggaccgtgggaagaaggaataccttcatcgggacaccctactggatggcccctgaagtcatcgcctgcgatgagaaccccgacgcaacctatgactatcggtctgacttatggagctgcgggattacagccattgagatggctgaaggggctcctccactgtgcgacatgcaccctatgcgcgcactgtttcttattcctaggaatccacccccacgtctcaaaagtaagaaatggtcaaagaaatttttctcattcatagaaggatgtttggtaaagaattatatgcagcgacctagtaccgaacagctactcaagcatccatttatcagggaccagccgaacgaacgccaagtaaggatccagctgaaggaccatattgatcgtactcggaaaaagcgcggagagaaggacgaaaccgagtatgagtactcgggaagtgaggaagaagaagaggaagttcctgagcaggagggcgaaccctcatccatagtgaatgttcccggagagagcaccttgaggagggactttctccgcctgcagcaggagaataaagagaggagcgaggccctgcgacgccaacagctactgcaggagcagcagctgcgggaacaggaggagtacaaacggcagctgctggcagagcgtcagaagcggattgagcaacagaaagaacagaggcggaggttagaagagcaacagcgaagagagcgggaggctcgcagacagcaggaaagagaacagaggcgcagggagcaggaggagaagcgaaggttggaggaattagagcgcagaagaaaggaggaagaggaacggaggagggccgaggaagaaaaacgacgggtggaacgcgagcaggagtacatcaggcggcagctggaagaggagcagaggcacctcgaagtgctgcaacagcagctgttgcaagaacaagccatgttgttgcatgaccatcgtcgccctcatcctcaacactctcagcaaccaccaccacctcagcaggaacgaagcaaaccaagtttccacgctcccgaacctaaagcccactatgagccagcagaccgcgcacgagaagtccccgtgaggactacgagcagatctccagtgctatctaggagggattcacccctgcaggggtcagggcagcagaactctcaggcaggacagcgcaactcaacatcgtctatcgaaccacggctgctgtgggaacgggtggaaaaattagtacctaggcctggcagcgggtctagctccggatcctccaactcaggttctcagcccggttcccatccaggtagccagtccggctcaggcgagcggttcagagtgaggtctagtagtaagagcgaaggctctccgagccagcgcctagagaacgccgtgaagaaacccgaagataagaaggaagtcttccggcctctcaagccggctgtgcgtatcgaccttactgctctggcaaaagagttaagagctgtggaggatgtcaggcccccacataaagtgacggactatagttcatcatccgaagagagtggtacgactgacgaagaggacgatgatgtcgagcaggagggcgcagatgaaagtacttcaggccctgaggatacaagagctgcctccagccttaatttaagcaacggtgagaccgagtcagtgaagacaatgattgtacatgacgatgtggaatctgagccagcgatgacccccagcaaagaaggcactcttatcgtgcgtcagacccaatccgccagtagcactctccaaaaacataagtccagctcaagttttacccccttcatcgatccgaggctgttacagattagcccctcgagtggtactacagtcacctctgtcgtcggcttttcctgcgacgggatgaggcctgaggcgataagacaggacccaacaaggaagggctctgttgttaacgtaaatccaaccaacaccagaccccagtccgatactcccgaaatccggaagtacaagaagcggtttaatagtgaaattttgtgtgccgctttatggggagtgaatcttttagtgggaactgagtctggcttgatgctcctggatcggtctgggcaaggaaaggtctatccgctgataaatcggaggcgctttcagcagatggacgtgctcgaaggactgaatgttctcgtgaccatcagtgggaaaaaggataagctccgggtttactatctgtcctggctccgcaacaaaattcttcataacgaccccgaggtcgaaaagaaacaggggtggacgacagttggcgaccttgaaggttgcgtgcactacaaggtagtcaagtacgagagaataaagtttctcgtcattgctctgaagtcatcagtcgaagtgtatgcgtgggctccaaagccttaccacaaattcatggcttttaaaagcttcggcgagctggtgcacaaacctctgctggtggacctgacggtggaggaggggcagagattgaaagtgatctatggaagctgtgcaggctttcacgcagttgacgtggacagtggctctgtgtatgacatttatctacccacacacgtgcggaagaatccccatagtatgatccagtgcagcattaaaccacatgctatcatcatacttcccaacactgatggtatggaactcttggtatgttacgaagacgaaggcgtgtacgttaacacatacggacgcattaccaaggacgtggtattgcagtggggtgaaatgcctacgtcggttgcttacatcagatcaaaccagacaatggggtggggcgaaaaggccatcgaaattcgatcggtagaaactggtcacttagacggcgttttcatgcataaacgggcacagaggctcaaatttctttgtgagagaaatgataaggtatttttcgcttcagtgaggtcaggcggttcatcgcaggtttacttcatgactcttgggagaacgtctttgctttcatggtag

SEQ ID NO: 28402 - DNA, 2466 bp, Artificial Sequence
  Description of Artificial Sequence: Synthetic coding sequence
atggtcgcccctgtccttgagacttcacacgttttttgttgccctaatagagtgcgaggcgttctgaattggtccagcgggcctaggggcttgctggcattcgggacttcatgttccgtagtgctgtatgatcctctgaagcgcgtggtcgtgactaacctgaatggccacactgctagagtgaactgcatccagtggatctgtaagcaggatggcagtcctagcacagaactcgtctcaggtggttctgataaccaggtcattcactgggaaattgaagataaccagcttctgaaggcggtgcacctgcagggccatgagggacccgtgtacgctgtgcatgcggtgtaccaaagacgcacttctgaccccgctctgtgcaccctgattgtgagtgccgcagcagacagcgctgtccgactgtggtccaagaagggacccgaagtcacctggaagacgggccaagtggagcggggacgagcctggaaaccaccagcgtccctcgcattgtgcagccgatcatgcgacagtatggtaagttgctatgcatcaatactttgcaaggcgttgtggaaggagaagctgcatactttctggcaccataaccgaatttctttcctgccatccgcttttcgccctatcccaattctcgcatgcggaaacgatgattgccgtattcacatctttgctcaacagaacgaccagtttcagaaagtgctaagtctatgtggacatgaggattggatccgaggcgtggagtgggctgccttcggacgcgatctgttcctggcttcttgctctcaggattgcctcattaggatttggaaactgtatatcaaaagtacctctctcgaaacgcaagatgatgacaatatccgactgaaagaaaatacttttactattgaaaacgagtccgtgaagatagctttcgccgtgaccttggagaccgtgttagctggccacgaaaactgggttaacgccgttcactggcagcccgtgttctacaaggacggtgttctgcaacaacctgttagactgctcagcgcctcaatggacaaaaccatgatcttatgggccccagacgaggaatccggcgtgtggctggaacagcgggagtggacgccggagattgtcatctcagggcatttcgatggtgtgcaagacctcgtgtgggacccagaaggggagtttataataactgtggggaccgatcaaactaccagactgtttgctccctggaagagaaaggaccagagtcaggtgacttggcacgagatcgccagaccgcaaatccacggctacgacctgaagtgcttggccatgatcaacaggttccaatttgtctctggagccgatgagaaagtgcttcgtgtgttcagcgcaccgcgtaacttcgttgagaatttttgcgccataactgggcaaagtctgaaccacgttctgtgcaaccaagacagcgacctgcctgaaggggctacagtgccggcacttggcctaagcaacaaagccgtgtttcaaggagacattgcctctcaaccctccgatgaggaggagcttttgacatctaccggatttgagtaccagcaggtggctttccagccctctatcctaacagaaccgcctacggaagaccatctattgcagaacacattgtggcccgaagttcagaagctgtacggccacggatatgaaatattctgtgttacctgtaattccagcaagaccctcctggcaagtgcttgcaaggctgcaaagaaagagcacgccgctattatcctgtggaacactacttcgtggaaacaggtgcagaatctggtttttcactcgctgaccgtgactcaaatggccttctctccaaatgagaaattcctccttgctgttagcagagacagaacttggtccctgtggaagaaacaagacacgataagccccgagtttgagcctgtcttttccctgttcgccttcaccaacaagatcacatctgtgcactctcggataatctggagctgcgattggagtccggatagtaaatactttttcacgggttctagggataagaaggtcgtagtctggggggagtgtgatagtacggatgattgtatcgagcacaatatcggcccttgtagcagcgttttggacgtagggggagcagttaccgcggtgagcgtgtgccctgtcctgcacccatcacagcggtatgtggtcgccgtggggctggagtgtggaaagatttgcctctacacatggaaaaagacagaccaggtccccgagataaacgactggacccactgcgtcgaaacatcccagtcgcagtcccatactctggcaattagaaaattatgttggaagaactgttccggcaaaaccgaacaaaaggaagctgagggagccgaatggctgcatttcgcgtcttgcggcgaagaccatacagtgaagattcacagggtgaataaatgtgccctgtag

SEQ ID NO: 28403 - DNA, 969 bp, Artificial Sequence
  Description of Artificial Sequence: Synthetic coding sequence
atggtcagcgtaataaacacagtggacacgagccacgaggacatgatacacgatgctcagatggactactacggtacccggcttgcaacatgcagctctgacaggagcgttaagatttttgatgttcgcaacgggggacagatcctgatcgccgacctgagggggcatgaaggccctgtgtggcaggttgcctgggctcaccctatgtacggaaatatacttgcttcttgtagctacgatagaaaagtgataatctggcgggaagaaaatggcacttgggagaaatcacacgaacacgccggacacgatagcagtgtgaattctgtctgctgggctccacacgactacggactcatccttgcttgtggtagctctgacggcgctatttcactgctgacatacacaggcgagggccagtgggaggtgaagaagattaacaacgctcataccatcgggtgtaacgcggtgtcatgggcccctgccgtggtgcccggttccctaattgaccatccaagtggccagaagcctaattatataaagcgttttgcctccggaggctgcgacaatttgattaaactgtggaaggaggaggaagatggacaatggaaagaagagcagaagctagaagcacacagtgactgggtgagagatgtcgcatgggccccttctatcggccttcccacctccaccatcgcctcatgtagtcaggacggtcgggtgttcatttggacatgtgatgacgcaagttctaacacttggtctcctaaacttttacataagttcaatgatgttgtttggcacgttagctggagtattaccgctaatattcttgccgtttccggaggggacaacaaggtcacgctgtggaaggaaagtgttgatggccagtgggtttgcatttccgatgtgaataaagggcagggatccgtgtccgccagtgttaccgagggtcagcaaaatgagcaatag

SEQ ID NO: 28404 - DNA, 1347 bp, Artificial Sequence
  Description of Artificial Sequence: Synthetic coding sequence
atgagctctcggaaactttcaggacctaagggaaggcggctctctattcacgtggtgacgtggaatgttgccagcgcagcaccaccattggacctcagtgacctccttcagctcaacaaccgtaatcttaacctggatatctacgtgatcgggttgcaagagctgaattcgggcattatttctttactgagcgatgccgcattcaacgacagttggtctagtttcctgatggatgttctgtctcccctgagtttcatcaaagtgtcgcacgttcgcatgcagggaattcttctgttagtgttcgcaaagtatcagcacctcccgtacatccaaatcttatcaactaagtccacaccaacaggtctgttcggttactggggcaataaggggggtgtaaacatctgtctgaagctgtatggatattacgttagcatcattaattgccacttaccaccccacatctccaacaactaccagcggctggagcacttcgatcgcattcttgaaatgcagaattgtgaaggccgagatattcctaacatcctggaccacgacctgatcatttggttcggggacatgaatttcaggatcgaggattttggcttgcatttcgttcgagagtccatcaaaaaccgttgctacggtgggctatgggagaaggatcagctctcaattgctaaaaagcacgatcctctgctgcgagaattccaagaaggaagactccttttccccccaacctataagtttgaccgcaatagtaacgactacgatacttccgaaaaaaagaggaagccggcttggactgaccggatcctgtggcgattaaagagacagccttgcgcaggccctgacacccctattccccctgctagccacttttcactgtcactgagggggtatagctcccatatgacttacggcatcagcgaccacaagcctgtgagcgggacattcgaccttgagctgaagccgctagtgagtgctcctttaattgtcttaatgccagaagacctgtggacagtcgagaacgacatgatggtatcttatagttctacatccgacttcccgagcagtccttgggactggatcggcttgtataaggtggggctgcgggatgtgaatgactatgtcagttatgcctgggtcggagatagcaaagtcagctgtagtgacaatctgaatcaggtatatatcgatatatcgaacatccccacaaccgaggacgaatttctcttatgctattactcaaactcccttcgctctgtggtgggcatcagcagaccctttcagatcccccctgggagtctgagggaagaccctctcggggaggcacagcctcaaatctag

SEQ ID NO: 28405 - DNA, 1641 bp, Artificial Sequence
  Description of Artificial Sequence: Synthetic coding sequence
atgggtgcatatctgtcacagccgaatactgtgaagtgctctggggacggcgtgggagcccctcgactgcccttgccctatggcttcagcgcaatgcagggctggcgcgtgtccatggaggacgcccacaattgcataccggaactggattccgaaacagctatgttctcggtgtacgatgggcacgggggagaggaagtggctctttactgtgccaagtacctgccagacataatcaaagaccaaaaagcttataaggagggcaaactgcaaaaagccctggaagatgccttcctggccattgacgctaaattgactaccgaagaagtcatcaaagaattagctcaaattgccggacgtcccaccgaggacgaagatgaaaaggagaaagttgccgacgaggacgacgtcgataatgaagaggccgcactgctgcatgaagaggctaccatgacgatcgaagagctgctgacgaggtatggacagaattgccataagggacctccccattcgaaatctggcggaggcactggggaggagcccggatcacagggcctgaatggtgaggctggaccagaggattcaactagagagacgccaagtcaggagaacggacccactgcaaaggcctacacgggtttttcctctaacagcgaaaggggcacggaggctgggcaggtgggcgaacccggtatccctaccggtgaggctggaccgtcctgctcctctgctagtgataaattgccccgagttgctaagagcaagttttttgaagatagcgaagatgaaagtgacgaagccgaagaggaggaggaagacagtgaagagtgctcagaggaggaagatggctattcttccgaggaggcggaaaacgaagaggacgaagacgacaccgaggaagctgaggaggatgacgaggaggaagaggaagagatgatggtgcctggcatggagggtaaagaagaacccggatcggactcaggcacaacggctgtggtggctctgattaggggcaaacagctcattgtcgcgaatgccggtgactcccgatgtgtggttagcgaggctggcaaagctctcgatatgagctacgaccacaagccagaggatgaagtggaactggccaggattaagaacgcagggggaaaagtgactatggatggacgggttaacggaggtctcaatctgtccagggcgatcggggatcacttctacaaacggaataagaatctgccacctgaggagcagatgattagtgctttacccgacataaaagtccttaccttaaccgacgatcacgaatttatggtgattgcctgtgatggtatttggaatgttatgagcagccaggaggtcgtagacttcatccagagtaagatttcccaaagggatgaaaacggtgaactcaggctgctgagtagtattgtcgaagaacttctcgatcagtgtctggctcccgatactagcggggatggaactggctgcgacaatatgacctgcatcataatctgttttaaaccaaggaacacagccgaacttcaacccgaatccgggaaacggaagctggaggaagtgctgagcaccgagggagccgaagagaacggcaactcagacaagaagaagaaagccaagagggattag

SEQ ID NO: 28406 - DNA, 3840 bp, Artificial Sequence
  Description of Artificial Sequence: Synthetic coding sequence
atgttgcaggctctccaactgcggaccggcttcttttgtttccgagtcctggtggccttaagcccctgcgccctccacgactcaggacgcctgaccaccggctcatttaacgtggtgcgagacgaagaagaagaaataaaactggaaataaacatgttgaagaagtacagccatcaccgcaacattgctacctattacggggcattcatcaaaaagagcccccctggccacgatgaccagctctggctcgttatggaattttgcggcgctggttcaatcaccgacctggtgaagaataccaaggggaataccttgaaagaggactggatagcttatatttctagagaaatcctgcgtggcttagcccacctacacatacaccacgtgatccatagagacattaagggacaaaacgtgctcctgaccgaaaatgctgaggtaaaattggtcgactttggggtgagtgcccaactggaccgcactgtgggcagacgtaataccttcatcggcactccatactggatggccccagaagtgatcgcctgtgatgagaatccagatgccacctacgactacaggtcggacctgtggtcttgcggcatcacagcaatcgagatggccgaaggcgctccccctctgtgtgatatgcatccaatgagggccctgttccttattcccaggaatcctcccccacggctgaagtctaagaagtggtccaagaaattcttctctttcatcgaggggtgtctcgttaagaattatatgcagcgaccttctaccgagcagctgttaaagcacccattcattagagaccagcccaatgagaggcaggtgcggattcagctcaaagatcacatagacagaacccgaaagaagagaggggagaaagatgagaccgagtatgagtactccggcagtgaggaggaggaagaagaggtgcctgagcaggaaggagaaccttcctcaatcgtcaatgtgcctggtgaatccaccctgaggcgcgactttcttcgcttacagcaagaaaataaggaacgcagtgaagcattgcgtaggcagcagctcctgcaggagcaacagctcagagaacaggaggaatataaaagacagctcttggcagaaagacagaagagaattgaacaacagaaagagcagcgcagaaggctggaagaacagcagcgcagagaacgcgaagctcggaggcagcaagagcgtgagcagcgcaggagggagcaggaggaaaagcgcagactcgaggagctggaaagaagaagaaaagaggaggaggagaggcgacgtgctgaagaggagaagaggcgcgtggaacgagagcaggaatacattcggaggcagttggaagaagaacaacgccacttagaggtactgcagcagcagctcctgcaggaacaggcaatgttgctacacgaccaccggaggccgcacccccaacattctcaacaacctcctcctcctcagcaggagcgctcaaaacccagctttcatgcaccagagcccaaggcccactatgagcccgctgatagagcgcgtgaggtgcaatggtcgcatctggcctcactcaaaaacaatgtttcccccgtgagcaggtcacactcattctccgacccttcccccaaattcgcgcaccatcatctgcgcagccaagacccttgccctccgtccaggtccgaggttctgtcacaatcctctgacagtaagtcagaagccccagatccaacacagaaagcctggagtcgttctgactccgatgaggttcctcctagggtgccggttcgaactacttcacgcagtcccgttctgtcacggagggatagccctttgcagggctcaggacagcagaattctcaggctggccagcggaactctaccagctctattgagcccagactcctgtgggagcgggtcgagaagttggtgccacgtcccggatctggatcttcaagcggctcctcaaatagcggctcacagccaggcagccatcccggatcacagagcgggtcaggagaacgattccgtgtgaggtccagctccaagtctgaggggtcccctagccagcgccttgaaaacgccgtcaagaaaccagaggataagaaagaggtgttcagaccccttaaaccagcggtgcgaatagacctgaccgccctggccaaggaactgcgagccgtggaggacgttcggcctccgcacaaagtgactgactactcctcttctagcgaggaaagcgggactactgatgaagaagacgacgacgtggagcaggagggcgctgacgagagcacatctgggcctgaggacactagagcagcctcctcgcttaatctctccaatggagagactgaatccgtcaagactatgatcgttcatgacgatgtggagtctgaaccagccatgactccctccaaggaaggtaccttgatagtccgtcagtccacagtcgatcagaagagagcatcgcaccacgagagcaacggcttcgctgggaggattcacctgttgcccgacctgctgcagcagtcccatagctcatctacctcttctaccagttcatctccgtcttcatcccagcccaccccaacaatgagcccgcaaacacctcaggataaattgacggctaacgaaacccaatccgcttcaagtactctgcagaaacataagagctcatcgtccttcacgccattcatagaccctcgcctgttgcagatctctccatccagtggcaccaccgtaacatctgtagtgggcttcagctgtgatggaatgagacccgaggctatccggcaggatcctacccgtaaaggcagcgtcgtgaatgtgaatcctaccaatactcggcctcaatctgatacccctgagatacgtaaatacaaaaaaagatttaacagtgagatcctgtgcgcggcactgtggggcgtgaacttattggtgggtactgagtcagggttgatgctgctcgacagaagtggtcagggaaaggtttacccactgataaaccggagacgctttcagcagatggacgttcttgagggacttaacgtgctggtgactatctcaggcaagaaagacaagctgcgggtctattacctctcctggcttcgcaataagattcttcataacgatcccgaagttgagaaaaagcagggatggaccactgtcggagacctcgaaggatgcgtgcattacaaagtggtgaaatacgagcgcatcaagttcctggtgattgccctgaagtcatctgtggaggtgtacgcctgggccccaaaaccctatcacaagtttatggccttcaaatcattcggcgaactggttcacaagcccttattagtggatctgacagttgaggagggccagcgtcttaaagtcatatacggctcatgcgctggatttcacgcggtggatgtggacagtgggtcagtgtatgatatttatcttcccacacatattcaatgctctattaaaccccacgccattatcatcctgcccaacaccgacggaatggagctgcttgtgtgctatgaggatgaaggcgtgtatgttaatacttacggcaggatcactaaagacgtggtgttgcagtggggcgaaatgccaactagcgtcgcgtacataagatcaaaccagacgatggggtggggtgaaaaggccattgaaattcggagcgttgagacgggccatctagacggcgtgtttatgcacaagcgtgcccagcgcctcaaattcctctgcgaaaggaatgataaagtatttttcgctagcgtgcgttctggaggcagctctcaggtgtatttcatgactctgggtaggacgtcactactgtcttggtag

SEQ ID NO: 28407 - DNA, 1989 bp, Artificial Sequence
  Description of Artificial Sequence: Synthetic coding sequence
atggcctcatgtcccgactctgataactcctgggtcctggctggatctgagagtctacccgttgagacactggggcctgcttcgagaatggaccccgagtccgagcgagcactccaggccccacatagccctagcaaaaccgatggcaaagaactggccggaactatggacggtgagggcactttgtttcagaccgaaagcccccagagcggctccatactaaccgaggagacagaagtgaaaggcactctcgagggtgacgtgtgcggcgtggagcccccaggccctggcgacacagtcgtgcaaggcgatttgcaagaaacgaccgtggtaaccgggctgggcccagatacacaggatctggagggacagagcccaccacagtccttaccgagtacacctaaggctgcctggatccgtgaagaaggacgctgtagctccagcgatgacgacacggatgttgatatggaaggcctccgtcgaaggcgtggaagggaggcaggtccccctcagcctatggtacctctggcagtggagaaccaggccggaggcgagggtgccggaggagagttaggcatctcattgaatatgtgtcttttaggcgctctcgtattactgggtctcggcgtgctattattcagtggcggtttgagcgaatctgaaacaggcccaatggaagaggtcgaaaggcaggtcctgcctgaccctgaagtgttggaagcagtgggcgataggcaagacggactgagggagcagctacaagccccagtgccacctgattccgtgccaagcctccagaacatggggctccttctggacaagctggctaaggaaaaccaggacatcaggctgttgcaggcacagctgcaggcacagaaagaagagctgcaatcccttatgcaccagcctaaaggcctggaggaagaaaacgcgcagctgagaggggctctgcaacagggcgaagcatttcagcgggcactcgagagcgagctacagcagctccgcgctagactccaggggctggaggctgattgcgtacgcggtcccgacggagtgtgtctgagcgggggaagagggccacagggcgataaagccatccgtgagcaaggcccacgtgaacaggagcctgaattatcttttctgaagcagaaagagcaactggaggccgaagcgcaagctttgcgacaggagctcgaacggcaacgccgtctgcttggttctgtgcagcaggacctcgaaagaagcttgcaagatgcttcgaggggagatccggctcacgcaggcctcgccgagcttgggcacaggctggcccagaagctccaggggctcgaaaattggggacaggatccaggcgtgtcggctaatgcttctaaagcttggcatcagaagagccactttcaaaatagcagggagtggtccggaaaggaaaagtggtgggacggtcagcgagatcgcaaggcagagcattggaagcacaaaaaggaagaatcggggagggaacggaagaagaactggggcggacaggaagaccgggagccagctggaagatggaaggagggccgtcctagggtggaggagagcggcagcaagaaagagggaaagcgccaggggccaaaagagccacctagaaagagcggaagttttcactccagtggtgaaaaacagaagcagcctcggtggcgagagggaacaaaagaactgccgttgtccccagccttttttggagaggacggaatcttccgccatgatagactacggtttcgcgatttcgttgacgcgctggaggatagcctcgaagaggtcgccgtacagcaaactggggatgacgatgaagttgatgattttgaagattttatcttttctcactttttcggcgacaaggcgctgaagaaaagatccggtaaaaaggataaacactcacagtccccccgagccgcaggcccacgcgaaggtcactcccattctcaccaccatcatcaccgaggatag

SEQ ID NO: 28408 - DNA, 2403 bp, Artificial Sequence
  Description of Artificial Sequence: Synthetic coding sequence
atggtcgctccggtgctggagaccagccatgtcttttgctgcccgaatagggttcggggagtgctcaactggagctccggtcctagggggttgctggcctttggtacctcctgttcggtggtgctctacgatcccctgaaacgcgtggtagtaacaaacctcaatgggcatactgcccgtgtgaactgtatccaatggatttgtaagcaggatggctccccctctactgaactggtaagtggaggatctgacaatcaggtcatccactgggaaattgaagataaccaattgcttaaggctgtgcacctgcaaggccacgaaggccctgtgtatgccgtgcacgctgtgtaccagcgccgtacttccgatcctgcattatgcacactcattgtctccgccgcagccgatagcgctgtgaggttgtggtctaagaaaggaccggaagtacccattttagcctgcggtaatgatgattgcaggattcacatttttgctcaacagaacgaccagtttcagaaggtcctctcgttgtgtggacacgaagattggatcagaggcgtagagtgggccgcattcggacgagaccttttcctagccagttgttctcaggactgcctgatacgcatatggaaattgtatatcaaatctacctccctggaaacacaagacgatgataacatccgactgaaagaaaacacttttacaatcgagaacgagagcgttaaaattgcttttgccgtgacactggaaacagtactggctggacacgaaaactgggtgaacgccgtgcattggcagccagtcttctataaggacggcgtcctgcagcagcccgtgagactgcttagcgccagcatggataaaacaatgattctgtgggccccagatgaggaaagtggcgtgtggttggaacaggtgagggtcggtgaagttggcggaaacaccttggggttctatgattgtcaattcaatgaggacgggagcatgattattgctcatgcgttccatggtgccctgcatctctggaagcagaacaccgtcaatcccagggaatggaccccggaaatcgtgatttctggacactttgatggcgtgcaggaccttgtttgggatcctgagggtgagttcatcattacggtggggactgaccaaacaacacgcttgtttgctccttggaaaaggaaagaccagtcccaggtcacttggcacgaaattgccaggcctcagatccatggatacgatcttaagtgcctggcaatgattaaccggtttcagttcgtgagcggcgctgatgaaaaagtgctgcgagtgttttccgcccctcggaactttgtggagaacttctgcgccatcacgggacagagtctgaatcatgtactctgcaatcaggactccgaccttcccgagggcgcaaccgtacccgctctgggcttgtcaaataaggccgtgttccaaggcgacatagcttcacaaccaagcgacgaggaagaattattgacgtccaccgggttcgagtaccaacaagtcgccttccaacctagcatcttgaccgaacccccaacggaggatcatctccttcaaaatactctgtggcctgaggttcagaagttgtacggacacggctatgagattttctgtgtaacatgcaattccagtaaaaccctgctggccagtgcctgcaaggcggcaaaaaaagaacacgccgcaatcatactctggaacaccacctcttggaagcaagttcagaaccttgtattccattccttgacggtgactcagatggcctttagcccgaacgaaaaatttctgcttgctgtctctagagaccgtacctggagcttgtggaaaaagcaagacaccatttcgccagagttcgaaccggtattctccctgttcgccttcacaaataaaattacgagcgtgcatagccgcatcatctggagttgtgattggagccccgatagcaagtattttttcactggcagcagagataagaaagtggtcgtgtggggcgaatgcgactccactgacgactgtatcgagcataatatcgggccatgttcctccgtcctggacgtgggtggcgctgtgacagccgtgagtgtgtgcccagtgctgcacccctcccagagatatgtggtcgccgttggcctggaatgcgggaagatctgcctttatacctggaagaaaaccgaccaggtccccgaaattaatgattggacacattgcgttgagacctctcagtcccagagccacacgctggcaattagaaagttatgctggaagaattgctctggcaaaacagagcagaaagaagccgaaggagcagaatggttacacttcgcttcatgcggagaagatcatactgtgaaaatccatcgtgttaacaagtgcgcactctag

SEQ ID NO: 28409 - DNA, 561 bp, Artificial Sequence
  Description of Artificial Sequence: Synthetic coding sequence
atggccggagaaaactttgccacaccatttcacggtcacgttggcaggggtgcctttagtgatgtttatgaacccgcagaagatacattcctgttgctgaacgccttagaggcagctgctgccgagctagccggagtagagatctgcctggaggtgggatccggcagcggagtggtgtcagccttcctagcctccatgataggcccacaggccctgtatatgtgcaccgatatcaaccccgaagctgccgcatgcactttggagaccgcaagatgtaacaaggtgcacattcagcccgttattactgacctggtggggtcccatggaattgaagccgcatgggctggtggaaaaaacggcagagaagttatggataggttttttcccctggtcccggatcttctcagtcccaagggcctgttttacctggtcacaataaaggagaacaacccagaagagatcctcaaaattatgaagacaaagggactgcaaggcaccaccgccctctcgcggcaggctgggcaggagactttaagcgttctaaaatttaccaagtcatag

SEQ ID NO: 28410 - DNA, 2352 bp, Artificial Sequence
  Description of Artificial Sequence: Synthetic coding sequence
atggcaaaatataatacagggggtaatcccacagaagacgtctccgtgaactcacgaccctttcgtgtaactggtccaaacagctcatccgggattcaggccaggaagaacctgttcaataaccaaggcaacgcctcacctcccgcaggaccgtccaacgtccctaagttcggaagtcccaagcctccagtagcagtgaaaccctccagcgaagaaaagcctgataaagagcctaagccgccatttctcaagccaacaggagctggccagaggtttggaacccccgcttcacttaccacgcgcgaccccgaggctaaagtgggcttcctaaagccagtgggacctaaaccaatcaatctccccaaggaggacagcaaacccaccttcccctggccccctggaaataaaccatctctccattctgtgaaccaagaccatgaccttaaacctctcggacccaagtcaggccctacgccacccacctccgagaatgagcaaaaacaggcattccccaaactgacgggtgtgaaaggaaaatttatgagcgccagccaagatctggagccgaagccacttttccctaagcccgcattcgggcagaagccgccattatccacggagaacagccatgaggacgagtcacccatgaagaatgtgtcttcgtcgaagggaagcccagcgccactgggagtccgctcaaaaagcggcccactgaaacccgcaagggaagattctgagaacaaggaccatgcgggagagatatcttccttaccgttcccaggcgtcgtactgaagcctgccgcttccaggggaggtcccggactgtccaagaatggcgaggagaagaaggaagaccggaagatagatgcggctaagaacacctttcaatcgaagatcaaccaggaggagctcgcttcaggaacgccacctgctcgcttccccaaggctccttctaagctgactgttggcggaccttgggggcagtcccaggagaaagaaaaaggcgataaaaactctgcgactccgaaacaaaagccactcccacctttgtttactctggggcctcctccacccaaacctaatcgaccccctaacgtggacctgacaaaattccacaagacttcttctggaaattctacttcaaaaggacaaaccagttacagtactacgtctctgccgcctccgccacccagccacccggcaagtcagccgcctctgcccgcatcccatccctcgcagccgccagtcccatctctgccaccccgaaacataaagcctccatttgacctgaagagtccagtgaatgaagataaccaggacggcgtcacccattcagacggcgcaggtaatctggacgaggagcaggactccgagggcgaaacctatgaggacatcgaggcttcaaaggaacgcgaaaagaaacgagagaaagaggaaaaaaaacgccttgaactggagaagaaggagcaaaaggagaaggaaaagaaagagcaagagatcaaaaagaaatttaagctgaccggcccaattcaggtgatccatctggcgaaggcatgttgcgacgtgaaggggggtaaaaacgaactctcatttaagcagggggaacagatcgagattatccgtattaccgacaacccggaaggcaagtggctgggacgaaccgctagaggctcctatggttatatcaagacaacagccgtggaaattgattacgattcactgaaactcaaaaaagacagtctgggagcgccaagtcggcctatcgaggatgaccaggaagtgtacgatgatgtcgctgagcaggatgatatttcttctcatagccaatccggctctggcggaatcttcccaccacctcctgacgacgatatatacgatgggattgaggaggaggacgctgacgacggattcccagcaccgcctaagcaactcgacatgggtgacgaggtatatgatgacgttgacacatccgattttccggtgtctagtgctgagatgtcgcaagggaccaatgttggcaaagccaaaacggaagagaaggacctgaagaagctgaaaaagcaggaaaaggaggagaaggactttcgcaagaagttcaagtatgatggggagatccgtgttctgtattccaccaaggtcaccacttctataacttcgaagaagtgggggacacgtgatttgcaagtgaaacccggagagagcctagaggtcatccaaaccaccgacgacacgaaggtgctgtgcaggaatgaagagggaaagtacggctacgttctgcgaagttaccttgcagataacgatggcgagatttacgacgatatcgcagacggctgcatttacgataacgactag

SEQ ID NO: 28411 - DNA, 1722 bp, Artificial Sequence
  Description of Artificial Sequence: Synthetic coding sequence
atgattcctccccaagaagccagcgccagacgtagggagatcgaggataagctgaaacaagaggaggaaaccctgtccttcattcgggactctctggaaaaatctgaccagctgacaaaaaatatggtatctattctttcctcttttgagtccaggcttatgaagttggagaactccatcatccccgttcataaacagacagagaacctccagcggttgcaggaaaacgttgaaaaaactctgagctgccttgaccatgtgattagctactaccacgtgatcagtggcgatgatgatctcgaagcacaggaggatgtaacactggaacacctcccggagtctgttttgcaggacgtgatcaggattagcaggtggttagttgagtatggcaggaaccaggatttcatgaatgtttactaccaaattagatcgtcccagcttgataggagtattaagggcttgaaggagcatttccacaagtcctcgtcctccagtggcgtaccttactcccccgctatacctaataagcgcaaggacactcccacgaaaaagcccgtcaaacgcccaggaagggatgacatgctggacgtggaaacagatgcctatatccattgcgtttccgcatttgtgaaactggctcaaagtgaatatcagctgctggctgatatcatccccgagcaccatcagaagaagacctttgacagcttaatacaggacgcactggatggactcatgctcgagggagaaaacatcgtgtccgcagccagaaaggctatcgtgcggcatgacttcagtacagtgctcactgtgtttcccattcttcgccaccttaagcagactaagccggagttcgaccaagtcctccaaggcaccgccgctagcacaaaaaataaattaccgggtctaattacgtccatggagaccattggtgcgaaagctctcgaggattttgctgataatattaagaatgatccagataaagaatacaatatgccaaaggatggcaccgtacacgagctgacaagcaacgccattctgtttctacagcagcttctcgactttcaggagacagctggggctatgctggcatcacaggagacatcatccagcgccacaagctactcctcagaattctccaagagactcttgagcacatatatctgtaaagtgttggggaacttgcagttaaacttgctctctaagagcaaagtttatgaagatccagcactctctgccatcttcctccacaacaattacaattatatcctgaagtcgctggaaaaaagcgagctcatccagttagttgcagtgacacagaagaccgccgagagatcttaccgggaacatatcgagcagcaaatacagacctatcaacgatcgtggttgaaagtgactgactatatcgctgagaagaatctcccagtatttcagcccggagtcaaactgcgggataaagagaggcagattattaaagaacgcttcaaagggttcaatgatggccttgaggagctgtgtaaaatccagaaggcgtgggccatacctgataccgagcagcgcgataggattcggcaggctcagaagacaatcgtgaaagaaacatacggagcgttcttgcagaagttcgggtccgtacccttcactaaaaaccccgaaaagtacattaaatatggggttgagcaagtgggtgacatgatcgacagactttttgacacatccgcctag

SEQ ID NO: 28412 - DNA, 2475 bp, Artificial Sequence
  Description of Artificial Sequence: Synthetic coding sequence
atgatgcagaacgtccatctggctcccgaaacagacgaagatgacctgtacagcggctacaacgactacaatcctatttatgatatagaggagctggaaaacgacgccgcatttcagcaggccgtcagaacatcccatggccgacggcctccaatcactgctaaaatctcctccacagctgtaacacgacctatcgctactgggtatggatcgaaaacctcactggcctcttccatcggcaggccgatgactggtgccatacaggacggggtaacacgacctatgaccgccgtccgcgcagccggattcacaaaagctgccctgagagggtctgccttcgatcctctaagccaaagcagaggccctgcctctcctctggaggccaagaagaaggactcccctgaagaaaagatcaaacaacttgaaaaagaggtgaacgagctagtggaagagagctgtatcgctaattcatgtggagacttgaagctcgctttggaaaaagcaaaagatgccggacgcaaagaacgggtgctggtgcggcagcgggagcaggtgacgactccagagaacattaacctggatctgacctatagtgtgctgttcaacctcgcctcccagtactctgttaatgagatgtacgctgaagctctgaatacttaccaggtcattgtcaaaaacaagatgtttagcaacgcaggaatactgaagatgaatatggggaacatatatctgaaacagagaaattacagcaaggctatcaagttttatagaatggctctggatcaggtcccatccgttaacaagcagatgcggattaaaatcatgcagaacattggagttactttcatacaagccggacaatatagcgacgctattaactcatatgaacacataatgagcatggcccctaatctgaaggcgggttacaatctgacaatctgttattttgcgatcggggacagagagaagatgaagaaagcttttcaaaagctcatcactgtaccactggaaatcgatgaagataaatatatctccccatcggacgacccacatactaatctggtcaccgaggcgatcaagaatgaccatttgcggcagatggaacgggaacggaaagcaatggcggaaaaatatataatgacatcagccaagctcattgcaccagtgatcgagacttccttcgcagccggatacgattggtgtgtggaagtggtgaaggcttctcagtatgtggaactggctaacgatctggaaatcaataaagccgtcacctatttaagacagaaggactataatcaggccgtggagatactgaaggtgctagagaagaaggactcccgggttaagtctgcagctgccacaaacttatctgctctgtactatatgggaaaggactttgcacaggccagcagctacgctgatattgcagtcaatagcgataggtacaaccctgctgccttgacaaacaaggggaacacggtgtttgctaacggagattatgagaaagccgcagaattttacaaagaagctctgcgcaatgactcatcatgcaccgaggcactatacaacatcggtctcacatatgaaaagcttaatcggctggacgaagccctggattgctttctaaaattacatgccatattaagaaatagcgctgaggtgctctaccaaattgctaatatatacgaactaatggaaaatccaagtcaagcaatcgagtggctgatgcaggtggtgtctgttatccccacggacccccaggtgctgagtaagctgggggagctgtatgatagagaaggtgacaaaagtcaggcctttcagtattattacgaatcctaccggtacttcccatgcaacatcgaggtgattgagtggctcggcgcatactacatcgacactcagttttgggaaaaagccatccagtattttgaacgcgcttcgctgattcagcctacccaggtgaagtggcagcttatggtcgcctcttgtttccggcgatctggcaattatcagaaagccctggacacatacaaggacacgcataggaaatttccagagaatgtggagtgtttgcgattcctcgtaaggctgtgcaccgatctgggactaaaagatgcccaggagtacgctaggaaattgaagaggctggagaaaatgaaggagatccgggagcagcgcatcaaatctggcagggacggatccggagggtcacgcggtaaaagagagggcagtgcctccggagactctggccagaactactccgcctcaagtaaaggcgaaagactgtccgctaggctgcgagctctccccggaactaacgaaccctacgagagttcttcaaataaagaaatcgatgcatcgtacgtcgatcctctgggccctcagatcgaacgacctaagacagccgcaaagaaaagaatcgatgaagacgactttgctgacgaggagctgggcgacgacctcctgcctgaatag

SEQ ID NO: 28413 - DNA, 2850 bp, Artificial Sequence
  Description of Artificial Sequence: Synthetic coding sequence
atgcttaggacagccggtagggatggtttgtgccggctgtcaacgtacctcgaggaactcgaagcggtggagctgaagaaatttaaactgtacctgggaacggccaccgagcttggtgagggcaagattccctggggctccatggagaaagccggtcctctggagatggctcagttgcttatcacccacttcggccctgaagaggcctggcgcctggcgctgtcaacatttgagcgcatcaaccgcaaggacctttgggagcggggacaacgggaagacctggtgcgtgacacaccccctgggggaccctcatctttggggaatcaatccacctgtctcctcgaagtttcactagtcacaccacgcaaagatccacaggagacctatagggattacgtgcgccgtaagttccgcttgatggaggaccggaacgcccgactcggggagtgcgtaaacctctcccacaggtacacacgcctgttactcgtcaaagagcattctaatccaatgcaggtgcaacaacagttgctagatacgggccgaggccacgctaggacagttggccaccaagcgtccccaatcaagatagaaacactgttcgagcctgatgaggaacgccctgagcccccacggactgtggtgatgcagggtgccgctgggatcggaaagtccatgctagcgcacaaagtcatgctggattgggctgacggaaagctgttccagggcaggtttgactatttattctacataaactgcagggagatgaaccaatccgccaccgagtgctccatgcaggatcttatctttagctgctggccagaacccagcgcccctctgcaggaactgatcagagtgcccgagcgactattatttatcattgacggcttcgacgaactcaagccaagctttcacgaccctcagggcccttggtgtctgtgctgggaggagaagcgtcccaccgagcttttactgaattcccttatcagaaagaagcttcttccagagctgtcactattgattaccacgagacccacagccttagaaaaactgcaccggctgctcgaacacccacgacatgtggagatcctgggtttctccgaagcagaaaggaaagagtatttttataagtattttcataatgctgagcaggcaggtcaagtttttaactacgtccgcgacaatgaacctctgtttactatgtgttttgttccactagtgtgttgggttgtctgtacttgtctgcagcagcaactcgagggcggaggcctcttgagacagaccagccgaaccaccacggcagtctatatgctgtacctactgagcctgatgcagccaaagccaggcgcaccacgattgcagccaccgcctaaccagcggggtctgtgtagtcttgctgcggacgggctatggaatcagaagattttgtttgaagaacaggacctccggaaacatggcctggatggagaggatgtgtctgctttcctcaatatgaacatcttccaaaaggacattaattgtgaaaggtactattccttcatccatctttccttccaggaattttttgctgccatgtactacatcctggacgagggtgaaggaggcgcaggccctgatcaggatgtgacccggctgctcaccgagtatgcgttctccgagcgcagcttcttggccctgacaagcagattcttgtttgggctgctgaacgaagagacaagatcccacctggagaagtccttgtgttggaaggtgagcccccacatcaagatggatctgttgcagtggattcagagtaaagcacagtctgacggtagtacgcttcagcaaggctccttagaatttttttcctgcctctatgaaatccaggaggaggagttcatccaacaggcactctctcatttccaggttatagtggtgtctaatatagcttcgaagatggaacacatggtctcctccttttgtctgaaaagatgtcggtctgcccaggtgctccatctgtacggtgccacatacagtgcggatggtgaggacagagctcgctgttctgctggagcgcatacacttcttgtgcagctgccggagaggaccgtgctgctggatgcatattcagagcatctggccgcagcactgtgcacgaaccccaatttgattgaactctcgctgtaccgaaatgcattaggtagcagaggagtgaagttgctgtgtcaaggccttcgtcatccaaattgtaagctgcaaaacctccgattgaaacgctgtcggataagctcctcagcctgtgaggatttgagcgcggctctgatagcaaacaaaaatcttactcgaatggatcttagcggaaatggggtgggcttccctggcatgatgttattatgcgagggactccggcacccccagtgcaggctccagatgattcagttgagaaagtgccagctcgaatcaggggcttgccaggagatggcttccgtcttgggtaccaacccacacctggtggagttggaccttaccgggaatgccttagaggacctcggactgaggctgctgtgccagggcctgaggcatcctgtttgccggctgagaacactctggttgcagctagattcatgtggtctgaccgccaaagcttgcgaaaatctgtatttcaccctgggaattaaccaaacattgaccgacttatatctcacaaataacgccctcggggatacaggagttaggttgctgtgtaaacgcttgagccatcctggttgtaagctgcgggtgctttggctgtttggcatggatcttaacaaaatgacccactcccggctcgccgctctcagagtgaccaagccctatctcgacattggctgttag

SEQ ID NO: 28414 - DNA, 5795 bp, Artificial Sequence
  Description of Artificial Sequence: Synthetic coding sequence
atggctgccagaagtgcgccaagttgtcacctccggctggagtgggtatacggctacagaggccaccagtgtcggaacaatctctattacaccgccgcaaaggaaattgtatatttcgtggctggtgtgggtgtggtctactcccctagggagcacagacaaaaattttatagaggccactcagacgacatcataagcctggccttgcatccggagagagtgctcgttgcaaccggacaggtcggaaaagaaccctatatctgcatctgggactcatatacggtgcagacaatttccgtgttgaaggacgtccatacccatgggattgcttgcctggcctttgaccttgacggccagaggctggtcagcgtgggcctcgattccaagaatgccgtgtgcgtgtgggattggaagcgcggaaagatgctgtccatggccccaggccataccgatagaatatttgatatctcctgggatttgtatcagcctaataagctggtctcctgcggagttaagcacatcaagttctggtcgctgtgcggaaacgcactaaccccaaaaaggggagtctttggcaagacgggcgacctgcagaccattctctgcctggcatgcgccagggacgaacttacgtacagtggcgctctcaacggagacatttatgtgtggaagggcataaacctcatacggacaatacagggagcacatgcagctggaatcttttctatgaacgcttgcgaggaggggtttgccacaggtggcagggacggatgcattcggctgtgggacctcacatttaagcctatcactgttatcgacctgcgggagactgaccaggggtacaaagggctctctgttcgctccgtttgctggaggggggaccacatcttggtcggcacacaggatagcgaaatatttgagatcgtggtgcaggagcgcaataagccatttctgatcatgcagggtcactgcgagggtgagctgtgggccctcgctgttcaccccaccaagccgctcgccgtgactgggtccgacgaccgcagtgtccggatctggagcctggtggaccacgcgctgatcgcccgatgcaatatggaagagcctataagatgcgccgctgtgaacgctgacggaattcatctggcactcggaatgaaggatggctcttttacagtgctgcgggtgagggacatgaccgaagttgttcatattaaagaccgaaaggaggccattcacgagctgaagtatagcccagacggaacctacctggctgtgggatgtaatgatagttccgtggatatctatggcgtggctcagcggtacaaaaaagtgggtgagtgccttgggtcactcagtttcattacccatcttgattggtcatccgatagcaggtacttgcaaacgaacgatggtaatggcaagagacttttttaccggatgcccggtgggaaggaggtcactagtacggaggagatcaagggagtgcattgggcctcttggacttgtgttagcgggctcgaagtgaacggcatctggcccaaatatagtgacatcaacgacataaattctgttgacggaaactacataggccaggtccttgttactgcggacgattacgggattataaagctgtttagatatccttgcctgaggaaaggagccaagttcaggaagtacatcgggcacagcgcgcacgtcaccaatgtgcggtggtctcacgattaccagtgggttatctctatcgggggagccgatcacagcgtctttcagtggaagtttattcctgagaggaaactgaaggatgccgttcacattgccccacaggaaagcttggctgacagccattctgatgagagcgactccgaccttagcgacgttcccgagctcgatagcgaaattgagcaggagactcagctcacctacaggcgacaggtttataaggaagacctgcctcaactgaaagagcaatgcaaggagaaacagaagtcagcgaccagtaaacgaagagagagagccccaggaaattcgatccgactgcacttcgtacacggataccgtggatatgactgtcgttcaaacctgttctatacacagattggcgaaatcgtgtaccatgtggccgcagttggcgtgatttataaccgacaacagaatacccagcgcttctacctgggtcacgacgacgatatcctgtgcctgactatccatcctcttaaggattatgtggccacagggcaggtgggacgagacccttctattcatatctgggatacggagaccattaagcctttgagtatcctgaaagggcaccaccagtatggcgtcagcgcagttgattttagcgctgatgggaaaaggcttgcaagtgtgggaatcgatgactctcacacagtggtcctgtgggattggaaaaaaggagagaagctgtctattgcaagaggaagcaaagacaagatctttgtcgtgaagatgaacccttacgtgccagacaagctcatcacagcagggattaaacatatgaagttctggaggaaagccggagacgtttgtatctggagggatattttcttggtaaaaactgtgaaagcccacgatggcccagttttctctatgcatgccttggaaaaaggtttcgttaccggaggaaaagatggcatcgttgctctgtgggatgatagtttcgagcgttgtttaaagacatatgcaatcaagagagcagccctcgccccagggtctaagggcctgctgctggaggataacccaagcattcgcgctatctccctgggacacggccatattctggtcggaactaaaaatggggagatcctagaagtggacaaaagcggtcctattacactgctcgtgcagggccacatggagggagaggtgtggggtctggccactcacccttatttaccaatttgtgccactgtttccgatgataagaccttgcgtatctgggacctctcaccctcccactgtatgctagctgtacgcaagctgaaaaagggtggaaggtgttgctgtttctcgcccgacgggaaggctctggctgtcggtttgaatgacggtagtttcctcatggcaaatgctgacacactagaggaccttgtttcattccaccacagaaaggacatgatttccgacatccgattctctcccggatccgggaaataccttgcagtggcaagtcacgactcgtttatagatatttacaacgtgatgagttcaaaaagagtcgggatctgtaagggcgcaacgagctatatcacgcacatcgactgggacatccgcggaaaattattgcaagttaacactggagctaaagaacaattgttcttcgaagcgcctagagggaagaagcaaaccatcccatccgtggaagtggaaaaaattgcgtgggcctcttggactagcgtactgggtttgtgctgcgaggggatctggccagtcattggggaagtgaccgacgtcactgcgtcttgtcttacctcggacaagatggtgttagccacaggcgatgacttagggttcgtgaagctgttccgatatccaacaaaaggaaaatttggcaaattcaagcggtacgtggctcacagcactcacgtaaccaacgtgagatggacatacgacgattctatgcttgtcaccctcggcggtacagacatgagtctgatggtttggaccaacgaaatggagggctacagggagaagcgtccatgtgatagcgaagaatcagatatagacagcgaagaagacgggggttacgacagcgatgtgacccgagagaatgagatcagttacactatcagagctttatctacaaatattcgcccaatgcttggtattaagcctcatttacagcaaaaagagccctctattgacgaaaggcctcctgtttccagagccccacctcaacctgagaagcttcagactaacaacgtcggaaaaaaaaaacgacccatcgaggaccttgtactcgaattgattttcggctacagaggccgagattgtcgcaataacgtacactatttgaacgatggcgatgacataatctaccacaccgcaagcgttgggattctgcacaatgtggcgaccggatcccagtccttctatcaggaacataatgacgatattctgtgcctcacagtcaaccagcatccgaagtttatcaatatagtggcaaccggccaggttgtactgtcctgctctttgcttactactgccccaagcatccacatatgggatgcaatgaacaagcaaaccctgtctattctgaggtgctaccatagcaagggagtgtgttctgtgtcgttcagtgcgacaggaaaactgctactttcagtggggcttgatccagagcatacaataacaatctggcggtggcaggagggagccaaaatcgcctcccgggcaggccacaaccaaaggatttttgtggcagagttcagacccgattctgacacccagttcgtgtccgtcggagttaagcatgttaaattctggaccctggccggtcgtgccctgcttagcaagaagggcctcctgtccactctggaggatgccagaatgcaaactatgctggcaattgcattcggcgcaaacaacctaactttcaccggaaccataagcggagatgtctgcgtgtggaaggaccacattttatgcaggatcgtggctcgtgcccataatgggccagtctttgcaatgtatacaacgctccgcgacggtctgattgttactgggggtaaagagaggccaagcaaggaaggcggtgccgtcaaattatgggaccaggaactgcgtcggtgccgcgcttttagattagagactgggcaggccaccgactgcgttcggtccgtctgtagggggaagggtaagatcctcgtcgggacacggaacgccgagatcatcgaggtcggagagaagaacgcagcatgcaacatcttggtcaacggtcacgtggacggcccaatttgggggctcgcaacccaccccagccgcgacttttttctgagcgctgccgaggacggaaccgtcagactgtgggatatcgcagacaagaaaatgctgaacaaggtgaatttgggacacgccgcacggacggtgtgctacagccccgagggcgatatggttgctatcggcatgaagaatggggagtttatcattttgctagtctctagtttgaaaatatgggggaagaagcgagacaggcggtgtgcgattcacgatatccgtttctcacccgacagtcgctatttggccgtaggcagcagtgagaattcagttgatttttatgatcttaccttaggtcctactcttaaccggatcagctactgtaaggacatcccctcattcgtgatccagatggacttttcagccgactcctcctacctgcaagttagctctgggtgctacaagcgtcacgtctatgaggtcccatctggaaagcatctaatggatcatgcagccatagacagaatcacatgggcgacttggactagtatcctgggcgacgaggttctgggtatatggagccgccacgctgagaaagctgacgtcaattgtgcctgcgtgagccattcagggatctctctggtcacaggagacgacttcggaatggtgaagttattcgacttcccgtgtccagagaaattcgctaagcacaaaagatttttagggcacagcccccacgtgactaatattaggttcacctctggcgacagacacgtggtgagtgccggtggcgacgattgttcgctgttcgtgtggaagtgtgtccacacgccacacta

SEQ ID NO: 28415 - DNA, 429 bp, Artificial Sequence
  Description of Artificial Sequence: Synthetic coding sequence
atgtcaatttctagtgatgaagttaactttctggtttatagatacctgcaggaatccggatttagccactctgcctttacgttcggcatcgaatcccatatctctcagtcgaacatcaacggtgccctcgttccgcctgcagcactaatctcgataatccagaaaggcctccagtacgttgaggcggaggtgtcaatcaacgaggacggcacactattcgatgggagacccatagagagcctatctctcatagacgccgtgatgccagacgtggtgcaaaccagacagcaggcctaccgtgacaagcttgcgcagcagcaggctgcagctgctgccgcagcagccgcagccgcatctcagcagggcagtgctaagaacggggagaacaccgctaacggggaagagaatggagcacacactatcgcctag

SEQ ID NO: 28416 - DNA, 1704 bp, Artificial Sequence
  Description of Artificial Sequence: Synthetic coding sequence
atggagtttttcaccatgccaccaagaacctggtttatgcggcaactgcaaaggatgtggttcctccgcccaagtatggccataatggtgtttagaatgatagaagaacggccaacacatgctatcaccgtacgcgtgtcttacctggagatctataatgaatctctgttcgatctcttaagcaccttaccgtatgtggggccatcggtaacccctatgacaatagtggaaaatccccaaggcgtgttcataaaggggctctccgtccacctgacatcccaggaggaagacgcatttagcctgctcttcgagggagagactaacagaatcatcgcctcccataccatgaacaagaactctagccgctcccactgcatcttcacaatatacctcgaagcccattcacggacattgtccgaagaaaaatacattactagtaaaattaacctcgtggatctggccggtagcgaaagattaggaaaaagtggctctgaagggcaggtcctcaaggaagcaacatacatcaataaatccctatcttttctcgagcaggcaatcatcgctctgggtgaccagaaacgggaccacattccattcagacagtgtaagctgactcacgctctgaaagactccctgggcggtaactgcaacatggtgctagtgaccaatatttatggagaagccgcacagctggaggagacactgtctagtctccgctttgcgagccgcatgaagttagttactactgagccagccattaacgaaaagtacgacgcggaacggatggtgaaaaacttggagaaagagctcgctctcctgaagcaggaacttgctatacatgactcactgaccaatcgaacctttgtcacctatgaccctatggacgagatccagattgctgagataaatagtcaggttaggagatatctcgagggcacactggatgagatcgacatcatcagcctgagacagatcaaggaagtctttaaccagttcagagtcgtcctgtcacagcaggaacaggaggtggaatcaacgctccgcaggaaatataccttgatcgatcggaatgatttcgctgccatctcagcaatacaaaaggccggtctagttgacgtcgatggacatcttgtaggcgaacctgaggggcagaacttcggactgggcgtagcgccattctctacaaagccaggcaaaaaagccaaaagtaagaagaccttcaaggagcccctgcggccagacaccccacccagcaagccagtggccttcgaggagttcaaaaacgagcagggcagcgagattaaccggatctttaaggagaacaagtccattctgaacgaaaggcgaaagagggccagcgagaccacccagcacataaatgcgattaagagagaaattgatgtgactaaagaggcgttaaactttcagaagagcctcagggagaaacagggaaaatatgagaataagggcttgatgataattgatgaggaagaattcttgctgattttgaaattaaaagaccttaagaagcagtatagaagcgagtatcaagaccttcgagatctgagggctgaaatccagtactgtcaacacctcgtagaccagtgtcgtcatcggctactgatgggcgctactgttggaaaaaacctgacctccggtacgatgtctcccctgtctagccttaggacatgccgatggcactag

SEQ ID NO: 28417 - DNA, 1428 bp, Artificial Sequence
  Description of Artificial Sequence: Synthetic coding sequence
atggccgaaggctcggtgatgttcagcgatgtgagcattgatttctcccaggaagagtgggattgcctggatccagtccagagagacctttacagagatgtgatgttggaaaattacggaaaccttgtctcgatgggactttacacccctaaaccacaagtgatttctttgctagagcagggtaaggaaccgtggatggtcggcagggaacttactcgaggtctttgctcggatttggagagcatgtgtgagactaagttgctaagccttaaaaaagaggtgtatgagatcgagttgtgccaaagagagatcatggggcttaccaagcatggtctggaatattcatccttcggtgacgtgctggagtaccgcagccatctggctaagcagcttggctaccccaatgggcatttcagtcaggaaatcttcacccctgaatatatgccgactttcattcagcagacgttcctgaccctgcaccaaataatcaacaacgaagataggccctacgagtgcaaaaagtgtggcaaggctttctcccagaactcccaattcattcaacatcagagaattcatattggggaaaagtcatacgaatgcaaagaatgcgggaaatttttcagttgcggaagtcacgtaaccaggcatttaaaaattcacactggcgagaaaccattcgagtgcaaggagtgtggcaaggctttctcttgttcgtcctacctgtcacaacatcagcgcattcatactggcaaaaaaccatacgagtgtaaggaatgcggaaaagccttttcatattgctcaaacctcatcgaccaccaacggattcatactggcgagaaaccatatgagtgcaaggtatgcggtaaagccttcactaaatcctcgcaactcttccagcacgccagaattcacactggcgagaagccatatgagtgcaaagagtgcggcaaagccttcactcaatcttccaaattagtccagcaccagagaatccacacaggggaaaaaccatacgagtgcaaggaatgcgggaaagctttcagttcagggagcgccttgaccaatcaccagcgcattcatacaggggagaaaccgtacgactgcaaagagtgcggcaaagctttcacacagagttcacagctgcgccagcatcagaggattcatgccggtgagaagcctttcgaatgcctagagtgtggcaaagcattcacacagaattcacagttgttccagcaccaacgaatacacactgatgaaaagccttatgagtgcaacgagtgcgggaaggcattcaacaagtgcagcaacctgacgcgacaccttcggattcacacaggggaaaaaccttataactgcaaggaatgtggtaaggctttctcctcaggatccgatctgattcggcatcagggaattcacaccaacaagtag

SEQ ID NO: 28418 - DNA, 462 bp, Artificial Sequence
  Description of Artificial Sequence: Synthetic coding sequence
atggcaaggaatacattgtcctcaaggttcaggagggtggatattgatgagttcgacgagaacaagttcgtcgacgagcaggaagaggcggcagccgctgcggcagagccagggcctgacccttctgaggtcgatgggctgttgcgccagggagatatgctccgggcttttcatgccgctttacgcaatagcccagtgaacaccaagaatcaggcagttaaggagcgtgcgcagggagtggtgctaaaggtcctcactaatttcaagtcttctgagattgagcaggccgtgcaatctctcgatcgtaatggcgtggacttgctgatgaaatacatctataaggggttcgagaagccaactgaaaactcaagcgctgtgctgttacagtggcatgagaaagccctagcggtcggcggactagggtccattatacgggtcctcacagcccgaaaaaccgtctag

SEQ ID NO: 28419 - DNA, 2616 bp, Artificial Sequence
  Description of Artificial Sequence: Synthetic coding sequence
atgggagagggaggtctgcctcccgcatttcagttgctcctacgtgcgtgcgaccagggggatacagagactgcgcgtcgcctacttgagccaggggcagccgaaccagccgaaaggggggcagagcccgaagctggcgcagagccggcaggcgcagaagttgcgggtcccggagccgctgccgctggggcagtgggcgcaccggtgcccgtggactgttcggacgaggccggtaacaccgcgttacagttcgcggcagccggaggacatgagccgctggtgcgtttcctgctgagaaggggggcatctgtgaattcaagaaatcattatgggtggtcagctctgatgcaggcagccagattcgggcacgtctcagtcgcccacctcctcctggatcacggagcagacgtaaacgctcaaaatcggctgggggcttctgtactaactgtcgcctcccgtggcggtcaccttggcgtggttaaattgttgttggaagctggggcatttgtggaccaccaccatccttccggggagcagctggggctggggggatcacgcgacgaaccgctggacatcacagccctgatggccgctatacagcacggacatgaagcagttgtgaggttactgatggagtggggcgctgatccaaatcatgcagcgcgaacagtcgggtggagccctttgatgctggccgctctgaccgggagattgggcgtggctcaacagctggttgagaagggcgctaaccccgatcatctgagtgtgctggagaaaacagcttttgaggtggctttagattgtaaacacagagacttggtcgattatctggaccctttaacaacagtgcggccaaagaccgacgaagaaaagcgcagacctgacatcttccatgccctaaaaatgggaaacttccaactcgtcaaagagatcgcagacgaagacccgtcacatgtcaacctggtgaatggcgatggcgcaaccccactcatgttggctgccgtgaccggacagttagcattagtccagctactcgtcgagcggcatgctgacgtcgataagcaggattcagtacacggctggaccgcactcatgcaggccacatatcacggcaataaagaaattgtaaagtaccttctgaaccagggggctgatgtgactctccgcgcaaagaatggttacacagcttttgatctcgtgatgttgctaaatgacccagacacagagcttgtaaggcttctcgcctccgtctgtatgcaagtcaacaaggacaagggaaggccctcacaccaaccccctctgcctcattcaaaggtgcggcagccttggagcatacctgttttacctgatgataaaggcggtcttaaatcctggtggaatcgcatgtccaaccgatttcgcaagttgaaactaatgcaaacacttcctagagggctcagctctaaccagccactgcctttcagcgatgaaccagaaccagcgctggactcaacgatgcgcgcagccccacaagataaaacaagccgctccgctctcccagacgccgcacccgtgacgaaggacaacggacctgggtccaccaggggcgagaaagaggatacactgctgacgacaatgttgcgcaatggggctcctttgacaaggttaccttctgacaaactcaaggccgttattccgcctttcctcccaccttcctctttcgagctgtggtctagcgataggagcaggaccagacataacggcaaggctgaccccatgaaaaccgcccttcctcagagagcctccagaggccacccagtaggtgggggtggcaccgacaccactcccgtcaggcctgtgaagttcccatctttgcctcgcagtcccgcttcatcagcgaattccgggaatttcaaccatagcccccacagttcagggggaagttccggggtgggcgtttcgcgacacggaggtgagttgctgaaccggtccggcggaagcatcgataacgtgttgagccagatcgctgcccaaagaaaaaaagccgcaggattgctggagcagaagccctctcatagaagttcgcccgtagggccagcacccggaagctccccgtccgagctgccggcaagccctgctgggggaagcgcaccagtggggaagaagctcgaaacctccaagaggcccccaagcgggacttcaacgacctcaaagtcaacatcacccactctaacgccctccccatctcctaagggacataccgccgagtcttctgtgagtagctctagtagccaccggcagagcaaatcctctggaggctcctcctcaggtacgatcaccgatgaggacgagttaacaggtatcctgaagaagctgtcactagaaaagtaccagccaatttttgaggaacaggaggtcgatatggaagcttttctcactctgacggacggggatctcaaggagctgggcatcaagaccgacgggtcaagacagcagatattagcagctatctccgaactgaacgcgggaaaaggtagggaaaggcagatccttcaggagacaattcataacttccactctagtttcgagtcctccgcaagcaatactcgtgcacccggtaactccccatgcgcatag

SEQ ID NO: 28420 - DNA, 1359 bp, Artificial Sequence
  Description of Artificial Sequence: Synthetic coding sequence
atgagcgcctccctgaactacaaatctttttctaaggagcagcagacaatggacaacttagaaaagcaactgatctgccccatctgcctggagatgtttacaaaacctgtggttattctcccatgtcagcacaatctctgccgcaaatgtgctagcgacattttccaagccagtaacccttatctgcctactaggggcggtactaccatggcctccggcggacgtttccgctgccctagctgccgacacgaggttgtgttagaccggcacggtgtctacggcttgcagcgtaacctcttagtcgagaacattattgacatctataaacaggagagcacaaggccagaaaagaaaagtgatcagccaatgtgcgaggaacatgaagaggagcgtataaacatctactgtttaaattgtgaagtacccacttgttctctgtgcaaagtctttggagctcataaagactgtcaggttgctccgctgacccacgtttttcagaggcagaaatccgagctcagcgacgggatcgctatcctcgtggggtccaacgacagagtgcagggcgtgatcagtcagctggaggatacctgcaagacaatcgaggaatgctgcagaaagcagaaacaggagctctgcgagaaatttgactatctatatggaatactggaggagagaaagaacgagatgacacaagtgatcactagaacccaagaagaaaaacttgaacacgtccgagcgctgatcaagaagtacagcgaccacctcgagaacgtgtctaaactcgtggaaagcggcattcagttcatggatgaacctgaaatggcagtgttcctgcaaaatgccaaaactctgctgaagaagatttctgaggcatctaaagcgtttcagatggaaaagatagagcatggatacgagaacatgaaccacttcactgtgaaccttaacagagaagagaaaattatccgcgagatcgatttttatcgggaggacgaggatgaggaggaagaagagggaggtgagggggaaaaagaaggcgaaggggaggtggggggtgaggctgtggaggtcgaggaggtggaaaacgtccagactgaattccccggtgaggacgaaaatccggagaaagcatcagagctctcccaggtcgagttgcaagcagcgccaggcgctctccctgtgtcatccccggaaccaccgcctgccctgccacccgctgcagacgctcctgtcacccagatcggctttgaagccccacctttgcagggtcaggccgctgccccagcatccggcagcggtgctgatagcgagccggcaaggcacattttctccttttcctggctgaattctttgaatgaatag

SEQ ID NO: 28421 - DNA, 492 bp, Artificial Sequence
  Description of Artificial Sequence: Synthetic coding sequence
atgccatctattaagctgcagtcttctgatggcgaaatatttgaggtggatgttgagatcgccaaacagtctgtaacaataaaaactatgctggaggaccttggaatggacgacgagggcgacgatgaccccgtccccctaccgaatgtaaacgccgctattctgaaaaaggtgatccaatggtgtacgcatcataaggatgacccccctcctccagaagacgatgagaataaggagaagcgcacagacgacatccccgtctgggatcaagagtttctcaaggtggatcagggcactcttttcgagcttattttagccgctaactacctcgacattaagggactgctggatgtgacatgtaaaactgtcgctaacatgatcaagggcaaaactcctgaagagatccgcaaaacctttaacatcaagaatgatttcactgaggaggaagaggcccaggtgaggaaggagaaccagtggtgcgaagagaagtag

SEQ ID NO: 28422 - DNA, 1200 bp, Artificial Sequence
  Description of Artificial Sequence: Synthetic coding sequence
atggcggcaccttcacccagtgggggtggtggctctggtggcggaagcggctctggcacccccggacccgtaggctcccccgctcccggtcatccggcagtgtcctctatgcaaggaaaaaggaaagccctcaaactcaacttcgccaatcctccttttaaaagtactgctaggttcactctgaacccgaatcccacaggggtacagaacccccatatcgagcgcctgagaacacattcaattgaatcaagtggtaaactgaaaatatctcccgagcagcactgggatttcactgctgaagatctcaaggacctcggcgagataggtagaggcgcttatgggtccgttaacaaaatggtgcataaacccagtggccagatcatggctgtcaaaagaattcggtctactgtagacgaaaaggagcagaaacagctgttgatggatctggatgtagtgatgcggtctagcgattgcccctacatagtgcaattttacggagctctgtttagagagggcgactgctggatatgtatggagctgatgtccacatctttcgacaagttttataagtatgtatactcagtgctagacgacgtgataccggaggagatccttggtaagattaccctggccactgtgaaagccctcaaccaccttaaggagaatctaaagatcatccatcgcgatattaagcctagcaacatcctgctggataggtccggcaacattaaactttgcgacttcgggatttccggccagctggttgactcaattgcaaagacccgggatgcaggctgccgtccatatatggctcctgaacgcatagatccatccgcttctcggcaggggtacgacgtccggtctgacgtctggagtctggggattactctgtatgagttggccacaggacgattcccttatcctaaatggaattctgtcttcgatcagctgacgcaggtggtgaagggcgatccgcctcaactgtcaaattcggaggagcgcgaatttagccctagcttcataaatttcgtcaatttgtgcttgacaaaggacgaatctaagcggccaaaatataaagagctgctcaaacaccccttcatcctgatgtacgaggaaagggctgtcgaggtggcttgctatgtgtgcaagatcctggaccaaatgcccgcaactccaagcagcccaatgtacgtggattag

SEQ ID NO: 28423 - DNA, 1122 bp, Artificial Sequence
  Description of Artificial Sequence: Synthetic coding sequence
atggcccaggagtcccctaaaaattctgcggctgagataccagtcacatctaatggtgaagtcgatgactctcgagaacatagttttaaccgagatctgaagcactcgctgccttccggactgggtctgtccgagacccagatcaccagccacggatttgacaacacgaaagagggagtgattgaagctggcgctttccagggatctcctgcaccacctcttccttccgtaatgtcaccctctcgggtggcggcatcaagactggctcagcagggcagtgacttgatcgttcccgctgggggacagcggacgcagactaagtccgggccagtcattctcgctgatgaaataaagaaccccgcaatggagaaattggagcttgtgagaaagtggtctctgaacacctataagtgcacccgccagataatcagtgagaagcttggcagaggctcacggactgtcgacctggagttagaggcacaaatcgatatactgcgggataacaagaaaaagtatgagaatatcctgaagctggctcagaccctctctacgcagctgtttcagatggtccatacccaacgtcagttgggagatgcctttgccgatctgtccctgaagtctctggaactgcacgaggagttcggatacaatgccgacactcagaagttgctggctaaaaacggcgagaccttactgggcgctattaatttcttcatagcatccgtgaacaccctggtaaacaaaaccatagaggatacattaatgactgttaagcagtacgagtccgcaaggatcgaatatgatgcctacaggaccgatcttgaggaacttaatcttggaccgagagatgccaataccttacctaagatcgagcagtcacaacacctgtttcaggctcacaaggagaaatatgacaagatgaggaacgacgtgagcgtgaaactcaaattcctagaggagaacaaggtcaaagtactacataaccagctggttctgtttcacaatgctatcgcggcatactttgcaggtaatcaaaagcagctcgagcaaaccttaaagcagttccacattaaactcaaaactcccggtgtcgacgccccaagctggctcgaagagcagtag

SEQ ID NO: 28424 - DNA, 654 bp, Artificial Sequence
  Description of Artificial Sequence: Synthetic coding sequence
atgtactcactgaaccaagagattaaagcctttagccgtaataatctgcgcaaacagtgtacgcgggtgaccaccctgacagggaaaaagatcatcgagacctggaaggacgctagaatacatgttgttgaagaagtggaacctagtagcggcggtgggtgcgggtacgttcaggatctctcatctgacctccaggtgggagtgattaaaccgtggctcctgttggggtcccaggacgctgcacacgacttagacacccttaagaaaaacaaagtaactcatatcctgaatgtggcatacggcgtggaaaatgcctttctgagtgattttacttataaatccatctccattctcgacctgcccgaaaccaatatcctgtcctacttccccgaatgctttgagtttattgaggaggctaagcgaaaagatggcgtggtactcgttcattgcaacgccggtgtgagtagagccgcagctatcgtgattgggtttctgatgaactccgaacagaccagttttacaagcgccttcagcctcgttaaaaatgcccgtccctctatttgccccaactcaggctttatggagcagctgcgaacgtatcaggaaggcaaagaatcaaacaagtgcgatcgcatccaagaaaattcctcctag

SEQ ID NO: 28425 - DNA, 2679 bp, Artificial Sequence
  Description of Artificial Sequence: Synthetic coding sequence
atgctgcggactgccggacgggacggtctctgtaggctctccacatacctagaagaactggaggcagtcgagcttaaaaaattcaaactttatctgggaaccgctacggaattgggtgaagggaaaatcccatggggatctatggaaaaggcaggtcccctcgagatggcccagctgctaatcacacatttcggtcctgaagaggcttggaggctggccctgtccacttttgagcgcattaatcgcaaagatctgtgggagcgcggtcagcgcgaagatctcgttcgggataccccacccggaggcccttcaagtttaggcaaccagtctacttgcctgctcgaggtgtctttggtaacaccgagaaaagacccgcaggagacatacagggattatgtgcgccgaaagttcaggttaatggaggatcgaaacgccaggcttggtgagtgcgttaacctgtcacatagatatacccgtctcttgctggtgaaagaacacagtaaccctatgcaggtgcaacagcagctccttgatactggcagagggcatgcacggacagtcgggcaccaggctagcccaattaagatcgaaacactgtttgagcccgatgaggagcggccagagccacctcgcactgtggtcatgcaaggcgcagctggaattggtaagagtatgctagcccacaaagttatgctggattgggcggacggcaagttgtttcaaggccgtttcgattacctgttctacataaattgccgggaaatgaaccagtcagcaacggaatgttccatgcaggatttaatttttagctgttggcccgaacctagcgcaccactacaggagttaattagggtgcctgagcggcttctgttcattatcgacggtttcgacgaactgaagccgagttttcacgatccacaggggccttggtgcctctgctgggaggaaaagaggccgactgaactgctgttgaactcactgatcagaaagaagctgctgccagagctgagcctgttaatcaccaccaggcctacggctctggagaaactacatagacttctagagcatccccgacacgttgagattttgggcttctccgaggccgaacgaaaggagtacttttacaaatactttcacaacgcagagcaggctgggcaggttttcaattacgtcagggataatgaaccgctgttcaccatgtgcttcgtgccccttgtctgttgggtggtctgtacttgtctgcagcagcagcttgaaggcggaggcctgctaagacagacaagccggacaaccactgctgtctatatgctctacctattatctctgatgcagccgaagcccggtgcaccgagactgcagcctccacctaaccagcggggactatgcagtttggcagccgacggcctctggaatcagaaaattttgtttgaagagcaagatctgcggaagcatggtctggatggcgaggacgtgagtgcctttttgaacatgaatatatttcagaaagatatcaattgtgaacgatattatagttttattcacctgagcttccaggaattttttgctgccatgtattacatccttgatgaaggcgaaggcggagctggacccgatcaggacgtgacccggttgctcaccgagtacgccttcagcgagcgcagctttcttgctctgacgagtagattcctgttcggcctgctcaacgaggagactagaagccacctcgagaaaagcctgtgttggaaagtcagtccccatatcaagatggacttgcttcagtggattcaaagcaaggcacagtccgatgggagtactctccagcagggatcacttgagttcttttcctgtctgtacgaaatccaggaggaagaattcattcagcaagccttgagtcactttcaggtgatcgttgtcagcaatattgcaagcaaaatggagcatatggtgagcagtttctgcctgaaacgatgtaggtcagcccaggtgttgcatctctacggcgcaacctactctgctgacggggaagacagggcacgatgttccgccggagcacacacccttttggtgcagcttcccgaacgcaccgtgctcttagatgcctacagtgagcacctggcagctgccctgtgcacaaaccccaatcttatcgagctctccctgtataggaacgcactgggctctaggggggttaaactcctctgtcagggactgcggcaccccaattgtaagctccaaaatctaaggctgaagcgctgtagaatctcatcaagcgcttgtgaggatctctccgctgccctcattgcaaataagaatctaacccgcatggatctttctggcaacggggtgggatttcccggtatgatgctattatgcgagggactccggcatccacagtgtcgccttcaaatgatccagctgcggaagtgtcaacttgagagcggagcgtgccaggaaatggcctccgtgctgggtacgaacccccatcttgtcgagctggatcttaccggcaacgccctcgaagatttggggctgcgtctcctgtgtcaagggctcagacaccctgtgtgcaggttacggacgctgtgctggatgcttttcggcatggacctgaataagatgacacacagcagattggccgcactgcgtgttacaaagccttacttagacattggatgctag

SEQ ID NO: 28426 - DNA, 945 bp, Artificial Sequence
  Description of Artificial Sequence: Synthetic coding sequence
atgcagacctttctaaaaggaaagagagtgggctactggctcagtgaaaaaaaaatcaagaaactgaacttccaggcctttgccgagctctgccggaaacgcggaatggaggtggttcagctaaacctgtctcgtccaattgaggaacagggccctcttgatgtcattatccataagctgacagacgtgattttggaggctgaccagaacgactcccagagtctggaattggtacatcggttccaagaatacattgatgcccaccctgaaaccattgttttggaccccctccccgctatccgcaccctcctcgatcgtagcaaatcatacgagcttatacgtaaaattgaggcttatatggaagacgatcgaatttgttcccccccatttatggagctgacatccctatgtggggatgacaccatgagactgttggagaagaacggcctgacttttccattcatttgtaaaacgcgggtggcacatggaactaacagccatgaaatggcaatagtgtttaatcaggagggactgaacgctatccagcctccatgtgtcgttcaaaattttatcaaccataatgctgttctctataaagtgttcgttgttggagagtcttataccgtggtccagcgcccatctttaaaaaatttttctgctggcacaagtgatcgtgagtccattttctttaatagtcacaacgtcagcaaaccagaaagctcatcagtacttaccgagctggacaaaatagaaggggtctttgagagaccctctgacgaggttattagggagctcagtcgggctttgagacaggctttaggtgtgtccctattcggtatcgatattattattaataaccagacaggccagcatgctgttatcgatatcaacgctttccctggggattgccaagtctgtttcatcgagggctggaagacagattag

SEQ ID NO: 28427 - DNA, 630 bp, Artificial Sequence
  Description of Artificial Sequence: Synthetic coding sequence
atgcctgtcgctgttatggctgagagcgctttttccttcaagaagcttctcgaccagtgtgagaaccaggagctggaagccccaggtgggatcgcaacccccccagtttatggacagctgctggccctgtacttactgcacaacgacatgaataacgctagatacctgtggaagcgcatccctcccgcaatcaagagtgccaatagtgagctcgggggaatctggtcagttggtcaacgcatctggcaacgggacttcccgggaatttacacaaccataaacgcgcatcaatggtccgagactgtgcagcctattatggaagccctgcgggatgctacacgcaggcgtgcatttgctctagtgtcacaggcatacacaagtattattgcagatgatttcgccgctttcgtgggcttgcccgttgaggaggccgtgaagggcatcttggagcaaggttggcaggccgactccacaacgcgcatggtcttgcctcgcaagcctgtcgcgggagccttggatgtctcttttaataagttcattccactgtccgaacccgcacctgttcctcccatcccaaatgaacaacagttagcaagactgactgattacgtggcgttccttgagaactag

SEQ ID NO: 28428 - DNA, 4935 bp, Artificial Sequence
  Description of Artificial Sequence: Synthetic coding sequence
atgttctggtgcgggacatgttttgttaccaataatatgaagggaagcgaagtgagcctcgaaaaaaaaaaaaagataaagatgcccgtgaagcgcctgagagaggtggtgtcacagaatcacggcgatcacctcgtgctgctgaaagatgagttgccttgcgtgcctcctgcactctccgcaaacaagcgtctgcctgttggaaccggcacctcactgaatggcaccagtcgaggctcatccgatctgacaagcgcacgcaactgttatcagcccctgctggagaaccccatggtgtccgaaagcgacttcagcaaggatgtggctgttcaggtgctaccattagataagatcgaggagaataacaaacagaaagccaatgacattttcatcagccagtacacaatggggcagaaggacgccttgaggacggtgttaaaacagaatgtgtccctttgcctcaccggttggtctgaccacagtggtgtgattaccacccactgttctctctacctcttgcgcctgatgcgctcatctcacttgtccctcccttcatcctgggattatcgggcacagagcatgcccgtgtttaaggaagtgaaagtgcatcttctcgaggacgctggtatcgagaaagacgcagtgacccaagaaacccggatctcaccctccggcatcgatagtgctacaacagtggctgccgctactgcagccgcaatagcaaccgccgcacctcttatcaaggtccagagcgatctggaggcaaaagttaattccgtgacggagctcctatccaagctgcaggaaacagataagcatctgcagagagtaaccgagcagcaaacttctatccaaagaaagcaggagaagctacactgccatgatcacgagaaacaaatgaatgttttcatggaacaacacatacgtcatctggaaaaactgcagcaacaacagatcgatatccagacgcactttatcagtgctgccctcaagaccagtagctttcaaccagtatcaatgcctagcagcagggctgtcgaaaagtacagtgttaagcccgagcaccccaaccttgggtcgtgcaacccaagcttgtacaacacttttgccagtaagcaagctccgctcaaggaagttgaagacacaagctttgacaaacagaaaagtccattggaaacgccggctcctcgtcggtttgctccagtgcctgttagtagggatgacgagctgagcaagcgagaaaatctgctcgaagaaaaggaaaacatggaggtgtcttgccatcgaggtaacgtgcggcttctagagcagattcttaacaataatgactccctgacaaggaaatcggagtcctctaacaccacatctctgaccaggtctaagataggctggacccccgaaaagactaaccggtttcccagctgtgaggagctagaaaccaccaaagtgacaatgcagaagtcagacgatgtcctacatgacctcggccaaaaggagaaggaaacaaatagcatggtacaacccaaggaatctttaagcatgttaaaactacctgacctccctcagaattccgtgaagctgcagactacgaataccacacgatccgtcctcaaggatgctgagaagattctgcgaggggttcagaacaataagaaggtgttagaggaaaacttggaggcaatcattcgcgctaaggacggggcagccatgtactccctcatcaatgccctctccaccaatagggagatgtctgagaaaataagaatccgtaagactgttgatgagtggatcaaaacaatctctgccgagattcaagatgaactgagcagaacagactacgagcagaagcgctttgaccagaagaatcagcgcaccaaaaagggtcagaatatgaccaaggatatcagaacgaatacgcaagataagaccgttaacaagtctgtgatcccccgtaagcattcccaaaagcagattgaggaacactttagaaatcttcccatgagaggaatgccagcatccagcctgcagaaggagcgtaaggagggccttcttaaagccacaacagtgattcaggatgaggactatatgttgcaggtgtacggaaagcccgtttatcaggggcacaggagcaccttgaaaaaaggaccttatttgaggttcaacagccctagtccaaaatcccgccctcaacgaccaaaagtcattgagcgcgtaaaggggactaaagtcaagtcaattcgaactcagaccgacttttacgccactaagcccaagaaaatggactccaagatgaaacacagcgtccctgtccttcctcacggagaccagcagtacctcttctcccccagcagggagatgcccacattttcaggcacactggaaggtcatttgatccccatggcgattctgctcgggcaaacccagtccaactccgatacgatgcctcccgctggagtgattgttagcaagccccaccctgtcaccgtaactacaagcatcccccctagttccagaaaagtggagacaggagtaaagaaaccaaatatagctattgtagagatgaagtcagagaagaaagatcctccccagctgaccgttcaggtgctcccttcagtagatattgattcaatatccaattccagtgcagacgtgttgagccccttgtcaagtccaaaggaggccagtttgccccctgttcagacctggattaagaccccagagatcatgaaggtcgatgaagaagaagtaaagtttccagggactaatttcgatgaaattatcgacgtaatacaggaagaggagaaatgcgatgagatacccgactctgaacctattctggaatttaataggtccgtaaaggcagatagcaccaagtacaatggacctcccttcccaccagtcgcttccactttccagccaacggcagatattttagataaggtgatagaaaggaaggagactttggagaactctttgatccagtgggtcgaacaggaaatcatgagcaggatcataagcggcctgttccccgtgcagcagcagatagctccaagtatttcggtgtccgtcagcgagacctccgaaccccttacctctgacatcgtcgagggaactagttctggggcactgcagctcttcgtggacgcaggagttccagtcaatagcaacgtgattaagcacttcgttaacgaggccttagccgagacaatcgctgtgatgttgggggaccgagaggcaaaaaagcagggccctgtcgctaccggcgtcagcggggatgccagcactaacgagacctacctgcccgcaagagtctgcactccgttaccaaccccacagccaaccccgccttgctcaccaagcagtccggcaaaggaatgtgtgttggtcaaaacccccgattcttccccctgcgatagcgaccacgatatggcctttcccgtaaaagagatttgtgctgagaagggcgatgatatgcccgctattatgctggttaatacgcccacggttacccccactaccacaccccctcctgcggctgccgtgttcacccctaccctgtcggacatcagcatcgataagctcaaggtgtcttctccggagctgccaaaaccctggggagacggggacttaccgttggaggaagaaaatcccaacagccctcaagaagagctgcacccccgtgctatcgtgatgtccgtcgcaaaagatgaagagccggaatctatggacttcccagctcagccacctccaccggaacccgtgccattcatgccgtttccagctggtacgaaggccccatcaccttcccagatgcccggaagcgacagcagcacacttgaaagcacattatcagtgacggtcactgagacagaaaccttggataagcccatatccgagggcgagatcctgttctcctgtggccagaaactggcacccaagattttggaggacattgggctgtatttaaccaatctgaacgatagcctgtcctcaacgctgcatgatgccgtcgagatggaggacgatccaccatccgagggacaggtcatccgaatgtcacataagaagtttcatgcagatgctatcctgagcttcgctaagcagaatcaggaatctgcagtgtcacagcaagccgtttaccatagcgaggatctcgagaactctgttggagaactaagtgagggtcagaggcctcagctgactgccgcagccgagaatatcctgatgggtcattctctgtacatgcaaccccctgttacgaatacgcagtccctggatcagcagtgcgacccaaaacccctcagccggcagtttgatacggtttctggatcgatttatgaggattcctgtgcttcccacgggccaatgagtctcggagagctcgagcttgagccaaattccaaattggtgctgcctacaaccttgcttaccgcgcaggaaaatgatgttaatctgccagtagcagcggaagatttcagtcagtaccagctgaagcaaaaccaggatgttaagcaagtggaacacaagccatctcagagctatctccgggtgcgcaataaaagcgatattgcaccatcacagcagcaggtctctcccggagacatggatcgaacgcaaattgagctaaacccctatctaacctgcgtttttagcggtttgggcgttcacgtaaagaaagtcagctgcatcggtaaactcggcctctggaggtttgtcatccagattatctcttctcctagatgggaaagctccgcgacactccggtttacagatgccccttgtcaggacgttagcgacgcagcagtgtcagagccacgtgggttactgtccgtttccgagagtcagcataacgctggcggtcacggggtttttggaggcaggtatctgcttaacggtaagagacagcccgctcagtgcctgtgtcactggttctag

SEQ ID NO: 28429 - DNA, 3138 bp, Artificial Sequence
  Description of Artificial Sequence: Synthetic coding sequence
atgctaacagttcaggttaaaaccagttctgccatcgagttgccagacagtctcgcctttctgtggatcattcccatgtggtattgtgaaggtaaggaactggagaattccccggatattcatatcgtccaggctgggaatctgcacagcttgaccatagccgaggccttcgaagaagatacaggaaggtactcctgcttcgcatcaaatatctacgggaccgactcaacctcagccgagatttacattgagggcgtgtcctcatccgatagcgagggtgaccccaataaggaagaaatgaatcgaatccagaagcccaacgaggtgtcctctcctcctaccactagtgccgtcattccgcctgctgtcccacaggcgcagcacctggtggcgcaaccaagagtggccaccatacagcagtgtcagtcacccaccaactatctccaaggtctggacggaaagccgataattgccgcacctgtgtttacaaagatgttgcaaaacctgagtgctagtgaggggcagctggtggtgtttgagtgtcgcgtcaaaggagcgccatccccaaaagtggagtggtatcgcgagggcacacttatcgaagatagccctgacttccgtatcttacagaagaaacctagaagtatggctgagcccgaagaaatttgtaccctggtgattgcggaagtctttgctgaggacagcgggtgctttacatgtacggcctccaacaaatatggaaccgtctcatctatcgcgcagctccacgtgcgcggaaatgaagacctctctaataatggttcactgcatagtgcaaactcaactactaatctcgctgccattgagccgcagcccagccctccacacagcgagcctccatccgtcgagcagcctcctaagcccaagttggaaggggttcttgtgaaccacaatgaaccccgttcatcatcccgcattggactcagagtccacttcaacctgcctgaggatgataaagggagcgaagcctcttctgaagcgggagtcgtgaccaccagacagacccgccctgattcgtttcaggaacggttcaacgggcaagccactaagacaccagagccaagcagtcccgtaaaagaacccccacctgttttagcaaagccaaaattggactccacgcagttacagcagctacacaatcaagtcctcctggagcaacatcagctacagaatcccccaccctcatcacctaaagaatttcccttctctatgacggtgctgaacagtaatgccccacccgctgtgaccaccagctctaagcaagtgaaggctcctagctcgcagacttttagcctggcaagacctaaatatttcttcccaagcaccaacacaaccgccgcaacagtggcgccttcatcatccccggtgttcacacttagttctacaccacagactatccaacgcacagtgtctaaagagtcgctgcttgtgagccatccttcagtccaaactaaatcccctggcggtctgtctatacagaatgagccattgcctcccggaccaactgaacccaccccccctccttttaccttcagtatacccagcggaaaccaatttcaacccaggtgcgtcagcccgattcccgtgtcaccaaccagcagaatccagaatcccgtggcctttctttcctctgtgctgccaagcttgccagccattcctccaactaacgccatgggtctgcctcggtcagcgccttcaatgccaagtcaggggcttgccaagaagaacaccaagtccccgcagccggtgaacgacgacaacatcagggaaactaaaaacgctgtgatacgcgacctgggcaagaaaattaccttttctgacgtccgtcctaatcagcaagaatataaaatcagctcctttgaacagaggttgatgaatgaaatcgagttccgcctagagagaactccagtggacgaaagcgatgacgagatacagcatgacgaaatccctacaggaaaatgcatcgctcctatatttgataagcggttgaaacattttcgagtgactgagggttcgccagtgactttcacgtgcaaaattgttgggatccctgtgcccaaagtgtactggtttaaggacgggaaacagataagcaagcggaatgaacattgcaaaatgcgaagggaaggagacgggacctgctctcttcacattgaaagcacaacttcagatgatgacggcaattacacgataatggcagccaatccacaggggagaatctcatgcagcgggcacctgatggtccagtccctaccaataaggtcacggctcacatccgccggtcagagtcaccggggacgatccagggtgcaggagcgcgataaggaaccactacaggagaggttctttagaccccatttcctgcaagccccaggagacatggtggctcacgaaggcagactctgccggcttgattgcaaggttagtgggctgcctccgccagaattgacctggctgctgaatggccagccagtcctgcctgatgcctcccacaagatgctggtaagagaaactggagtacatagcctcttgattgaccctttgactcagcgggatgccggaacgtacaagtgcatagctaccaataaaacgggacagaatagcttctctttggagctgtctgtggtagctaaagaagtcaagaaggctcctgtgatcctagaaaagttgcaaaactgtggcgtccctgagggccacccagtcaggcttgagtgccgggtaattgggatgcctcctcccgtgttttactggaagaaagacaacgaaactatcccctgtacaagggaacggatatccatgcaccaagacacaaccggctacgcatgccttctaatccagcccgctaagaaatcagacgcaggctggtatacactctccgccaagaatgaagccggtattgtgtcatgtactgctcggctggatatctacgcacaatggcaccaccagatcccaccacctatgtcagtacgcccttcaggctccaggtacggaagtctgacttcaaaagggttggacattttcagcgcattttcttccatggagagtactatggtgtatagctgctcttcacgttctgtggtagagagtgacgagctgtag

SEQ ID NO: 28430 - DNA, 951 bp, Artificial Sequence
  Description of Artificial Sequence: Synthetic coding sequence
atgaccccatctgaaggagctcgcgctggcaccggtcgggaactggaaatgctcgacagtttgctggccctcgggggtctggtattactgcgagacagcgtggaatgggaaggcaggtcacttttaaaggcactcgtgaaaaaaagcgccctgtgtggcgagcaagttcatattttaggctgcgaggtgtctgaagaagagttcagggaagggtttgacagcgacatcaacaacaggctggtataccacgacttcttccgggatcctctgaattggagcaaaacagaagaggcttttcccggtgggcctctcggagcgctgagagctatgtgtaagcggacagatccagtcccagtgaccattgccctggactcactgagctggctcctgctcagactgccatgcacaacgctgtgccaggtcctgcacgccgtctcgcaccaggattcttgtcccggtgactcatctagtgtgggcaaggtaagtgtcctaggcctcctccatgaggagttgcatggccctggaccagtgggcgctctgagctccttggctcagaccgaggtcactctagggggaacaatggggcaggccagcgcccatattctatgccggcgaccgcgacaaagacctacagaccagacgcagtggtttagcattctgcctgacttctctctggaccttcaagagggcccatctgttgagagccaaccctactctgaccctcacataccacccgtggatcctaccacccacctcactttcaaccttcacctgagcaagaaagagcgagaagcaagggatagcctcatcctgccattccagttttccagcgagaaacagcaggccctcctgcgccctcggccaggccaggcaacaagtcacatcttctatgagccggacgcctacgatgacttggatcaggaggaccctgacgatgatcttgatatctag

SEQ ID NO: 28431 - DNA, 1473 bp, Artificial Sequence
  Description of Artificial Sequence: Synthetic coding sequence
atgaacggagctctcgaccattctgaccagcctgatccagatgccatcaaaatgtttgtgggccagatccctcggtcctggtcagagaaggagttgaaagagctgtttgagccatatggtgccgtgtatcagatcaacgtcctgcgggataggtctcagaaccctcctcagtcaaaaggctgttgtttcgtgaccttttacaccaggaaagctgcactcgaggcccagaacgctctgcacaatatcaagactctgccgggaatgcatcaccccatccagatgaagccggctgatagcgagaaatctaacgctgtggaggatagaaagctgttcattggcatggtgtcaaagaaatgcaacgagaacgacatacgcgttatgtttagccctttcggacagattgaagagtgccggatccttcgagggcctgacggtctgtcccgcggatgcgccttcgtcacattctccacacgcgctatggctcagaacgccatcaaagccatgcaccagagccagactatggagggatgctcgtctcctattgtcgttaagtttgccgacacacagaaagacaaagagcagaggcggctgcaacaacaactggcccagcagatgcagcagctcaatacagctacttgggggaatctgactggactgggtggactcacaccgcagtacctcgcactcctgcagcaggcgacgtcatccagcaacctcggggcattttctggcatacagcaaatggccggaatgaacgccttacagttgcagaatctggccaccctggccgcagcagcagccgcagctcagacgagtgccacctccacaaacgcaaaccctctgtcaactaccagttctgctctgggggctctgacgtccccagtagccgcaagtaccccaaacagcactgcaggcgcagcgatgaactccttgactagcctgggcactctgcaaggcctcgctggcgctaccgtgggcctcaataatatcaacgccttggccgtggctcagatgttgagtggcatggccgcactgaatggaggactgggggcaactgggctcacaaacggtaccgccggaaccatggatgccctgacacaggcctacagcggtatccagcagtacgcagccgcagccctgcctacactgtacagccagagcctgcttcaacagcaatccgctgctggatcgcagaaagagggacccgaaggtgctaatctgtttatatatcacctgccccaggagttcggtgatcaggatattctgcaaatgtttatgccctttggtaacgtgattagtgccaaggttttcattgacaaacagaccaacctcagcaagtgctttggctttgtgagctacgacaatccagtgagcgctcaggccgctatccaggcgatgaacggctttcagatagggatgaagcgactcaaagtccagctgaaacgcagcaagaacgattccaagccgtactag

SEQ ID NO: 28432 - DNA, 1428 bp, Artificial Sequence
  Description of Artificial Sequence: Synthetic coding sequence
atggaagccctactcgagggcatccagaaccggggacacggagggggatttctgacctcatgcgaagccgagcttcaggaactgatgaaacagattgatattatggtcgctcataaaaaatcagagtgggagggcaggacccacgccctagagacatgcctgaagatcagggaacaggaactgaaatcgctgagaagccagctggatgtcacgcataaggaggtgggcatgctccatcagcaagtggaggaacacgaaaagatcaaacaggagatgacaatggagtacaaacaggaattgaagaaacttcacgaggaactgtgcatactaaaacggtcctatgagaagcttcaaaagaaacagatgagagaatttcgaggcaacaccaagaatcaccgggaggatcgcagcgagatcgagcgattaacagccaagattgaggaatttcgccagaaatccctggactgggaaaagcagaggctaatctatcaacagcaggtgagcagcctcgaggctcaaagaaaagccctggcagaacagagtgaaattatccaagcccagctcgtaaacagaaagcagaagcttgaatctgtggaacttagcagccagagcgaaattcagcatctgagcagtaagctcgagcgcgcaaacgacactatttgcgcgaacgagcttgagatcgaacgtctgaccatgcgggtgaatgacctcgttggtaccagcatgactgtcctacaggaacagcaacagaaagaggagaagctccgcgaatccgagaagctgctcgaggccctgcaggaagagaagagggagctcaaggcggcattacagagccaggaaaacctgattcacgaggctcgtattcagaaggagaagctgcaggaaaaggttaaagcgacaaacactcaacacgcagtcgaagctatttcacttgaatccgtctccgctacttgtaagcagctgtcccaggagctcatggaaaagtacgaggagttgaaacgcatggaggcgcataataatgagtacaaggccgaaataaaaaaactgaaggaacagattcttcagggtgagcaatcttacagctccgcgcttgagggaatgaagatggagatctcccatctgacacaggaactgcaccagagagacattactatcgcttcaacaaaagggagcagctctgatatggagaagaggctgagagccgagatgcagaaagccgaagacaaggctgtcgaacacaaggagatcctggaccagctggaatcactgaaactcgaaaaccgccacctcagtgagatggtgatgaaattggagctcggcctacatgagcggtggggctttaccatgctgagtagcctggtactaaattttggcatacaggcaatccgccagccccagcggccaaaggtcctggagttacaggtttag

SEQ ID NO: 28433 - DNA, 2340 bp, Artificial Sequence
  Description of Artificial Sequence: Synthetic coding sequence
atgagaatcgaggagcgtaagagccagcatctcaccggcctgaccgatgagaaagttaaagcatatttgagccttcatccacaggtgctcgatgaattcgtctctgagtctgtgtcagcggagacggtggagaagtggctcaagagaaagaacaataagtccgaagacgagagtgcccctaaagaagtgtcgaggtatcaggacacaaatatgcagggagtcgtgtacgagttaaactcctatatcgagcagaggctagatacgggcggagacaatcagctgcttctgtacgagttgtccagcattataaaaatagccacgaaggcggacggcttcgcgctttactttctgggcgagtgtaataacagcctatgtattttcaccccgcctgggatcaaagagggaaagccacgcctaataccagctggtccgatcacacaaggcaccactgtgtcggcctacgtagccaaaagtcggaaaaccctgcttgttgaagacatcctaggagatgaacggttccctaggggcacaggacttgagtccggcactaggatccaatctgttctgtgtctgcccattgtgacggcaatcggcgacctcattggcattctggagttgtatcgtcactggggcaaagaggctttctgcctcagccaccaggaggtagccaccgctaacttggcctgggcctcggtggccatccaccaggttcaggtttgccggggtctagccaagcaaactgaactcaatgattttctgcttgatgtctctaagacatattttgataatatagtcgcaattgattccctcttggagcatatcatgatctacgcgaaaaaccttgtcaacgccgaccgctgcgcactcttccaggtcgaccataagaacaaggagctgtactcagacctgttcgacattggcgaggagaaggagggcaagccagtgttcaaaaaaacaaaagagattagatttagcatcgagaaagggattgccggacaggtggccagaaccggtgaggtactgaacataccagatgcatatgctgaccctagatttaatcgagaagttgatctgtatacagggtataccactaggaatatactatgtatgccaatcgtttcacggggaagcgtgatcggcgtggtgcagatggttaacaaaatatccggcagcgccttttcgaagactgacgagaacaatttcaagatgttcgctgtattttgcgctctcgctctccattgcgctaacatgtaccaccgaattcgacactcagaatgtatttatagagtgacaatggaaaagttgtcttatcactctatttgcacaagcgaggagtggcagggcctaatgcaattcacactgccggtcaggctgtgcaaggaaattgaactgttccactttgatatcggaccatttgagaatatgtggcccggaatttttgtatatatggtgcatcgaagttgtggcacaagctgttttgagttggagaagctgtgtcgttttattatgagcgtcaagaagaattatagacgagtaccataccacaactggaaacacgccgttactgtggcccactgcatgtacgctatcctgcaaaataatcacacattgtttaccgacctagaacgcaagggattgctgattgcctgtctgtgccatgatctggatcaccgcggtttttccaattcttatctgcaaaaattcgatcaccctctcgcggctctctactctacgagtaccatggaacaacatcacttcagccagacagtttcgatcctgcagttggaggggcataatatcttcagcactctgagttcctcagaatacgaacaagtgcttgagatcattcgtaaggctatcattgcgaccgacctcgcactctactttggcaatagaaaacagctggaggagatgtatcaaacaggttcactgaatctgaacaaccagtcccaccgggaccgtgtaattgggctgatgatgacagcttgtgacctgtgctccgttacgaagttgtggccagtaacaaaactgactgcgaacgacatatacgctgagttctgggccgagggcgatgaaatgaagaagctcgggatacagcctatccccatgatggatcgcgataagaaagatgaagtgccccagggacagctggggttctacaacgcggtcgctattccctgttataccaccctgacccaaatcctgcccccaaccgaacctctgctcaaagcctgcagggataatttgagtcagtgggagaaggtaatccgaggagaagaaacagccacatggatctccagccctagcgtagcacagaaagccgcagcatcagaagattag

SEQ ID NO: 28434 - DNA, 2112 bp, Artificial Sequence
  Description of Artificial Sequence: Synthetic coding sequence
atggcggcagcaaccggggaccccggactctctaaactacagtttgccccattttcaagcgccctcgacgtaggtttttggcatgagcttacacagaagaagctgaatgaatatcgcctcgacgaggccccaaaagacataaagggatactactataacggcgacagtgctggtttgcccgctcgactcaccctggaattctccgcgtttgacatgagcgccccaactcctgccaggtgttgcccagcaattgggactctctacaatacaaatacgctcgagtccttcaagacagctgacaagaaactactgcttgagcaagccgcaaacgagatttgggagagtataaagtccggaaccgccctcgagaaccccgtcctgctgaataaatttctcttgctcacttttgcagacttgaaaaaataccacttctactactggttttgctatcccgctttatgcctgccagaatccctgcctctgattcaggggccagttggactggatcagcgtttttcactcaagcagattgaagcccttgagtgtgcctatgacaacctatgtcaaactgagggagtgacagcactaccttattttcttattaagtatgacgaaaacatggtgctggtatccctactgaagcattactcagacttctttcagggacagcgcaccaaaattaccatcggtgtgtatgatccatgtaacctagcccagtatcccggatggcccttgaggaacttcctcgtgctggccgcacataggtggtcgtcttccttccagagcgttgaagtggtttgttttcgcgataggactatgcaaggcgcaagggacgtcgcacactccattattttcgaggtcaagcttcctgaaatggcgttctcacccgattgccctaaggccgtgggatgggaaaaaaatcaaaaaggcggaatgggcccacgcatggtgaacctgtctgagtgtatggatcctaaacgattggccgaaagctctgtggatttgaatttgaaactgatgtgttggcggctggtgccaacactcgacctggacaaggtggtcagtgtgaaatgcctgttactgggtgccggaacccttggctgcaacgtcgcaaggacactcatgggttggggagtgcgtcacattacgtttgttgataacgcaaagattagttacagcaatcctgtgcgccaacccttatatgagtttgaggactgtctggggggagggaaaccaaaggcgcttgccgcagcagatcggctgcagaagattttccccggagtcaacgccaggggtttcaatatgagtatcccgatgcccggacatcctgtcaatttttccagcgtcactctggagcaggctcggcgagacgtcgagcaacttgagcagctcatagaaagtcatgacgtggtattcctactcatggatacacgggaaagccgctggcttccagcggtgatcgccgcttccaaacgcaaattagtcatcaatgcggctctgggctttgatacttttgtagtgatgcgacatgggttgaaaaaaccaaaacagcagggggcaggagatctgtgtcctaatcaccccgtcgcctctgctgatttgttaggaagctccctcttcgcaaacattccagggtacaagttaggttgttacttctgcaatgatgtagttgcccctggcgattccacgcgagatcgtacccttgatcagcagtgcactgtatctagacccggacttgcggtaattgccggagcattagctgtcgagttgatggtttccgttttgcagcaccctgaaggagggtacgccatcgcatcctcatccgacgatcgcatgaatgagccacccacctctctgggccttgtgccccaccaaatccgcggatttctgagcaggttcgataatgtcctgccggtttcgctcgcattcgataagtgcacagcttgcagctccaaagtactggatcagtatgagagggaaggttttaacttcctggccaaggtgtttaactccagccacagctttctcgaggatttgaccgggctgaccctgctccaccaggagacccaggccgctgaaatctgggacatgtccgatgatgaaaccatctag

SEQ ID NO: 28435 - DNA, 3246 bp, Artificial Sequence
  Description of Artificial Sequence: Synthetic coding sequence
atggagtccgcaggcctcgagcagctgctgcgggaactgttactccccgacactgagaggatccgccgagccacggagcagctgcaaatagtgctgagagcccctgctgccttacccgcactttgtgatttgctcgcatcagccgcagaccctcaaattagacagtttgcggctgtgctgacacgccgtagactcaacacaaggtggcgtaggctggctgcggagcaacgggaatccctcaagagcttaatactaacagctctgcaaagagagacagaacactgtgttagcctaagcttagctcagctgagcgccaccatttttaggaaggaagggctcgaggcctggccacaacttctacagctgctgcagcacagcacacacagcccacattccccagagcgggagatgggcctcctgctattgtcagtggtggtgacgtctaggccagaggctttccagccgcaccacagggaactgcttcgtcttctaaatgagacacttggagaggtcggatcccccggacttctattctacagcttgcgaacacttaccaccatggctccatatttgtcaacagaagacgtccccctcgctcgtatgctggtcccaaaactgatcatggctatgcagaccctgattcctattgatgaagcgaaggcatgtgaagcactggaggccctggatgagctgcttgagtcagaggtgcccgtgataaccccatacctgtctgaggtgctcacattctgccttgaggtggcacgtaacgtggctcttggaaatgccattagaatcagaatcctatgttgcttgacattcctggttaaagtgaagtccaaagctctgctgaagaaccgcctcctgccccctcttctccacactttgtttccaatcgtggctgcagagcctccacccggtcagctagacccggaggaccaagactccgaggaggaggaactagaaattgagctgatgggcgaaacaccaaagcattttgccgttcaggtcgtagacatgttggcactacatctgcctcccgaaaaactgtgtcctcaacttatgccaatgttggaagaggcactgagaagtgaaagcccgtaccagcgtaaagctggattgctggtgttagcggtgctgagtgacggtgccggagaccacatccggcaacgccttctgccgcctctgctgcagatcgtctgtaaaggactcgaagatccttctcaagtcgtacgcaacgctgccctgtttgctctggggcagttttcggagaacctgcagccacatatctcgagctactctcgggaagtcatgccacttcttctggcgtacctcaaaagtgtgccccttgggcacacgcaccatctggccaaagcctgttacgcactcgaaaactttgtggaaaatctgggaccaaaagtgcagccatatttgccagagttaatggagtgcatgctccaactcctacgaaatccctctagcccccgagccaaggagctcgctgtttcggccctgggggcaatagccactgccgcacaggccagcttgctgccttattttcccgctatcatggagcatctgagggaatttctgcttacgggtagggaagatctgcagcctgtccagattcagtctctggagactctgggcgtccttgctcgtgcagtcggagagccgatgcggcctttggctgaggagtgttgtcaactgggtttggggttgtgcgatcaggtcgatgatcccgatctgaggcgctgtacatattccttgttcgctgctctttctggcctgatgggcgaaggattagctccccatctggaacagattacaacgctcatgctcctgagtttgcggtccacggaagggattgttccccagtacgacggatcctcatcctttctcttgttcgatgacgaatctgatggagaggaggaagaagagctgatggacgaagacgtggaagaagaggacgattccgagatcagcggatactctgttgagaatgctttctttgatgagaaggaggacacatgtgccgcagtgggagaaatatccgtgaacactagtgtggcgttcctgccttacatggagagcgttttcgaggaagtgttcaagctgcttgagtgcccccacctcaacgtgagaaaggcggctcatgaagctttagggcagttttgctgtgcactgcataaagcctgccagtcatgccccagcgaaccaaacacagctgccttacaggccgcattggctcgcgttgtgccctcctatatgcaggcagttaaccgggaaagagaacgccaggtcgtcatggcagtacttgaggcccttactggagtactacgctcttgcggtacgcttacactcaagccaccaggcagactggctgaactgtgcggggtgctgaaagctgtgttgcaacggaagaccgcatgtcaggacacagacgaagaggaagaagaggaggacgatgaccaggcagagtacgacgctatgctgctcgagcacgccggagaggcaatacccgcattggctgccgctgccggaggtgattcctttgctccatttttcgctggatttctgcccctgttggtatgcaagaccaagcagggatgcactgtggcggagaagtcctttgctgtcggaactctggcagaaaccattcagggcctcggggctgcaagtgcgcagtttgtgagcagattgcttcctgtccttctctctacagctcaggaggctgaccctgaagttcgctccaacgcaatattcggaatgggagtgttggcagagcatggcggtcaccctgcacaggagcattttcctaagctgctgggactcctgtttccacttctcgccagggagcggcacgacagggttagagataacatttgcggagccctggctagactgctcatggcctctccaacaaggaaacccgagccccaggtgctggctgcattgcttcatgcactccccctgaaagaagacctggaggaatgggtcacgatcggacgactctttagctttctctaccagagcagtccagaccaggttattgatgttgcacctgaattgcttcgaatatgctctctgatcctcgctgataacaaaatccccccagacaccaaggccgcactgctcttgctcctgacctttctggccaaacagcacactgactcttttcaggcggcactcggttctttacctgtggacaaggctcaagagcttcaggctgttctgggcctttcctag

SEQ ID NO: 28436 - DNA, 7223 bp, Artificial Sequence
  Description of Artificial Sequence: Synthetic coding sequence
atggtaggcgagcgtcatgccggagaccttatggtcccactgggccctcggcttcaggcgtaccccgaggaacttatcagacaaagaccaggccatgatggtcatccggaatatctgattcgatggagcgttctgaaatgtggagaagtggggaaggtgggcgtagaggaaggtaaggccgagcatatcctgatgtggctaagcgcgcctgaggtgtatgctaactgtcccggtctgcttggggaacgagccctgagcaaagggctgcaacacgagccggcaggcgtgtccgggtccttccccagggaccctggcggtctggatgaggtggccatgggggaaatggaagctgacgtccaggccttggtgcgccgtgccgctcgccagctagctgagagcgggacaccttctctcacagctgcggtcctgcataccatccacgtgctgtcagcgtacgcctccataggtcccctgaccggtgtgtttcgagagacgggggcactggatctattgatgcatatgctctgcaaccccgagcctcaaatccggagaagtgctggcaagatgctgcaggcactagccgctcacgacgccggtagtcgggctcatgtgcttctctcactttcccagcaggacgggatcgagcaacatatggacttcgattctagatacacactgctcgaactctttgccgaaaccacatccagcgaggaacactgcatggccttcgagggaattcatttgccccagataccgggaaagcttttgttctcactggtgaagaggtacctgtgcgtgaccagcttgttggatcagttgaatagttctcccgagctgggagcaggagatcaatctagcccttgcgccactcgcgaaaagagtcgtgggcaaagggagctggaattctctatggcggtcggaaatctcatctccgaactcgtcagatcaatgggatgggcccgtaacctaagcgagcagggcatgtccccacctagacccacaagatccatctttcagccatacatctccggaccatctttgctgctacctacaattgtgacaacccccagaagacaaggttgggttttcagacagcgatccgagttcagcagtagaagcggatacggcgagtatgtacagcagacactgcaacccggtatgagagtcagaatgctcgacgactacgaggagatttctgccggagacgaaggtgagttccgacaaagtaacaacggcattcctccagtccagaccctcggggagaaggcactcggagagatttctgtgagtgtggaaatggctgaaagccttctgcaggtgctgagcagtcgcttcgagggaagtacattgaacgaccttctaaattcccaaatttataccaagtatggcctgctgtctaatgagccctcaagctccagcacttcccgaaaccatagctgtactcccgacccagaggaagagtccaagtcagaggcatcctttagcgaagaagaaacagaatccctgaaagccaaggctgaagctccaaaaacagaagctgagcctaccaagacccggactgagactccaatggcgcagtctgatagtcagctattcaatcaattgctggtgaccgaagggatgactctgcccaccgaaatgaaggaagcagccagcgaaatggccagggccctccggggacctggcccacgcagctctctggatcagcacgtggcggctgttgtggctacagtgcaaatctccagcctcgacacaaatctccaactctctggactgtccgctctgtcacaggccgttgaggaagtgacagagcgcgatcaccctttagtgcgtcctgatagaagtcttcgtgagaaattggtgaaaatgctggttgagctgcttactaaccaggtcggagagaagatggttgtggttcaggctcttagactgttatacctgcttatgaccaaacacgagtggcggccactgttcgctagggaggggggtatctatgcagtccttgtctgcatgcaggaatacaaaacgtccgtcctcgtacagcaggccggtctcgctgctctgaagatgttagccgttgcctcttccagtgaaatccccacatttgtcacggggcgtgactccatccattcactgttcgatgctcaaatgacacgggaaatctttgctagtattgattctgcgacccgccctggctctgagtccctgctcctgacagtacccgcagcagttatactcatgttaaacacagagggatgttcctcagcagccaggaatggcctgttgttattaaaccttctgctgtgcaatcaccatacgctgggggatcagattatcacgcaggaattacgtgacacactgtttcggcatagcggaatagcccctcgtaccgagcctatgccaaccacgagaaccatattgatgatgcttctgaataggtattctgaaccaccgggaagtcctgagagggcagcactggaaacaccgataatccaggggcaagacggatctcccgaactgctgatcagaagtttagtggggggtccctccgctgagctcctgttggacctcgagagagttctgtgccgtgagggtagcccagggggtgctgtgcgtccccttctcaaaaggctacagcaggagacgcagcccttcctgctgttgctccggactctcgacgcccctggccctaataagacgctcttattgtctgtgctcagggtgatcacaagattattggatttccctgaggctatggttctaccctggcacgaggtgttggagccttgcctcaactgcctgagcggaccctccagcgatagcgaaatcgtgcaggaactgacgtgctttctgcatagactcgcgtccatgcataaagattacgcagtggtgctttgttgcctcggagccaaagaaatcctgtcaaaggtcttggataaacattcagcccagcttctgctggggtgtgagctgcgagaccttgtgactgagtgtgagaaatacgcccagctgtattccaacctcacatctagtatcttggcgggttgcattcagatggtgctcgggcagattgaagaccaccggagaactcaccagccaatcaatataccattcttcgacgttttcctccgacacttgtgccaggggtctagcgtagaggtgaaggaggacaaatgttgggaaaaggtggaggtcagctcaaatccccatcgcgcttccaaactcaccgaccacaatccgaagacttactgggagagcaatggatctaccggcagtcattacatcacactccatatgcaccgtggcgtgttggtgaggcaattaacactgcttgtggccagtgaagattcgtcttatatgcccgctcgggtcgtggttttcgggggtgacagcaccagctgtatcgggacagagctgaacactgttaatgtcatgccatctgctagcagggtgattctgctggaaaaccttaacaggttctggcctataatccagattaggatcaagcggtgccaacaggggggaatagacaccagggtccgcggagtggaggttctgggtccgaagcccacattttggcctctgttccgagaacagctatgccgccgtacctgcttgttctacaccattcgggctcaggcctggtcccgcgatatcgctgaagaccacagaaggttgctgcagctgtgcccaagactcaatagggtcttgcgtcatgaacaaaactttgccgacaggtttctgcccgacgacgaagctgcacaggccctcgggaaaacctgttgggaggcacttgttagcccactggtgcagaatatcacatccccagatgcggaaggcgtgtccgcactcggttggttgctcgaccagtatctggagcagagggagacctctcggaatccactctctcgagcagcaagcttcgcatcacgggtgagacgcctctgccacctattagttcatgttgagccacctcccggaccatctcccgagccgagcacgcgcccattctccaaaaattccaaaggacgggataggtcccccgcaccttccccagtcctcccctcctcgagcctgcgaaacataactcagtgctggctgtctgtagtccaggaacaggttagtcgatttctggctgccgcttggcgtgccccagatttcgtcccccgttactgtaagttgtacgaacatttacagcgggctggtagcgaactcttcggcccacgtgcagcatttatgctcgcgctcaggtcaggatttagcggtgccttgctgcagcagtctttcttgactgcagcccacatgtccgaacagtttgccagatacatcgaccaacagattcagggaggattaattggtggagcaccgggagtagagatgttagggcagctacagcgccatctggaaccgataatggttctctctggattagaattagccactacctttgaacacttttaccaacattacatggccgacaggctcctctcatttggcagctcgtggctggagggcgctgtgctcgaacagataggtctctgttttcctaacaggttgccccagcttatgctgcagtctctgagcacatctgaggaactgcagagacagttccacctgtttcagctccagcggctggacaagctttttctggagcaggaggatgaggaggaaaagaggcttgaagaggaggaggaggaggaggaggaggaggaggccgagaaagaactgtttattgaggacccaagcccggctatttcaatcctggttctgagccctcggtgttggccagtcagtccactctgctatctgtaccaccccaggaagtgcctgccaaccgagttttgtgacgctttggataggttctctagtttctatagccagagccaaaatcacccggtccttgatatgggcccacatcgccgactgcagtggacctggctggggagagccgagctccagttcggcaaacaaattttacatgtctccaccgtgcagatgtggctactgttgaagtttaatcagacggaagaagtcagcgtggaaacgcttttgaaagatagcgatctgtcgccagaactgctcctgcaggcattggtgcccctaacatctggcaacggccctctcacccttcatgaaggacaagatttccctcacggcggagtcctgcggctgcacgagcctggccctcagcggtcaggagaagcgctgtggttaatacccccacaagcatatttgaacgtggagaaagacgaggggaggactttagaacaaaagcgaaacttgctttcatgccttctggtgagaattctgaaggcacacggcgagaagggactgcatatagaccagctggtgtgtttggtgctcgaggcgtggcagaaagggccaaaccctcccggtaccctaggacataccgtcgctggcggagttgcatgtacctccactgatgtactgtcatgtattctgcacctgctcggtcaggggtatgttaagcggagagatgatcgtcctcagattctgatgtatgctgccccagagccaatgggcccttgtcgcggtcaggccgacgtccccttctgcgggagtcagagcgagactagcaagcctagcccggaggccgtcgccaccctggcatctcttcagttgccagctgggcgaacaatgtctccgcaggaagtggaaggcctgatgaagcagaccgtgagacaggtgcaggaaactcttaatctggagccggacgtagcccagcatctcttagcccactcacactggggagccgagcagttactccagtcttacagtgaggaccccgagccgctgcttcttgccgcagggctgtgcgtgcaccaagcgcaggccgttcccgtcaggcctgatcactgtcccgtgtgcgtttcccctcttggctgcgacgacgatttgccctccctgtgttgcatgcactactgttgtaaatcctgttggaacgaatacttgacaaccaggattgaacagaatctcgtgctaaactgtacatgcccaatcgctgattgccccgcacagccgaccggggcttttatacgggcaattgttagtagccctgaagtgatctcaaaatatgagaaggcattgctgcgtggttacgtagagtcgtgttccaacctgacctggtgcacgaacccacaaggctgtgaccgcattctgtgtcggcagggcctgggctgcggcaccacatgttccaaatgcggttgggcttcatgttttaactgttcctttccagaggcccactaccccgcttcttgtggacacatgagtcagtgggtggacgacggcggatattatgacgggatgagcgttgaggctcaatccaaacacttagccaaattaatcagtaagcggtgccccagctgccaggccccaattgagaaaaacgaaggctgtctgcatatgacctgcgctaagtgcaatcacggattttgctggcgctgtctgaagtcctggaagccgaaccataaggactactataattgttccgctatggtgagcaaggccgctcgccaggaaaagaggtttcaagactacaacgagcgatgcacatttcatcatcaggcacgtgagttcgccgtcaatctgcgcaaccgagtgtcagcgattcacgaggttcctcctcctcgttctttcacctttctcaatgatgcgtgtcagggtcttgagcaggcgagaaaggtactggcttacgcttgtgtctattcattttactcgcaggatgcggagtacatggacgttgtggagcaacagacagagaacttggagctccacaccaacgctctgcagatccttcttgaggaaaccctgctgcggtgtcgagatcttgcctctagcctgcggcttctcagggcggactgcttgtctactggcatggaactgttgcgtcgtattcaggaacgtcttctggcgatcctccagcactcagcccaggacttcagagtggggctgcagagcccttctgttgaagcctgggaggctaagggccctaatatgcccggatcccaaccacaggcctcttctggcccagaagctgaagaagaagaggaagatgatgaggacgacgtgcctgagtggcagcaagacgagtttgatgaagaactggataatgatagctttagttatgacgagtcagagaatctcgaccaggaaacattctttttcggcgacgaagaggaggacgaagatgaggcgtacgacta

SEQ ID NO: 28437 - DNA, 672 bp, Artificial Sequence
  Description of Artificial Sequence: Synthetic coding sequence
atggaggatgtgaaactagagttcccttccctcccacagtgtaaggaagacgccgaggaatggacatatcccatgcggagagaaatgcaggagatcctgcctggactgttcctggggccttacagctccgccatgaagtcaaaactccctgtcctgcagaagcacgggattactcatatcatatgtatccgccagaacattgaggcgaacttcattaaacctaattttcagcagctttttcgctaccttgtcctggacatagccgataacccagtagaaaacatcattaggttctttcccatgacaaaggaatttattgacgggtcactgcagatggggggtaaggtgttggtgcatgggaatgccggaatctctcgatctgcagcctttgtgattgcctatataatggaaacattcggcatgaaataccgcgatgccttcgcctacgtgcaggaacgcagattctgcatcaacccaaatgccggatttgttcaccagctgcaagaatacgaagccatctatcttgcaaagttgaccattcagatgatgagccccctccagatagaacgatcactctcagtgcatagtggaaccaccgggtctttaaagagaacacacgaagaggaggacgacttcggcaccatgcaggtagcgactgcccagaacgggtag

SEQ ID NO: 28438 - DNA, 1689 bp, Artificial Sequence
  Description of Artificial Sequence: Synthetic coding sequence
atggatgacaagggtgatccttcaaatgaggaagcgccaaaggcaatcaaacctacttctaaagagttcagaaaaacctggggtttcagaaggaccaccattgccaagcgggagggagcgggagatgctgaagcagatccactggaaccccctccgcctcagcagcagctcgggctgtccctccggcgtagcggtcgacagcctaaacggactgagcgcgtcgagcagtttctgaccatcgccaggcgaaggggtagaaggtcaatgcctgtttccctggaagatagtggggaacctaccagctgtcctgcgactgacgcggaaaccgccagtgagggcagtgttgagtctgcctcagagaccagatccgggccacagtcagcatctacagccgtcaaggaaagaccagcttcctcggagaaagtcaaggggggagatgaccatgatgacacgtcggactccgactccgatggtctcactctcaaggagctccagaatagactcagacggaagcgagagcaggagcctacggagcgtcccttgaagggtatccagagccgtctcagaaagaagcgacgcgaggaagggccagccgagaccgtgggctccgaagccagcgacacggttgagggggtgttgccttccaagcaggaacccgaaaatgatcagggagtggtgagccaggccggaaaggacgatagagagtctaagctggagggaaaggctgctcaggatatcaaagacgaagagcccggagacctgggcaggccaaagcccgagtgtgagggatatgatcctaatgcactctattgcatctgtcgacaaccccacaacaataggttcatgatctgttgcgataggtgcgaggagtggttccatggggattgcgttgggatttccgaggcccgagggaggcttctcgaacgcaatggcgaagattatatctgtcctaactgtacgatcctgcaagtgcaggacgagacacactccgaaactgccgatcaacaggaagccaaatggcgccctggagatgctgatggtaccgattgcacatcaatcggaaccatcgaacagaaatccagcgaggaccagggtatcaagggccgaatcgaaaaagccgcaaacccctccgggaagaaaaagctgaagatcttccagcctgtgattgaggccccaggcgcatcaaaatgtatcggacctggctgctgccatgtggcccagcccgactctgtttattgttccaacgattgtatactcaagcacgcagcagcgacaatgaagttcttgagctccgggaaggaacagaaaccaaaacccaaagaaaagatgaaaatgaagccagagaaaccttccttaccaaagtgtggcgcacaagctggaatcaaaatcagctccgtgcacaaaagacctgctccagagaagaaggagacgaccgtgaagaaggcagtcgtggtgccagccaggtcagaggcactcggcaaagaggccgcatgcgagagttccacccctagctgggcaagcgaccacaattacaacgctgtgaagcccgaaaaaactgctgcaccaagcccttcgcttctgtataagtgcatgtatcatctcggggtgggtctcctcgatccatcacgaagcttctggatcgccatcccctgggcctgtcccggtctcggcgtggcggctctttgctag

SEQ ID NO: 28439 - DNA, 360 bp, Artificial Sequence
  Description of Artificial Sequence: Synthetic coding sequence
atgatcctgcagcagcccctgcaaagaggaccccagggcggagcccagaggctccctagagcggcactgggggtgacctggggcctggacgctcgagagccactacgcaaacagtttctgtctgaggaaaacatggcgacccatttttctcagttgtcccttcacaatgatcatccatattgctcaccacctatgaccttttcaccagccctaccacccctacggagcccctgttcggaattgttactttggcggtatcctggtagtctgatccctgaggccctacggcttctgcggcttggcgatacccctagccccccttacccagccacacctgcaggagatattatggaattgtag

SEQ ID NO: 28440 - DNA, 1794 bp, Artificial Sequence
  Description of Artificial Sequence: Synthetic coding sequence
atggttcctgaggagcgcagggtcgggctaagttccgatgagacttcgtccgatagtctgaagagttggcatagcatttgtgtgttggactccaaggaacagccacttgcttgccaacaaaagcaacgacagttcgtgaaacccgtgacagagtccgaacaacccacagtactcgagcttctgcttgccgaactccgcactctgttctccgccgtcctccaggactcttcacctgctgcctggcggtacctccacgctgtcctgggtctactaccaccttaccgggaactgctcgtgggtcacttagacctactccccttcttggagcagctctactgttgggccccatgggttcagacgcatctccacctggacctgttgggggcaattgtgcaggcattcccaccagactctagcctcctggattccgcttcccatgccgattgctgccctcaaaagcggcgactgcaccaccggcctccttgccctgcatgcccttttgtgcaggcccagtggtcaaggcagcaggtcaaagaggaactcgcaacatggctccggcctcttaccttaccggagcttcagagatgtttgggaatagtcggtgcacaggtcgccttggaagaagccgtgtggttggatggcctttctctgctaccgctggccctggccgctgacatcccagtgcgatatgaatctagtgacactgacaacgccgaagtggaacctgtgggcaggaaagaaactcggagccagctcgattacgaagtgcccagggagaaagctttccagaagtccagcacagggttcagtccggaaacttccttccttgatagccaggtcatgaccgccctcaaaatggagaggtacctgaaaaagatccacttcctttatcttaacgtggcccctagccgatactttagaccctactctctgatggtcgtccccccagacaaagtcaatccggagcactatatctttagccccttcggaattctgcatgtgcatcccgtggagggctctgagactatgacactggggacttggcaccaccactgtgttttatggcagcagttacagttcattccgttcttcaaatattgtttgctgaggaagtcatttacgtgctggaagaaaaacgtcaggttgcaaggactgcatcgactccagaaatttctggagaaccatctgctgctggcagtgccacacttcggggctggcttattacacatcagcaggctgctgcaggagttgcactccgtgtcctggctcccgcaggagcttgaccgctgttacgaattactcgatctgcagacagctcttgccgaagaaaaacataaggccctgaggctgctccaccggtgcctgaacttgtgcacaagtattctgcggttagtgcacgaggatacctatcatatgcagcagtgcttgcaagaacgggtccaaaactgcgaccgaatcaggaccggtcagggcagtatttacctccagcgagtccagcacaagcagttagagcagaagcttaaacaggcagaggcatggtggctgcagctgggtaaattcgcgcgtttagtcgattacatgatatgccagtctctgatttcggttttggaagaacagatcacatccttcgttgcaaatatacttcaggcacctcggcagaagccctttctttcaagtcaattagtcttcgatgaccatggtcaactttctcatgtgccctgtgttgaaaacatgatacagactcttactggtgggctccagagcgttaaaaccagcgcactgcaggtgttctag

SEQ ID NO: 28441 - DNA, 591 bp, Artificial Sequence
  Description of Artificial Sequence: Synthetic coding sequence
atggaagatttgttcgagactttccaggacgaaatggggttctctaatatggaagacgatgggccagaagaagaagaaagggtcgctgagccccaagctaacttcaacacaccacaggctctgaggtttgaagagctgcttgccaaccttctaaatgagcagcatcagattgctaaagagttgttcgagcagctgaagatgaagaagccaagcgccaagcagcaaaaggaggtggaaaaggtgaaaccgcagtgtaaagaggtgcaccagactctgattctggatcccgctcagaggaagcggctgcagcagcagatgcagcagcacgtgcagctgctgacacagatccacctgttagcaacctgtaacccaaatctcaatccggaagcttcctctactaggatatgtctaaaagaactcggaacgttcgcacagtcttctatcgctctacaccatcaatataatccaaagttccagacgctgttccagccctgcaacctgatgggcgcaatgcaattgatcgaagatttctctacacatgttagtatcgactgctccccacacaagactgtgaaaaagaccgtttgctag

SEQ ID NO: 28442 - DNA, 888 bp, Artificial Sequence
  Description of Artificial Sequence: Synthetic coding sequence
atggagttgatccaggataccagtagaccccctttagaatacgtgaaaggcgtccctctgatcaagtatttcgccgaggcccttggcccactgcagagtttccaagctcgccctgatgaccttttgatcaacacatatcccaagtctggaactacctgggtttcccaaatcctggatatgatctaccagggcggtgacctggagaagtgcaaccgcgctcccatatatgtgcgcgtgccttttcttgaagtgaacgaccccggagagccatctggacttgaaacccttaaagacacaccacctccaaggctgatcaaatcccatctgcctctagcactgctgccccaaacactgctggaccagaaagtcaaggtggtatacgtagcacgaaaccccaaggatgtggctgtgagctactatcatttccacaggatggagaaagctcaccccgagcccggaacatgggattcctttctagaaaaatttatggccggagaggtgagctacggtagttggtaccagcacgtccaggaatggtgggagctatcccgaacacatcccgttttgtacctcttctacgaggatatgaaggagaaccccaagagggagatccaaaagattctggagtttgtcggccgatctctcccagaggagaccatggacttcatggtccaacatacaagttttaaagagatgaagaaaaaccccatgaccaattacacaacagtgccacaggaactcatggaccattccatcagtccgtttatgcgcaaaggcatggctggagactggaaaaccaccttcactgtagctcagaacgagcgattcgatgccgattacgctgaaaagatggccggttgtagcctgtcttttagatccgaactgtag

SEQ ID NO: 28443 - DNA, 915 bp, Artificial Sequence
  Description of Artificial Sequence: Synthetic coding sequence
atgaagagagcccatcccgagtattcctcctccgatagcgagctggacgaaacaattgaggtggaaaaggaatccgccgacgaaaatggaaacctgtctagtgcactagggtctatgtcgccgactacctcctcacagattctcgctaggaagagaagacgcggaattattgagaagaggagacgggacaggattaacaactctctctcagaactcagacggctcgttcccagcgctttcgaaaagcagggatccgccaaactggaaaaggcagaaatcctgcagatgaccgtggatcacttaaagatgctgcacacagccggtggaaaaggttattttgatgcacatgctcttgccatggactataggagcctgggctttcgtgagtgtctcgccgaagttgctcggtacctgagcataatagaggggctggacgcttcagaccccctgcgcgtgcgactggttagccacctcaataactatgcgagtcagcgcgaggcagcatcaggagcgcatgctggactaggccatatcccgtggggcactgtcttcggccaccacccacacatagctcaccccctgctgctgcctcagaatggccacggaaacgctgggacgactgccagccctacagaaccacaccatcaaggcagactggggtcagcccatcctgaggcccctgcactgcgagctcccccttccggatccttaggccctgttctgcccgtggtgaccagcgcttctaaactgagccctcctctcctcagcagcgtggcctctctgtcagcttttccgttttcattcggctcgttccacctgctgtctcctaatgctctgtctccctctgcccctacacaggccgcaaatttagggaagccgtacagaccctggggcaccgaaatcggtgctttctag

SEQ ID NO: 28444 - DNA, 2529 bp, Artificial Sequence
  Description of Artificial Sequence: Synthetic coding sequence
atgtgcgggagcgagcgcattctccaagccggaaatattctagagattagggtgggccaggccggagctcggagggtcgctacaatgacctcccctgtgctggtggatattagggaggaagtgacttgccccatctgcctggagctgctaactgagccactctctattgactgtggccactcattttgccaggcatgtattacccccaatggaagggagtctgtgatcggccaggagggggagaggagttgccccgtttgccaaacatcctaccaaccagggaatttaagacccaaccgtcacctggcaaacatcgttagacgactcagggaggttgttcttggtccgggaaaacagcttaaagcagtcctctgtgccgatcatggggagaagctgcaactgttctgccaagaggacggaaaagttatctgctggttatgtgaacgttcccaggaacatagagggcatcataccttcctggtggaggaggtcgcccaggagtatcaggagaaattccaggagagccttaaaaaattgaaaaacgaggagcaagaggctgaaaagctcacggctttcatccgcgagaagaaaacttcttggaagaatcagatggagccggagcgctgtaggattcagaccgagttcaatcagctgcgaaatatactggatagggtcgaacagcgcgagctgaagaagctggaacaggaggagaagaaaggccttaggatcatcgaggaggcggagaatgacttggttcaccagacccagagcctgagggagctgattagcgatctggaacgaaggtgccagggctccacgatggagttgctgcaggacgtgtcggatgtcactgagcgcagcgaattctggacattacggaaaccagaagccctgcccactaaactgagatccatgtttcgggcacccgacctcaagagaatgttgcgggtttgtagggagctgactgacgttcaatcctactgggccatccagggatctcttacaaggagggagaggcgggcttccggggtaaggacacggaggagccaaggtagctccgctatggccagcaaaattttgctgaacgttcaggaggaggtgacatgccctatatgcctggagctgttgaccgaaccactatccctggattgtggccattcactatgtagagcatgcattactgtgtcaaataaggaggcagtgaccagtatgggaggcaaatcatcttgtcctgtgtgcgggatcagttacagctttgagcacctgcaggccaaccagcaccttgcaaatattgtcgagcgcctcaaggaggtaaaactgagtccagacaacggaaaaaaacgtgacctctgcgatcatcacggagagaaactcctgctgttttgtaaggaggatagaaaggtgatttgttggctgtgtgaaagatctcaggagcaccgcggacaccatacggtgctgactgaggaggtgttcaaggagtgccaggagaagctgcaggccgtactgaagaggctgaaaaaagaggaggaagaggcagaaaagctagaggccgacatacgtgaagaaaagacatcatggaaataccaggtgcagacagagcgccagagaatccaaacagaattcgatcagctcaggtcaatcctcaataacgaggagcagagagaattgcagcggttggaggaggaggagaaaaagacccttgataaattcgcggaggcggaagatgagctggtgcagcagaagcagctggtgagagagcttatttccgacgtcgagtgtcgctcccagtggtccacaatggaactgctgcaggatatgagtggcatcatgaagtggagcgaaatctggcgactgaagaagcctaagatggtgtcaaaaaaactgaagaccgtcttccacgcgccagatctctctcgtatgctgcaaatgtttagggagctcacagccgttaggtgctattgggtggatgtgaccctcaattcagtgaacctgaacttgaatctggtgctgtctgaagatcaacgccaggtgatctctgtaccaatttggccctttcagtgttataactacggagttcttgggtcacaatatttctcttccgggaaacattactgggaggtggatgtgagtaagaagacggcctggattctgggagtgtattgtaggacatattcaagacacatgaagtatgttgtcaggcggtgcgctaataggcaaaacctttacaccaaatacagacctttattcggttactgggtaattggcctgcagaataaatgtaagtacggagtgttcgaggagtccttgagctcagatccagaggtccttaccctcagtatggccgttcctccatgtagagtaggcgtcttcttggattacgaggccggaatagtgagttttttcaacgtgacgagccatggtagcctcatctacaagttttctaagtgttgtttctcccagcccgtctacccgtatttcaacccctggaattgtcctgcccctatgactctgtgcccaccttcatcatag

SEQ ID NO: 28445 - DNA, 1497 bp, Artificial Sequence
  Description of Artificial Sequence: Synthetic coding sequence
atgaacggggcactggatcactctgatcagcctgatcctgacgccatcaaaatgttcgtggggcaaattccaagatcatggagcgagaaagagctgaaggagctcttcgaaccatacggggctgtgtatcagataaatgttctacgtgaccgatcacagaatcctcctcagtctaaaggttgctgttttgtgacgttctacacgagaaaagcagcattggaggcccagaacgcgctacataatatcaaaaccctgcctggaatgcatcatcccattcagatgaagccagcggattctgagaagagcaacgccgtagaagaccggaagctgtttatcggcatggttagcaagaagtgcaatgaaaacgacattcgggttatgtttagccccttcggacagatagaagagtgcagaatccttaggggaccggatggactttcccgcggatgcgcatttgtgacattctctacgagggccatggctcaaaatgctattaaggcaatgcatcagagccagaccatggagggttgtagctcgcccatcgtggttaaattcgcagatactcaaaaagataaagagcagcggagacttcagcagcagctggcgcagcagatgcagcaactgaatacggccacctggggtaatttgaccggcctgggcggtctcacgccacagtacttagcactcttacagcaggcgacatccagctcaaatcttggggcattttctgggattcagcaaatggccggtatgaacgccctgcaactgcagaacctcgccactcttgctgccgctgctgccgcagctcagacctctgctacctccacaaacgctaatcccctgagcactaccagttcagctctcggagccttgacatctccggttgccgctagcaccccaaattccactgctggcgcagccatgaattcactgacctcacttggtactctgcaaggccttgccggagccaccgtgggcttgaacaacatcaacgcccttgctgctcccagatcaaagagactcctcctgcctaaggacaacaatggcatggccgctttgaatggaggactcggggctactggtctgacaaacggaacagcaggcacaatggatgccctgacacaggcttactccggcatccagcaatacgcagctgcagctttgccaacactctacagccagagtttacttcagcaacaatcagccgctgggtcacagaaagaggggccagagggagctaatctctttatttatcacctccctcaggagtttggcgaccaagacatcctgcaaatgtttatgccctttggaaatgtgatctccgccaaggtgtttattgataaacagacaaacctgtccaaatgtttcggatttgtgtcctacgacaaccccgtgtcagcgcaggctgccatccaggctatgaatggattccagataggcatgaaaaggcttaaagtgcagttgaagcgcagcaaaaacgactctaagccttactag

SEQ ID NO: 28446 - DNA, 2580 bp, Artificial Sequence
  Description of Artificial Sequence: Synthetic coding sequence
atgctggaggtgctggaagagatctggagtgtgcgggctcggagggcccaccggccatgccctgggccatccctcgcagatgacacggatgctaactctaatggatcatcagggaacgagtcaaacggtcatgagtctagaggcgcttcacagcgatcctctcattcttcttcctccgggaacggtaaagatagtgcccttcttgaaaccactgagtctagtaaatcaaccaactcccagtcaccctccccgccttccagcagcattgcttacagtctgctgagcgcctccagcgagcaagacaacccgagtaccagcggatgcagttctgagcaatccgccagggctaggacccaaaaggagcttatgaccgcactcagagaactgaagcttcgtttgccccctgagcggagaggcaaaggacggtccgggaccctggcaacactacaatatgccctggcttgtgtgaaacaggtgcaggctaaccaggagtattatcagcagtggagcctggaagagggtgagccttgcagtatggacatgtcaacctataccctcgaggagctcgagcacatcacttccgagtacacgttgcagaatcaggacacgttctccgttgcggtaagctttcttacaggtcgaatagtttacatttcggagcaagcggcagtgctactccgctgcaaaagagacgtgttccggggtactcgttttagcgagctgctggcaccccaagacgttggagtattttacggcagcacggcgccttcccggctgcctacatggggcacaggtgcttcagccggaagtggtttgcgggattttactcaagaaaagtccgtattttgccgaatccggggtggtcccgaccgcgatcccggacctcgttatcaacccttcaggctgacgccttacgtgacgaagattagggtcagcgacggagcgccagcccaaccctgctgcttgctcatagcagagcgcatccattctgggtacgaggccccaagaattccacctgacaagagaattttcacgactcgacatacccccagctgtttatttcaagatgttgatgagcgtgccgctcctttattgggctatctgcctcaagacttattaggcgctccagtccttttgttcctccatcctgaagatcggcctctcatgttagccattcacaaaaaaatccttcagctcgccggacagccatttgaccacagccccatcaggttctgcgcaagaaatggcgagtacgtcacaatggatacgagttgggctggcttcgtgcatccgtggtcgaggaaagttgctttcgtgctcggtcggcataaagtgaggacggcaccattaaacgaggatgtattcaccccgcctgcacctagtcccgcaccctctctggataccgatatccaagagctatctgagcagatacatcggcttctactgcagcccgtgcatagtccttccccaaccggactctgtggcgtgggggcagtgacaagccccggacccctgcatagcccgggatcctcaagcgatagtaacggcggagatgccgagggacccggtccacccgcaccggtgaccttccagcaaatttgcaaggacgttcacctggtgaagcatcaagggcaacagctgtttatagagagccgagctaggccacagtccagacccaggctgcccgcaaccggaaccttcaaggccaaggccctgccatgccaaagccccgatcccgagcttgaggccggatcagctcctgtacaggctccactggcactcgtccccgaggaagcagaaaggaaagaggcaagttcatgcagctaccaacagatcaactgcttggactctatactacggtatttggagtcttgcaatctgccaagcaccacaaaacggaaatgtgccagctcgtcttcttataccaccagcagcgcctccgacgatgatcgccaacgtaccggtcccgtgagcgtgggcacaaagaaagacccgccaagcgctgcactgagcggtgagggagccacccccagaaaggagcctgtagtcgggggaacactatctccgctggctcttgcaaacaaggcagagtccgtggtctccgtgacctctcaatgcagtttttcaagtactattgtgcacgtaggagataagaaacccccagagagcgacattatcatgatggaggatctgcctggactggccccaggccctgcgccatcccccgcacccagtccaacagtggctcctgatcccgctcctgacgcctatcgccctgtcggcctgactaaggctgttctctccctccacacacagaaagaggagcaggcgttcttatctcgatttagggacctcggccgattgagaggccttgatagctcctcgaccgcccctagcgcccttggcgagcgtgggtcacacctcgggccacccggagcctgcccccttcctagtctgggcctagactgctggggggttggcctgaagggaggcgtgtcagctccgggaactcaggccggtgtggcaagcaccactcgtccttgcttggggaccggaccaagtcttgccagcccacattag

SEQ ID NO: 28447 - DNA, 1266 bp, Artificial Sequence
  Description of Artificial Sequence: Synthetic coding sequence
atggcttcatccagtgtccccccagccactgtatcggctgccacagcaggcccaggaccgggatttggcttcgccagcaagaccaagaagaaacacttcgtgcaacaaaaagttaaggtttttagagctgctgaccctctcgtgggagtcttcctgtggggtgtggcgcattcgattaacgagttaagccaggtcccccctcccgtcatgctgctcccagatgacttcaaagcaagttcaaagattaaagtcaacaatcacctttttcaccgggagaacctgcctagtcattttaagttcaaagaatactgcccccaggtgtttcggaatctccgtgaccgattcggcatcgacgaccaggactatctggtttcattgactcgcaaccccccaagcgagagcgagggatccgacggaagatttctcataagctacgatcggacacttgttattaaagaagtgtcttcagaggacattgccgacatgcactcaaatttatctaactatcatcaatatatcgtgaagtgccacggtaacacccttctgccccaattcctggggatgtacagagtctcagtggacaacgaggattcctacatgctcgtgatgaggaacatgttttctcatcggctcccggtgcaccgcaagtatgacctgaagggaagcctggtgtctcgtgaggcaagcgacaaggaaaaggtgaaggagttgcctaccctgaaagacatggacttcctgaacaagaatcagaaagtatacatcggcgaggaggaaaaaaagatatttttggagaaattaaaaagggacgtcgagtttcttgtgcagctgaagataatggactactccttgctactcggaatccatgacattatccgaggatctgaacctgaagaagaggcgcctgtgcgtgaagatgaatcagaagtcgacggcgactgttcgcttacaggcccacctgcactggtcggatcttatgggactagcccggaagggattgggggttatatccattcacatagaccactcggccctggcgagtttgagagttttatcgatgtttatgcgatccgctctgcggagggggctccacagaaagaggtctatttcatgggactgatcgatatcctgacccagtacgacgccaaaaaaaaggccgctcatgctgcgaagaccgtgaagcatggtgctggcgcagagatcagtaccgttcacccagagcagtacgcaaagagattcttagactttattactaacatttttgcgtag

SEQ ID NO: 28448 - DNA, 2031 bp, Artificial Sequence
  Description of Artificial Sequence: Synthetic coding sequence
atggccgcagctactggcgaccccggactgagcaaactgcagtttgcacccttttcttcagccctagacgtcgggttttggcatgaactgacgcagaaaaagctgaacgagtaccggttggatgaggcccctaaggatataaagggatactactacaacggggacagcgcaggtctacctgcccgtctcaccctcgagttctcagctttcgacatgagtgctccaacccccgctcggtgctgtcctgccatcgggaccctgtacaacaccaacaccctcgaatcatttaaaaccgccgataagaagcttctgctggaacaagcagcaaacgaaatttgggaatctataaagtccgggaccgccttggagaaccccgttttgctgaacaagttcttgctcctgactttcgccgacttgaaaaaataccacttctactactggttctgctaccccgctctatgtctgccggagtctctcccccttattcagggaccagttggcttagaccagaggttctctctgaagcagatcgaagcgctggagtgcgcatatgacaatctctgtcagacagaaggtgtgacagccctcccttacttcttgattaaatacgacgagaatatggtgcttgtttccctgctgaaacattacagcgacttttttcagggccagcggactaagattaccatcggggtctacgatccatgtaatctcgcccagtaccctgggtggccactgcgaaacttcttagttcttgcggcacacagatggtctagtagcttccaatccgttgaagtcgtttgttttcgcgacagaacaatgcaaggagccagagacgtggcccactcaatcatcttcgaggtgaagctccccgaaatggcattcagccccgactgtcctaaagccgtgggctgggagaaaaatcagaagggcggaatggggccacgcatggtgaatttaagcgagtgcatggaccctaaaagactggcagaatcttcggtggatctgaacctcaaattaatgtgttggaggcttgtgccaaccttagacctcgacaaagtggtttccgtcaagtgcttgttgctaggggctggcacccttggctgcaatgtggctaggaccctcatgggctggggcgtacgacatataacatttgtagataacgccaaaattagctactcaaatcccgtgcgacagcccctttatgaattcgaggactgcctgggtggcggtaagcccaaggctcttgccgctgccgacaggttacaaaaaatttttccaggcgtaaatgcccgaggcttcaatatgagcatcccaatgcctggccaccctgtaaacttctcttctgtgaccctggaacaggcgaggagagatgtggaacagctcgagcagctgattgagagtcacgatgttgtgttcctccttatggacacgagagaatcgcgctggctgcccgcagtcatagccgcttccaaacgcaagctggtgataaatgctgccttggggttcgatacctttgtcgtgatgagacacggactgaagaaaccgaagcaacaaggggcaggggacctttgtcccaaccacccagtggcctcagcagacctgctggggtcctctctgtttgctaacatccccggatacaagctcgggtgctacttctgtaacgatgttgttgcaccgggtgatagtacacgcgacaggaccctggatcagcaatgtaccgtgagccggccaggcctggccgtaatcgcgggtgccctcgccgtggaacttatggtgtccgttctgcagcaccctgaggggggatatgctattgcttcctccagtgatgaccggatgaatgaacccccaacatctttaggcctcgtcccccatcaggtactggaccagtacgagcgagaaggatttaacttcttagccaaagtgtttaatagctcacacagcttcctggaagatcttacgggcctgacactactccaccaggaaacacaggccgcagagatttgggatatgtcagacgacgagacaatctag

SEQ ID NO: 28449 - DNA, 1329 bp, Artificial Sequence
  Description of Artificial Sequence: Synthetic coding sequence
atggcctcagacggcgcttctgccctgcctggacctgacatgagtatgaagccctctgccgctccatcaccaagcccagcccttccattcctgcctccaacctctgatccccctgaccaccctccccgagaacctcccccacaaccgatcatgccctctgtcttttcccctgataacccgttgatgctgtctgccttcccttcatcactgttggtgacaggcgacggcggaccttgcctgtccggagctggagctgggaaagtgatcgtcaaggttaaaacggaagggggtagcgccgagccctcccaaacccagaacttcatcctgactcagactgcccttaacagtacagccccaggaacgccatgtgggggtctcgagggaccggcacctccatttgttactgcttccaatgtgaaaacaattcttccaagcaaggcagtaggggtgtcgcaggaagggcctcccggtttgccaccccagccgccacctcctgtagcgcagctggtacctattgttccattagagaaggcgtggcctggaccacacggaacgactggcgaggggggtcccgtggccactctgagtaaaccgtcactgggggaccgttccaaaattagcaaagatgtgtacgaaaattttcggcagtggcaaagatataaggctttagccaggaggcacctgtctcagagccccgatacagaagcggttaaggagtacgtcgacatcatggaatggcttgtggggacccatctggccacgggcgaatctgacggcaaacaagaggaagagggccaacaacaggaagaagaagggatgtatcccgaccccggactccttagctacataaacgagctctgcagccagaaggtcttcgtgtccaaagtcgaggccgtgatccacccccagttcctggcagatctgctgtcgccagagaagcagagagatccgctggcattgatcgaggaactcgaacaagaggagggactcactctggcgcaactggtgcagaaacggttgatggcactggaagaggaggaggatgcagaagccccaccttcgttctctggtgcccagttagactccagtccgtcagggtccgttgaagacgaggatggcgatggaaggctcagaccgtcacctgggctgcagggcgcaggaggggctgcttgcctgggcaaggtgtccagcagtggtaagagggccagggaagtccatggagggcaggagcaggccttggactcccctaggggcatgcacagagacgggaacacactccctagtccatcttcctgggatttaccgactaacggagagagccagtgctag

SEQ ID NO: 28450 - DNA, 666 bp, Artificial Sequence
  Description of Artificial Sequence: Synthetic coding sequence
atgcaagttcaggacgacggggtgaatctcattcccttcgcaaagtgtagtcgtgtggtgagtcgcagcccccctccacgcctgcccagtcagtcgctgcgacctatgccgcagagatacggcgacgttttttggaagaacctcaaccaacgccctactcctacctggctggaggaacagcacatcccgcctatgcttctgccccctcccgagatgctgtggagaagaaaaaaacgaaggccctgtctggaagggatgcagcagcaaggccttggcggagtgcctgcaagggttagagcggtcacctatcacctggaggatttgcggagaagacagtccattattaatgaactcaaaaaagcccaatggggcagcagtggcgcagcatcagaacctgtcgtcctcggcgaggagggatgtggattccctagcacaaacgaatacccagacctcgaggaagagagggctacatacccccaggaagaggatagattcctgacacctggccgagcgcaactcctgtggagcccttggagtccattggaccaggaggaagcttgcgcctctcgccagctccactcgctcgccagcttttctaccgtgacagctagaaggaatcctctgcacaatccctggggcatggaattggccgcatccgaggagtag

SEQ ID NO: 28451 - DNA, 480 bp, Artificial Sequence
  Description of Artificial Sequence: Synthetic coding sequence
atgcagcgtgtcggaaacacatttagcaatgagagtagggttgcaagtcggtgccctagtgtaggactggccgagcgcaatcgtgtggccaccatgcctgtgagactgctgcgagatagcccggcagcccaggaggataatgatcatgcacgggatggattccagatgaagttagacgcacatggatttgcccctgaggagcttgttgtgcaagtcgatggtcaatggctgatggtgaccggtcaacagcagctagacgtgagagaccctgaaagggtgagctatcgaatgtcgcagaaggttcaccgcaaaatgctaccatctaatctttctccgaccgctatgacatgctgcttgacccctagcggccagctgtgggtaagagggcaatgcgttgccctagccctgcctgaggctcagaccggaccttcccctagactcggtagcctcggaagtaaggcatctaacctgacccggtag

SEQ ID NO: 28452 - DNA, 1782 bp, Artificial Sequence
  Description of Artificial Sequence: Synthetic coding sequence
atggaaaaactgagcgccctccaggagcagaaaggggaattaaggaagcgtctgtcctacacaactcacaaactggagaagttggaaactgagtttgactccactcggcactatctggagattgagttgagaagggcgcaggaggaactcgagaaggtaacagaaaaattgcggaggatccaaagtaattacatggctcttcagaggattaaccaggaactagaagataagctgtacagaatgggacaacattatgaagaggagaaaagggccctgtctcacgagattgtggcacttaactctcaccttctggaagctaaagtgactatcgacaagttgagcgaggataatgaattgtatcgaaaagattgcaacctggctgctcagctgctgcaatgctcccagacctacggaagagttcacaaggtatcggagctgccaagcgattttcaagaacgggtgtcactacacatggagaagcatgggtgcagcttgccatctcctctttgtcatccagcctacgcagacagtgtccctacctgtgttatcgcaaaggtgctcgagaaaccagatccagcttcccttagttccaggctgagtgacgcttctgctcgtgatctggcattctgcgacggtgtcgagaagcccggacccagacccccatataaaggcgacatctactgcagcgacactgccctgtactgcccagaggagcggaggagagatcgcaggccgagcgtcgacgctcctgtgaccgatgtcggcttcctgcgtgctcagaattctactgatagtgcagctgaggaggaggaggaagcagaggctgctgcttttcccgcaggtttccagcacgaagcattcccctcatacgctggttccctccctacaagtagctcctattcgagtttctccgcaacttctgaagagaaagagcacgcacaagctagcaccttaactgcctcacagcaggccatctatctaaactcacgcgacgagctgttcgacagaaaaccacccgcaacgacctatgaaggctctcccagattcgccaaggccactgcagccgtggccgcacccttggaagcggaagttgctcccggatttggacgaactatgtccccctatcctgcggagactttcagatttcctgccagtccagggccacagcaagctctgatgcccccaaatctgtggagtctgagggccaaacctggaacagcaagactcccgggtgaagatatgaggggccagtggcgcccattgagcgtggaagacatcggcgcttactcatatccagtttcggcggctggtcgtgcctccccgtgttcatttagcgaaagatattacggcggagcaggcggtagccccggaaagaaggccgatggaagggcttcgcctctatatgctagctataaggcggacagcttcagtgagggggatgacctgagtcaggggcacttggcggaaccctgttttctgcgggctggcggagatttatccctctctccaggacggtcggccgaccccctgccaggctacgcgccttctgaaggcggagacggggatcgactcggtgtgcagctctgcggcaccgcttccagccctgagccggagcagggatcccgtgattcccttgagccctcgtccatggaggcaagtccagagatgcaccccgctgccaggttaagccctcagcaagctttcccaaggactgggggtagcggtctgtccagaaaggactctctgacaaaagcacagttgtacggaacattactgaactag

SEQ ID NO: 28453 - DNA, 2610 bp, Artificial Sequence
  Description of Artificial Sequence: Synthetic coding sequence
atggggaacagggagatggaagagttaatcccacttgtgaataggctccaggatgcattctcggccctgggacagtcgtgcctgctggagctgccccagatcgccgtagtgggcggtcagagcgctggaaaatcttctgtcctggagaattttgtcggaagagacttcctgccacgtggatctggcattgtaacgcgtcgacctctcgtgctgcagctcgtgacctctaaggccgagtacgcagagttcctgcactgcaagggcaagaaattcactgactttgacgaagttagattggagatcgaagcagagacagatagagtcaccggcatgaacaagggcattagttctattcctattaatcttagagtgtattctccgcacgttctcaacttaactttgatcgaccttccaggcatcaccaaggtgccggtcggagaccaacctccagacatagaataccagattagagagatgatcatgcaatttattaccagagagaactgtctgatccttgctgtgactccagcaaataccgacctggctaattccgacgcactgaagctcgcaaaagaggtggacccacagggcttgcggaccataggggttataaccaaactggatcttatggacgaggggaccgacgccagagatgtgctggagaataaacttctgccactccgccgaggctatgttggagttgtcaaccggtcccagaaggacatagacgggaagaaggacatcaaggccgcaatgctggcggaaagaaaattcttcctctcgcacccagcctaccgacacatcgccgatcgtatgggcacacctcatctgcagaaagttctgaatcagcagctgacaaatcatatccgcgatacactccctaactttaggaataagctgcaggggcaattgctatcaatagaacatgaagttgaggcatacaaaaattttaagcccgaagatcctacaagaaaaacaaaggccctgcttcagatggttcaacagtttgctgttgacttcgaaaaaagaatcgagggtagtggggaccaagtggatacattggaactgtccgggggagctaagattaatcgaatttttcacgaacgattcccatttgagatcgtgaagatggaattcaacgaaaaagagctccgtagggagattagctacgctatcaaaaacatacacggtatccggactggcctatttaccccggatatggccttcgaggctattgttaagaaacagatagtgaaactcaaaggtccatccctgaagtctgtcgacctggtgattcaagagctgatcaatactgtgaagaagtgcacgaaaaaactggctaactttccccgtttatgtgaggagactgaacgcattgtagcaaaccatatcagagaacgggaaggaaaaaccaaggatcaggtacttctcctcatcgatatacaggtgtcatatatcaacaccaatcatgaggactttattgggtttgcaaacgcccagcagcgctccagccaggttcataagaaaaccacggtagggaaccaaggaaccaatctgcctcctagtcgtcagatagtcattcgcaaagggtggctgacgatcagcaacattggaatcatgaaggggggaagtaagggctactggttcgtgctaactgccgaaagcctgtcatggtataaggatgatgaagagaaggaaaaaaaatacatgctgcctctagacaaccttaaagtgcgcgatgttgaaaaatcctttatgtcaagcaagcacatttttgcactgtttaatactgagcaaaggaatgtctacaaggactatcgcttcttagagctggcgtgcgattcccaggaggacgtcgactcatggaaagcatcccttttgcgggcaggggtctaccccgacaaatcggtggcagagaatgatgaaaatggtcaagccgaaaatttctcaatggatccacagctggagcgccaggtggagacaattcgcaatctggtggattcttatatgtccattataaacaagtgcatcagggatctgattcccaaaaccatcatgcatttgatgatcaataatgtaaaagactttatcaattcggagttgctggctcagttgtactcctcggaggaccagaacacactgatggaggagagcgccgaacaggctcaacgccgtgatgagatgcttcggatgtaccaggcgcttaaagaagcactgggcattatcggcgacatctcaactgctacagtgtccaccccggctccacctccggttgacgattcatggatccagcactcgcggaggtcgcctcccccatcccctacaacacaacgcaggcccacccttagtgctcctctggccagaccgacgtccggaagaggtccagctccagctataccctcgccaggaccgcacagtggcgcaccaccggtacccttcaggcctggccctcttcctcccttcccttcttcatccgactcattcggcgcaccaccccaggttccctcacggcctacaagagccccaccttccgttccgagccgtagaccccctccttcccctaccaggcctaccataatccggccacttgagtcatctctgctcgactag

SEQ ID NO: 28454 - DNA, 1896 bp, Artificial Sequence
  Description of Artificial Sequence: Synthetic coding sequence
atgaactctagcgacgaggaaaagcagctccaacttatcacgagcttaaaggaacaggctatcggcgagtatgaagatctgcgggcagaaaaccagaagaccaaggaaaaatgtgacaaaatcagacaggagcgcgacgaggccgtgaagaaactggaggagttccagaaaatctcccacatggtgattgaggaggtaaactttatgcaaaaccatctcgaaatcgagaagacctgccgcgagtcagcagaggcgcttgccacaaaattgaacaaggagaacaaaactctgaagagaatctcaatgctctacatggcgaaacttggaccagatgtgataacagaagagatcaacattgatgacgaggattctaccacagacacagatggggctgcagaaacgtgcgtgtcagtgcaatgccaaaagcaaatcaaggagcttcgggatcagattgtgtcagttcaagaggaaaaaaaaatcctggcgatagagctggagaacctgaaatccaagctcgtggaagtgattgaggaagtgaacaaggtcaagcaagaaaaaactgtgcttaatagcgaagtgctggagcaacgcaaagtactagagaaatgtaatagggttagcatgctagccgtagaggagtacgaggaaatgcaggttaatctggaactggagaaggacttgaggaagaaggccgagagttttgcacaggaaatgtttatcgaacagaacaaactgaagcgacagagccatttactgttgcaatcttcgattcccgaccagcagctgctgaaggcacttgacgagaacgctaagttaacacaacagttagaagaagagcgtattcagcatcagcaaaaagttaaagaattagaggaacagttagagaacgagaccctacacaaggagattcataatctgaagcagcagttagagcttcttgaagaggataagaaggagctagaattaaagtatcagaacagcgaagagaaggcccgaaacctgaagcattccgtcgatgagcttcagaagagggtgaaccagtctgaaaattccgtacctcccccacccccacccccaccaccactcccaccacctcctcctaatcccatccggagcttaatgtctatgatcagaaagaggtcacatccctccgggtctggagcaaaaaaggagaaagccacacaacctgagacaacagaagaagtgaccgacctgaagcggcaggctgtcgaggaaatgatggacagaataaagaaaggcgtccacctccgaccagtgaatcagacagccagacccaaaacaaagccagaatcttcaaaaggctgcgagtcagcggtcgacgagctgaaggggatcctggggacactgaacaaaagcacatcttcaagaagtttgaagagcttagatccagagaactctgagacagagcttgagagaatcctaagacggaggaaggtcaccgccgaggcggattcatcttcccctactggtatccttgcaacatccgagtccaagagtatgccagttcttggctcagtatccagtgtgaccaagacagccctgaacaaaaaaaccctcgaagcagagttcaatagtcctagtcccccaacccctgagcctggtgagggccctcgtaagctcgagggttgcacgtcctccaaggtgactttccagcccccttccagcatcgggtgcagaaaaaaatacatcgatggagagaaacaagccgaaccggtcgtggtactggaccctgtgtccacccatgaacctcagactaaagaccaggtagcagaaaaagaccctacccagcacaaagaggacgaaggcgaaatacagccagagaataaagaggatagcattgaaaatgtcagagagactgactccagtaattgctag

SEQ ID NO: 28455 - DNA, 1701 bp, Artificial Sequence
  Description of Artificial Sequence: Synthetic coding sequence
atggaccttcaccgcgcagcgttcaagatggagaacagctcctacctgcccaatccactggcctccccagccctgatggtgctggcaagtaccgccgaagcgagccgcgatgctagtatcccatgccaacaaccaagacctttcggcgtccccgtgtccgtagacaaggacgtccatataccttttacaaacgggtcgtataccttcgcaagcatgtatcaccgccaaggaggtgtgcccggaactttcgccaacagggatttcccccctagcctactgcacctgcacccccaattcgctccgcctaatctagactgtacacctatttctatgctgaaccactctggggtaggggcatttcgtcccttcgcctcgaccgaggatcgggagtcttatcaatctgcttttactcccgcaaagagactgaaaaactgccacgacacagagtcccctcacctgaggttttccgatgcagatggcaaagaatacgattttggaacccagttgccttctagctccccaggatccttgaaggtagacgatactggaaagaagatcttcgccgtctcgggattaatatccgatcgtgaagcttcctcctcaccagaggatagaaacgaccgctgcaaaaagaaggcggctgccctttttgattcccaggcacccatctgtcctatatgtcaagtgctcctccgtcccagtgagcttcaagagcacatggagcaggaactggagcaactggcccagctgccctcttccaagaactccctgctgaaggacgcaatggcccctggcactccaaagtccctcctcctcagcgctagtattaagagggagggcgaatcacccactgccagtccacattcgtctgctactgatgaccttcatcacagcgatcggtaccaaaccttcctgcgcgtacgcgctaacagacagacaaggcttaatgctagaatcggcaaaatgaaaagaaggaaacaggatgagggtcaaagagaaggatcctgcatggccgaggatgatgcagtcgatatcgagcacgagaacaacaatagatttgaagagtatgaatggtgcgggcagaaacgaattagagctactacattgctcgaggggggattccgtggcagcggctttataatgtgcagcgggaaggaaaatcccgactccgatgcagacctggatgttgatggcgatgacacactggaatatggaaagcctcaatacacggaagcggacgttattccatgcaccggagaagagcccggagaagcaaaagagagagaggcacttaggggggcagttctgaatgggggtcctccctcaacacgaatcacgccagagttctcaaaatgggctagcgatgagatgccttctacaagcaatggagagtccagtaagcaggaggccatgcagaaaacctgtaaaaactccgacatcgagaaaatcactgaggactccgccgtgaccacctttgaagcactcaaggccagggtgagggaactggagcgccagctttcgcgcggagaccggtataagtgtctaatttgcatggatagctattcgatgccattaactagtatccagtgctggcatgtgcactgcgaagaatgttggctgaggacgttgggtgccaaaaagctctgcccgcaatgcaacaccatcacagcaccgggagacctgagacgcatctatctctag

SEQ ID NO: 28456 - DNA, 1071 bp, Artificial Sequence
  Description of Artificial Sequence: Synthetic coding sequence
atgctgtcggccatcactaatgtcgtgcagaacaccggcaaatcagtgctgacaggcggtctcgatgctctggagttcatcggcaagaaaaccatgaatgtgctggccgaaagcgaccccggattcaagaggacaaaaacccttatggaaagaactgtttccttatctcagatgctgcgggaggccaaagaaaaggagaaacagcggctggctcaacagctaaccatggaacggaccgctcactatgggatgctgttcgacgagtatcagggcctctcacatctggaggctctggagatcctgagcaacgagtccgaatccaaggtccagagtttcctcgcaagtctggatggcgagaaactggaactactgaaaaacgatctgatttctatcaaagacatttttgctgcaaaggaactggagaatgaagagaaccaggaggagcagggcctcgaggaaaaaggagaggaattcgcacggatgctgacagaattactgtttgaactccatgtggccgctacccccgacaaattaaacaaagcaatgaagcgtgcccacgattgggtggaagaggaccaaaccgtcgtgtccgtggacgtggcaaaagtatctgaggaggaaacaaagaaggaggagaaggaggaaaagagtcaggatccccaagaggacaaaaaggaggagaaaaagacaaaaacaatagaggaagtgtatatgtcctctattgagtccttagccgaggtgaccgctagatgtatagagcagttgcataaagtcgctgaacttatactgcatggccaggaagaagaaaaacccgcacaggatcaggccaaagttctgatcaagctcacaacagcaatgtgtaatgaagtcgccagtctttccaagaagttcactaactccctgaccaccgtcgggagcaataagaaggccgaagttcttaaccccatgattagctcagttctgctggaggggtgtaacagcaccacctatatccaagacgccttccagttgcttttacctgttcttcaggtctcccacatccagacttcttgcttgaaggcccagccttag

SEQ ID NO: 28457 - DNA, 519 bp, Artificial Sequence
  Description of Artificial Sequence: Synthetic coding sequence
atgagctataactgttgtagcggtaatttcagtagccgcagctgcgggggttacctccactatcccgcatcctcttgtggcttttcctatccttccaaccaggtgtactccacggacctctgttcccctagcacatgccagttaggtagcagcttgtatcggggatgtcaacagacatgttgggagccaaccagctgtcagacatcctacgtagagtcaagcccatgtcagacatcctgttatcgccctaggacttcgcttttatgctccccgtgtcaaacgacctactctggctcactgggtttcggttcttcctcctgtcgcagtctgggttatggttccagaagctgctattcagtcggatgtggatcctcaggcttcaggagcctgggatatggaggatgcggcttcccaagcctcggctacggagtaggcttttgccgtccgacctacctggcaagtcggtcttgtcagtctagttgctaccgccctacatgcgggtccgggttctactactag

SEQ ID NO: 28458 - DNA, 2253 bp, Artificial Sequence
  Description of Artificial Sequence: Synthetic coding sequence
atggaagatctgttcgaaaccttccaagatgagatggggttctccaacatggaggacgacggacctgaagaagaagagagggttgctgagccacaagcgaactttaacacacctcaagcacttcgattcgaggagctgctggccaacctactaaatgagcaacaccagatagccaaggagctattcgaacagctcaagatgaaaaaaccatctgctaagcagcagaaggaagtagaaaaggttaagccgcagtgtaaggaggttcaccagaccctgatcctcgaccctgcccagcgaaagcgccttcagcagcagatgcaacaacatgtccagctgctgacccaaattcacctgctggccacttgcaaccccaatttaaacccagaagcctccagcactaggatctgcttgaaagagctgggcacttttgcccaaagctctattgccctgcatcaccagtacaaccccaagttccagactctgttccagccatgcaaccttatgggtgctatgcagcttatagaagacttttccactcatgtgagcatagactgttctccgcataagactgtcaagaaaactgctaacgagtttccgtgcctgcccaaacaggttgcttggatcttagccacttctaaggtgtttatgtaccccgagctgctccctgtctgttcactcaaggccaagaacccgcaggataagattcttttcaccaaggctgaggacaacctgttggccctggggcttaagcacttcgagggtacggaatttctcaatcccttaattagtaagtatcttttgacctgtaagactgccaggcaactgaccgtgcggataaaaaatcttaacatgaatcgcgcaccagataacatcattaagttctataaaaagacaaagcagctccccgtattaggcaagtgctgcgaagaaatacaaccacaccagtggaaacctcctatagagcgggaggagcaccggctgccattttggctgaaggccagtctcccctcaatccaggaagaactcaggcacatggctgacggcgctcgggaagtcggcaacatgacagggaccaccgaaattaactcagaccagggtttagaaaaggacaatagcgagttaggcagcgaaaccaggtatcccctcctgttgcccaagggcgtcgttctcaaattaaaaccggtcgccgacagattcccaaaaaaagcctggagacagaaacgctcgtctgtactcaaaccactgctgattcaacctagccctagcctgcagccatccttcaacccaggaaagacgcccgctcaaagtactcactcagaggcgcctccgagcaagatggtgctgcggattccccaccccattcagccagcgaccgttttgcagactgtacctggagtgccccctctcggtgtcagtgggggagaaagtttcgaatcccccgctgccctgcccgcaatgccccctgaggctcgtaccagctttcctctctctgagtcacagaccctgctcagttcagcaccagtgccaaaagtgatgatgccctccccagcttctagcatgttccgcaagccctacgtgcggaggaggccgagtaagaggcgcggtgcgagagcgttccggtgtatcaagcctgctcctgtgatacacccagcctccgtcatatttaccgtccccgcaacaacagttaagattgtgtccctcgggggaggttgcaacatgattcagcccgtaaatgccgcagttgcccaaagcccccagaccatcccaatcgccaccctgctggtcaaccccactagtttcccatgccctctgaaccagcctcttgttgcctcctctgtgtcccctctgatcgttagtggtaattccgtgaatcttccaataccctccactcccgaagacaaagcccatatgaatgtcgacattgcatgtgcggtagcggacggagaaaacgccttccaaggactggaaccgaagctcgagccacaggagttgtccccgctctctgcaacggtgtttcctaaagtggagcattctcctggcccaccacctgtggataagcagtgccaggagggactttctgagaattcggcatatcgctggacagtcgtaaaaacagaagagggcaggcaggccctggagcctctgccccagggcatccaggaaagcctaaataattcctctcctggggatctcgaggaggttgtcaaaatggaaccggaagacgctaccgaagaaatcagcggcttcctctag

SEQ ID NO: 28459 - DNA, 888 bp, Artificial Sequence
  Description of Artificial Sequence: Synthetic coding sequence
atggagttaattcaggatacaagtcgccctcccttggaatacgttaaaggagtacctctaatcaaatactttgcagaggccctgggccctctccaaagttttcaagcccgtcccgacgatcttttgatcaatacctatcctaaatcaggtacaacttgggtctctcaaattctcgacatgatttatcaggggggagacttggagaagtgcaaccgtgcgcctatttacgtgcgtgtgccgtttttggaggtgaatgatccaggggaacctagtggtctggaaacccttaaagacacccctccgcctcggcttataaaatcccacttgccccttgccttactcccacaaacacttctcgatcaaaaagttaaagtggtttatgttgccagaaaccctaaggatgtcgctgtgtcttactaccactttcataggatggagaaggcccatccggagccagggacatgggactcttttctcgagaagttcatggccggagaggtgtcctatggatcttggtatcagcatgttcaagagtggtgggaactgtcgcggacccatcctgtcctgtacctcttttacgaagacatgaaagagaaccccaagcgcgaaatacagaaaatcctggaatttgtcggccgtagcctcccagaggagaccatggatttcatggtacagcacaccagcttcaaggagatgaagaagaacccgatgactaattataccacagtgccccaggagctcatggaccattcaatttcgccctttatgagaaaggggatggccggtgactggaagactacgttcactgttgcacaaaatgaaaggttcgacgcggattatgctgaaaaaatggcaggttgctcacttagcttccggtccgaactgtag

SEQ ID NO: 28460 - DNA, 1476 bp, Artificial Sequence
  Description of Artificial Sequence: Synthetic coding sequence
atggatactaagggatgtactaccaccaattctccctctacaccttgtcaaaactgctcacgcatcaccaacgtcagtactatttcgagcaacaacgggtgccacccaggcggactgaccgtgaataattgtcagccggcaggtcacgttctccgtatcccctgggatcaaggatgtcagcctacccctaggttttgccgaaaacccatctacctcatgaacaacttcaacgcgagattttctcttgacgactgctcgtggtatggggaaggcatcaattcaaatgagaaagagaccatgcagatcctgaatgagagactcgccaactatctgcagaaagtgaggatgctcgagcgagagaatgcagagctcgaatccaagattcaagaggagtctaacaaggagctgcccgttctgtgtcctgattacttatcttactatactacaatcgaggagctgcagcagaaaattctgtgcactaaggccgaaaatagcaggctcgtcagtcagatagataatacgaaattgaccgccgatgacttacgggctaaatatgaagctgaggtgagcttgagacagttggtcgaatccgacgccaacggcttaaagcagattctgaatgttctgaccctggggaaagcagatctcgaagcacaagtgcaaagtctgaaggaagaactgctatgtcttaagaacaatcataaggaagagatcaattcccttcaatgtcagttaggcgaaaggcttgacatcgaggtgacggccgctccctccgcagatctgaaccaagtactgcaggagatgaggtgccagtacgaaccaatcatggagacaaacaggaaagatgtagagcaatggtttaatacacaaatcgaggaactcaaccagcaggtggtaacctcaagtcagcagcagcaatgctgtcagaaggagatcatcgagttgcggagaagcgtgaatacactcgaggtcgaattgcaggcacagcacagaatgcgggactctcaggagtgcattctgaccgagacggaggctagatataccgccctgttaacacagatccagtctctgatcgacaacctcgaagctcagctcgctgagattcgatgtgccctcgaacgccagaatcaggagtatgaaatcttgctggatgtaaaaagccggctagaatgtgagatcaccacgtacagatctctgctggagagtagcgacgggaaacggccttgctatccccgagccaccaagtgtgagcctagcccctggacctcgtgtaaaagcggcgcaatagagtccactgctcccgcttgcacttcttcctctccatgttccctgaaggagcactgtagcgcgtgtgggccattgagcaggatcctggtcaaaatctgtacaataaccaaagaaatcaaggacggcaaggtcatcagcagctatgaacatgtccagccatgctttatcatccgccctgcaaaggtgtag

SEQ ID NO: 28461 - DNA, 1287 bp, Artificial Sequence
  Description of Artificial Sequence: Synthetic coding sequence
atgaagcgcggaggacgagacagtgataggaactcctctgaggaggggacggccgagaaaagcaagaagctaagaaccaccaacgaacatagccaaacctgcgactgggggaacttattgcaagacataatcctgcaggtctttaaatacttgccactcctggacagggcccacgctagccaagtatgtaggaactggaaccaggtgtttcatatgccagatctgtggaggtgctttgaatttgagctgaaccagccagctacctcatacctgaaagccactcatcccgagctcatcaagcaaatcatcaaaagacattccaaccacctacaatatgtgtcttttaaggtggactcaagcaaagagagtgccgaggctgcctgcgacatactctctcagctcgtgaactgtagccttaagacgttgggtctcatatcgactgccaggccaagcttcatggatctgcccaagtcacactttatcagcgcactgacagtggtgtttgtgaattctaaatcattatcatccctgaaaattgacgatacccctgtagatgatccatctctaaaagtgctcgtagcaaataactcggacacactgaaactgcttaaaatgtcaagttgcccacatgtaagcccagcgggtattttgtgtgtggctgaccagtgtcacggcctacgggagctggcactgaactatcatctgctctccgacgagttactgctggccctcagttcagagaagcatgtgcgcttggagcacctccgcattgacgtggtttccgaaaatccaggccagacacacttccacactatccaaaaatcctcctgggatgctttcatccgacactcccccaaagtaaatctcgtcatgtacttcttcctgtatgaggaagagtttgatcccttttttaggtatgaaatcccagccactcacctatactttgggcgttccgtttcaaaggacgtgctaggcagggttggaatgacatgtcccagactggtcgaactcgtcgtctgcgcgaatggcttgcgtccattagacgaagaacttattcggatcgccgagaggtgtaagaatctctctgccatagggttaggagagtgcgaggtgagctgctccgcgtttgttgaatttgtgaaaatgtgcggaggtaggctctcgcagttatccattatggaagaagtcctgatcccagaccaaaagtatagtttggagcagatccattgggaggtctctaagcacctaggcagagtgtggttccctgatatgatgccaacatggtag

SEQ ID NO: 28462 - DNA, 3603 bp, Artificial Sequence
  Description of Artificial Sequence: Synthetic coding sequence
atgaatacggattctgggggatgcgctcggaagagggccgcaatgtcagtcactctcacctcagtcaagagggtgcagtcctctcctaatctcttagctgctggtagggattctcaatcaccggacagtgcttggcgtagttataacgatggtaatcaagaaaccctgaacggggacgcaacctacagcagcctagcggcaaaaggattcaggtcagtgagaccgaatctgcaggataagagaagcccaacccagtcgcagatcacagtaaacggcaattccggaggggctgtgagcccgatgtcatattaccagaggcctttttccccgtctgcctacagcctgcccgcaagccttaactcaagtatcgtgatgcaacacggtacctccctggacagcacagacacataccctcagcacgcccagtcccttgacgggacaacctcctcttctatacccttgtaccgctcaagtgaggaggaaaagagggtgaccgtcattaaagcaccacactatcctggcatcgggcctgtcgatgagtccggcattcctaccgcaatccggacaacagtggacagacccaaggactggtacaaaactatgtttaagcaaattcacatggtgcataagcccgacgatgacaccgatatgtacaacacgccctacacttacaatgctgggttgtacaaccctccctactcagctcagtcacacccagccgctaagacgcagacctatcgaccattgtccaagtctcatagcgataattcacccaatgcttttaaagatgcctcatcccccgtgccaccacctcacgtgcccccacccgttccacccctgcggcctcgagataggtcttccactgagaagcatgactgggatccccctgaccgcaaggtcgacaccagaaaatttagatcagaacccaggtcgatctttgagtatgagccgggaaagtccagcattctgcagcacgagaggcctgcatccctgtatcagagctccattgacaggtctctcgagcgcccaatgtctagcgcaagcatggccagtgacttccgcaagaggcgcaagtctgagccggcagtcgggcctccacgagggctgggcgaccagagtgcgtcaaggacatctcccggtagagtggacttgccgggtagtagtacgaccttgacgaaatctttcaccagcagttcgccgtcatcccccagtagggctaaaggcggtgatgattccaagatttgtccatctctctgtagttattctggactcaatggaaatcctagttctgagcttgactactgttctacctaccgtcagcacttggacgtgcctcgggactcaccacgtgctattagcttcaaaaatggctggcagatggccagacagaacgccgaaatctggtcctctactgaagagacagtctctccaaagattaagagccgtagctgcgatgatctgttaaatgatgattgcgatagtttccctgatccaaaggttaagtctgaatctatgggcagcctgctgtgtgaagaggatagtaaggagtcttgcccaatggcctgggggtccccatacgtgcccgaagtgagatctaacggaagatcaaggatccggcatcgatctgcccgtaatgctccaggcttcctaaaaatgtacaagaaaatgcataggatcaatagaaaagatctaatgaattccgaggtgatctgctctgtaaagtcgcggatactgcagtacgagtcggagcagcaacacaaggacctccttcgcgcttggtctcaatgcagtacagaggaagtaccacgggatatggttcccacgcgtatctccgagttcgagaagctgattcagaagtctaagagcatgccgaacttaggggacgacatgctctctccagtgaccctcgaaccaccgcagaatggcttgtgtcccaagcgtcgtttcagtatagagtacttgttagaggaggagaaccagagcggacccccagccagaggcaggcgcggttgtcagtccaacgcgctcgtccccatccacatcgaagtgactagtgacgagcaacctcgcgctcacgtggagttttccgatagcgatcaggatggcgtcgtgagcgaccactccgactatattcacctggaagggtcatccttctgttccgaatccgacttcgatcatttctctttcactagttctgagagtttctatggttcatctcaccatcaccaccaccaccatcaccaccaccatcggcatctcatcagctcttgcaaaggacgctgcccggcatcctacaccagatttaccactatgcttaagcatgaacgcgcacgccatgaaaacactgaagagccccgtcgccaggagatggatcctggccttagtaagctggccttcctcgtgtctccagtgccttttcgacgcaaaaagaatagtgcccctaaaaaacaaaccgagaaggccaaatgcaaggccagcgtgttcgaggcactcgatagcgcactgaaagacatctgcgatcaaatcaaggcggagaaaaagagaggttccctgccagacaacagcatactgcatcgcctgatcagtgagttactcccagacgtccccgagaggaattcctccctcagggccttgagacgatcacctctgcaccaaccgctgcacccactccctcctgatggcgcaatccactgccccccatatcagaacgactgtggtcgcatgcccagatcagcctccttccaggatgtggataccgctaattcctcctgtcaccaccaggacaggggcggtgctctgcaggaccgagaaagtcccagatcatacagtagcactctgactgacatgggccgatcagcgcctcgggaaaggaggggcacacccgagaaggaaaaactgccagctaaggcggtgtacgacttcaaagcgcaaacaagtaaggaactatccttcaagaagggggatacggtgtatatcttgagaaaaatcgatcagaattggtacgaaggagagcaccacgggcgagtaggcatcttccccatctcttatgtggagaagttaaccccacccgaaaaagcgcaacccgcaaggcccccacccccagcgcagcctggagagatcggcgaggccatcgccaaatataatttcaacgccgatacaaatgtcgagctcagcctgcggaagggggatagggtgattttgcttaagcgtgtagaccagaactggtatgagggaaaaatcccaggtactaataggcagggcatatttcccgtctcatacgtggaggtggtcaagaaaaacacaaagggagcagaggactaccccgaccccccaataccacactcttactctagtgatagaatccacagtctctccagcaacaagcctcagcggcctgtgttcacgcacgaaaacatccagggtgggggagaaccctttcaggccttatataattacacacccaggaacgaggacgagctcgaactgagagagagcgatgttattgacgtgatggaaaagtgtgatgacggctggtttgtgggcacatcaagacgcaccaagtttttcggaacgttcccgggaaattatgttaagagactctag

SEQ ID NO: 28463 - DNA, 1470 bp, Artificial Sequence
  Description of Artificial Sequence: Synthetic coding sequence
atggaagattctgccagcgcctctctctcgtcggctgcagccacgggaacatcgacctctacacctgccgcacctactgccagaaagcagttggataaggaacaggtgaggaaagctgtggacgcccttttgactcactgcaagtctagaaagaacaattatggtctgttattgaatgagaacgagagcctcttcctgatggtggtgctctggaaaatcccaagcaaggagctaagggtgagacttaccctgccacactccattcggtcagattccgaagacatttgtttattcactaaggacgagccgaactctacccctgaaaagactgaacagttctaccggaagttgctcaataagcacggaattaagactgtgtcccagatcatctcattgcagaccttaaagaaggagtataaaagctacgaggcaaaactgaggttgctgagctctttcgacttcttcctgaccgatgccaggataaggcgtttattgccaagcctgatcggccgacatttctaccaacgcaagaaggtccctgtgagtgttaatctcctttctaagaacctttccagggagattaatgattgtattggtggcactgtgctgaacatttcaaagagcgggtcctgctccgcaatcagaattggccacgttggaatgcagatcgaacacattatagagaacatcgtagcagtcaccaaaggtctcagcgaaaaactccccgagtgggaaagcgtgaagctgttattcgtgaagactgagaagtccgctgccttgcccatcttttcttccttcgtgagcaactgggatgaagcaacaaagagatctctgctgaataaaaagaagaaagaggcccgtcggaaacgcagagagagaaactttgaaaaacagaaggagcggaagaagaaaagacagcaagctaggaagacggctagcgtcttgtcaaaggatgatgtcgctccagagtcgggcgatactaccgtaaaaaaacccgagagcaagaaagaacaaacgcccgagcacggcaaaaagaagagaggcagaggtaaggcccaggtcaaagccacaaacgaaagcgaggatgagatcccacagctagtacccataggtaagaaaacgccagccaacgagaaagtggagatccagaagcacgcaacaggcaaaaagtcaccagccaagagccccaacccttccaccccgagggggaaaaaaagaaaagcactgcccgctagcgaaactccgaaggccgctgaatccgagacccctggaaaaagcccggaaaagaaacctaaaatcaaagaagaagcagtcaaggagaaatccccttccctgggaaagaaggatgccagacagaccccgaagaagccggaggccaaattttttacaactcccagtaaatctgtacggaaagcgagccatacccctaagaaatggccaaagaagcccaaggtgcctcagtctacctag

SEQ ID NO: 28464 - DNA, 3171 bp, Artificial Sequence
  Description of Artificial Sequence: Synthetic coding sequence
atggctggggcactcagacgcggacgcgcactgggctccagaccttcaggaccaacagtttccagcagacgatctcctcaatgtcccgtggcacaagagggattaggcgcaagatccaggccgcgagtagcgccaagatccctcgcgagatgcgggccttcaagccgactcatgggctggaaaccttcagaggctagagggcaatcccagtccttccaagcctccggattgcaacccagaagtttgaaggccgcacggagagctacaggccgtcccgaccgttcacgcgcagcacccccaaatatggatccggaccctcaggcaggggtccaggtgggcatgcgcgtcgttaggggcgtggactggaagtggggccagcaggatggaggcgagggcggagtagggacagtggtagaattgggacgccatggtagcccctcgacacctgatcggaccgtggtagtgcaatgggatcagggaactaggacaaattatcgcgctgggtatcagggagcacacgacttgctactgtacgacaatgctcagattggtgtcagacaccctaatatcatttgtgactgttgcaagaaacacggtttgagggggatgcggtggaagtgtcgggtgtgtctcgactatgatctgtgtactcagtgttacatgcacaacaagcacgagctagcacacgccttcgaccgctacgagactgcacactcacgcccagtcacactcagcccaagacaggggctgcctaggataccattgaggggcattttccagggggctaaggtggtgcgaggcccagattgggaatggggtagtcaggatggaggggagggtaagcccggtcgggtcgtcgacatccgcggatgggatgtcgaaactggcaggagtgtggcctccgtcacctgggcagacgggaccacaaacgtttatcgtgtcggtcataaagggaaagtggaccttaaatgcgttggcgaggcggctggaggcttctactacaaagaccatctcccgcgtttaggcaagcccgctgaactccaacgtagagtgtctgcggattctcagccttttcaacatggcgataaggtgaaatgcctgcttgatacggacgttctgcgtgagatgcaggaaggccacggaggttggaatccccgaatggccgaattcataggccagaccggcacagtgcaccgcatcacagaccgcggagacgtgcgggttcagttcaaccatgagacgcgctggaccttccaccctggtgccctcacaaagcatcacagcttttgggtcggagatgtcgtgcgggtcatcggagacctggatacggtgaagcgtctccaggccggacatggcgaatggacagacgatatggcgccagctctcgggagggtggggaaagtggtaaaagttttcggcgatggcaacctccgtgttgctgtggcagggcaacggtggactttttcaccttcttgcctggtggcttaccgaccagaggaggacgctaatctggacgtcgctgaacgcgctcgtgagaataaatcttcattgtctgtagcactggacaagcttcgcgctcagaagtcggatccggagcatcctggccgtctggtggttgaggtagccttaggcaatgccgctcgtgcactggacctgctgcgtcgtcggccagaacaagtcgacactaagaatcagggtaggactgcactacaggtggctgcatatctgggacaagtagagctcatcagacttcttttgcaggctcgcgcaggcgtggatttaccagacgacgagggtaataccgcattacactacgccgcactcggtaatcaacctgaagcaacaagggtcctcctcagcgcagggtgcagggcagacgccatcaattccacacagagcacagctctgcatgtcgctgtgcagcgtggcttcttagaggtggtaagagccttgtgcgaacgcggatgtgacgtcaacctccccgacgcccatagcgacactccactgcattcagcgatttccgccggtacaggcgcttctggcattgtggaggtgcttaccgaagtacccaatattgatgttactgcaaccaacagtcaggggttcaccctactgcatcatgcttcactcaagggccatgccctggccgtgagaaagattcttgctcgagccaggcagctggtggacgcaaagaaggaagacggatttactgccctgcacctggccgcactgaataaccacagggaggtcgcgcagatcctgataagggaggggagatgcgacgttaatgtgaggaatcgcaagttgcaaagtcccctgcatctggcggtccagcaggcccatgtgggactcgtgcccttacttgttgacgccggatgctccgtgaacgcggaggatgaggaaggtgataccgctttgcacgtcgctctgcaaaggcaccagctgcttccccttgtagctgacggcgctggcggagacccaggaccgctgcagctactcagtagacttcaagcatctggtcttcctgggtccgctgaacttacagttggagccgctgtagcctgttttctggccctcgaaggggctgacgtgtcctatactaatcataggggtagaagccctttagacctcgccgcagagggccgtgtattaaaagcccttcaggggtgcgcccagaggtttcgggaaagacaggctgggggaggcgctgccccaggacccaggcagacactgggtacgcctaataccgtgacgaacctccacgtgggagcagcaccgggtccagaggcggcagagtgcctcgtgtgtagtgagttggctctgctcgtacttttctccccctgtcagcatcggacagtgtgtgaggagtgtgcacgcagaatgaaaaagtgtataaggtgccaggtggtggtgtctaagaagttgcggccagacgggagtgaggtcgccagcgcagcccctgctcccggaccccctcgtcagttggtggaagaactacagagcagatatcgtcagatggaagagcgcatcacatgccctatctgtatcgattcccatataaggctggtattccagtgtggacacggagcatgtgccccttgtggcagtgccctctctgcgtgtccgatttgcagacaacctatccgagacagaattcagatttttgtttag

SEQ ID NO: 28465 - DNA, 858 bp, Artificial Sequence
  Description of Artificial Sequence: Synthetic coding sequence
atgtccgaagcaggtgaagaacagccaatggaaaccaccggagccactgagaacgggcacgaagccgtcccggaaggtgaaagcccagcaggagccggaacaggagctgccgctggagcaggcggagcaactgccgcacctcctagcgggaatcagaatggtgcagaaggagatcagatcaacgcatcaaagaacgaagaggatgccggaaaaatgtttgtaggaggtctgagctgggacacaagcaaaaaggacctcaaggactattttacaaagtttggcgaggtggttgactgcaccatcaaaatggatccaaacactgggagatcccggggatttggattcattctttttaaggatgctgcgagcgttgagaaagtgttggatcaaaaggagcatcgcctcgatggacgcgtgattgaccccaagaaagccatggctatgaaaaaggacccagtgaagaagatctttgtcggaggcctgaatccagaagcaaccgaggaaaaaatccgtgaatacttcggcgaattcggcgaaattgaggctatagagctgcctatggatcccaagctgaataagaggagaggatttgtgttcattacctttaaggaagaggagccagtcaagaaggtgttggagaagaagtttcataccgtgtcgggaagcaagtgcgagattaaggtcgctcagccaaaagaagtgtatcagcagcaacagtatggttcgggcggacgaggcaatcgaaatcgcggaaatcggggtagcggcggtggaggagggggagggggtcaaggctcaaccaattacggtaagtcccagcggaggggaggacaccaaaataactataagccatactag

SEQ ID NO: 28466 - DNA, 1212 bp, Artificial Sequence
  Description of Artificial Sequence: Synthetic coding sequence
atgtcgggttccgacggcggactggaagaggagccagagctttctattacattgaccctgcgtatgttaatgcatggcaaagaagtgggaagcatcatcggaaagaagggggaaaccgtgaaacgaattcgtgaacagtcttccgcgagaattaccatttccgaaggctcctgccccgagcgcatcactaccataacgggttctaccgccgcagtgtttcacgcagtatccatgatcgctttcaaactggatgaagacctatgcgccgctccggctaacggtggcaacgtcagcagacctcctgtgaccctgcgattagtgattccagccagtcagtgcggaagtctgattggcaaggccggaactaagataaaggaaattagagagactacaggagctcaagtacaagttgctggagacctgctacctaatagcactgagcgcgcagtcaccgtgagcggagtacccgatgcaatcattctgtgtgtgcgacagatctgcgctgttatccttgaaagtccccctaagggagccactattccttatcatcccagtctgagcctcgggactgtcctccttagcgctaatcaaggcttcagcgttcagggacagtatggtgctgtcacgcctgcagaggtgacgaagctccaacagcttagtagccatgctgtcccgtttgcgacccctagcgtggtaccagggctggatcctggaacacagaccagcagtcaagagtttctcgtgcccaatgacttgatcggatgcgtgattggcaggcagggcagcaagatctccgaaatcaggcaaatgagtggagcccatataaagataggaaatcaggcggagggtgcaggcgagagacacgtgaccatcactggttctccagtcagcatcgcattggcacaatatctgatcaccgcctgtctggaaacagccaaatcaacgagtggcggaactcctagtagcgctccggctgatctacccgctccattctccccccctcttacggccctcccaactgctccacccggtctgctgggcactccgtacgcaatcagtctgtcaaacttcattgggttgaaaccaatgccttttctggccctgccacctgcctctcctggtccaccacctggattggccgcttacactgccaagatggctgccgcaaatgggtctaagaaagctgaacgccaaaagttcagcccttactag

SEQ ID NO: 28467 - DNA, 1347 bp, Artificial Sequence
  Description of Artificial Sequence: Synthetic coding sequence
atggctacggattcttgggcactggccgtagacgagcaggaagccgctgccgagagcttaagcaacttgcatctgaaagaggagaaaatcaagcctgatacaaacggcgctgtcgtaaagaccaacgccaacgcggaaaagacagatgaggaggaaaaggaagaccgcgctgcccagagcctgttgaataagctcatcaggtccaacttagtcgacaataccaaccaggtggaagtgctgcagcgagacccaaattctcctttgtattccgtgaagtcgttcgaagaacttaggctgccgcagaacctgatagctcagagtcaaagcggcactggcaaaacagcagcattcgtgcttgctatgctgtcacaggtggagcccgctaataaatacccgcagtgtttgtgtttgtcaccaacatacgagcttgctctgcagacaggaaaggtgatcgaacagatgggaaaattttaccctgagcttaaattggcctacgccgtgcggggaaataagctcgagcgcggtcagaagatctccgagcagattgtcattggcacgcccggtaccgtccttgactggtgctcaaagctcaagtttatcgatcccaagaagataaaagtgttcgtcctggatgaggccgacgtgatgattgccacccagggtcatcaggaccagagcattcgcattcagcgcatgttaccccgtaactgccagatgctcctcttctcggctactttcgaagactctgtgtggaaatttgctcagaaggtcgtgcctgaccccaatgtaattaaactcaagcgtgaggaagagactttggacacaattaagcagtattacgttctctgcagctcgagggacgaaaagttccaagcattatgcaatctatatggcgctatcaccattgcacaagctatgattttttgccatactaggaagaccgctagttggcttgccgcagaactcagtaaggagggccatcaggtagctctgctgagcggcgagatgatggtggaacagcgtgctgctgtcatcgagcggtttcgcgagggtaaagagaaagttctcgttaccacgaacgtctgcgctcggggaatagatgtagagcaggtgtcagtggtgatcaatttcgacctgcctgtggataaagacggcaacccagacaacgagacgtacctacacaggatcggtcgaaccggcaggttcggcaagcgcggtcttgccgtgaatatggtcgactctaagcattccatgaacatcttgaatcgaatacaggagcattttaacaaaaagatcgagcgactcgacaccgacgatctggatgaaatcgagaagatcgccaattag

SEQ ID NO: 28468 - DNA, 1248 bp, Artificial Sequence
  Description of Artificial Sequence: Synthetic coding sequence
atgatgcttggccctgagggcggtgagggcttcgtcgtgaagttgaggggcctgccatggagctgtagcgttgaggatgtgcagaattttctctccgactgcaccatccacgacggggcagctggggtccattttatttacacaagagaaggcagacagagcggtgaagcttttgttgaactggggtccgaagatgatgtgaaaatggcactgaagaaggacagggagagcatgggacatcgatacattgaggtgttcaaatcccatcggaccgaaatggactgggtgctcaaacattccggcccaaattctgcagacagcgctaacgatggcttcgtgcgtctgcgagggcttccattcggatgcacaaaagaagaaatagtgcagtttttttcaggattagagatcgttcccaacgggataactctccctgtcgacccagaagggaagatcaccggcgaggccttcgtccagtttgcctcccaagaattggctgagaaggctctggggaagcacaaagaacgcattggccaccggtacatagaggttttcaagtcgtctcaggaggaggtgagatcgtattccgaccctcccctgaagttcatgtcagtgcagcgaccaggaccatacgatcgccctggtaccgcaaggagatacatcgggatagtgaaacaggcagggctggagcggatgcgcccaggggcttactccactggctatggcggatacgaggaatactccggcctgagcgatggttacggatttaccacagatctgttcggacgggacctctcatattgcctgtcggggatgtacgatcataggtatggtgactctgaatttactgtccagtccactacaggccactgtgtgcatatgagaggcctaccgtacaaagcgaccgaaaacgacatctacaacttcttcagtccgctcaaccccgtacgggttcatattgaaattggaccggatggacgcgtaactggagaagctgacgttgaattcgccacccatgaggaagcagtggcggcaatgtctaaagatcgggcaaacatgcaacacagatacattgaacttttccttaatagtacgactggagcttcaaacggagcatacagtagccaagtgatgcaagggatgggcgtctctgccgctcaagcaacatactccgggctggaatcacagagcgtgagcggctgctacggtgcaggttacagcggccagaactctatggggggatatgactag

SEQ ID NO: 28469 - DNA, 1026 bp, Artificial Sequence
  Description of Artificial Sequence: Synthetic coding sequence
atggcacaggagtcccctaagaattctgccgcagaaattcctgtcaccagcaacggagaggtggacgattctagggaacactcctttaaccgagacctgaagcactctctcccgagcgggctcgggttatctgagacccaaatcacttcccatggctttgacaacactaaggagggggtgatcgaggcaggagccttccaaggaggtcagagaacacaaacaaagagcggacctgttatcttggcagatgagatcaaaaatcccgcaatggaaaaactggagctcgtgagaaaatggtctctgaatacttacaagtgtacacgtcagattatctcagaaaagctcgggcgaggctctcggaccgtcgatctcgagttggaggctcagattgacattctgcgtgacaacaaaaaaaagtacgaaaatattctgaagctggcccaaacccttagcacgcagttgtttcagatggtgcacacccaacgacagttgggcgatgcttttgctgacctcagcttaaagtccctggaactgcacgaggagtttggctacaatgcggacactcaaaagctcttggcaaagaacggcgagaccttactgggtgctattaacttctttatagcttcagtcaatacgctggtcaataagacaatcgaggacactttgatgacagttaaacagtacgagtctgcacgcatcgagtacgatgcataccggacggacctggaagagttgaacttaggacctagggacgctaacacattgcccaaaatagagcaaagccagcatctctttcaggcccataaagagaagtatgataagatgcgaaatgacgtgtccgtcaagctaaaatttcttgaggaaaacaaggtgaaagtacttcataatcagctcgtgttatttcacaacgccattgcagcgtactttgctggaaatcagaagcaattggaacagactctgaagcagttccacattaaactgaaaacacccggtgttgacgctccaagttggctcgaggaacagtag

SEQ ID NO: 28470 - DNA, 1572 bp, Artificial Sequence
  Description of Artificial Sequence: Synthetic coding sequence
atggcaaatgttggcctgcagttccaagcctccgccggagactcagaccctcagtctcgccctttgctcctgcttggccagttgcatcacctgcaccgagtgccttggtcgcatgtgagaggcaagctgcagcccagagtaaccgaagaactgtggcaagccgctttgagcacactaaacccaaaccccaccgacagttgtcctctgtatctaaactacgcgaccgtggccgcattaccctgccgggtctcccgccataacagtcctagtgctgcacatttcatcacacgattggtgcgaacctgtctgccccctggggctcaccggtgcatagtgatggtgtgtgagcagccggaagtgttcgcttctgcgtgtgctctggcacgcgcttttcctctgtttacccataggtcaggggcaagtcgccgactggagaagaagactgtcacagttgaattcttcttggtcgggcaggacaatggtccagtcgaggtttctaccctgcaatgcctcgcaaatgccacagatggcgtgaggctggccgctcgcattgtggacaccccttgtaacgagatgaacactgatacctttctggaagagatcaataaagtaggtaaagaactcggcatcattccgaccattattcgagatgaggaattaaaaacccgcggtttcgggggtatatacggtgtgggaaaagctgccttacatccccctgcgctggccgttctctctcatacccccgatggcgctacacagacaattgcctgggtgggtaaaggcatcgtttatgacacaggcggactgagtatcaaggggaagacaacgatgcctggaatgaaaagggattgtggtggagcagctgctgttttgggcgctttccgggcagcgattaagcagggcttcaaggataacctccacgcagttttttgcctagccgagaactcagtgggacccaatgccactagacccgacgacatacatttgctgtatagcgggaagacagtcgaaataaacaacacagatgccgagggcaggctcgtgttggctgacggcgtatcatatgcttgtaaagacctgggggctgatatcatcctggatatggcaaccctgacaggcgcacagggaatcgccaccggtaaatatcacgccgctgtacttaccaatagtgccgagtgggaggccgcatgtgtgaaggccggacgaaaatgtggcgacttagtccacccactagtgtattgcccagaactgcacttcagcgagtttacctccgcagtagccgatatgaaaaatagcgtggcagatcgggacaactcgccgtcgagctgcgctggactctttatcgcctctcatataggattcgactggccaggcgtgtgggttcatcttgatatcgccgctccagtgcacgccggagaaagggccaccggatttggtgttgccctgcttttggcactcttcgggcgtgcttcagaagatccactccttaatttggtaagccctctggggtgcgaggtcgacgtggaggaaggggacctgggacgcgactccaagagaaggcggcttgtgtag

SEQ ID NO: 28471 - DNA, 1371 bp, Artificial Sequence
  Description of Artificial Sequence: Synthetic coding sequence
atggctgatgggggaagtgagagagcagacggcagaatcgtgaagatggaggtcgattactccgccactgtcgaccagcgactgccagagtgtgccaaactggccaaggaggggagattgcaggaggttattgaaacccttctaagcctggaaaaacagaccaggactgctagtgatatggttagtacttctcggatcctagtcgcagtggtaaagatgtgttacgaggcgaaggaatgggatcttctgaacgagaacatcatgctgctaagcaagcgacgatcccagttgaagcaggctgtcgccaaaatggtgcagcagtgttgtacgtatgtggaggagattacagatttgccaatcaagctgaggctgatcgataccctccgcatggtgactgagggaaagatctatgtagagatcgaacgcgcacgccttacaaagacactggccaccatcaaggaacagaatggggatgtcaaggaagctgcatctattttacaggaactgcaggtggaaacctatggcagcatggaaaagaaggagagggtggagtttatcctggaacagatgcggttatgcctggccgtgaaggactacatccgaacacagattatttctaaaaagataaacacaaagttctttcaggaagaaaacaccgagaaactcaaacttaagtattacaacctaatgatccagctcgatcaacacgagggtagttacctgtctatctgcaagcactacagagctatttacgacacaccctgcattcaggcagagagtgagaaatggcagcaggctctgaagtctgtggtcctgtacgttattttagcaccctttgataatgaacagtccgacttggttcaccgtatctctggagataagaagctggaagagattccaaagtacaaggatcttctcaagctattcacaacaatggaactgatgcgttggagtaccctcgtggaagattatggaatggaacttagaaagggctctctggagagccccgctacggatgtctttggctctacagaggaaggggagaaaagatggaaggacctgaagaaccgggtggttgagcataatattcgcattatggccaaatattacactcgcatcacaatgaagagaatggcacagctgctggatttgtctgtcgacgaatctgaggcctttctctctaatctagttgtgaataagaccattttcgccaaagttgatcggcttgccggaattatcaacttccaacggccaaaggacccaaataatctgttaaacgattggagccaaaagctgaactccctgatgagtctcgtcaacaagacaactcatctgatcgccaaggaggaaatgatccataatctccagtag

SEQ ID NO: 28472 - DNA, 1011 bp, Artificial Sequence
  Description of Artificial Sequence: Synthetic coding sequence
atgaagattgacatccactcgcatattctgcctaaagagtggcccgatcttaagaaaaggtttggctacggcggatgggtccagctgcagcatcattccaagggcgaagctaagctgcttaaggatgggaaggtgtttagagtggtcagagagaattgctgggacccagaggtccgcattagggagatggatcagaagggcgtgaccgtgcaggcactgagcaccgtccccgtgatgttttcatactgggcaaagcccgaggacacccttaatctttgccaactgcttaacaacgacctggcctctactgtggtgagttaccctagacggtttgtcggcctggggacactgcccatgcaggctcctgaactcgccgtgaaggagatggagaggtgtgtcaaggagttaggattcccgggagtgcaaatcggtacacacgtgaacgagtgggacttgaacgcccaggaactatttcctgtctatgcggcagccgaacgcctgaaatgttcgctgtttgtccatccatgggacatgcagatggacgggagaatggcgaaatattggctcccttggcttgtgggcatgccagctgaaaccaccattgcgatctgttccatgattatggggggtgtatttgaaaaatttcctaaattaaaggtctgctttgcccatggcggtggcgcttttcctttcacagttggaaggatttcccacggcttctccatgagaccggatctctgcgctcaggacaacccaatgaaccccaaaaaatacctaggctccttttacacagacgctcttgtgcacgacccactgtcactcaaactcctgacagacgtgataggcaaagacaaggtgattctgggtacagattacccgttcccccttggtgaactcgaaccagggaagctcattgagtcaatggaagagttcgacgaggagactaagaacaagctcaaggcaggtaatgcacttgcttttctcggtttggagagaaagcaatttgaatag

SEQ ID NO: 28473 - DNA, 1617 bp, Artificial Sequence
  Description of Artificial Sequence: Synthetic coding sequence
atggagctctcatatcagacgttaaaatttacccatcaggccagggaggcgtgcgaaatgcggacggaagctcggaggaagaacttactcatcttaatctcccactatttgacccaagaggggtatatcgatacagcgaatgcacttgaacaggagaccaaactaggtttgcgtcggtttgaggtttgcgacaacatcgacctcgagaccatactaatggagtatgagtcatactactttgtcaagttccaaaagtaccccaaaattgtgaaaaaaagtagcgatactgccgaaaataatttaccccagagatcccggggaaaaactcggaggatgatgaatgattcatgtcagaatctgcccaaaattaaccaacagcggccacggagcaagacgaccgcaggtaaaactggagacaccaaatcccttaataaagagcacccaaatcaggaagtagtggataatacacgcctcgaatcagccaacttcgggttgcatatttcccggatccgcaaagacagtggggaggagaatgcccaccccagacggggtcaaattattgattttcagggcctcctaaccgatgcaatcaagggcgcaacatcggaattagccttaaacactttcgaccacaatcccgacccttctgagcggcttcttaagcccctttccgcctttatcggtatgaattcagagatgcgagagctcgccgctgtcgtctcccgagatatctacctgcataatccaaatattaaatggaatgacatcattggactcgatgccgctaagcagttggtcaaggaggccgtcgtgtatcccatacggtacccgcagctttttacaggaatactgtctccctggaaagggctgctcctttacggccctcctggcaccgggaagacactgctggcaaaagctgtggccaccgagtgtaagaccaccttttttaatatctcggcctctacaattgtgagcaaatggaggggagattcagagaagttagtgcgtgtgctgttcgaactcgcccgataccatgctccttccacaattttcctagatgaactggaatccgtcatgagccaaagagggacggcctcaggaggtgagcacgaaggcagcctgaggatgaagactgaactcctggtccagatggatggtctggctcgatcagaggaccttgtctttgtcctagctgccagtaatcttccctgggagcttgattgcgctatgctgagacgcctcgaaaagcgcatactggttgatctgccgtcaagagaggctaggcaggccatgatttaccattggcttccccctgtctcgaaaagtcgggcactggagctgcataccgagttagagtactctgtgctgtcacaggagacggaaggttacagtgggtcagatatcaagctcgtgtgccgggaggccgctatgcgtcctgtccgcaaaatcttcgacgccctcgaaaatcaccagagtgagagctcagacctgccacggattcagctggacatcgttacgaccgccgattttctagatgtgctgacacacactaagccgtccgccaagaacctggcccagcggtattcagactggcaacgagaattcgaaagtgtgtag

SEQ ID NO: 28474 - DNA, 507 bp, Artificial Sequence
  Description of Artificial Sequence: Synthetic coding sequence
atggccgaggggagtcgtattccacaagctcgtgcattgctccagcaatgcctccacgccagacttcagatacgccctgcagacggcgacgtggctgcccagtgggttgaggtgcaaagaggcttagtcatctacgtgtgttttttcaagggcgctgataaggaactcctcccaaaaatggtaaatacgctgttgaatgtgaagttatcagagaccgagaatggcaaacacgtgtccatccttgacctccctggcaatattctgattatcccacaagccactttgggcggacgcctgaaggggagaaatatgcaataccacagtaactccggtaaggaggaaggtttcgagctgtattctcagttcgtaacattgtgtgagaaggaagtggcggcaaacagtaagtgcgcggaggctcgcgtagttgtcgagcacggcacttacggaaataggcaggtgctgaagcttgacaccaacggaccattcacccatctcatagagttctag

SEQ ID NO: 28475 - DNA, 1764 bp, Artificial Sequence
  Description of Artificial Sequence: Synthetic coding sequence
atggcatccgaggatatagcaaagctcgccgagacgctcgccaaaacacaagttgcagggggacagctttcttttaaggggaagtctctgaagttaaacacagctgaagatgccaaagacgtgatcaaggagatcgaagattttgattccctggaggctctgagactcgaggggaatactgtgggagtcgaggcggctagggtgatcgcaaaggcgctggagaagaagtccgagctgaaaaggtgtcactggtccgacatgtttactgggcgtctgaggaccgaaatccctcccgcattgatctctttgggcgagggcctcatcactgctggagcacagctagtcgaactggatttaagtgataacgcctttggacctgacggcgtgcaggggttcgaggctctgctgaagagctcagcctgttttacattgcaggaactgaagttgaataactgtggtatgggcataggcggaggaaagattctcgcagctgctttgactgaatgtcacaggaagtcaagcgctcaggggaagcctctggccctgaaagtgttcgtagccggtaggaaccgtctggagaacgatggtgcaacagcactcgcagaggctttccgggtaatcggcacgcttgaagaagtgcacatgccacaaaatggcataaaccatcctgggattaccgcgttagcccaggccttcgctgtgaacccattgctaagggtgataaacttaaacgataatacttttactgagaagggcgctgttgccatggctgagacccttaaaacgctgcggcaggtggaagttatcaactttggggactgcctggtgcgatcaaaaggcgctgtcgccatagcagatgcaattcggggaggtcttccaaagttgaaagagcttaatttgagcttctgcgaaattaagagggacgctgccctggcggtggcggaggccatggctgataaagcagagttagagaaacttgacctgaatggaaacaccctcggcgaggaagggtgcgagcagctgcaggaggttcttgagggtttcaacatggccaaagtgctggcatctttgtccgacgacgaggatgaggaagaggaagaggaaggggaggaagaggaagaagaggccgaggaggaggaggaggaggacgaagaggaagaggaagaggaggaggaagaggaggaggaagaaccgcaacagcggggacaaggagaaaaaagcgcaacacctagtaggaagattttagacccaaacacaggggagccagctccagttctctcttcacctccaccagctgatgtgagcacatttttagcctttccaagtcccgagaagctccttcgcttgggtcccaagtcatctgtgctgattgcacagcagacagatacttccgacccagaaaaggtggtgagcgcctttctgaaagtgagctcagtgttcaaagatgaagcgacagtgagaatggccgtccaggacgccgttgacgcgcttatgcagaaagctttcaactctagttctttcaatagtaacacttttctaaccaggctgctggtacacatgggcctgttgaaaagtgaggacaaggtgaaagccattgcaaacctctacggacctctgatggccttaaaccacatggtccagcaggactacttccccaaagccttggcaccactcctgttggccttcgtgaccaagcccaactcagcacttgagtcgtgctcttttgctcggcattcgctactacagaccctgtacaaagtgtag

SEQ ID NO: 28476 - DNA, 2529 bp, Artificial Sequence
  Description of Artificial Sequence: Synthetic coding sequence
atggatatttccaaaggactgcctgggatgcagggaggcctacatatctggattagtgagaatcggaaaatggttcctgtgcctgaaggggcttatgggaatttctttgaagagcattgctacgtaatattacatgtgcctcagagccctaaagctacacagggtgctagtagcgatttgcactactgggttggaaaacaggccggagcagaagcacagggtgccgctgaagcgtttcagcagcgacttcaggatgaattaggcggacagaccgtgttgcacagggaggcccagggtcacgaatctgactgtttttgttcttacttcaggcccggaatcatatacagaaaagggggattagcgagtgacctgaaacacgtagagacaaacttatttaacatccagagactgctccacataaagggacggaagcacgtttccgctacggaagttgagctctcctggaactcctttaacaagggagacattttcttactcgatctgggtaaaatgatgatccagtggaatggccctaagacatccatctccgagaaagccagaggccttgctctgacttactcacttagagaccgcgaaaggggaggaggtcgcgctcagatcggcgtcgttgacgatgaagccaaggcacctgatctgatgcagatcatggaggcggttctgggtcggagggttggcagcctcagggctgctaccccatcaaaggacatcaaccagctgcagaaagccaacgtccgcctctaccatgtgtacgaaaagggcaaggacctgctgcaggaggaagatttttatatcctggatcaggggggattcaaaatctacgtctggcaggggcgaatgtctagcctccaggaaaggaaagccgcattcagtcgggcagtgggatttattcaggccaaggggtaccctacttatactaacgtggaggttgtgaatgatggggcagagtctgccgcattcaaacagctatttcgtacttggagtgaaaaaagacggagaaaccagaagctgggaggcagagataaatccattcacgtgaagctcgacgtgggtaagcttcacactcaaccaaaacttgctgcacagctgcgcatggtagatgatggatccggaaaggtggaggtgtggtgcatacaggatcttcataggcaaccagtggatccaaagcgacatgggcagctctgcgccggaaattgctatttagttctttatacctatcagcgtctcggtcgtgtgcagtacatactgtatttatggcaaggacaccaagccacagcagatgagattgaggcgctcaatagcaatgccgaggagctggacgttatgtacgggggagtgctggttcaggagcacgtcacaatgggttcagaaccaccccactttctcgccatttttcagggccaactcgtcatcttccaggagcgggctgggcatcacggcaagggccagagcgccagtactactcggctgtttcaggtccagggtaccgactcacataataccaggaccatggaagtgcccgctagagctagtagtctgaattcctctgatatttttctgctagtcacagcatccgtatgttatctgtggttcgggaagggatgcaatggcgatcaaagggaaatggctagggtcgtggttaccgtaataagccgcaagaatgaagagactgtcctggagggacaggaacctccccacttctgggaggccctggggggacgggctccctatccctctaacaagagactccctgaggaggtcccgagctttcagccaaggctgtttgagtgcagttcccatatgggttgcttagtcctcgccgaggtagggttcttctctcaggaggaccttgacaaatatgatattatgctccttgacacgtggcaagagatctttctgtggctcggagaagccgcttccgaatggaaggaagcggttgcctggggacaggaatacctgaaaacgcatcctgctggtcggtctcccgctactcccatagtgctggtgaaacaaggtcacgaacccccaacctttataggctggttcttcacctgggatccctataagtggacttctcatccttcccataaggaagtagtagacggcagcccagctgccgcttccactatatctgaaatcaccgccgaagtgaacaatctgagattgagccgctggcccggtaacggtcgcgcaggcgcagttgccctccaggctcttaaaggatcccaggactcctctgagaatgatctcgtaaggtcaccaaaatccgcgggaagcaggacgtcctccagtgtttccagcacatcagccaccattaacggcggtctgcgtagagagcagctcatgcatcaggcagtagaggaccttcctgagggagtggaccccgcacgcagggagttttatctctcagactccgactttcaggacatttttggaaagagtaaggaggaattctactctatggcaacttggcggcaaaggcaggaaaagaagcagcttgggttcttttag

SEQ ID NO: 28477 - DNA, 1620 bp, Artificial Sequence
  Description of Artificial Sequence: Synthetic coding sequence
atggacgccatggcctcacccggtaaggacaattacagaatgaagtcatataaaaataaggccctcaacccacaggagatgagaagacggagagaggaggagggcattcagctgcgaaagcaaaagcgtgaggaacagctcttcaagaggaggaatgtttacctacccaggaacgacgagagcatgttagaatccccaatccaagaccctgatatcagttcaaccgtgccgataccagaggaggaggttgtcaccacggacatggtccagatgatctttagcaacaatgccgatcaacaactcaccgcgacccagaagttcaggaagctgctatctaaagagccaaacccaccaatagatcaggttatccaaaaacccggagttgttcagcgtttcgtgaagttcctcgagagaaacgagaactgtacactgcagtttgaagctgcctgggccctgacgaatattgcaagtggaacctttctgcacactaaagtggtgattgagaccggagctgtaccaattttcataaagctgctgaatagcgaacacgaggatgtacaagaacaggcagtgtgggctctcggtaatattgcgggagacaacgcagagtgtcgggattttgttctgaactgcgaaattctgcctccgttactagaactgctaacaaactctaaccgcctcaccacaaccagaaatgccgtgtgggcgctatccaatctctgcaggggcaagaacccgccacccaacttctccaaagtcagcccttgcctgaacgtattatcgcggctgcttttttcttctgacccagatgtgctggcagatgtgtgctgggccctgagttacctgtccgatggtccaaatgataagatacaagccgttatcgacagtggcgtttgtcggaggcttgtcgagttgctcatgcacaacgattataaggtcgtctcgccagcactgcgggcagtgggtaatattgtgaccggcgatgacatccagacacaggtcatactgaactgtagcgcccttccttgccttcttcacttgctgtctagtccgaaggaatctatccgcaaggaggcctgctggaccgttagtaacattaccgccggaaatagagcccagatccaggctgtcatcgatgcaaatatttttcctgtactgatcgagatcctgcagaaagccgagtttagaactaggaaggaggcagcttgggctataactaatgcaactagcggaggaacgccagagcagatacgctacctggttgcactcggatgcattaagccgttgtgcgacctattaacagtcatggactctaaaatcgtgcaggtcgccttgaatggcctggaaaacattctgagactgggcgaacaagaaagtaagcaaaacggtattggcatcaatccgtactgtgctctgattgaagaggcttacggccttgacaaaatagaattcctgcagtcccatgagaatcaagagatttatcagaaggcattcgatcttatagaacactacttcggcgtggaggaagatgatccttccattgtcccgcaagtggacgaaaatcagcagcagtttatcttccagcagcaagaggcgcctatggacgggttccaactgtag

SEQ ID NO: 28478 - DNA, 3735 bp, Artificial Sequence
  Description of Artificial Sequence: Synthetic coding sequence
atgctaatcaaggagtatcatatcctgctgcccatgtcacttgacgagtatcaagtcgcacagctgtacatgattcaaaagaagtctagggaagaatcgagcggggaaggttcgggagttgagattctggctaatcggccatatacggatgggccaggtggatcagggcagtatacgcataaagtgtatcacgtgggcagtcacatcccagggtggttccgcgcactcctaccgaaagccgctctccaggtcgaagaggaatcctggaatgcatacccatacactaggacgcgctacacttgcccattcgttgagaaattcagtatcgagatagagacctactatttgcctgacggaggtcagcaaccgaacgtgtttaacctgtcgggagcagagaggcgccaaaggattcttgacactattgatattgtccgcgatgctgtcgccccaggtgaatacaaggcagaggaagatcccagattgtaccatagcgtgaaaactgggaggggaccattgagtgatgactgggcgcgtaccgccgcacagacaggacctctcatgtgcgcctataagctgtgcaaagttgagttcagatattggggaatgcaggcgaagatcgagcagtttatacacgacgtgggattgcgacgggttatgctcagggcccaccggcaggcttggtgttggcaggacgagtggaccgaactcagtatggccgacatcagggccctggaggaggaaacagcgcgtatgttggcgcagcgcatggccaaatgtaacactggcagcgagggttccgaggctcagccgccaggtaagcctagcactgaggcacggagcgccgcttctaatacaggaactcccgacggcccagaggccccaccgggtccagacgctagccccgacgccagctttggtaagcagtggagctcttcgtctcgaagcagctacagctcgcagcacgggggagccgtgtccccccaatccctgagtgaatggagaatgcagaatattgctcgagacagtgaaaacagcagcgaggaggaatttttcgatgctcacgaagggtttagtgactctgaggaggtgtttcccaaggagatgactaagtggaacagcaacgactttattgacgcatttgcgagccctgttgaggcagaagggaccccagaacccggagcggaagctgcgaaaggaattgaggacggggcacaggccccacgcgacagcgaaggcctggatggtgcgggagagctgggggcagaggcctgcgcagtccatgctctatttctgattcttcattcgggcaacatcttggactctggacctggggatgcgaactcgaagcaagcagacgtccagacactgagcagcgccttcgaagcggtcaccagaattcactttccagaggccttagggcacgtagcactgcggctcgtcccctgtcccccaatttgcgctgccgcatacgccctggtctcaaatctctctccttacagtcatgacggagatagcctctcccgctcacaggatcacatccccttagcagctctgccactgttggccacatcaagctctcggtaccagggcgctgtcgccactgttatcgctcgcactaatcaagcctactcagccttcctgagatcccccgaaggtgcaggcttctgtggacaggtagccctgatcggtgacggtgtgggagggatcctggggtttgatgctctctgccatagcgccaacgcaggaactgggagtcgcggaagttccagaagggggagcatgaacaatgaactcctgtcacctgaattcggtccagtccgcgatcctctcgccgacggtgtggaaggtctgggccgaggcagcccagaaccttccgccctccccccacaacgcataccctctgatatggctagccccgagcctgagggaagtcagaattcattacaggccgctcccgcaacaacttcatcctgggaaccaaggagagcaagcactgcattctgtccccctgcggcttctagcgaggcaccagatggaccctcctcgactgctagactcgactttaaggtatcaggcttctttctgttcggatctcctctaggcttggtcctcgcccttagaaagaccgtaatgcctgctcttgaggcagcgcaaatgcgcccagcttgcgagcaaatctataatttgttccatgcggcagacccctgtgcttcccggctagaaccactgttagccccaaagttccaggccatagcaccactcactgttcccagataccagaagttcccactgggcgacggctcttccctactcttggccgacaccttgcagacccactcttcactgttcttagaggagctggagatgctagttcccagcacccctactagcacgagcggggctttttggaagggatctgaactggctacagaccctccggcacagccagccgctcctagcactactagtgaagtcgttaaaatactggagagatggtggggaactaaacggatcgattacagcctttactgtcccgaagctcttactgcctttcccactgtgacattgccgcatctgttccacgcttcttactgggagtccgctgatgtcgtggcgttcattctgagacaggttatcgagaaagagcgcccacagctcgccgaatgcgaggaaccatcaatttattcacccgcttttccacgagaaaaatggcagcgcaaacggacccaggtcaaaattcgcaacgtcacgagcaatcatagagcttctgatactgtggtctgcgagggtaggccacaggtgctctctggcagattcatgtatggcccattggacgtggtcactctgaccggggaaaaagttgacgtgtacattatgactcagccattaagtggcaaatggatacatttcggcactgaggtgaccaattcctcagggcgacttacattccctgtgccccctgaacgcgcactaggaataggtgtgtatcctgtccggatggtcgtgcgcggagatcacacatacgcggagtgttgtctcactgtcgtggctcggggaaccgaagccgttgtattctctattgacggcagctttacagcctctgtctccataatggggagtgatccaaaagtgcgggctggtgccgttgacgtcgtgcgccattggcaggattctgggtatctaattgtgtacgttactggtcgccctgatatgcagaagcatcgtgtggtggcatggttgtcacagcacaatttcccgcacggggtcgtcagcttctgtgatgggctcacgcacgaccctttgcgtcagaaggctatgttcctacagtctttggtacaggaggtggaactgaatattgtggcagggtacggatcacctaaagacgtcgccgtgtatgccgctttagggctgagtccctctcaaacctatatcgtggggagagcagttaggaagctgcaggcccagtgccagtttctttcagatggatatgtcgctcacttaggtcagctggaggcaggttcccattcacacgcgtcctccgggcctccgcgagcagcactgggtaagagcagttatggggttgcggctcctgttgactttctgcggaaacagtctcagctcttgagatccaggggaccttcacaagccgaaagggagggaccgggaacaccgccaaccaccctggctcgcggaaaggctcggtctatttcactgaagcttgactcagaggagtag

SEQ ID NO: 28479 - DNA, 882 bp, Artificial Sequence
  Description of Artificial Sequence: Synthetic coding sequence
atgacagaggatagtcaaaggaacttcagatccgtatactatgagaaagttggcttccggggtgtagaagagaaaaaaagtttggaaatcctcctaaaagacgacagattggatacggagaaactctgcacattctcccagaggtttcctttgccctccatgtaccgcgcactggtttggaaggtgctgttgggtattttacctccgcatcatgagagccatgccaaggtgatgatgtataggaaggagcaatacctcgacgtgctgcatgcacttaaggtggtgaggttcgtcagcgacgcaacccctcaagctgaagtgtatttacgaatgtatcagctggagagtgggaaactgccaaggtccccgagttttcctctggaaccagacgatgaggtcttcctggctatcgccaaggccatggaagaaatggtagaggattccgtggactgttattggattacacgcaggttcgttaaccagctgaataccaaatatagggacagcctgccacagttacccaaagcatttgagcagtatctgaacctggaggatggcagacttctaacacatctgcggatgtgttcagcggcaccgaagcttccttatgacctgtggttcaaaagatgcttcgccggatgtctgcccgagagctcacttcagcgagtttgggataaagtagtcagcggctcatgtaagatccttgtcttcgtggcagtggagattttattaacttttaagattaaagtgatggctctgaactcagcagaaaagataacaaaattcctggagaatatacctcaagactctagcgacgcgattgtaagtaaggcaatcgatctgtggcataagcactgtgggactcctgtgcactcctcgtag

SEQ ID NO: 28480 - DNA, 249 bp, Artificial Sequence
  Description of Artificial Sequence: Synthetic coding sequence
atgtccgaaggcgaaagccagaccgtgcttagtagtggcagtgatcccaaggtcgagtcttcgtctagtgctcccggactaaccagcgtgagtcccccagtgacatcgaccactagtgcagcttctcctgaggaagaagaagaatcagaagacgaatccgagatcctggaagagagcccttgtggacgttggcagaagcggagagaggaagtgaatcagaggaatgtgcctggcatagattcagcgtag

SEQ ID NO: 28481 - DNA, 5057 bp, Artificial Sequence
  Description of Artificial Sequence: Synthetic coding sequence
atgtcattacccttttaccagagatgccatcagcattacgacttatcttacagaaacaaggatgtacgatcgaccgtctctcactatcagcgtgagaaaaagcgctccgctgtgtatacacagggcagcacggcttactcctcacgcagctccgcagctcaccgtcgggagtccgaagccttcagaagggcatccgccagttcaagtcaacagcaagcgtcccagcatgccctgagtagtgaggtgtcccgcaaggcggcatccgcttacgattatggttccagccatgggttgactgattccagcctcctgctggacgactattcatccaagctgtcaccaaaaccaaagagggccaagcactcgcttctcagtggcgaggaaaaggaaaacctgccatctgattacatggtaccaatcttcagcgggagacaaaagcatgtgagcggcatcaccgatactgaagaagagcgaattaaagaagctgccgcatacattgcccaaaggaatctgctagccagtgaggaaggaatcacaacgagtaaacaatccacagcgagtaagcagaccacagcttcaaagcagtccaccgcatccaagcagagtactgcctccaaacagtccactgcgtcacggcagtcaactgcgagtcggcagtccgtggtatctaagcaggcaacctcagcacttcagcaggaagaaacctcagaaaagaaatctagaaaggtggtgatccgagaaaaggctgaaaggctttctctccgcaagacactggaagagactgagacctatcatgccaaactgaacgaggaccatctcttgcatgcccctgaatttataataaagccacgaagccacaccgtttgggaaaaagaaaacgtaaagctccactgctcaatcgctggatggccagaaccacgagtcacatggtacaaaaaccaagtgcccatcaatgttcacgccaatccgggtaagtacatcattgaaagcagatatgggatgcacaccttggaaatcaacggatgcgatttcgaagacactgcgcagtatcgcgcttctgcgatgaatgtgaagggagagttaagtgcatacgcatcagttgtggtaaagagatataaaggagaatttgacgaaacacgatttcacgcaggggcttcaactatgcctttatcatttggggtaaccccttacggctacgctagcagatttgagatccatttcgacgataaattcgacgtgtcttttgggcgtgaaggtgagacgatgtcactgggctgtcgggtggtgatcacaccagagataaagcactttcagcccgaaatacagtggtataggaacggagtgccactgagccctagcaaatgggtccagactttgtggagtggagagcgcgcaactctgacgtttagccaccttaacaaggaggatgagggtctatacacaatacgggtccgcatgggggaatattatgagcagtattccgcatatgtgttcgttcgcgatgcggacgcagaaattgagggggctccagccgctcctctcgacgtcaagtgccttgaagctaacaaggattatattatcatttcatggaagcagccagcggtcgatggaggctctccaatcttaggttattttattgacaagtgcgaggtcggaaccgacagttggagccagtgtaacgacactccagttaaatttgctcgcttcccagtaaccggcctcattgaggggcgatcatacattttccgcgtgagggccgttaacaaaatggggattgggttcccgtctcgggtttctgagccagtcgccgctctggatccggctgaaaaggccagacttaagtctaggccgagcgcaccgtggactggacagattatagttacagaggaagagcctagcgagggcattgttcctggccctccaaccgacctgtctgtgaccgaagctactcgctcctacgtagtgttgagctggaagccaccaggccagaggggtcacgagggcatcatgtacttcgtggagaaatgcgaggctggtaccgagaactggcaaagggtgaacaccgaactccctgtgaagagcccacgatttgcactcttcgaccttgccgaggggaaaagttattgcttccgggtccgatgtagcaattccgccggtgtgggggagcctagcgaggcgacagaagtgaccgtcgtgggagacaaactggacattccaaaagcccctgggaaaatcattccttccagaaacacggatacgtccgtagtggtgagttgggaggagtccaaagatgccaaggaactcgtggggtactacattgaggcatcagtcgcagggagcggtaaatgggagccctgtaataacaaccccgtaaaggggtctcgatttacatgtcacgggctcgttactggtcagtcctacatattccgcgtgagagccgtcaacgcggcagggctgtcagaatacagtcaggatagcgaggctatcgaggtgaaagccgctatcggtggtggggtgtctcccgacgtctgccctgcgctctccgacgaacctggcggtctcaccgcttccagaggccgagtgcacgaagctagtcccccaactttccaaaaagatgcactacttggatcaaagccgaacaagccttcattgcctagcagttcccagaacctgggacagacagaggtgtccaaggttagcgaaacggtccaggaagagctgacccctccacctcagaaagccgcaccccagggcaagtcaaaatctgaccctctgaagaaaaaaacggatagagcccctccaagtcccccatgcgatatcacatgtcttgaatcttttcgcgacagtatggtgctgggctggaaacagcccgacaaaataggcggagccgaaattacaggttattacgtaaactacagggaggttatagatggagtacccggaaaatggcgggaggccaacgtgaaagctgtctctgaggaagcctacaagatctcaaatctcaaagaaaatatggtgtaccagttccaggtggcagccatgaacatggcaggtctgggggctccatctgctgtgtccgaatgctttaagtgtgaggagtggactattgccgtgcccggtccaccacactccctgaagtgcagcgaggtgagaaaggattcgctcgttctgcagtggaaaccccctgtccacagcgggaggacccctgtcacaggttacttcgtcgatctgaaagaggcaaaggccaaagaggatcagtggcgcggactgaatgaagccgctatcaagaatgtatatcttaaggtgagggggcttaaagaaggcgtgtcttatgtcttccgagtgcgtgccatcaatcaggccggagtgggcaaaccttcggacctggccggacctgtggtcgccgaaactaggcccggtaccaaggaggtagtggtgaacgtggacgatgacggggtaatcagcctcaattttgaatgtgataagatgacaccaaaaagcgaattttcctggtccaaggattatgtcagtactgaggactccccaagacttgaggtagaatccaaagggaataagactaagatgaccttcaaagatctgggcatggatgacctgggaatttatagttgtgatgtcaccgacaccgatggtatcgcaagctcttacctcatagacgaggaggaattaaaacgattgctcgcactcagtcacgaacacaaattccccacagttccagtgaagtccgaacttgcagtagaaattttggaaaaaggtcaagtgcgattctggatgcaagccgaaaagctctccggaaatgcaaaggtgaattacatattcaatgaaaaggagattttcgaagggcctaagtataagatgcacatcgacagaaacactggcatcatagagatgtttatggaaaaactacaggatgaggacgagggaacctatacattccagttgcaggacggtaaggctaccaaccacagtactgtcgtgctggtgggagatgtcttcaagaaactgcaaaaggaagccgaattccaacggcaggagtggattaggaagcaggggccacacttcgtggagtatctatcctgggaagtaaccggcgagtgtaatgtgttgctgaagtgcaaggtcgccaacattaagaaagagacgcatatagtgtggtacaaagatgagagagaaatttcggtcgacgagaagcacgacttcaaagatggcatatgtacactgctcatcaccgagttttctaaaaaggatgcaggcatttacgaggtaatccttaaggatgacagggggaaggacaagtccagacttaagctcgtggatgaggcattcaaggaattgatgatggaagtgtgcaagaagatcgccctcagcgccaccgatctgaaaatccagagcactgctgaggggatacagctttactcttttgtgacttattacgtggaagacttgaaagtgaactggtctcataacggctccgcgatccgctattctgatcgtgtcaaaacaggcgttaccggtgaacagatatggctgcaaatcaatgagccaacacctaatgacaaggggaagtacgtgatggagctgtttgacgggaagacagggcatcagaaaactgtggatctgagcgggcaggcttacgatgaagcttacgcagagttccagcggttgaagcaggctgctatagccgaaaagaatagggccagagtcctcggtgggctgcctgacgtcgttactattcaggaaggtaaggccctgaatcttacgtgcaacgtatggggcgaccctccaccagaagtttcgtggctcaagaatgagaaagctctggcttctgatgaccattgcaatttgaagttcgaggccggacgcaccgcttacttcaccatcaacggcgtgagcactgcagactcgggcaaatacggcctggtggttaagaacaagtatggatccgagactagcgactttactgtatccgtgttcatacctgaagaagaagccagaatggctgcgctcgagtcgctcaaaggcggtaagaaagctaagta

SEQ ID NO: 28482 - DNA, 5876 bp, Artificial Sequence
  Description of Artificial Sequence: Synthetic coding sequence
atggctgatcgcacggcaccacggtgccagctgcgcctggaatgggtgtacgggtacagggggcaccagtgcagaaataacctgtactataccgctggtaaagaagtcgtgtattttgttgctggggtgggtgtggtctataatacccgcgaacacagtcagaagttcttcctgggacataacgatgatataatcagtctcgcactgcatcccgacaagacgctcgtggctaccggccaggtcggcaaagagccgtatatttgcatttgggacagctacaatgtacagacggtcagcttactcaaggacgtgcacacgcacggcgtcgcttgtttggcctttgactccgacggacagcgccttgcatcagtgggtctagatgctaagaataccgtatgcatctgggattggaggaagggtaaactgctagcgtcagctactggacattctgacagaattttcgatattagctgggacccataccaacccaatagggtggtttcctgcggagtaaagcacatcaaattttggacactctgcggaaatgcccttacagccaagagaggcatctttggtaagacaggagacctccaaacaatcttatgtcttgcgtgcgcgaaggaggacattacttattcaggggcactgaacggcgatatctacgtatggaagggccttaacttagttcggaccattcagggcgctcacagcgcaggaatctttagtatgtacgcctgtgaagaaggattcgccaccggcggacgggatggttgcatccggctctgggacaccgactttaagcccatcaccaagatcgacctgcgcgagaccgagcagggttataaaggcctctctattcgcagcgtctgctggaaagctgacagactgcttgccggtacacaagacagtgaaatttttgaggtgatcgtgagggaacgcgacaagcccatgctgattctacagggacactgcgagggcgaactgtgggcattggccctccaccccaagaagccgctcgcagtcaccggatctgacgacagatctgtgcgactgtggtctttagccgatcacgctctaatcgctcgatgcaatatggaagaagctgtgcgatctgtagccttctcacctgacggttcccagttagccctgggcatgaaagacgggtcctttattgtgctgagagtgagggacatgaccgaggtcgttcatattaaagaccgaaaggaggtcatccacgaaatgaagttctctccagatggctcctatctggccgtggggtctaatgacggtccggtggatgtgtacgctgttgcacagagatataagaagataggcgaatgcagcaagtccctcagtttcatcactcatatcgattggagcctggactctaagtatctgcagacgaacgacggagccggtgaacggttgttttacagaatgccatccggcaagccgctgacaagcaaggaagaaatcaaagggattccatgggcatcttggacatgcgtgaagggcccagaagtgtctggaatctggcccaagtacactgaggtaacagatatcaactctgtcgacgccaattacaactcatctgtgctcgtttcaggtgatgattttgggctcgtgaagctctttaaatttccctgcctgaaaagaggcgcaaaattccgcaaatatgtgggtcacagtgcgcatgtaaccaatgtgcgatggtctcatgatttccagtgggttctgtccacaggaggagctgaccactctgtttttcagtggcgtttcataccagagggggtaagcaatggtatgttggaaacagccccacaagaaggaggggcagattcctatagcgaagagtccgactccgatctgagtgatgtacctgagcttgatagcgatatcgagcaggaggcccagattaactacgacagacaagtttataaagaggatctgcctcaactgaagcagcagagcaaggagaaaaaccacgccgtcccttttcttaaacgagaaaaggcacctgaggatagcctcaagctccagtttatccacggatatagaggatacgactgtcggaacaacctgttttacacccaggccggagaggtcgtgtatcacatagctgctgttgctgtggtttataatcgtcagcagcattcacagcgtttgtatctcggacacgacgatgatatcttgtcactaactatccacccagtaaaagactatgtggcaactggtcaagtgggtcgcgacgctgcaatccacgtgtgggacactcagacacttaagtgcctaagcctactgaagggacagcaccaaaggggagtctgcgccctggatttttctgctgatggcaaatgcttggtgagcgtgggattggacgatttccacagtatcgtgttctgggattggaagaagggggagaagattgccaccacgagaggacataaggataaaattttcgtggtgaagtgtaatcctcaccatgttgataaactggtgacagttggcattaaacacattaagttctggcagcaggccggaggtggctttacctcgaagcgcggtaccttcggaagcgttggcaaattggaaactatgatgtgcgttagttacggccgaatggaggatctggtcttctccggagccgcaaccggcgatattttcatatggaaggacatcctcctgctgaagaccgttaaagcccacgacggtcctgtgttcgcgatgtatgctcttgacaagggctttgtgaccggtggtaaggatggcattgttgagctgtgggacgacatgtttgaaagatgcctgaagacttatgctatcaaacggtctgccctgagcacctccagtaagggcctgctgctggaggataacccaagcatcagagctatcaccttgggccacggccatattcttgtgggcacaaaaaacggtgagattctcgaaatagataagtcggggccaatgacactcctcgtgcagggccacatggaaggggaggtttgggggcttgccgctcacccgcttctgccaatctgcgctacggttagcgacgacaaaacactccgcatatgggaactgtccgcccagcatcggatgctggccgtcaggaagctaaaaaagggcggtcggtgttgtgccttttcacccgacggtaaggcactggctgttgggcttaatgacggatctttcctggtcgtgaatgctgatactgtcgaagacatggtgagcttccaccacaggaaagagatgatctcagatattaaattcagcaaggatacgggcaagtacctcgctgtggcctcccatgacaattttgtggacatttacaacgtcctgactagcaagcgtgtggggatctgcaagggcgcttcaagctacatcacccatatagactgggatagtcggggaaagctactgcaagtgaatagcggagctagggagcaattgtttttcgaggctcctcggggtaagcgccacattatcagaccctctgaaattgagaagatcgagtgggacacctggacttgtgtactggggccaacctgtgagggtatttggccagcacattcagatattacggatgtgaacgccgcttcgctcacaaaggattgtagcctcctggccaccggagacgattttggcttcgttaagctgttttcctatcccgtgaaagggcagcatgcacgtttcaagaagtacgtgggtcactccgcccatgtgacaaatgtgaggtggctgcataacgattccgtgctcctgaccgtgggcggagcagatacggctctgatgatctggacaagggaattcgtcggcacacaggagagtaagcttgtggacagtgaagagagtgataccgacgtcgaggaggacggcggatacgactcagacgtcgctagagagaaagccatcgactataccaccaagatctacgccgtgtctatccgggagatggagggcactaaaccccatcaacaactcaaggaggtgtccgtcgaggaacggcctccagtatcccgcgcagcccctcagccggagaagttgcagaagaacaatatcacaaagaagaagaagctcgtggaagagctggcccttgaccacgtattcgggtataggggttttgattgtcgaaataacctacactacttaaacgacggcgcagacatcatttttcacactgcagcagccggtatcgtgcaaaatctgtctactggcagtcaaagtttctatctggagcatacagatgacattttgtgtctgacagtgaatcagcaccccaagtacagaaacgttgtcgccacttctcaaatcggtactacaccttctatccatatatgggacgctatgaccaagcacacgctgtccatgcttcgttgtttccattccaagggtgtaaactacatcaacttcagtgccactggcaagctgctggtaagtgtgggggtggatccggaacataccattaccgtgtggagatggcaagagggcgcaaaggttgctagcaggggcggacacctagagagaatctttgttgtggaatttaggcccgactccgacactcagtttgtctctgtcggtgtgaaacatatgaagttttggaccctggctggcagcgctttgctctataagaagggagtaatagggtctctgggcgctgcaaaaatgcaaacgatgctttctgtggccttcggggctaacaacctgacatttaccggagccatcaacggggatgtgtatgtgtggaaagaccatttcttaatccggcttgtggcaaaagcccatacaggcccagtcttcaccatgtacactaccctcagagacggccttattgtgactggagggaaggaacgccctactaaggagggaggagcagtgaagctctgggatcaggaaatgaaacggtgccgtgccttccagctagagaccggtcaactggtggagtgcgtacggtctgtgtgtcgtgggaaaggaaagatcctggtggggaccaaagatggtgaaattatcgaggtgggcgagaagaatgcagcctctaatatcttaatcgatgggcatatggagggagagatctggggcctcgctacccacccctccaaggatctattcatctcagcatcaaatgacgggactgctagaatctgggacctcgccgataagaaattgttgaataaggtctccctcggccacgctgctcgttgtgccgcttactcccctgacggggagatggtcgcaatcggcatgaagaacggagagttcgtcatcctcctcgtgaattcactgaaggtatgggggaaaaagagagataggaagtcagcaatacaggatattagaatttcgccagataacaggtttctggccgtgggaagctctgagcatactgtcgacttctatgatctaacacaggggaccaatctgaataggatcggatactgcaaggacattccctcttttgtcattcaaatggactttagtgctgatgggaaatatattcaagtgagcaccggtgcctataagcgccaagtacacgaagtaccactaggcaagcaagtgaccgaggctgttgtcatcgagaaaataacttgggcatcatggacatcggttctgggggatgaagtgataggcatatggcccagaaatgctgacaaagcagatgtgaactgtgcctgtgtaacccatgctgggttaaacatcgtcactggcgatgatttcggactggtgaagctgtttgattttccgtgtaccgagaagttcgccaagcacaagagatatttcggccactccgctcacgtgacaaacatccgattcagttacgacgacaaatatgtagtgagcacaggcggagacgactgttctgtctttgtttggcgatgtttata

SEQ ID NO: 28483 - DNA, 630 bp, Artificial Sequence
  Description of Artificial Sequence: Synthetic coding sequence
atgaatcccagtatgaaacagaagcaggaggagatcaaggagaatatcaaaaactcttcagtgccaaggcgcaccctgaagatgatccagccgtctgcctctgggtctctggtgggcagagagaatgagctgtcagcgggactttcaaagcggaaacatcggaacgaccacctgacctctacaacatcttcacccggtgttatagtgcccgagtccagcgagaataaaaatctggggggagtgacccaggaatcttttgacctaatgataaaagagaaccccagctcacaatattggaaagaagtggccgagaagaggcgcaaggccctctacgaagccttgaaagagaatgaaaaactccacaaagaaatcgaacagaaggataatgaaattgcaaggctgaagaaggagaataaggaactggcggaggtagcagagcatgtccagtacatggccgagcttatcgaacgactcaatggcgaaccgctcgataattttgaaagtctggacaatcaggagtttgactcagaagaggagaccgtggaggattcattggttgaagacagtgagattgggacctgcgccgagggaaccgtgtcttcaagtactgacgcaaagccctgcatttag

SEQ ID NO: 28484 - DNA, 1635 bp, Artificial Sequence
  Description of Artificial Sequence: Synthetic coding sequence
atgaacacttcaatcccttaccagcaaaatccctacaatccccgtggatctagtaacgtgattcagtgttaccgctgtggtgacacatgcaaaggtgaagtcgtacgtgttcataataaccacttccatatcaggtgctttacctgtcaggtttgcgggtgtgggttggcacaaagcggctttttttttaaaaatcaggaatacatatgtacacaggactaccagcagctgtatggcacacgctgcgatagctgcagagattttattacaggagaagtcatcagtgccctggggaggacttaccacccgaaatgtttcgtgtgtagtctctgcaggaagccgttcccaatcggggacaaagttacattcagtgggaaagagtgcgtatgtcagacctgctctcagtcgatggcgagctctaaaccaattaaaatcagaggcccatcgcactgcgcaggctgcaaagaggagataaagcatggccaaagtctcctggccctcgataagcaatggcatgtgtcctgctttaagtgccaaacgtgcagcgtcattcttactggcgaatacatctctaaagacggcgtgccatactgtgagtccgactaccacgctcagtttgggattaaatgcgaaacctgcgatagatatatttctggaagagtgttggaagcagggggtaaacattatcaccccacttgcgccagatgtgtgaggtgtcaccaaatgttcaccgaaggggaagaaatgtacctgaccgggtccgaggtctggcatcctatttgtaaacaggctgctcgagccgagaaaaagcttaagcaccggaggactagcgagacttcaatcagcccgcctggttcttccatcggttctcctaatcgcgtaatctgcgatatatatgagaatttagatctgcgacagcgcagagcctccagtcccggatatattgactctccaacatactcccgacagggtatgtcaccaactttttctcgaagtcctcaccattattatcgatccggtgatctttcgaccgcgaccaagagcaagactagcgaggatatatcccagacgtctaaatacagccccatctacagtccagacccatactacgccagtgagtctgagtactggacataccatggttcccctaaggtgcccagagctaggcgctttagcagcggtggagaagaagacgactttgatcggtctatgcacaaactccaaagtgggatcggaaggctgattctaaaggaagaaatgaaggcacgaagtagctcatatgccgacccttggacccccccacgttcaagtacatcctctcgcgaagcccttcacacggcaggatacgagatgagcctaaatgggtctccgagatcccactatctggccgacagtgatcctttgatctccaaaagcgcttctctgccagcatatcgcagaaacggccttcatcgcaccccgagtgcggatctttttcactatgattccatgaacgctgtaaattggggaatgagagaatacaagatctatccttatgaattgctccttgttacaaccagaggcagaaaccggctgcctaaggatgtcgacagaacaaggctggagggaaatttctggaaatctggatgtctgtag

SEQ ID NO: 28485 - DNA, 840 bp, Artificial Sequence
  Description of Artificial Sequence: Synthetic coding sequence
atgacgccttccgagggcgcacgcgcagggactggcagagaattggaaatgctggattccttgctggccctggggggacttgtgctgttgagggattccgtcgagtgggagggtcgcagcctgctgaaggctctggtgaaaaagagtgcactttgcggggaacaggtgcacatcctgggatgcgaagtgagcgaggaggaatttagggagggattcgactcggatatcaacaaccgactggtgtaccacgacttcttccgcgatccacttaactggtcgaaaactgaagaggcattcccaggaggcccactcggagcacttcgtgccatgtgtaaaaggactgacccagttcctgttacgatcgctctcgattccctgtcttggctgcttctgcgcctgccttgcacaacactgtgccaggttctccacgccgtgtcgcaccaagactcatgccccggagattcttcctctgttggcaaggtttcggtgctcggactcctccatgaggagcttcacggccctggacccgtcggcgctcttagctccctggcacagacagaagtgacactgggcggtacaatgggccaggctagtgcacatattctttgccgcagacctcgccagcgccctacagatcagacccagtggttctccatcctccccgatttttccctcgatcttcaagaagggccaagcgtggaatcccagccgtatagtgatccacatataccacccgttagtaaaaacgctaaagcgaggacaagaaagtgcagcttagtttcaggccatggaagggagaacaagtcttgtcggggatgggggtggggtcagggcttttag

SEQ ID NO: 28486 - DNA, 405 bp, Artificial Sequence
  Description of Artificial Sequence: Synthetic coding sequence
atgtccgagaatgcagccccaggtctttgcggggagctcttgctgcaaagagggaccacaaaggtggctaccggtctggttctaaacagggaccaacgcctagcatgggcggaaaacagcatcgacttcattagccgggagctgtgtgcacactcaattcgcaagctgcaagcgcacgttctactgattaaggctgtacatggatacttcgactcccggcaaaattatagtgagaaagagtctctaagcttcatgatcgataccatgaagtccacgctcaaggagcaatttcagtttgtcgaagttccaggcaatcactgcgtgcacatgtccgagcctcaacacgtcgcatccatcatttcttctttcctgcagtgtacacacatgctgcctgctcaactgtag

SEQ ID NO: 28487 - DNA, 1350 bp, Artificial Sequence
  Description of Artificial Sequence: Synthetic coding sequence
atgatgctgggcaccgaaggcggagaaggattcgtggtgaaggtccggggattgccatggagctgttcagccgacgaggtccaacgttttttttctgactgcaagatccaaaacggagcccagggaatccgcttcatctacacgcgggagggtcggccttccggcgaggctttcgttgaactggaaagtgaggacgaggtgaagctggctctcaaaaaggatagagagaccatggggcacaggtatgttgaggtgttcaaatccaacaacgtcgaaatggattgggtcctgaaacacactgggccaaactcgcctgacaccgcgaatgacgggtttgtgcgcctaaggggcctgccctttggatgctcaaaggaggaaattgttcagtttttctcaggcctggagatcgttcctaacgggattaccttaccagtggatttccagggcagatccacaggcgaggccttcgtccaattcgcctctcaagaaatagcggagaaagccctgaagaaacacaaggagcggatcggtcacaggtatatagagatctttaagagctcaagagccgaagtgcgcacacattatgatccacccaggaaattgatggcaatgcagcgacctggtccctatgatcggccaggggcaggcagaggctacaattcaataggcagaggggctggctttgaaagaatgcgccgtggagcctacggtggcggttatggtggctatgatgactacaacgggtataacgacggatacgggttcggtagcgacaggttcggcagagatttgaattattgtttctccggaatgagtgatcaccgctacggagacggcggatctactttccagagcacgacagggcattgtgtccatatgcgaggcctgccatacagagctaccgagaacgacatttataactttttcagccctctgaaccctgttagggtccatatcgagattggacctgatggaagagtcactggggaagctgatgtggaattcgctacccacgaagatgcagtggcggcaatgagtaaggacaaagcaaacatgcaacataggtacgttgagctgtttctgaattcaaccgctggcgcatcgggtggggcatacgagcaccggtatgtagagttatttctgaactcaaccgccggagcatctgggggtgcttacgggtctcagatgatgggagggatggggctgtcaaatcagtcttcctacggaggcccagcaagccaacaactgagtgggggatacggcggaggctacggtggccaatcttctatgtcagggtacgaccaggttctccaggaaaatagttcggatttccaaagcaatatcgcctag

SEQ ID NO: 28488 - DNA, 4077 bp, Artificial Sequence
  Description of Artificial Sequence: Synthetic coding sequence
atgggcaaccagctggcaggtatcgctcctagccaaatcctcagcgttgagtcatatttcagtgatattcacgatttcgaatatgacaagtccctgggcagcacacggtttttcaaggtagccagagctaaacatcgagagggactggtcgtggtgaaggtttttgccatccaagatccaaccctgcctctgacatcttataagcaagagcttgaggaattaaagattagactaaattccgcccaaaattgcctgccatttcaaaaagcttctgaaaaggccagcgaaaaggcagcaatgctgttcagacagtacgtgcgggacaacctgtacgaccgcataagcacgcggccattcctgaacaatatagagaagcgatggatagctttccaaattctgaccgctgtcgaccaagctcataaatctggagtgcgccacggcgacattaaaaccgagaatgtgatggtgactagttggaattgggtcctgctgactgactttgcctcattcaagcccacttacctgccggaggataaccctgctgattttaactatttctttgacacctcgcgcagaagaacctgttacatagcccctgagcgctttgtggatggaggaatgtttgccacagagctcgagtacatgcgggatccttcaacaccgctagtcgatctgaatagcaaccagcgcactcgcggtgaactgaaacgggctatggatatcttctctgctggctgcgtgatcgccgaactgttcacggaaggggtgccactgttcgatttatcacaattacttgcttatagaaatgggcacttcttccccgagcaggtgttaaacaaaatcgaggaccacagcattagagagttggttacgcaaatgatccaccgggaacccgacaagagactcgaggccgaggattatcttaaacaacagagaggaaatgcctttccagagatattctacacctttctgcagccttacatggcccaattcgctaaggagaccttcttatctgccgacgaacgaatattggtgattcgcaaggacctggggaacatcattcacaacctatgtgggcacgacctgcctgaaaaagccgaaggtgaaccaaaagagaacggtttggttatattagtgtccgtgattacttcctgcctgcagacattgaagtactgcgattcaaagctcgccgcactggagctcattttacacctggccccacgcctaagtgtggagattctgttagacaggataacaccttacctgcttcatttcagtaatgactcagttccacgcgtgcgggctgaggcactgagaaccctgaccaaggtgttggccttagtgaaagaagttcctcgcaacgacattaacatatatcctgagtatatcttgcctgggattgcacatctggctcaggatgatgcaacaattgtccgcctggcctatgcagagaatatcgctctgctggccgagacggcgctcaggttcctggagcttgtccagctcaagaacctgaatatggaaaatgacccaaacaacgaggagatagatgaagtaacacatcccaatggaaattatgacaccgagcttcaggcccttcacgagatggtccagcagaaggtagtgacactcttatcggaccctgaaaacattgttaaacagacactgatggaaaacggaatcacacgtttatgcgtttttttcggtagacagaaagccaatgacgtccttctgtctcacatgatcaccttcctaaatgataaaaatgattggcatctcaggggagcatttttcgactcaatagtcggcgtcgctgcatacgttggatggcagagcagctctatactgaagccgttgttgcagcaaggtttatccgacgccgaagagttcgtgatcgtaaaggccttatacgccttgacatgtatgtgccagttgggtttgctgcagaagccacatgtgtatgagttcgctagtgatatcgcgccattcttgtgtcacccaaacctatggatcagatacggcgcagtgggcttcattacagtggttgccagacagattagtacagcggacgtctattgcaagctaatgccctatctcgatccctacattactcagcctataatccagattgagcgcaagcttgtgctactgtctgttctgaaggaaccagtgtcccgcagtatctttgactacgccttgcgatcaaaagacattacgtccctgttccggcatctgcacatgagacagaagaagcgtaacggcagtctccccgactgcccccctcccgaggatccagccatcgcgcagctgctgaagaaattgctctctcaaggaatgaccgaagaggaggaggacaaattactcgccttgaaagatttcatgatgaagtctaacaaagctaaggcgaatatcgtcgatcagtcccacctccatgactcttctcagaaaggggttattgacctcgccgcactgggcatcaccgggcgtcaagtggatctggtgaaaaccaagcaggagcccgacgataagcgggctcgtaaacacgtgaagcaggactctaacgtaaatgaggaatggaagtccatgttcgggagcttagaccctccaaatatgccccaggcccttcctaaaggatccgaccaggaggttatacaaaccgggaagcctcccagaagcgaaagttccgcaggcatttgcgtgcctctaagcactagctcacaagtgccagaggtgactaccgtgcaaaacaagaaacctgtaatcccagtgctgtcgagcaccattctgccctccacctatcagatcaggatcaccacctgtaaaacagagctacagcagctgatacagcagaaacgggagcagtgtaacgccgagcgcatcgcaaaacaaatgatggaaaatgcggaatgggagtctaagccaccaccccctggttggcggcctaaggggcttctcgtcgcccacctccatgaacataaatcggcagttaatcggatccgagtgagtgacgagcattctctgtttgcaacctgctcaaatgatggcactgtcaagatctggaactctcagaaaatggaggggaaaaccacgactacccgcagcattttgacctacagtagaataggcggaagggtaaaaacccttacattctgtcagggctcacattacttggcgattgctagtgataacggtgccgtgcagttgcttgggattgaagcctctaagcttcccaaatctcccaaaattcacccattacaatctagaattctggatcagaaagaggacgggtgtgtggtcgatatgcaccattttaactctggtgcccagagtgttctcgcctacgctacggttaacggctccttagtaggatgggacttacgatctagctccaatgcatggacactgaagcacgatctcaagtctgggctcattacctcattcgccgtggatatacaccagtgctggctgtgcatcggtacctcatccggcaccatggcctgttgggacatgcgatttcagttgccaatttcgtcccactgccatccatcccgcgctaggatacgtaggctgtccatgcatcccctgtaccagagctgggtgatcgctgcagtgcaagggaataacgaagtctctatgtgggatatggaaaccggagaccgaagattcaccctatgggcctccagcgcacctcccttatctgaattgcaaccaagtcctcattcagtgcacggaatctattgctcacctgccgacggtaatcctatactgctcactgctggctctgatatgaagatccggttctgggatctggcatacccggaacgctcctacgtcgtcgccggaagcacgtcttccccgtcagttagttactatcgaaaaatcatagagggtacggaggtcgtgcaggagatccagaacaaacagaaagtgggacccagcgacgatacgcctaggcggggacctgaaagcctgcctgtgggccatcacgatattatcaccgatgtggctacattccagaccacacaggggttcatcgtgacggcctctcgagacggtatagtaaaggtctggaagtag

SEQ ID NO: 28489 - DNA, 993 bp, Artificial Sequence
  Description of Artificial Sequence: Synthetic coding sequence
atgcccgttgtgacaaccgatgccgaatcagagacggggatccctaaaagtttgtcaaacgagcccccatccgaaaccatggaagagatagagcacacctgcccacagccacggctcactctcacagcccctgctccttttgcagacgagactaactgtcaatgtcaggcgcctcacgagaaattgacaattgcacaggccaggctgggcacgccggctgataggccagtcagagtgtacgccgatggtatcttcgacctgtttcatagtggacatgctcgggctctgatgcaggccaaaacactgtttcctaactcctatctattggtcggggtctgttcagatgatctgacacacaaatttaaagggttcacagtgatgaatgaggcagaacggtacgaggccttgcgccattgcagatacgtcgacgaggttataagggacgccccttggacactgactccagaatttctggagaagcacaaaatagattttgtggcacacgacgacatcccatactcttcggccggatctgatgacgtgtataaacatataaaggaggcaggaatgttcgtgcctacccagcggacagaggggatctcaacctcagatattattactaggattgtgagagactacgacgtgtacgctcgcagaaatctccaacgcggatacacggcgaaggaattgaacgtgtcttttattaacgaaaaacgttataggttccagaaccaagttgataagatgaaagaaaaggttaagaacgtagaggagaggtccaaggaattcgttaacagggtggaggagaaatcccacgacctgatccagaaatgggaggaaaaatcgcgtgagtttatcgggaacttcttggagttgtttggtcccgacggcgcatggaaacaaatgttccaggaacgaagctcacggatgttacaggctctgtcaccaaaacagtctcctcttaaatcatgggctaggtgcagggatttctag

SEQ ID NO: 28490 - DNA, 2025 bp, Artificial Sequence
  Description of Artificial Sequence: Synthetic coding sequence
atgcagacatcgagttcaaggtctgttcatctgagcgaatggcaaaaaaactacttcgccattacctctgggatttgtacgggccctaaggctgatgcttaccgtgctcaaatcctccggatacagtatgcatgggcaaattccgagatctcacaggtgtgtgctaccaagctcttcaagaagtatgccgagaaatattcggccatcattgattcagataacgttgagagcggactcaacaactatgccgagaatattctgactctcgctggcagccaacagaccgactctgataagtggcagtccggactatccattaacaatgtgtttaagatgtcatccgtgcagaagatgatgcaggccggaaagaagtttaaggacagcttacttgaaccagcactggccagtgtggtgatccacaaggaagcaaccgttttcgatttacctaaattctcggtgtgtggctctagccaagagtccgattcactgcctaattccgcccacgacagggaccgcacgcaggattttcccgagtccaatagactaaagctgctgcagaatgcacagcctcccatggtcaccaataccgcccgaacctgccccaccttcagcgcaccagtgggcgagagtgcgacggcaaaatttcacgtgacacccctctttggcaatgtaaagaaggagaaccattcgtctgctaaggaaaatatcggactgaacgtgttcctaagcaatcaaagctgctttcccgctgcttgcgagaatccccagagaaaaagtttttacgggtctgggaccattgatgccttaagtaatccgatcctgaacaaggcctgttctaagactgaggacaatgggcctaaagaagacagtagcctgccaacgttcaagacagcaaaagagcaactgtgggtggatcagcagaaaaagtatcaccagccacagcgagctagcggaagctcctatggaggggttaagaagtctttgggcgcttcccgaagcaggggaattctggggaaattcgttccacccattccaaagcaagatggcggagagcagaacggcggaatgcaatgtaaaccctacggcgctgggccaacagagcccgctcaccctgtggatgagagattgaaaaaccttgagccaaaaatgatcgaactcatcatgaacgaaatcatggaccacggccctccagtgaattgggaagatatagccggagttgaatttgcaaaagccactatcaaggagatcgttgtttggccgatgcttcgcccagatatctttactggcttgagaggacctcccaaggggatcctcctgtttggcccacctgggacaggaaagacactgatcggcaaatgtattgctagtcagtcaggagctacatttttttcaatttccgcatcttccctgacttctaagtgggtcggggagggagaaaaaatggtgagggctctatttgcagtggcacgatgtcagcagccagctgtgatctttatcgatgaaatcgactcactactctcccagcggggtgatggggaacacgagtcgtccagaaggattaagaccgaattcctcgtgcagctcgatggtgcaacgacatcctccgaagacaggatactcgtggtcggcgcaacaaacaggcctcaagagatcgacgaagcggcacggagacgcctggtgaagaggctctatatcccgctgcccgaagcctctgctcgcaagcaaattgttattaacctcatgagtaaggagcaatgctgtctgtctgaagaggaaatcgagcagatcgtgcagcaaagcgacgccttcagtggagccgacatgacccaactgtgccgggaggcaagcctgggccctattcgaagcctccaaactgccgacattgcaaccatcacacccgaccaggtccgacctatcgcctacatcgacttcgagaatgcttttagaaccgtcagacccagtgtcagccctaaagacttggagctctatgagaactggaacaagaccttcgggtgtggcaagtag

SEQ ID NO: 28491 - DNA, 1143 bp, Artificial Sequence
  Description of Artificial Sequence: Synthetic coding sequence
atgctccgccgtaaaccctccaatgcttctgaaaaagaaccaacccagaaaaagaagctgtctctgcagcgctctagctcctttaaggattttgctaagtcaaaaccatctagccccgttgtgtcagagaaggaattcaatcttgacgacaacattccggaggacgacagtggagtgcccactccagaggatgcaggtaagtctggtaaaaagctagggaagaaatggagggcggtcatcagcaggactatgaaccggaagatggggaagatgatggtgaaagcccttagcgaggaaatggccgatacactcgaagaaggtagtgcttctccaacatctcctgactacagcctggatagcccagggccagaaaaaatggctctcgcttttagcgagcaagaagaacatgaactgcccgtgctgtcccgacaagcgtcaaccggaagcgaactgtgtagccccagccccggtagtggaagcttcggggaagagcccccagccccacagtacaccggacctttctgcggtcgggcaagagtgcacacagattttacaccgtcaccctacgaccacgattctctgaaactccagaagggcgatgttatccagattattgaaaaacccccagtgggtacctggctcgggctgctgaacggtaaggtggggagttttaagttcatctatgtggatgtgctgccagaagaggccgtcggccatgctaggccctcccgccgacagtccaaagggaaaaggccaaaaccaaagacccttcacgaacttttggagcggatcggcctggaggaacatacctctaccctgctgctgaatgggtaccagacactggaagacttcaaagagctccgggaaactcacctcaacgagctgaacatcatggacccgcaacacagagccaagctactgacggcggctgagctgttactggactatgataccggttctgaggaggccgaggagggcgcagaatcttcccaagaacccgtggctcacaccgtgtcagagcctaaagtggacataccaagagacagtgggtgctttgaaggatccgagagcgggagagacgatgccgagctggctggcactgaggaacaactgcagggactttccctggccggagctccctag

SEQ ID NO: 28492 - DNA, 1692 bp, Artificial Sequence
  Description of Artificial Sequence: Synthetic coding sequence
atgaacccattatttggccctaacctctttctcctgcagcaggagcagcaggggctggccggacctctgggcgactccctgggaggtgaccacttcgcaggagggggagatctgccacctgcccctctgtctccagccggaccagccgcttactcacctcccggacctgggcctgctccaccagcagccatggcgctgaggaatgacctggggtctaacattaacgtgctgaaaaccctgaatctcagatttaggtgtttcctggcgaaggtccacgagctcgagaggaggaaccgcctgctggagaaacagctgcagcaggccttagaggaaggcaagcaagggcgacggggacttggacgcagggatcaggcagtacagacaggattcgtcagccccataagacccctgggtctgcagctgggagctcggccagcagcggtgtgctcaccttccgctagggtgctgggatctcccgctcggagtccagctgggccactggcgccttccgccgcatcactgtctagctcctccacctcaactagcaccacatactcctcctcagccaggttcatgcccggaacgatttggagctttagccacgcccgacgcctgggtccagggttggagcccacactggtgcaaggcccagggctttcatgggtgcatcctgacggagtcggtgtgcagatcgacaccatcacaccagagatccgggctctctataatgtcttggcaaaggtgaaacgagagcgggacgaatacaaaagaagatgggaagaggagtatacagtgaggattcaactgcaagatagagttaatgaactgcaagaagaagctcaggaggctgatgcgtgccaagaagagcttgccctcaaggtagagcagcttaaggcggagctagtggtgtttaaaggcctcatgtctaataatctgtcagagctagacactaagatccaggaaaaagctatgaaggttgacatggatatatgtcgaaggatagacattaccgctaaactgtgtgatgtggcccagcagcgtaactgcgaggacatgattcagatgtttcagaagaaattagtgccttccatggggggacgtaaaagggaaagaaaagccgcagttgaagaggataccagtctctcagagtccgaaggccctaggcaacctgacggagacgaggaagaatccaccgcgttgtccatcaatgaggagatgcaacgcatgttaaaccagctccgggagtacgactttgaggatgattgcgatagtcttacctgggaagagaccgaggagaccttgttgctatgggaggatttttctggatatgctatggctgctgccgaagcccaaggtgagcaacaggaggactccctggagaaggtgattaaggacacagagtccctttttaaaacacgcgaaaaggaatatcaggaaaccattgaccagattgagctggaattggccacggccaagaatgatatgaacagacacctacatgagtatatggagatgtgttcaatgaagcgcggtcttgacgttcaaatggaaacctgccgccgacttattacacagtcaggggaccggaaatctcccgctttcactgccgtcccactgtcagatcccccaccacctccatctgaggccgaggattcggatcgtgatgtcagcagcgattccagcatgcgctag

SEQ ID NO: 28493 - DNA, 1893 bp, Artificial Sequence
  Description of Artificial Sequence: Synthetic coding sequence
atgctatttctcgcaattccccagagcatagacgaggagacagaggtatggagtgatcacattatctttcccaggattccgagagggcctgtgcagcagcctctcgaagaccggatctttacgccagctgtgtctgcagtgtactccactgtaactcaagttgccaggcagcccggaacacccacaccatcaccctactcagcacacgaaataaataaaggtcaccctaacctcgcagccacaccccctggccacgcgtcgagccccggtctatcgcaaaccccttatccaagcggccagaacgcagggcctactaccctggtgtacccacagactccacaaacaatgaattctcaaccacaaacccggagtcctttcgccgctgggcctcggccaccccaccaccaattcttccagcggccacagatacaacctccccgagctacgatacccaacagttcccctagcatccggcctggggctcagacaccgacggctgtttatcaggccaaccagcacatcatgatggtgaatcatctaccgatgccctacccggttccacagggtccccagtattgcattccccaataccggcacagtggcccaccttacgttgggccacctcagcagtatccggtccagcctcccggacctggcccattttatcccggacccggtcctggagacttccctaacgcttacggaactccgttttacccttctcaacccgtgtaccagtccgcacctatcatcgtgccgactcaacagcagcctcccccagccaaacgcgaaaaaaaaacaattaggatcagggatcctaatcagggcggaaaagatataactgaggagattatgtccggcggaggaagtcggaacccaacaccgccaatcgggaggccaacaagcacacctacccccccacaacaactaccatctcaggtgccagagcatagccctgtggtctatggcaccgtcgaaagcgctcatttagctgctagcacgccagtgaccgcagctagtgatcagaagcaagaagaaaaaccaaaaccagatccagtgctgaaaagtccaagccctgtcctcagactcgtgctgagtggcgagaagaaagagcaggaaggtcaaacttccgaaactacagcgatagtgtctatagccgaactaccactgcccccttcaccgaccaccgtaagttcagtggcccgaagcaccattgcggcaccaacctcatccgctctctcctcccagccaatatttaccacagctattgatgaccgttgtgagctgagtagccccagagaggacacaatcccaattccaagtttaacaagctgcactgaaactagcgatcctttaccgacgaacgagaatgatgacgatatatgcaaaaagccttgctcagtagctcctaacgacatccctctggtgtcgtcgaccaatttgatcaatgagattaacggtgtgtcggaaaaattaagcgcgactgaaagcatcgtggagatagtaaagcaggaggtactccctctcaccctggaactggaaatcctagaaaacccccctgaggagatgaagctggaatgtattccagcaccaattacacccagcacagtgccgagtttccccccaactcctcccactcctccagctagtcccccacataccccagtgatcgttcccgcagccgctactacagtgtcgagcccctcagccgcaattaccgtgcaaagggtgttggaagaggatgaatccattcgaacctgtctgagcgaggacgccaaggagatccagaataagatcgaagtggaagccgacggccagaccgaggagatcctggattcgcagaacctgaacagccggagatcacccgttcctgaaacttctaatgaatgctag

SEQ ID NO: 28494 - DNA, 414 bp, Artificial Sequence
  Description of Artificial Sequence: Synthetic coding sequence
atgatcttaccaaccaaagccatggctacgcaggaactgacagtgaaacggaagctgtccggtaacaccctccaggtgcaggcaagctctcctgtggccctgggtgtgcggatcccaacagtggccttacatatgatggagctgtttgacactacagtggaacaactttactcgatctttaccgtaaaggaactaacgaacaaaaagatcatcatgaagtggaggtgcggaaactggccagaagagcactacgccatggtggctctgaattttgttcccactctggggcaaacagaattacagctcaaggaattcctctctatttgtaaggaggaaaacatgaaattctgctggcagaaacagcattttgaagagataaaaggttctctgcaactcactcccctgaatggctag

SEQ ID NO: 28495 - DNA, 1248 bp, Artificial Sequence
  Description of Artificial Sequence: Synthetic coding sequence
atgatgctggggcctgaaggtggagagggattcgtcgtgaagctgcgcggacttccatggagttgcagcgttgaagacgtacagaacttcctgtctgactgcaccatccatgacggcgcagctggagtgcactttatttacacccgagagggtaggcaatctggtgaagcattcgtagaacttggtagcgaggatgacgtcaagatggcccttaagaaagatagggagagcatgggccaccgttacattgaagtgtttaagagccaccggacagaaatggattgggttctaaagcattctggcccaaacagcgcagattcagcaaacgacggttttgtccgactgcggggactaccgtttggctgtacaaaggaagagatcgttcaattcttcagcggattggagattgtgcccaacggcatcaccttgccagttgaccctgaggggaagataaccggggaggcatttgtccagtttgccagtcaggaactcgctgagaaggccctcggcaagcacaaggagcgcatcggacatagatatatcgaggtgtttaaatccagccaggaagaagtacggtcgtactccgatcctccgctcaagttcatgtctgtccaaagacccggaccctatgaccgccctggtactgcacggaggtacataggcatcgttaagcaggccggactggaacggatgcggcctggggcttattccaccggatacggcggttacgaagaatatagcggcctgagcgatggctacggttttacaaccgaccttttcggcagggacctatcctactgtttgtcaggcatgtatgaccatcgatatggcgattcggaatttacagtacagtctactacggggcattgcgtgcatatgaggggattaccatacaaggcaacggaaaatgatatttacaacttcttttcccccctgaaccccgtgcgagttcatattgagattggtccggacggacgggtaacgggtgaggctgatgtggaattcgctacacatgaggaggcagtggccgctatgagcaaggaccgagctaatatgcagcaccggtacatcgaactgttcctgaatagcactacaggggcaagcaatggagcctatagtagtcaggtgatgcagggcatgggggtgtccgcagcccaggctacctattctggtctcgaaagccagtctgtgagtggttgctacggggcagggtactcagggcagaactctatgggaggttacgattag

SEQ ID NO: 28496 - DNA, 1464 bp, Artificial Sequence
  Description of Artificial Sequence: Synthetic coding sequence
atgtcttcaccccttgccagcttatcaaagacccgcaaagtgccgctcccgtccgaacccatgaaccccggtagacgcggaattcggatttacggcgatgtcccagcttcccacgactctgagctcatggccttcatgactcgaaagctatgggacctcgagcaacaggtgaaggctcaaacagacgagattctctccaaagatcagaaaatcgcagcgctggaagacctggtgcagaccttgcgtcctcatcccgctgaagcgaccctgcagagacaggaggaactggagacgatgtgcgtgcaactgcagagacaggtccgggagatggagcgatttctctcagactatgggctgcagtgggtgggagaacctatggatcaggaggattccgaatcaaagaccgttagtgaacacggagagcgcgactggatgaccgccaagaagttttggaagccaggagattctctagcaccacctgaggtggactttgacaggctccttgcctcactgcaagatctcagcgagcttgtagtcgagggagatacccaggttacccccgtgccaggcggagctcgacttcgcacattggagccgatccccctgaaactctatagaaatggcatcatgatgtttgacgggccttttcaaccgttctacgatcctagtacacagcggtgcctccgtgacattctggacgggttcttcccctcagaacttcagcgtctttacccaaacggagttccattcaaagtgtccgacctgagaaaccaggtttatctggaggacggactggatccttttcctggtgaagggcgtgttgtgggtagacaattgatgcacaaagcccttgatcgggtcgaggagcatcctggatcccgcatgactgcagagaagttccttaatcggttgcccaagttcgtaattcgacagggtgaagtaattgacataaggggccctatcagagacacattgcaaaactgctgtcctctgccagccaggattcaagagattgttgttgaaactcccaccctcgcagccgaacgggagagatcgcaggagtcacccaacacaccagccccaccactttctatgctgaggatcaagagcgagaacggagagcaggcattcctgctgatgatgcagcccgacaatacaattggggatgtgagagccttgctcgctcaggcacgtgttatggacgcctcagcctttgagatcttttcaacatttcccccaactctgtatcaggatgatactctgacccttcaggccgcaggtttggtaccaaaagccgctcttctgctccgcgcaaggcgcgctccaaaaagtagcctgaagttctctcctggcccttgccccggacctggtccgggaccctccccagggccaggacccggaccaagtcctgggccaggcccaggccctagcccatgcccgggaccgagcccatctccacagtag

SEQ ID NO: 28497 - DNA, 1467 bp, Artificial Sequence
  Description of Artificial Sequence: Synthetic coding sequence
atgtctgccttctgtctgggcctggtcgggcgtgcttccgccccagcagagcctgatagcgcttgctgcatggaactgcccgctgccgctggcgacgccgttcggtccccggcagctgctgccgctctgatattccctgggggatcaggcgagctggaactggctctggaggaggagctggcccttctggctgcaggagagaggccatcagaccctggggaacacccccaagccgagctcctgagtgtcattaggcagaaagagaaagatcttgtattggctgcacgtctgggcaaggctctgttagaaagaaaccaggacatgagtagacagtacgagcagatgcataaggaattgacagataaactagaacaccttgagcaggagaaacatgagctgcgacgtagattcgaaaatcgtgagggagagtgggaaggtcgcgtgagcgaactcgagagcgacgtcaaacaattgcaagatgagcttgagagacagcagatacacctcagagaggctgacagggaaaagtctagagcagttcaggagctgtctgaacagaaccagcgcctattggatcaactgtcgcgggcatctgaggttgaacgtcagctgagtatgcaggtgcatgccctgcgtgaagattttagagagaaaaattcctcaaccaaccagcacattatccggctggaaagcctgcaggccgagataaaaatgctgtccgaccgaaagcgggaactagagcataggctctccgccacactcgaggaaaatgacctcttgcagggtacagtggaagaactccaggacagagtccttatcttggagcggcagggccatgacaaagatctgcagctccaccagtctcaactggagcttcaggaagttagactgtcatgtagacagttgcaagtaaaagttgaagagctcactgaagaacggtcactgcagtcctctgccgcaacctctacatccctcttgtctgaaatcgaacagagtatggaggcagaggagctcgaacaagagcgggagcaactacgccttcagctgtgggaggcatactgccaagtgaggtatttgtgctctcacctacggggaaatgatagcgccgattccgcagttagtactgacagcagcatggatgagtcttcggaaaccagcagtgccaaagatgtgccagccggttctcttcggacggcattaaacgagctgaagcgtctgatccagagcatcgtagacgggatggaaccaaccggcagcagacgacttgatgacgacagcctggaggagcaaataaggcagacaagtgaagactctagagctctgcgagagctaatggagggggaacgaggtcgactgcctgaggcaagccgttgctgtctgccagcatgcagtcaaccaattcagtcgccttctctgccccatgttggaaaggctcagcaggggtgcgcggcaagaatgtacctttag

SEQ ID NO: 28498 - DNA, 1428 bp, Artificial Sequence
  Description of Artificial Sequence: Synthetic coding sequence
atgacacgcggtactggcggtaccgctcagcggggaagatcaggaccagactcccaggggttgctggattcttcactgatggcgtccgggacagcctctcggagtgaggacgaggagtctctggctgggcagaaacgggcttccagccaagcactgggcaccataccaaaacggaggtccagtagccgatttatcaaacggaagaagttcgacgatgaactagttgaaagctccctcgctaagagctctactcgcgcaaaaggcgcttctggggtagagccgggacgctgtagtgggtccgagccctcttcctccgaaaagaaaaaggttagtaaagcaccaagcacaccggtaccaccctctcctgccccagcaccaggcctgaccaaaagagtgaaaaaaagcaagcaacctttacaggtgaccaaggacttagggcgatggaagccggctgatgacctcctcctcataaacgcagtgctgcagactaatgatctcacaagtgtgcatctcggcgtgaagttctcgtgcaggttcacattgcgcgaagtgcaggagagatggtatgcccttttatatgaccctgttatatcgaagctcgcctgtcaagccatgagacagctccatcctgaagctatcgcggctatacaatctaaggcacttttctcaaaggccgaagagcagctgctcagcaaagtaggaagcacaagccagcccacacttgagacttttcaagatttgcttcaccgtcatcctgatgcgttctacctcgccagaaccgccaaagctctgcaggcccactggcagcttatgaagcagtactatttgttggaagatcaaactgtgcaaccactgcccaagggggaccaggttcttaatttctccgacgccgaggatctaattgacgatagcaaactaaaagatatgcgcgacgaggtgctggaacacgagcttatggtggcagatcggagacagaaacgcgagattagacagctggagcaagagcttcacaagtggcaggtcttggtggactccatcactgggatgtcttctcccgacttcgataatcagacactcgctgtattgagaggacgcatggtgcgatacctgatgaggagtcgcgaaattacactgggacgggcaaccaaagataaccaaatcgatgtagacctcagtctcgaaggcccagcatggaaaattagcagaaaacagggggtcatcaagcttaaaaataatggagacttctttatcgcgaacgaaggtcgcaggcccatctacatcgacggcaggccggtgctgtgtggatcaaagtggcggctgtcaaacaactctgtggtggagatcgctagcctccggtttgtgtttctgatcaaccaggacctgatagccctgatccgcgcagaggccgctaagatcactcctcaatag

SEQ ID NO: 28499 - DNA, 1311 bp, Artificial Sequence
  Description of Artificial Sequence: Synthetic coding sequence
atggctgacgggggatcagaaagagcagatggaaggatcgtcaagatggaggtggactacagtgctacagtggaccaacgactgcccgagtgtgcgaagttggcaaaggcctctgacatggtgtcaacatctcggatactcgtcgccgtcgttaaaatgtgctacgaagcgaaagaatgggatctgctcaatgagaatatcatgctgctctcgaagcggcgatctcagctcaagcaggcggtggctaaaatggttcagcagtgctgcacatatgtggaagagattacggatctaccgatcaagcttaggctcatcgacactctgaggatggtgactgagggcaagatctatgtcgagattgaaagggctcgccttactaagactttagctaccattaaagagcagaacggagacgtaaaggaggctgcatctattttgcaagaactccaggtggagacatacggatccatggagaagaaagaaagagtcgagtttatcctggagcagatgaggctttgcctcgcagtgaaggactacattcgaacccaaatcatctcaaaaaaaattaacaccaaattcttccaggaggagaacaccgagaaactcaagctgaagtactacaatctgatgatccagcttgatcaacacgaaggatcatacctgtcgatttgtaaacactaccgagcaatctacgacacgccatgtatccaggccgaaagtgagaaatggcaacaggctttaaaatcagttgtgctgtacgtcatcctagcacctttcgataatgagcagtctgatttggtccaccggatctctggagacaagaagctcgaggaaatccctaaatacaaagacttgctgaagcttttcacaacaatggagctgatgcggtggtccacgttggtcgaggattatggcatggaattgcgtaagggctccctagagagtccagccaccgacgtgttcgggagtacagaggaaggtgaaaaaagatggaaagacttaaagaaccgagtggtggagcataatatcaggatcatggccaagtactacacacggattactatgaaacggatggcccagctgctggacttgagcgttgatgaaagcgaggcgtttctctctaacctggttgtgaacaaaaccatttttgctaaggtcgatagactggcgggtattattaattttcaacggccaaaggatcccaataatctccttaatgactggagtcagaaactgaactctctgatgtctcttgttaataaaaccacgcatctgattgcaaaggaggagatgatccacaatcttcaatag

SEQ ID NO: 28500 - DNA, 1974 bp, Artificial Sequence
  Description of Artificial Sequence: Synthetic coding sequence
atggacgatcctgactgcgattccacatgggaggaggatgaagaagacgcagaagacgccgaggatgaggattgcgaagatggggaggcagcgggagccagagatgctgatgctggagatgaagatgaagagtccgaggagcctagggcagccagaccatcttcattccagtctcggatgaccggaagtagaaattggagggccacacgggacatgtgcagatatagacacaactatccggacctagtggagcgcgactgcaatggcgacactccaaatctgtctttctacagaaacgagattagattcttgccaaacggctgttttatcgaagacattctacagaattggacagataactatgacttgctcgaagacaatcatagctatatccagtggctgttcccactccgagagcccggagtcaattggcacgcaaagcctcttacactcagagaggtcgaggtgtttaaaagttcacaggaaatccaggagaggctagtacgcgcatacgaactgatgctcgggttctacggtattcggttggaggacaggggcactgggaccgtgggccgtgcccagaactaccagaaacggtttcagaacctaaactggcggtcacataacaacctgaggatcaccagaattctcaaatccctcggggagctgggattggagcacttccaagctcccctggtgcggttcttcctagaggaaactctcgtgcggagagaacttcccggtgtccgccagtctgctttggactacttcatgtttgccgtccggtgtcggcaccagaggcgccagctcgtccacttcgcctgggagcatttccgccctaggtgtaagtttgtgtgggggccacaggacaagttgcgcaggtttaagccatcctctcttccccaccccctagaaggatctagaaaggtggaggaagagggctctcccggtgaccccgaccacgaagcatcgacccaggggaggacgtgcggcccagagcatagcaagggcggtggcagagtcgacgagggccctcagccccgttctgtggagccccaggatgcagggccactggagcgtagtcagggagatgaagcagggggacatggcgaagaccgtcccgagccattgagtcccaaggagtccaagaaaagaaaactggagctgtcacgcagagaacagcctccaaccgagcccggtccacagtcggcgagtgaggtcgagaagattgctctgaatctagaagggtgcgcactgtcccagggctcgctcagaacagggacccaggaggtgggaggccaggatcccggagaggctgtacaaccctgcaggcagcctctgggcgctcgcgtggcagacaaagtgcggaagcggcgtaaggtggacgaaggtgccggagatagtgctgccgttgcgtctgggggtgcgcagactctagctttggcgggaagcccagctcctagcggacatcccaaagccggacactcagagaacggggttgaggaggacaccgagggtcggaccggccctaaggaaggcaccccgggtagtcccagcgagactcccggtcccagccctgcaggccctgccggtgacgagcctgccgagagtccctctgagacccccggaccgaggcccgcaggcccagccggagatgagcctgccgagtctcccagtgaaactcccggaccatctcccgcaggcccaacccgggacgagcctgccgagagtccaagcgaaactccaggaccaaggccggctggtcctgcaggcgatgagcccgctgagagccccagtgaaacaccaggacctagacctgcgggacccgctggcgatgaacccgctgagagccccagcgagactcccggaccctcacccgctgggccaacacgggacgaaccagcgaaggccggtgaagccgctgaactgcaagatgccgaagtagaatcctccgctaagtccggcaagccttag

SEQ ID NO: 28501 - DNA, 615 bp, Artificial Sequence
  Description of Artificial Sequence: Synthetic coding sequence
atggatcctaaggatagaaaaaagatccagttctcagtccccgcacctcctagccagctggacccacgccaagtcgagatgatccgacgcagacgccctacaccagcgatgctgttccgcctctctgagcatagctcccctgaggaggaagcaagcccccaccagcgggcttcaggcgaagggcaccatctgaaatccaagcgccctaacccttgcgcttatacccccccttctctgaaggccgtacagcggatcgccgaatcacatctgcagtcgatcagcaatttaaatgagaaccaggcctctgaagaggaagacgaactcggcgagctgagggagttgggttaccctcgagaagaggacgaagaggaggaggaagatgatgaggaggaagaggaggaagaagacagtcaggcagaggtgctgaaggtgattcgccagtctgcaggccaaaaaaccacttgtggccaaggattggaaggaccctgggaacgcccaccacccctagacgagtctgaacgggacggtgggtcggaagaccaggtcgaagaccccgctctctccgagcctggggaggagcctcagcgcccatctcccagtgagccaggcacatag

SEQ ID NO: 28502 - DNA, 3042 bp, Artificial Sequence
  Description of Artificial Sequence: Synthetic coding sequence
atgggttggaaaccaagtgaggccaggggccaatctcagtcctttcaggctagcggtctacaacccagatcattgaaagcagcaaggcgggctacagggaggcccgatcgttcaagggccgctcgtcctactatggatccctctgcacataggtcaagagcggctcccccaaacatggatcccgaccctcaggctggcgtccaggtagggatgcgcgttgttcgcggtgtggattggaaatgggggcaacaagacgggggagagggcggagttggaactgtcgtcgagctgggcaggcacgggtcgcccagcacgccagacagaaccgtggtggttcagtgggaccaggggacaaggacaaactacagagctggttaccagggcgcacacgatctgctgctttacgataacgcacaaattggcgtgcggcacccgaatatcatctgtgactgttgtaagaaacatggactgcggggtatgagatggaagtgccgggtgtgcctggactatgatttatgtacccagtgctacatgcataacaagcacgagctggcacacgcgttcgaccgctacgagaccgcccacagcagaccggtgaccctttctccacggcagggtctcccacgaatccccctgcgcggtatctttcaaggcgcaaaggtcgtgcgcggacccgattgggagtggggaagccaagatgggggagagggaaagcccggacgcgtggtggatataagaggctgggatgtggaaactgggcgtagtgttgcaagtgtgacgtgggcagatggtactactaatgtttaccgggtggggcataaagggaaggtggacttgaaatgtgtaggagaggccgctggcggattttactacaaagaccacctacccaggctgggcaaaccagctgaactgcagcggagggtaagcgccgactcacagccttttcaacacggggataaagtcaaatgcctgcttgacacggatgtgttgcgtgagatgcaggagggccatgggggttggaatccacggatggccgagttcatcggtcagacaggcaccgtgcaccgcataaccgaccgtggggacgtgagggtgcagttcaatcacgagacaaggtggacctttcatccaggcgctctcacaaagcaccactccttttgggtgggagacgtcgttagagtaattggagacttggatacagtgaagagactgcaagctggccacggcgagtggacagatgacatggctcctgccctgggtcgcgtgggaaaagtcgtcaaagttttcggagacggcaacttgcgggttgcagtggccggacagcggtggactttttccccgtcttgcctggtagcttataggcccgaagaggacgccaatttagacgtggcagaacgagcgagagaaaacaaatctagtctgtcggtggctctcgacaagctgcgggctcagaagagtgatcccgaacacccaggaagactggtggttgaagtggccctcggcaatgctgcacgcgctttagacctactaaggcggagacctgaacaggttgacactaagaatcagggccgtacagcactccaagtcgctgcctatctgggccaggtggagctgatccgcctattactacaggccagagcaggggtagacctccccgatgacgaggggaataccgcgctccactacgccgctttgggaaaccagccggaagcaactcgtgtcctgctgagtgccggatgcagggctgacgccatcaactccacccagtccaccgcccttcacgtggcagtgcaaaggggattcttagaggttgtccgcgctctctgcgagcgcggttgcgacgtgaacctcccagacgctcactcagacacccctctacacagtgctatcagtgcaggcacaggagccagcgggatcgtggaagtccttactgaagtgcctaacattgatgttacggctaccaactcacagggattcacactgctgcaccacgccagtctgaaaggtcacgccctggccgtacggaaaatccttgccagagctcggcagcttgtcgatgcaaaaaaggaagatgggtttacagccttgcatctggccgctctgaacaaccatcgcgaggttgcacagatactgatcagggaaggacggtgtgacgttaatgtgaggaatcgaaaactacagagcccactccatctggcagtccagcaggctcacgttggactcgtgcctctgctggtggatgcaggttgttctgtcaacgcggaagacgaagaaggagataccgccctacacgtggccctgcagcgacaccagctgctccccctggttgctgacggcgctggcggagacccaggccctttacaactcctgtcaagactgcaggccagtggactaccaggatccgccgaattgacagttggagcagcggtggcatgcttcttagctctcgaaggagctgacgtgtcctataccaatcaccgcggtcggtcccccctggacttagcagctgagggtagagtgttaaaggcactacaggggtgcgcacaaaggtttcgagagcggcaggcaggaggaggggctgccccaggccctagacagactctggggacccccaacaccgtaacaaacctccacgtgggggctgcacccggacccgaagccgcagagtgcctagtgtgctcagagcttgccctgctagtgttattttcaccgtgtcaacacaggactgtgtgtgaggaatgtgccaggcgcatgaagaaatgcattagatgtcaagtcgttgtctccaagaaactgcgcccagacggttctgaggtggcgtctgcggcacctgcaccgggtcctccgcgtcagctcgttgaggaattgcagtcccgctaccgccagatggaggaaagaattacttgtccaatctgtattgacagccacatacgcctcgtgttccagtgcggacacggagcgtgtgcaccgtgcggaagcgcactctcagcttgccctatctgtagacagcctatcagggaccgaattcaaatcttcgtgtag

SEQ ID NO: 28503 - DNA, 2055 bp, Artificial Sequence
  Description of Artificial Sequence: Synthetic coding sequence
atgataccgcctcaggaggctagtgccaggcggagagaaatcgaggacaagctgaaacaagaggaggagactctttctttcattagagatagcttagagaaatctgaccagttgaccaagaacatggtttcgattcttagtagcttcgaatcgcggctcatgaaactggaaaactctatcataccagtgcataaacagactgagaatcttcaaaggcttcaagaaaatgttgagaaaaccctctcctgcctggatcacgtgatttcatattaccacgtggcctccgataccgaaaaaattatccgcgagggccctaccggtagactcgaagagtatctcgggtctatggcgaagattcagaaagccgtggagtacttccaggataattcccctgacagcccagagctgaacaaggtgaaactgttgtttgagcggggtaaagaagctctggagagtgaatttagatctcttatgactcgccactctaaggttgtatcccccgtactcatcttagatctaattagtggggatgatgacctcgaggcccaggaagatgtgaccttggagcacctgcctgagtcagtgctgcaggatgtcatccggatcagcagatggttggtggagtacggccgtaaccaggatttcatgaatgtgtactaccagattcgcagtagtcaactggataggtctatcaaagggcttaaagagcactttcacaagtcttcctcgtcatcaggcgtgccgtactcccctgcaatccctaataaaaggaaagacacaccaacaaagaagcccgtgaaacgacctggtaccattagaaaggcccagaatctactgaagcagtacagccagcacggactggacggtaagaagggcggttctaacctgattccacttgaaggccgagacgatatgcttgatgtggaaacagacgcctacatccactgcgtgtccgctttcgttaagcttgcccagagcgagtatcaactgctcgccgacatcataccagagcaccaccaaaagaaaacatttgactccctgatacaagacgctttggatggtctgatgctcgagggagagaacattgtctctgctgccaggaaagcaatagtgcggcacgatttctctacagtccttacagtttttcccatcttgcggcatctcaaacagacgaagccagagttcgaccaggtacttcagggcacagccgcatctaccaagaataagctacccggtcttattacctccatggaaaccatcggcgctaaagccttggaagattttgctgataacatcaagaatgacccagacaaggagtacaatatgcccaaggatggcactgtgcacgagctcaccagcaatgccatattatttctgcagcaacttttggactttcaggaaaccgccggtgccatgctggcaagccaggagaccagcagctctgctacttcttacagttcggagttttcaaagcgccttctttctacatacatctgtaaagtgctgggtaatcttcagctgaatttgctgtcaaagtccaaggtttatgaggacccagctctttcggctatctttctgcacaacaattacaattatatactcaaatctcttgagaagtcggaactaatccagttagtggccgttacccagaagaccgcagagcggagttacagagagcacatagaacaacagattcagacataccaaaggtcctggttaaaggtcacggactatattgccgagaaaaatctccctgtctttcagcctggtgttaagctacgcgacaaagaacgccagattattaaggaaagattcaaggggttcaatgacggcctcgaagagctgtgtaagatacagaaggcttgggccattcctgataccgaacaaagggaccgaataaggcaggctcaaaagaccatagtgaaggaaacgtacggagcttttctgcaaaaattcggctctgtgccgttcacaaaaaatccagagaagtatataaaatacggagtcgaacaggtaggcgacatgattgatcggctcttcgacacgagcgcatag

SEQ ID NO: 28504 - DNA, 3576 bp, Artificial Sequence
  Description of Artificial Sequence: Synthetic coding sequence
atgccagtgcaggctgctcagtggacagagttcttatcttgcccgatatgttataatgagtttgatgagaatgtgcacaaaccaattagcttgggttgctcccatacagtttgcaaaacctgtctgaacaagctgcatagaaaagcctgtccatttgatcagactgccataaacacagatatcgacgtactgcctgttaatttcgccttgctacagctggttggcgcacaagtgcccgatcaccagtctataaagctcagtaacctgggggaaaataaacattacgaagtggcaaaaaagtgtgtggaagacttagccctttacctgaagccgctgtccgggggtaagggagtcgcctccctcaaccaatcagcattatcccggcctatgcagagaaagctcgtcaccctcgttaattgtcaactggttgaagaggaaggcagagtgagggccatgagagctgcgagatccctgggtgagcgaacggttactgagttgatcctccagcatcagaacccacagcagctgtctgcaaatctctgggctgctgtgcgcgctcgcggttgccagtttctcgggccagccatgcaggaagaggctctgaaactggtgttgctcgcactggaggacggcagtgccctaagcaggaaagtgctagtgctgtttgtggtacaacggctggagcctcgcttcccacaagcatctaaaacctctatagggcacgtggtgcagctgctgtatcgcgcatcatgtttcaaagtcaccaagcgcgacgaagatagctctctgatgcagctgaaagaagaattcaggagctacgaggctcttagaagagaacatgatgcccaaatcgtgcatatagctatggaagcgggactccgtatcagccccgagcagtggtctagcctattatatggagacctggctcataaatcacacatgcagtctattatcgataagctgcagtctccagaatccttcgctaagagtgtgcaggagctgacaatcgttctccaaagaacaggcgaccccgcaaaccttaacagacttcgtccccatctggagctgctggctaatattgaccccaacccggatgctgtgtcgcccacttgggaacagttagagaacgctatggttgccgttaaaactgtggtacacggactggtggattttattcaaaactattccaggaaagggcacgaaactccacaaccccagcccaactccaaatacaaaacatccatgtgcagggaccttcggcagcaggggggatgtcccagggggactaactgcaccttcgctcattcccaggaggagctggagaaataccgcttgagaaacaaaaagatcaatgctacagtgagaaccttccccctcctaaataaggttggggtgaataataccgtgaccaccacagccggaaatgtgatctccgtgataggcagtaccgagactacaggtaaaatcgtcccgtcgactaatgggatttccaacgctgaaaactccgttagccagctcatatctcgtagtacggatagcactctcagagccctggaaactgttaagaaggtcggcaaagtaggggctaacggccaaaacgccgcagggccttccgcagattcagtgacagaaaacaagatcggttcccccccaaagactccggtgtccaatgtggctgccactagcgctggacctagtaacgttggcaccgagttaaattccgtccctcaaaagtcttcccctttcctgacccgcgtgcccgtgtatcctccacactcggagaatattcagtattttcaggatccccgaacacagattcctttcgaagtgccgcagtacccacagaccggatactatcctcctcctcctaccgtgccggcaggcgtggccccttgtgtccccaggtttgtgaggtccaataacgtgcctgaaagttctcttccacccgcatctatgccatatgcagatcactattcgacgttctcaccaagagatcgcatgaactcgtccccttaccagccacctcctccccagccgtatggcccagtgccgcctgtgccatcagggatgtacgctcctgtttacgatagccgtcggatatggcggcctccaatgtaccagcgcgatgatataatcagaagcaattcactgccacccatggacgtcatgcactccagtgtgtaccaaacctctctgcgggagcggtacaatagtctggatgggtattactctgtcgcctgccagcctccgtcggaacccagaactactgttcctttgcccagggaaccttgtggccacctgaaaactagctgcgaggaacagatcaggaggaaaccggatcagtgggcacaataccacacacagaaggccccactcgtaagtagtacgcttcctgtggccactcagtctcccactccacccagtcccttgttttccgttgacttcagggcggatttctcagagagcgtatccggtactaaatttgaagaggaccacttgtcacactattccccctggtcctgcgggactatcggaagctgcattaatgccatagactccgaaccaaaggatgtaatcgcaaattctaacgccgtattaatggatcttgactccggggatgtaaagcggcgagtacacctgttcgagacccagcggcgaacaaaggaggaagatccaatcatccccttttcagacgggccaatcatttcgaagtggggagccatctcacggtcgtcacggactggctaccatactaccgatcctgtgcaggcaacagcatcccagggctctgcaacgaagccaatctcagtatctgattatgtaccttacgtgaacgcggtggactctcggtggtcatcctatggaaacgaggccaccagctccgcccattatgttgaaagggatcggttcattgtgacggacctatccgggcatagaaagcactcttccacgggggacctgctgagtctggagctacagcaggctaaaagtaattcccttctgctacagagggaggccaacgccctcgctatgcaacagaaatggaatagcctagatgaagggaggcatcttaccctaaacctactgtccaaagagatcgaattgaggaacggtgagctgcagtcagactacacggaagacgctaccgataccaaacctgacagggacatcgagcttgaattgagcgctctcgataccgatgaacctgacggtcagtccgagcccatcgaagaaattcttgacatccagctggggattagctcccaaaacgatcagcttctgaacggaatggctgttgagaatggccatcctgttcagcagcatcagaaggaaccgcctaagcagaagaaacagtcgttaggcgaagatcatgtgatcctggaggaacaaaaaaccatcttgcccgtaacaagctgcttctctcagcccctgccagtgtcaattagcaatgccagctgtctgcccattactaccagcgtgagcgccggaaacctgattcttaagactcatgtgatgtctgaggataaaaatgattttctgaagcccgtcgccaatgggaaaatggtgaattcctag

SEQ ID NO: 28505 - DNA, 2100 bp, Artificial Sequence
  Description of Artificial Sequence: Synthetic coding sequence
atgtgtggcatctttgcgtacctgaactatcatgtgccacggacaagaagagaaatcctggagacactaatcaaagggctccaaaggctggagtatcgcggatatgattctgctggcgtgggtttcgatggcggtaatgacaaagattgggaagcaaatgcctgcaaaatacagttgatcaaaaagaaagggaaagtcaaggctctggatgaggaagtgcacaagcaacaggatatggacctggatatcgagtttgatgtgcacctaggcatcgctcacacgcgctgggccactcatggtgaacctagccccgttaacagccaccctcaacgttccgataaaaacaatgaatttatcgtcatccataatggaatcattaccaactacaaagaccttaaaaaatttctcgaatccaagggctatgattttgaatcagaaaccgacaccgaaacaatcgctaaattggtgaagtacatgtacgataacagagaaagccaagacactagtttcaccacactggtcgagcgtgtgatccagcaactggaaggcgcatttgcacttgtcttcaagtcagtgcattttcctggccaggctgtgggtactaggcggggaagtcctttacttatcggtgtacgtagtgagcataagctgagcacagaccatatacccatactgtatcggactgctagaacccagatcggttccaagtttactaggtggggctcccagggagagagagggaaggacaagaaaggttcctgcaacctctcaagggtggacagtaccacctgcttatttccagtggaggagaaggcagtcgagtactactttgccagcgacgctagtgctgtcattgaacataccaatcgtgtgatatttttggaggacgatgacgtggccgctgtcgtcgacggcaggctgagcattcaccgaatcaaaaggaccgccggagaccatcccggacgcgctgtccagactctccagatggagttgcagcagattatgaaggggaacttttcatcgttcatgcagaaggagatcttcgagcaacccgagagtgtcgtcaataccatgaggggccgtgtgaacttcgacgattacactgtgaatcttggcggactgaaagaccatatcaaagaaatccagcgctgcagaaggctaatactgatcgcttgcggaacaagttaccacgcaggcgtcgccactcggcaagtattggaggagctgactgagctccctgttatggtggagctggccagtgactttctggaccgaaatactcctgtgtttcgcgacgacgtctgcttctttctttcgcagagcggcgaaacagccgataccctgatgggtttacgctactgcaaggagagaggcgctctgaccgtggggatcacaaatacagtcgggagtagcatttcgcgcgaaactgactgtggggtccatataaacgccggacccgaaataggggtggccagtacgaaggcctacacttcccagtttgtgagcttggtgatgttcgctctgatgatgtgcgacgacagaatctcaatgcaagaacgcaggaaggagattatgctcggactaaaacgcctccccgacctcatcaaggaagttctgtctatggacgacgaaattcagaaactggctactgaactgtaccaccagaagagcgttctcataatgggtcgcggttaccattatgcaacttgtctggaaggcgcattgaaaattaaggaaatcacctatatgcatagcgaagggatactggcaggagaactaaagcacgggccactggcacttgtcgataaattgatgcctgttattatgataatcatgcgcgatcatacgtacgcgaagtgccaaaatgccctgcagcaggtcgtcgctcggcagggacgcccagtcgtgatatgcgacaaggaggacactgaaactatcaaaaacaccaagaggaccatcaaggtgcctcactctgtggactgccttcaaggaattcttagcgtgattccactgcagctcttggccttccacctggctgtgcttcgaggatatgatgtggacttcccaaggaacttggctaaatctgtaacagtggaatag

SEQ ID NO: 28506 - DNA, 2067 bp, Artificial Sequence
  Description of Artificial Sequence: Synthetic coding sequence
atgtctgtcaacagcgagaagtccagcagcagtgagcggcctgagcctcagcagaaggctccattagtcccaccccctccgccaccccctccgcctcctcccccacctttgccggatccgacacctcccgaacccgaggaggagatcttggggtctgacgacgaagagcaggaggaccccgctgattattgtaaaggaggctaccaccccgtaaagataggtgacctcttcaacggtcgttaccatgtcatcagaaaactgggctggggccatttcagcacggtgtggctgtgctgggatatgcagggcaaacgatttgtggctatgaaagtggttaagagtgctcagcactatacagaaacagctctggacgaaataaaactgctgaagtgtgttcgggagagcgatccatccgacccaaacaaggatatggtggtgcagctgatcgacgactttaaaatatctgggatgaacgggattcatgtctgcatggtatttgaggtgctggggcaccatcttctcaaatggattataaaatctaactatcagggcctccccgttcgatgcgtcaagtcaattattcgccaagtacttcagggcctggactatcttcacagtaagtgcaaaatcatccacacagacattaaacctgaaaatattttgatgtgtgtggatgacgcctacgtgagacgaatggctgccgaggccacggaatggcagaaagcaggagcacccccacctagcggctccgccgtttcaacagcaccccagcaaaaacccattgggaaaatctccaaaaacaagaagaaaaagctgaaaaaaaaacaaaaacggcaggccgaactactcgaaaaacgcctgcaggagattgaagagctggagcgagaagctgaaaggaagattattgaagaaaacatcacatctgcagccccatctaatgaccaggatggagagtattgccccgaggtgaagttaaaaaccacaggactggaagaagcagcggaagcagagacggccaaggataatggcgaggctgaggaccaagaggaaaaagaagacgcagaaaaagagaacattgagaaagacgaggacgacgtcgatcaagagcttgctaacatcgatcccacctggatcgaaagccctaaaacaaatggccacattgaaaacgggcctttcagcctggagcaacaactcgacgacgaggatgatgatgaggaggattgtcctaatcctgaggaatacaacctggatgagcctaacgctgaatccgactatacctatagtagctcctacgagcagttcaacggtgagcttcctaatggcagacataagatccccgaatcacagttcccggaattctccacctcattgttcagtggttcactggagccagtagcatgcggctccgtgttgtctgaggggtcgccccttactgagcaagaggagagcagcccaagccatgacaggagtcgtaccgtaagcgcgtcaagcactggcgatctgcccaaggcaaaaactcgagccgcagatctgctggtgaaccccctggacccccgaaacgccgacaagatcagggtcaagattgctgacctcgggaatgcatgctgggtccataagcacttcaccgaagacattcagaccagacagtatcgtagcatcgaggtgctgattggagcagggtatagcaccccagcagatatttggagcaccgcatgcatggcattcgagcttgcaactggagattacttgttcgagcctcactctggcgaggactacagtcgcgatgaagaccacattgctcatattatcgagctgctgggatcaatcccgaggcatttcgccctgtccggtaaatacagtcgagagttttttaatcgcagaggggagcttagacacataaccaagctgaaaccgtggtctctgttcgacgtattggttgagaaatatggctggccccacgaggacgcagcacagttcaccgacttcctcatccctatgctcgaaatggttccagagaagagagcatcagctggtgaatgcctgcggcatccatggctgaactcctag

SEQ ID NO: 28507 - DNA, 1308 bp, Artificial Sequence
  Description of Artificial Sequence: Synthetic coding sequence
atgagcggatatcagagacggccaggcgcaacaccattgagtagggcacgctccttagccattcctgacgcacccgcattttacgaacgcaggagctgtcttccacaacttaattgtgaacgcccacatggcagagatctggactcaccttttttcggaatccggcctgctttcatgtgctacgttccctcacctgtactagcaagcgtgggagacacagatttcggctacggcaaaggcaagtgtagcaaacagagccctagcggagcacatggaacccacttcggcgatgatcgcttcgaggacctggaagaggcaaaccccttcagctttcgcgaatttctgaaaacgaaaaatttgggcctgtctaaagaggatccagcctcaagaatctatgcaaaggaggccagcagacactcactgggactagaccataatagcccgccaagtcagacaggcggttatggactggaataccagcagccttttttcgaggacccaactggcgcaggtgacctcctggacgaggaggaagacgaggataccggctggtccggggcttatctcccgtctgcaattgaacagacacatccagaaagggtccccgctgggactagtccttgtagcacatatctgagtttcttttccactccctccgaactggcaggtccagagtcactgccttcctgggctctgagcgacaccgactctagagtgtctccagcctccccagctggatcaccaagtgccgattttgctgtgcacggcgaatccctgggtgaccggcatctccgcactttacagatatcttacgatgcgctgaaagatgagaattccaaacttaggaggaagctgaacgaagtacaatcgttcagcgaagcccaaactgagatggtgaggactctggaaagaaaactggaagccaaaatgataaaagaagagagtgactatcatgatctcgaatcggtggtccagcaggttgaacagaacctggaactcatgaccaagcgagctgttaaggccgaaaatcacgtggtgaaactcaagcaggaaatcagtctgctacaggcgcaggttagtaactttcagagagaaaacgaggctttaaggtgtggccagggtgcctctctgaccgttgtgaagcagaatgccgatgtcgctctgcagaatctccgggtcgttatgaacagcgcccaagcaagtattaagcagctggtttcgggcgctgagaccttaaatctggtggccgagattcttaaaagtattgacaggattagtgaagttaaagacgaggaagaggacagttag

SEQ ID NO: 28508 - DNA, 591 bp, Artificial Sequence
  Description of Artificial Sequence: Synthetic coding sequence
atgaaagtgaaaatcaagtgctggaatggcgtcgcaacctggctatgggtggccaatgacgaaaactgcggcatttgcagaatggcgtttaacggctgctgccccgattgcccacttcacggcgaaagcataagcaggtgtttgggctggtgtccccaacctgtgccagttcttggaggaagggctcatccacaggttccaatcaatacagcctctcccaccccaggtcagcacacagggtctttaatgtcccgggaggaatctagtcgcagccctgaccccacccctcccgctttagaccaggaaacctctagcctattacgctgcacatcaccatggtgtctcgatcacagctgcgatctgttcggtattaccgaccaagtgagcgctgatggtccacgagcttgtaggcaaggcgctcgacggaggctcccggctggggtgggccctgtactcccattgctgccccatgccttgcacccccaggtcgctgcacgcaccgccggagccgcagctctgccacacgtgccaccaggaatggaggtgcagggcgtgcgccctgatcttgcactcgcaggaggggcatcttag

SEQ ID NO: 28509 - DNA, 5126 bp, Artificial Sequence
  Description of Artificial Sequence: Synthetic coding sequence
atggccgctattggaagggggagatcactcaaaaacctgagggtccggggtagaaatgactcaggagaagagaacgtaccgctcgacctcaccagagaaccatccgacaacctccgagaaatactccagaatgtggccaggctccagggcgtgagcaatatgcggaagcttggccatctaaacaattttaccaagctactctgtgacattgggcactctgaggaaaagcttggatttcactatgaagatatcataatctgtctacgacttgcattgctgaatgaggctaaagaggtccgagccgcaggcctgagggcccttcgctacttgatacaagatagcagcatactccagaaggtgcttaaactgaaagtagattacctcattgctcggtgtattgatatccagcagtccaatgaagtggagaggacacaagctctgcgcttggtgcggaagatgattactgtgaacgcatcgttattcccatcatctgtgaccaacagtttgatcgctgtcggtaacgatggactgcaagagcgcgaccgaatggttcgtgcctgcatagcaataatatgtgaactcgctctccagaatcccgaggtcgttgcactgcgaggtggcctcaatacgattcttaaaaacgttattgattgtcagctgtccagaatcaacgaggctctgatcaccaccattctccacctgctcaaccaccctaagaccaggcagtatgtgagggcagacgtagagctggaacgtatactcgcaccttacaccgacttccattaccgccatagcccagatacggctgaaggccagttgaaggaagacagggaggcaaggttcctggcgagtaagatgggaatcatcgctacctttcgctcctgggccggtatcataaacctctgtaagcccggtaatagcggcatccaatctttgataggcgtcctatgtattcccaacatggagatccgacgtggactgctcgaggtcctctatgatatatttcggttgcctctgcccgtagtgactgaagagttcatagaggctctgttgagtgtcgaccccggtcgttttcaggattcatggcgcctttctgatgggtttgtagctgcggaggccaaaactatcctaccacatagggccaggagccgtccagatctgatggataattacctggccctcatcctgagcgcctttatccgtaacgggctattggaaggcctggtggaggttatcaccaatagtgacgaccatatcagtgtaagagccacgatcctcctgggagaactattgcatatggccaacacaattctcccccacagtcacagccaccatctgcactgtctgccaaccttgatgaacatggcagcatctttcgatattccaaaagagaaacgcctgcgggcatccgcggcactcaattgtctcaaacgtttccacgagatgaagaaacgaggtcctaagccttacagtctgcatctggaccatatcatccaaaaggcaattgctacccatcagaaacgagaccagtatttgcgggtgcagaaagatattttcatactcaaagataccgaggaggcccttctgataaacctgagagattcgcaggtcctgcagcacaaagaaaatttagagtggaattggaacctaatagggactattctaaaatggcccaatgttaatctgagaaactacaaggacgagcagttgcatagattcgtaagaaggttattatatttctacaaaccgagctccaagctttatgctaatctcgatctagatttcgccaaagccaaacaacttactgtggtgggatgtcagttcaccgagttcctcctcgaatcggaggaggatgggcaaggatacctagaagatctggtcaaagacatcgtgcagtggctgaatgcctcgtcagggatgaagccagaaagaagcctgcagaataacggactcctgaccacgctctcccagcactattttctgtttattggcacattgtcttgtcacccacatggggtgaaaatgttggagaagtgttccgtgttccagtgcctcctgaatttgtgctccctaaaaaaccaggaccacctactgaaactgacagtgtcatccctggactactcaagggatggcctggctcgcgttatcctgagcaaaattctgaccgctgcaacagacgcatgccgcttgtatgcgaccaaacacctgcgagtgctcttacgggctaacgtggagtttttcaacaactggggcatcgagttactggttactcagctgcatgataagaataagacaatctcatctgaagctctggatattctggatgaggcttgtgaggataaggctaatctgcacgcactgatccaaatgaagccagccctctcccacctcggagacaagggtttgctccttctgctcagatttctgtccatcccaaaaggattcagctacctgaacgagcggggttatgtcgcaaagcaactggaaaaatggcaccgggagtacaactctaagtacgtcgacctgatcgaggagcaactgaacgaagccctgacgacatatcgaaaacctgttgacggagataactacgtgcgcaggtctaaccagcggttgcagaggccacatgtgtacctcccaatccatctgtacggccagttggtacaccacaagacggggtgccacttattagaggtccagaacatcattacagagctttgccgcaatgttcgaacacctgacctggacaaatgggaggaaattaaaaaacttaaagcatccctgtgggccctcggaaacattggatcctcgaattggggactcaacctgcttcaggaggagaacgtgattcctgatattttaaaactcgccaaacagtgcgaagtgttgtccattcggggaacctgtgtctacgttctgggactcatcgcaaagacaaagcaaggatgtgacatactgaaatgtcacaactgggacgcagtaaggcactcccgcaagcatctctggcccgtggttccggatgatgtcgagcagctctgcaacgagctctcctcgatcccctctactttgagtcttaacagcgagtctacatcctcccgccataactctgaaagtgaatcagtgcccagtagcatgttcatcctggaagatgatcgcttcggaagctcgtccacctctacattctttctggatattaatgaagacacagagcccaccttctatgatcgcagtgggcctataaaagataaaaattctttcccgtttttcgcatcctcaaagctcgttaagaacagaatactcaacagtctcacactgcccaataagaaacaccggtcaagctcagatcccaaggggggaaagctatcttccgagtctaagaccagcaaccgtcgtattcggactctgactgaaccatcagtcgacttcaaccatagcgatgattttactccgattagtacggtacagaaaacgctacagctcgaaacatcgttcatgggaaacaaacacattgaagacacaggctcaacgccttcgattggggaaaacgatcttaaattcaccaagaattttgggaccgaaaatcaccgtgaaaatacatctagagagcggctcgtggtagagtcaagcacttcttcccatatgaaaattcgatcccagagctttaacacagacactacgacttctggaatctcgagcatgtcctctagccctagtcgcgaaacagtcggcgtcgacgccactaccatggataccgactgtggcagtatgtcaactgtggtttccactaagactatcaaaaccagccactacttgaccccacagagcaaccacctgagcttgtccaagtctaactccgtaagtttggtccctcctgggtcctcgcataccctgcctaggcgggcacagagcctcaaggcaccttccattgctactataaagtcactcgcagattgcaattttagctatactagctctcgcgacgcatttggatatgcgaccctcaaacggctacaacagcagcgcatgcatccttcactgtcacattccgaggcccttgcaagtcctgcaaaagacgtgttgttcactgacactatcaccatgaaggccaacagctttgaatcacgactgacgccctcccgttttatgaaggccctgtcatacgcctctctcgacaaagaggatcttctgtccccgattaaccagaatacccttcaacggtctagttctgtgagatctatggtgagctctgcgacatacggcggatctgatgactatatagggctggccttgcccgttgacattaatgacatcttccaggttaaggacattccttatttccagactaaaaacattcctcctcatgatgaccgaggcgcaagggcatttgcccacgatgctggaggactgccctctggcaccgggggactagtcaaaaatagctttcatttactccgccagcagatgtccctcaccgagataatgaatagtattcattctgatgccagcctgtttctggagtctacagaggacaccggcctccaagagcacaccgatgacaactgcctatactgcgtctgtatcgagatcctaggctttcagccctccaaccagctcagcgccatctgctctcacagcgactttcaggacattccatattctgactggtgcgagcaaaccatccataatccactcgaggtcgtgccgagtaagtttagcggaatttcgggctgttcggatggggtgagtcaggaggggagcgcgagcagcacaaagtctacagaacttctgctaggtgtcaagacaatcccagatgatactcccatgtgtcgcattctcttgcggaaagaagtcctgaggttggtcatcaatctttcttctagcgtgtccaccaaatgtcacgagaccggactgctgaccatcaaggaaaaatatcctcagacatttgacgacatctgcctctatagcgaagtgagccacctgctgagtcactgcaccttccggctcccgtgtagacggtttattcaggaactgttccaggatgtgcagtttctccaaatgcacgaggaggcagaggccgtgctcgctactcccccaaagcaacccatcgtggatacctccgcagagtccta

SEQ ID NO: 28510 - DNA, 3867 bp, Artificial Sequence
  Description of Artificial Sequence: Synthetic coding sequence
atgcctaggaagggaacacagccgtctaccgcacgcaggcgcgaggagggaccacctccaccgagccctgatggcgctagcagcgacgccgaaccagaacctccatccggcaggaccgaaagtcccgctaccgccgcagaaactgcgagcgaggaattggacaacaggagcctggaagagatactgaactctataccacctccccctccccctgccatgacaaatgaggctggggcacctaggctgatgatcacacacatcgtaaaccagaacttcaagagttatgcaggggagaagatcctcggccctttccataagagatttagctgtattattggaccaaatggctcaggcaaatctaatgtgattgacagtatgctcttcgtgtttggctatagagcacagaaaattcggtccaaaaaattatctgtgcttatccataacagcgacgagcacaaggacattcagagctgtacagtggaagtgcatttccagaaaataatcgacaaggagggggacgactatgaagtgatcccaaatagcaatttttacgtgagtaggaccgcttgtagagacaataccagcgtgtaccatatctcgggaaaaaaaaagacgttcaaggacgtgggaaatttgctcaggagccatggaatcgatctcgaccacaaccgcttccttatactgcaaggcgaagttgagcagattgccatgatgaagccaaagggacagaccgagcacgacgagggaatgctggagtatcttgaagatatcatcgggtgcggtcgtctgaatgaacctatcaaggttctctgcagacgcgtcgagattctgaatgagcatcggggagaaaagctgaatagggtgaaaatggttgaaaaagagaaggatgccctggaaggcgaaaaaaacatcgcaatcgaattcttaactctcgagaacgagatattccgaaagaaaaaccacgtgtgccagtactacatttatgaacttcagaagaggatagctgaaatggagacacaaaaggagaagatccacgaagatacaaaggaaattaacgagaagagtaatattctgagcaatgagatgaaggcaaagaataaagacgtcaaagacacagagaaaaaacttaacaagattactaagtttatcgaagagaacaaagaaaagttcacacagctggacctggaggatgtccaggtgcgcgagaaactaaagcacgctacctctaaggctaagaaactggagaaacagctgcagaaggataaggaaaaagtggaggagtttaagagtatacctgcgaagagcaacaatattatcaacgaaacgactactcgtaataacgctctcgaaaaggaaaaagagaaggaggaaaagaaacttaaggaggttatggattctctgaagcaagaaacccagggtctccaaaaggagaaggagagtagggagaaagaattgatgggattttctaagtctgtgaacgaggccagaagcaaaatggatgtggcacagtctgagcttgatatttacctaagcagacataacaccgccgtaagtcagctgaccaaagccaaagaggccctgattgcagccagcgaaaccctgaaagaacgcaaagctgctataagggacatcgaaggcaagctgcctcagaccgagcaggaattgaaagaaaaagaaaaagaattgcagaagctcacacaggaagaaaccaatttcaaaagcctggtgcacgacctctttcagaaagtggaagaagcgaagtcaagtctcgcgatgaacaggtcgcgaggaaaagtgctcgatgcaattatccaagagaagaaatccggtagaatccccggaatatacggccgattgggggatctaggggctatagatgaaaagtatgacgtggccatatccagctgctgccatgccctagattacatagtcgtggattccatcgatattgcccaagagtgcgtgaatttcctgaaacggcagaatattggtgttgccacctttatcggacttgataagatggccgtgtgggctaaaaagatgacagagattcagacaccagaaaacacacctcggctgtttgatttagttaaggtcaaggacgaaaagatccgacaggccttttacttcgctctgcgcgacactctggtagcagataatctggaccaggctactcgcgtggcttatcagaaggacagaagatggcgggtggtgactctgcaggggcaaatcatagagcaatcaggcacaatgacaggcggaggatctaaggtgatgaagggacgcatgggtagcagccttgttatcgagataagtgaggaagaggtgaacaaaatggagtcccagcttcagaatgacagtaagaaagcgatgcagattcaggagcaaaaggtacagctggaagagcgtgtggtcaagcttaggcactcggagcgtgaaatgagaaataccctcgaaaagttcacagcttctatccaacgactgattgagcaggaggaatatctcaacgtgcaggtgaaagagttggaagctaatgtattagccacagctccagacaagaagaagcagaaacttctcgaggagaacgttagtgcttttaagaccgagtacgacgccgtggcggagaaagcaggtaaggtggaggcagaggttaaacgactgcacaacaccattgttgagattaataatcataaactaaaggctcagcaggataaactggataaaattaacaagcagctggacgagtgtgcttccgcgatcactaaagcccaagtcgcgattaaaaccgcagataggaatctgcagaaggcccaggacagcgtgctgcgtacggaaaaagagatcaaggacaccgagaaggaggtggatgacctcacagcagagttgaaaagcctggaggacaaagcagccgaagtagtgaagaatactaatgccgctgaagaaagcctgccagagatacagaaggagcataggaacctgctacaggaacttaaggtgattcaggagaacgagcacgcgctacaaaaagacgcccttagcataaaactgaaactcgagcaaattgatgggcatattgccgagcataacagcaaaattaagtattggcataaggaaatttccaagatttcgttacatcccatagaggacaatcctatcgaggaaatctcagtcttgtcaccggaggacctggaagccatcaaaaatccggacagcatcactaatcagatagctctcctggaggccagatgccatgagatgaagccaaatctgggcgctattgcggaatataagaaaaaggaggagctgtatctacagcgcgtagcggagctggataagattacatatgaacgagactcatttcggcaagcatacgaggatctgcgcaaacagaggctaaacgagtttatggccggattttatatcattactaataagctgaaagaaaactatcagatgttaactctaggaggagacgcagagctcgaactcgtggatagccttgaccccttctcagagggaatcatgtttagcgtcagacctcccaaaaaatcatggaaaaagatttttaacttgtccgggggagagaagactttgagctccctagcattggtctttgcactccatcactataagcccacgccactctatttcatggacgaaattgacgcagctctggattttaaaaacgtttccatcgtcgccttttatatctacgaacagactaaaaatgctcagtttatcataattagtctgaggaataacatgtttgaaataagcgataggctgatcgggatttataagacctacaatatcaccaaaagcgtggcggtgaaccctaaggagatagcatcaaaaggcctgtgttag

SEQ ID NO: 28511 - DNA, 2829 bp, Artificial Sequence
  Description of Artificial Sequence: Synthetic coding sequence
atgacaggcagcaattcacacatcaccattttaacactcaaagtacttccccactttgaatccctagggaagcaagagaaaatacccaacaagatgagtgcctttaggaaccactgtccacatctggattctgtgggcgaaattacgaaggaggatctgattcaaaaaagtctgggcacctgtcaggattgtaaagtgcaggggccaaatctgtgggcatgtttagagaatcggtgctcatatgtgggctgtggtgagtcacaagttgaccactccactatccactcccaagaaaccaagcactatctaacagtcaatctcacaacactgagagtgtggtgctatgcgtgttctaaggaagtgtttttggaccgaaaactgggcacacaaccctctctgccccacgtaaggcagccccatcagatacaagagaatagcgtacaggatttcaaaattcccagcaatacgacattgaaaacccctctcgtcgcagtattcgacgatctagatatcgaggcagacgaggaggatgaattacgcgctcgcggtctcactggcctgaagaatattggcaatacctgctatatgaatgcggctttacaagcactctctaattgtcctcctctgactcagttttttctggattgcggtgggttggctcgcaccgacaagaaaccggcaatttgtaaatcctatcttaagctcatgactgaactttggcataaatccagacctggttctgtggtccctacaacccttttccaaggaattaagactgtcaatccaacttttagaggctactcacagcaggacgcccaagagttcctccggtgccttatggatctcctacacgaggaactcaaagagcaagttatggaggtcgaagaggacccccagacaatcactacggaagagaccatggaggaagacaaaagtcagagtgatgtcgactttcaatcctgcgaaagctgttccaattctgatcgagcagagaacgaaaacgggtcccggtgcttctctgaagataataatgagaccaccatgctgatccaggatgatgagaataactccgaaatgtccaaagattggcagaaggaaaagatgtgtaataaaatcaacaaggtaaattcggaaggagagttcgacaaagaccgggactctatcagtgagaccgttgacctcaacaatcaggaaacagttaaagtacagatccactcacgtgctagtgaatatattactgatgtccactccaatgatctgtccacaccgcaaatcctcccttctaatgagggcgtcaatccaaggttgtcagcttcaccacctaagtccggtaatctgtggccaggattggcccctccgcataagaaggctcagtccgcatcacccaaacgcaagaaacaacacaagaaatatcgctctgttatatcagatattttcgacggaaccattatctcatccgtgcagtgcctgacctgcgaccgtgtgtccgttaccctagagacatttcaggatttgagtctgcctattcctgggaaagaggatctggcaaaactgcatagctcctcccatccaacgtcaattgtgaaggctggaagttgcggcgaagcctacgccccacagggttggatcgcattttttatggagtacgtgaagcgctttgtcgtttcttgcgttccctcttggttttggggaccagtggtcaccttgcaggactgcctcgctgctttcttcgcacgcgatgagctgaagggagacaacatgtacagctgtgagaagtgcaaaaaactcagaaacggggtcaagttctgcaaagttcagaacttcccggagatactgtgtattcacctaaagcgcttccgccacgagcttatgtttagtacgaaaatcagcactcatgtaagttttccacttgagggtctcgatctacaaccatttctggcaaaagattcacccgctcagattgtcacgtatgatcttctttcagtcatctgtcaccatggcaccgccagctcagggcactacattgcatactgccgcaataatctgaacaatctgtggtacgaatttgacgaccaaagtgtgaccgaagtgtccgagtctaccgtacagaatgccgaggcctacgtgctgttttaccggaagagctccgaggaagcccaaaaggaaaggcggcgtatctctaaccttctgaacatcatggaaccgtccctcctgcagttctacatcagcaggcagtggctgaacaagttcaaaactttcgcagagccaggcccaatcagcaataacgacttcctctgcattcatggcggtgtgccaccgcgaaaggctgggtacattgaagacctcgtcctgatgctgccccagaatatttgggacaatctgtactctcggtatggcggaggaccagccgtgaaccatctgtatatctgtcacacctgccagatcgaggccgagaagatcgaaaagcggcgtaaaacggagctggaaatatttatcagattgaaccgcgctttccagaaggaggattcaccagccacattctattgtatcagtatgcagtggtttagagaatgggagagttttgtgaagggaaaggacggagatccccctggccctatcgataacaccaaaattgcggtgactaaatgtggcaacgtgatgctgagacagggcgctgattctggccagatatctgaagagacttggaattttttacaaagtatttatgggggtggcccagaagtgatcctccgccctcccgtggtgcatgttgatcccgatatcctgcaagcagaagagaaaatagaggttgaaaccaggagtttgtag

SEQ ID NO: 28512 - DNA, 2106 bp, Artificial Sequence
  Description of Artificial Sequence: Synthetic coding sequence
atgatgaaacggcagctccaccggatgcgacagctggcccaaaccggcagcctcggccgaacgcctgaaacagcggagtttctgggcgaggacctcctgcaggtggaacagaggctcgaaccagccaaaagggccgctcataacattcacaagcgactccaggcttgcctacaaggccagtccggggctgacatggataaaagagttaaaaagctgccccttatggctctatcgacaactatggccgagagctttaaggaactcgatcctgactccagcatgggtaaggccttggagatgtcctgtgccatccagaaccaactggctcgcattctggctgaattcgaaatgacgctagagcgggatgttctccagccattgagtaggctcagcgaggaggagctccccgctattcttaagcataagaaatcactgcagaaattggtctccgattggaataccctcaaatcccggctgtcccaggcaacaaaaaactccgggagctcacagggcctaggtgggtctcccggatcgcactcccatacgaccatggctaataaggttgagaccctcaaggaggaagaagaggaactgaaacgtaaggtcgagcagtgcagagacgaatacctggccgacctctaccatttcgtaacaaaggaagacagttatgcaaactattttatcaggctgttggagatccaggccgactaccacagacgttctttatcctctcttgataccgccctcgcagaactgagggagaaccatggacaggccgatcattcccctagcatgacagctacccatttccctagggtatacggagtctctctggccactcacttacaggagttgggccgtgagatcgctctacctattgaagcctgcgtcatgatgttgctctcggaggggatgaaggaggagggactgtttcggttagctgcaggagccagcgttctaaagaggctgaagcaaaccatggcctccgacccgcacagtttagaagagttttgttcggatccacacgctgtggctggcgcactgaagagctatctccgcgaactcccagagcctctgatgacctttgacctttatgatgactggatgcgcgctgccagccttaaagaacccggagcgagattgcaggctctgcaagaggtttgttccagattgccgccagaaaacctatctaacttgagataccttatgaaatttctggccagactggccgaggagcaagaagtgaataaaatgacccccagcaacattgcaatcgtcttggggccaaatcttttatggccccctgagaaggagggggaccaggcacaacttgacgcagcatccgtctctagtatccaggttgtaggcgtcgtcgaggctttgatccaaagcgcagacacccttttccccggtgacattaatttcaacgtctctggcctgttctccgctgtgactctccaggacaccgtcagtgatcggctcgcatctgaagagctgccgagcaccgccgtgcccacccctgcaaccactcctgccccagcacctgcccctgcgccagccccagcaccagcgctagcctccgcggcaactaaggagcgtactgagtctgaagtacctcctaggccagccagcccaaaagtgacgagatcaccccctgagactgcggcacccgtagaagacatggctaggagaaccaagagaccggctcccgctcgcccaacaatgccccctccccaggtcagcggaagtcggagctcacctcccgctcctccgttaccccctgggtccgggagcccaggcaccccccaggctcttcctcgcagattagtgggctcgtccctccgtgccccaacagttccaccccctctgccacccaccccgcctcagcccgcaaggcgccagagccgtaggtcacctgcatcccccagcccagcgtcaccagggcctgcaagcccctcccctgtgtctctgagcaatcctgcccaggttgatcttggagcggcaactgctgaaggcggtgctccggaggcaataagcggcgttccaacccctccagccattcctccacagcctagaccgaggagcctggctagtgagacgaactag

SEQ ID NO: 28513 - DNA, 1818 bp, Artificial Sequence
  Description of Artificial Sequence: Synthetic coding sequence
atggaggtaagagcatccctacagaagattgtttccaacggggatgagcagcttgagaaggcgatggaagaaattcttagggacagcgaaaaacggccatcgtctctattggtggattgccagagctcgtcggagatcagcgatcatagtttcggggatattcccgcttcgcaaaccaacaagccctccctccagttgatcctcgatccgtccaataccgagatctccacacctagaccatcctcaccgggaggtctgcccgaagaagattctgtgctctttaacaagctaacgtacttaggatgcatgaaggtaagttccccacggaacgaggtagaagccctgagagccatggccaccatgaaaagctcctcgcagtatcctttccccgtgaccctttacgttccaaatgttcccgaggggtcagtaaggatcatagaccagagctcaaacgtagaaatcgccagctttcccatctataaggtactgttctgtgcccgaggccacgacgggaccacagagtccaactgctttgctttcactgaaagctctcacggatccgaggagttccagatccatgtcttctcttgtgagatcaaagaagcagtgagccggattctgtacagcttctgtactgcctttaagcgatcaagtcggcaggtgtccgacgtgaaagattcagtgattcccactcccgatagcgacgtgttcactttttctgtgagcttagaggtgaaagaagacgatggcaagggaaacttcagtccagtcccaaaggatagggacaagttctactttaaacttaaacagggtatcgaaaaaaaggttgtcatcaccgtacagcagctctccaataaggagctcgccattgagagatgtttcgggatgctcttgtcgccaggccgaaatgtcaagaacagtgacatgcaccttcttgatatggaaagcatggggaaaagttacgatggtcgcgcatatgtgatcactggtatgtggaatcctaacgccccagtgttcctggcattgaatgaggaaactcctaaggacaagcaggtctacatgaccgtggccgtggatatggtggtgacggaagttgtggaaccagtgcgctttctgcttgagactgtcgtgcgggtctacccggcaaatgaacgattttggtacttcagtcgcaaaaccttcacagaaaccttcttcatgcggctcaaacagtctgagggaaaaggtcacacaaacgcgggtgatgcaatctatgaggtagtaagtctgcaacgcgaaagcgacaaagaggagcctgtcactcccacatcaggcggtgggccaatgtcaccccaagatgacgaggcagaagaagaaagtgacaacgaactatcgagtggcacaggggacgtcagcaaagactgtccagaaaaaatcttgtacagttggggtgagttgttggggaagtggcacagtaacctaggtgcgcgtcccaaaggcctgagtactctggtaaagtccggtgtgcccgaagctctcagagctgaagtgtggcagcttctggccggttgccacgacaaccaagccatgctggaccgctacaggatacttatcactaaacagcagatgaagttttcactgactcccagacaaacgatccatctggtgaagtacgagggctccatgaaggtgagtatgaccccatgtaatcagctgcaatttgacattagactcgatgtcctgatcacttatactttctgtttctctagtttccccgagcccgagctgtacaagtacgttctcaagcaccaactaattaaacggctgaacgcttgctag

SEQ ID NO: 28514 - DNA, 3120 bp, Artificial Sequence
  Description of Artificial Sequence: Synthetic coding sequence
atggctgtgcaactggtacccgacagcgccttggggctgttaatgatgacagaagggcgtcgctgccaggtccacctcttggacgaccgcaagcttgaattgctggtgcaacccaagctcctggccaaggaattgttggatctggttgcttctcatttcaatctgaaggagaaggaatactttgggattgcctttaccgatgaaacgggtcatttgaactggcttcagctggacaggagagtgctggagcatgattttccaaaaaaatcagggcctgtggttctttacttttgcgtaagattttatatagaaagcatctcttatctcaaagacaacgcaaccatagagctgtttttcttaaatgcaaagtcatgcatttacaaagaactcattgatgttgactcagaagtggtcttcgagctggcgtcgtacatcctccaggaggccaagggagactttagttcgaacgaagtcgtgagaagtgatctgaaaaagctgccagcactccccacccaggccctgaaggagcacccctcactggcttattgtgaggatcgcgtgatagagcattacaagaagctgaacggacaaactagaggccaggccattgtcaattacatgagtattgtagagtccctgcctacgtacggcgtccactactatgctgtcaaagataagcaagggattccatggtggctcggactcagctacaagggaattttccagtatgattatcacgacaaagtgaaacccagaaaaatcttccagtggcgacaattggagaatctatatttcagagaaaagaagtttagcgtcgaggtgcacgatccgcgtcgggcttctgttactagacggactttcggacactccggaatcgcggttcacacgtggtacgcatgccctgcacttataaagtccatctgggcaatggccatttcccaacatcagttctacttggataggaaacagtcgaagagtaagatccatgcggcaagatctctatctgaaatcgctatcgatctgaccgagacaggcacactgaagacgagcaaactggctaatatgggcagcaaaggcaaaattataagcggctcttcaggttccctgctatcttccggctcgcaggaatcagattcaagtcagtctgccaaaaaagatatgctcgccgctctgaaatcacgtcaggaggccctggaagagactctccggcaacggctggaagaacttaaaaagctgtgcttacgcgaggctgaactaaccggaaagctgccagttgagtatcctctcgatccgggtgaagaaccccctatcgtgcgacgccgtattgggacagcctttaaattagatgaacagaagatcctccccaaaggcgaggaggctgaactggagcggcttgagcgcgagttcgccatccagtctcagatcacggaagccgcacggaggctcgcctcagaccccaacgtgagcaagaaacttaaaaaacagagaaaaaccagctacctgaacgcattgaaaaagctccaggagatcgaaaacgcaattaatgagaatcgcatcaagtccggcaaaaaaccaacccagcgggcatcactaatcattgatgacggcaacatcgcttctgaggacagttcactgagcgacgctctcgtgctcgaggacgaggacagtcaggtcacaagtactatttcgcccttgcatagtccgcataagggacttcctcccagaccccctagccataacaggcctccacctcctcagtccctagaaggcttaagacaaatgcactatcaccgaaatgactatgacaaatcacccataaagcctaagatgtggagcgagagcagtttggatgagccatacgaaaaagtcaagaagaggtcttcccattcacatagctcctcccataaaaggtttccttcaaccggttcctgcgccgaggcaggaggcggatccaatagtctacagaactccccaattcgcggactgccacattggaactcgcagagtagcatgcccagcacccccgatctgagggtgcgaagtccccattatgtacactcaacaagaagcgttgatataagtccaacacgtctgcactccctcgccctacacttcagacaccgctcgtccagtttagaaagtcaggggaagctgctcgggagtgaaaacgacactgggtctccggacttctacaccccaagaactcgcagtagcaatggttcagatccgatggatgactgcagttcttgtacctcacatagttcaagtgagcactactatccagctcagatgaacgccaattattccactctggccgaagactccccttccaaggctagacaaaggcagcgtcagcggcagcgggctgccggagcgctggggtcagcctccagtggaagtatgcctaaccttgccgctagaggtggcgcaggaggcgctggcggtgcaggagggggagtctacctgcacagccagagtcagccatcttcccagtatcgaatcaaggagtaccccctgtacatcgagggcggtgcgacccccgtagtggtgcgctccttggagagcgaccaggagggccattattcagtgaaagcccagttcaaaacgagtaattcatacacggctgggggtctgttcaaggaaagctggcgcggtggagggggagacgagggggacaccggcagactaacaccttctaggtcccagattctgcgcactcctagcctgggtcgcgagggagctcatgataaaggggctggcagggccgcagtgtccgacgaattacggcagtggtatcaacgcagcactgcgagccacaaagagcactccaggctgtcccacacgagttctacctcaagcgacagtgggtcacaatatagcacaagcagtcagtccaccttcgtcgctcacagcagggtcactcgcatgccccagatgtgcaaagcaacttctgctgccttaccacaatcacagcgctcaagcactccgtctagcgaaatcggcgctactccaccctccagtccacaccatatcctgacctggcaaaccggcgaggcaaccgaaaactcccctatcttagatgggtcggagtctcctccgcaccagagtactgatgagtag

SEQ ID NO: 28515 - DNA, 3228 bp, Artificial Sequence
  Description of Artificial Sequence: Synthetic coding sequence
atggtggtggaggtggactcaatgcccgcagctagtagcgtgaaaaagccatttggccttcgaagcaagatgggaaaatggtgttgtaggtgcttcccatgctgtcgcgagagcgggaaatcaaatgtgggaacatccggcgatcacgatgatagcgctatgaaaacactgagatccaaaatgggtaaatggtgccgacattgtttcccctgttgccgcggaagcggcaagtccaacgtcggggcttctggtgatcatgacgattctgctatgaaaacactcaggaacaaaatgggaaagtggtgttgccattgcttcccttgttgcagagggagctcaaaatccaaggtgggcgcatggggcgattacgacgactccgcatttatggaaccacgctaccacgtcaggggagaagacctcgacaaattgcaccgagcagcttggtggggcaaagtgccgaggaaggacttgatcgttatgctcagggacaccgatgtgaataagcaagataagcagaaaagaacagcactgcatctggcttcggctaacggcaactctgaggtggtcaagctcctgcttgataggagatgccaattgaacgttctggataataagaaacgcacagcactgattaaagcggttcagtgtcaggaagatgaatgcgctcttatgctcctcgaacatgggactgatcctaacattcctgatgagtacggcaacactaccctgcattatgcaatctacaatgaagacaagctcatggctaaagccctgctgctgtatggcgctgatatagaatccaagaacaaacatgggctgacccccttgctgctgggagtgcatgagcaaaagcaacaggtcgtgaagttcttgatcaagaaaaaggccaatctgaacgcgctggatcgctatggtagaaccgctttgatccttgccgtgtgctgcggcagtgcaagcattgtatctttgcttttagaacaaaatattgatgtgtccagccaggacctctccgggcaaaccgcgagagagtacgctgtgagcagccatcaccacgtgatctgtcagcttctgtctgactataaggaaaaacagatgctgaagatatccagcgagaactccaaccccgagcaagatctcaagctcacgagcgaagaggagtcgcagcggtttaagggaagcgaaaacagccaacccgaaaagatgagccaagagccggaaatcaacaaggatggggatcgcgaggtggaagaggaaatgaaaaaacacgaatctaacaacgtaggcctgttagaaaatctgacgaacggggtgacagccggaaatggcgacaatggactgattccacagcgcaagtcacggacgcctgaaaaccagcagttccctgataatgaaagtgaggaatatcatcggatatgtgaactgctcagtgactataaggaaaaacagatgccaaaatattcctccgaaaacagcaaccctgaacaggacctcaagctcacttcagaggaggagtcacagcgactcaaaggttccgaaaatggccagcctgagaaaagatcccaggaacctgagattaacaaggacggtgaccgggaactggagaacttcatggccatcgaagagatgaaaaagcacagaagtactcacgtgggattccctgagaatctgacaaatggtgccaccgctggaaatggagatgatggcctcatcccccctcgcaagtctcgcacccccgagtcccagcagtttcccgatactgagaacgaggagtaccattcagacgagcagaatgacacccagaagcagttttgcgaggagcagaacacaggaattttgcacgacgaaattctgattcacgaagagaagcagattgaggttgtggagaagatgaacagcgagctgagcctttcatgtaagaaggagaaagacattctgcatgagaactcaacgctccgggaagaaatagccatgcttcgcctggaacttgacaccatgaagcaccagtcgcagctgcgcgagaaaaaatacctcgaagatattgaaagtgtgaagaagcggaatgataacctgttgaaagcactccagctgaacgagttaaccatggacgacgacaccgccgttctggtgattgacaacggtagtggcatgtgcaaggccggatttgcaggtgatgatgcaccgcgtgcagtgttcccaagcatcgtgggcagaccaagacagcagggaatgatggggggaatgcaccagaaggaaagttacgttggcaaggaggcgcagtctaagagaggaattttgactcttaaataccccatggagcacggtatcatcactaattgggacgacatggaaaagatctggcatcacacattctataatgagttgcgcgtggctcccgaagagcaccctgtgctattaacagaagccactttaaacccgaaggcaaaccgagaaaagatgactcagattatgtttgagaccttcaacacccctgccatgtacgtggccattcaggccgttctgtcgttgtacactagcggacggaccacaggcatagtaatggacagtggtgatggcgtgacacacactgtccccatttatgaggggaacgccctgccacatgcgacactgcggttagatctcgccggtcgcgaactgccggattatttgatgaagatactgaccgagcatggttatcgattcaccacaatggccgagagagagattgtccgcgacataaaagagaagctgtgctacgtcgctctggattttgagcaggaaatggccacagtcgcgtcctcctcttctctggagaagtcttacgagctcccggacggccaggtgattaccatcggaaacgaacggttccgctgtcctgaagctttgttccaaccttgtttcttgggaatggaatcgtgtggtatccacgagacaacctttaatagcatcatgaaaagcgacgttgacattcgaaaggacctatacacaaataccgtcttaagtggaggtacaactatgtaccctgggatggcccaccgtatgcagaaggaaatcgccgcactggccccttctatgatgaaaatccgaattattgctcccccaaagcgcaagtatagcgtgtgggttgggggtagcattttagcctctttgtcaactttccagcagatgtggatcagtaaacaggaatacgacgaatctggaccgtcaatcgtgcaccgcaagtgtctgtag

SEQ ID NO: 28516 - DNA, 1752 bp, Artificial Sequence
  Description of Artificial Sequence: Synthetic coding sequence
atgctcagcgagtctaaagaaggcgaggaaaaggaggaagtaacgatggataccagtgagaacaggcctgagaatgatgtccctgagcctcctatgcctattgctgaccaggtgtccaacgacgatcgcccagaaggttctgttgaggacgaggaaaaaaaagaatcgtccctgccaaagtcgtttaagaggaaaatcagcgttgtgagtgccaccaagggagtgcccgcagggaactctgatacggagggtggtcagccgggtcgtaaaaggcgctggggcgcatctaccgccactacacagaagaagccgtcaatctcaattaccacggagagtctgaagtcactgatcccagatattaagcccctagcaggccaggaggccgttgttgacctgcacgctgatgatagtagaatcagcgaggacgagactgagagaaacggcgacgacggcacccatgacaaaggtctgaagatatgtagaacggttacccaggtggtgccggcagagggccaggagaatggccaacgcgaggaagaagaggaggaaaaagaaccagaagccgagcccccagttcccccacaggtgagcgtcgaggtggccttgcccccacctgcagagcatgaggtcaagaaagtaaccttgggagatacactcacccgaagaagcatttcccaacagaaatcaggcgtttccatcacgatcgatgacccggtccggaccgcacaagtcccctctcccccaaggggcaaaattagcaacatcgtccacatctcaaacttagtcaggccttttaccctaggccagctgaaggaattgctgggacgcacgggaacacttgtggaagaggcattttggatcgataagataaaaagccactgctttgtcacttattctacagtggaggaggccgtagcgacacggaccgccttacacggcgtcaagtggccccagtctaaccccaagtttctgtgcgcggactatgctgaacaggacgagctcgactatcataggggccttctggttgacagacccagcgagaccaagacagaagagcaagggatcccccgacccctgcatcccccacccccacccccagtacagcctcctcagcatcctagagctgagcagcgcgagcaagagagagctgtgagagagcaatgggctgaacgggagcgcgaaatggagcggagagaacggactcgctccgagagagaatgggatcgcgataaggtacgcgagggccctcgaagccggtccagatctcgcgataggcggagaaaagagagggctaagtccaaggagaaaaaatccgaaaaaaaggaaaaggcacaggaggaacccccagccaagctgctggacgatctcttcagaaagacaaaggctgctccatgcatctattggctgccccttaccgacagccaaatcgtacaaaaagaggccgagcgcgcagagagggccaaagaaagggaaaagaggaggaaggagcaggaagaggaggagcagaaggagagggagaaagaggctgagcgcgaacgaaatcggcagctcgagcgggagaagcgtcgcgaacactcccgcgaacgggaccgggaacgagaacgggagcgggaaagggatagaggcgaccgagatcgggatcgggaaagggacagagaaaggggtagagaacgggataggcgggataccaagcgccatagtcgcagcaggtccaggtctacacccgtcagagatcgtggtgggaggcgctag

SEQ ID NO: 28517 - DNA, 963 bp, Artificial Sequence
  Description of Artificial Sequence: Synthetic coding sequence
atgtctaaaagtgcttcccctaaggagccagaacaacttaggaagttgtttattggaggcctatcctttgagaccactgatgagagcctgagatctcactttgaacaatggggaacactgacagactgcgtcgtgatgcgtgatccaaatacaaagcgtagcagagggttcggattcgtcacttacgctaccgttgaagaagtggacgcggctatgaacacgactccccataaggtggacgggagggtcgtcgagccgaagcgggctgtcagccgcgaagactcccagagacccggagcccatctcacggttaaaaaaattttcgtggggggaataaaggaggatactgaagagcaccacctgagggattatttcgaacaatatggtaaaattgaagtgatcgaaataatgacggatcgcggtagcgggaaaaagcggggttttgcatttgtcacattcgacgaccacgactcagtcgataagatcgtgatacagaagtatcataccgtgaaggggcacaattgtgaggttagaaaagccctaccaaaacaggagatggccagcgcgagcagtagccaacgaggtcggcgaggttccggcaatttcggtggtggacgcggagatggattcggtgggaacgacaactttggccgagggggaaatttctccggacggggaggctttgggggatcctgcggaggcggaggttatggaggcagcggcgacgggtacaatggttttggcaacgatgggagtaatttcggagggggtgggtcttacaatgacttcggcaactataacaatcagagcagcaactttggtccaatgaagggagggaactttggaggccgaagttcgggtccgtacgggggtggcggtcaatattttgccaaaccccagaaccagggagggtacggggtcagctctagcagctcctcatacgggagtggcaggcgcttctag

SEQ ID NO: 28518 - DNA, 3294 bp, Artificial Sequence
  Description of Artificial Sequence: Synthetic coding sequence
atggctgctgcggctgccgaacagcaacagttctacctgctcttgggcaatctcttgtcccccgataacgttgtgcgaaaacaagctgaggaaacctacgagaacattccaggccaaagcaaaattacctttttgcttcaagcaataagaaatactactgctgccgaggaagcgaggcagatggccgctgtgctgctgcgcagactgttgtccagtgccttcgatgaggtgtaccccgctctgcctagcgacgtgcaaactgccattaagtccgaattgctaatgattatccaaatggagactcagtctagtatgcgcaagaaagtgtgcgacatagcggctgagctagcaagaaatctgatagacgaggatggcaacaaccagtggcctgagggccttaagtttctgttcgatagcgtttcttcgcagaatgtgggattgagagaggccgctctgcatattttttggaattttcctggtatttttggtaatcagcaacagcattatctggacgtcatcaagaggatgttggtgcagtgtatgcaggaccaggagcaccccagtatccgtaccctgtcggcaagggctacggcagcatttattctcgccaatgaacataatgtggctctgtttaagcacttcgctgatttactacccggttttctgcaggcagtgaacgattcctgttatcagaacgatgactccgtgttaaaaagcctggtcgaaatcgcggatactgtaccaaaatacctcagaccacacctggaagcaaccctgcaactgagtctgaaactgtgtggagacacatcactgaacaatatgcagcgacagctggctctcgaagttatcgtgaccctctcagaaaccgccgctgcgatgctgagaaagcacacgaatattgtcgcccagaccataccccaaatgttggcaatgatggtcgatttagaagaggatgaggactgggctaatgccgatgagctggaagacgatgatttcgattcgaacgccgttgctggtgaaagcgctttggacagaatggcctgtgggctcggtggaaagctggtcctccctatgattaaggaacacattatgcaaatgctgcaaaacccggactggaaataccggcacgcaggactgatggccctttctgcaattggggaagggtgtcaccagcagatggagggcatacttaatgaaattgtgaactttgtgctcctctttttgcaggacccccacccaagagttaggtatgccgcttgtaatgcagttggacagatggccacagacttcgcaccaggatttcagaagaagttccacgaaaaggtcattgccgcattgctacagaccatggaagaccagggtaatcaaagagttcaggctcacgcagctgctgcattgatcaactttactgaggattgtcctaagtctctgctgatcccatacctcgacaaccttgtcaagcacctgcactccatcatggtgcttaagctgcaggagttgatccagaagggcaccaagctggtgctcgaacaggtcgtgacctcaattgcaagcgttgctgacactgccgaagaaaagtttgttccttactacgacctgttcatgccctctctcaagcatatcgtggagaatgccgtccaaaaagagctccgcctcctccggggaaaaacaatcgagtgcattagtctgatcggccttgccgtgggcaaagaaaagtttatgcaagacgccagcgatgtaatgcagttattgctgaagactcagaccgatttcaacgacatggaagatgacgacccccagattagttatatgataagcgcatgggccaggatgtgcaaaatcttgggaaaggagttccagcagtatttacctgtcgtaatggggccactcatgaagacggcttctataaaacccgaagtggccctgctcgacacacaagacatggaaaacatgtctgacgatgatggctgggaattcgtaaacctgggggaccagcaatcctttgggatcaagacagctgggctggaagagaagtcaactgcctgccagatgctggtgtgttacgcaaaggaactcaaggagggttttgtagagtacacagaacaagtcgtgaagttgatggtcccactgctgaagttttacttccatgacggtgttcgggtagcagccgctgagagcatgcctcttcttctggaatgcgccagagtgagagggccagaatacctgactcagatgtggcatttcatgtgtgacgccctcatcaaggctatcggtactgaacccgacagtgacgtcctgagcgagatcatgcattccttcgcgaagtgtattgaagtgatgggagacggctgcctgaacaatgaacacttcgaggagctggggggaatccttaaggctaagctcgaggaacactttaaaaatcaagagttgcggcaggtgaaacggcaggacgaggactatgatgaacaggtggaggagtcactacaggacgaggatgataatgacgtttatatcctgactaaggtgagcgacatactgcactccattttctcatcttacaaagagaaagtccttccctggttcgaacagctcttgccattaattgtcaatttaatctgccctcaccgcccatggccagaccgccaatgggggctgtgcatttttgatgatgtaattgagcattgttccccggcatccttcaaatatgccgagtacttccttcgacccatgctccagtacgtttgcgataattctccagaggttcggcaggccgcagcgtacggtcttggagtgatggctcagtacggaggcgacaactacagacccttctgtacagaggcacttcccctgctggtcagggtgatccaatcagccgactccaagacgaaggaaaatgtaaatgctacggagaattgtatcagcgccgttgggaaaatcatgaagtttaagcctgactgcgttaatgttgaagaggtgcttcctcattggctgtcctggttacctctgcatgaagataaagaggaagccgtccaaacatttaactacctgtgtgatctaatagaatcgaatcaccccatcgtcctcggtccaaacaacaccaatttgcccaagatcttctctattatagcagaaggcgaaatgcacgaggcaatcaagcacgaagacccgtgtgccaagcgcctcgccaatgtcgtcagacaggtccagacctccggcggactctggactgagtgcattgcccagctctcacctgaacaacaggctgcaattcaggagcttcttaactccgcttag

SEQ ID NO: 28519 - DNA, 2715 bp, Artificial Sequence
  Description of Artificial Sequence: Synthetic coding sequence
atgttccctgcccttgagactcatttaaaacagaccatacctgacccttatgaggacttcatgtaccgacacctgcagtactatggctatttcaaggcgcagcggggatctctgcctaactcagcgacacatcagcacgttagaaaaaataatccccaatgccttctcaatggctcgctcggagaaaaggacgatctgatccctgatacattgcagaaggaaaagcttctgtggcccatttccctcagttccgccgttcatcgacaaatcgaggcaattaaccgcgacttccacagttgtctgggctggatgcaatggcgaggcctgagcagtctccagccgccaccacctaggttcaaggactctcccgcatcggccttcagggtggccggtattaccgatagccacatgctgtcgctccctcacctgcggtctcgccaattgctgtacgacgagctggacgaagtgaatcctcgccttcgggaacctcaggaactcttttctatcttgagcacaaaaaggccactgcaggcccctcgctggcccatagaatgcgaagttataaaagaaaatatccaccatatcgagtgggcccctccccagcccgagtacttctaccagcccaagggtaacgaaaaagtgcccgagatcgtcggcgaaaagaaaggcaccgtagtgtaccagctcgactcggttccaattgaaggttcctactttacatccagcagagttggtgggaaaagaggcatcgtgaaagagctagccgtaactctccagggtcctgaagataataccttgctgttcgagtcacgcttcgaaagtggaaatctccaaaaggccgtgcgcgttgacacatacgaatacgagctgactctaagaacagacctatatactaacaagcacactcaatggttctatttcagagttcaaaacacacgaaaggacgctacttacaggttcaccatagtgaacctcctcaaaccaaaaagcttatatactgtgggcatgaaacctttactctactctcagctcgacgcaaatacaaggaatattggatggcgtcgggagggcaacgaaataaaatactacaaaaataatactgatgacggccagcagcccttttactgtctgacttggaccatccagttcccttacgaccaggatacctgcttttttgcccatttctacccttacacgtacaccgacctgcagtgctaccttctcagcgtcgcaaacaatccaatacagtcacaattctgtaagttacagaccctgtgcagaagtctggctgggaacaccgtgtatctactgaccatcaccaacccatcacagacgccgcaggaggcagccgcaaaaaaggccgtcgtgctgagcgcacgggtgcatccaggtgaaagtaacggcagctgggttatgaaaggattccttgactttatcctctcaaattcgccagatgctcagctgcttcgcgacattttcgtcttcaaagtgctcccaatgttaaaccccgatggcgtcatcgtggggaattatcgatgttcccttgctgggcgtgaccttaatagacactataaaacaatcctgaaggagagctttccgtgcatctggtacacccggaacatgattaagcgcctcttggaagagcgagaggtcctgctgtactgtgattttcacggccatagcaggaagaataacatatttttgtacggctgtaacaacaacaatcgcaagtactggcttcatgagagagtctttccgctgatgctgtgcaaaaacgcacctgataagttcagttttcatagctgtaactttaaggtacagaaatgcaaagaaggaaccggcagggttgttatgtggcgtatgggaatccttaactcgtatacaatggagtccaccttcggtggctctactctggggaacaagagggatacccactttactattgaagacttgaagtcattggggtatcacgtctgcgacactttgttggacttctgtgaccctgatcagatgaaattcacgcagtgcttagccgaattgaaggagcttctgcgacaggaaattcataagaagtttcacgagctcggtcaggacgttgacctggaggggtcctggtcagatatttcccttagtgatatcgagtcaagaaactctacctcaggcagtgactcttcactgtccgatgggctgcctgtccatctcgccaacatagccgatgaactgacgcaaaagaagaaaatgtttaaaaagaagaaaaagaagagcctgcagacacgaaagcaaagaaatgaacagtaccagaagaagaacctgatgcagaaattgaagcttaccgaggacacctccgaaaaagctggctttgcatcgaccctacagaaacaacccacattttttaagaatagcgaaaacagcagtttccttccaatgaaaaatgaaaatcctagattaaatgagacgaatctgaacagacgagacaaggatacgccgctcgacccgtcaatggccactctcattcttcccaagaataaaggcagaatgcagaacaaaaaacccggttttacagtatcgtgctcaccgaaacgcacaatcaacagcagccaggagcccgctcccggtatgaaacccaactggccacggagcagatacccagccactaaacgaggctgcgctgcaatggcagcctatcctagtctgcacatttacacctatccatag

SEQ ID NO: 28520 - DNA, 789 bp, Artificial Sequence
  Description of Artificial Sequence: Synthetic coding sequence
atggccctgtcactgggatggaaagcacatagaaaccactgtggtctgttactgcaagcgctaagatcaagcgggctactgctgtttccttgtggccaatgtccatggcgcggagcaggatccttcctcgaccccgagattaaagctttcttggaggagaatacagaggtgacttctagcggctctctcaccccggagatccagctccgtctgttgaccccgagatgcaagttttggtgggagagggctgacctgtggccccacagtgacccatattgggcgatttactggcctggtgggcaggcgctttccagatatctcctcgacaaccccgacgtagtgaggggcaagagcgtgctggacttaggtagcgggtgcggggcaactgctatcgcggcaaagatgagcggcgcaagtcgcattctcgccaacgacatcgatcctattgcgggtatggccatcaccctgaattgcgaactgaacagattgaaccctttccccattctcattcagaacatactgaacctcgagcaggataagtgggacttggtggtgctgggcgatatgttctatgacgaagatctggcggattcactgcaccagtggctgaaaaaatgcttctggacttaccggacaagggtactcattggggaccccggtcggccacaattctctgggcattcgattcagcaccatttacataaggttgtcgaatactctttgttggaatctacgagacaggaaaacagcggattgacgacctctacagtctgggggttccaaccgtag

SEQ ID NO: 28521 - DNA, 2619 bp, Artificial Sequence
  Description of Artificial Sequence: Synthetic coding sequence
atgaattatcccggacgcggaagtccccgatcaccagagcacaacggcagaggaggcggtgggggtgcttgggaactaggaagcgatgctcgacccgcattcggaggcggtgtgtgttgtttcgaacatctcccaggaggcgaccctgacgacggtgacgtacccttggcacttctccgcggagagcccggattacaccttgccccaggaaccgatgatcacaatcaccacctcgcacttgatccctgtctgtcagacgaaaattacgatttctcgagcgcggagagtgggagctcactgcgttactatagcgaaggtgaatctggaggcggaggatcctctctgtctctgcacccaccgcaacagcctcctcttgtgccaacgaactccggagggggaggggctacagggggatcccccggagagcgaaagaggacaagactggggggtcccgctgctagacacagatacgaagttgttaccgaactgggaccagaagaagtccggtggttttataaggaggataagaagacatggaaacccttcattgggtatgattccctccgaattgaactggcctttcggactctgctgcagacaaccggtgctcgaccccagggaggggacagagacggggaccatgtgtgtagtccaacaggccctgcctcttcgagcggcgaggacgacgacgaagaccgcgcttgcggcttctgtcagagcactactggtcacgagcctgaaatggtcgaattggtgaatattgaaccggtgtgcgtacgtggcggtctgtatgaagtagacgtgacgcagggtgagtgctatccagtctactggaatcaggccgataaaatccctgtcatgagaggccagtggtttatcgacgggacatggcaaccgttggaagaggaagaaagtaatcttatcgaacaggagcacctgaactgcttcagggggcagcagatgcaggaaaacttcgatatcgaagtgagcaagtccattgacggcaaggacgcggtgcactctttcaagctctcgagaaaccatgtggactggcactctgtcgatgaggtgtatctgtattccgatgcaacaaccagtaagatagctcgaacggtaacacagaagctcggcttctccaaggcaagttcttcagggacaagactgcatcggggttacgtggaagaggcaaccctggaagacaagccctctcagactacccacattgtatttgttgttcatggcattgggcaaaagatggaccaggggagaatcatcaaaaatactgctatgatgcgtgaagcagctaggaagatcgaggagaggcatttcagcaatcacgctacacacgttgaattcttacctgtcgagtggcggtcaaagcttaccttggacggtgacactgtagactccattaccccggataaggtgagaggactgcgtgacatgttaaattcgagtgccatggacatcatgtattacacctccccactgtatcgcgacgaactggtgaagggcctgcagcaagaactgaaccgcctctactcgttgttttgttctcggaaccctgactttgaggagaaagggggtaaggtctctatcgtctctcacagtttgggatgcgtgattacgtacgacatcatgaccgggtggaatccagtgcgcctgtacgagcagctcctgcagaaggaggaagaactcccggacgaacgttggatgtcctacgaagaacgacacctactggacgagctctatatcacaaagagacgactgaaagagattgaggaacggctgcatggactgaaagcaagtagcatgactcagacccctgcactgaaattcaaggtggaaaactttttttgtatgggcagtccgctggctgtctttctggcacttagaggtatcaggccaggaaacacgggaagccaagaccatatcctgcctagagagatctgcaatcgcctgctgaacatatttcacccaacagatcctgtggcataccgcctggaacccctcatcttgaagcactactctaatatctcacccgtgcaaattcattggtacaatacatcaaacccgctcccttacgagcatatgaagcctagcttcctgaacccagccaaggaaccaacatccgttagcgaaaacgagggaattagcacgatcccttcaccagtgacctcaccagtacttagcagacgtcactacggcgagtccattacaaatattggcaaagcctccattttgggggctgccagcattggcaagggactcgggggaatgctgttctctcgatttgggaggtcttcaaccacccagtcttccgaaacctcaaaagactcaatggaggatgagaagaagccggtcgcttcgccctctgcaacgaccgtgggaacccagactctcccgcattccagttccggcttccttgatagtgcattagaacttgatcaccggatcgacttcgagttaagggaaggactggtggaatccaggtattggtccgccgtaacaagtcatacagcctactggagctccctggacgtcgcgttgtttctactgactttcatgtataagcatgagcatgatgatgacgcgaaacccaacctggatcccatctag

SEQ ID NO: 28522 - DNA, 1461 bp, Artificial Sequence
  Description of Artificial Sequence: Synthetic coding sequence
atggtgagtcacacttttcacatgaggaccgaggagagcgacgcctcccaggaaggcgacgacctccccaagagcagcgccaatacatcacacccaaagcaggacgactcgccaaaatcctccgaggaaaccatacaaccgaaggagggtgacatccctaaggccccagaggagacaatccaatctaaaaaagaagatttgccaaaatccagtgaaaaggctatccaaccgaaggaaagtaacatccccaagtctagcgctaaacctatacaaccgaaacttggaaacatcccaaaggcatcagtcaagccttctcaacctaaggagggagatatccctaaggcgcctgaagagactatacagagtaagaaagaggacctccccaaatcttctgaagaggccatccagcccaaggaaggcgacattcctaaatcttccgctaaacctatacagcccaaactcggaaacatagccaagacctctgtgaagcctagtcagcctaaggaaagcgatatacctaagtctcctgaagagaccatccaaccaaaagagggtgatatccccaagtcctccgccaaacccattcaaccgaagctcgggaacatccctaaggcaagcgtgaagccaagccagcccaaagaaggggacattagtaaatcccccgaagaggccattcagcccaaagagggcgaccttccgaaaagcctcgaagaggccatacaacccaaagagggagacatccctaagtcgccggaggaggccattcagccgaaagagggcgacattccaaaaagcttggaagaagcaatacaacccaaagagggtgatatcccaaagagtcctgaggaaactatacaacccaaaaagggagacattcctaagagccccgaggaggccatccagcccaaggagggagatatccctaagagcccaaaacaggccatccagcccaaagagggcgatattcctaaatccctggaggaagccattcctcccaaagaaatcgacattccaaaaagcccagaggagaccattcaacctaaagaggacgactctcccaagtccctagaggaggctactccgtccaaggaaggtgatattctgaaacctgaggaggaaacaatggagttccccgagggagacaaggttaaagtgatactctccaaagaagatttcgaagccagcttgaaggaggctggggagaggcttgttgccgttgactttagcgcaacttggtgtggcccatgtcgcaccatccgcccttttttccacgccctgagcgtgaaacacgaggatgtcgttttcctcgaagttgatgccgacaactgcgaagaggtagttcgagagtgtgcgatcatgtgcgtccccactttccagttctacaaaaaagaggagaaagttgacgagttgtgcggagctctcaaagagaagctggaggccgtgattgccgaacttaaatag

SEQ ID NO: 28523 - DNA, 1005 bp, Artificial Sequence
  Description of Artificial Sequence: Synthetic coding sequence
atggctgcctctggatccgggatggcgcagaagacgtgggaattagcaaacaatatgcaggaggcccagtccatcgatgagatttacaagtacgacaagaaacagcaacaggagatcttggctgccaagccttggacgaaggaccaccactacttcaaatactgcaagatctctgcactggccctgctcaaaatggtgatgcatgccagatccggcggaaatctggaagtgatgggcctcatgctcggcaaggtagacggtgagacaatgattattatggacagtttcgccctcccggtcgagggaacggagacccgagtcaacgcccaggccgcagcttacgaatacatggccgcttacatcgaaaacgccaagcaagttggcagactcgagaacgccattggttggtatcactcgcacccaggctatggctgctggcttagtggcattgacgtgagtacacagatgctgaatcaacagttccaggagccattcgttgcagtggtgattgacccaacaagaactatttccgccggtaaggttaacctgggcgctttccgaacttaccccaagggttataaacccccagacgagggaccatcagagtaccagactatcccactgaataagatagaagactttggagtgcattgcaaacaatactacgcactggaagtatcatactttaagtccagccttgatcgcaagctgctggagctcctgtggaataaatactgggttaatacactaagcagcagtagtctgctcacaaatgccgattatacgacaggccaagtcttcgatctgtctgagaaattagagcaatctgaagcccagctcggtagagggtcattcatgctggggttggagacacatgatcgcaaaagtgaagataaactggccaaggccacccgcgattcttgtaagacaactatagaggcaatccacgggctgatgtctcaggtaatcaaagacaaacttttcaaccagatcaatattagttag

SEQ ID NO: 28524 - DNA, 1350 bp, Artificial Sequence
  Description of Artificial Sequence: Synthetic coding sequence
atggtcatggagaagccgagtccactgctagttggtcgtgagtttgtgaggcagtactacactttactgaacaaagcaccagagtatctgcaccggttttatgggagaaacagttcctatgtgcatggtggggtcgacgcttcaggcaaaccccaagaggcagtgtatggccagaacgacattcatcacaaggtgctttcactcaacttctcagagtgtcacaccaagatcaggcatgtggacgctcatgcgacactgtcggatggcgtggtggtgcaggtgatggggctgctgtccaatagcggacagccggaacgcaagtttatgcagacatttgtgttagcacccgagggctcggtgcctaacaagttttatgtgcataacgacatgtttcgttacgaggacgaggtgttcggcgactccgagcctgagctggacgaggaatcggaggatgaagtcgaagaggagcaggaagaacgacagcccagccccgagcccgtgcaagaaaacgccaattctggatattacgaagcgcacccagtgacaaatggcatcgaggagccactcgaggagagctcacatgagcccgaacctgaaccagagtctgaaacaaaaacagaggaattgaagccgcaagtcgaggaaaagaatctggaagagctcgaagagaagagcacaacaccgccaccggcagagccagtctccctcccccaggaacccccaaaacccagagtagaagcgaagcccgaggtgcagagtcagcccccaagagtgcgggagcagcgcccacgggagagacctggattcccacctcggggacctcggccaggacggggtgatatggaacagaatgattctgacaaccgtcgaattatcaggtatcccgactcccaccagctgttcgtgggcaacctccctcacgacattgatgagaatgagctcaaagagttcttcatgagctttgggaatgtggtcgaactgcgcattaataccaaaggcgtgggtggtaagctgccgaacttcggatttgtggtgttcgacgacagtgaacctgtacagagaattctgatagctaaacccatcatgttccgcggagaggtccgtttgaacgtggaagaaaaaaaaaccagagcagcccgagaacgagagacccggggaggtggcgacgaccgcagagacattcgacgtaacgatcgtgggcctggcggaccacgagggatcgtgggtgggggaatgatgagggatcgagatgggagggggcctcccccaagggggggaatggcccagaagcttggatccggtcgcggtaccggacagatggagggcaggtttactggacaacgccgttag

SEQ ID NO: 28525 - DNA, 333 bp, Artificial Sequence
  Description of Artificial Sequence: Synthetic coding sequence
atggaagagatacctgcgcaagaagctgcaggttcaccgcgagtgcagttccagagcttagaaacacagagcgaatgcctctccccagagccacaattcgtccaggacacagatatggagcaaggactgacaggcggtatcttgttacggctgcccactacccggattcactcagtgaatagttgccccgcactgagccacactcaggcctctgcattttccggggaaaccctggcagtgttgaccgctggcatctccaagagatggccaaagtaccgtctgccaatcgacatcgccaggccctgtagtgaaaccccctttccacgcttgtag

SEQ ID NO: 28526 - DNA, 822 bp, Artificial Sequence
  Description of Artificial Sequence: Synthetic coding sequence
atgggccagaaagttaccggcggaatcaaaacggtagacatgcgcgacccaacctatcgtccactgaagcaggaattgcaaggcctggattattgcaaaccaacgaggctggacttgctgctggatatgcctcctgtcagttacgacgtgcagttgctgcattcctggaacaataacgacaggtcgctgaacgttttcgttaaggaggatgataagttaatattccatagacacccagtggctcagtcgacagacgctatccgcggaaaggtaggttatacaagagggctgcatgtgtggcaaataacttgggccatgcgacagagaggaactcacgccgtcgtgggggtagccaccgcggatgcaccattacacagcgtcggctatactaccttggttggaaataatcacgagagctgggggtgggacctcggcagaaaccggctctatcatgatgggaaaaatcagccatccaagacatatccagcctttctcgaaccagatgagactttcattgtgcctgattccttcctggtggcccttgacatggatgatgggactctgtctttcatcgtggatggccagtatatgggggtggctttccgaggacttaaggggaaaaaactctacccggtggttagcgcagtatggggccattgcgagattaggatgaggtatctgaacggcctagatcccgagcccctcccactaatggacctctgcaggcgaagcgtacggctggccctgggcagagaaagactcggcgaaatacacaccctgcccctccctgctagcttgaaggcatatctgctgtatcagtag

SEQ ID NO: 28527 - DNA, 2916 bp, Artificial Sequence
  Description of Artificial Sequence: Synthetic coding sequence
ctcagccggagagtaccctgtgtaaggaggggatgtcggcctcctctgcctcctctaccaggatctcagagtcgggcttggagcagagacagagaagcccctttagaccccggtaggccggctcagtctggacgtaggcccacttctcgcagcgtgtctcatgcttgcagctggaacgggggatcattagacccactggaaggaaccccagcccttttgaggtccgccgagcggctgatgcggaaagtgaagaaactgcgccttgataaggagaacacaggtagttggaggtcatttagtctgaatagcgaaggggcagagaggatggctaccaccgggacccccaccgctgacagaggggatgcagctgccacggacgacccggctgctcggttccaggtgcagaagcacagctgggacggacttaggtctatcatccatggcagtagaaagtatagcggactgatcgtgaacaaggccccacatgattttcaattcgtgcagaagacggacgagagcgggcctcactcccaccgactgtactacttaggcatgccctacgggtcacgcgagaatagtttgctctactcagagatacccaagaaggtgcgtaaagaagcactcctgctactgagttggaagcagatgctggaccacttccaggccacaccacaccatggcgtgtattcccgcgaggaggagctgctccgagagcgaaaacgcttaggcgtgttcggcatcacgagctatgatttccacagcgagagcggactgtttctgttccaggcctccaacagtcttttccactgtagagatggaggcaagaatgggtttatggtttcccccatgaaacctttggaaatcaaaacacagtgctccggacctagaatggacccaaagatctgcccggctgatcccgcttttttttcgttcatcaacaattccgacctgtgggttgccaatattgaaaccggggaggagaggaggctcacattctgtcaccagggcctgagtaacgtgctggatgacccaaagagcgctggagtggccacatttgtgatccaggaggagttcgacaggttcaccggttactggtggtgcccaacagcgtcttgggaggggtctgaaggactgaagacactcagaatcctgtacgaagaggtggatgaaagcgaagttgaggtcatccatgtcccgtcgcccgcacttgaggagcggaagaccgacagctacagatatccaagaacaggtagcaagaatcctaaaattgcactcaagcttgctgagttccagacagacagtcagggcaaaatcgtttcaacgcaggagaaagagctggtccagccatttagctcgctattccccaaggttgaatacattgccagggcgggatggacccgtgatggcaagtacgcttgggcaatgtttttagatcggcctcagcagtggctccagctcgtgctgctgccgccagctctgttcatcccgagtaccgagaacgaagagcagcgtcttgcctccgcacgcgctgttccccgtaacgtgcaaccatacgtggtgtatgaggaagtgacaaatgtgtggattaacgtccatgacattttctatccctttccgcagtcggagggtgaggacgagctctgcttcctgcgagccaacgagtgtaaaaccggcttctgtcacctgtacaaggtcacagccgtactcaaatctcaggggtatgattggagcgagcctttctcccccggagaagatgagtttaagtgcccgatcaaggaagagatcgctctgaccagcggagagtgggaagtgctcgcaagacacggcagcaagatctgggttaacgaagagaccaaattagtttacttccagggcaccaaggacacccccctcgaacatcacctctacgttgtttcttatgaagccgcaggtgaaattgtacgtctgacgacacctggatttagccacagttgcagcatgtcccaaaatttcgacatgttcgtctcacactattctagtgtctccacacccccttgcgtgcacgtatacaagctcagtggtcccgacgatgaccctctccataagcagcctaggttctgggcctccatgatggaggcagcatcgtgtccccctgactacgtccccccagaaatctttcacttccatacgcgaagcgacgtgcgtctgtacggcatgatatacaaacctcacgctctacagccaggcaagaaacatccaactgtgttgttcgtgtacgggggtccgcaagtgcagctggttaataatagcttcaagggaataaagtacctcaggcttaacacgcttgctagcctgggctacgctgtagtggtgatcgacggcagaggatcctgtcagcgaggcctccggttcgagggggcactgaagaaccaaatgggtcaggtggagattgaggatcaggtggagggcttgcagttcgtggctgaaaagtacgggtttattgaccttagccgggtggccattcatggatggtcctatggtgggttcctgtctctgatgggcctgattcacaaaccacaggttttcaaggtggccatcgccggagctccagtgaccgtctggatggcctatgatactgggtacacagaacggtatatggacgtccctgagaataaccaacatggatatgaggccggaagcgtcgcactgcacgtggagaagctcccaaacgaacctaacagactgctgatccttcatggctttctggacgaaaatgtgcacttttttcacacgaatttcctggtgtctcagttgattcgggctggaaaaccctaccaattgcagatatatccgaatgagagacattccattagatgccctgagtcaggcgagcactatgaggtgaccctgttgcattttttacaggagtacctgtag

SEQ ID NO: 28528 - DNA, 2592 bp, Artificial Sequence
  Description of Artificial Sequence: Synthetic coding sequence
atgggcaatagagagatggaggaacttattccgctggtcaacagacttcaagacgccttctcagctctgggccagagttgcctcctggagctgccacagatcgccgtggtcgggggacaatctgctggtaagagttccgtattggagaacttcgttggcagagactttctaccaagaggcagtggcatcgtgacaaggcgacctctggttctccagttagtcacttctaaagcggagtatgctgagttcttacactgcaaagggaaaaaatttacggattttgatgaagtcaggctcgagatcgaagccgagaccgatagagtgaccggcatgaacaagggaatcagctctatcccaatcaacctgcgagtttatagccctcatgtgttgaacttaaccctgatcgatttaccgggaataacaaaagtccctgtgggagaccagccaccagatattgagtaccagattcgggaaatgataatgcaatttatcaccagggaaaattgcctcattttggccgtgactcccgcaaacacagaccttgccaactctgatgcattgaaactcgctaaggaggtggacccccagggactccgcactattggggtcattactaagctggacctcatggacgagggtacagacgcacgcgatgtactcgagaacaaattgctccccttacggcgaggttacgttggggtcgtgaatagatcacagaaggatatcgacggaaaaaaagatattaaagcagcaatgctcgccgaacgcaagtttttcctatctcatcctgcctatcgacacatcgccgaccgaatgggaactccccacctccagaaggtgctgaaccagcagctgacaaatcatattcgggacacactgccaaattttagaaataagcttcagggtcaactgctatccatcgagcacgaggtggaggcttataagaactttaaaccggaagatccaactcggaagactaaggcattgcttcagatggtgcagcagttcgccgtagactttgaaaagagaatcgagggatctggggaccaggtggatacactagagcttagcgggggagctaaaattaaccggattttccacgagcgcttcccattcgagattgtgaagatggaatttaatgagaaggaacttaggcgtgagatttcgtacgccattaaaaatatacatggaatccgcacggggctgttcacacccgacatggcatttgaggctattgtaaaaaagcagatcgtcaagctcaagggtccaagcctgaagagtgtcgatctggtaatacaggagctgataaacactgtgaagaaatgtacaaagaaattggcaaacttcccaagactgtgtgaggaaacggaacgtatcgtggccaatcatattcgcgagagggaagggaagaccaaggaccaagttctcttgctgatcgatatccaggtttcttacatcaacacaaatcacgaagacttcatcggctttgctaacgcacaacagcggtcctctcaagtgcacaagaaaacaacggtcgggaatcaggttatccgaaagggttggttgacaatctcaaatatcgggattatgaaaggtggcagcaagggctattggttcgtcctgactgccgagtcactctcttggtacaaagacgatgaagagaaggagaagaaatatatgttgccattagacaacctgaaggtccgtgacgtcgaaaagtctttcatgtcctccaaacacatattcgccttatttaataccgaacaacggaacgtttacaaagattatcgctttctggaactggcttgtgacagtcaggaggacgtcgatagctggaaggcatccctgctccgtgcaggggtttatccggataagtctgtcggcaataacaaagctgagaacgatgagaacggccaagccgagaatttcagcatggatccgcagctggagcggcaggtcgaaactatccgaaacttggtggattcttacatgagtatcattaataagtgtattcgagaccttattcccaagaccatcatgcacctgatgataaacaatgttaaggattttatcaacagtgaattactggcccagctgtattctagcgaggatcaaaatacccttatggaagagagtgcggaacaggcccagagaagagatgagatgctgaggatgtaccaagcccttaaagaggccctcgggatcattggtgacatctccaccgccaccgtttcgaccccagcaccacctcctgtggacgatagttggatccagcactcacggagatcaccccctcccagcccaaccacacaacggcgaccgactctgtccgcacccctggccagacccactagcggaaggggaccagcccctgctatccccagccctggcccacattccggagctcctcctgttccatttcggccaggcccattgcctccgtttccttcaagctcagactcctttggtgcgcctcctcaagtgcctagtcgcccaaccagagcaccccctagtgtgcccagccgcaggccacctccctctcccacccggcctacgatcataagaccacttgaaagcagtcttctggactag

SEQ ID NO: 28529 - DNA, 1263 bp, Artificial Sequence
  Description of Artificial Sequence: Synthetic coding sequence
atgctaaaggctgtgatcttaatcgggggaccacagaaaggcaccaggttccggcctctctctttcgaggtacccaaacctttattccctgtggccggtgtgcccatgatccagcatcacatcgaagcctgcgcccaggtgccgggtatgcaggagattctccttatcggtttctaccagccagacgagcccctgactcaattccttgaggctgctcagcaggagttcaatctgccagtccgctacctccaggagttcgccccacttggcacaggaggaggcctgtaccattttcgggaccagatactggctggctctcccgaagctttctttgtgttaaacgccgacgtatgttccgattttcccctcagcgccatgctggaagcccaccgcagacaaagacaccctttcctgcttctgggcacaaccgcaaatcgcacacagtcattgaattatggatgtatcgtggaaaatccacagacccacgaagttctgcactacgtagagaagccctcaacttttataagtgatatcatcaattgcggcatctacttgttcagccccgaggccctcaagccgctgagggacgtatttcagaggaaccaacaggacggtcagctcgaggattctcctggcctgtggcccggtgctgggacaatcaggcttgaacaggatgttttttctgcactggccggacagggacagatctacgtccacctgactgatggtatatggtcacaaatcaagtcagctggatctgcactctacgcaagtcgcctctacctgtcaaggtatcaggatactcatccagaacgccttgcaaaacacacacccggagggccttggattcgaggtaacgtatacatccatcctaccgccaaagtggccccatcagccgtactggggccaaatgtcagcattggtaagggcgtgacggtgggagaaggcgtgagactgcgggagtccatcgtcctgcacggcgctacgctgcaagaacacacctgtgtgctccactccatcgtcggatggggatctacggtggggagatgggcccgagtggaaggtacacccagcgacccaaacccaaacgatcccagagcgagaatggacagcgaaagcttgtttaaagacggaaagctgcttccagcaattactatcctcggctgtcgtgtccgaattcctgccgaggtcctgattctcaactccatcgtgctgccccacaaggagctctcacggtcgtttacaaatcagatcattctctag

SEQ ID NO: 28530 - DNA, 2481 bp, Artificial Sequence
  Description of Artificial Sequence: Synthetic coding sequence
atggttgctcccgtcttggagacatcccacgtgttctgttgtccgaaccgagttaggggtgttctgaactggagcagcggacctagaggcctgctagcgttcggcacatcttgttcagtggttctttatgaccccctgaaaagggtggtggtgacgaatctgaatggccacacagctcgggttaactgcatccagtggatctgcaagcaggacggctcaccctcgaccgaattagtgtctggcggatcagacaaccaagtgattcactgggagatcgaggataatcagctgctgaaggcggtgcatctgcagggccacgagggaccagtgtacgcggtgcacgcagtttatcagcgtcgcacgtccgacccggctttgtgcactcttatcgtgtccgccgctgccgatagtgctgtgcgcctttggtcaaagaagggcccagaggtcatgtgcttacaaactctcaactttggcaacggctttgcactcgctctgtgtctgtcatttcttcccaatacagatgttcccatcctggcgtgtggaaatgacgattgccggatccacattttcgcacaacagaatgatcagtttcagaaggtactctcattgtgcggtcatgaagactggatccggggagtggagtgggccgcttttggccgagatcttttcctcgcatcttgctctcaggactgtctgatccggatttggaaactgtatattaaatccacatcgcttgagacccaggatgatgacaatatcaggctgaaggaaaatacattcacgattgaaaacgagtccgtgaagatcgcatttgccgtgactctggaaacagtgctagccggacatgagaactgggttaacgccgtgcactggcagccagtattctataaggatggcgtgctccagcagccagtccgcctgttaagtgcctctatggacaaaacaatgatcctgtgggcacctgatgaggaatcaggcgtgtggctagagcaggtgcgagtaggggaggtgggtgggaacaccttggggttctatgactgtcagttcaacgaggacggtagtatgattatcgcccacgctttccacggggcactccacttatggaagcaaaataccgtcaaccctcgcgaatggaccccagagattgtgatcagtggacacttcgatggggttcaggacctggtatgggatcccgaaggagaatttatcatcacagtcggcaccgaccagacaactagactttttgcaccatggaagcgcaaagaccagtcccaggtgacatggcacgagatagccagacctcagatacacggatacgatttaaaatgcctagctatgatcaaccgctttcagttcgtttccggagccgatgaaaaggttctgcgggtgttcagtgctccaagaaacttcgttgagaacttttgcgctattaccggccaaagccttaatcatgtactctgcaaccaagattctgaccttccggaaggtgccacggtgcctgctcttggactgagtaacaaggcagtgtttcagggcgacattgcgagtcagccatctgatgaggaggagcttctcacatccaccggttttgagtaccagcaggtggcattccagccgtccatactcacggagccaccaaccgaagaccatcttctccagaacacattgtggcccgaggttcaaaaattatacggacatggctatgagatattctgcgtaacatgcaactcctcaaaaacccttctggcttccgcctgcaaagcagccaagaaggagcacgccgcaattatcctgtggaacacaacatcttggaaacaggtgcaaaatctggtctttcattccctgacagtgacccagatggccttctctcccaacgaaaagttccttctagctgtgtcaagagacaggacctggagcctgtggaagaaacaggatacaatcagccctgaattcgagcctgtgttttccctgttcgccttcaccaataagataacatcagtgcactccagaatcatatggtcgtgcgattggtctcccgatagcaagtactttttcacaggcagtcgagacaagaaagtcgtcgtctggggtgagtgcgactcgacagacgattgcatcgagcataatatcggaccttgctccagcgtgctggatgttggtggcgctgtcaccgcagtgtccgtgtgtcctgtcctgcatcctagtcaaagatacgtcgtggctgtgggtttggagtgcgggaaaatttgcctgtatacttggaagaaaaccgaccaagtgcccgagatcaatgactggacacattgcgtggaaacttctcagagtcaaagtcacacgctggccattcgcaaactgtgctggaaaaactgtagcggtaagactgaacagaaggaggcagaaggtgccgaatggttacactttgcctcatgtggcgaggatcacacagtgaagatccaccgggtgaacaaatgcgccctgtag

SEQ ID NO: 28531 - DNA, 1152 bp, Artificial Sequence
  Description of Artificial Sequence: Synthetic coding sequence
atggacagaacttgtgaagagaggcctgctgaagacgggtccgacgaggaagacccagactccatggaggcgcctactaggattagggacacccccgaggacattgtgctggaggctcccgcatcggggttagctttccatccagcacgcgatctgttggccgcaggcgacgtcgatggggacgtctttgtcttctcttactcgtgccaggaaggcgagacgaaggaactgtggagctcaggccaccacctcaaggcctgccgagccgtggcattttccgaggacggccagaagttaattaccgtctcaaaggataaagccatccatgtgttggatgtggaacaggggcagctcgagagacgcgtcagcaaagcacacggagcgccaattaactcactgctcctcgtggacgaaaatgttctggctacaggggatgacactggtggaatctgcttgtgggaccaaaggaaggaagggccactgatggatatgcggcagcacgaggaatacatagccgatatggctctggaccctgccaagaagctcctgttaacggctagcggggacggatgtttggggattttcaatatcaagcgacggagatttgagcttttatccgaacctcagtccggagacctgactagtgtgacactgatgaaatggggcaaaaaagtggcctgtggtagctctgagggcactatctatctgtttaactggaacggttttggcgctactagcgacaggttcgccctccgagccgaatctattgactgtatggtccccgtcaccgagtctctcctgtgcactggatccactgacggtgtgatcagggccgtgaatatcctaccgaaccgtgtcgtggggagcgtggggcagcacacaggtgagcccgtcgaagagctggctctgtcacactgtggaaggttcctcgcatccagcgggcatgaccagagactgaagttctgggacatggctcaattgagagccgtggtagtggatgattaccgcaggcgcaagaagaaggggggaccactcagggcccttagcagtaagacatggtccaccgatgacttcttcgcaggactgagggaagaaggggaggattccatggcgcaggaggagaaggaggagacgggagacgactcggactag

SEQ ID NO: 28532 - DNA, 999 bp, Artificial Sequence
  Description of Artificial Sequence: Synthetic coding sequence
atgtctgaggctggggaggaacagccaatggagactactggcgcaacagaaaatgggcacgaggctgtgcctgagggcgaaagcccagcaggtgccggaactggggctgcagcaggggctggcggagctacggccgcacctccctctgggaatcagaatggtgctgagggtgaccaaattaacgcttccaagaacgaggaggacgcgggtaagatgtttgtgggaggcttgtcatgggatacaagcaagaaggatttgaaggattattttaccaagtttggcgaggtggtggattgcaccattaaaatggaccccaacactggcagaagtaggggatttggattcatcctgttcaaagatgccgctagtgtggagaaggtcttggaccagaaagaacatagattggatggacgtgttatcgatcctaagaaagccatggctatgaaaaaggatcccgttaagaaaattttcgtggggggtctcaacccagaggccactgaagaaaagatcagagagtacttcggagagtttggggagatcgaggcgatagaactccccatggacccaaaactgaacaaaagacgtggtttcgtgtttatcaccttcaaggaggaggagccagttaagaaagtgctcgaaaagaaatttcacaccgtttccggaagcaagtgtgagataaaggttgcacagcctaaggaggtgtaccagcagcagcagtatggaagcggtggcagaggaaatcgcaacagagggaatcgtggcagcggaggcggagggggtgggggaggccagtcacagtcctggaatcagggatacggtaattactggaatcagggatacgggtatcaacagggctacggccctggctacgggggatacgattattctccttatgggtattatggctacgggccagggtacgattactctcaggggagcaccaactatgggaagagccagagacgaggcggtcatcagaataattacaagccatattag

SEQ ID NO: 28533 - DNA, 2745 bp, Artificial Sequence
  Description of Artificial Sequence: Synthetic coding sequence
atgggtgattctcgcgacctttgcccacaccttgattcaatcggagaggtcacaaaagaggatttacttttaaagagcaaaggcacatgccaatcatgtggcgttaccgggccaaatctttgggcttgcttgcaggtggcctgtccctacgtgggttgtggagagtcgtttgccgatcacagcacaattcatgcacaggcgaaaaagcataatttgactgtgaatctgaccactttccggctatggtgctatgcctgtgagaaggaagtgtttctggaacagagactggctgctcctttgctgggcagctcctcgaagttcagcgagcaagactcccctccgccttctcaccctcttaaagccgttcccattgctgttgccgatgagggagagagtgagtcggaggacgatgacctgaaacctcgcggacttaccggtatgaagaacttggggaatagttgctacatgaatgccgctctgcaggcgctctccaactgcccccctttgacgcaatttttcctggagtgcgggggtttggttaggaccgacaaaaagcctgccctgtgcaagtcgtaccaaaaactggttagcgaagtgtggcataagaagcgtccctcatacgtggttcccaccagtttatcccacggaatcaaattggtaaacccaatgttcaggggctacgcccaacaggacactcaggaattccttagatgcttgatggatcaattacacgaggagctgaaggaaccagtagtcgctaccgttgcattgactgaggcaagggactcagactcatccgataccgatgaaaaaagagagggtgaccgtagcccttctgaggacgaatttctgagttgtgactccagcagtgacaggggggagggggacggccagggaaggggcggaggatcctcacaggcggagaccgagctgctgatccccgacgaagcgggtcgagcaatcagcgaaaaggaaaggatgaaggaccgcaagttcagctggggccagcaacgaacaaactcggaacaggttgatgaagacgctgacgtcgacacagctatggcggctctggacgatcagcctgcagaggcacagcccccttctcctcgatctagctcaccatgccgaactcctgagcctgataatgacgcccacctgcggtcgagctccaggccatgcagcccagtccaccatcacgaagggcatgccaagctaagtagctcgcccccaagagccagcccggtcaggatggccccttcttacgttcttaaaaaagcccaggtgctgtctgcagggtcaaggagaaggaaggagcagagatacaggagcgtgatcagcgacatcttcgacgggagcatcctgagccttgttcaatgcttaacgtgtgaccgagtgtcaacaactgtggagacttttcaggatctgtctctgccaattccgggtaaagaggatcttgcaaaactccattcagccatttaccaaaatgttccagccaaacctggggcttgcggtgactcctacgccgcacagggatggttggcgttcatagtcgaatatatccggaggttcgtggtgtcttgtacgccttcttggttttggggcccagtggtcacgctggaggattgtctcgctgccttttttgctgccgatgagctcaaaggcgacaacatgtattcttgcgaaaggtgcaagaaactccggaacggagtgaaatattgcaaggtgctgagactcccagagattctgtgtatacatcttaagagattcaggcacgaagtcatgtactcttttaagatcaatagccacgtgagcttcccactcgaaggccttgatctgaggcccttcttggccaaagagtgtacatcccagatcacaacttacgacctgttgtccgtgatttgtcaccatgggactgcaggatccggccactacatagcttactgccagaatgtgatcaatgggcaatggtacgagttcgatgatcagtacgtgactgaggtgcacgaaacggtggtgcaaaacgcagagggttacgtgttgttttaccgcaaaagcagcgaagaagcgatgcgtgagcggcaacaggttgtgtccctcgccgcaatgcgcgaaccgagccttctccgcttctacgtgtccagggagtggcttaataagtttaatacctttgctgaacccggacccataacaaatcagacgtttctgtgttcacatggcggtatcccccctcacaaataccattatatcgacgatctggttgtgatcttgcctcagaacgtgtgggaacacctgtacaatcggttcggaggcggtccagcagtgaatcacctctatgtgtgctctatttgtcaagtggaaattgaagctctggctaagagacgtcgcatcgaaatagatacctttattaagctgaataaagcattccaagctgaagaatcccccggagtaatatactgcatctctatgcagtggttcagagagtgggaagccttcgtcaaagggaaagataatgaaccccctgggcctatcgacaactcgaggattgcccaggtgaaaggctccggacatgtgcagcttaaacagggcgcagattatggccagatttctgaagaaacctggacctatttgaactcactgtacggaggaggcccagaaatcgctatccggcagtccgtagctcaaccattggggccagaaaatctgcatggagaacaaaaaatcgaagctgaaacgcgcgcagtgtag

SEQ ID NO: 28534 - DNA, 2772 bp, Artificial Sequence
  Description of Artificial Sequence: Synthetic coding sequence
atggccgcttctacggggtatgttagattgtggggagccgcacgatgctgggtgctgagacggcctatgctggcagccgcaggaggccgagtaccgacggccgctggcgcttggcttcttagagggcaaagaacctgtgacgccagtccaccatgggctttgtggggacggggtccagccattgggggaagtgccggagccggtgaggggcctgtgattacggctctgactcctatgacaatcccagacgtctttccgcacttacccttgatcgccatcacccgcaatcctgtctttccccgttttattaaaataattgaagtgaagaataagaaactcgtagaacttctgcggcgtaaggtccggttagcccaaccttacgtgggggtattcctgaagagggacgacagcaatgagtccgacgttgttgagagcctagatgagatttatcacacaggaacatttgcccagatacacgaaatgcaagatctcggagataaacttcgaatgatcgtgatgggacataggagagtgcatattagtcggcaattggaagtcgaacctgaggagccagaagctgaaaacaaacacaagcccaggcgaaagtccaagagaggaaagaaagaagcggaggatgaactatccgccaggcatccagccgagctggccatggagcccacgcccgagctgccggctgaagtgctgatggtggaggtcgaaaacgtggttcatgaggatttccaagttactgaagaagttaaggcgctgaccgctgaaattgtgaaaacaattcgcgatattattgcactgaatccactatacagagagtctgtgctgcagatgatgcaagcaggacagcgtgtcgtggataaccctatctatctgtcagacatgggtgcagccctaacgggtgccgaatctcacgaactacaggacgtcctcgaagagactaacatcccgaagagattgtacaaggcactgtccctgctcaagaaggaatttgagcttagtaagcttcagcagagactagggcgagaggtcgaagaaaagatcaaacagacgcatcggaagtacctcctgcaggagcagttgaagattatcaaaaaggagctgggcttggagaaagacgataaagacgcgatcgaggaaaagttcagggagagactaaaagagctggttgtgcctaaacacgtgatggatgtggtcgacgaagaactgtctaagcttggcttactggataaccacagttctgagttcaatgtgactcggaactatttagattggctgacaagtataccttggggtaagtattccaatgagaatctcgacctggcccgagctcaggccgtgcttgaggaagatcactacggtatggaagacgtgaagaaacgtatcctggagtttatcgccgtgtcacagctgagggggagcacacagggaaagatactctgtttttacgggccacctggtgtaggaaaaacctccatagcaaggtctattgccagagcactcaatagagagtattttcgattttcagtcggcggtatgactgacgtggcggaaattaaggggcatcggaggacatatgtcggtgcgatgcccggtaagatcatccagtgcttaaagaaaaccaagacagagaatcccttaatactgatagacgaggttgacaagatcgggaggggctaccagggcgaccccagcagtgccctcctcgagcttctcgatcctgagcagaacgccaactttcttgatcattatttggatgtgccagtagacctgagcaaggtgctatttatctgcactgctaacgtgaccgacacgatccctgagcccctgcgcgatcggatggagatgataaacgtttccggctacgtggcccaagaaaagctggccattgccgagagatacctggtcccacaggccagagctctctgtggattggatgaatctaaagcaaagttgtcgtcagatgtgctaacattgctgatcaagcagtactgtagggagtctggcgtacggaatctgcaaaaacaggtcgagaaagtgttgaggaaaagtgcttataagatcgtttcaggagaagccgagtctgtcgaagtgacccccgaaaacttacaagattttgtggggaagcccgtgttcacggttgaacgtatgtacgatgtgactcctcccggagtggttatgggactcgcttggacggctatgggcggtagcactttgttcgtagaaacaagcctgagaaggccacaggacaaagacgctaagggcgataaggatggttctctcgaagtgacaggccagctgggagaagtaatgaaggagagcgccaggattgcttatacctttgcgcgtgcgtttctgatgcagcacgcacccgctaatgactatcttgttaccagccacatccacttgcacgtgcctgagggcgctacaccgaaagacggcccttcggccggatgtaccatagtgacggcgctactgagcctagcaatgggtaggccagtccggcagaatctggccatgaccggggaagtgtcactgaccggaaagatcctgccagtgggcggaattaaggaaaagacgatcgcagccaaacgagccggagtcacttgtatagtcctgcccgcagagaacaagaaagacttttacgacttggcagcctttataacagaagggcttgaggtgcattttgtggagcactaccgggagatttttgacatcgcttttccagacgaacaagccgaggccctggctgtggagaggtag

SEQ ID NO: 28535 - DNA, 681 bp, Artificial Sequence
  Description of Artificial Sequence: Synthetic coding sequence
atgggcccactacccaggactgtggaactgttctatgacgtcctgtcaccttattcctggttaggtttcgagatactgtgccggtaccagaacatttggaatatcaacttgcaactgagaccgtccctaataaccggcataatgaaggattcgggaaacaagccccctgggctgctaccgagaaaggggctctacatggctaatgacctgaagctcttacggcaccacttgcagatccctatccattttccgaaagatttcctcagcgtgatgctcgaaaaagggtctttgtctgccatgcgattccttactgcagtgaatctcgagcaccctgagatgctggagaaagccagtcgtgagctgtggatgagggtctggtcccggaacgaggacatcaccgagccacaatccatcctggccgcagccgagaaggctggaatgagtgccgagcaggcgcaggggttgttggaaaagatcgcaaccccgaaggtcaagaaccagttgaaagaaaccacggaagctgcttgcaggtatggtgccttcggattacccatcactgttgctcatgtggatggtcagacacacatgttattcggcagcgatagaatggagctgctcgctcaccttctcggcgagaaatggatgggcccaatccccccagctgtgaacgcccgactctag

SEQ ID NO: 28536 - DNA, 2055 bp, Artificial Sequence
  Description of Artificial Sequence: Synthetic coding sequence
atggaggctaaccacagcgaacagctcagcgctgaacgacaatcgactccacctggggacagttctagtctgcctagccataatggattggagaaggaggacggccaagatagccccacacccgtgcagcctcctgaaaaggaggcttccgtgcaccctgatatctccgaagaactcaacaggcagttggaagatattatcaacacttacggctccgctgcttcgactgcgggtaaggaaggaagtgcgagggcgtcggagcagcctgaaaatgcagagtcaccagataacgaggacggtgattgtgaggagaccacagaggaggccggaagagagcccgtagcctccggagagccacccaccgttaaagagccagtgtctaacaaggaacaaaagctcgagaaaaaaattcttaaggggttaggaaaggaggcaaatctgctaatgcagaatcttaacaagctgcaaactcccgaagaaaagttcgatttcctgtttaagaaatatgccgaacttctcgatgagcaccgaaccgaacagaagaaacttaaacttctacaaaagaaacaagtgcagatacaaaaggaaaaggaccagctgcaaggagagcacagccgcgctattctcgccaggagtaagttagaaagcctctgccgcgagctgcagcggcacaataaaactctgaaggaggaagctttgcagcgggcaagggaagaagaagagaagcgtaaagaaatcactagccatttccaatccacattgacggacatccagggccagattgaacagcaaagcgaaaggaatatgaaactctgccaagagaacacagaactggccgagaagctgaagagtatcatcgaccagtatgaactgcgagaagagcacctcgacaagatttttaagcaccgcgaactgcagcagaaactggtcgatgccaaactcgaacaggcacaggaaatgatgaaagaggctgaggagcggcataagagagagaaagaatacctgctaaatcaggcagctgagtggaagttgcaggctaaagttctgaaggagcaggagacagtgctgcaggctcagctgaccctttacagcggcagattcgaggagttccaatcaacgctcactaagtctaatgaggttttcgctactttcaaacaagaaatggacaaaaccaccaaaaaaatgaagaaattggaaaaggacacggccacctggaaggcacggtttgaaaattgtaataaggcactattagacatgatcgaggaaaaggccctcagggcaaaagagtacgagtgcttcgtgatgaaaatcgggaggttggaaaatctctgtcgagctctgcaggaggagcgcaatgagctgcataaaaagattagggatgccgagatatccgagaaggatgaccaatcccagcacaactcagacgaggagcctgagagtaacgttagcgtggatcaggagatcgacgccgaggaggtgaatagcgttcagaccgcggtaaagaatctggctaccgcatttatgattattcatcatcccgaatccacccctcatcagtccaaagagacacagcccgagatcggctctagtcaagaaagtgcagatgccgctctcaaggaaccagagcagccaccgctcatccccagtcgggactcggagtcccctctgccacctctgacaccccaggccgaggccgaagggggaagtgatgctgagccccctagtaaggcttctaattcacctgccggactgggggctgagacccagtgcgaggggttgcctgtcggcgctcaagctgaccaggcatcctggaaaccagaggccgaggcctcgggccaggccccacaggcaccaaccgaagcttctcttcagaaaatggaagcagacgtgccagcaccggcatgtgccgctgaggagcatgtggctgccatggtcccagcctgcgaaccgtctagacagcctccaagggccgcagccgaagagcttcccgttggcgctagcgcgggaccacagcctagaaacgtggccgatactaacttggaaggggtggattag

SEQ ID NO: 28537 - DNA, 1461 bp, Artificial Sequence
  Description of Artificial Sequence: Synthetic coding sequence
atgaacggcacgctggaccaccctgaccaaccggatctggacgcgattaagatgtttgtgggtcaggtgccaagaacatggtctgagaaggacctcagagaacttttcgaacagtacggcgcagtgtacgagattaatgtgcttcgggaccggagccaaaacccccctcaatccaaaggctgctgttttgttacattctatactcgtaaagccgcactggaggcccagaatgccctgcacaacatgaaagtgctccctggaatgcaccatcctatccaaatgaaacccgctgatagcgagaagaacaacgcagtagaggatcggaaactctttatcggaatgatctcaaagaagtgtacggagaacgacattcgtgtgatgttttcttccttcggccagatcgaggagtgtaggatcctgagaggacccgatggactttcccgtgggtgtgccttcgtcacctttacaactagagccatggcacagaccgccataaaagcgatgcaccaggcgcagactatggagggatgttcttcccctatggtagtgaaattcgctgatacccaaaaagacaaagagcagaagcggatggcccagcagctgcagcagcaaatgcagcagatctccgctgcctcagtgtggggcaaccttgccggtctgaacaccttaggaccacagtatctagcattgtacctccaacttctacagcagactgccagctcaggaaatcttaatacactaagcagtctccatcctatgggcggtctgaatgccatgcagttacagaacctcgccgcactggctgcagccgcatccgctgcccagaatacaccgtccgggaccaacgctctgacgacttcatccagcccgctctctgtcctgacatcatcaggctcatctccttcaagttcatcctcaaattctgtcaaccccatcgccagtctcggggcactccagaccctcgcgggagctactgcaggcctcaatgtcgggagccttgccggtatggctgcgctgaacggtggactgggcagctctgggctttctaacggaacggggagcacaatggaagctctcacacaagcctactccggtatccaacaatacgccgctgccgcactgcctactctgtataaccagaacttgctcacccagcagtccatcggcgctgctggaagccagaaagaaggccctgagggagctaacctgttcatttaccatctgcctcaggagttcggtgatcaggacctgctgcaaatgtttatgccctttggaaacgttgtttcagcaaaagtattcatagataaacaaaccaatctgtcaaagtgttttgggttcgtcagctacgacaaccctgtcagtgcacaggctgcaattcagagcatgaacggcttccaaatcggaatgaaacggctgaaggtgcagctgaaaagatccaaaaatgacagtaaaccctactag

SEQ ID NO: 28538 - DNA, 7811 bp, Artificial Sequence
  Description of Artificial Sequence: Synthetic coding sequence
atggagaaagctacagtccccgttgcagctgctaccgccgctgagggagagggatcccccccagctgtggccgcagtcgccggtccgcctgcagccgctgaggtcggaggtggagtgggaggctcctcacgggcacggagcgccagctctcctagaggcatggtgcgcgtgtgtgacctgcttctgaagaaaaagccacctcaacagcagcaccacaaagcaaagcgcaacagaacctgcaggccaccctcatcctctgagtcctcatccgatagcgataactctggcggtgggggaggcggaggcggtggcggtggcggtggaggcggtacatcaagtaataattctgaggaagaagaggacgacgacgacgaggaggaggaagtgtccgaggtagagagcttcatattagatcaggacgatctggagaatccgatgttggaaacggcctccaaactgctcttatctggcaccgccgatggagccgatttacgcaccgtggatccagaaactcaggcacgcctggaggctttgcttgaggccgctggtattggaaagctgtccacagccgacggcaaggctttcgccgaccccgaggtgctaagaaggttgacatcctccgtaagttgtgccttggatgaggccgcagcggctctaacgaggatgagggctgagagcactgccaatgcagggcagtcagataatcgatccctcgctgaagcctgttctgaaggagatgtgaacgctgtgcggaagctcctgattgaggggcgttcggtgaacgaacacacagaagaaggggaaagcctcctgtgcctggcctgctctgccggatattacgaactagcccaggttctgctggcaatgcacgccaatgtcgaggaccggggaatcaaaggcgacattacacctctgatggcagctgccaacggcggacacgtaaagatagtgaagcttctcttggcccacaaagcagatgttaacgctcagagctccacaggaaacactgccctgacttatgcctgcgctgggggatatgtcgatgttgtgaaggtgctgctcgaatccggcgcatcgatcgaagaccataatgagaacggtcacacccctctcatggaggctggctccgccggacacgtggaagttgcccgacttctgctagagaacggagctggcatcaatacgcacagcaacgagttcaaggaatcggctctcaccctggcatgctataagggacaccttgaaatggtgcgcttcctgctagaggccggagctgaccaggaacacaagaccgatgagatgcacactgcactgatggaggcctgtatggatggacatgtggaagtggctcggctactgcttgacagcggggcacaggtaaacatgccggcagactcatttgaatctccgctaactctcgcggcatgtggcggtcacgttgaacttgccgctcttttgatcgaacgtggggcatctcttgaggaagtgaacgacgagggctatacccccctcatggaggccgctcgcgaggggcacgaggaaatggtcgccttattgctggggcagggggcaaacataaacgcacaaaccgaagagacccaggagacagctttgacactagcatgttgcggaggttttctggaagtggccgactttctcattaaagccggagccgatatcgagctcgggtgcagcacaccacttatggaggctgcgcaggaagggcatctcgagcttgttaaatacctcttggccgcaggtgccaatgtacacgccactaccgccaccggcgacactgccctgacttatgcctgtgagaacggtcacaccgatgtggcggatgtcctgctgcaagcaggcgcagacctggaacatgagtccgaaggagggagaaccccactgatgaaagctgctagagccggacacgtctgcacggttcagttcctgatcagtaagggagctaacgtcaaccgaacgacagcaaataatgaccacacggtactcagcctcgcctgcgccggaggtcatcttgcggtcgtagagctactcctcgctcacggcgcagatccaacccacagactgaaagacggctccaccatgctgattgaggctgctaaagggggacacacaagtgttgtttgttacttgctggactacccaaataacctgttgtccgctcctccccctgatgtgacgcagcttacgcctccaagccacgatctgaaccgggcacccagggtgcccgtccaggcactgcccatggtggttcctccgcaggagccagataaaccgcctgccaacgtggccaccacactgcctatccggaataaggccgctagcaagcagaagagttcttctcacctgcctgcgaattcacaagacgtgcagggatacattacgaatcagagccctgagagcatcgttgaggaagctcagggaaagctcacggaactggaacaacgtattaaggaagctattgagaagaatgcacagctacaaagtctcgagctggcacacgccgaccagctcaccaaggagaagatcgaagagctgaacaagactagggaagaacaaattcagaagaagcaaaagatcttggaagagctccagaaagttgaacgagagctgcagctcaagacccagcagcagctaaagaagcaatatctagaggtaaaagctcagcgcatacaattgcagcaacaacagcagcagtcctgccagcacctcggactgttgacacctgtaggcgtgggagagcagttatctgagggtgactatgctaggttgcaacaggtggacccagtgttacttaaagacgaacctcagcaaaccgcagcccagatgggattcgctccaatccagccgttggccatgccccaggctctgcccctggcagcagggccactcccacccggaagcatcgcaaatctgacagagctgcaaggcgtcatcgtgggacagccagtgttgggacaggcacaactggcgggactcgggcaggggattcttacagagacccagcaaggcttgatggtggcctcccccgcacaaaccctcaacgacaccctagatgatattatggccgctgtaagcggcagggcctctgcaatgagtaatactcctactcattcgatagcagcatcaatctctcaaccccagacacctaccccatcccccatcattagcccctcagccatgctgcccatatatcctgcaatcgacatagacgcgcagaccgaaagtaatcacgatacagctttaacactagcttgcgctgggggacacgaagaattggtgcagaccctgcttgagcgaggagcttcaatcgaacatcgagacaaaaagggatttacacctctgatcttggccgcaacggcgggacacgtcggggtggtagagatacttctggataacggagcagatattgaagctcaatccgaaagaaccaaagacactccactgtccctggcgtgctctgggggacgccaggaggtagtggagttactactggcacgaggagcgaacaaagagcaccgcaacgttagcgattatacccccttgtcgctggcggcttctggagggtacgtcaatataatcaaaatactcctgaatgctggggcagagatcaacagtcgcaccggttccaagctaggtatatccccgctgatgctcgccgcaatgaacggacacactgctgctgtgaagctactgctcgatatggggtcggatataaatgcacaaattgaaacaaaccggaacacagccctcacccttgcatgctttcagggcaggaccgaagtcgtaagtctgctactcgaccgaaaggccaacgttgagcatcgggctaagacgggtttgacccctcttatggaggccgcatccggaggctatgccgaggttggtagagtcctgctcgacaagggcgctgacgtgaatgcacccccagtgccttcctctagagacacagcgttgaccatagcagcagataagggacactataagttctgcgagctgcttatcggacggggagcccatatcgacgtgcgtaataaaaagggaaatactcccttgtggctggccgcaaacggcggacacctggacgttgtccaactcctagtgcaagcaggagctgatgtcgacgcagctgacaaccgcaagatcaccccccttatggctgcctttcgcaaaggacacgtcaaagtcgtgcggtacttggtgaaggaagtgaatcaatttccatcagactctgaatgcatgcggtacatcgcgactattaccgataaggagatgctgaagaaatgtcatctgtgcatggagagcatcgtccaggccaaggaccggcaggccgcagaggctaacaaaaatgcaagcatcctgcttgaagagctcgacctcgagaaactgagggaagagagccgacggcttgctcttgcagctaaacgagagaagcgtaaggagaagagacgcaagaaaaaggaagaacagcggcgaaagctggaggagatcgaggccaaaaataaggagaattttgagcttcaggcggctcaggagaaagaaaaacttaaagtggaagacgaacctgaagtactgaccgaacccccttctgccacgacaaccacaaccattgggatatccgcgacttggactactcttgccggatcacatggcaaaagaaataacaccatcaccacaacttcgtctaaacgcaaaaaccggaaaaataagatcacgcctgagaacgttcagataatctttgacgacccactgcctatttcctattctcaacccgagaaggtgaatggcgagtccaagtcatctagtacatccgaatccggtgatagcgataatatgagaatctcctcctgttcagatgagagctcaaattctaattcctcccggaagagcgataaccacagtcctgccgtggttactactaccgtttcttccaagaagcagccctccgtgctggtcacctttccgaaagaagagcgtaagagcgtttctggaaaggcaagcataaagcttagcgagacaatctccgagggcacctccaacagcctctcaacctgcacaaaatctggtccctcccccctgtcctctcccaatgggaaacttaccgtggctagcccgaagcgtggtcaaaaaagagaggaaggttggaaagaagtcgttcgacggtcaaagaaagtgtctgtgccatctaccgtaatatcaagggtaataggacgcggtgggtgtaacatcaatgccataagagagtttaccggagctcacattgatattgataaacagaaagacaagacgggcgacagaattattacgatacgtgggggtaccgagagtacgcgccaggctacgcaactgataaatgccctgatcaaagatcctgataaagaaatcgatgagcttattcccaagaataggctgaaatcctcatcagcaaactcaaagattgggtccagcgctccgaccactactgccgcaaacactagcctgatggggatcaagatgaccaccgtggcgctctcctctacgagtcagaccgcaaccgccttgacagttccagcaatttctagtgcctcaactcacaagaccatcaaaaaccctgttaacaatgtgcggccaggattcccagtatccctgcctctcgcctatcctcctccacagttcgcccatgccttgcttgccgcacagacgttccagcagattcggccacctcgattgcctatgacccacttcggaggtacgtttccacccgctcagagcacatggggcccattccctgtacgaccattgtctccagcgcgagccaccaactcacctaagccccacatggttccccgacattccaatcagaattcctctggctcccaggtgaattctgccggaagcctgactagtagtcccactaccaccaccagctcctcagcctcgacagttccaggcacctctacgaacggatctccgtcaagcccatccgttcgcagacaactttttgtgacagtggtcaagactagtaacgctaccacaaccacagtgaccacaactgcttcgaacaataacactgcccctaccaacgccacatatcccatgcccaccgccaaggaacactaccccgtgagttctccctcatcacccagccctccggcacaacccggaggcgtgtcccggaacagccctctagactgtggctccgcgtcgcccaacaaggttgccagtagctcggagcaggaggccggttccccgccagtggtcgagaccactaatacacgtccccctaactcttcgtcttctagcggatctagcagcgcccactcaaatcaacagcagccgcctgggtcggtgtcccaggaaccgagaccccctttgcagcagtcccaggtcccaccaccagaggtgaggatgactgtaccaccactggctacaagcagtgcccctgtcgcagttcccagtactgcacctgtgacttatccaatgcctcagactcctatgggatgcccacagccaaccccgaaaatggagactccagcgatccggccaccgcctcacggaactacggctccccacaaaaatagcgcgtctgtccaaaactcatccgtggccgtgctcagtgttaaccacattaagagaccacactcagtgccttcatctgtgcagcttccgtctaccctctccacgcagagtgcgtgccaaaactctgtccaccctgccaataagcctattgcacccaacttttctgcgcctctgccttttgggccattttctaccctatttgaaaattcacctacctccgcgcacgccttctgggggggaagtgtcgtgtccagccagagcacaccagagagtatgctctccggaaagagctcttatctccccaatagcgatcctttacaccagtccgacacgtccaaagctcctgggttccggcctcctttgcaaaggcccgctccatctccatccggcatcgtgaatatggattccccttacggtagcgtgacccctagctccacacacctaggaaattttgcatctaacatctcaggaggtcaaatgtacggcccaggagcacctctggggggagctccagccgcagccaattttaaccggcagcacttctcgccactgtcacttctcacaccttgtagtagcgcgtctaacgattcatccgcacaatcagtatcttcgggagtaagagcgccaagccctgctccatccagtgtccctttgggcagcgagaaaccaagcaatgtgtctcaggatcgaaaagtgcctgtccctataggaaccgaaagatcagctaggattcgacagaccggcacctccgctccttccgttatcgggtcgaacctttccacttctgttggacattccggcatttggtcgttcgagggcatcggaggtaatcaggacaaagttgattggtgtaatcccggaatgggcaaccccatgattcatagaccaatgtccgatcccggagttttcagccaacaccaggcaatggaaagagactcgacaggcatcgtgacgccctctggcaccttccatcaacatgtgcctgccggttacatggatttccccaaggtaggtgggatgcctttctccgtatacggtaatgccatgatccctcccgttgctccgattccagacggggcaggtggtcccattttcaatggaccccatgccgcagacccatcctggaattcacttattaaaatggtatccagcagcacagagaacaatggtccgcagaccgtgtggactggcccttgggcccctcatatgaattctgttcatatgaaccaattaggata

SEQ ID NO: 28539 - DNA, 3075 bp, Artificial Sequence
  Description of Artificial Sequence: Synthetic coding sequence
atgaccgagggcaggcggtgtcaggttcatctcctggatgataggaagttggaattacttgtgcagcccaagcttttggccaaggagctcctcgatctcgtggcttctcacttcaatctcaaagagaaggaatactttggtatcgcattcactgatgaaacaggccacctcaactggctgcagctggatcgtcgcgtgctggaacacgacttccccaaaaaaagtggacccgttgtgctgtacttctgcgtgcggttctacattgagagcatcagttatcttaaggataatgccacaattgagctgttctttttgaacgcgaagtcttgtatctacaaggagctgattgacgtcgacagcgaggtggtcttcgagctggcctcatacatcctacaggaagccaaaggcgactttagcagcaacgaagtagtgcgctccgacttaaaaaagttgcctgctctgccaacacaggccctcaaagaacacccctcattggcctactgtgaggaccgcgttatagagcactataagaaactgaacggccagactcgcggacaagcgattgttaattatatgtccattgtcgagagcctccccacttacggtgtgcactactatgcagtgaaggataagcagggcatcccctggtggctgggtctctcgtacaaagggatcttccagtacgactaccatgataaggtgaagcccaggaagatttttcagtggagacagctggagaatctttactttcgcgagaaaaaattttcagtcgaagttcacgaccctcgcagagcgtcagtcactagacgaacattcggtcactctgggattgccgtacatacctggtatgcgtgtcccgcattaatcaaaagcatctgggcaatggccatttcccaacaccagttttacctggatagaaaacagagtaagtctaagatccacgctgccagatccctctcagagattgcgatcgacctcaccgagaccggcactctaaaaacctcaaaacttgccaacatgggttcgaaagggaaaatcatttccggatctagtggcagcctgctatcctcgggctcccaggagagtgacagctcccagtccgccaaaaaagatatgctggctgcattgaagagccgccaggaagctcttgaagaaacattaaggcagcggcttgaggagctgaagaagctctgtctgcgggaggccgagctaactgggaaactacctgtggagtatccccttgaccccggagaagagcctcccattgtcagacgcaggatcggcaccgccttcaagctggatgagcagaagatcttgcccaaaggagaagaagctgagctcgaaaggctggagcgcgaatttgcaattcagtctcagataaccgaggctgcccgacgcctcgcctctgaccccaacgtgagcaaaaaactgaagaaacaacgaaaaacatcttatctcaatgcattaaagaagcttcaggaaatcgaaaatgccatcaacgaaaatagaatcaaatctggcaaaaagcctacccaacgagcttcattaattatagacgatggaaacatcgcttccgaggactccagcctttctgatgccctggtcttagaagatgaggattcccaagtgacttccactatcagtcctctgcattcacctcacaaagggcttccaccccgtcctccctcccataaccggccaccccctccccagtccctagagggtctaaggcagatgcactatcatcgcaatgactacgataagtctcctattaaacccaagatgtggagtgaatccagccttgacgaaccctacgagaaggtgaaaaagagatctagtcactcgcactcttcatcgcacaaacgattccccagtacggggtcatgtgctgaggcaggcggagggtcaaacagtcttcaaaactcccccatcaggggcctgcctcactggaactcacagagcagcatgccttcaactcctgacctcagggtaagatctcctcattatgttcactccacacgctccgttgacatctccccaactagactgcactccctggcgctacacttccgccataggtcttctagcctggagagtcagggtaaactactgggttctgaaaacgacaccggcagccctgacttttacacgcctagaacacggtcaagcaacggcagcgatccaatggacgactgttcttcctgtactagtcattccagctctgagcattattaccctgcccagatgaatgctaactacagcaccctggccgaggacagcccttccaaggcacgccagcggcagcgacaaaggcagcgggcagctggtgccctgggctctgcttcttctggaagcatgcctaacctcgctgcaaggggtggagctgggggagccggaggcgcaggcggaggcgtgtaccttcattctcaatctcaaccctccagtcagtatcgcatcaaggaatatcccctctatatcgagggaggcgctacccctgtggtggtccgtagtctcgaatctgaccaagaggggcattattctgtgaaggcacagttcaaaacaagcaatagctataccgcaggaggcctcttcaaagagtcctggcgcggaggagggggtgatgaaggagacactggcagactcacacccagtcgctcccaaatcctcaggaccccaagcctaggaagagagggtgcacacgataaaggtgccggacgcgctgctgtgagcgatgagcttcgccagtggtatcaacgctctaccgcatcacacaaggaacactcacgactgtcccacacatcctctacatcgagcgactccgggtcacagtattcaacctctagccaatctaccttcgttgcccattcccgcgttacgcgaatgccccaaatgtgtaaggcaaccagcgcagcgctgcctcagtcacaacgaagcagcactccctcctccgagatcggcgctacacccccatccagccctcaccacatcttgacatggcaaacaggagaagcaaccgagaactccccaatactcgacggatccgaaagcccacctcaccagtccacggacgagtag

SEQ ID NO: 28540 - DNA, 864 bp, Artificial Sequence
  Description of Artificial Sequence: Synthetic coding sequence
atgtcacaagcctggtggcacacttccgtgtcccctgccacacaagaggctaaggccggtggcctgctacaacccagacgacaacgcctctggctcaagcgctgtaggatttcatctagtgcctgcgaagaccttagtgcagccttgattgctaacaagaatctgaccagaatggaccttagcggcaatggtgtaggattccctggcatgatgctgctgtgcgagggccttcgccatcctcagtgcaggctgcagatgattcaactacgaaagtgtcagctagagtccggtgcctgccaggagatggcttccgtcctcgggacaaatccacacttagtggagctcgatcttactggtaacgcactcgaggacttgggcctccgtctactctgtcaaggtcttagacatcctgtatgccgtcttcgcaccttatggctgaaaatctgtaggctcacagccgcagcatgcgatgaattggcatccacgttatctgtgaaccaatcccttcgcgagctcgatctctcgttaaacgaactcggcgacctcggcgtgctccttctgtgtgagggactgcgacatcccacatgtaagctgcaaactttaaggctggactcatgcggcctaaccgccaaggcttgtgagaacctgtattttaccctgggcataaaccagacacttaccgacctgtatctaaccaataacgcactgggcgatactggcgtgaggctgctctgcaagcgtttgtctcaccccggttgtaaactgcgggtgctctggctgtttggaatggacctgaataaaatgacccattcccggctggcggcattacgagtgacaaagccctatcttgatatcggctgctag

SEQ ID NO: 28541 - DNA, 615 bp, Artificial Sequence
  Description of Artificial Sequence: Synthetic coding sequence
atggccggttacttgtcagagagcgactttgtgatggttgaggaaggattttcaactcgggacctgctgaaggagctgacactgggcgcatcacaggctaccaccgacgaggtcgcagccttcttcgtggccgatctgggggcaattgtgagaaagcacttttgcttcttgaaatgcttgccgagagtgagacccttctacgcagtcaaatgcaactctagccctggtgtgttgaaggtcctggcgcaattgggactgggtttcagttgcgcaaataagatcgcttccgtaatcaacagtgcccttgacttgtattttccagaagggtgtggtgtggacatcttcgctgagttgggccgatattatgttacatccgcattcactgtggctgtgtcaatcattgcgaaaaaagaagttctcctggatcagcctggaagggaggaggagaatggctccaccagtaaaaccatcgtgtatcacctggatgagggtgtatatggcattttcaactctgtgctgttcgataatatatgcccgaccccaatcctgcagaagtccaaaaaccattccccatgctatatgtcgttagagtccatacacttcatagccgtttag

SEQ ID NO: 28542 - DNA, 519 bp, Artificial Sequence
  Description of Artificial Sequence: Synthetic coding sequence
atgatgaaactgaaaagcaatcagaccagaacatatgatggtgatgggtataaaaagcgagccgcatgcctgtgcttcagaagtgagagcgaggaggaggtactgttggtttccagcagccgacacccagatagatggatagtgcccggaggcggtatggaacctgaggaggaaccgagtgtggcggctgtaagagaggtctgcgaggaggccggtgtgaagggaaccctgggtcgcctggtggggatttttgaaaaccaggagcgaaagcaccggacctacgtgtacgtcctcatcgtgactgaagtcctggaggattgggaggatagtgtcaatatagggaggaagagggagtggttcaaaatagaagacgctatcaaagtcctccaatatcacaaacccgtacaagcctcctactttgagacgctgaggcagggatacagtgccaacaatggcacaccagtcgtggccactacgtattcggtgtcagctcagtcctctatgtcaggtattcggtag

SEQ ID NO: 28543 - DNA, 4284 bp, Artificial Sequence
  Description of Artificial Sequence: Synthetic coding sequence
atgtcaatgctgaagccatctgggttaaaagcccctacaaagattctcaaacctggaagcactgctttgaagactcctactgccgtggtggcacctgtggagaagactatctcatcagagaaagcttcatccacgccaagtagcgaaacccaggaggagtttgtggatgacttccgcgtgggcgagagggtgtgggtcaacggcaataagccgggttttatacagttcttgggcgagacacagttcgccccaggccaatgggcaggaatcgttctggatgagcctatcgggaaaaatgacggcagcgttgctggtgtgcgatacttccagtgtgaaccgcttaagggcatcttcaccagaccatcgaaactgacgagaaaagttcaagcagaagacgaggccaatggccttcagaccaccccggcaagccgcgcaacttcacccctctgcacatccactgcatccatggtgagtagcagcccatccactccctccaacatcccgcagaagccttctcagcccgctgccaaagagccaagcgccacacccccaataagtaatctcacgaaaaccgcttctgaaagcatcagtaatctgtcagaggccggaagtattaaaaaaggtgagcgcgagctgaaaattggcgatcgcgtgttagtaggtggaaccaaggcaggtgtagtaaggttcctgggggagacggacttcgctaagggagaatggtgcggcgtggagctcgatgaacccctcgggaagaatgatggggcagtggcaggcaccaggtattttcagtgtcagccaaagtatggattattcgcgcctgtgcacaaggtgaccaagataggttttccatccaccacccctgccaaggccaaagccaacgcagtccgcagggtgatggccactaccagtgctagtttaaaacgttccccaagcgcttctagtttatcctccatgagtagtgttgcctctagcgtttcctcaaggccaagccggactggcctgctcacggaaacatcgtccagatatgcacggaagatctccggcacaacggccctgcaggaagccctgaaggaaaaacagcagcatattgagcagcttctggcagagagagatttggagcgggctgaagttgcaaaggctacttctcatgttggggagattgagcaggagctggccttggcccgagacggccacgatcagcatgtgctggaattagaggctaagatggatcagctgaggaccatggtggaagcagctgatagggaaaaggtggaactcctgaatcagttggaggaagagaaaagaaaggtggaagacctgcagttccgggtcgaagaagaaagtattaccaagggggacctcgaaacacagactaagttagagcacgccaggatcaaggaattggaacagtccctactgtttgaaaaaaccaaagctgacaaattgcaacgcgagctggaggatacccgcgttgcaacggtgagcgaaaaatcacgaattatggaattggaaaaagatctcgcccttcgtgtgcaagaagtcgcagaactcagaaggcgccttgagtcaaataaacccgcaggtgatgtggatatgtccctttcactgctgcaggaaataagcagtttgcaggaaaaacttgaggtcactcgaactgatcaccagcgcgagataacgagcctgaaggagcattttggcgctagagaagagactcaccagaaggagatcaaggccctctataccgccactgagaaactgtctaaagaaaacgaaagtcttaagtcaaaattagagcatgcaaataaagagaactcagatgtgatcgccctttggaagtccaagttggaaactgccattgccagtcaccagcaggccatggaggaacttaaggtgagttttagcaagggacttggaaccgaaactgccgaattcgccgaactaaagacccagatcgagaagatgcgcctcgattaccagcacgaaatagaaaatttacaaaaccagcaggacagcgaaagggctgctcacgcgaaggaaatggaggcccttcgagcaaaattaatgaaggtcatcaaggaaaaggaaaattcactcgaagctattaggtcaaaacttgataaagcggaggaccagcatttggtggagatggaagatacactgaataagctccaggaggcagaaattaaggtaaaggagctggaggtcttacaggctaagtgtaacgagcaaactaaggtcatcgataactttacatcacaattgaaagcaactgaggaaaagctgctggatctcgacgcgctgcgaaaagcctcaagcgagggtaagtctgaaatgaaaaagctgcgacaacagctggaagcagcagagaagcagataaagcacctggaaatcgagaagaatgcagagtctagcaaggcctcgtccatcacccgggagctccagggacgcgagctcaaactgacgaacctccaggaaaacctgtcagaggtatctcaggtcaaggagaccctggaaaaggagttgcagatccttaaggagaagtttgctgaggccagtgaagaagctgtgtctgtgcagcgcagtatgcaggagaccgtgaataaacttcatcagaaggaagagcaatttaatatgctgtcctccgatctggagaaacttagggagaacctagcggatatggaagctaagtttagagagaaggacgagagagaagaacagctgattaaggctaaggaaaagctagagaatgatatcgcggagattatgaagatgtctggtgacaacagttcccagttgacaaagatgaatgatgaactcagactgaaggagcgggacgtggaggagcttcaactgaaacttacgaaagcgaatgaaaacgcgtcatttctccagaaaagcatcgaagacatgacagtaaaagccgagcaaagccagcaggaggctgctaaaaaacacgaggaagagaagaaagagctcgagagaaaactatccgatctggagaagaaaatggaaacaagccataaccaatgccaggagctaaaggctaggtacgagcgcgcaacatcagagacaaagactaaacacgaagaaattctgcagaacctgcagaagactctccttgataccgaagataagctcaagggtgccagggaggagaactccggacttctccaggaattagaggaactgcgtaaacaggccgacaaggctaaggcggcacagacagctgaggatgcaatgcagattatggaacagatgactaaggagaaaacagaaacactagccagcctggaggacactaagcagaccaacgcaaaactgcagaatgagctcgacaccctgaaagaaaacaatctcaagaatgtcgaagagctaaataagtctaaagagctgctcactgtagagaaccagaaaatggaagaatttagaaaggagatcgagactctgaaacaggcagccgctcagaagagtcaacaactctcagcgctgcaggaagaaaatgtcaaacttgccgaggaactgggccgttctagggatgaggttaccagccaccagaagctggaggaagagagatccgtccttaataaccaactcctggaaatgaagaagcgcgagagcaaattcattaaggatgcggacgaagagaaagcttcactgcagaagagtattagtattaccagtgccttattgacggaaaaagatgctgagctcgagaaactgcggaatgaagtgactgtactccgtggcgaaaatgcgagcgccaaatcgctacactccgttgtgcagaccctcgagtctgataaggtgaaactagagctcaaggtgaagaatctggagctgcagctgaaggaaaacaagcggcagctgtcttcgtcctcgggaaacacagatacgcaggctgatgaggatgagagggcacaggagagtcagatcgacttcctcaactccgtaattgtggacctacagagaaagaaccaggacctcaaaatgaaagtggaaatgatgagcgaagcagctctgaacggcaatggggacgatttgaacaattacgacagtgatgaccaggagaaacagtccaaaaaaaagcccaggctgttttgtgatatttgtgattgtttcgatctgcacgacaccgaggattgcccaacgcaagctcagatgagcgaagaccctccccactccactcaccatgggagccggggtgaggaacgaccctactgcgaaatctgtgagatgtttggtcactgggctacaaattgcaacgacgatgaaacgttctag

SEQ ID NO: 28544 - DNA, 1179 bp, Artificial Sequence
  Description of Artificial Sequence: Synthetic coding sequence
atgggggatagctgccccgctgtgaccttccggtcacaaaaggaaaaccgcgcagggctccaggagaaactgcgctacttacagcagcagctccaggatgagaccccgcgtaggcaagaagctgagctgcaggagcctgaggaaaagcaggaacccgaagaaaagcaagaacctgaggagaaacagaaaccagaggctggcctctcatggaactcactaggcccagctgctacctcccagggatgccctggcccaccaggatctcctgacaaaccatctaggccacatgggcttgtgccagccggatggggcatgggtccacgggctggagaagggccttatgtctcagaacaggagctccaaaagctgttcactggtattgaggagctcagaagggaggtatcctctctgactgcaaggtggcaccaggaggagggggctgttcaggaggcattgagactccttgggggacttggaggtagagtcgatgggttccttgggcagtgggaaagggcccagcgggagcaggcccagactgcccgagacctccaggaactgagagggagagccgatgagctgtgcaccatggttgagaggtctgctgtgagcgtggcctctcttagaagtgagctcgagggtttgggccctctcaaaccaatcctcgaagaatttggtagacagttccaaaatagccgtagggggcctgacctgagcatgaacctggacagaagtcatcaggggaactgcgcgagatgcgcctcccaggggagtcagctatctaccgaatccctgcagcagctcctggatcgggctttgacaagcctggtggatgaagtaaaacagagaggcttaacacccgcttgcccaagctgtcaacggctccacaaaaaaatcctcgaattggaaagacaggcactcgccaagcacgtaagagcagaggcgctttccagcactctgaggttagcccaagatgaggcactacgtgctaaaaacttgctcttgactgacaagatgaaacccgaggagaaaatggccacactggatcatctgcacttaaagatgtgctcactgcatgaccatctatctaacctcccacttgagggttcgactggcaccatgggcggtggatcttcagccggaactcctcctaagcagggcggttccgcacccgaacagtag

SEQ ID NO: 28545 - DNA, 1692 bp, Artificial Sequence
  Description of Artificial Sequence: Synthetic coding sequence
atgagtgatgatgcaggggacactctagcgacaggtgacaaggccgaggtcaccgaaatgccaaactccgactcgctgcctgaggatgccgaagtacactgtgactccgcagcagtctcccacgagcctacccctgcagaccctaggggagagggtcacgaaaatgcagccgtccagggcgcaggcgcagcagctataggacccccagttcaacctcaggacgctaatgcactggaaccgccactcaatggtgacgttaccgaagacacgctggccgagtgtattgacagtgtgtccctagaggccgagccaaggagtgagattcctctgcaggaacagaattacctcgcagtcgattcgccgccatctggagggggatgggccggatggggctcctgggggaaatccctcctgagctctgcaagcgctacagtggggcatggactaacagccgtgaaggagaaggcaggtgcaacactcaggattcatggcgtgaactccgggtcaagcgagggggctcaacctaatacggagaatggagttcccgagatcacagacgcagccaccgaccaggggcctgctgagagcccgcctacgagtccctcttctgcaagtaggggcatgctcagcgccatcactaacgttgttcagaataccggtaagtccgtgctgactggaggacttgacgctttggagtttataggaaagaaaaccatgaacgtcctcgccgaatctgatcctggctttaagaggactaagacactaatggagcggacagtgtctttgagccaaatgctccgcgaggctaaggagaaggaaaaacaaagattagctcaacaactgactatggaacggaccgcccactacgggatgctgttcgacgaatatcaggggctgtcgcaccttgaagcgcttgagattctcagcaatgaatccgagagcaaggtccagagttttctggcgtcactggacggtgaaaaattggagctgctaaagaatgatctgataagcatcaaagatatttttgccgctaaggaattagagaatgaggaaaaccaagaagaacagggactggaagaaaagggtgaggagttcgcgagaatgttaactgaactgctctttgaactccacgtggccgcaacccctgataagctcaataaggccatgaaaagagcccacgactgggtggaggaggaccagacagtggtgagcgtggacgtggccaaagtgtccgaggaagaaacgaagaaggaggaaaaggaggaaaaatcacaggatccacaggaagataaaaaagaggagaaaaagaccaaaaccatcgaggaggtgtacatgtcttctatagagagtcttgcggaggttactgcgaggtgtatcgagcagttgcataaggtggccgaactaattctccacggccaggaggaggaaaagccagctcaggatcaggccaaggttctcatcaaactgactacagcaatgtgtaatgaagtggcttcactgtccaaaaagttcactaactcacttactaccgtgggatccaataaaaaggcggaggtgctgaatccaatgattagctctgtattgctggaagggtgcaactccaccacatacattcaggatgcatttcaactcctgctccccgtgttgcaagtgtcacatatccaaactagttgccttaaggctcaaccatag

SEQ ID NO: 28546 - DNA, 1257 bp, Artificial Sequence
  Description of Artificial Sequence: Synthetic coding sequence
atgttttctcccgatcaggagaaccaccccagcaaagcgccagtcaagtatggagagcttatcgtgctcggttataatgggagcctccccaatggtgatcggggaagaaggaaaagccgttttgccttgtttaaaaggccaaaggctaacggagtaaaaccatcaactgtccacatagcatgcactccccaagccgctaaagccatctctaataaggaccagcactctatatcctacactctttcccgggcacagaccgtggtcgtggagtacacccacgactccaataccgacatgttccagatagggagatcgacggaaagccctattgattttgtcgttacagatactgtccccggatcacagagtaattcggacacacagagtgtacaaagcactattagccgttttgcatgcagaatcatctgtgaacgtaatcccccttttacagctaggatttatgccgctggttttgactcatccaagaacatctttctgggggaaaaggccgctaagtggaagacatcagatggtcagatggatggcctgaccacaaacggagttttggtaatgcacccaaggaacggtttcacggaagactctaagcccggtatctggcgcgagatcagcgtttgtggcaacgtgttttcactgagggagacccgctccgctcagcagcggggaaaaatggttgaaatcgaaactaaccaattacaggatgggagtctgatcgatctttgcggcgctactctcctctggcgtacagcagaagggctgagtcatacccctactgtgaaacatttggaggcccttcgacaggagattaacgctgcccgtccccagtgcccagtcggcttcaatacgctcgcgttcccttccatgaaacgtaaggacgtggttgacgagaagcagccatgggtgtaccttaactgcggacacgtgcatgggtatcacaattggggtaacaaggaggagagagacggtaaggaccgggagtgtcctatgtgtcgatctgtaggtccatatgtgccgctgtggttggggtgtgaagccggtttctatgtcgacgcgggtcctccgactcacgccttttctccctgtggacacgtgtgttctgagaagaccacggcatactggtctcagatccccctgccacacggcactcacacatttcacgccgcatgcccattttgtgcgcatcagcttgcgggtgagcaaggatacatccggttgatcttccagggccctctggattag

SEQ ID NO: 28547 - DNA, 3963 bp, Artificial Sequence
  Description of Artificial Sequence: Synthetic coding sequence
atgcaggacgattccatcgaagccagtacctcaatcagccagcttttaagagagagctacctggccgaaacacgacatcggggtaacaacgagcggtctagggccgagccgtccagcaatccctgtcattttggctcaccctctggtgccgctgaaggcggtggaggccaggatgatctgcccgacctctccgcgtttctgtcacaggaggaactagacgaaagcgtgaatttggctagattggctattaactacgatccactggagaaagccgatgaaactcaggcccgaaaacggctgagcccagaccagatgaagcacagccccaacctgagcttcgagcccaatttttgccaagataatcccaggtctcccacgtccagcaaagagagtccacaggaggctaagagaccacagtactgttcggagactcagagcaagaaggttttcctgaacaaggccgcagacttcatagaggaactgtccagccttttcaaaagccattcatccaagagaatccggccacgcgcatgtaaaaatcacaagtccaagctcgagagccagaacaaagtgatgcaagaaaacagttcaagcttttcagatcttagcgaaagaagggagagatcatcagtcccaattccgatacccgctgacacccgagataatgaggttaaccatgctctggaacaacaggaggccaagcgacgggaagccgagcaggccgcaagtgaagccgctggaggcgataccacacccggttcctcccccagctctctctattatgaggagccattagggcaaccaccaagatttacacagaagcttaggagccgagaagttccggaaggaacacgggttcagctggattgcatcgtagtcggaatcccaccccctcaagtgaggtggtattgcgaaggaaaggaattggaaaacagcccagatatacatatagtccaggcagggaatctccactcactaaccatcgcggaggctttcgaggaagacactggaaggtactcatgcttcgccagcaatatctatggcacagactccacaagcgcggagatctacatcgaaggcgtctccagttccgacagtgagggagaccccaataaggaggaaatgaatcggattcagaagccaaacgaggtatcatccccgcctaccacatccgccgtaatcccacccgcagtgccccaagcccaacatctggtggcgcaaccacgggtggctaccatccagcagtgccagtcgcccaccaattacctgcagggccttgacggcaagccgattattgccgctcccgtctttactaaaatgctgcagaatctatctgcatctgagggacagctggtcgtcttcgagtgcagggtcaagggggcaccgtccccaaaagtggaatggtatcgagaaggtaccctaattgaagactcacctgatttccgcatcctgcagaagaagcctagatctatggccgagcctgaagagatctgcactctggttatcgctgaagtatttgccgaggactctggatgttttacctgtacagcatccaacaaatacggaaccgtttccagcatcgcacaattacacgtcagaggcaacgaggatctttccaataatgggtcattgcacagcgcaaactcaacaaccaatttagctgccatcgagccacagccttcccccccacatagcgaaccccctagcgtggagcagcccccaaaaccaaaattggagggcgtgctggtcaatcataacgaacccagaagtagctccagaataggcctgagagtgcatttcaatctcccggaagatgacaaaggaagtgaagcgtcatccgaagctggcgtcgtcacaactcgacagaccagacccgattctttccaggaacgtttcaatggccaagccaccaagacacctgaaccatcatcccccgtgaaagaaccccctcctgtactcgccaagcctaagctggattcaactcagcttcaacagctccacaaccaggtccttctcgagcagcaccagttgcagaatcctcctccgtcatcccccaaagaatttcccttctcaatgactgtactgaacagtaacgcacctccggctgttacgacttcaagcaagcaagtgaaggccccatccagccagaccttctcactcgcacggcctaagtattttttcccttccactaacacaaccgctgccacggtcgccccttcaagcagcccggtgttcaccctgtcaagcacaccccagaccattcagcggacagtgtccaaggaaagcctgctagtttcccacccctctgttcagaccaaatcccccggaggtctgtctattcagaatgaaccgttgcctccgggtcctacggaaccgacccccccaccattcactttcagcattccgtccgggaaccagtttcagcctcgatgcgttagccccattcccgtgtcccccaccagccggatccagaaccccgtggccttcttaagctccgtgcttccgtcactgccagccatcccccctaccaatgctatgggacttccaagatccgcaccctctatgcctagtcagggcttggctaagaagaatacgaagagtcctcagccagttaacgatgataatatcagagagactaaaaacgcagtgatccgcgatctgggtaagaaaatcactttttcagacgtccgacccaaccagcaggaatacaagatttcttcatttgaacagaggttgatgaacgaaatagaatttcgattagaaaggacccccgttgacgaaagcgacgatgagatacagcatgacgaaatccccaccgggaaatgcatcgccccaatatttgacaaacggttgaaacacttccgcgtaaccgagggttcgccggttacatttacgtgcaaaatcgtgggaatccctgtgcctaaggtgtactggttcaaggatgggaagcaaatcagtaaaagaaatgaacactgcaagatgcgccgagaaggggacggaacctgttctttacatattgagagcactacaagcgacgatgacggcaactacaccataatggccgctaatccacagggacggatttcctgcagtggacaccttatggttcagtctctgcctatccgttctcggctgaccagcgctggccagtcacacagaggcagatctagggttcaagagcgggataaggagcccttgcaggaaaggttttttcgaccccatttcctgcaggcccctggggacatggttgcccacgaaggaagactctgcagactagattgcaaagtttccgggctgccgcctcctgaacttacatggttgctgaatggtcagccggtgctaccagacgcttctcacaaaatgttagtgcgcgagaccggcgtccactctctgctcattgaccccctgactcagagagacgccggtacctataagtgcatcgccactaataaaaccggtcaaaactcattttcattggagttatccgtggtagcgaaagaggtgaaaaaagcaccagttatactggaaaagctccagaattgtggggtacctgagggccacccagtgcggcttgaatgcagggtcattggaatgcctcctcctgtcttctactggaagaaggacaatgaaacgataccttgtaccagagagagaatctccatgcatcaggacaccactggatatgcttgtctgctgatccagcctgcaaaaaaatccgatgccggatggtacaccctgtccgctaaaaacgaagccggaatcgtgagctgtactgctcgcttggacatctacgctcagtggcatcatcagatcccgccacccatgtccgtccgccctagtggctctcggtacggcagtctcacaagcaaggggttagatattttttctgcgttctctagcatggagtccaccatggtgtattcttgttcaagcagatcggtagttgaatcagatgagctgtag

SEQ ID NO: 28548 - DNA, 4206 bp, Artificial Sequence
  Description of Artificial Sequence: Synthetic coding sequence
atggcatcttgcgcatctatcgacattgaagatgcgacccaacatttgagagatatcctaaagctggatcggccagccggtggtccaagtgccgaaagtcctcggcctagctccgcgtataatggggacttgaatggcttgctcgtgccagacccactgtgcagcggagattctacatctgcaaacaaaactgggctccgaaccatgccacccatcaacctgcaagaaaagcaggtgatttgcctttccggtgatgacagttcaacctgtatcggaattctcgccaaagaggttgaaatcgtcgcctctagcgactccagtatctcatctaaggcccgtgggagcaacaaggtcaagatccagcctgtggccaaatatgattgggaacaaaaatattattacggaaatttaatcgctgtcagcaattcatttttggcttacgctattcgcgcagctaataacggttccgctatggtccgcgtgatcagcgtgagcacatccgagcggacgcttctgaaggggttcaccgggtcagtagcagacctggctttcgcgcacctaaattcaccccagctggcctgcctcgatgaagccggaaacttgttcgtctggcgactggcattagtgaatggcaaaattcaggaagagatcctggtccacatccgccagccagagggcaccccacttaatcatttccggcgaattatctggtgcccttttattccggaagaatcagaggactgttgtgaggagagctcacccaccgttgcgctattacacgaggacagagcagaggtgtgggatctcgatatgctgcgatcttctcactccacatggccggttgatgttagtcaaataaagcagggcttcatagtggttaagggtcactccacatgcctgtcagagggtgccctaagccccgatggaaccgtgctcgcgacggcctctcacgatgggtacgttaagttctggcaaatctacatagagggtcaggacgagcccaggtgtctgcatgagtggaagccgcacgacggtcgacctctctcttgtctcctattctgtgacaaccacaagaaacaggaccctgatgttcctttttggaggttccttatcaccggagcagaccaaaatagagaactgaagatgtggtgtactgtgagttggacctgcctgcaaacaattcgatttagcccagatatatttagttctgtgagcgttccaccatctctcaaggtttgcctagatctgtcagctgagtatctgattttgagcgacgtgcaaagaaaagtcctatatgtaatggaactgctccagaatcaggaggagggtcatgcatgctttagcagcatttctgagtttttattaactcatcctgtcctgagctttggcattcaggtcgttagccgatgtcggctccgacatactgaggtcctgcccgctgaagaggaaaatgacagcttgggcgcagatggcactcatggtgccggagcgatggagagtgcagcaggcgtcctgatcaagctcttctgtgttcacaccaaggcactgcaggacgttcagattcggttccagccacagctgaaccctgacgttgtcgcaccactccccacgcatacagctcacgaggacttcacctttggggagtcacggcctgagttggggtctgaaggcttgggatctgcagcacatggttcccagcccgacctcagaagaattgtggagctcccagctccagcagacttcctctctctgtccagcgaaactaagcctaagctgatgacaccagatgccttcatgacacccagcgccagcttacagcagattaccgcctccccaagttcaagcagcagtgggtcttcttctagctcatccagttccagcagctctctgacagcagtcagcgctatgagttccacttccgcggtggatcccagcctgacaagaccaccagaggagctgacactgagcccaaagctccaactggatggcagcttgacaatgtcttcttctgggtccctgcaggcgtcaccacggggtctgttacctgggctgttaccagccccagctgacaagctgacccctaagggtcctggacaagtgcccaccgccacttccgccctcagtctggaattacaggaggtggagcctctgggtttgccccaggcatcccctagtaggacgaggagccctgacgttatctcctctgctagtaccgctctgagtcaagatattccagagatcgcctcggaggccttgagcagaggcttcggatccagcgctcccgaagggcttgagccagattccatggccagcgcagcatccgcactgcatctcctcagtcccagacctcgcccaggtccagagttaggtccacagcttggcctggacgggggaccaggcgatggtgataggcacaacacacccagtctgctggaggcagcgttaacccaagaggcaagtacaccggattctcaagtctggcctacagccccagatattactagggagacatgcagcacgctggccgagagtcccagaaacggactgcaagaaaaacataagagtctggcctttcatcgcccaccttatcatctgttgcaacagcgcgactcacaggacgctagtgccgagcagtcagaccatgacgacgaggtggcctccctggcttctgctagcggtggcttcggcaccaaggtgcctgcacccagactacccgctaaagactggaagaccaaggggtctccgagaaccagtccgaaattgaaaaggaagagcaagaaggatgacggagatgcagcaatgggctccaggctgaccgaacaccaggttgctgagcctccggaggactggcctgctttgatctggcagcagcaaagagaactagcggagctgagacattcccaggaggagcttctgcaaagactgtgcactcagctggaaggacttcagtctacagtgaccggccacgttgagcgtgccctggaaacgcggcacgaacaagagcagagacgtctagagagagcccttgcagagggtcagcagaggggaggccagctgcaggagcaattgactcagcagctgtcgcaggctctctccagcgctgttgccggtcggctagagagatcaatcagggacgaaatcaagaagaccgtccccccttgcgtttctcggtccttggaacctatggcaggccaactctccaacagcgtcgctacaaagctcaccgcagtcgaggggtccatgaaggaaaacatttcaaagctcctcaaatccaagaacttgactgatgccattgcgagggccgcagcagacaccctgcaggggcctatgcaggctgcctatcgcgaggcattccagagtgtagttttaccagccttcgagaaatcttgccaggccatgtttcagcagatcaatgacagctttcggcttggcacccaggaatacttacagcagctggaatcccatatgaagagtcggaaggccagagagcaggaggcgcgtgaacccgtgttagcccagcttagaggtttggttagtactcttcagtctgctacagaacagatggccgcaacagtggccggatctgtgcgcgctgaagtacagcaccagctccacgttgccgtcgggtcattgcaagagagcatcttggcccaggtccagcggatcgtcaagggggaagtgtctgtggctctaaaggagcagcaggcagccgtaacatcttcgatcatgcaggcaatgcgatcagcagcagggaccccggtgccatcagcacatttggactgtcaggcacagcaagcacacatactccaactgcttcagcaaggccacctgaatcaggcattccagcaggccctaacagcagccgatcttaacctggttctctacgtgtgtgagacggttgatccggcacaggtgtttggccagccgccttgccctttgtcccaaccggtgctgttaagcctgatccaacaactggcaagtgacttagggacccgtacggatttgaaacttagttatcttgaggaagcggtgatgcacctcgaccattctgatcccataactagagaccacatggggtccgtgatggcccaggtacgtcagaagctgtttcagtttctgcaggcagagccccacaactctctcggaaaagccgcacgccgactttcactgatgttgcacggactggttacccctagcttgccatag

SEQ ID NO: 28549 - DNA, 576 bp, Artificial Sequence
  Description of Artificial Sequence: Synthetic coding sequence
atgtctagcggagccgatggagggggaggggcagctgtggccgctagaagcgataaggggtcccctggcgaagatggctttgtgccatcggcattgggcactagggaacattgggatgcggtatatgaaagagagctgcagacctttcgcgagtatggcgacacgggcgaaatatggttcggggaagaaagtatgaatagactcatccgctggatgcagaagcataagattccactcgacgcctcagtgctggatataggaactggaaacggagtcttcttggtggaattggctaagttcggattcagtaacatcactgggatagactacagtccttctgctatccagctttcagggtccattatcgaaaaagagggcctttctaacattaagctgaaagtcgaggatttcctgaacctcagtacacagctcagtggtttccatatttgcatcgacaagggcacattcgacgcaatctctttaaaccccgacaacgctatcgaaaagcgtaagcagtacgtgaaatctctgtcacgggtcctgaaggtgaaagggttcttcaacaacgtcatgtag

SEQ ID NO: 28550 - DNA, 2622 bp, Artificial Sequence
  Description of Artificial Sequence: Synthetic coding sequence
atgggaaatagagaaatggaggagctgatccctctggtcaatagactccaggatgctttctccgcactgggccagtcatgtctgctcgaactgccccagattgctgttgtgggaggtcagagtgctggcaaatcttccgtcctcgagaactttgtgggcagagactttctgccaaggggatccggcattgtgaccagaagaccattagtactccagctagtcacatcaaaagccgaatacgcggaatttctccactgcaagggcaagaagttcacagattttgatgaggtcagactggagatcgaagcagaaaccgaccgcgtaaccggaatgaacaaaggaattagctctattccaatcaaccttcgggtgtactctccccatgtcctaaacctgacactcattgatttgcctggtatcaccaaggtcccagtaggagaccagccaccagatatcgaatatcagattcgtgaaatgatcatgcaatttatcacacgcgaaaattgtcttattctggcggtaactcccgcaaacactgacctcgccaacagtgacgctcttaaacttgccaaggaggtggatcctcagggcctccgaacaatcggcgtcattacaaaactcgatctgatggacgaaggcaccgatgcaagagacgtgcttgagaacaagctcctgcccttgcggagaggttacgtgggggtcgtgaaccgctctcagaaggatatagacggtaagaaagacatcaaagccgctatgttagccgagcggaagttctttttatcccacccagcttatagacacatcgcggaccggatgggcaccccgcatctgcagaaggtgctcaaccagcagctgaccaatcacatccgggataccctgcctaattttaggaataagttgcagggtcaacttctgagcatcgagcacgaggtcgaagcctacaagaacttcaagccagaagatcccaccaggaagacaaaggcactgttgcagatggtgcaacagtttgcagtcgatttcgaaaagcgcattgagggcagcggtgaccaagtggatacactagagctctctggaggagcaaaaataaaccgcatctttcacgagaggtttccatttgaaattgtgaaaatggagttcaacgagaaagaactgaggagagagatttcgtatgctattaagaacatacacggcattcgtaccgggctgttcacccctgacatggctttcgaagccatcgtgaagaaacagattgtgaaactgaagggcccttccctcaagtcagtggatttggtgatccaggaactcataaataccgtgaagaaatgcactaaaaagctggctaattttccgagactctgtgaggagacagagcgcatcgtcgcaaaccacatccgtgaacgcgagggtaaaaccaaggaccaggtcctgctactgatagacattcaagtgtcctacatcaacaccaaccacgaagactttattggctttgcaaacgcccagcagaggtcttcgcaggtgcacaagaagaccaccgttggtaatcaggggaccaacctcccccctagccggcaaatagtgattcggaagggctggctcactatatccaatatcggcattatgaaagggggatctaagggttattggttcgtcctaaccgctgagtccttgagttggtacaaggacgatgaggaaaaggaaaagaagtacatgttacccctggacaatcttaaagtgagagatgtcgaaaagtcattcatgagctcaaagcatatctttgcccttttcaataccgagcagcgcaatgtgtataaagattaccggtttctggagttagcatgtgattcacaagaggacgtcgattcatggaaggcttctctcctgagggccggtgtgtacccagacaagtccgtgatgaacaagaaggccgaaaacgacgagaacgggcaggccgagaacttctcaatggatccccaactggaacgccaagtagagacaattcgaaatcttgttgactcctacatgagtatcattaataagtgcatcagggacctaattccaaaaacaattatgcacctgatgatcaacaatgtgaaggattttatcaacagcgaactgctggcccaattgtactccagcgaggaccaaaacaccctcatggaagaaagcgccgagcaggctcagcggagagatgagatgcttaggatgtaccaggctctaaaagaggctctcggaattatcggagacatttctactgccaccgtctcaacccctgcccctcctcccgtggatgatagctggattcagcattcaagaaggtctccacccccaagtcctacaactcagcgtagaccaaccctgagcgcgccactcgctcgtccaacatccggcagagggcctgctcccgctattccctccccaggccctcatagtggagcaccacctgtgccctttcgccctgggcctttaccgccttttccgtcatctagcgactcgtttggggcaccgcctcaggtgccaagtagaccaacacgggctccgccttctgtcccgtctcgtagacctccgccaagtccaacaagaccgaccattatacggcctctagagagttcattgctggactag

SEQ ID NO: 28551 - DNA, 3111 bp, Artificial Sequence
  Description of Artificial Sequence: Synthetic coding sequence
atgaggaaacaggaggtgcgaaccggaagggaggccggacaggggcacgggacgggatcgccagcagagcaggtgaaggccctgatggacctattggcaggcaaagggagtcaaggctcccaagctccgcaggcactggatcggactcctgacgcgccactgggcccttgctccaatgatagccgtatccagagacatcgaaaggccctcctgtccaaagttggcggtggcccagagcttgggggaccatggcaccgtttagctagccttctgctggtggaggggctgacagaccttcagctccgggagcacgactttacacaagtcgaggcaacccgtggcggtgggcatcccgcacgcacagtggctcttgatcgattgttcctgcctctgtcaagagtgtccgtgcctcctcgggtgtcaataaccataggagtggccggaatgggtaaaacaacactggtgcgccattttgtgcggttgtgggcacacgggcaggtcggcaaggatttctctctggtcctaccactgacattcagggatctaaatacccacgagaagttatgcgcagacaggttgatctgctccgtcttcccacacgtgggcgaaccgtctcttgcagtggctgtcccagctagggctctgttgatcctagatggtctggacgaatgccggaccccactggactttagtaatacagtcgcttgcactgatcctaagaaagagattcccgtagatcatctgataacaaacattatccgtggcaacctgtttccggaagttagtatctggatcacttcacgaccctcagccagtggacagatacctggagggctggtcgaccggatgaccgagattagaggcttcaacgaggaggaaattaaagtgtgtttggagcagatgtttcctgaggatcaggccctgcttggatggatgctgagtcaggtgcaggccgatcgcgctctatacctgatgtgcactgtgccggctttttgcaggctgaccggcatggcactcggccatctttggcgttccagaactggccctcaagatgctgagctttggcctcccaggactctgtgtgaactctattcctggtatttcagaatggcgctaagtggcgagggacaagagaaaggtaaggcgtcacctagaatcgaacaagttgcccatggagggagaaaaatggtcggcacacttggtcgactggccttccacgggctgctgaagaagaagtacgtgttctatgagcaggatatgaaagcatttggagtcgaccttgctctcctccagggcgcaccttgtagctgcttccttcagagagaagaaacgttggcatcaagcgtggcttactgcttcacgcacctctctctgcaggagttcgtggcagccgcatactattacggagccagcaggcgggctattttcgacctctttaccgagtccggcgtctcttggccgcgattaggctttttaactcatttcaggtcagcagcccagcgagccatgcaggcggaggacggcaggctagatgtgtttcttcggttcctgtctggcctgctttcgccacgcgtgaacgctctgctcgccggatctctccttgcacaaggtgagcatcaggcctatcggacacaggtagccgagctcctgcaagggtgtctgcgcccagatgccgcagtgtgtgctagagccatcaatgtcctccattgtctgcatgaactccaacacaccgaactggccaggagcgtcgaagaagccatggaatctggtgcgttggcacgcctgactggcccagcccaccgagcagccctggcctatttactccaagtctctgatgcctgtgcgcaggaagcgaacctctcattatctctatcccagggtgtactgcaaagtctgctcccgcagttgctgtattgccgaaagttgcgcttagatacaaaccaattccaggatcctgtcatggaactgctggggtctgtgctgtccggcaaggactgtcgtatacagaagatttccttggccgagaatcagatcagcaataagggggctaaagctctggccaggtctctcttagtgaacaggagtttgacatccctggatctaaggggcaattcaattggccctcagggagcgaaggctctcgcagatgctttgaaaatcaaccgtactcttacatctctcagtttacagggtaacacggtcagggacgatggcgctagaagcatggctgaggctctagcctccaacaggactcttagcatgttgcatttacagaaaaacagtattggacccatgggcgcacagcgtatggctgacttaaagcaaaaccgcagcctgaaagaactcatgttctcatccaactccatcggagacggaggggctaaagctctggcagaggctctcaaggtgaatcaggggctggaaagtctcgatctccaaagtaactctatttctgatgctggggtcgctgccctaatgggggctttatgcactaaccaaaccttactttccttgagcctaagagagaactctatttctccggagggggcacaggctattgcccacgctctgtgtgcaaattcaacgctcaagaatctggatctccagtggaactttatccaagccggagctgctcaagctctcggtcaggccttgcagctgaatcgtagtctcacctctcttgacttgcaggaaaatgcaatcggagacgatggagcctgtgccgttgctagagctctaaaggtcaacacagccctgaccgccttgtacctgcaggtcgcctctattggcgcatccggggctcaggtgctgggggaggctcttgcagttaatcggacactcgaaattctggacttgaggggtaatgccatcggagtagccggtgcaaaggctttggcaaacgccttgaaagtaaatagctcactgagacgtctgaacctccaggaaaactccttgggaatggatggagccatctgtattgccacagccctgtctggaaaccatcggttgcagcacataaacctgcagggtaatcacataggagactccggcgctcgaatgatctccgaggcaatcaaaaccaacgcccctacttgcaccgtcgaaatgtag

SEQ ID NO: 28552 - DNA, 2784 bp, Artificial Sequence
  Description of Artificial Sequence: Synthetic coding sequence
atgttctggaagttcgacttgaataccacaagtcatgtagacaagctgctggacaaagagcacgtgacattgcaagagctcatggacgaggacgatatcctgcaggagtgtaaggcccagaatcagaagttgctggattttctgtgccggcaacagtgcatggaagagttggtgagcctgattacccaggatcccccactggatatggaggaaaaggtccgcttcaaataccctaacaccgcctgcgagcttttgacttgtgatgtaccgcagataagcgaccgcctgggaggagatgagtccctcttgtctttactctacgacttcctggatcacgagccccctctcaacccgctcctggctagtttcttctccaagacaataggaaatctgattgctaggaagacagagcaggtgataaccttcctaaagaaaaaagacaagtttattagtctggtcctgaagcatattggaacttctgccctgatggatctcttgcttaggctggtgtcatgcgtggagccggcagggctccgtcaggacgttctgcactggctgaacgaggaaaaggtcatccaaagactggtggagcttatacacccaagtcaggatgaggaccgccagtcaaacgccagtcagaccttatgtgatatcgtgaggctgggcagggaccagggttcccaactacaggaggccctggagcccgacccactgctcacggctttggaatcccaagactgcgtggagcagctactaaaaaacatgttcgatggcgatcgaactgaaagctgcttggtctctggcacacaagttctcttgactctgcttgaaactcggagagtcggcacagagggcttagtggatagcttcagtcaggggctggagcggagctatgccgtcagttcttccgttctacatggtatcgaacccaggttgaaagacttccatcagttgctcttgaacccacctaaaaaaaaggccattcttacaacgatcggtgtattagaggaacctttgggtaatgccaggctgcacggggctcggctgatggcggctctgctgcataccaacacccctagcattaaccaggagctttgcagacttaatacaatggacctcctactcgatctcttttttaagtatacgtggaataatttcctgcatttccaggtcgaattgtgtatagctgccatcctctcccatgccgctcgcgaagagcgtacagaagccagcgggtccgagagccgcgtagagcctcctcacgagaacgggaaccggagtctggaaactcctcagccagccgcaagtctaccggacaatactatggtgacccacctttttcagaagtgttgcctggtgcagcgcatccttgaggcctgggaggcaaatgatcacacccaggctgccggtggaatgcgcagggggaacatggggcacctcacccggatcgccaacgcagtggtgcaaaacctggagcgcggaccggttcagacccacataagtgaggttattcggggactccccgctgattgtaggggcagatgggagagcttcgtggaggaaaccctgaccgagactaatagaaggaacaccgtggatttggctttctctgactaccaaattcagcagatgactgccaattttgttgatcaattcggttttaatgatgaagaatttgctgaccaagatgataacatcaatgccccattcgatcgcattgctgagattaacttcaatattgacgcagatgaggattcacctagcgccgctctgtttgaggcatgctgctcagatagaatccaaccctttgacgacgacgaagacgaggacatatgggaggatagcgacacccggtgtgccgctagggttatggctaggccaaggtttggggctccacatgcttcagagagctgctcaaaaaatgggccagagcgcggaggacaagatggcaaagcctcactggaggcccatagagacgcaccaggagcaggtgctccccctgcccctggcaaaaaagaggcccctccagttgagggtgatagcgaagctggagcaatgtggacagctgtttttgacgagcctgcaaacagtactcccactgccccaggcgtggtgagggacgtgggaagttccgtgtgggcagccggtacttctgcacctgaagagaagggctgggccaagtttaccgacttccagccgttctgttgtagcgaaagcgggccacgctgctccagtcctgtggataccgagtgctcccacgcagaaggatctcgcagtcaggggccagaaaaagccttctccccagcctcaccatgcgcatggaatgtctgtgtgacaagaaaggcacccttattggcatcagattcttccagcagtggcggatctcattcagaggacggagaccagaaggccgcttctgccatggacgcagtgtcgcgcggaccaggacgggaggctcccccacttcctaccgtggcaaggacagaggaggccgtgggcagggtaggttgcgcagactccaggcttctgagtcccgcttgccccgctcctaaagaagtgacagccgctcccgcagttgctgtgccccctgaagccactgttgctatcacaactgccctttcaaaggccggaccagccatccccacccctgccgttagttccgcactggccgtagccgtgcctctgggaccgatcatggcagtcaccgccgctcctgctatggtggctactttgggtactgtaactaaggacggacagatgccaaggcaaaaagagcttccctag

SEQ ID NO: 28553 - DNA, 2220 bp, Artificial Sequence
  Description of Artificial Sequence: Synthetic coding sequence
atggggttcagtaacatggaagatgacggccctgaggaggaggagagagtggctgaacctcaggccaacttcaatactcctcaggccctgaggtttgaggaactgctggccaatctcctgaacgaacaacaccaaattgcaaaggagctgttcgagcagctgaagatgaaaaagcccagcgcaaagcaacagaaagaagtggaaaaggtcaaaccgcagtgtaaagaagttcaccaaacactcatactggatcctgcccagcgcaagaggcttcagcagcaaatgcagcagcacgtgcaacttctcacacagattcacttactcgcaacctgcaaccccaatttgaaccccgaggcttccagtacccgaatttgccttaaggagctgggtacctttgcacagtcttccatcgccctgcatcaccagtataacccgaagtttcaaaccctttttcaaccctgtaatctaatgggtgcaatgcaacttatagaggatttttctacccacgtgtccatagactgcagtcctcataagacggtaaaaaagaccgcgaatgagtttccatgtctgcccaagcaggtggcctggatccttgcaacgtcaaaggtcttcatgtatccggaattattgccagtttgctccctcaaggcgaaaaatccgcaggacaagattctgttcaccaaggcggaagacaacctgttggcattaggactgaagcattttgaagggacagaatttctgaacccgctcatctcaaagtatctgcttacatgcaagaccgcaaggcagctcacagtcagaatcaagaatttaaacatgaatagggcacctgacaatatcataaaattttacaaaaaaaccaagcagttgccggttctgggcaaatgttgcgaggagatccaaccgcaccagtggaagcctccaatcgagcgggaagagcacagactccctttttggctaaaggcttcactcccaagcatccaggaggaactacggcacatggcagacggagccagggaggtcggtaacatgacaggaactacagagattaactcggaccagggtctcgagaaagacaattcagagctggggtcagagacgaggtatccattactcctacccaaaggagtagtgctgaagctcaaacccgtggctgatcgctttcctaaaaaagcctggcgccaaaaacggtctagcgtcttaaagcctctgctgatacagccttctccctccctgcagcctagtttcaacccgggaaagacccccgctcagtcgacccacagcgaagccccaccgtccaagatggtgctgagaatacctcaccccatccagccggcaacagtcctccagacagtgccaggcgtgccacctttgggagtttcagggggtgagtcattcgaatctccagcggctctgcctgccatgccacctgaggccaggacatcgttccctctgagcgagagccagacactcctctccagtgctcctgtgcctaaggtcatgatgccctccccagcgtcctccatgttccgtaaaccctatgtgagaaggcgcccatctaagcgccgaggggcacgtgcctttaggtgcataaaaccggctcctgtaattcatccagccagtgttatttttaccgttcccgcaactactgtcaagatcgtgtccctgggagggggatgcaacatgatacagcccgtgaatgcagctgtcgcccagtccccacagaccatccctatagccaccctgctggtgaaccctacgtctttcccttgccctctgaaccagccccttgtggccagctcagtctcccctttaatcgtgtccggcaactctgttaatctgcccatcccaagtacacccgaggataaagctcatatgaacgtggacatcgcatgcgctgtcgctgatggtgagaatgctttccaggggctggagcccaaactcgagcctcaggagctgtcccctctatccgcaactgtttttcccaaggtggagcattcacccggaccccctccagtcgataagcagtgccaggaggggctgagcgagaacagcgcttacagatggacggtcgttaagacagaagaaggacgtcaagccctggagcccctgccacagggcattcaagagagccttaacaactcatcccccggtgatctagaggaggtcgtcaagatggaacccgaggacgctactgaggagattagtgggtttctctag

SEQ ID NO: 28554 - DNA, 1911 bp, Artificial Sequence
  Description of Artificial Sequence: Synthetic coding sequence
atggagaaagccgtcaacgacggatcccatagcgaggaattattttgccatctgaagacaatctccgagaaggaggacctaccgaggtgcacctcagagagccacctgagttgcctcaaacaggatatcctgaacgaaaaaacagagctggaggccacgctcaaggaggccgaattagtgacacatagtgtagagctcttgctacctctgtttaaagacaccatcgaaaaaataaattttgagaatgcaaaccttagcgccctgaatctgaagatctcggagcagaaagagatcttgataaaggaactcgacaccttcaaatcagtgaaattagcgctggagcacctgctgcggaagagggactacaagcagacaggggacaatttgtcctcaatgctcttagagaacctaaccgacaacgaatcggaaaacactaacctgaagaagaaggttttcgagaaggaagcacacatacaggagctgtcctgtttgttccagagtgaaaaggccaacactctcaaggctaatcggtttagccaatcagtcaaggtcgtccacgaaagactgcaaatccagatccataagcgcgaggccgagaatgacaaactcaaagagtacgtgaaaagcctagagacaaaaatcgcaaaatggaacctgcagagtagaatgaacaagaacgaagccattgtcatgaaagaggcatctaggcaaaagactgtggctttgaaaaaggcgtcaaaggtctataagcagaggcttgaccactttaccggcgctatagaaaaattaacttctcagattagggatcaggaggccaagctgtccgaaaccatttccgcaagcaatgcttggaaatctcactatgagaaaatcgtaattgaaaagacagaactagaggtccagatcgagactatgaagaaacaaattatcaacttattagaggacttgaaaaagatggaggatcacgggaagaatagctgcgaagaaatcctgcgcaaggtgcacagcatcgagtacgagaacgaaaccttaaaccttgaaaacacaaagctgaagttacggtttccctgtcggatcacggagtccaaaaatatgaacatactgatcgttctggatatgctttgctatataagtagcgagaaaacgaccttggccgcacttaaggacgaggtggtgtccgtcgagaatgaactctccgagctgcaggaggtggagaagaaacaaaagactctgatagagatgtacaaaacccaggtgcagaagttgcaggaagctgccgagattgtcaaaagtagatgcgagaatctcctgcataaaaataatcaaattacgaaaaccaagaataagaatgttgaaaagatgagagggcagatggagtcccatctaaaggagctggaaagggtatgcgatagtcttaccgctgcagagcgtcgcctccacgaatgccaggagtccctacagtgctgcaaagggaaatgcgctgaccaagaacacacaattagagagctgcagggccaagtggatggcaaccataatcttctgacaaagctaagcctggaggaagagaattgtctgatacagttgaagtgtgagaatctccagcaaaagctcgagcagatggacgccgaaaacaaggagctcgagaagaagctcgctaaccaagaagaatgtttgaagcactccaacttgaagttcaaagaaaaaagcgccgaatataccgcactcgccaggcagctggaggcagctttggaagaggggaggcagaaggtcgcagaagagatcgaaaaaatgtcttctcgggaatctgcccttcagatcaaaatactggacttagaaacagagctgcgcaaaaaaaacgaagagcaaaaccagctggtatgcaagatgaactctgacccagaaactccatag

SEQ ID NO: 28555 - DNA, 873 bp, Artificial Sequence
  Description of Artificial Sequence: Synthetic coding sequence
atggctgctgtggaaaaaaggagacaggcagtccctcctcccgcaggattcactgatagcggccgacagagtgtatctagagccgctggcgctgctgaatcggaagaggacttcctgcgccaagtaggtgtcaccgaaatgctgagagctgctttactgaaagtgctcgaggcgaggccagaggaaccaattgccttcctggctcactatttcgaaaacatgggcttgaggagccccgtgaacgggggagctggtgaaccccctggacagctcctgctgcagcaacagagactgggacgagcactgtggcatttacgcctggcccaccactctcaacgtgccgcatttaataacaacgtatcagtggcatatgagtgcttgtcggcgggaggccgtcgcaagcgtcccggtctcgatggtcgaacttattcagaactgttaaggcggatatgtcgcgacggccaggcccctgaagaagtggtagcccctcttctaagaaaggtgcagtgtagggaccacgaggcggtccctctatctgtgttccgagccggaactttaacctgcttcgtcttgctcgagttcgtggcaagggccggtgctctgttccagcttctagaggactcggctgccgctgtcgccgacagacgagtcggccaggctgtcctggacactctggagggggctctacaggctagtgatgccgcagctcctgctcgcttcctggaggccggatcccgcttggggccagattcattagcgctggccttggacagggcagtgggcggacggagacccagcgcgcctatgacaagagaagagtttttggaacgtgccgcagctctattcatcgccaaagttaagcctgtgggctag

SEQ ID NO: 28556 - DNA, 1221 bp, Artificial Sequence
  Description of Artificial Sequence: Synthetic coding sequence
atggcagatagccagctgttctgcgtggcagaggaaagaagcggccactgcgccgtggtggacggcaactttctctacgtgtgggggggttacgtgagcatcgaggacaacgaagtttacctgcccaacgacgagatatggacttacgatatcgattccggcttgtggaggatgcatctgatggagggcgaactgcccgcatccatgagcggatcctgcggcgcttgtatcaacggaaaactctatatctttggtggatacgacgataaagggtactccaatcggctctatttcgtcaacctccggacccgggatgaaacctacatatgggagaaaatcacagacttcgagggccagccacctaccccccgtgacaaactgagttgttgggtgtataaagataggcttatttatttcggcggatatggctgtcgaagacactcggaacttcaggattgttttgatgttcacgatgcaagttgggaagagcagattttttggggttggcataacgatgttcatatctttgacacaaagacccaaacctggtttcagcccgagatcaagggtggcgtgccaccccagccgagagcagctcacacgtgcgcggttctcggcaacaagggctatatcttcggcggacgggtcctgcaaacccggatgaatgacctgcattaccttaacctcgatacctggacctggtcagggaggattaccatcaatggggagtcccccaaacaccgctcatggcacacactgaccccaatcgcggacgataaattatttctgtgcggaggcctatctgcggataatatcccactgtcagacggctggattcacaacgttaccaccaactgctggaagcaattgactcatctcccgaaaacccgccctaggctgtggcacaccgcatgtttaggcaaggagaacgaaataatggtttttggcggaagtaaggatgatctcctagctttagatacaggtcactgtaatgatctgctcatcttccagacacaaccatactcactgttaaggagctgcttggattgtataggcaagaatagcatcatgttagagtcgcagatctcactgctgcccccaaagctgttgcagcaggtgctgaaaaagattacattttgggcagccgcaaatcatcgggaagagcagagagtacaaaaggaagagacagagaataagtaccagtggatctcctccaactag

SEQ ID NO: 28557 - DNA, 1113 bp, Artificial Sequence
  Description of Artificial Sequence: Synthetic coding sequence
atggtgcagcccttcacaacaattccctttccaccacctccacagaacggaatcccgaccgaatatggggtgccgcatactcaggattacgccggtcagactggagagcataatcttactctctacgggagcacgcaagctcacggcgaacagtcgtccaactcaccatctactcagaatggtagtctcacgaccgaagggggagcccagaccgatggccagcagtcacagacacaatcttctgagaattctgagagcaagagcaccccaaagaggctccacgtctctaacattccttttcgattccgcgacccagacctgaggcaaatgttcggccaatttggcaagatccttgacgtcgagatcatcttcaatgaacgtgggtccaaaggcttcggctttgtcactttcgagaattcagcagacgccgacagggctagggagaagctgcatgggacagtcgtggaggggagaaaaatagaggtcaacaatgccacagcccgagtgatgaccaacaaaaaaatggtgaccccttacgcgaatgggtggaaattgtcccctgtcgtgggagcggtctatggccctgagctttacgccgcatcttcttttcaggccgatgtaagcttgggtaacgatgccgctgttcctcttagcgggagagggggaattaacacatatataccactgattatccctggctttccctatccaactgctgcgacaacggcagctgcattcagaggcgcacacctgcgaggacgaggcagaactgtgtatggagccgtccgggcagttccgccaacggccatccccgcatatccaggcgtggtttatcaagacggcttttacggcgcagatctctacatagaaagcgctaattgcttcagatctaatagggttgatatgcagccaacagatatgcattccctgcttctgcagccacagccaccacttctgcagccactgcagccactcaccgtgacagttatggcgggatgcacacaaccgacaccaacaatgcccttgcccttgcccctggccatggagctggctttgtggagagtctatacagaggtagctaccgccgacttgccacccaccgaggtgacttag

SEQ ID NO: 28558 - DNA, 534 bp, Artificial Sequence
  Description of Artificial Sequence: Synthetic coding sequence
atgagcgaagatagcgagaaggaggattactctgatagaacaatctccgacgaagacgagagcgatgaagatatgttcatgaaatttgtgagtgaggatctacacagatgtgcactcctcacggccgattccttcggagacccctttttcccaagaacaacccagattctcctcgagtatcagttgggccgatgggttccacggttgagggaacctagagacctgtatggcgtatcttcatccggtcctctcagcccgactcgctggccataccactgtgaagtaattgatgagaaagttcagcacatagatggggtcagctgttggtccgagagccaccaggccggtgcgcagtggtgtgacctgggatccctccagccacctccgccaaggttcaagaggtttgcatgcttctcactgctgagttcaagagattaccgtagagtcccccctcggtcagcaaattttgtatttctggtagagaccgggtttcaccatgttggacaggacggactgagattgctgactagctag

SEQ ID NO: 28559 - DNA, 1827 bp, Artificial Sequence
  Description of Artificial Sequence: Synthetic coding sequence
atgtccgataaatccgatttgaaggccgaactcgagcgcaagaaacagagactggcacagatacgcgaggagaagaagagaaaagaagaagagcgcaagaagaaagaagcagatatgcaacagaagaaggagcctgtccaggacgacagcgacctcgatcggaaaagaagagaaacagaggcgctgctacagagtatagggatttctcccgagccgcctctggtgcctacgcctatgagcccctcatccaagtctgtttcaacgccctccgaagccggatcccaggacagcggcgacttggggcctctgactaggaggcgattacataaactgggcgtgagcaaagtcacccaggttgactttctcccaagagaggtcgtgtcttatagcaaagaaacccagacccctctggctacgcaccagtctgaggaggacgaagaggacgaagagatggtcgagtcaaaagtgggccaggacagcgaattggagaatcaggataagaagcaggaagttaaggaggccccacctcgagagctcacagaagaggagaaacaacaaatcctccactccgaagagttcctgatcttcttcgaccggaccatccgagtgattgaaagggctctggccgaagattcggacatcttttttgactattctgggagggaactggaggagaaggacggtgacgtccaggctggcgcaaacctctccttcaacaggcagttttatgacgaacattggtcaaagcatagagtggtgacgtgcatggactggtcactccaatatccggagttaatggttgcttcgtataataacaatgaagatgccccacacgagcctgacggcgtggctttagtgtggaatatgaaattcaagaagaccacgccggaatacgtttttcattgtcagagcagtgtgatgagtgtgtgcttcgctcggtttcatcccaacctcgtggttgggggaacgtattctggacagatcgtgctgtgggataaccggagccacagaaggacacccgtgcagcggacgccactgtccgcggctgcacacacacatcctgtttattgtgtgaacgtggtgggcacacagaatgcccacaacctgatcacggtctccaccgacggcaagatgtgctcttggagtctcgatatgctttccactccccaagaatccatggaactggtatataataaaagtaaaccagtcgcagtaactggaatggcgttccccacaggagacgtcaacaattttgtggtcggcagcgaagagggtacagtctatactgcatgtcgccacggaagcaaagccggtataggggaagtgtttgagggacaccagggacccgtgacaggcatcaattgtcatatggctgttggcccaatcgatttcagtcaccttttcgtgaccagctctttcgattggacggtcaagctgtggactaccaagcataacaaaccgctctatagtttcgaagacaacgccgattatgtctatgacgttatgtggtctccagtgcatccagccctcttcgcctgtgtcgacggaatggggcgactggacctgtggaatttgaataacgatacagaggttccaacagcatcagtcgccattgaaggcgcaagtgcgttgaaccgcgtccggtgggcccaggcgggtaaagaggtggcggtgggggatagcgaaggacgaatctgggtttacgacgtgggtgaattagcggtgccacacaacgacgaatggacccgatttgcgcgaaccctggtggagataagggcgaacagagcagattctgaagaagagggtacagtcgaactcagcgcgtag

SEQ ID NO: 28560 - DNA, 627 bp, Artificial Sequence
  Description of Artificial Sequence: Synthetic coding sequence
atggagggcgctgcagcacctgtggccggtgatcgtcctgacctcgggctgggagctcctggctctcctcgcgaagcggtcgccggagcgactgcagctttggagcctcgcaaaccccacggggtgaagaggcatcaccataaacacaacttaaagcaccggtatgaactccaggagacactggggaagggaacctacggcaaggtaaagcgggcaaccgagcggttctctggacgtgtggtggccattaagagtatccgcaaggacaaaatcaaagacgagcaagatatggtacatattaggagggagatcgagattatgagttcgttgaaccaccctcacatcatttccatctatgaagtgttcgagaataaagacaaaatcgttatcattatggagtatgcgtcaaagggcgagctctacgactatatcagtgagcgacgacgtctgagcgagcgagaaactcgtcacttcttcagacagatcgtttccgcagtccactattgtcataagaatggcgtggtacaccgagatcttaagctgaaacgaccgtctcgggaaaatcaggtgactacgttacctcagtccgctgtgtccctacggtcatgttggaccgtgatgatgtag

SEQ ID NO: 28561 - DNA, 990 bp, Artificial Sequence
  Description of Artificial Sequence: Synthetic coding sequence
atggaagtggcggagcccagtagtccaacagaggaagaggaggaagaggaagagcattccgccgaacctaggcccaggacacgttcgaatcctgagggagccgaggatcgggctgtaggagcccaggcttctgtgggatcaaggagcgagggtgagggggaagccgctagcgcggatgatggctccctgaacacctcaggtgctggacccaagtcctggcaggtgccaccacccgcaccggaggtccagattcgtacacccagagtaaactgccccgagaaggtgatcatttgccttgacctctccgaggaaatgtccctgccaaaacttgaaagttttaatggaagtaaaactaatgcattaaacgtgtcccagaaaatgattgaaatgtttgtgcgcacaaagcacaaaatcgacaagtcgcatgagtttgcattagtcgtcgttaacgacgatacagcctggctaagtgggctgacgtccgatcctcgcgaactgtgcagctgtctgtatgaccttgagactgcctcatgtagcacgtttaacctggagggacttttttcccttatccagcagaagacagagcttcccgtcacagaaaacgtacagacaatccctcccccttatgtggtcaggaccatcctggtctactcacgacccccttgccagccacagttttctctgactgaacccatgaaaaaaatgttccaatgtccatatttcttttttgacgtggtgtatattcataacggaacggaagagaaggaagaagaaatgtcttggaaagatatgtttgcttttatgggatctctggacactaaggggacatcctataagtacgaagtggccctggccggacctgctctggaactgcacaattgcatggccaagctgctcgcccaccccctgcagagaccctgtcagtcacacgcttcatacagtcttctagaagaggaagacgaggccatagaagttgaagccacagtgtag

SEQ ID NO: 28562 - DNA, 885 bp, Artificial Sequence
  Description of Artificial Sequence: Synthetic coding sequence
atgtcacagcccgctggagggcgacgcaagcctcgcaccctaggccctcccgtctgtagcattagaccatttaaatccagtgaacagtatctcgaagcaatgaaagaggatctcgccgagtggttgagagacctctatggactggacatcgacgcggcaaacttcctccaagttctggaaacaggtctggtcctatgccagcatgctaatgtcgtaacagatgccgctctcgcgtttctggccgaagctcccgcacaggctcaaaagattcccatgccccgagtgggcgtgtcctgcaacggcgctgcccagcctggcacgttccaggcccgtgacaacgtttccaactttatccagtggtgcaggaaagagatgggtattcaagaggtactcatgtttgaaacagaggatctggtactgaggaagaatgtgaaaaacgtagtgctctgcctgttggaactcggccgtcgcgcatggaggtttggggtggccgctccaacattagtgcagctggaagaggagattgaggaggaagtgcgcagagagcttgcactccctcctctgcctcagccaggacctgacggggcagagccctgcgagcctttgcacgtgccatcggccgtcctgcacgggcaaagtgtgtatgtgttcctaggtcctgcgcgacagcccccaaaagaccgtctgcttcgcgcagtcctgggttctaaggggggagaggcaagcagggtggacggggctagtgtcggtgaggaggaagaagaggggaaagaagagaaagagcccgctgctccactggaatcgtccccacagccacccgaagggctgcagcctcactggttaaaccaggcaccactgccccctgaggaagagtcttgggtgtag

SEQ ID NO: 28563 - DNA, 1554 bp, Artificial Sequence
  Description of Artificial Sequence: Synthetic coding sequence
atggagacagatcttaactcccaagacaggaaagacttggataagttcatcaaattctttgctctgaagacagtccaggtcatcgtgcaggctagactgggagagaagatttgtaccaggtcaagctcttctcctactggctcagattggtttaatcttgcgatcaaagatatcccggaggtgactcacgaggccaagaaggcactggcgggacagttacccgcagtggggcgatccatgtgcgtggaaatatctttgaaaacaagcgagggtgactctatggagttagagatttggtgcttggaaatgaacgaaaagtgtgataaagaaatcaaggtctcctataccgtgtacaaccggttaagcctcctcctgaaaagtcttctcgccattactcgagttaccccagcatacagattatctaggaaacagggccacgaatacgtcattctttataggatttatttcggagaagtccagctgtctggcttaggcgaaggcttccagaccgtgagagtcggcacagtggggactccagtggggacaattactttgagctgtgcttaccgaataaacctcgcctttatgtccacgcggcagttcgaaaggaccccccctattatgggtatcataatcgaccacttcgtggatagaccctaccccagcagctcccccatgcacccttgcaattacagaacagctggggaagacaccggcgtgatctaccctagcgttgaggactcacaggaggtgtgcaccacctccttcagtactagccctcccagtcagcttagttcgagtcgcctttcctaccaacccgctgcattgggagtggggtccgctgatcttgcctacccagtggttttcgctgcgggtctgaacgctacccatccacaccagctcatggttcctggaaaagaaggtggcgtacctctggctccaaatcaacccgtgcacggcacacaggcggaccaagaacgcttggccacgtgtacaccaagtgaccggacacattgtgcagccaccccttcctcatcagaagacaccgaaactgtgagcaactctagcgagggtcgagctagtcctcacgatgtgctggagaccatatttgtgcggaaggtcggcgctttcgtgaacaaacctattaaccaggttacactgacatcgctggacattcctttcgccatgtttgccccaaaaaacctagagctggaggacaccgatccaatggtcaacccccctgacagtccggaaacagagtctcccctccaaggctcactgcattcagatggctcatctggaggaagctctggtaacacccatgacgacttcgtgatgatagattttaagccagctttttctaaagatgatatcttgccaatggatctggggaccttttaccgggagtttcaaaatccaccccaactgtccagcttgtcaattgatattggagcccaaagtatggccgaagatctggatagtcttccagaaaagttggccgttcatgagaagaacgtgagggagttcgacgctttcgtggaaacgctgcagtag

SEQ ID NO: 28564 - DNA, 951 bp, Artificial Sequence
  Description of Artificial Sequence: Synthetic coding sequence
atggcaacattcgtggagcttagcaccaaggctaaaatgcctattgttgggctcggaacctggaagtcaccattgggcaaggtgaaggaagccgttaaagttgcaatcgatgccggatatcggcacatagattgcgcgtacgtgtaccagaatgagcacgaggtgggggaagccattcaggagaaaatacaggagaaagccgtgaaacgcgaggatcttttcatcgtgagcaaactttggcctacgtttttcgagcggccattggtcagaaaagcttttgagaaaacacttaaggatctcaagctctcttatctcgacgtgtatctaatccactggccacaagggttcaaatccggagacgacttgtttcccaaggatgacaaggggaatgcgatcgggggaaaagctacatttttggacgcatgggaggccatggaagagctcgttgacgaagggctggtgaaggcgttgggagtgtccaactttagtcacttccagatagagaaacttcttaataaacccggattgaagtacaaacccgttaccaatcaggtcgagtgtcacccctacctgacccaagagaagctgattcagtattgccacagtaaggggataaccgtaaccgcatactctccgctggggagccctgacagaccatgggccaagccggaggatccatctctcttagaagatcctaagattaaggagatagccgctaagcataagaagactgccgctcaggtcttgatcaggtttcacatacagaggaatgttattgtgatccccaagtctgtgacaccggctagaatcgtggagaacattcaggtgttcgactttaagctgagtgacgaggaaatggctacaattcttagcttcaaccgcaattggcgcgcttgcaatgttctgcagagcagtcacctggaggattatccatttaacgcagagtactag

SEQ ID NO: 28565 - DNA, 8273 bp, Artificial Sequence
  Description of Artificial Sequence: Synthetic coding sequence
gaacccaaggtagtgtttgcgaaagagcagccagtgcaccgggaggtgcaggcccaggctggtgcttctacgactctgtcctgcgaggttgcacaagctcagactgaggtcatgtggtataaagatggaaagaagctgtctttttctagtaaagtcagaatggaagccgtggggtgcacgcgcagactggtcgtgcagcaggctggccaggccgtcgcaggggaatactcatgtgaggccggaagtcagcggctgtccttccacctccacgttgcagagcccaaagccgtgtttgcaaaggagcagcctgcccacagggaagtgcaagctgaggctggagcctccgcgaccctgtcttgcgaggtggcacaagcgcaaacggaggtcacgtggtacaaggacggtaagaaattaagttccagcctcaaggtacatgtagaggccgctgggtgtactaggcggctcgtggttcagcaggctggtcaggcagatactggagagtacagctgtgaggccggtgggcaacagctgtcatttagactgcaagtggcagaacccaaagccgtgtttgccaaggaacagccagctagtcgcgaggtgcaggccgaggccggaactagcgcgacccttagttgcgaagtggcacaggcacagactgaggtcacatggtataaggatggcaaaaaactgagcagctccagcaaggtgagaatggaggcagtgggctgtaccaggagattggtcgtccaggaagccggacaggctgacgctggtgagtattcctgtaaagctggggatcagcgtctgagttttcatctccacgtggccgagccaaaagttgtttttgccaaagagcagccggcacaccgtgaagttcaggcggaagctggggcttcagccactttgtcttgtgaggttgctcaggcacaaacagaggttacctggtacaaagatggaaagaaattatcatccagttctaaggtccgggtggaagccgtcggctgtactcgcaggctggtggtccaacaggcaggacaagctgaagctggtgagtatagttgcgaggccggaggtcagcagctgagttttcgtttgcaggtggccgagcccaaagccgtgttcgcgaaggagcaagtcgtgtttgccaaggatcaacccgtgcaccgcgaggtgcaggccgaagccggtacttccactatgctttcctgcgaagtagctcaagcccagactgaggtcatgtggtacaaggatggtaagaaactgtcttcaagttctaagatgagagttgaagcggttggctgtacgcgccgtctggtggtccaggaggccggtcaggcggatgccggtgaatactcatgtgaagcaggcggacagagactttcttttcatctgcacgtggccgagcctaaggttgtgttcgctaaggagcagcccgcttgccgggaggtgcaagcagaggccggagctagcgctacattatcctgcgaggtagctcaggggcaaatggaagtcacttggtataaggacggaaagaaactgtcaagctccagcaaggttcacatggaggcttcaggctacacccggaggctcgtcgtacaacaggccggacaagccgacgcaggcgaatacagctgcgaggcaggcggacagcgcctatcctttcggctccatgtggcggaactcgagccacagatctcggagagaccctgccgcagagagccacttgtggtaaaggagcacgaggatattatcctgactgctactctggcgacgccctctgctgctactgtcacatggctgaaggacggcgtcgaaattcggaggagcaaaagacacgaaaccgcctcgcagggcgacacccacacgctgacagttcatggagcccaggtcctggacagtgccatttatagttgtagggtgggcgcagagggccaagactttccagtgcaggttgaggaagtcgccgcaaaattctgtcgactgctcgagcccgtctgtggggaactaggtggaaccgtgacgttggcctgcgagctcagccccgcatgtgccgaggtggtttggcggtgtggaaatacccaactgcgtgtcggtaaaagattccagatggtcgcagaaggcccagtcagatctcttacagtgttgggactgcgagcagaggatgctggagagtacgtctgtgaatcccgtgatgatcatacatcagcacagctgacagtaagtgtgccccgtgtcgtgaaattcatgtccgggctttcaactgtggtcgcagaagaaggcggagaggccacattccagtgcgtagttagcccctctgatgttgctgtcgtttggtttagggacggagcactgctgcagccttccgaaaagttcgcaatttctcagtcaggtgccagtcattctctgacgatttcagacctggtgctcgaggatgctgggcaaattaccgttgaggctgaaggtgccagctctagcgctgccctgcgcgtacgggaggcaccagtgctgtttaagaagaaacttgagccccagacagtggaggaaaggtcatccgtgacattggaggtggagctcacacggccttggccagaactgcgctggacccggaatgcaacagccttggcgcctggcaaaaatgtcgaaattcatgccgaaggagcccgtcacaggttggttctgcacaacgtcggattcgcagacaggggattctttggatgcgaaactccggatgacaaaacccaggccaaactgacagtggagatgcggcaggtgaggcttgtgagaggacttcaggccgtggaagcaagggagcaggggacagccacaatggaagttcaactgtcccatgccgacgttgatggatcctggacaagagatgggctgaggttccaacaaggccctacctgccacctggcagtgagggggcctatgcatactctgacactatcaggtttgaggcctgaagatagtggtctgatggtgtttaaagccgaaggggttcacacgagcgccagactcgtagtgacagaactcccagtgagtttctcgaggcccctgcaagatgtggtaacaacagagaaggaaaaggtcaccctcgagtgtgaattatcccggccaaatgtcgacgtcagatggctcaaggatggagtcgagctccgagccggaaagactatggccatcgccgctcagggtgcctgtaggtcccttactatctaccggtgcgagttcgcagaccaaggggtgtatgtgtgtgacgctcacgacgcccaaagttcagcatctgtgaaggttcagggcagaacctacaccctgatataccggagagtgttggccgaagatgctggcgagatacagttcgtggcagaaaatgctgagtctcgcgcacagctcagggtcaaggagctccccgtgactctcgtccgtcctcttcgagataaaatcgcaatggaaaagcacaggggcgtgctagaatgtcaggtttctcgtgcgagcgcccaagtgcgctggtttaagggcagccaagagctccagcctggcccaaaatatgaactggtgtccgatggcctgtaccgtaagctgattatctccgatgtgcatgcagaggatgaagacacatacacctgtgacgctggggacgtcaagacgtcagcccagttttttgtcgaagagcagagtattactatagtcagaggcctgcaggatgtcaccgtcatggagcccgctcctgcctggttcgaatgtgagacgtcaatcccttctgtgcggccaccgaagtggctgctgggaaagacagtgctgcaagcagggggaaacgtaggccttgagcaggagggcactgtccaccggctcatgctccgtagaacctgctcgaccatgacaggcccagtccactttactgtggggaaatctcgctcctctgccaggctggtggtgagcgatattcccgtagtgcttacccgtcctctggagcctaagaccggccgtgaactgcagtctgtggtgctgagttgcgatttcaggccagcaccaaaggctgtgcagtggtacaaggacgacacaccactctctccctccgaaaagttcaagatgtctcttgagggacagatggccgagctgcggattttgaggctgatgcccgctgacgccggagtgtaccgatgccaggctgggtctgcccactcatccaccgaagttacagtcgaggccagggaggtgactgttactggacctttgcaggacgccgaggccacagaagagggttgggcatcctttagctgcgagctctcccatgaggatgaggaagtggaatggagtctgaacggcatgcccctctataacgatagcttccacgaaatatcccataaggggaggcgtcatactctcgtgctgaaatcaattcagcgcgctgacgcgggtattgtgcgggcaagcagcttgaaagtttccaccagcgcacgtctcgaggtcagagtgaaaccagtggtttttcttaaagctctggacgatctgtccgccgaggaacgcggaacattggctctccagtgcgaggtctcagatccagaggcccacgtggtctggcgcaaagacggtgtgcagctcggaccctcagacaagtatgacttcctccatactgcaggtacaaggggactggtggtacacgacgtcagtcctgaggacgcgggactctacacatgccacgtcggcagcgaggaaacccgagccagagtccgagttcacgacctgcatgtcggaatcaccaagaggctgaagactatggaggtcctggagggagagtcctgttctttcgagtgcgtcctgtcacacgaaagcgctagtgatccggctatgtggaccgtgggtggcaaaactgtaggctccagcagccgcttccaagctactcggcaaggacgtaaatacattttagtggtgagggaagccgctccatctgatgccggagaggtggtcttctctgtcaggggcttaacctccaaggcaagtttaatagtgagggaacggccagctgctatcattaagcctctggaggatcagtgggtggccccaggggaggatgtggaactgagatgtgaactttccagagcaggtactcctgtgcattggctgaaagatcgcaaggcaatcagaaagtctcagaagtacgacgtcgtgtgtgaggggacaatggctatgttagtaattcgcggtgcctctctgaaagatgccggagagtacacttgtgaggtggaggctagcaagtctaccgcttccctgcacgtggaggaaaaggcaaactgctttactgaggagctgacaaatctgcaggtcgaagaaaaagggacagccgtattcacctgcaagaccgaacacccggctgccactgtgacatggaggaaaggcctcctcgaacttcgagcaagtggaaaacaccagccaagtcaggagggtctcacactgcgtcttaccatctccgcactcgaaaaggccgacagcgacacttatacctgtgatattggccaggcacagtcacgggcacagttgctggtgcagggcagaagagtgcatataattgaggatctggaggatgtcgacgtccaggaggggagctcggcaacgtttcgatgtagaatctctccagcaaattacgagcccgtccattggtttctcgataagacccctttacatgcaaatgagttaaatgaaattgacgcccagcccggtgggtatcatgtgctgacacttagacaacttgcactgaaggatagtggcaccatttacttcgaagcgggagatcagagagccagtgctgccctgagagtgaccgagaagcctagtgttttttctcgggaactcaccgatgcaaccatcaccgagggcgaagatctaaccctggtgtgtgagacctcaacttgtgatataccggtttgctggaccaaagatggtaagaccctgcgtgggtcagctagatgccagttgagtcacgaaggtcatcgggctcagctgttaattacaggagcaacgcttcaagactccggtcggtacaaatgcgaggcagggggagcctgctctagctcaatcgtgcgcgtgcatgcacgcccagtccgcttccaggaggctctgaaagacctggaggtgctagaaggtggggcagccactctgcggtgcgtgctttcctccgtggccgctcccgtgaaatggtgctatgggaacaacgtgctgcgccctggcgataagtactctctgcgacaggaaggggcaatgctggagttggtggtgaggaacctgcggccacaggacagtggcaggtacagctgctcgttcggcgaccagactacttcggctacactgacagttaccgctctgccagcgcaatttatcggcaagctgcggaataaggaagctactgaaggtgccacagctacactccgctgcgaactctctaaggcagcacctgtggaatggaggaaaggaagcgagaccctgcgtgacggagatcggtactgcctaaggcaggacggtgccatgtgtgaactgcaaattcgcggacttgccatggtggacgccgcagagtattcttgtgtgtgcggcgaggagaggacatccgcctctctgacgatccggccaatgccagcccacttcatagggagactgcgccaccaagagtcaatcgaaggggcaaccgctacactacgatgcgaactgtccaaggccgctcccgtggaatggagaaagggaagggaatccctgcgcgatggcgatcgacacagcctccgccaggacggagcagtgtgcgagttacagatctgtggccttgctgtggctgacgccggtgagtatagctgtgtttgtggtgaagaaagaacctctgctacactcaccgtgaaggccctcccagctaagttcacagagggactgagaaacgaggaagctgtcgagggtgctaccgccatgctatggtgtgagctgtcaaaggttgcgcctgtggagtggaggaagggccctgagaatttgagagacggtgaccggtacatactaaggcaagagggaacccggtgtgaactacagatttgcgggctggcaatggccgacgccggagagtatctgtgcgtctgcggccaggaacgcacttctgctacactgactattagggcactccctgccaggttcatcgaagatgttaaaaaccaggaggcccgagagggtgctaccgccgttttgcagtgcgagttgaattccgccgctcctgtggagtggaggaagggaagcgagactctccgcgacggtgaccgctactcgttgcggcaggacggcaccaagtgtgagttgcagatacgaggactcgcgatggctgacacaggagaatactcttgcgtctgtggccaagagaggaccagcgccatgctgaccgtgagagcccttccaataaaatttaccgaggggctccggaacgaggaggcaaccgagggggcaacggcagttctgagatgcgaactcagcaagatggcaccggttgaatggtggaaggggcacgagacactgagggacggggatcggcactcactacgccaggatggggcaaggtgcgagcttcaaattaggggtctcgttgccgaggatgcgggagaatatttgtgcatgtgcggcaaggagcgaaccagcgctatgctcacagttcgagccatgccatccaagtttatcgagggcttgagaaatgaggaagccaccgagggcgacaccgccactctgtggtgtgaactgtctaaggccgcacctgtggagtggaggaaaggacacgagaccctacgggatggcgatcggcactcactgagacaagatggctcacgatgtgagctgcagatacgcggattagcagtagtggatgctggggagtactcttgcgtgtgcggccaggagcgcacctccgcgactctgacagtgagggcactgccagctcgattcattgaagacgtcaagaatcaggaggcgcgtgaaggcgctacagctgtcctgcagtgtgaactgtcaaaggccgctcctgtagaatggaggaagggcagcgaaacgctgaggggtggagatcgatattccctgcggcaggatgggacccgctgcgagcttcagatacatggcctgagcgtcgccgacactggagagtacagctgcgtctgtgggcaggagcggacatccgctacactgacagtgcgtgcgctacccgctcgacatagtagatccgaggaccaaggaggcctcagacggggacattcctacactgccgtgta

SEQ ID NO: 28566 - DNA, 1449 bp, Artificial Sequence
  Description of Artificial Sequence: Synthetic coding sequence
atggtgatggagaagcctagccccctgttagtgggcagagaattcgtcaggcaatactacaccctgttaaataaagcacctgaataccttcatcgattctacggcagaaatagcagttacgtgcacggaggagtcgacgcctcaggaaaaccacaggaggcggtatacggccagaatgatatccaccacaaagtactgagtctgaactttagcgagtgccacacaaaaatccgccatgtggacgcacacgctactctgagtgatggtgttgtggtgcaagtgatgggactgttgtctaactcagggcagcccgaacgtaagtttatgcagaccttcgtactcgcccctgaaggctcagtacctaacaaattttatgttcacaatgacatgttccggtacgaggacgaggtgtttggggacagtgagccagaactcgatgaggaatcagaggacgaagtggaggaggagcaggaagagagacaaccgtcacccgagcccgtgcaggagaacgctaactctgggtactacgaagcccaccctgtgacaaacggaatcgaagaacctctggaagagtccagccatgagcccgagccagagccagagtccgaaacgaagaccgaggaactgaaaccacaggttgaagagaaaaacttggaagagctcgaggagaagtccacaacaccccctcctgccgagccagtgtctctgccgcaggaaccacccaaggcatttagctgggccagcgtcacatctaagaatctacccccaagcggtacagtgtcatctagcggtatcccacctcacgttaaagccccagtgagccagcccagggtcgaggccaagccggaagtccaaagtcagccaccacgcgtccgcgagcagcggcctagagagcgtcctggcttccccccaagggggcctcgacccggacgaggcgacatggagcagaacgattccgacaataggcgcattatccgttacccagactcacatcaactcttcgtcgggaaccttccccacgatattgatgagaatgagttgaaagagttcttcatgagcttcgggaatgttgtggaactgcgcattaacaccaagggggtgggcggtaaattgcctaattttggatttgtggtgttcgacgactctgaacccgtgcagagaatccttattgcgaagccaattatgttccgcggagaggtgcggttaaacgtggaagaaaagaaaacacgggcagctcgggagcgcgaaactcgtggagggggtgacgatcgacgcgacatccgcaggaatgacaggggccctggagggccaaggggtatcgttgggggaggcatgatgagggaccgcgatggccgaggcccacctccccgtggaggcatggcacagaagttgggctcagggcgagggaccgggcagatggagggcagatttaccggccagcgaagatag

SEQ ID NO: 28567 - DNA, 807 bp, Artificial Sequence
  Description of Artificial Sequence: Synthetic coding sequence
atgtccggcaggaagaggagctttacattcggggcatatggaggagtcgacaagtcgttcacctcaagacgatccgtctggcggtccgacggccaaaaccagcattttccccaagctctcgacctgagccgggtgaatctggtgccctcttatacaccttcactgtacccaaaaaatacggacctttttgaaatgattgagaagatgcaagggtcccggatggatgagcagagatgctcattccctccaccactgaaaactgaagaggactatataccctatccatcggtccatgaggtgctgggtcgtgagggacctttcccactcattctgctgccacagttcggcggatattggatcgaaggtaccaatcatgaaattacgagcattcccgaaacagaaccactgcagtcccccacgactaaggtgaaattggaatgcaaccctaccgcccgtatatacagaaagcacttcttggggaaggagcatttcaactattactccttggatgcagccctgggacacctggttttcagcctgaagtatgatgtgattggcgatcaagagcatctgaggcttctcctaaggaccaaatgcaggacatatcatgacgtgatcccaatatcttgtttgacagaattcccaaatgtggtgcagatggccaaacttgtatgcgaggacgtgaatgtggaccggttctaccccgttctctatcctaaggcatcacgcttaatcgtgacttttgacgaacacgtgatatccaacaacttcaagttcggtgtgatttaccaaaaactaggccagtag

SEQ ID NO: 28568 - DNA, 606 bp, Artificial Sequence
  Description of Artificial Sequence: Synthetic coding sequence
atgtacaccctcttaagtggactatacaaatatatgtttcagaaagatgagtactgcattctgatcctgggcctggacaacgccggaaagaccacgttcttggaacagtccaaaacccgatttaataagaactataagggcatgagtctatcaaagataacgacgaccgtgggcctcaacattgggacagtggacgtgggtaaggctcgtctaatgttttgggacctcgggggacaggaagagctgcaatctctctgggataagtactacgccgagtgtcacggtgtgatatatgtgattgattcgactgacgaagagcggctcgccgagagcaagcaggctttcgaaaaggtcgtaacatccgaggccttatgcggagtgccagtcctggtgctcgctaataagcaggatgtggagacatgtctctccattcccgatattaagaccgcttttagtgactgcacatctaagattggcagacgagactgtttgacccaggcctgcagtgccctgaccggaaagggggtccgtgaggggatagagtggatggtgaagtgcgtggtgcgcaacgttcatagaccccctaggcaaagggacatcacgtag

SEQ ID NO: 28569 - DNA, 1707 bp, Artificial Sequence
  Description of Artificial Sequence: Synthetic coding sequence
atgggtctgctcaccttccgcgacgtagccatcgagttctccttggaggaatggcagtgtcttgatacagcccagcgaaacctgtacaaaaatgttatcttggaaaactacagaaacttggtcttcttgggcatcgccgtcagtaagcaggacctcattacctgcctggagcaggagaaagaacccctgacagtaaagcggcacgagatggtcaacgaaccgcctgtcatgtgcagtcattttgcacaagagttttggcccgagcagaacatcaaagacagcttcgagaaagttacgttgcgcaggtacgagaaatgcggcaatgataacttccaacttaaggggtgcaagtctgtcgacgagtgcaagctccacaaaggaggatataatggcctgaaccaatgcttgcctaccatgcagtcgaaaatgtttcagtgcgacaaatacgtaaaagtttttaataagtttagccacagcgaccgccacaaaataaagcacatggagaataaaccctttaagtgcaaagaatgcggcaggtccttctgcatgctgtctcatttaaccagacacgaaaggaactatacaaaggttaatttctgtaaatgtgaggagtgcgaaaaggccgtgaatcagagttcaaaactgacaaagcacaagcggatatatacttgtgagaaactttacaagtgccaagagtgcgatcgtacatttaaccagttctccaatttaacggagtacaaaaaagattacgcacgggagaagccctacaagtgcgaagagtgcgggaaagcgttcaaccaatcatctcatctcactacacataaaatcatccacacgggagagaagccttacaaatgtgaagagtgcggcaaggccttcaatcaattcagcaacttgaccactcataagaagatccacactggagagcaaccctatatttgcgaggaatgtggaaaggcatttactcagtcatctacattgactacccacaaacggatccacaccggcgaaaaaccatacaaatgcgaggagtgtggtaaagctttcaatcggtcatctaaactcacagagcacaagaacatccacactggcgagcaaccttataagtgtgaagagtgtggaaaggctttcaaccgaagctctaacctgacggagcatcgcaaaatccacacagaggagaagccttataagtgtaaggaatgtggcaaagcctttaaacacagctctgccttgaccacacacaaaaggatccatacaggcgagaaaccctacaagtgtgaggagtgtggcaaagcctttaatcgtagttccaagctgactgagcacaagaaactccacacggggaagaaaccttataaatgtgaggagtgcggaaaggcgttcatccaatcttctaagctgacagagcataaaaagattcactcgggagagatcccctataagtgcgaggagtgcggtaaagccttcaaacactcctccagtctgaccactcacaagcggattcacacaggggagaagccttataagtgcgaggagtgcggcaaggctttcagccggagcagtaagctcaccgagcataagatcatacacacaggcgagaaaccgtacaagtgtgagcgatgcgacaaggcctttaatcagagtgccaatttaactaaacacaaaaaaattcacactggcgagaagcttcagaattggaatgtctag

SEQ ID NO: 28570 - DNA, 1383 bp, Artificial Sequence
  Description of Artificial Sequence: Synthetic coding sequence
atggactccgaactcatgcatagcatcgttggctcttaccataagcctccggagcgcgtgtttgtgccttccttcactcagaatgagcctagccagaattgccaccccgcaaaccttgaagtgacaagtccgaagatactccattctccaaatagccaggctctcatactggcactgaagacccttcaggagaaaatccatcgattggaactcgaacgtacacaagctgaggacaacctgaatattctgtctcgggaggctgcacaatataaaaaagccctggagaacgagactaacgagcgaaatctcgcccaccaggagctcatcaaacagaaaaaggacatatctatccagctgtcgtccgcacaaagtcggtgtactcttctggagaagcaactcgaatatacaaaaagaatggtgctgaacgtggagagggagaagaacatgattttagagcagcaggcacagttgcagcgtgagaaggagcaggatcagatgaagctgtatgccaagctcgagaaactggatgttctggagaaggagtgctttcgcctgaccactactcagaagactgctgaggacaaaatcaagcatctggaggagaaactcaaggaggaggaacaccagcggaagctgtttcaggataaggcctctgaactgcagaccggcttggagatttcaaaaatcataatgtcttccgtgtcgaatctcaagcactccaaggaaaagaagaaaagctccaaaaagactaagtgcataaaacgtcgaccaccgtggcagatctgctcaaagtttggggcacttccctttgtggcagagaaaatgagacagcaccgggatccacatatactgcagaaaccttttaatgtgacggagacccgatgtctgccgaagccttcacgtacaacatcttggtgtaaggcgataccgcctgactctgagaagtcaataagtatctgtgataacctgagtgaactactcatggcaatgcaggacgagctggaccagatgagtatggagcatcaggagttgctcaaacagatgaaggagacagagtcacacagcgtatgtgatgacatcgagtgtgaattagaatgcctcctgaagaaaatggagattaaaggcgagcagataagcaagctgaagaagcaccaagactccgtatgtaaacttcagcaaaaagtgcagaactcgaagatgtccgaagcctcaggaattcagcaggaggactcatatcctaagggatccaagaatatcaaaaacagtcccaggaaatgtcttaccgacactaatctcttccagaaaaattcgagctttcatcccatcagggtacataatttacagatgaaactgagaagagatgatataatgtgggagcagtag

SEQ ID NO: 28571 - DNA, 1833 bp, Artificial Sequence
  Description of Artificial Sequence: Synthetic coding sequence
atgtctcaaacatcactcaaacaaaaaaaaaatgagcccggtatgaggagttcaaaggagtccctagaagctgaaaaaagaaaggaatcagacaaaaccggggttcggctgagcaatcagatgcggcgagctgtgaatccgaatcactccttgcggtgctgccccttccaaggtcacagtagttgtaggcgctgcctgtgtgcagcagagggcacagcactggggccttgtcacaccatccgcatctacatccatatgtgcttgctttgggaacaggggcagcagatcactatgatgaggggttctcaggagtcctccctccgcaagacggactctaggggctacctcgtgcgctcccagtggtcccgcatctccaggtcgccttcaacaaaagcgccttcgatagacgagcctcgcagtcgcaacacgagcgccaaacttccctcatcaagcacttcatccaggaccccctctacctccccatccctccacgattcctcgccgcctcctcttagtggacagcccagtctgcagccccctgctagtcctcagcttcccagaagcctggacagccgccctccgactcccccagagcctgatcccggaagtcgccgaagtacgaaaatgcaggagaatcccgaggcctgggctcagggaattgtccgggaaatacgtcagactcgagattcacagccccttgaatacagtcgcaccagcccaacagagtggaaaagctcttcacagagacggggtatctatccggcttccacacagctcgaccgcaactcgttgagcgagcagcagcaacagcagcgggaagatgaagatgattatgaagctgcgtattgggcctccatgcgcagtttctacgaaaagaatccttcctgcagcagaccttggcccccaaaaccaaagaatgccattactatcgcactttctagctgcgccctgtttaacatggttgatggcaggaagatctatgaacaagaaggattggaaaagtacatggagtatcagttgacaaacgaaaatgtaatcctgacaccaggccctgcctttcgttttgttaaagcgcttcagtacgtgaacgctaggctgcgagatctttaccctgacgagcaggacctgtttgacatagtgctcatgactaataatcatgcgcaggtgggggttcggttgatcaattccgtgaatcattacgggttactcatagataggttctgtctgactggaggcaaagaccccataggctatctcaaggcttatttgaccaatctgtacattgcggctgactctgaaaaagtccaagaagccattcaggaagggattgcctctgccaccatgttcgacggcgcaaaggacatggcctactgcgatactcaactgcgcgtggcctttgacggcgatgcagtgctcttttcagacgagtctgaacacttcacaaaggaacacggacttgataaattttttcagtatgatacactgtgtgagagtaagccccttgcacagggacccttgaaggggtttctggaagacctgggtagactccaaaagaagttctatgcgaagaatgaaagactgctctgccctattcggacttatttagtgactgctagaagcgcggcatcttctggggcaagagtgctcaagactcttcgcagatggggcctcgaaattgacgaggcactctttttggcaggcgctcctaaatcccccatcctggtaaagatccgacctcacatcttcttcgacgatcacatgttccacattgagggcgcacaaaggcttggttcaattgccgcatatggatttaacaagaagttttcctcatag

SEQ ID NO: 28572 - DNA, 456 bp, Artificial Sequence
  Description of Artificial Sequence: Synthetic coding sequence
atgtctaaaaacaccgtgtcttccgccaggttcagaaaagtcgatgttgacgagtacgatgagaataaattcgttgacgaggaggacggcggagatggccaagccggtccagatgagggcgaggtggactcctgtctccggcaggggaatatgacggcagccctgcaggcagcactgaagaaccctcctatcaatacaaagagccaggctgtgaaagatagggcgggtagcatcgtactcaaagtgctgatcagctttaaggctaatgatatcgagaaagccgtgcaatcattggataaaaatggggtggacctgttaatgaagtacatttataaaggattcgaaagcccatcggataatagttccgcaatgctcctgcagtggcacgagaaggccctcgctgccggtggcgtaggatctatcgtgagagtgttgaccgcaagaaagacagtctag

SEQ ID NO: 28573 - DNA, 3522 bp, Artificial Sequence
  Description of Artificial Sequence: Synthetic coding sequence
atggtcacagtcggtacaaacatactcccttcaaggcctgcggctagcgccaacacagctcgagaggatgcagcactgttctccagaagaatcccccctcgccacaagaacggcgcagcccagcccggtgctgcgcctggcccaggcgcaccgggtgccaatatgggaaatgctcattccaaaagtggcgatcggcattccgctctacccggtagaccggaactcagcttctacggatccttcccaaggaaatggagtgaaaacgtattcttggacaacgagctcctgacctccaaaatcctatccgtcctgagaccacaaagtgagagaggcttccgtgcgggtgatctgcgatatcccactcactttctcagtaccaactctgtgctcgccagcgtgactgcatccctgaaggaacatccccgtggcacattgctgtccgacggaagcccagcactctcacgcaacgtcggaatgacagtcagccagaaaggcggaccacagcctacaccgagcccggctgggcctggaacccagctgggaccaattacaggtgaaatggacgaagctgattcagcctttttgaaatttaagcagacagctgatgactcgctgtccttaacgagcccaaatactgagagcatctttgtagaggacccgtacaccgcctctctgagaagcgagatcgagtctgatggtcacgagtttgaggctgaatcatggtcgctcgcggtagacgccgcttatgccaagaagcagaaacgggaagtcgtcaagcggcaggacgtgctgtacgaactgatgcagaccgaagttcatcatgtgcggacactcaaaataatgttgaaagtgtacagtcgggcacttcaggaagagctgcagttctcttctaaagccatcgggagattgttcccttgtgctgatgatctgcttgagacccatagccattttctggcacgcctgaaggagagacgtcaagaaagcctggaggagggatcagacaggaactacgttattcagaaaattggcgatctgctcgtgcagcaattctccggcgagaacggggaacggatgaaggagaagtacggggtcttctgcagcggacacaacgaggcagtctcccactacaagctgctgttacagcaaaataaaaagttccagaacctgataaagaagataggcaactttagcattgtgaggagactgggggtacaagaatgtatactgctggtcactcagcgaatcactaagtatcccgtgctcgtggagcgaattatccagaatactgaggcaggaacggaggattacgaggacctgactcaggctctcaatctgatcaaagatatcatttcccaggtcgatgctaaggtcagcgagtgtgaaaaggggcagcggctgagggaaattgcgggaaaaatggatttgaagagtagttccaaacttaaaaatggactgacgttccgaaaagaggatatgctccagagacagctgcacctggaaggcatgctctgctggaaaaccactagtgggagactgaaagacatcctggcaatcttgctgacggatgtgctgctcctactgcaagaaaaagatcagaaatacgtgtttgccagtgtcgactctaagcccccagtcatctctctccagaagctcatcgttagagaggtggcaaacgaggaaaaagcaatgttccttatttccgcatcactccagggacccgagatgtatgaaatctacacatcatccaaggaggatcggaacgcctggatggcgcacatccagcgagcggtagagtcctgccctgacgaggaggaggggccattttcccttcccgaggaagagcgcaaggtagttgaggccagggcgactagactgcgcgacttccaggagaggctgtccatgaaggaccagctaattgcacaatccctcttggaaaaacagcagatctatcttgaaatggcagaaatggggggtctggaagacctcccacagcctcggggtttattcagaggtggagaccctagtgagactcttcagggagagcttattctcaaatctgccatgtctgagattgaggggattcagagcctgatttgcagacaactcgggtcagcaaacggtcaggcagaggatggcggttcctcaactggaccgccaaggcgcgctgagacatttgcgggatacgactgcacaaattctcctactaaaaatgggagctttaagaagaaagtcagctcgacagatcccagaccacgggactggagaggaccccctaacagccccgatctcaagctcagcgactccgacattcctggatctagcgaggaaagtccacaggtggtggaagctccagggacagaatccgatcccaggcttcctactgttttagaatcagaactggtgcagcggattcagactctgtcccaactgctgcttaatctgcaggcagtgatcgctcaccaggactcgtacgtcgagacccagcgggcagccatccaggaacgcgagaaacagtttcggctccagagcacgcgcggaaatctgctgttggagcaggagcgccagagaaacttcgagaagcaacgagaggagagggccgcactggaaaaactgcagtctcagctccgtcacgagcagcagcgctgggagcgcgaacgtcaatggcagcaccaggagctggagagagcgggagcacgcctgcaggaaagggagggtgaagccaggcagctccgcgagagattggagcaggaacgggctgagttggagagacaacgccaggcttaccagcatgacctggagcgcctcagagaggctcaacgggctgttgagagagaacgtgagagactggagctcctgcggaggcttaaaaagcagaacaccgccccaggagcgttaccacctgacaccttagctgaggcacagcctccatcccacccgcctagttttaatggggaggggttggagggacccagggtgtctatgcttcctagcggagtggggccagaatacgccgagaggccagaagtcgctagaagagacagtgcccctacggagaacaggctagccaaatccgatgtgcccatccagctgttatccgcaacgaatcaattccagcgccaggctgccgtccagcagcagatacccaccaagcttgccgcatctacaaaagggggaaaggataagggtggtaaatcccgtggttcgcaacggtgggaatcgtccgcgtcattcgacctgaagcagcagctgctcctgaataaactgatggggaaggacgagtctacctcgaggaacaggcgctctctaagtccaatcttaccaggacgacattctcccgctccgccacctgaccctggatttcctgctccaagtcctccccctgccgattcaccgtccgagggattcagtttgaaggcgggtggcacagcattgctacccggtccacctgccccatcaccactgccagccaccccgctgtccgcgaaagaagatgcgagtaaagaagacgttatcttcttctag

SEQ ID NO: 28574 - DNA, 1674 bp, Artificial Sequence
  Description of Artificial Sequence: Synthetic coding sequence
atggacagtaccgtaccttctgctctagaactaccccagcggctagctctgaacccgagggagagccccaggtcacctgaagaggaggagccccacctgctctcgtcactagccgcagtgcagactcttgcttccgtgataagaccttgctatgggccacatggccgacagaaattcctcgtgaccatgaagggcgaaacggtgtgcaccggctgcgctactgcaattctaagagccctggagttggagcacccggctgcttggttgttaagagaagccggtcagacccaggctgagaactccggtgatggaaccgcttttgttgtcctgctgaccgaggctctgctggagcaggctgagcagcttctgaaagctgggctgccacggcctcagttgagagaggcatacgccaccgctactgccgaagtattggctacgttgcccagccttgctatacagtctttgggacctctggaagatccttcttgggccctccactctgttatgaacacccatactctgagccccatggaccacttgacaaaactcgttgcgcacgcatgttgggccatcaaagaactcgacggctccttcaaaccagagcgagtcggcgtttgtgcattgcctggcggaacactcgaggatagctgtctgctgccagggctggccatcagtggaaagctttgcggacagatggcaaccgtgctctccggcgctagggttgctctattcgcatgcccattcggccctgcccaccccaatgccccagccaccgctcggctatcgtcacctgccgatcttgcacagttttctaaaggaagcgaccagttacttgagaaacaagtcggtcagttagccgcagccggaattaatgtcgccgttgttctcggggaggtggacgaggagactctcactttagccgacaaatatggaattgtggtgattcaggcaagaagttggatggagataatttacctatccgaagtcctcgacactccacttctcccacggttgctgccaccccaaagacccggaaagtgccaacgcgtttatagacaggagcttggagacgggctcgccgtagtctttgagtgggagtgcaccggcaccccagccctcaccgtggttctgcgaggcgcaacaactcaaggcctccgcagtgctgagcaagcggtgtaccacggaatcgatgcttatttccaactttgtcaggatcctcgactgattccgggtgctggagccactgagatggcactggccaaaatgctgtccgataagggttctcgcctcgagggtcccagtggtcccgctttccttgcttttgcatgggccctgaaatacctgccgaagacccttgcagagaatgccggacttgctgtctctgacgtaatggccgagatgtctggcgttcaccagggcggaaacctcctgatgggggtcgggaccgaggggattattaacgtggcccaggaaggtgtgtgggacacgttaatcgttaaggcgcagggttttagggctgtggccgaggtcgtgcttcagttggtcacagtcgatgaaatcgtggtggccaagaaatcaccgacccaccaggagatttggaatcctgactctaagaagactaagaaacacccaccccctgtggagactaagaagatcctgggcctcaataattag

SEQ ID NO: 28575 - DNA, 939 bp, Artificial Sequence
  Description of Artificial Sequence: Synthetic coding sequence
atgactaggtccctatttaaaggaaacttctggtcggccgacattctgtccaccattgggtatgacaatatcatacagcatctgaacaatgggagaaagaactgcaaggagtttgaagacttcctcaaggaaagagcagctatcgaagagagatatggcaaggatctgcttaatttatcgcgcaagaagccatgcggccagtctgaaatcaacactctgaagagggcactggaggtttttaaacaacaggtagataacgttgcccagtgtcatatacagctggcccaatctcttagggaggaagccagaaaaatggaggaattcagagagaaacagaaacttcagagaaagaaaacagagttgataatggacgcaattcacaaacagaaatcattacagtttaaaaagacaatggatgctaaaaagaattacgagcaaaaatgccgggataaagatgaggcagagcaagcagtgagccgtagcgccaatctcgtcaaccctaagcagcaggagaagctgtttgtcaaactggcaaccagcaaaacagccgtggaagactcagataaagcctatatgctccatataggtacccttgataaggtgcgcgaggaatggcagtcagagcacattaaggcctgtgaggccttcgaggcacaggaatgcgagcgtattaatttttttcgaaacgccctctggctgcacgtgaaccagttaagtcagcagtgcgtcacctcagatgaacatccctcatgcatgcgcatctccacaccaccacgtcggatgcagtcacaacaggaacgcctccagggactaacatggcagggggaggaccccagtcaatttctcaaggcacatcaaatgattcccattaccttatggttgatgaccactgtgtgttccatctccaagatcaacgaaactcgagcattctcaggctag

SEQ ID NO: 28576 - DNA, 3693 bp, Artificial Sequence
  Description of Artificial Sequence: Synthetic coding sequence
atgcctaggaaaggcacgcaacccagcaccgccagacggcgtgaggagggtccccctcctcccagcccagacggcgcaagctccgatgcagagcccgagcctccgagcggtagaacagagtcccccgcaaccgctgccgaaactgcaagcgaggaacttgacaataggagcctcgaggagattctgaattcaattccccctccccctccgcctgccatgacaaacgaagccggagcacccagactcatgattacacacattgtgaatcagaattttaagagctacgctggtgaaaaaattctcggacctttccataagcggttttcctgcatcattggtcccaatggcagtggcaagagcaacgtgatcgatagcatgctgttcgtttttgggtatagggcacagaaaattagaagtaaaaaactgtccgtcctgatccacaacagcgacgaacataaggatattcaatcctgcacagtggaggtgcattttcagaagattatcgacaaagagggggacgactatgaggttatccccaactcgaacttctacgtctctaggactgcttgcagagataatacatctgtttatcacatatcaggaaagaagaagaccttcaaggatgttgggaatctgctgcggagccatgggattgatttggatcataatcggtttctgatattgcagggggaagtggagcaaattgcaatgatgaagcctaaaggacaaacagagcacgatgaaggcatgctggaatatttagaggatatcatcgggtgcggacggctgaatgaacccatcaaagtcttgtgtaggagagtggagatcctcaacgagcatcgaggagaaaagctgaaccgcgttaagatggtggagaaagaaaaagacgctctggagggagaaaaaaacatagccatagaatttcttaccctggagaatgaaattttccggaaaaagaatcacgtgtgccagtattacatttatgaattgcagaaaaggatagctgaaatggaaacccagaaggagaagatacacgaggacacaaaagagatcaacgagaaatccaacatattatcaaacgaaatgaaggctaagaacaaggacgttaaggacaccgagaaaaagttgaacaaaatcactaagttcatagaagaaaacaaggaaaaattcacacagctagatttagaggatgtacaggttcgcgaaaagctgaaacatgccacctctaaggccaaaaaacttgagaagcagctgcaaaaagacaaggaaaaagtggaggaatttaagagcattccagctaaaagcaataacataatcaatgaaacaaccacaagaaataacgccctggagaaggaaaaagaaaaggaagaaaagaaactgaaagaagttatggattcactgaaacaggagacacagggtctgcaaaaagagaaagagtctcgcgaaaaggagctcatggggttctccaagtctgtgaacgaggctcgatctaaaatggacgtggcgcagtcggaattggatatctatctgtctaggcacaataccgctgtctcgcagctaacaaaggcaaaggaggcactgatcgccgcttccgagacattaaaggagagaaaggctgcgattagagatattgaaggcaagttgccccagaccgaacaggagctgaaggaaaaggagaaagagctgcagaagttgactcaggaagaaactaactttaaatctcttgtccatgacctatttcagaaagtggaagaggcaaagtcaagcctcgccatgaatcggagtaggggaaaagttcttgatgccatcattcaggagaaaaagtcaggcaggatccctggtatctacggcagactaggggatctcggggcaattgatgagaaatacgatgtggcaatttcgagttgttgccatgcgttagattatattgtggtggactctatagatatcgcccaggagtgcgttaatttcctgaaacgacagaacattggcgtggccactttcataggactcgacaagatggcggtgtgggccaaaaaaatgaccgaaatacagacgcctgagaacacacctcggctgtttgatctggttaaagtaaaggatgaaaaaatccgtcaagctttctactttgcgcttagagacaccctggttgctgacaatctggaccaggccacacgggtggcctatcagaaagacaggcggtggcgagtcgtgactctgcagggacagattattgagcaaagcggcaccatgacaggcggagggagcaaagtaatgaagggcagaatggggagctctctggtgattgagatcagcgaagaagaggttaacaagatggagagtcagcttcagaacgattccaagaaggctatgcagatccaagagcagaaagtgcaactggaagagagagttgttaaattacgccacagcgaacgcgagatgcgcaatactctagagaagtttaccgctagtatccaacggctgatcgaacaggaggagtacctgaacgtccaagtgaaagagctggaagctaatgtcctggctactgcacccgacaagaaaaaacagaagttacttgaagagaatgtgagtgccttcaagaccgagtacgacgcggtggcagagaaggcaggaaaagtggaagcggaggtgaagcgcctccataatacaattgtggaaataaataatcataaactgaaggctcagcaggacaagcttgacaagatcaacaaacagctggatgaatgcgcctctgcgattacaaaggcacaggtggcaattaaaaccgctgaccggaatctccaaaaagctcaggactctgtactccggacagaaaaggaaataaaagacacggagaaagaggtggatgacctgacagcagagttaaagagcctggaagataaggctgcggaagtcgtgaagaataccaatgccgcagagatcagcaaaattagtcttcatccaatcgaggacaaccccatcgaagagatctctgttctctcccctgaggacctggaggccatcaagaatcccgacagcatcacaaatcagatcgccctgttggaagcgaggtgtcacgaaatgaagccgaacctcggggctatagcagaatataaaaagaaggaagaactgtatctccaaagagtggccgaactggacaaaattacctacgaacgggactctttcaggcaggcgtacgaagatctgcgaaaacagagactgaacgagttcatggctggtttttacattataaccaacaagttaaaggaaaactaccagatgctgactctgggcggagacgctgaactagagctggtggacagtctggatccattcagcgaaggcattatgttctctgttaggcctcccaaaaagtcctggaaaaaaatctttaatctgagtggtggggagaaaacgttgagcagccttgcgcttgtgtttgcactccaccactacaaacctacccccctctactttatggacgagattgacgccgcactggacttcaagaatgtgagtatcgtggccttctacatttatgagcagaccaaaaacgcccagttcattatcattagtctcaggaacaacatgttcgagatatccgatagacttattggtatatacaagacatataacattacaaaatctgtagccgttaacccgaaggagatcgcctctaaagggctgtgttag

SEQ ID NO: 28577 - DNA, 2661 bp, Artificial Sequence
  Description of Artificial Sequence: Synthetic coding sequence
atggaacttaggtgtggaggtctgctgttctcctcccgattcgactccggaaacttggcccatgtggagaaagtagagtctctttcatcagacggagagggcgtgggagggggtgccagcgcgctgacgagcggaatagctagtagtccagactatgagtttaacgtgtggaccagaccagactgcgcagaaactgaattcgaaaatggaaacaggtcttggttctactttagtgttcgaggaggaatgccaggcaagctgattaagatcaacatcatgaatatgaacaaacaaagcaagttgtactcccaaggcatggcaccctttgtaaggaccttgcccacccgtcctagatgggagcgcattcgcgatcgaccaacttttgagatgaccgagacccaatttgtcctcagcttcgtgcatagatttgtggaagggaggggggctaccacatttttcgcattctgttacccattctcgtactctgattgtcaggagctgctgaatcagctagatcaacgcttccctgagaatcacccgacacattcctcccccctcgacacaatttattaccaccgagagcttctgtgctattccctggacggtctgcgtgttgatttactcacaataacctcatgtcacggcttacgcgaggacagagaaccgaggctggagcagctgttcccagatacgtccacacctaggcccttcaggttcgccggtaagaggattttcttcttgtctagtcgcgtgcatcccggagagacgccctcctcttttgtgttcaatggcttcctggacttcatattacggccagacgaccccagggcacagacacttcgcagacttttcgtgttcaaactgatccctatgcttaatccagacggcgtggtgagaggccactacaggactgactcccgcggtgtaaacctgaacagacaatatctaaagccagacgccgtcctgcaccctgcaatatacggcgcaaaggcagtattgctctaccatcatgtgcacagccgactgaactctcagagctcctcagaacatcagccctcttcatgtttgcctcccgatgccccagtctctgatctggaaaaggccaacaacctccaaaacgaagcacagtgcggtcatagcgctgaccgccacaacgccgaagcatggaaacagacagagccagcggagcagaaactcaacagtgtgtggattatgccacaacagagcgccggtttagaagagagtgcaccagataccatacctcctaaggaatctggggttgcttattacgtcgacctccacggtcacgccagcaagaggggttgctttatgtatggcaactccttctcagatgaaagcacacaagtggagaacatgctttacccaaagctgatatcattgaactccgcccacttcgattttcagggctgtaatttttccgagaagaacatgtatgcgagggataggcgagatggacagtccaaggagggaagcggacgggtggccatatacaaggcctcaggcattattcactcttacacactggaatgcaactataacacgggcaggtcagtgaatagtatccccgctgcttgtcacgacaacggacgcgctagcccaccacctcctccagcatttccatccagatacactgtggagcttttcgagcaggttggcagggcaatggccatcgccgctcttgatatggccgaatgtaacccctggccaaggattgtgctcagcgaacactccagcctgactaacctgcgtgcttggatgctcaagcacgtgagaaactctcgtggactgtcttcaaccctgaacgtgggagttaacaaaaaaagagggcttagaacgcctccaaaaagtcacaacggactgcccgtatcgtgctcagaaaatacgctctcccgggcaaggagtttttcgacgggaacaagtgccggaggctcgtcaagctcacaacaaaactctccccagatgaaaaattcccccagttttccgttccacgggtctcggccagcagggctgcccggactgggttcatctactcagaaagtaacacaccgcgttctgggtcccgtcagagagccccgttcccaggataggcgccgacaacagcaaccccttaaccatcggcctgccggatcccttgctccttcacccgcaccgacttcctctgggccagcaagttctcataaactggggtcttgcctacttcctgactccttcaatatccccggttcttcctgttctctgttatcaagcggcgataaacccgaggccgtgatggtgatcggcaaggggcttttaggaaccggagcgagaatgccatgcatcaagaccagactgcaggcaagaccgaggttgggacgcggttcgcccccaacccgcagaggcatgaaggggtcctctggtcccaccagccccacaccaagaactagagaaagctcggaattagagctgggtagttgtagtgccacccccggactgcctcaagccaggcctccacgccctaggagcgcacctgcattttcgcccatctcctgtagtctctctgactctcctagctggaattgctattcgagggggcctcttggtcaacctgaagtatgctttgtgcccaaatctccacctctaactgtttctccaagagtgtag

SEQ ID NO: 28578 - DNA, 4221 bp, Artificial Sequence
  Description of Artificial Sequence: Synthetic coding sequence
atgtggtctctcactgcctcagaaggcgagagcacgaccgcccatttcttccttggcgctggggacgaggggctaggtactcggggaattggcatgaggcctgaagaatcagattctgaactgctcgaagacgaggaggacgaggtccctccagagccgcagattatagtaggcatctgcgcgatgaccaaaaagagtaaaagtaagcctatgacccagatattagagcgtctctgcaggtttgactatctcactgttgtgatcctcggagaagacgtcatcttgaacgaacccgttgagaactggccgagttgccattgcctgatctccttccattccaagggattccctctggataaagccgttgcctatagcaaactgagaaacccgttcctcataaacgatcttgccatgcaatactatattcaggatcgaagggaggtctatagaatacttcaggaggaggggatagatttgccacggtatgccgtcctgaatcgggatcctgccagacctgaggagtgcaaccttattgagggagaggaccaggtggaggtgaacggagccgtcttcccgaagccgttcgtagaaaaaccagtgagcgccgaggatcataacgtctatatctactatccatcctcagccggaggtggcagccagcgtctgtttcgtaagatcggctccagatcctccgtttattcccccgaaagctctgtacgcaagacgggttcatacatatacgaggaattcatgcctaccgatggaaccgatgtgaaagtgtacacagtgggaccagattacgcgcacgcagaagcccgaaagtccccagcactcgatggcaaagtggaaagggactctgagggaaaagaaattcggtatcccgtgatgctgacagctatggagaagttggtggccaggaaagtctgtgtggccttcaaacagaccgtgtgcggcttcgacctcctcagagccaacggccacagttttgtgtgcgacgtcaatggcttctcttttgtgaagaactctatgaagtattatgacgattgcgctaagatactgggcaacacaatcatgcgcgagctggctccccagttccagatcccatggagcatcccgactgaggctgaggacataccaattgtgccgactacaagcggaacaatgatggaactaaggtgtgtaattgctattatcagacacggcgacaggacacccaagcagaaaatgaaaatggaggtgaagcaccctagatttttcgcgctctttgagaagcatggaggatacaaaacaggcaagttgaaactgaagcgtcccgaacaacttcaggaggtgttggacatcacgaggctcttgttggcggagcttgaaaaggaacctggcggtgaaatagaggagaagactggtaaactggagcagctaaagagcgtactagagatgtacgggcatttctccgggattaataggaaagtgcagctcacttactatccccatggcgtaaaggcttctaatgaaggtcaggatcctcaaagggaaacactggctcctagcctgttgcttgtcctgaagtggggaggcgagctgacaccagcagggcgagtccaggcagaagaactgggcagggcgttccggtgcatgtacccaggaggtcagggagactatgccggtttccctggttgcggacttctgagactgcatagtacctttcgccatgatctcaaaatctacgctagtgacgagggtagggtgcagatgactgcagcagctttcgcgaagggactactggccctggagggcgagctgacaccgatccttgtgcagatggtgaaatcggctaacatgaatgggctcctggacagcgacggcgattcactgagctcatgtcaacacagagttaaagcccgtctgcatcatatactgcagcaggacgccccttttgggcctgaggactacgaccagctggcccctaccaggtccacaagtctcctgaactctatgactatcatccagaaccctgtgaaggtctgcgatcaggtcttcgccctgattgaaaatcttacccaccaaatcagagaacggatgcaagatccgaggagcgtcgacctgcagctctaccacagtgagacactggaactgatgctgcagcggtggagtaaattagaaagggacttccggcagaaatccggtaggtacgacatatcaaaaattcccgacatctacgactgtgtgaagtacgatgttcagcacaatgggtcgctgggactccaaggaactgccgagctgcttaggttgagtaaggctcttgccgatgttgtgataccccaagaatacggaatctcccgagaagaaaagttggaaatcgcagtgggattctgtttgcctctcctgcgaaaaatcctgcttgatctccagagaacacacgaggacgagtcagttaacaagctccaccccctttactctcgtggagtcctttccccaggaaggcatgtgcggacaaggttgtacttcacaagcgaatcgcacgttcacagtctgcttagcgtttttcgatatggcggactgctggacgaaactcaggatgctcagtggcagagagcactggactacctgagcgccatttcagagctgaattatatgacccagatcgtgattatgctctatgaggacaacactcaagaccccttgtcagaagaacggttccacgtggagctgcatttcagccccggtgttaaaggtgttgaggaggagggctccgcgcctgcaggatgtggctttcgtcccgcatcaagcgaaaatgaagagatgaagactaaccaaggatctatggagaatctgtgcccgggtaaggctagtgatgagcctgacagagctctgcagactagccctcagcctcctgagggtccgggacttccaaggcgttctcccttgattcgcaataggaaggctggcagcatggaggttctaagtgagacatcctcatcaaggcccggagggtataggctcttctcaagctcccggcctcccacggaaatgaaacagagcgggctgggttttgagggatgtagtatggtgccaaccatttaccccttggagacactgcacaatgcattgtccctccgacaggtctctgaatttctctcaagagtgtgtcagagacacaccgacgcgcaagcccaagccagtgccgcattgttcgatagtatgcactctagccaggcgtcagataaccctttctcccctccgaggaccctgcactcgccaccactccagcttcagcagcgctctgagaagcccccttggctcgagacaagattctgccatgtagggcaggccggactggaattgttaacctcctcagatcttccggctagcgcaagtcagtcagctggaatcactggcgtctctcatcgcacacaacccgactcttccggcccttcgtctaccgtcagcagcgccggtccttcctccccgaccaccgtggacggaaacagccaattcggcttttccgatcagccttcccttaactctcatgtggcggaggagcaccagggactggggctcctccaggagactccaggctctggagctcaggaactttccatagaaggggaacaggagctattcgagcccaaccagtcgccacaggtacctcccatggaaactagccagccttatgaggaagtctctcagccctgccaagaggtgccagatatttcacagccctgccaggacatttccgaagccctgagccagccctgtcagaaagtgccggatatcagtcagcagtgccaggaaaatcacgataatggtaaccatacctgccaagaggtgccccacatttctcagccctgtcagaaatcatcccagttgtgccagaaagtcagcgaagaggtgtgtcagctgtgcctggagaacagcgaggaggtctcccagccttgtcagggcgtgagcgtggaggtcggcaagttagtccataaattccatgtcggtgtagggtcattggtgcaggaaacactggtcgaagtggggagcccagcagaggagatcccagaggaagtgatccagccataccaagaattctccgtggaagtgggaaggttagcccaggagacatccgcaattaacttgctgagtcaggggattccggagattgataagccttcccaagagttcccagaggagatcgacctgcaagcgcaagaagtgcccgaggaaatcaactag

SEQ ID NO: 28579 - DNA, 1308 bp, Artificial Sequence
  Description of Artificial Sequence: Synthetic coding sequence
atgggggatctagagcttctgctgcctggagaagctgaagtgctagtgcgagggctgcgaagctttcccctgcgggagatgggctctgagggatggaatcagcagcatgagaatctggagaagctaaatatgcaagccattttggacgcaactgtttctcaaggagaacccatccaggaacttctcgtgacgcatgggaaagttccaactctggtggaggagctgatcgccgtcgagatgtggaagcaaaaagttttccccgtgttctgccgcgtagaagactttaaaccacagaatacatttcctatctacatggtagtgcatcacgaggcttcgattattaatttactggagaccgtattttttcacaaggaggtctgcgaatccgcagaggacactgtgctagatctcgtagattactgtcatcgaaagctgacgctcctcgtggctcagagcggttgtgggggtccacccgagggagaaggcagtcaggatagcaacccaatgcaggagctacagaaacaggctgaactaatggagttcgagattgcactcaaagcattgtcagtgttgcgctacattactgactgtgtggaccgccagtggtctgtgtcgcagcccccacaactcgctcatcttaaaagaatccagcggctgcaccccgtctgctggttcctgagtcctgggaaattgcagcagttcgaagggtctaggtggcacactgtcgcaccaagcgaacaacagaaactcagtaaattagacggccaggtctggattgcgctatataacctccttttgtctcccgaagcccaggcacgatattgcttgacttcatttgccaagggccgtctcctgaaattgagggcgttcctgacagatacactgctcgatcagctgcctaatctcgcccatttgcagtccttcctggcccaccttacacttactgagacgcagccacccaaaaaagacctggtgctcgaacaaattccagagatctgggaacggctcgaaagagaaaacaggggtaaatggcaggccatcgctaaacatcagttgcaacatgtgttttcccctagtgagcaagatctgcgccttcaggccaggcgctgggctgagacataccgtctcgacgtgctcgaagccgtggctcccgagaggcccaggtgtgcatattgtagcgccgaggctagtaagcggtgcagccgctgccagaacgagtggtattgctgtcgcgaatgccaggtgaagcactgggaaaaacacgggaagacatgcgttctggccgcacagggggacagagccaagtag

SEQ ID NO: 28580 - DNA, 1377 bp, Artificial Sequence
  Description of Artificial Sequence: Synthetic coding sequence
atgaacgaggctatggctacggatagtcctcggaggccttctagatgcaccgggggtgttgtggtcagaccgcaggccgttaccgaacaatcatatatggaatcagtagtgacctttctccaggacgttgtgccgcaagtgtactgttgcggtgacaatatccaatcctacaccgccaccgtcatatccgcggctaagaccctgaaaagtggcctgaccatggtgggaaaagtggtgactcagctcaccgggaccctccctagcggtgtgaccgaagatgacgttgctatccattcaaactcccgcaggagccctttagttcctggaatcatcactgtcatcgatacagaaactgtaggcgagggtcaagttcttgtctctgaagattctgactccgatggcatcgttgcacatttccctgcacatgaaaaacccgtgtgttgcatggcgtttaacacaagcggcatgcttcttgtcactaccgacactctaggtcatgacttccatgtctttcagatcctgactcatccctggagttccagccaatgtgcagttcatcacctttataccttacaccgcggagagaccgaagcaaaagtgcaggacatctgcttttctcatgactgcagatgggtcgtggtgtcgacccttagaggaacatcccatgtctttcccataaatccctatggcggacagccttgcgtgcgcacccacatgtctccgagagtagtcaaccgcatgagtcgatttcagaaatctgctggactagaggaaattgaacaagagctgacctctaagcagggcggaagatgttctcctgtcccaggccttagctcaagcccttccggctcacccttgcacggcaagctaaactcacaggacagttataacaacttcaccaataacaaccccggtaatccgaggctgtcaccactccctagcctgatggttgtaatgcctttggcacagattaagcagcccatgaccctgggaaccattaccaaacgcaccggcaaggtaaagcccccaccacagattagtccgtctaaatctatgggaggagagttctgtgtcgccgctatattcggcaccagtagaagttggttcgctaataatgcaggactgaaacgcgagaaagaccaaagcaaacaggtcgtggtggagtctctttatataattagttgctacggtaccctagttgaacacatgatggagccccagccactaaatgggatgaactgctcgcatagacttatgcaaactacactctgcagtagcctgcaaatgcagtactcaatcattagcagttgtttactggcttggtttcccttggaggttctaggacccctcctagacatgggcctcactactgtgtag

SEQ ID NO: 28581 - DNA, 309 bp, Artificial Sequence
  Description of Artificial Sequence: Synthetic coding sequence
atgcgggctagcccgtgcatctcccaacctgcggcatcttggcaccccagaccatccgctctgcgtccgaccgccggaagtgggcctgatacccgaactcccggaacagtcgaagacggttccgcaccgtgcccggcttttaggagtccagccgtcagcccctgtggagaggagccatgctgttttcaaatctcccccgctgaagagaccctggagcttggcagattggtctcccccggatgccacaagtccagtgcacctcaagaacgcagattagacccacgagctcgctgtgtggttcacatttag

SEQ ID NO: 28582 - DNA, 4227 bp, Artificial Sequence
  Description of Artificial Sequence: Synthetic coding sequence
atgtggagtctgacagcaagcgagggtgagagtactaccgcgcacttcttcctgggagctggggatgaagggctgggcactagggggatcggcatgcgccctgaggagtctgatagcgaactgctggaggacgaggaagacgaggtccctcccgagccccagatcatcgtaggtatttgtgccatgaccaaaaaatccaagagcaaaccaatgacccaaatcttggaacggttgtgccgatttgattacctcaccgtcgtcattctgggggaggatgtgatcctcaatgagccggtggagaactggcccagctgtcactgcctcataagcttccatagcaagggttttccattggataaagccgttgcgtatagcaagctacggaatccttttctaatcaatgatctcgctatgcagtactatatccaggaccggcgagaagtgtatagaattctgcaggaagagggcattgaccttccccgttatgcagtgctaaatagggatccagctcggccagaggagtgtaacttaattgaaggcgaggatcaagtcgaagtcaacggagccgtatttccaaaaccctttgtcgagaaacccgttagtgctgaggaccataatgtgtacatctattatccatcctccgcagggggagggagccagcgcttgttccgaaaaatcggatccagaagctccgtctattcgcctgaatcatcagtgcgcaagaccggttcctacatatatgaagagtttatgcccactgacggcactgatgttaaggtttataccgtcggtccagactatgctcatgcagaggctcggaagagcccagctctggatggaaaggtcgagcgggactccgaagggaaagagatcagataccctgtgatgctcacagcaatggaaaaactggtggctcggaaagtttgtgtggctttcaaacagaccgtttgcggcttcgacttactacgcgctaacggccattctttcgtgtgcgacgtgaatggtttcagcttcgttaaaaactcgatgaagtattacgatgactgcgccaagatcctggggaacactattatgcgggagctggcaccccaattccagatcccttggagtatccctacagaggcggaggatattcctatcgttcccaccacatcaggaacaatgatggagctgcgctgtgttatcgcaatcatccgccacggggatcgcaccccaaaacaaaaaatgaagatggaggtgaaacatccgcgattctttgccctcttcgaaaagcatggcggatataagactggcaaactcaagctcaagcggccagagcagcttcaggaggtgctggatatcacacgccttctgcttgctgagctggagaaagaacccggtggagagattgaagagaagactgggaagttagagcaacttaagtcggtcctagaaatgtatggacacttctctgggattaatcgaaaagtgcagctgacctactatcctcacggtgtgaaggcaagcaatgaggggcaggatccacaacgtgagactttagcaccatccttgctgctcgttctcaagtggggtggagagttgacacctgctgggcgagtgcaggcagaggagcttggaagagcttttaggtgtatgtatcccggtggtcagggggattatgccggattcccaggctgtggcctcctgcgcttgcactccacgttccggcatgacctcaaaatatacgcctctgacgaaggcagagttcagatgacggccgctgcatttgccaaaggacttctcgctttagagggggagctgactccaatcctagtgcagatggtcaagtccgctaacatgaatgggcttctggactccgatggggacagtttgagcagctgtcaacacagggtcaaggcccgtctccaccatattctccaacaggacgccccatttggccctgaagactacgatcagctggcccctacacgatccacttctctattgaattcaatgacaatcatccagaatcctgtaaaggtttgcgaccaggtctttgctcttatcgaaaatcttacccatcaaattagggagcgaatgcaagatccaagatctgtcgatttgcagctctatcactccgagacgttggaactcatgttacagcgctggagcaagttggagcgtgactttcgtcaaaaatctggtaggtatgatataagcaagatccccgatatttacgattgtgtcaagtatgacgtgcagcataacggaagcctgggactccagggcactgccgagctgctgcggctgtccaaagccctggccgatgttgttatcccccaggagtacggaatttctcgtgaagagaagcttgaaattgccgtgggcttttgcctccccctgctccggaaaattctcctggatctgcagcgcacacacgaggatgagagtgtgaataagctgcaccctctatacagtagaggggtactgtcaccaggcaggcacgtccgcactcggctgtacttcacttccgaatcccatgttcattcgttgctgtcagtgtttaggtatgggggtttactcgatgaaacgcaggatgcccaatggcagcgcgcactggactatctgtccgcaattagcgaactcaattacatgacacaaatcgtcatcatgctctatgaagataatacccaggaccccctgagtgaggaacgcttccacgtggaactgcattttagtcctggcgttaagggagtggaggaggagggcagcgcaccagcaggctgtggttttaggcctgcaagtagtgaaaatgaagagatgaaaacaaatcagggcagtatggagaatctctgccctggcaaagctagcgatgagcctgaccgggctctgcaaacgtctccccagccccctgaaggccctggacttccgagaagatctccactgatccggaacagaaaggcaggaagtatggaggttctctcagaaacctccagctccaggcccggtggctatcgcctgttttcatctagccgaccccctactgagatgaaacagtccggcttggggtcccagtgcactgggctgttctcaaccactgtcctgggcggatcctctagtgcaccaaacctacaggactatgccagatcccatggcaagaaattgcccccagcctctctaaagcaccgtgacggatttgagggatgtagtatggtgcccacaatatatcctctcgagacactgcacaatgccctgagcttgaggcaggtgtccgagtttctatctagagtttgtcaacggcatacagacgcccaggcccaagccagcgccgcactgttcgacagcatgcattcctcccaggctagcgacaatcctttctctccacctcgtacgctgcatagtccaccactccagctgcagcaaagatcagagaagcccccttggtactcatccggtccctcttccaccgtgtcaagcgcgggaccttcatcgcctaccaccgtcgacggaaacagccagttcgggttctccgatcagccctctctgaactcgcatgtggctgaggaacaccagggacttgggctactgcaagagaccccaggatctggtgcacaagaattaagtatagaaggcgagcaagagctctttgagccaaaccagagcccgcaggttccaccaatggaaactagtcagccgtatgaagaggtttcacagccttgtcaggaggtcccagacattagccagccatgccaggacatatctgaagccctaagccagccatgccagaaggtaccggacatcagccagcagtgccaggagaaccacgacaatgggaaccacacgtgtcaggaagtcccacatatttcacagccgtgtcagaaaagctcccagctgtgccagaaggttagcgaggaggtttgtcaactgtgcctcgagaactccgaggaagtttctcagccatgtcagggagtgagtgtcgaagtcggaaagctcgttcacaagttccatgtaggcgtgggaagccttgtgcaggagacactggtcgaggtcgggtcacccgctgaagaaattcccgaagaagttatccagccctaccaggaattctcagtagaagttggtaggttagcccaggagaccagtgcaatcaaccttcttagtcagggcatcccagaaatcgataagccctcgcaagagtttcccgaagaaatagatctgcaggcccaggaggttcctgaggagatcaattag

SEQ ID NO: 28583 - DNA, 2994 bp, Artificial Sequence
  Description of Artificial Sequence: Synthetic coding sequence
cgtccccctcccgcagggcctcaggccccagagggggcaagggccggaagtcgcccagttcagctgctcgcgctactgtccagctggtgcgaagaattgggcagactcttgctgctgaggcaccagaagtcgcgccagagtgacccccctggtaagctgccaatgcagccacctctgagcagcatgtcatcaatgaagccaacactctctcacagcgacgggtcattcccctatgactctgtgccttggcagcagaatacgaatcagccccctggctctttatccgtcgttacaacagtctggggggtgaccaacacgtcacagtcccaggtattagggaacccaatggccaacgctaataatcctatgaatcctgggggtaaccctatggcctcaggtatgaccacaagcaacccaggactgaactcacctcagttcgcgggtcaacagcagcagtttagcgccaaggcgggtcccgctcagccatacatccagcaatcaatgtatgggaggcctaattaccctggatcaggagggttcggagcgagctaccccggtgggcctaatgcccctgctggcatgggaattcctccccatacgagacctcccgctgatttcacacagccagccgcagctgccgctgctgccgctgtcgctgctgctgccgcaactgccaccgcaaccgctacggctaccgtggctgcattgcaggagacccaaaataaagatataaatcagtacggacccatgggcccaacccaagcttataactcacagttcatgaatcagccagggcctaggggccctgcaagcatggggggaagtatgaatcctgcctctatggctgccggtatgacgccgtcaggaatgtcaggaccacctatgggaatgaatcagcccagaccacctgggatctctccctttggcacacatggccagcgaatgccccaacagacttaccccggacccagacctcagtccttgccaatccagaatattaagcgcccatacccaggggaaccgaactatggtaaccagcagtatggcccaaattcacagtttcctacccagccaggccagtatcctgcaccgaatccacctcggccactgacttcacccaattacccaggccagcgcatgcccagtcagccaagttccggtcagtaccccccaccaacagtgaacatgggccagtactataagccagaacagttcaatggccagaacaacactttttcggggtcttcctatagtaattacagccagggtaatgtgaacagaccaccgcgaccagttcccgtggcgaactatccacactccccagtcccaggcaacccaacaccacctatgacaccagggtcctccatccccccatatttatctccgagccaggacgttaaacctccctttccgcctgatatcaagccgaacatgtcagcgttaccaccacccccagccaatcataacgacgagctgaggctcacatttccggtccgagatggagtggtattggagcccttccgtctggagcacaacttagctgtgtccaaccacgtgttccacttgaggcccacagtccatcagaccctcatgtggcgaagcgatctggaactacagtttaaatgttatcaccatgaagaccggcagatgaatacaaattggcccgcttctgtacaggtgtctgtaaatgcgacccctttaacaatagaacggggagataataagaccagtcataagcccttacacctgaagcatgtgtgccagcctgggagaaacactatacagattacagtcacagcatgttgctgtagccatctatttgtgttgcaactggtacataggcctagtgttagatccgttctgcagggcctgttgaaaaagagacttctccccgctgaacactgcataactaaaatcaaaaggaatttctctagtgttgccgcttcaagcggtaataccacactgaacggtgaggacggagtagaacaaacagccatcaaggtaagcctgaagtgcccaatcacttttcgcagaatccaactacccgcacgtggccacgactgtaagcacgtccaatgcttcgacctcgagtcctacttgcagctcaattgtgagcgcggtacatggcgatgtcctgtctgcaacaagactgcccttctagagggtctagaagttgatcagtacatgtggggaattcttaacgcgattcaacactccgaattcgaagaggtgacaattgatcccacctgttcgtggagaccagtcccaattaaaagcgacctgcacattaaggatgatcctgacggaattccctccaagagattcaaaaccatgagcccttctcaaatgatcatgccaaatgtcatggagatgatcgctgcactgggacccggaccctcgccttaccccctgccgcctcctcccggtggaactaactctaacgactactcttctcaagggaacaactaccagggccatggaaacttcgattttccacacggcaaccctggcggtacatccatgaacgattttatgcacggtcccccacaactgtcccatccccctgacatgcctaacaatatggcagccttagaaaagcccttgagtcaccccatgcaggagaccatgccacacgccggatcctctgatcagccacacccatctatccaacaaggcttgcacgtgccacaccctagcagccagtcagggccaccattgcaccactctggggcaccacctcctccaccatctcagccacctcggcaaccgccacaggccgcacctagcagtcatccgcacagcgatctaacgttcaaccccagctctgcgttagaaggccaggccggtgcgcaaggggctagtgacatgccggaaccttcactggatttactgcccgaactgacaaatcccgatgaattattgagctatttggatccgcctgacttgcccagcaattctaatgatgatctcctgtctcttttcgagaataactag

SEQ ID NO: 28584 - DNA, 3405 bp, Artificial Sequence
  Description of Artificial Sequence: Synthetic coding sequence
atggggaaagaacaggaattgctagaggctgctcggaccggacatctgccagcagtggagaagctccttagcggaaaaagactatcaagcggtttcggagggggaggcggtggtggctccggaggcggtggcggaggctccggaggtggtgggggaggcctagggtccagtagtcaccctctctcctcactgctctcaatgtggcgtggcccaaacgtcaattgcgtggacagcaccggatatacacccttgcaccatgcagcccttaacggtcacaaagacgtggtggaagtacttctgcgcaatgacgctctcaccaacgttgcagattctaagggctgctatcctctgcaccttgcggcttggaagggggacgcgcagatcgttcggcttctgatccatcagggcccatcccatacacgagtgaatgagcagaataatgataatgagacggcgcttcattgtgccgctcagtatggccacaccgaggtggtgaaggtgctcttagaagagttgacagatcccacaatgcggaacaacaaatttgagactccgctggacttggcagctctctacggcagactagaagtagtgaaaatgctgctcaatgcccatcccaaccttctgtcatgtaacaccaagaagcacacccctttacaccttgccgcaaggaatggccataaggctgtggtgcaggtgctcctggatgcgggaatggattcaaattatcagaccgaaatgggaagcgcattgcacgaagccgcactgtttggaaaaacagatgttgtgcagattctgcttgccgctgggaccgatgttaatatcaaagataatcacggtttgacagcgttagatacggttcgggaattgccttcccaaaagtcacaacagattgctgcactgattgaagaccatatgacagggaagcggtcaacaaaagaagtggataagacccctcccccacaaccacctttaatctcaagtatggattctattagtcagaagtctcagggagacgtggagaaagctgtgactgagctgatcattgattttgatgccaacgcagaggaagagggaccatatgaggcactttataacgccatcagctgtcattcgctagactctatggcatccggcagatcatccgaccaagactcaactaacaaagaggccgaggccgctggagtgaagcccgcaggggtgagacccagggagagaccaccccctccggcaaagcctcccccagacgaagaggaggaagaccacatcgataagaaatacttccccctgactgcttctgaggtgctctcaatgcggccacgcatccacggatctgcagccagagaagaggatgaacatccatatgaactgctactgactgccgagaccaagaaggtggtgctggtggacggcaagaccaaagaccatcgaagatcctcctcctccaggtcccaagactctgcggagggtcaggacggacaggtgcccgaacagttctctggcctgctccacggctcctccccggtgtgtgaggttggacaggaccccttccaacttctctgcaccgcaggacaaagtcaccctgatggaagccctcagcagggagcatgtcacaaagcatcaatgcagctggaagaaactggcgtacatgcaccaggagccagtcagccatccgctttggaccagagcaaacgcgtgggttatttaaccgggctgccaactaccaatagtagatcccaccctgaaaccttgacccacactgctagtcctcacccgggaggtgccgaggagggtgatagaagcggcgcaaggtccagggcccctcccaccagtaagccgaaggctgagctgaaactttcgcgcagcctgagtaaatccgattcagacctacttacatgctcacccacagaagatgccaccatgggcagccgatccgagagtctcagcaattgctcaattggaaagaagcggctggagaaatccccaagttttgcttctgagtgggatgaaatagagaaaattatgtcctctatcggagaggggattgactttagtcaagagcgccagaaaataagtgggttgaggaccctcgagcagagcgtcggagaatggctagagtctatcggccttcagcaatacgagagcaagctcttgttaaacggttttgacgatgtacatttcctgggtagtaacgtgatggaggaacaggacctcagggatatcggaatcagtgacccacagcatcgtagaaagttgctgcaggccgctagaagtctgccaaaggtgaaggctctgggctacgatggcaatagtcccccttctgttccctcatggctcgacagcctggggctccaggattatgttcatagcttcctatcttcgggctacagttcgattgacaccgtgaaaaacctatgggaattggaactggtcaacgtattgaaggtgcagctgcttggacaccgcaagagaataatagcaagtcttgccgacaggccatacgaggagccccctcagaagccgccacggttctcccaactgcgctgtcaagatcttctgtctcaaacaagcagcccgctctctcaaaacgacagttgtacaggcagatcggccgatctgctcttaccccctggcgacacaggcagacgtcgacatgattccctacatgacccagccgctcccagtagagctgagcgatttagaattcaagaggagcatagggaggcaaagctcaccctacgcccaccctcattggctgccccttatgctcctgtccaaagctggcagcatcagccagaaaagctcattttcgaatcctgcggctatgaggccaattatctgggatcaatgttgatcaaggacctacggggaactgaaagtacgcaggatgcatgcgctaaaatgcgcaagagcacagagcatatgaaaaaaatacccaccatcatcttgagcatcacttacaagggagtcaagtttatcgacgcttctaacaagaacgtgattgcagaacacgagatccggaacatatcttgcgccgctcaggacccggaagatttgtgcacttttgcctatatcactaaggacctccagacatcccaccactactgccacgtcttcagcacagtggacgtaaatttaacatacgagattatcttgacactgggtcaggcctttgaagttgcctatcagctagcccttcaggcccaaaaaagcagggctacgggcgcaagcgctgcagaaatgattgagaccaaatcaagtaaaccagtgcccaaacctcgtgtgggcgtgcgtaaatctgccctggagccccctgatatggaccaggacgcgcagtctcacgcttctgttagctgggtggtcgatcccaagcctgatagcaaaagatccctcagcacaaactag

SEQ ID NO: 28585 - DNA, 3099 bp, Artificial Sequence
  Description of Artificial Sequence: Synthetic coding sequence
atggaagccgctgcagcagtggtcgccgcagaagcagaggttgaaaacgaagacggagattcctcctgcggcgatgtctgctttatggacaaggggcttcaatctatcagcgagctcagcctggactcaactctccacgcagttaacctgcattgcaacaacattagcaagattgaagcgatcgaccatatctggaatttgcagcacctcgatttgtcaagcaaccagatcagtcggatagaggggctcaatacactaaccaagctgtgtacactcaatttatcctgcaacctgataacaaaggtagagggcctggaggagctaattaacctgactcggctgaacgtatcatacaaccacattgatgatctcagcggcttaatccctctgcacggtataaaacacaaactaagatacatagacttgcactctaaccggatcgattctatccatcacctacttcagtgcatggtagggctgcattttttgactaatctgatcctagagaaagacggagacgataatccggtctgtcgcctgcccggttacagggccgtgatcctgcagactctcccacagctgagaatacttgattgcaagaatatctttggggaaccagttaacttaaccgagataaactcatcacagttgcagtgtctggagggcctgctggacaatctcgtgagttctgacagtccgctgaacatttccgaagatgaaattatcgacaggatgccggtcatcactgctcctattgatgagttagtgccactggaacagtttgcttctaccccctccgatgccgttctgacaagttttatgtccgtgtgccagagctccgagccagagaaaaacaaccacgaaaacgatttgcaaaacgagataaagctgcagaaactcgacgatcagatcctccagctactgaatgagacttccaattctattgacaatgtgcttgagaaggaccctaggccaaaaagagacacggacatcactagtgaatcggactatggcaaccggaaggagtgtaatagaaaggttccccgaagaagcaagattccatacgatgccaagaccattcaaacaatcaagcatcataacaaaaattacaacagctttgtgtcttgcaaccgtaagatgaaaccaccctacctcaaggagctgtacgtctcatcgtctctggccaactgtcccatgctgcaggagagtgaaaagcccaagactgagatcattaaagtggaccaatcccactctgaagacaacacctatcagtctctcgtcgaacagctcgatcaggagcgcgaaaagagatggcgcgcagaacaggccgaaaataaactcatggactacattgacgagttgcataaacacgcgaatgaaaaagaggacattcacagcctggcactgctcacaaccgaccgcctgaaggaaattattttccgggagcgtaacagcaaagggcagctggaggtgatggtccataagctccagaacgaaatcaaaaagctgacggttgaactaatgaaggcaaaggaccagcaggaggatcacctgaagcacctgcgaactctcgaaaaaactctggagaagatggagcggcaaaagcgtcagcaacaggctgcccaaatcagattaatccaagaagtagagcttaaggcctctgcggctgatcgtgagatctacttgcttcggacctccctgcaccgtgagcgagaacaagctcagcaactccatcaactcctcgcgctgaaggagcaagagcacagaaaggaactggaaacgcgggaattcttcaccgatgcggacttccaggatgccctggcaaaggaaatagccaaagaagaaaagaagcacgagcagatgatcaaggagtaccaagagaagattgacgtactgtctcaacagtacatggatttggagaacgagttcaggattgcactgaccgttgaagcgcgtagatttcaggatgtgaaagacggatttgagaacgtggctacagaactggccaaatctaaacatgcactgatctgggcccaaagaaaagagaatgaatcctccagtctgattaaggacctcacttgcatggttaaggaacaaaagacgaaactagctgaagtcagcaagcttaaacaggaaactgctgcaaacctgcaaaatcagatcaatactctggaaatactgattgaagacgacaaacagaagagcattcaaatcgagctcctcaaacacgagaaagtccagcttatctccgagctggcagcaaaggagagtctgatttttgggctgaggacggaaagaaaagtctgggggcatgaactcgcccaacaaggctcctctctggcccagaatcggggaaaactggaggctcagattgagagccttagccgggagaatgagtgtttacggaaaacgaacgaaagcgactccgatgccctcagaatcaaatgtaaaattattgatgaccaaacagagactattagaaagctcaaggactgcctgcaagaaaaggacgagcacattaagcggttgcaagaaaagataacggaaattgagaagtgtacacaggagcaactggatgagaagtcttcccagctggatgaggtcttggaaaaattggaacgacacaatgaaaggaaggagaagcttaagcaacaacttaagggtaaagaagtagaactagaagagataaggaaagcctattcaacactcaaccgaaaatggcatgataagggtgagctcctctgtcacttagagactcaggttaaagaggtgaaggagaagtttgaaaacaaggagaaaaaattgaaagcggaacgtgacaagagtatagagcttcagaagaacgctatggagaagttgcacagcatggacgatgctttcaagaggcaagtggacgccatcgttgaagctcaccaggccgaaatagcccagcttgccaatgagaagcaaaaatgcatcgacagcgcgaacctgaaggtgcatcagattgaaaaagagatgcgagagctcctggaagagacctgcaagaataagaagacgatggaagccaaaatcaaacagctcgcatttgcattaaacgagatccagcaggatatgtag

SEQ ID NO: 28586 - DNA, 219 bp, Artificial Sequence
  Description of Artificial Sequence: Synthetic coding sequence
atgtcatatcagcagcagcagtgcaaacaaccttgccagccccctcccgtatgtccgacgcctaagtgtcctgagccctgtcccccacccaaatgccccgagccttgcccgtcccccaaatgtccacaaccatgtcccccacagcaatgtcagcaaaagtatccacccgttacccctagtcctccctgtcagccgaaatgtcctcccaaaagcaagtag

SEQ ID NO: 28587 - DNA, 888 bp, Artificial Sequence
  Description of Artificial Sequence: Synthetic coding sequence
atggaactgatacaggacacatcgaggcccccactcgagtacgtcaaaggggtccccctaatcaaatactttgccgaggcacttgggccactccagtccttccaggcacgtcctgatgaccttctgatcaatacatacccgaaatcgggcactacctgggtcagccagattctcgatatgatttaccagggaggggatctggaaaagtgcaaccgagcgcctatttatgtccgcgtgccttttctcgaggtgaatgaccccggagagccaagcgggctggagacactaaaggacacccctccacccaggctgattaaaagccaccttcctctcgccttattgccccaaaccctgctcgatcagaaggtgaaggtcgtttacgttgcgaggaaccctaaggatgttgccgtgagctattatcacttccaccgcatggaaaaggctcatcctgaacccggaacgtgggacagttttttggaaaaatttatggcaggcgaggtttcctacgggtcatggtaccagcacgtacaggagtggtgggagctgagcaggacacaccccgtgctgtacctcttttatgaggatatgaaggagaatcccaagagggagattcagaagattctggagtttgttggcaggtccctccctgaggaaacaatggattttatggttcagcatacaagcttcaaggagatgaaaaagaatcctatgacaaactacacaaccgtgccgcaggaactgatggaccattccattagtccctttatgagaaagggtatggccggagattggaaaacgacgttcacagtggcccagaatgagcgcttcgacgcggactacgccgaaaagatggctggatgttctctgagcttccggagcgagttgtag

SEQ ID NO: 28588 - DNA, 1491 bp, Artificial Sequence
  Description of Artificial Sequence: Synthetic coding sequence
atgaagctggggaaaaagcccatgtacaagccagttgatccctactccaggatgcagtcgacctataattataacatgcggggaggcgcttaccccccaagatacttctatcccttcccggttccacctttattgtaccaggtcgaactgtcagtaggcggtcaacaatttaacggtaaagggaagaccagacaggctgccaagcatgacgctgctgccaaggctctgcgcatcctgcaaaacgagcctttgcctgagagactggaagtaaacggaagagagtccgaggaggaaaatctgaacaagtctgagatctcgcaggtgttcgagatcgccctgaaacggaatttgcctgtcaattttgaagtggccagagagtctggcccaccgcacatgaaaaattttgtgactaaggtgtccgttggtgagttcgtgggggagggggaggggaagtcaaaaaagatcagtaaaaaaaacgcagcaatcgccgtgctagaagagctcaagaagctccctccactgcctgctgttgagagggtaaagcccaggatcaagaagaaaactaagcctattgtgaagccacagacctccccggaatacggtcagggcattaatcccatctcacggctggctcaaatccagcaagcaaagaaagagaaagagcccgaatatacactcctgaccgagagagggctgccacgtaggcgcgagtttgtgatgcaggtcaaagtgggcaaccacaccgcagagggcactggtacaaacaaaaaggttgcaaaaagaaatgctgctgagaacatgctagagatcctgggattcaaggtaccgcaggcccaaccaaccaaaccagctctgaagagtgaagaaaagacccccatcaagaaacccggtgatgggaggaaagtaacattctttgagcccggttcaggggatgaaaatgggaccagtaataaagaagacgaatttaggatgccgtatttgagccatcaacagctgcctgcaggcatccttcccatggttcctgaggtagcccaggctgtcggtgttagccagggacatcacacgaaagacttcactcgtgctgccccaaacccagccaaagccaccgtgactgccatgattgcgagggagctcctctatggtggcacgagcccaaccgctgagaccatcttaaagaataacattagttcagggcatgtgccacacgggccacttactaggccgagtgagcagctcgattacttgtcaagagtgcaaggattccaagttgagtataaagacttccctaagaacaataagaacgagtttgtgtcactgatcaactgttcttcccagcccccactgattagccacggcattggcaaagacgtggagtcctgtcatgacatggcggcattaaacatcctcaaactactctctgaattggaccaacaatcaaccgagatgccgagaaccggcaacggcccaatgtctgtgtgtggacgctgctag

SEQ ID NO: 28589 - DNA, 1575 bp, Artificial Sequence
  Description of Artificial Sequence: Synthetic coding sequence
atgagcagttgcgtgtcaagccaaccctccagcaaccgtgctgccccacaagacgagttgggtggaagaggcagctcaagcattcatctggggatggagtcattcattgtagtaacagaatgtgagccaggttgtgctgtggatctcggccttgcaagggaccgtccattagaggccgatggtcaggaagtgcccttagataccagcgggagccaagccagacctcacctgtccggaagaaaactttccctccaggagcgctcccaggggggactggccgctggcggaagtctggatatgaacggacggtgtatatgcccatccttaccatactcccccgtctcttccccgcagtccagccctagacttccccgacgccctacagtcgaatcccatcacgtgagcattacaggaatgcaggattgtgttcagctgaaccagtacactttaaaggatgagatcggcaagggttcctatggtgtcgtcaagctcgcctataacgaaaatgacaacacctactacgctatgaaagtactgtccaaaaagaaattgattcgtcaggcaggcttccctcggcgacctcctcctagaggcacgcgccctgcccctggagggtgcatccagccacgcggacccatagaacaggtgtatcaggagatagccatccttaaaaagctggatcaccctaacgtggtcaagcttgtcgaagtgcttgacgatcccaatgaggatcatctgtatatggtgtttgagttggtgaaccaggggcctgtgatggaggtccctacgctaaagccgctgtcagaagaccaggctcgcttctatttccaggatctcatcaaaggtattgagtatctccattaccaaaaaattatccacagggatattaaacctagtaacctcctagttggtgaggatggacatattaaaattgcggacttcggagtcagtaacgagttcaagggatctgacgccctcctgtccaataccgtgggaactcctgcctttatggccccagagagtttgtccgaaacccggaagatctttagcgggaaagctctcgacgtatgggccatgggagtaactctgtactgcttcgtcttcggccaatgccccttcatggatgagcggattatgtgcttgcactctaagattaaatcacaagccctggagttccccgaccagccggatatcgccgaggatctcaaggatttgataacccggatgttagataagaacccagagtccaggatcgtcgtgccagagataaagttacacccatgggtgacaaggcatggcgctgagcccctgccctctgaggacgagaattgcaccctagtagaggtaacagaagaagaggtcgagaatagcgtaaaacatattccatccctagcgactgtgattctagtgaaaacgatgattcggaagcggagctttggcaaccctttcgaagggtcccgccgagaggaacgtagcctttccgctcctggcaacctgctgactaaacaggggtccgaagacaacctccaaggtactgatcctccaccagttggcgaggaggaggtgctgctgtag

SEQ ID NO: 28590 - DNA, 1902 bp, Artificial Sequence
  Description of Artificial Sequence: Synthetic coding sequence
atgaaagcaattaagaagtctctgacagaagaagaatacctgtacctggactttagtcatcagactgagggctgcattttcccactgcacaccagtgtgaccctgtttcttctgagttattgtgactgtaaaatcttcaagatatgtttggtggtcaccaaagaagtctcccgcgactctagcctgttaagggacgacctgattcaggatgtcgaaatccagatcatcagccggcaggagctgccacctattgtgcagaactgttgcctgccggcagtcgtggaaagatctgataatttttgtcgcgcagggcttgcagtggtgctgcgtcatattatccaaaaaagctacgaggccgaccccctgaaaaaagagcttctagaactgctgggctttaaaaagacctgcctgaaggcctgtgccgaagtgagccagtggactcgcttgtgtgagctgaccattccgttggcaatagagaacttccttagggaaagtagcgaccagccacccaccattcccgtggagatcctgcagctagagaaaaagttgagcgagcctgtgcgggtgcataacgatgacaagctgagaaggcagaagcttaagcaacagaaggcagatggcgtcggcccaccgttaaccaagggcaaagcaaagagcaaagtgcacacacaagaaacttcagaaggccttgattctagttctaagagcttggagttaaaggtggcattctccaagctgactgtgcaggaggagcctgccacaactaatcgggagccaagccatatcagaaaagccaaagcttccgacctgcctcctctcgagcacgtttttgctgaaggactttatttcacgctggctgacattgtcctcctcccttgcatacaccactttctggtcatcattagtaggaaattttcagaaaaactggtggaatttccacttctggcctcttggtaccaacgcattcaggaggtccctggagtgaagacagccgcatccaagtgcggaattcagtttcttcacctgccgaaactcttaactacatcaactgaacagcatcctaatctctgcgaagtcccaggtgtagaagagcagtctgacccgctcttcattgggggtccgaggccaacaatggctaagttgatggagaagggcatagaagtcatgttttccccacacccgtgtcctacatggactctggattggaacgtgcttcccgctgcagttagcccaaaggaagggaagatgagcagcgacagagccctgaggaaacagcagcaactgaataaccttgtgtatgtggtgacgaaccaggctaaacctggggatcggatcgtggatttctgctccgggggtggccatgtcggtattgtcctggctcacatgctcccatcctgccaagtgaccctgatcgagaataaggagctatccctgattcgcgctaaaaagcgatcagacgaacttgggctctccaacatttggtttattcaggccaacatggagtatttcacaggaatgttcaacatcggcgttgcactccacgcttgtggagtcgcaaccgacatggtgatcgagcattgcataaaaactagagcttcctttgtcacctgcccttgctgttacggctttatccagaacacaagtaaatttaattttcctaagtccgaacagtttaaaaaaacactgtcctacaaggaacatatgattctctgtcgcttcgccgaccagaccgcagtacagctgccccctcagaggcggctgatcgggaaacagtgcatgtgcctcgtagacctcgatagggctagagccgcagaagagtgtggctatagcgtgcaggtgatctctatggagcctgagtcatgcagcccgaagaataacatgatcgttggagtgcccatttag

SEQ ID NO: 28591 - DNA, 519 bp, Artificial Sequence
  Description of Artificial Sequence: Synthetic coding sequence
atgagcagcggtaattatcagcagtctgaagccttatccaaaccaaccttttcagaggaacaagccagcgccctggttgagtccgtcttcgggctgaaagtgtcgaaggtgcggccattgccaagctacgatgaccagaactttcatgtatatgtctccaaaactaaggacggacccaccgagtatgttcttaagatttccaatacaaaagctagtaagaaccccgatctgatcgaggtgcagaaccacatcattatgttcctaaaggcggctggattccctacagctagcgtgtgtcatactaagggagacaacactgccagtcttgtttcagtcgattcaggctctgaaatcaaaagttacctagtccgtttactcacttatttacctggacgccctatcgcggagctgccagtcagccctcagctgctctacgagattggaaagctggccgctaagttggacaaaacactgcaggaagggaagccaagggtgactccattgctagctaagaattag

SEQ ID NO: 28592 - DNA, 2937 bp, Artificial Sequence
  Description of Artificial Sequence: Synthetic coding sequence
atgggctggaagcctagcgaggctcggggtcaatcccagagttttcaggctagtggtctccagcccagatcgctgaaagctgcgcgtcgggctaccggacgtcctgacaggtctagggcggcaaggcctacaatggaccctagcgcacatcggagtagagccgctccaccgaatatggatcccgatcctcaagcaggtgtgcaagtgggaatgcgagtagtgagaggggtggactggaaatggggacagcaagatggtggggagggcggagttgggacagtggtggaactcggacgccacggcagcccctctacccccgaccgcaccgtggtagttcagtgggaccaaggaacaaggactaattacagggcaggctaccagggtgcgcacgacctgttactttacgacaacgcccagattggagtcagacatccgaacataatctgcgactgctgtaaaaaacatgggctgcggggaatgcgctggaaatgccgcgtatgcctggactatgacctatgtactcagtgctatatgcacaataagcacgaactggctcatgcattcgatagatacgagaccgcccactcccgccctgtgacgctgtcccccagacaggggctcccacggattccactcaggggcatcttccagggtgcaaaagtggtccggggaccagactgggagtggggctcacaggacgggggagaaggaaaacccggacgcgtggtcgacattagagggtgggatgtggaaacgggacgaagcgtggccagcgtcacatgggcggacggaactacaaacgtgtatcgagtgggccacaaaggaaaggtggatctgaagtgcgtgggggaagccgctggaggtttttactataaagaccacctccctcgactgggcaagccagcggagcttcagcggcgagtcagcgcagacagtcagccgttccagcatggcgacaaagtgaaatgtctgctggacacagatgtcctgcgcgagatgcaggaggggcacggagggtggaaccctcgaatggccgaatttattggacagaccggcaccgtgcacagaatcacggacagaggggacgtgcgcgtgcagtttaaccatgagaccaggtggacattccaccctggagcactgacaaaggctttgggtcgcgtcgggaaggtggtgaaggttttcggtgacggcaatcttagggtcgccgtggccggtcaacgatggacttttagcccctcttgtcttgtggcttacagacctgaggaggacgccaatctggatgtcgccgagagggcacgggagaacaagtcctccctgagcgtggctcttgacaaactcagagcccaaaagtccgacccagagcaccccggtcgcctggttgtcgaggtggctctcggtaatgccgcaagagccctggaccttttaagaagacgacccgaacaggtcgatactaagaatcaaggtcgaacggcactgcaagtcgctgcatacttgggacaggtggaactcataaggctgctccttcaggcgcgagccggagtggatctccccgatgacgagggtaataccgcacttcactatgcagcactggggaatcagccagaagctacccgggtcctccttagtgctggatgccgtgctgacgcaattaatagcactcagtccacagccctgcacgtggccgtgcagagaggattcctggaggtggtcagggctttgtgtgagcgcggttgcgatgttaacctgccagatgcccactctgacacccccctgcatagtgccatatcagcgggaaccggcgcttccggtatcgtggaagtgcttaccgaagtgccaaacatcgacgtcacggctaccaattctcaggggttcacactattgcaccatgcctctttgaagggtcatgcactggccgtgcggaagattctcgccagggccaggcagctggtcgatgctaagaaggaagacgggtttactgcccttcacctggcagctctgaacaaccatcgtgaggtggcacagattttgattcgggaaggcaggtgcgacgtgaacgtcagaaatagaaaactgcagtcccccctgcatctggctgttcagcaggctcacgtgggcctggtaccactgttggttgacgcaggatgttcagtgaatgctgaggatgaggagggcgacaccgctctgcatgtggcactccagaggcatcagctattgccacttgtggccgatggcgctggaggggaccctggtcccctgcagctgctgtcgcggcttcaggcctctggcctcccaggctctgcggagctcacagtcggagctgccgtggcctgttttctcgccttagagggggcagacgtgtcatacaccaatcacagaggacggtcccccctggaccttgctgctgaaggcagggttcttaaggccctgcagggctgcgcacagcgtttcagagaaagacaagcaggcggaggagctgctcccggaccacggcaaacacttggtacgcccaacacagtcacaaatctacatgtgggagccgcacccggaccagaggcagcagagtgccttgtgtgctctgaacttgccctcctcgttctgttttccccttgccagcacagaaccgtctgcgaagagtgtgcccgaaggatgaaaaagtgtattagatgtcaagtggtagtctccaaaaagttacgccctgatggctccgaagttgcaagcgcagctcccgcacctggccctccacgccagctggttgaagagcttcagagccgatatcgccagatggaagaacgtatcacttgccctatctgcatcgattcccatatcagactggtttttcagtgcggtcacggtgcttgcgccccatgcggttcagctctcagtgcctgtcctatttgtagacagccaatcagagacagaattcagatcttcgtgtag

SEQ ID NO: 28593 - DNA, 1074 bp, Artificial Sequence
  Description of Artificial Sequence: Synthetic coding sequence
atggggggagctgtgagcgcgggtgaggacaatgatgacctgattgacaaccttaaggaggctcaatacatacgtaccgagagagtcgaacaggcatttcgggctattgatcgcggagattattacctggaaggctaccgggacaacgcttacaaagatttggcttggaagcatggcaacatacatctgtccgccccatgcatctactcagaggtgatggaggccctgaagctgcagccgggtctgtcatttcttaatctggggtccggcactggctatctgtccacaatggtgggcctgatactgggtcccttcggaataaatcacggtatcgaactgcattccgacgtcgttgagtacgcaaaagaaaagctggagagcttcattaaaaactcagatagttttgacaagttcgagttctgcgagccagcatttgttgttggcaattgtttgcagattgcaagcgacagccaccagtacgacagaatttattgtggtgccggtgtccaaaaggatcacgagaactacatgaaaatcctcttaaaggttgggggaatcctggtgatgcctattgaggatcagctcacacagatcatgcggacaggacagaacacatgggaaagcaagaatatcttggcggtctcctttgcaccattggtgcagccaagcaaaaatgataatggcaagccagattccgtcgggctaccaccttgtgcagtgagaaatctccaagacctcgccagaatctacatccgaaggaccctgcggaacttcatcaacgatgaaatgcaggctaaagggatcccccaacgcgcaccccctaagcggaaacggaaaagggtgaagcagcgaattaacacttatgtgtttgtcgggaaccagctgatcccacagcctctggattctgaggaagatgagaagatggaggaggacaataaagaagaggaggaaaaggatcacaacgaagccatgaagcctgaagagccacctcagaacctcctgagagaaaagattatgaagctcccactgcccgagtctcttaaggcctatctgacctattttagagataaatag

SEQ ID NO: 28594 - DNA, 633 bp, Artificial Sequence
  Description of Artificial Sequence: Synthetic coding sequence
atgtcctgccccaactactgttcagggaactcaaacagtgggtcactgagaacatcacggcacattccgctaacaagtatcgacctgtgtcccacatcagttagttgcggagatgtgctgtatctgcccactagttcccaggatcatacttgggtgacagataactgtcaggagacctgtggcgaaccaacttcatgccagcctgtgcactgtgaaacagggaaccttgagaccagctgtgggtcaagcaccgcatactatgtgcctagaccttgccaaggttccagctttctgccggcttcctttttctcctccagctgtcttcccgtctcctgccgtccacaaagatacgtgagctccgggtgtaggccactcagaccactgttgaatagttaccaaccaattggggattgcgttcccaatgcatatcgtccacagttctgtctgagcaaaagctgtcagccccaaaatctgcttacgtccggctgtcaacccagcagttgcctcgcgtacagaccgcagagtctccatgtggtcagttctagtctcagacctctcggccctctctttagcggatgccaacctctgacgcacgtgttttctacgtgccgacccagctgctccgggctttag

SEQ ID NO: 28595 - DNA, 606 bp, Artificial Sequence
  Description of Artificial Sequence: Synthetic coding sequence
atggccagcggagatgactcccctatttttgaagatgatgaaagtccaccctactcattggagaagatgacagatctcgtggcagtatgggacgtggccctctctgacggcgtccacaaaattgagtttgagcacggcaccacttcagggaagcgcgttgtgtacgtggacggaaaggaggaaattaggaaagaatggatgtttaagctggtgggcaaagagacattttacgtgggagccgcaaagaccaaggcaacaattaacattgacgccatatcgggcttcgcctacgagtatacacttgagatcaatgggaaaagcttgaagaagtacatggaagatcgaagtaaaaccaccaatacatgggtgttacacatggatggtgaaaacttcagaatagtgctggagaaggatgccatggatgtatggtgcaatggaaagaagttagaaacggcaggggaattcgtcgacgatggcaccgagactcacttctcgattggtaaccatgattgctacataaaggcagttagtagcggaaaacgcaaggagggaattattcacacactcattgtagacaatcgggaaatcccagaaattgcctcttag

SEQ ID NO: 28596 - DNA, 3390 bp, Artificial Sequence
  Description of Artificial Sequence: Synthetic coding sequence
atgccggcaacccgcaagccaatgaggtacgggcacaccgaaggccacactgaagtctgcttcgacgacagcgggagcttcatcgtaacgtgcgggagtgatggggacgtgcggatatgggaagacttggatgacgacgaccccaaattcattaatgtgggagaaaaggcgtattcatgcgctctcaaatccggcaaacttgtgaccgcagtcagtaacaacactattcaggttcatacttttcccgaaggcgtgcccgacgggattcttaccagatttactacaaatgccaatcatgtggtgttcaacggcgatgggacaaagatcgccgcaggtagcagcgattttcttgttaaaattgttgacgttatggatagttcccagcaaaagacctttagggggcacgacgcccctgtactgtccttgtcatttgaccccaaggacatttttctggcatccgcaagctgtgacgggagtgtgagggtttggcagatttcagaccagacatgcgccattagctggccactgctgcagaagtgcaacgacgtcataaacgcaaagtctatctgccggctcgcgtggcagcccaagagcggcaagctgctggcaatcccagtcgaaaaaagcgtcaagctgtaccgcagggaaagctggtcgcaccaatttgatttgagcgataactttatatctcagactctgaatatcgtaacttggtccccctgtggccagtatttggctgctgggtcaatcaacggattgattatcgtgtggaacgtcgagacaaaggactgtatggagcgggtcaagcacgaaaagggctatgctatctgcggccttgcctggcatcccacatgtggcagaatttcatacacagacgctgagggtaatctgggcctgctggagaacgtgtgcgacccatccggcaagacatcatcctctaaggtgagctcccgagttgaaaaagattataatgatctgtttgacggcgacgatatgtctaatgctggggatttcttgaacgataacgccgtggaaattccttcctttagcaaggggattatcaatgatgacgaggacgatgaggatctcatgatggcctcaggtaggccacgccagcgtagtcacatcttggaggacgatgaaaattctgtagacatttccatgctcaagactggatcatctcttcttaaagaagaggaggaagacggccaagagggatccatccataacctaccgctcgtcacatctcagcgcccattctatgatggccctatgcccaccccacgccaaaagccatttcagtccggcagcaccccgctgcacctcacgcaccgctttatggtctggaattccattggaatcattaggtgctataatgatgaacaggacaatgccatcgacgttgaattccacgacacgagtatccaccacgccactcacctttcaaatacattgaattataccatagccgacctctcacacgaggccatcctattggcttgcgaatcgactgatgagctggcttcaaaattgcactgtctgcactttagttcatgggactcatccaaggagtggattattgatctcccccagaacgaggatatcgaagccatatgtttggggcaaggttgggctgccgctgctacatccgccttactccttaggttatttaccattggaggggtccagaaggaggttttctcattggcaggccctgttgttagcatggctggccacggagaacagctctttattgtttaccacaggggaactggattcgacggagaccagtgccttggtgtgcaattattggagctcgggaagaaaaaaaaacagattctccacggcgaccccctgcccttgactaggaaaagctatctagcatggatcggattctctgctgaaggaaccccctgctacgtggatagcgagggtatcgttcggatgttgaacagaggcctgggtaacacgtggacaccgatctgtaacacaagggaacactgcaagggcaaatctgaccactactgggtggtcggaatacacgagaatccacaacaactccgatgcatcccttgtaagggatctcgctttccacctaccttacctagacccgcagtggccattcttagtttcaaattgccctactgtcagatagccacagagaaaggtcagatggaggagcaattctggcggtcagttatattccacaatcatctggactatctggccaaaaacggctacgagtacgaggaaagtacaaaaaatcaggcgactaaggaacagcaggaattactgatgaagatgctcgccctgagctgcaagctggagcgcgagtttagatgtgtggaattggctgacttaatgacgcaaaatgccgtcaacttggcaattaaatacgcctcccgcagccgcaagctgatccttgcacaaaagctgtccgagttagccgttgaaaaggctgcggagctgactgctacccaggtggaggaagaggaagaagaggaggactttcgtaaaaagcttaacgccggatattctaacaccgctaccgagtggagtcagccaagatttcgtaatcaggtggaagaagatgctgaagattccggggaagctgacgatgaggaaaaacccgaaatccacaagcctggccagaactctttttccaagagcaccaattcttctgacgtgtctgctaagtcaggagccgtgacattcagctcacagggccgagtcaatccgttcaaagtgtccgctagctccaaggagccagctatgagcatgaactccgcgaggagcacaaatatcttagacaacatgggcaaaagcagtaaaaaaagcaccgccctgagtcgcactactaacaacgagaaaagtccgatcatcaagccactgatccctaaacccaaaccaaaacaagccagtgcagccagttattttcagaagagaaactcacagacaaacaaaactgaagaggttaaagaagaaaatcttaaaaacgtgctcagcgaaactcctgctatttgcccaccccagaacactgagaatcagaggcccaaaaccggctttcagatgtggctggaggagaataggtctaatattctgagcgataatcccgatttttccgacgaggccgatatcatcaaagaaggaatgattcgcttccgggtgctgagcactgaagagcggaaagtgtgggccaataaggccaaaggcgagacagcttctgagggcaccgaggccaagaagcgaaaaagggttgtcgacgaaagcgacgagacggaaaatcaggaggaaaaagccaaggaaaacctgaacctgtctaagaagcagaaacccctcgatttttcaaccaatcagaagctcagcgctttcgccttcaagcaggaatag

SEQ ID NO: 28597 - DNA, 1476 bp, Artificial Sequence
  Description of Artificial Sequence: Synthetic coding sequence
agtggcagttcccactcatttcctggctccctcgaagttacagccctgatgaccacatggtctagtctgcagggctcccatgtaagcaagagggccctagcctatgcactggtcgtcactaactgccaggagcgcatccagcactggaaaaaggtggacaacgattataacgctctaagggagcgcttatccacactgcccgataagctgagctacaatattatggttccctttggaccttttgctttcatgcccggaaagctcgttcacactaacgaggttacagtactgctaggcgacaactggttcgccaaatgttccgctaaacaggctgtgggcctggtggaacatcgcaaggagcacgtgcgcaagaccatcgacgacctgaaaaaagtgatgaagaactttgaatcccgggtcgagttcacagaggacttgcaaaaaatgtccgacgcagcgggtgatattgtggacatccgtgaggagatcaaatgcgactttgagtttaaagccaaacataggattgcgcataagccacacagtaagcccaagacttcagacatttttgaggccgatatcgctaatgatgtgaaaagtaaggatcttcttgccgacaaagagctctgggctcgtctagaggagctcgagaggcaagaggagttgttgggagagctggattctaaaccagatacagttatcgccaacggcgaggacactacatctagcgaggaggaaaaagaggatcgaaacacaaacgttaatgccatgcatcaggtaaccgattcccacactccctgccacaaggatgtcgcttctagtgagccattcagcggccaagtgaactcccagctgaattgctcagtgaatggatcctcctcttatcatagtgatgacgatgacgatgatgacgacgacgatgacgacgataacatcgacgatgacgacggcgacaacgaccacgaggcactcggagtgggtgacaactctatcccgactatctacttctcccacacagtcgagcccaagcgagtgcgaatcaatactggcaagaacaccacactgaaattttccgagaaaaaagaagaggccaagagaaagaggaagaacagcacagggagcgggcactcagcacaggagctgcccaccattaggacccccgcagatatctatcgcgcattcgtggatgtggtcaacggagagtacgttcccaggaagtcaattctcaagtctcggtcaagggagaatagcgtgtgttctgatacatccgaatcttccgctgccgaattcgacgaccgcagaggcgtgctgaggtcaataagctgcgaagaggcgacatgcagtgataccagtgagtcgatcctggaggaggagcctcaggaaaatcagaaaaaactattgcctttatcggtgacacctgaggtcctgcgcctggttggatattctagaaacctggcccctttgaatgtcattctatag

SEQ ID NO: 28598 - DNA, 981 bp, Artificial Sequence
  Description of Artificial Sequence: Synthetic coding sequence
atgctcctctctaaattcggcagcctggctcatctatgcgggccaggtggggttgatcacctgccggtgaagatcctgcagccggcaaaggcagacaaagaaagctttgagaaggcgtatcaggtgggtgccgtcctagggtctgggggattcggtactgtgtacgctggctcgcggattgcggatggactccccgtcgctgtgaagcatgtcgtcaaagagcgtgtaactgagtgggggagtcttgggggagcaacagttccgctggaggtggtactgcttcgcaaggttggagctgcgggtggcgcacgaggtgttattaggctgttggactggtttgaacggccagatggtttccttctcgtcctcgaacgacccgaacctgcccaggacctgtttgatttcattacggagcgaggggctctggatgaaccgctggctagaaggttttttgcccaggtccttgccgcagttcgccattgtcactcttgcggcgtggtccaccgcgacattaaagatgagaatcttctggtagacctgaggtctggtgaattgaagctcatcgactttgggagcggcgctttactgaaggacaccgtttatacagactttgacgggacccgtgtctatagcccgccagagtggattagataccatcgatatcatggcagatctgcaaccgtctggtctttaggcgtcctcttgtatgatatggtctgcggcgatatcccttttgaacaggatgaagagatactacgcggaaggcttttgttccgacggagggtctctcccgagtgtcagcagctgataaggtggtgcttgtctcttagaccatctgaaagacccagcctggatcagatcgctgcccacccatggatgctgggggcagatggcggagtacctgaaagttgtgacctgcgactgtgtacgcttgatcccgatgacgttgccagtaccacctctagttcagagagcctgtag

SEQ ID NO: 28599 - DNA, 2880 bp, Artificial Sequence
  Description of Artificial Sequence: Synthetic coding sequence
atggccgctagcacaggatatgtcagactttggggggcagccagatgctgggtgttgcgtcgcccaatgctagccgctgctggtggaagggtgcctaccgcagccggagcatggctactgcggggacagcggacctgtgatgccagcccgccatgggcactgtgggggcgaggccctgctataggcggtcaatggcgcggtttttgggaagcgagttccaggggcggaggtgccttttctggtggggaggacgccagcgaaggcggagccgaagaaggtgccggaggcgcaggaggttccgccggagccggtgaagggcctgtcataaccgcgctcactcccatgaccatacccgatgtgtttccgcacctgcccctcatagcgatcacccggaatccagtgtttcccaggtttatcaaaattattgaggtaaaaaataaaaaacttgtggagctgcttcgaagaaaagtcagattagcccagccttatgttggcgtgtttttaaaacgggacgactccaatgagtctgatgtggtggagtccctcgacgagatttatcacacgggcacattcgcccaaattcacgaaatgcaggacttgggtgataaactgcgcatgatcgtgatgggccatcggagggtacatatctctcggcagctggaggttgagcccgaggagccggaggccgaaaacaagcacaagccaagacgcaaatccaagcggggaaagaaagaggccgaagatgagttgagcgctcgtcatcccgcagagctggcgatggagcccacacccgaactgcccgcagaggttctgatggtggaagtggaaaacgtggtccacgaggatttccaggtgacagaggaggttaaagccctcacagctgagatcgtaaaaaccatccgcgatataatagctctcaacccactgtacagggagtctgtgctgcaaatgatgcaggcaggtcagcgtgtggtggacaatcctatttatcttagtgatatgggggcagcccttacaggggcagaaagccacgaacttcaggatgtgctcgaagagactaacattcccaagaggttatacaaagcattgtccctgttgaagaaggagtttgagctgtccaagctgcaacagcgtctggggagggaagtggaggagaaaatcaagcagacgcatagaaaatacctcttgcaggagcagctgaaaatcataaaaaaggaactggggttagagaaggatgataaggacgccatcgaggagaaattccgggaacggcttaaagagcttgtggtgcccaagcacgtgatggacgtagtcgacgaagagctgagtaaactgggcctgctggacaaccattcgtctgagtttaatgttacgagaaattatttggattggctcacttccattccctggggtaaatattcaaacgaaaaccttgacctcgcaagagctcaagctgtgctggaagaagatcactatggcatggaggatgtgaagaagcgtatacttgagttcatcgcagtttcacagctgaggggctctacacagggcaagatcctttgcttctatgggccaccaggggtgggcaagacttccatcgctcgttccattgccagggcgctgaatcgggaatattttcgatttagtgtggggggaatgacagatgtagcggagatcaaagggcaccggaggacgtacgtcggcgcaatgccgggaaagattatccagtgtctgaagaagactaagacagaaaatcctctaattcttattgacgaagtcgataaaattggcagaggctaccagggtgatccctcgtctgccttactggagcttcttgatcctgagcagaatgccaactttcttgatcactatctagatgtgcctgtggatctcagcaaggtcctttttatctgcacagcgaatgtgacagacacaatccccgagccactccgcgacaggatggagatgatcaatgtatcaggctatgtagcccaggagaaactggccatcgctgaacgctatcttgtgcctcaggccagagccctgtgcggcctggacgagtcaaaggccaaactctcctccgacgttctgacgctcctgatcaagcagtactgcagagaaagtggagtgcggaacttgcaaaagcaggttgaaaaagtgttgagaaagagtgcttataagatcgtgagtggcgaggccgaatctgtcgaggtgactcccgagaatctccaggactttgttggaaagcccgtgttcaccgtggaacgtatgtacgacgtgaccccacccggagtagtcatgggtctcgcatggaccgctatgggcggttccactctcttcgtagaaacatcattgcggcgaccccaggataaagacgctaaaggagataaggatgggtctcttgaggttaccggccagctcggggaggttatgaaagagagcgctcgtatcgcctacacctttgcccgagcgttccttatgcagcatgcccctgctaacgattatctggtaacctcgcatatccatctacatgttcccgagggcgcaacacctaaagatgggccaagtgctgggtgtactatcgtgaccgcccttctgagcttggccatgggccgacctgtgaggcagaacctggccatgacaggggaggtttccctcaccggtaagattctgcctgtcggtggtataaaggagaaaaccatcgccgctaaacgggctggagttacctgtatcgtgctgcctgctgaaaacaagaaagacttttatgaccttgcagcctttattactgagggcctcgaggtgcactttgttgaacactatagagaaatctttgacatcgcctttccagacgaacaggccgaggcccttgccgtggaaagatag

SEQ ID NO: 28600 - DNA, 1203 bp, Artificial Sequence
  Description of Artificial Sequence: Synthetic coding sequence
atgaatccagcttccgcccctcctcccctgcccccacctggtcagcaggtgatacacgtaactcaggacttggacacagacctagaagcactcttcaatagcgtgatgaatcctaaaccatcatcttggcgcaagaaaatattgcccgagagcttcttcaaggagccagattctggatctcattctcgacagtcaagcacggatagttcagggggacatcctggcccacggctcgccggtggagctcagcacgttcgtagccattcttctccagcctccctccagctgggtaccggagctggagccgcaggatcccctgcacagcagcacgcccaccttcggcagcagagttacgatgttactgatgagctccccctccctcctgggtgggaaatgacatttaccgctacaggtcaacggtacttcctaaaccacattgaaaagatcacgacatggcaggacccacggaaagccatgaaccagccattgaatcatatgaatctacatcctgcagtcagttccacacctgtcccccagcgctctatggctgtgtcccagcccaatctggtcatgaatcaccaacaccagcagcagatggccccaagcaccctgtcccagcaaaaccatccaacacagaatccacccgcaggcttgatgtccatgcccaacgctctcactactcagcagcagcagcaacaaaaactgcggctgcaacggattcagatggagagggagagaattaggatgcggcaggaggagctcatgcgccaggaagccgctctgtgtcggcagcttcccatggaggcagaaaccctggcgccagttcaggcagccgtgaaccctccgacaatgacccctgatatgcgaagtattaccaacaacagctccgaccctttcctgaatggcggtccttatcacagtcgggagcagagcacggatagcggactcggcctgggctgttactcagttcctactacacctgaagattttctctctaatgttgacgaaatggacaccggggagaatgccggtcagacccccatgaacataaatcctcagcagacgcgatttcccgacttcctcgattgtttgcctggtactaatgtggatctcggaacactggagtctgaggacttgattccgctttttaacgatgtggagtcggctcttaataaaagtgagcccttcctgacatggctatag

SEQ ID NO: 28601 - DNA, 2625 bp, Artificial Sequence
  Description of Artificial Sequence: Synthetic coding sequence
atggaagtccttagagagaaggtggaagaagaagaggaggctgaacgggaggaggccgcagagtgggcagagtgggctaggatggaaaaaatgatgaggccagtcgaggtgcgcaaagaagagatcaccctcaagcaggagacccttcgcgacctggaaaaaaagttgtccgagattcagatcaccgtgtctgctgaactcccagcattcactaaggacaccatcgacatctcaaagctcccaatcagttacaagacaaacactccaaaggaggagcacttgctgcaggtggcagacaacttcagccgccaatactcgcacttgtgccccgatcgtgtaccccttttcctgcaccccctgaatgagtgcgaggttccaaagtttgtgagcacaaccctgaggcccaccttgatgccttatccggagctctataactgggatagctgtgcccagttcgtctctgatttcctgaccatggtgccgctacctgaccctctgaaaccaccatcgcacctgtattcgagcacaactgttctgaaataccagaagggcaactgctttgacttctcaactctgctgtgcagtatgctcattggcagcgggtacgatgcctactgcgtgaacggatacggctccttggacttatgccacatggaccttacccgggaggtgtgcccactgactgtgaaacctaaagaaactatcaagaaggaagaaaaagtattaccaaagaaatatacgatcaagcccccacgtgacctttgttcccgtttcgaacaggagcaggaggtaaagaagcaacaagagattcgggcacaggagaaaaaacgattgcgcgaggaggaagagcgccttatggaggccgagaaagccaagccagatgctctgcacgggctgagagtccactcttgggttttggtgttgtccggtaaaagagaggtccccgagaactttttcatcgatccattcaccggacactcatactctacccaggatgaacactttctcggcatcgagtccttgtggaaccacaaaaattattggatcaatatgcaggattgttggaactgctgcaaagacttaatctttgacctgggagatccagtgcggtgggagtatatgctcttgggtaccgataaatcccagctgtccctgacagaggaagatgactctggcattaatgatgaggacgacgtggaaaatctgggcaaagaagacgaagataaatccttcgatatgcctcacagctgggtggagcaaatcgaaatctcgcctgaggcattcgaaacaagatgcccaaacgggaagaaggttatccagtataagagagccaagctggaaaaatgggctccgtacctcaactccaatggccttgtgtctcgtctcaccacgtacgaagatttacagtgcaccaatatactcgagattaaagagtggtaccagaatagggaagatatgctggaactaaagcacatcaataaaacgacagacctcaaaacagattatttcaaacctggacaccctcaagctctgcgtgtacacagttacaaaagcatgcagcctgagatggacagagtgatcgagttctacgagaccgcgagagtggatggcttgatgaagagggaggagactcctagaaccatgacagaatactaccagggcaggccggacttcctgagttatcggcacgcaagcttcggtccaagggtgaagaagctaaccctgagctcagccgagagcaatccacgccctatcgtcaaaattaccgagagattctttcggaaccccgcaaagccggcagaggaagacgtggctgagcgggtctttctcgtcgccgaagagcgcatccaactgagataccactgccgagaagatcatatcaccgcctccaaacgggagttcctcaggagaaccgaggtcgacagtaaggggaacaagattataatgacacccgatatgtgtatatcctttgaggtggagcccatggagcacactaagaagctactttaccagtacgaagcaatgatgcatctaaaaagagaggagaaactctcgaggcaccaggtgtgggaaagcgagctggaggtattagagattcttaagctgagagaagaggaagaggccgcacacactctcactatttcaatttatgacaccaaacgtaatgagaagagcaaagaatacagggaggctatggaacggatgatgcacgaagaacatttgcggcaggtcgagactcaactggactatctggccccattcctggcacaactacctccaggggaaaaattgacatgttggcaggcagtacgcctgaaggatgaatgcctgtcagactttaaacagagactgatcaacaaggcgaacctgattcaggctcgattcgagaaggagacacaggagctccagaaaaaacagcagtggtatcaggaaaaccaggttacacttactccggaagatgaggatctttacctatcgtattgtagccaagcaatgttcagaatcaggattttggaacagaggctgaatcggcacaaggaattggcgcctctcaaatacttggctctggaggaaaagctctacaaagatccgagactcggcgagttacagaaaattttcgcatag

SEQ ID NO: 28602 - DNA, 1851 bp, Artificial Sequence
  Description of Artificial Sequence: Synthetic coding sequence
atggatgtgatgcttgagaactattgccatctcatctccgtgggctgtcacatgacgaaacccgatgtgatcctgaagctggaacgcggtgaagagccttggacctcatttgcaggtcatacctgtctcgaggaaaattggaaagccgaggatttccttgtcaaattcaaggagcatcaggagaaatactcgaggtcggtcgtctcgatcaaccacaagaaactggtcaaggaaaagagcaagatctacgagaaaacatttaccttaggaaagaatccagtcaactcaaaaaatcttccacccgaatacgacacacacggaaggatactgaagaacgtgtctgaactaataataagcaatctgaatccggctcgcaagcgcctgtccgaatacaacggctacgggaagagcctgctgagcaccaagcaggaaaccacacaccccgaagtgaagagccacaaccagtctgctcgcgcattctcccacaatgaggtcctcatgcagtatcaaaagactgagaccccagcacagtccttcggttacaacgactgtgaaaagtcgtttctacagagaggaggccttattacccactccaggccctataagggggaaaatccgtctgtttacaacaaaaagagaagagccacgaacattgaaaaaaagcacacctgcaacgagtgtggaaaatcgttctgtaggaaatctgtgttgatactgcatcaaggaatccattccgaagagaaaccctatcaatgccaccagtgcggaaacgcattccggagaaaatcatacctgattgatcatcaacggacccacaccggcgagaagcctttcgtgtgcaacgagtgcgggaaaagctttaggctgaaaacagctctgactgaccatcagcgcactcatacaggggaaaagtcatacgagtgcctgcagtgccggaacgcgttccgcttaaagtcccacctcattcgacaccaacgcacacacactggtgagaaaccctacgagtgtaacgactgtggcaaatctttcagacaaaaaactactctgtccctgcaccaacgcatccatactggcgagaaaccctacatctgcaaagaatgtggcaagtcattccaccaaaaagcgaacctgaccgtccaccagcgcacacacaccggcgagaaaccttacatttgcaatgaatgtggaaagtccttctctcagaagacgacacttgctctgcatgagaaaactcataatgaagagaagccctacatatgcagtgagtgcgggaagtctttccggcagaagaccacattggttgcccatcagaggacacacaccggcgagaagtcctacgagtgcccgcactgtggtaaggcatttagaatgaaatcctatttgatcgaccatcatcgcacacacaccggcgaaaagccttacgagtgtaacgaatgtggtaaatcattcagccagaagaccaacctgaatttgcatcaacgcatccatacaggggaaaagccctacgtttgcaacgaatgcgggaagtcatttcggcagaaggctacccttaccgtccatcagaagattcatactggccagaagagctatgagtgcccacaatgcgggaaggccttctcccgaaaaagctacctcatccatcaccagcgaacacatactggcgaaaagccatataagtgctccgaatgcggcaagtgtttccggcaaaagaccaatctgattgtgcaccaacgaacgcacaccggcgagaagccttatgtctgcaacgagtgcggcaaatctttttcttacaagcgtaacctgatcgtgcaccagcggacccataaaggagaaaatatcgagatgcagtag

SEQ ID NO: 28603 - DNA, 441 bp, Artificial Sequence
  Description of Artificial Sequence: Synthetic coding sequence
atgtgtcacacgagctgctccagtgggtgccagcctgcatgctgcgccccaagcccctgtcaaccggcttgctgtgtaccatcatcttgtcaggccagttgttgcgtcccagtgggttgccaaagtagcgtgtgcgtaccggtttcattcaagcccgctgtgtgcctccccgtgagctgccagagctctgtgtgcgttcccatgagtttcaaatcagcagtgtgcgtccctgtgagctgccagtcctctgtgtgcgtgcctgtcagttgtcgacctattgtttgtgccgctccgagttgtcagtcgagcctctgcgtaccagtttcgtgccgccctgtcgtctatgccgcaccaagctgccagtcatcggggtgttgtcagcccagctgcacgagcgtgctctgccgcccaatatcttactccataagcagttgttgttag

SEQ ID NO: 28604 - DNA, 1257 bp, Artificial Sequence
  Description of Artificial Sequence: Synthetic coding sequence
atgcgagagtgcatcagcatccacgttggacaggcgggagtacagatcggaaacgcctgctgggagctctattgcttggagcacgggatccaaccggatgggcaaatgccctctgacaaaaccattggcggtggggatgactcgttcaacacgttcttttccgagactggtgccggtaagcacgtcccacgcgcagtgtttgtcgatttagaaccaactgtggtggacgaagttcggaccgggacctatcgacagctcttccacccagaacaactgatcacaggcaaggaagatgccgctaataattatgcaagggggcattacactataggcaaagagatcgtggatctggtgttggacagaatccgcaagctcgccgacctatgtaccggcctccaaggcttcttgattttccacagcttcggcggaggaacagggtccggttttgcaagtctgcttatggaaaggctctcggtcgactacggaaagaagtctaagcttgaatttgctatctaccctgcaccccaggtgtcgaccgccgtggtagagccctataactccatactgacgacacacaccacgctggagcattcagactgcgcatttatggtggataatgaggctatttatgacatttgtagaagaaacctcgatattgagcgacctacctatacaaacctgaaccgattaatcggccagatcgtgagctccattacagcttcccttagatttgacggggctctaaatgtggacttaaccgaattccagaccaacttagtcccttaccctaggatccattttcccttggcaacctacgcaccagtcatctcggccgagaaagcctatcacgagcagctatctgtggccgagattacaaacgcgtgcttcgagcctgcaaatcagatggtcaaatgtgatcctcgccacggcaagtatatggcatgctgtatgctgtataggggagatgtggtccctaaggatgtgaacgctgccatcgcaacaattaaaactaagcggaccatccagtttgtggactggtgcccgacgggcttcaaagtgggaatcaattatcagccccctacagtcgtgcctggtggcgacctggcgaaggttcagagagctgtctgcatgctgagtaatacgacagccatcgccgaggcctgggccaggttagacctggcagcgctcgaaaaagattatgaggaagtgggtgtggattcggttgaggccgaggctgaagaaggagaggagtactag

SEQ ID NO: 28605 - DNA, 3351 bp, Artificial Sequence
  Description of Artificial Sequence: Synthetic coding sequence
atgtatggttcggcgaggtcagtggggaaagttgagcccagctcccagtcaccaggcagatcccctcgactcccacggagtccgaggcttgggcacaggcggacaaattcaaccggaggttcctctggcagctcagtcggcggtgggtccgggaagacattatcaatggagaatatccagtcccttaacgcggcatacgccaccagtggccctatgtacctgtcagaccacgaaaacgtagggtccgaaacacccaaaagcaccatgacactcggacggtctggtggaagactgccctatggcgtaaggatgaccgctatgggcagtagcccaaatatcgcctcttccggcgttgcctcagataccatagcgttcggagagcatcatctcccacccgtgtctatggcgtccacggtgccccatagcctccgacaagcgagggacaacactataatggatcttcaaacgcagctgaaagaagtcctgcgcgaaaacgatctccttagaaaagacgtcgaggttaaggaatccaagctgagtagtagtatgaactcaatcaagaccttctggagccctgagctcaagaaggagcgagctctacggaaggatgaggcatccaagattaccatctggaaggagcagtaccgagtggtgcaggaagagaaccagcatatgcaaatgacaatacaggcgctccaggacgaattgcgaattcagcgcgatctgaatcagttgttccagcaggattcatctagccggactggggagccttgtgtggccgagcttaccgaggaaaactttcagcgtcttcacgccgagcacgaaagacaagctaaagagctttttttgcttaggaagacccttgaggaaatggaactgaggattgagacccagaagcagaccctcaacgcaagggacgagtctataaagaagctgctggaaatgctgcagagcaaaggactgtcagctaaagccacagaggaggatcacgagcgcactagaagacttgccgaagcggagatgcatgttcatcacctggaatctttactcgaacagaaggagaaggagaacagcatgttgagggaggagatgcacaggcgcttcgaaaacgctccagactccgctaaaacgaaggccctgcagactgtgatagagatgaaagactcaaagattagctccatggagaggggccttcgcgatctggaagaagaaatccagatgctgaagtctaacggcgcactgtctacagaggaaagggaggaggagatgaagcagatggaagtgtaccgatcacacagcaaattcatgaagaacaaagtagaacagcttaaggaggagctttcttcgaaggaagcccagtgggaagagctgaaaaagaaagcagccggactccaggcagagattggtcaggtcaagcaagaactctctcgtaaggatacagaactattagctctgcagacgaagctcgagaccctgacgaatcagttttctgattctaagcagcacatagaggtgctgaaagagagcttaacagcaaaagagcagcgggcagccatcttgcaaacagaggtcgacgcattacggctgagactggaggaaaaagagaccatgctcaacaaaaagactaagcagattcaggacatggctgaggaaaagggaacccaggcaggcgaaatccacgacttgaaagatatgcttgatgtcaaagaaaggaaagtcaacgtgctgcagaaaaagatagaaaatttgcaagaacagttgagggataaggagaagcagatgtcttcacttaaggagcgggtgaagtcactgcaggcagacacaactaataccgatacggccctcacaacgctggaggaggctctggccgaaaaagaaagaacaattgagcgccttaaggagcagcgagatcgggacgaacgcgagaagcaggaagaaatcgacaattataagaaagacctgaaggacttaaaagaaaaggtgagcctcctgcagggcgacctttccgagaaagaagcttctcttctcgatctcaaagagcatgcttcctctctagccagctcgggtctgaagaaggatagtcgccttaagaccctggaaatcgccttagaacagaagaaggaggaatgcctgaaaatggagagtcagctcaaaaaggcccacgaggctgcccttgaagcccgtgcaagccctgagatgtcagaccgcattcagcacttggagcgcgaaataactagatataaggatgaatcttctaaagcccaggctgaggttgacaggctgcttgagattttgaaggaagtggagaatgagaaaaatgacaaggataagaagatcgccgaactcgaaagacaagtgaaagaccagaacaagaaggtcgccaacctcaaacacaaggagcaggtggaaaaaaaaaagtctgcccagatgcttgaagaggcccgaagacgtgaggataacctcaatgattcctctcagcagttacaagattctctccggaagaaggatgacagaattgaggagctggaggaagcgcttagagaatctgttcagatcaccgccgaacgggaaatggtgctcgcccaggaagaaagtgccagaacaaatgctgagaaacaggtcgaagagttactgatggctatggaaaaggtcaaacaagagctggagtccatgaaagcaaaattgagcagtacacagcaaagcctggccgaaaaagaaacgcaccttactaatctccgcgctgaaaggcgcaagcatctggaggaggtgttagaaatgaagcaggaggcccttctggcagccatatctgaaaaggacgcgaatatagctcttttagagctttccagcagcaaaaaaaagactcaggaggaggtagctgcacttaaacgagaaaaagatagattagtccagcaactcaagcagcaaacccagaatcgcatgaaactgatggccgataattatgaggatgaccactttaagtcttcccactcgaaccaaaccaaccacaagccaagcccagaccagattatccagcctctcctcgagttggaccagaatcgatcaaagctcaaactttacattggtcacttgactacactgtgccacgatagggaccccctgattcttcggggacttactcccccagcctcgtataacttggacgatgatcaggccgcttgggagaacgaactgcagaagatgactaggggacaactgcaggacgaactagagaaaggtgagagggataatgccgagctgcaagagtttgctaatgccattttgcagcaaatcgctgatcattgccccgacatacttgaacaggtggtgaatgcccttgaggagagtagttag

SEQ ID NO: 28606 - DNA, 3075 bp, Artificial Sequence
  Description of Artificial Sequence: Synthetic coding sequence
atgaattttataaaggataactccagagctctgatccaacgcatggggatgaccgtgatcaagcaaatcaccgacgatttgttcgtctggaacgttctcaatagggaagaggtgaacattatatgttgcgaaaaggttgaacaggatgccgctcggggaattatccatatgatcctgaagaagggcagcgaaagctgtaatttattcctcaaatcactgaaggagtggaactaccctctgtttcaggacctgaatggtcaatcgctgttccaccagaccagtgaaggcgacctggacgacctggcccaggacctcaaagatctttaccacaccccatcgtttttaaacttctatccactgggcgaggacattgatatcattttcaatctcaaatcaaccttcactgaacctgtgctttggagaaaagatcaacaccatcatcgggtagagcagctcactctgaatgggcttcttcaggcactgcagagcccttgtataatcgagggagagtccgggaaaggcaagtccaccctattgcaacgtatcgcgatgctgtggggcagcggcaaatgcaaagcattgactaagttcaagtttgttttctttctgcgcttgtctcgggctcaggggggattgtttgaaaccctctgcgaccagttgctggatattccaggtactatcagaaaacagactttcatggctatgctgctgaaacttagacagagagtgctcttcctcctcgacggctacaatgagtttaagccacagaactgtcccgagatcgaggcactgataaaggaaaaccatcgcttcaaaaatatggtaattgtgaccacaaccacagagtgcctgcgccacatacgacagttcggcgcactgactgccgaggtgggagacatgactgaagattcagctcaggcactgatcagagaagtccttatcaaggaactggccgagggcctcctgctccagattcagaagtcgcgttgcctacgtaacttgatgaagacccctttattcgtagttatcacctgtgccatccagatgggagagagtgagtttcatagtcacactcagacaacgctgttccacacattttatgaccttctgattcaaaagaataagcacaagcacaagggcgtagcggcaagtgatttcatcagatccctcgatcattgtggtgatctggctttagaaggcgttttcagtcataaattcgactttgaactgcaagatgtttctagcgtcaatgaagatgtgctgctcacaactggcctgctgtgtaagtatactgctcagagatttaagccgaaatataaatttttccataagtcctttcaggaatatacggcaggccgacgcctcagctctctgcttaccagccacgagcccgaggaggtcaccaagggtaatggatacctgcaaaagatggtttcaatctctgatatcacctcaacttattctagtctgctgcggtatacttgcggaagtagtgtcgaggccacacgggcagtgatgaagcatctcgccgcagtataccaacatggctgtctgctgggactctccatcgcaaaaagaccactttggagacaagagagcctacaaagcgtcaaaaacaccaccgaacaggagatactgaaggctattaatatcaactcctttgtggaatgcggaatccatctgtatcaagagtcgacctcgaagtcagctctaagtcaagagtttgaggcatttttccagggaaaatccctgtacatcaatagcggcaatatccccgattacctttttgatttctttgagcatttgccgaattgcgcgtctgccctcgatttcattaaactagatttctacggcggtgcaatggctagctgggaaaaggctgcggaggacacagggggaattcacatggaagaggcaccagagacctacatcccttcaagggcggtgtctctgttctttaactggaagcaggaattcagaactctggaagtgacactgcgcgacttctcaaaactgaataaacaagacatccgataccttggcaagatttttagctccgccaccagcttgcggcttcagattaagagatgcgctggagtggcgggtagtctttccctcgtgctgtcgacctgcaagaacatctattcattgatggtggaggctagcccgctgacgattgaagatgagcgtcacatcacaagcgtgactaaccttaagacactctccatccacgatttgcagaaccagcgcctgcctggaggactgaccgatagtcttggtaaccttaaaaatttaacgaaactaattatggataatatcaagatgaacgaagaggacgccatcaagctggctgagggcctgaagaatctaaaaaagatgtgtctgtttcatctgacccatctgtctgacatcggggaaggcatggactatatcgtcaagagtctgtcaagcgagccatgtgacctggaggagatccaactggtgagctgttgccttagcgcaaatgctgtgaagatccttgcccagaaccttcacaacctagtgaaattaagcatcttagatctgtcggagaactatttggagaaagacggaaacgaggccttgcacgaacttattgaccgaatgaacgtcctggaacagttgactgctctcatgctgccctggggatgcgatgtgcagggttctctgtcctctcttctgaaacatcttgaagaagttccccagttggtgaagttagggttgaagaactggcgattgactgatacagaaattaggatcctgggcgctttctttggcaagaatccgttgaaaaattttcagcagttaaacctcgcgggaaaccgagtttcctcagatggatggctcgccttcatgggtgtgtttgagaaccttaaacagcttgtgtttttcgacttttccaccaaggaatttctgcccgaccctgcactcgtgcgtaagctgtctcaggtgttatcaaaactcaccttcctccaggaggcacggctggtggggtggcagtttgatgatgatgatctttctgtcatcactggagccttcaagctggtgaccgcctag

SEQ ID NO: 28607 - DNA, 1065 bp, Artificial Sequence
  Description of Artificial Sequence: Synthetic coding sequence
atggctgaaagtccaactgaggaggccgcaacagcaggtgccggtgcggctggtccaggagcaagttctgtagctggtgtagtaggggtgtcggggtcgggcggtggatttggccctccgtttttgccagacgtttgggccgctgccgcagcagccggtggcgctggagggcctggtagcggtctcgctccactgcccggacttcccccttccgctgccgcacacggcgctgctctcctgtcccattgggatcccactctgtcatccgattgggatggagagcggacagccccacagtgcctactgaggattaagcgggacattatgtcaatttacaaagagcctcctcccggaatgtttgtggtgcccgacaccgtagacatgaccaagattcatgccctgattacagggccattcgacacaccttatgagggcggattctttctgtttgtgttccggtgcccaccagactaccctatccatccccctcgagtgaaactaatgaccacagggaataatacagtcaggttcaatcctaacttttaccgaaatggcaaggtttgtcttagcattctggggacatggaccggccctgcatggtctcctgctcagtctatatcaagcgtgttgatctcaatccaatctttaatgaccgaaaatccgtatcacaatgaaccaggcttcgagcaggagcgacatcctggagactccaaaaattacaacgagtgcatcaggcacgaaaccattagggtagcagtctgtgacatgatggagggaaagtgcccttgccccgaacctttacgaggcgtcatggaaaagtctttcttggagtactatgatttctacgaggtggcctgtaaggataggcttcatctgcaagggcagaccatgcaggatcccttcggggagaaaagggggcacttcgactaccagtctttgttgatgcggctgggtttgatccgacagaaagtgctggagcgtctgcataatgagaatgctgagatggactctgacagctcctctagtgggacagaaaccgaccttcatggaagcctgagggtatag

SEQ ID NO: 28608 - DNA, 2487 bp, Artificial Sequence
  Description of Artificial Sequence: Synthetic coding sequence
atggatagtgaagcatttcaaagcgctcgcgactttctggatatgaacttccagtccttggcaatgaagcatatggatttgaaacagatggagctcgataccgctgccgctaaggtggacgaactgaccaaacagctggaatctctctggagcgattcacccgcacctccaggccctcaggccggacccccaagcagaccccctcgctattccagctcttccatcccagagccctttggttctcggggaagtcccagaaaagcagctactgacggggctgatactccattcggtagatccgaaagcgcacctacattgcatccttatagcccacttagtcctaaagggcgtccatccagcccccgaacacccctgtatctgcaacctgatgcctacggcagcctggaccgagctacatcaccacgtcccagggccttcgatggagcgggtagcagtctcgggagggcgccaagcccacgcccaggccctgggccattaaggcagcagggcccaccgactcccttcgactttttaggccgtgcaggctcaccacgtggcagtcctcttgccgaggggcctcaagctttctttcctgaacgtggccctagtccgaggcctccagcaaccgcctacgatgccccagccagtgcatttggcagctcattgctgggctcagggggaagtgcgttcgcccctcctcttcgtgcccaagacgatcttaccctgcggcgaaggcctcctaaggcctggaatgagtccgatctcgatgtggcatacgagaagaagccctctcagacagcctcctacgagagactggacgtctttgcccgacccgcaagtccttctctccagctgttgccctggagggagagtagtctggatgggcttgggggaacaggtaaggacaacctgacctctgccactcttcctagaaattacaaagtgagcccactggcatctgacaggcggtctgacgcaggcagttataggaggtccctgggcagtgccggtccgagcggaaccctcccacgcagttggcaacctgtatctcgaattcccatgcccccatcatccccccagccacggggtgcaccgagacagcgacccatacctctgtcgatgatcttcaagctacagaatgcattttgggaacatggggcaagccgcgctatgcttccaggcagccctctgtttactcgcgcacctccgccaaagctgcaaccgcaaccacagccacagccacagccacagtctcagcctcagccacagctaccccctcaacctcagacccagccccagacaccgaccccagctccccagcaccctcagcagacttggcccccagtgaacgaaggccctcccaaacccccaaccgagctcgagcccgagcccgaaatcgaaggcctactgacccccgttttggaggcgggagacgtggacgagggcccagtagcgaggccgttgtcacccacccggcttcagcctgcgctgccacccgaggctcagtcagttccagagctcgaggaagtggctagagttctcgcggaaatacccagacccttaaaaagacgaggtagtatggaacaggctcctgctgtagcgcttcctcctacacataagaagcagtaccagcaaattatcagtcggctgtttcatcgccacggcggtccagggcctggagggccagagcctgaactttcccctataaccgagggcagcgaggctcgcgctggacctccagccccagcccctcccgctccgatacctcccccagctcccagccaatcaagtccacccgaacagccgcagtcgatggagatgagaagcgtgctgcgcaaagccggatcccccaggaaggctcgccgagctcgtctgaaccctcttgtcctccttctcgatgccgctctcacgggcgaactggaagtagtgcagcaagctgtcaaggaaatgaatgacccctctcagcctaacgaagaggggatcaccgctctccacaatgcgatatgtggagctaattacagcatcgtggacttcctaattactgcaggtgctaatgttaactctcctgatagtcacggatggacaccccttcattgcgctgcatcttgcaatgacacagttatctgcatggccctagttcagcacggagcggctatattcgcgacgacgctgagcgacggagcaacggcattcgaaaaatgtgatccctatagggaaggatatgcggattgcgcgacctacctggcagatgtggaacaaagtatgggcctgatgaacagtggcgctgtttatgccctctgggactattccgcggagtttggggacgaattgtcttttcgcgagggcgaaagcgtcacagttttgcggcgagacggcccagaggagactgattggtggtgggccgcactccacggccaggaggggtatgttcccaggaattatttcggtctattcccaagagtcaaacctcaacgatctaaggtatag

SEQ ID NO: 28609 - DNA, 1131 bp, Artificial Sequence
  Description of Artificial Sequence: Synthetic coding sequence
atggttgtggaggtagattcaatgcccgcagcctcatccgtgaaaaaacccttcggccttaggtccaaaatggggaagtggtgctgtcgctgcttcccgtgttgcagagaatccgggaagtcaaacgtcggcacgtccggtgatcacgatgattccgccatgaaaacgttgagatcaaagatggggaaatggtgccggcattgctttccctgctgtcgtggctccggtaaaagcaatgttggcgcttcaggtgatcacgacgatagcgcgatgaaaaccttgcgcaataaaatgggcaaatggtgctgtcattgcttcccttgctgccggggatcctctaaaagtaaggtgggagcatggggtgactacgatgatagcgcattcatggaaccccgatatcacgtgcgcggtgaagatctggataagcttcatcgggctgcatggtggggaaaagtgccacgcaaggacctgatagttatgctgagggacaccgacgtcaacaagcaggacaagcaaaagcgcacggctttgcatctggcttcagcgaacggcaacagcgaggtcgtgaagctactgttagaccgtaggtgccagcttaatgtcctagataacaagaagagaacggcactcatcaaagcagttcagtgccaagaagatgagtgtgcattaatgcttttggagcacggcactgatccaaatatccccgatgaatatggaaacaccaccctccattatgcgatatacaacgaagataagctgatggcgaaggccttgctgctctatggtgccgatatagagtcaaaaaataagcatgggttgacgccgttgctcttgggggtgcatgagcagaagcaacaggtggtgaaattcctaattaaaaagaaagcaaatctgaacgcgttagatcggtacgggaggactgcactgatcttggctgtgtgctgtggtagtgcttctatcgtctcattgttgctagaacagaacatcgatgtctccagtcaggacctctccggtcagactgccagagagtacgccgtgtcctcgcaccatcatgtcatctgccagttgctttccgattacaaagaaaagcagatgctgaagatctcgtccgaaaattctaatccaggatag

SEQ ID NO: 28610 - DNA, 765 bp, Artificial Sequence
  Description of Artificial Sequence: Synthetic coding sequence
atgcccgcttcatttcccatgctcaggtgtgccaggtccccctgctggacagtctgttggtctccttggtgtagagcactgcccgacggtagatgttcctgcctgtcctcacccccaagccctttggggccaacgcgagatccagtcgccacgtttctggaaacgtgcagagaaccaggctcccaacccgcagggcctgcaagtctacgcgctgagtacctcccaccgagcgtagcttcgattaaagtatctgccgaacttctccgtgccgctctcaaggatgggcactctggcgtccccctgtgctgtgcaactcttcaatggttattggccgaaaacgctgccgttgacgtggtgagagccagagccctgagcagtattcagggtgttgcccctgacggtgctaacgtccatttaatcgtaagagaggtcgccatgaccgatctctgcccggctggccctatccaagcagttgagatacaggtcgaatcgtcttccctggcggacatctgccgcgctcatcacgccgtcgtgggcagaatgcagacaatggtaactgagcaagctacgcagggatcaagcgcccctgatttacgggtccaatatctcagacagatccatgctaaccacgaaacactactgcgcgaggtgcagacgttgagggatagactctgtacagaagacgaagcatccagctgcgcaaccgcacagaggctcttacaggtctaccggcagctgagacacccatcactgatcctactctag

SEQ ID NO: 28611 - DNA, 2046 bp, Artificial Sequence
  Description of Artificial Sequence: Synthetic coding sequence
atgtgcggaatctttgcctacttaaactaccacgtcccgcgaacccgcagagagatactggaaacccttataaaaggcctacagcggttagaatatagagggtacgattccgcgggagtaggatttgacggaggcaacgataaggactgggaggcaaacgcatgcaagattcaactcatcaagaaaaagggcaaagtcaaggcactcgatgaggaagtgcacaaacagcaagacatggatctggacatcgaatttgacgtgcacctaggcatcgcacatactcgctgggctactcacggagaacccagccctgtgaatagtcacccccagcgttctgacaagaacaacgaatttatcgtgatccacaacgggatcattacaaattacaaggacctgaagaaatttctcgagagcaaaggatatgactttgaaagcgaaacagacacagaaactattgcaaagctcgttaaatatatgtatgataacagggaaagccaggatacatctttcacaactctggtggagagggtcatccagcagttggagggcgcattcgctctcgtgttcaaaagtgtgcatttccctggccaggctgttggcactcggcgtggttcgccattgctcatcggcgtgaggagtgagcacaagctgtctacagaccacatcccaatcctttatcgcacggggaaagataaaaagggctcatgcaacttatccagagtagatagcacaacttgcctgtttcctgtcgaagagaaagcggtggagtactattttgcttctgatgcctctgccgtgatcgagcacaccaaccgggttattttcctcgaggatgacgacgtggcagctgtcgtggacggtcgactgtctattcatagaataaaacgcaccgcgggtgaccatccaggcagagccgtgcagaccctgcagatggagctgcagcagattatgaaaggtaacttctcaagcttcatgcagaaagagattttcgagcagcctgaatccgtggtgaataccatgaggggcagagtgaactttgatgattatacagtcaatctcgggggactgaaagaccacattaaggagattcaacggtgtcgacgcctgatcctgatagcatgtggcacgtcatatcacgctggagtggccaccaggcaggtgctggaagagctaaccgagctcccagtaatggtggagctcgcttccgactttctcgacagaaacacgccagtgtttagagacgatgtgtgtttttttcttagccagtcgggcgaaaccgcagacaccctgatggggttacgctactgcaaggagcgcggagccctgacggtgggtataactaatacggtcggatccagtatcagcagagagactgactgcggggttcatataaatgccggacccgagattggggtcgcgtctactaaggcctacacatctcaatttgttagcctcgttatgtttgcactgatgatgtgcgatgatcgaatcagcatgcaggaacgcagaaaagaaatcatgctcggactcaagcgcctcccagacctgattaaagaagtgctctccatggacgacgagattcagaagctggccactgagctctatcatcaaaaaagcgttctgatcatgggacgcggttaccattatgccacttgccttgagggagctctgaagattaaggaaattacttacatgcatagtgagggcatcttggcaggtgaattaaaacacggccctctggctctggttgacaagttgatgccagtcattatgatcattatgcgggatcatacttatgccaagtgtcagaacgccctgcagcaggtagtcgctcggcagggaaggcctgtggtcatttgtgataaggaagacacagagacgatcaagaataccaaacggactatcaaagttcctcacagcgtagactgccttcaggggatcctcagcgtcatccctctgcaactccttgcgtttcatctggcagtgctcaggggatacgatgtagatttcccacgcaatctggccaaatccgtcacagtcgagtag

SEQ ID NO: 28612 - DNA, 498 bp, Artificial Sequence
  Description of Artificial Sequence: Synthetic coding sequence
atggaggatctcttcgaaactttccaagacgaaatggggttctccaatatggaggacgacggcccagaagaagaagagagagtggcagaacctcaagcaaacttcaacaccccacaggcactgcgtttcgaagagttgttagcaaatctgcttaacgagcagcatcagattgcgaaagagctgtttgagcaactcaagatgaagaagccgagcgccaaacagcagaaggaagtcgaaaaggtcaaaccacagtgcaaggaggtgcaccagactttgatactagaccccgctcagagaaagagactgcagcaacaaatgcagcagcatgtacagctgctcacccagatccatctcctcgccacgtgtaacccaaatttgaatcctgaggccagcagtacgcgaatatgcctgtcatgggaaccactcctcaaagcacccagtccttttacaatcagtactacaccctctttccgcccatgcagtaaccccgtgacatag

SEQ ID NO: 28613 - DNA, 633 bp, Artificial Sequence
  Description of Artificial Sequence: Synthetic coding sequence
atggctgctagcgtcgagcaaagggaaggtacaattcaggttcaggggcaggccctgtttttcagggaagcactgccaggatctgggcaggctaggttcagcgtactgttactccacggcattaggtttagtagtgagacatggcaaaatctcgggaccttacaccgcctcgcacaggccggttaccgcgcagtggcaattgatctccctgggctgggacacagcaaggaggccgctgcaccagcccctatcggcgagctggcacccggaagcttcctggccgctgtggtggacgccttggagcttggcccacctgttgtaattagtccatctttatccggaatgtatagtcttccatttcttacggctcccggaagccagctgccgggattcgttcccgtggcccctatatgtacagacaaaataaacgcagctaattacgcttcagttaagacacctgcgcttatagtttacggcgatcaggatcctatggggcagacttctttcgagcacctgaaacagctgcctaatcatcgggtgttgatcatgaaaggagcgggacacccatgctatcttgataaacccgaggagtggcatactggactgctggacttcctgcagggcctccagtag

SEQ ID NO: 28614 - DNA, 1248 bp, Artificial Sequence
  Description of Artificial Sequence: Synthetic coding sequence
atgcgcgcagcagactctggatcttgggagcgagtgcgacagctcgctgctcagggcgagccggctccatcttgcggagccggagccggacctgccagacctcccggtccagctgcttgtgaacaatgtgttgatgcagccggtcctggggatagacccagagccggtgttccccgagtcagggccgatggagattgcagccagcctgtactacttagagaagaggtgtcaagattacaggaagaagtgcatttgctgcggcagatgaaagagatgctagccaaagacctggaggaaagtcagggtggcaaatcctcagaagttctgagtgctacagagctccgagtgcagctggctcagaaagaacaggaactagctcgcgcaaaagaagcactgcaagccatgaaggccgataggaaacggctgaagggtgagaagaccgacctggtgtcacaaatgcagcaactatatgcgaccctggagtcacgggaggagcagctcagggacttcattcgtaactatgagcagcacaggaaggaaagtgaagatgctgtgaaggcgttagcaaaggaaaaggacctgttggaaagggagaagtgggaactccgacgtcaggccaaggaggctaccgaccatgctactgcactgcggtcacagctcgacctcaaggacaatcgcatgaaggaattagaagcagaactagctatggccaagcagtctctggccactcttacgaaagatgtgcctaaaaggcattccctggctatgcccggagaaaccgtcctgaacggtaaccaggagtgggtagtgcaggcggatcttccactgaccgcagccatccgccaaagccaacaaacgttataccacagtcaccccccacacccagcggaccgccaggccgtgagggtgtctccttgccattcaaggcagccttcagttatctccgacgcgtcagcagccgagggcgacagatctagcaccccatccgacatcaattcacctaggcatcgaactcactcactgtgtaacggggactccccgggtcctgtccagaaaaacctgcataatcctatcgttcagagtctggaggatcttgaggaccagaagcggaagaaaaaaaaagaaaagatgggctttggctcaatttccagagtgtttgctagaggcaaacagaggaagtctctggatccaggcctcttcgatggaacagccccagattactacattgaggaggacgcagattggtag

SEQ ID NO: 28615 - DNA, 693 bp, Artificial Sequence
  Description of Artificial Sequence: Synthetic coding sequence
atggaggccgctgagaccgaggccgaagctgctgccctggaggtgctggccgaggtcgccggtattctggagcccgtggggctccaggaagaggcagagctgcccgcaaagattttagttgaatttgttgtggatagtcaaaagaaggacaagctgttatgctcccaacttcaggttgcggattttctacagaatatacttgcccaggaagacaccgccaaggggctggacccacttgcatctgaagacaccagtcgccaaaaggcaattgctgctaaagaacaatggaaagagctgaaggcaacataccgcgagcacgtggaagcaatcaagatcgggctgactaaggcattgacccagatggaggaggcccagagaaaacggacacagctccgtgaggcatttgagcagctgcaagctaagaaacagatggctatggagaaacggcgtgcagtacagaatcagtggcaactacagcaagagaaacatctgcaacatctggcagaagtgagcgcagagggtaagctgctattcccagaagccgaagctgaggccgagaatttgcctgacgacaagccgcagcagcccacaaggccacaggaacagagcacaggggacaccatgggccgagatccaggcgtttcattcaaagctgtcggtctccagccagctggcgacgttaacctgccctag

SEQ ID NO: 28616 - DNA, 2547 bp, Artificial Sequence
  Description of Artificial Sequence: Synthetic coding sequence
atgcaggctgaggcagcggattggtttagctctatgccgttccagaaacatgtgtactatcctttggccagtggaccggaaggaccagacgtcgcagttgcagccgctgccgctggtgccgctagtatggcctgcgctccaccaagcgccgctagtggccctctgccatttttccaattccgtcctcgcctcgaatcggtggactggcgcagattgagtgccatagacgtggacaaagtcgccggtgcagtggacgtactcactctccaagaaaacataatgaacatcaccttttgtaagctggaagatgaaaaatgtcctcattgccagtccggggtcgaccccgtcttactcaagcttatccggcttgcacaatttactatcgagtaccttcttcattcacaagaattcctgacgtcccagctccataccctggaggagcgcctgcggcttagccactgtgatggtgagcagtcaaagaaactccttactaagcaggccggtgagattaaaacgcttaaagaggagtgtaaacgacggaaaaagatgatctctacccagcagctgatgattgaggccaaagcaaattactaccaatgccacttctgtgacaaggcgttcatgaatcaggcctttctgcagagccacatccagagacgccatactgaggagaattcccatttcgagtaccagaagaatgctcagatcgagaaactgaggtctgagatcgtcgttctgaaggaagagctgcaactcacccggtccgaactcgaggcggctcaccacgcttccgccgttcgcttctccaaggagtatgagatgcagaaaaccaaggaagaggactttctcaaactctttgaccggtggaaggaggaagaaaaggagaaactggtggatgagatggagaaagttaaagagatgtttatgaaggaatttaaagagttaacatcaaaaaatagcgccctcgagtatcagctgtcagaaattcagaagtctaatatgcagatcaaaagtaacatcggcaccctcaaggatgcacacgaatttaaagaggataggtctccttaccctcaagatttccataatgttatgcagctgctggattcacaagagagcaaatggacagcccgagtccaggcaattcatcaagaacacaaaaaggaaaaagggagattgctgtcccatatcgaaaaactgcgcacatctatgatcgatgatctgaacgcctctaatgtgttctacaaaaagcgtatcgaggaactgggacagagactgcaggagcagaatgagctgatcatcacacaaagacaacagattaaagactttacatgcaaccctctgaattctataagtgaaccgaaggtcaacgcacccgctttgcacactctggaaactaagtcttcactgccaatggtgcatgagcaggcattctcatcacatatactggagcccattgaagagttgagcgaagaagagaaggggagagagaatgagcagaaattaaataacaataaaatgcatctccgaaaagcactgaagtccaattcctctcttactaaggggctccggaccatggttgagcagaaccttatggagaagctcgaaacattggggatcaacgctgatatccgaggtatttcctccgaccagctgcacagggtgctgaagtctgttgaatcggaaagacataagcaagagagagaaatccctaactttcatcagatccgggagttcctcgagcatcaggtatcttgtaagatcgaagagaaggcactgctctcgagcgatcaatgctccgtgtctcaaatggataccctttcaactggggaagtgccgaagatgatccagctcccctcgaaaaaccgacagttgatcaggcagaaggctgtgtcaaccgataggacgtccgtgcctaagattaaaaaaaatgtgatggaggacccctttcccaggaaatcttccactataacaactccaccctttagtagtgaggaggaacaggaagacgatgacctgatccgagcctacgcctcccccggtcccttgcctgtgcctcctccgcaaaacaaaggctcctttggtaagaacaccgtgaagtccgacgctgacggtacagagggctctgaaattgaagataccgacgatagtcctaaaccagcaggcgtcgcagtcaagacccccacggagaaagtcgagaaaatgtttcctcatcgcaagaatgtgaataagcctgtgggaggcaccaatgtacctgagatgttcatcaaaaaagaggagctgcaggaattgaagtgtgctgacgttgaagatgaggattgggacatttctagcctagaggaagagatctccctcgggaagaagtcaggtaaagagcagaaagagccgcctccggcaaagaacgaaccacatttcgcacatgtattgaatgcctggggagcattcaaccccaagggacccaaaggagaaggtctccaggaaaatgagtcatcaaccttgaagtcatctttggtgactgtgacagactggagcgatacgtctgacgtttag

SEQ ID NO: 28617 - DNA, 1185 bp, Artificial Sequence
  Description of Artificial Sequence: Synthetic coding sequence
atggttgtggaggtcgattcaatgcctgctgccagttcagtcaagaaacctttcggtctgcggtccaagatgggcaaatggtgctgccggtgcttcccctgctgtagagagagcggaaagtctaatgttgggacctccggcgatcacgacgattccgctatgaagacactgcgatccaagatggggaagtggtgccggcactgcttcccttgctgtcgaggtagtggaaaatcgaacgtcggtgcctccggagaccacgacgattctgccatgaagactctccgaaacaaaatgggcaaatggtgttgtcattgttttccctgctgtagggggagcagtaaatccaaagtaggcgcatggggggactatgacgattctgccttcatggaacccaggtaccacgttcgcggtgaggatctggacaagctacatcgtgccgcttggtggggaaaagtcccccgtaaggatctgatcgtgatgctgcgtgataccgacgtcaataaacaagacaagcagaaaagaaccgccctccatctggccagcgctaatggtaactcggaagtggtcaaactccttctcgatcggaggtgccagctgaatgtcctggataataaaaagcgcaccgctctgatcaaggtgtgcagctcccagctgtaccaacatgaggccgtgcagtgtcaggaggacgagtgcgcccttatgctgctcgaacacgggacagaccccaatattcccgacgagtatggcaatactaccctgcactacgccatctataacgaagacaagctgatggccaaggctttgctattgtacggtgcagatattgaatccaagaacaaacatgggctgacccccctgcttctcggtgtacatgagcagaagcaacaggtggtgaaattcctcatcaagaaaaaagccaacttgaatgccctggacaggtacggcagaactgccttaattttggcagtgtgttgtgggagcgcgtctatcgtgtccctgctactggagcagaatatcgacgtgtcttcccaggatctgtcaggacagacagcgagagagtacgccgtcagttcccatcaccacgtcatctgtcaactcttgagcgactacaaggagaaacaaatgctgaaaatttcctctgagaattctaaccccgagaatgtcagccgcactcggaataagtag

SEQ ID NO: 28618 - DNA, 1308 bp, Artificial Sequence
  Description of Artificial Sequence: Synthetic coding sequence
atggctccttttggccgtaacttgctcaaaacgaggcataaaaatcggagtcctacgaaagacatggattctgaggaaaaggagatcgtggtatgggtatgtcaggaggagaagttggtgtgcgggctgactaaacggactacttcagcagatgttattcaagctctccttgaggagcatgaagcaaccttcggcgagaagcggttcctcctcgggaagcccagcgattattgcataatcgagaaatggcgaggtagtgaacgcgtcctgccccctttaaccaggattttgaagctatggaaagcctggggagacgaacagccgaatatgcagttcgtattagtgaaagccgatgctttcctgcccgtgcccctgtggagaactgcagaagccaagctcgtacagaacacagagaagctttgggagttgagccctgccaattatatgaaaaccctgcctcctgacaagcagaaacggatcgtgcgtaagactttcagaaaactcgcaaaaattaagcaagatacggtctcccatgacagagataacatggagacactggtgcatttgatcataagccaggatcatacgattcaccaacaggtgaaacggatgaaggagctggatctggagatcgagaaatgcgaggctaaatttcacctggatagagtagaaaatgacggggaaaactatgtacaggacgcttatcttatgccttcctttagcgaggtggagcagaacctcgatctgcagtacgaagagaatcagacactcgaagacctttcagaaagcgatgggatcgaacagctggaagagagactgaaatactacagaatcctcatcgacaagctttccgctgaaattgaaaaagaagtgaaatcagtgtgtatcgacatcaatgaggacgccgagggagaagcagcttctgagttggaatccagtaacctcgagtctgtgaaatgcgatctggaaaagtctatgaaagcaggcctgaaaattcacagtcatctcagtgggatccagaaggagataaaatatagcgattcactgctccagatgaaggcaaaagagtatgagcttctcgccaaagaattcaattcgctgcacatcagcaataaggacggttgtcagctgaaagaaaacagagcgaaagagagtgaggtcccatcatcaaatggcgaaatccccccatttacacagcgggtattctctaactataccaacgacactgattcagatacaggaatcagctcaaaccactctcaggactccgagacgaccgtcggagatgtcgtgctgttaagcacatag

SEQ ID NO: 28619 - DNA, 1644 bp, Artificial Sequence
  Description of Artificial Sequence: Synthetic coding sequence
atggccggaactaagaataaaacacgcgcacaggcaaagactgaaaaaaaggctgctatacaggctaaagctggcgcagagagggaagccaccggagtggtacggcctgtcgcaaaaacccgcgctaaggctaaggctaaaacaggctccaaaaccgatgccgttgccgaaatgaaggccgtttcaaagaataaggtggttgcggaaacaaaggaaggagccttgagcgagcctaaaacacttggtaaggctatgggcgatttcacgcccaaggccggaaatgagagcaccagttccacttgcaagaatgaggcgggaacagacgcatggttttgggctggagaggaggccaccataaattcctggttttggaatggagaggaggccggtaatagtttctccacgaagaacgataaaccagaaatcggggctcaggtgtgtgctgaggagttggagccagccgctggcgctgactgcaagcctcggtccggcgcagaggaagaggaggaggagaatgtgatagggaactggttttgggaaggggacgatacctccttcgaccctaaccccaagccagtttccaggattgtgaagccacagcccgtttacgagatcaacgaaaagaaccgccctaaggattggtctgaggttactatatggccgaatgccccagccgtgacccccgctgtactgggattccgcagccaggcgccatccgaggccagccccccatcctatattgtcctagcctccgccgaagaaaacgcctgttctcttcctgttgcaacggcttgccgcccttccagaaatacgcggagttgcagtcagcctatccctgaatgccgattcgattcagacccctgtatccaaactatcgatgagatacgtcggcaaattcgaatccgcgaagtgaacggtatcaagcccttcgcctgtccctgcaagatggagtgttacatggattccgaggagttcgaaaaactcgtgtctttattaaagtcaactactgatccactgattcataagatcgcaaggatcgccatgggagttcataacgttcatccgttcgctcaggaattcattaatgaagtaggagtggtcactctgattgaaagtttgctttcctttccaagtcctgagatgaggaagaagacggtgatcaccttgaacccaccctcgggggatgaacgccagcgtaaaatagaattacacgtaaaacatatgtgtaaggagaccatgagcttccctctgaactccccaggtcagcagtcaggactcaagattttagggcagctgactaccgacttcgtgcatcattatatcgtagccaactacttctctgaattattccatttgctctcatctggcaactgtaagactcggaacctagtactcaagctcttactcaacatgagtgaaaaccccactgcagcccgtgacatgatcaacatgaaggcactcgccgcactgaagcttatctttaaccaaaaggaagcaaaggccaatctggtcagcggagttgccatttttatcaacatcaaggagcatattcggaagggctctatcgtggtggtggaccatttgtcctataacacactgatggcaattttcagagaagtgaaggagattattgaaacaatgtag

SEQ ID NO: 28620 - DNA, 1362 bp, Artificial Sequence
  Description of Artificial Sequence: Synthetic coding sequence
atggccaggaaagttgtgagtaggaaacgtaaggcaccagcatcccctggcgcaggatctgacgcccagggcccacaattcggctgggaccatagcctccataagaggaagcgtctacctccggttaaaaggtcccttgtgtattacctgaagaacagggaggtccgcctgcaaaatgaaacgtcatattcccgcgtgctgcacggctacgcagcccagcagttgccttctcttttgaaagagagggaattccacttgggcaccctcaacaaggtgtttgcttcgcagtggttaaaccacaggcaggtagtatgtggcaccaagtgtaacaccctttttgtggtggacgtgcaaacatcgcagataacgaagattccaatcctgaaagatcgagagcccggaggcgttacacagcagggatgcgggatccacgcaattgagctgaacccaagccggaccttgctggcaacaggcggtgataatcccaacagcctggctatctatcgacttcccactctggatcctgtgtgcgtgggggatgacggacacaaggattggatcttcagcatcgcttggattagtgacaccatggctgtctccggctctagagacggaagcatgggcctctgggaggttacagatgatgtcctcactaaatctgatgctcggcacaacgtgagccgggtgccggtgtacgcccacattactcacaaagctctcaaggacattccgaaagaagatacgaaccctgacaattgtaaggtgcgtgccctcgctttcaacaataagaacaaagagctcggagccgtgagcctggacggatacttccacctgtggaaggctgagaacacattgtcaaaactgctctccacaaagctgccttactgcagagagaatgtgtgtctcgcctacggcagcgaatggtccgtgtacgcagtcggttcccaggcccatgtcagcttcctggacccacggcagccctcgtacaacgtaaagtctgtctgctcccgagaacggggtagcgggatcaggtcggtgagcttctacgagcacattattacagtaggaacgggccagggatccctgctgttttacgatatccgagcccagcgattccttgaggaaagattgtctgcctgttacggctccaagccacgtctggccggtgaaaatttaaagctgaccacggggaaggggtggctaaatcatgatgagacttggcgcaattacttctccgacatcgactttttcccaaatgcggtttatactcattgttatgatagctctggaactaagctttttgtcgccggaggcccattgccgtccgggctgcacggaaattatgctgggctatggtcctag

SEQ ID NO: 28621 - DNA, 2439 bp, Artificial Sequence
  Description of Artificial Sequence: Synthetic coding sequence
atggaagccttccaggaacttagaaagccaagtgccagactggagtgtgatcattgctcattcagaggcactgattatgagaacgtccaaattcacatgggaaccatccatccagaattctgcgatgaaatggatgcaggaggcctggggaaaatgattttctaccagaaaagcgcgaaactcttccattgccataagtgtttttttacatcgaaaatgtattccaacgtctattaccacatcaccagtaaacacgccagcccggataagtggaacgataagcccaagaaccagcttaacaaggagacagatccagtcaagagcccccctctgcctgaacatcagaagatcccttgcaactctgccgagcctaaatcaattcctgcactgtccatggaaacgcaaaaactgggctccgtcctgagcccggaaagccccaagcccactccactgaccccccttgagccccaaaaacctgggtccgtcgtgtcacccgagctacagaccccgcttcccagccccgagcctagcaaacccgcttcagtgtctagccctgagcctcctaagtctgtgcctgtctgcgagtcacagaagcttgcacccgtaccatctccggaaccccagaagcccgcaccagttagtcctgaaagcgtcaaggctacactaagtaaccctaagccacagaagcaatcccactttcccgagaccctgggccctccgagcgcctcctctccagagtctccggtgctcgctgcatccccagagccttggggacctagccccgctgcaagcccagagtccaggaaaagtgcccgtacaaccagcccggagccaaggaaaccttcacccagtgaatctcctgagccttggaagcccttccccgcagtgagcccagaaccacgcaggccagcacctgccgtgtcccctggtagctggaagcctggccctcctggctcacccaggccttggaagtccaacccttcagcaagctcgggaccttggaagccagccaaacctgccccatccgtctctccgggaccttggaagcccattcctagcgtctcacccggtccctggaagccaaccccctctgtctcctcagcgtcctggaaatcttctagcgtcagtccttcctcgtggaaatcacccccagcctcacccgagtcctggaagtctggacctcccgaattacgcaagactgcacctactctgtcacctgaacactggaaagccgtgccccctgttagccctgaactgcgtaagcctggacctcccctttcacctgagatcagatcacccgctgggtcacctgagctgagaaagccaagtggatctcctgatctgtggaagctgagtcctgaccagcgcaagacgagcccggcatccctagactttcctgagagccaaaagagctcaagaggtggctcaccggatctgtggaagagttccttttttatcgagccgcagaagccagtatttcccgaaactcgtaagcctggtccaagcggcccatcggaatccccgaaggctgccagcgacatatggaagcccgtgctcagtatagatactgagccaaggaagcccgctttgtttcccgagccagcgaaaactgcacccccagcaagccctgaagctcggaagagagcactcttcccagaacctcgaaagcacgccctgtttcccgagctgcctaaatccgctctttttagtgagagtcagaaggccgtggagttaggggatgaactgcagatagacgctattgacgaccagaaatgcgacatcttggtccaagaggagctgcttgccagtccgaaaaaactgctcgaagacaccctctttccatcaagcaagaagctgaaaaaggacaaccaagaatcatccgacgcagagctgtcctcttcagagtacatcaagactgacctcgatgcaatggacatcaagggccaggagtcctccagtgatcaggagcaagtggatgtcgaatccatagatttctcaaaggaaaataagatggacatgacgagtcccgagcagtcgcgaaatgtattgcagttcactgaagagaaggaggcatttatcagcgaagaggagatcgccaaatatatgaagaggggaaaaggcaaatactactgtaagatatgctgctgccgcgctatgaaaaaaggagccgtgctgcatcacctcgtgaacaagcacaacgtacactctccttacaagtgcaccatttgcgggaaagcctttcttctagaaagcctcctgaagaatcacgtagccgctcacggacagagcttgctgaagtgccctaggtgcaatttcgaaagcaatttccccagaggattcaaaaaacaccttacgcattgccagagccggcataacgaagaggcgaataagaaactcatggaagcacttgaacccccattagaagaacagcaaatttag

SEQ ID NO: 28622 - DNA, 1974 bp, Artificial Sequence
  Description of Artificial Sequence: Synthetic coding sequence
atggatgaacaggaagctctcaactcaatcatgaatgacctggtggccctacagatgaatcggaggcaccgcatgcccggatacgaaactatgaagaataaagacacaggacattcaaaccgccagaagaagcataatagtagctcatctgctctgctgaatagcccaaccgtcacaacttcatcttgtgctggcgctagcgagaagaaaaaatttctgagtgatgtccgaatcaagttcgaacacaacggcgagcggaggatcattgccttcagtaggcctgtgaaatacgaggacgtggaacataaggtaacaacagttttcggacaacctcttgatctgcattacatgaacaatgagctgtccatcctgttgaaaaaccaagacgatttagacaaggctatagatatcctcgaccgatcatcctcaatgaaatccctgcggattctgctgctctctcaggacaggaatcataattcttcttcaccccattctggtgtcagcaggcaggtcaggattaaggcatcccaaagtgccggtgacatcaataccatctaccagcccccagaacccagatcacgacacctaagcgtctcctcccagaaccccggtcgaagttctcctccgccaggttacgttccagagagacaacagcacattgcgaggcaagggagctacacctcgataaactcagagggggagtttatacctgagacctcggagcagtgtatgctggacccattgagctctgcagaaaattcactctccggttcttgtcagtcactggacaggtccgcggatagtcctagcttccgcaaatcacgcatgtcacgcgctcagtcctttccagacaaccgccaggaatattccgatcgagaaacccagctctacgataagggagtgaaagggggaacctacccacgtcgataccatgtgtctgtgcaccacaaagactactcagacggccgtcgcacgttcccaagaattcgacggcaccagggaaacctctttacactggtgccctcatcaagaagcctgagtactaatggagagaatatgggacttgccgtccagtaccttgatcccagagggaggcttcgctcggccgatagcgagaacgccctttctgtacaggagcgaaatgtacctaccaagagtccctccgcgcctattaactggaggcggggaaagcttctaggccagggcgcttttggcagagtgtacctctgctatgacgtggacacaggtagggaactcgcctccaagcaggtacaattcgaccctgattcccccgaaacatctaaagaggtgtctgctctggagtgtgaaattcagctgctgaaaaatttgcagcacgaacgtatcgtccaatattacggctgtctgcgggatagggctgagaaaactttgactatttttatggagtacatgcctggaggctcagtgaaagatcagcttaaagcctacggagcactgaccgaatcagttactcgtaagtacacccgccagatactggagggaatgagttatctgcactcaaacatgatagtgcaccgcgacataaagggggctaatatactccgggactctgccggaaacgtcaagctcggcgatttcggagctagcaaaagactccaaactatctgtatgtccggcaccggcatgagaagcgtcaccggaacgccctattggatgtccccagaagtgatctctggggagggctacggtcggaaagcggacgtctggagcctaggatgcaccgtagtggagatgttaacggaaaagccgccatgggctgagtatgaggccatggccgctattttcaaaatagcgacccagccaaccaaccctcagctgccctcgcacatcagcgagcacggcagagacttcctgagacggatattcgtggaggcaagacagcggcctagtgccgaggagcttctgactcaccatttcgcccagttgatgtattag

SEQ ID NO: 28623 - DNA, 2547 bp, Artificial Sequence
  Description of Artificial Sequence: Synthetic coding sequence
atgcaagccgaagctgcagattggtttagctccatgccttttcaaaaacatgtttactaccctttggcctccggaccagagggaccagacgtggctgtggcagcagctgcggcaggagctgcttccatggcatgtgcaccacctagtgctgcttctggtcctcttccattctttcagttccgacccagactggagtcagtggactggcgtcgcttgagtgctattgatgttgataaagtggccggagccgtcgatgtcctgactctacaggaaaatattatgaatataacattctgcaaacttgaggatgagaaatgcccacactgtcagtccggagtcgacccagtcctgcttaaactgattcgtctcgcccaattcactatagagtacctcctgcacagtcaggagttcctgacatctcaactgcacactctggaagaaaggctccggttaagccattgcgacggtgagcaatcgaaaaaacttctcaccaagcaagccggtgaaatcaagacccttaaagaagagtgcaaacgtcgtaaaaaaatgatatcgacccagcaactgatgattgaggctaaagcaaactattaccagtgtcacttttgcgataaagcgttcatgaatcaggccttcctacagagtcacattcagcggaggcacactgaggagaacagtcatttcgagtaccagaagaacgcacagattgaaaaactgagatcggaaatcgtcgtgctcaaggaagagttgcaactcacgaggtccgagctggaggccgctcatcatgcaagcgccgtgcgcttttcaaaggagtatgaaatgcaaaagacaaaggaggaagattttctgaagctgttcgatagatggaaagaggaggagaaagagaaactagttgacgagatggaaaaagttaaagagatgtttatgaaagagttcaaagaactgactagtaaaaactcagcactggaatatcagctcagcgaaatccaaaagagcaacatgcagatcaagtctaacatcgggacactcaaggacgctcatgagtttaaggaagaccgcagcccctacccacaggactttcataatgtgatgcagctactggacagtcaggagtccaaatggaccgctcgtgtacaggctatccaccaggagcataaaaaagaaaaagggagacttttgtcacacatcgagaagcttaggacctctatgatcgatgacttgaacgcctctaatgtgttttataagaagagaattgaagagcttgggcagcgcttgcaagagcagaacgaacttataattacacagcggcagcagattaaagattttacttgcaacccattaaattccatctcggagccaaaggtgaatgcgcctgcgcttcacactctggaaactaaaagcagtctccccatggttcatgaacaggcattcagtagccatatactcgagccgatcgaagagctgtctgaggaagagaaagggagagagaatgaacagaaactgaacaacaataagatgcatctgaggaaggccctgaagtcaaacagtagtcttaccaagggattgcgcacaatggtcgaacagaacttgatggaaaagttggagaccctaggcatcaacgcagacattcgaggtattagtagtgatcagctccacagagtcctgaaaagcgtggaaagcgagcgccataagcaggagagagagatccctaactttcaccagatccgggaattcttggagcaccaggtgtcgtgtaagattgaggagaaagctttactgtcttctgatcagtgcagcgtgtcacagatggacacattaagcacaggtgaggtcccaaagatgatccagctgcctagcaagaatagacagctcatacggcagaaggcagtttctactgaccgcacgagcgtccctaagatcaaaaaaaatgtcatggaggatccttttccaaggaaatcttctacaatcactacccctccctttagctcggaagaggagcaggaggatgacgatctgattcgcgcttatgcttcccctggccctttacctgtgccacccccacagaacaaggggtcctttgggaagaatacagtaaagagcgacgccgatggaactgagggcagcgagatcgaggataccgatgactcccctaaacctgctggggtggctgtcaagactccaactgagaaagttgaaaaaatgttccctcaccgtaaaaatgttaataaacccgtcgggggtacaaacgttcccgaaatgttcatcaaaaaggaggagttgcaggaactgaagtgtgccgacgtcgaggatgaggattgggatatatcaagtctggaggaagaaataagtcttggcaaaaaaagtggaaaagaacagaaagagccgcctccagccaaaaacgagccacatttcgcccacgtcctgaacgcctggggagccttcaatccaaaggggcctaagggtgaagggctccaggaaaacgaaagcagcacactcaagagcagccttgtgaccgttacagactggagtgatacgagcgacgtgtag

SEQ ID NO: 28624 - DNA, 4074 bp, Artificial Sequence
  Description of Artificial Sequence: Synthetic coding sequence
atggcagacacagatctcttcatggaatgcgaggaggaagaacttgagccttggcagaaaatcagtgatgttattgaggatagcgttgtagaagattataacagtgtagataagacgacaacagcgggaaatcctcttgtacaacagggcggacaacctctgattttaacccaaaaccccgctcccggtctggggacgatggtcacacagcctgtccttagacctgtccaggttatgcagaatgcaaaccacgtaacttcaagtcccgttgctagtcagccgatttttattaccacccagggcttccctgtgcggaatgtgaggcctgtgcaaaacgccatgaaccaggtgggcattgtgctgaatgtgcagcaggggcagaccgtgcgcccaatcacactagtcccggcaccgggaactcagttcgtgaagcctaccgttggtgtcccacaagtgttctctcagatgactccagtgcggcctggatccacaatgccagtaagaccaaccacaaacacatttacgaccgtgattcccgctacccttactattcggtctacggtgcctcagagtcagtctcaacagaccaaatccacaccttccacgagtacaactcccactgctacccagccgacctccctcggccagctagcagtccagagcccaggccaatccaatcagaccaccaatcccaaactggcgcctagcttcccatccccccctgcagtaagtattgcctcttttgtgacagtgaaacgtcccggtgtcacgggggaaaattcaaatgaggtggcaaagctggtcaacaccctcaatacgattccaagccttggccagtcaccagggccagtcgtggtgagcaataactcatccgcgcacggcagtcagcggacaagcggccctgagagcagcatgaaagtcacctcttcaattcctgtgtttgacctgcaggacggaggccgaaagatctgtccacggtgtaatgcccagttccgggtgacagaggctctgcggggacacatgtgttactgttgccctgagatggtggaataccagaagaagggcaagtccctggattcagagccttccgtgccttcggcagcgaaacccccaagccctgagaagacagctcccgtggcgtcaacccctagttctaccccaatccctgcattaagcccccctacaaaggtgcccgagccgaatgagaatgtgggagatgctgttcagaccaaattgatcatgctggttgatgacttctattacggacgcgacgggggtaaagtcgctcagctcacaaacttccctaaggtcgctacatccttccgatgccctcattgcaccaagagactgaagaataatattcgcttcatgaatcacatgaagcaccacgtggagctcgaccagcagaatggcgaggtggatggacacaccatttgtcagcattgctaccggcagttttctactccatttcagctgcagtgtcatctagagaacgtccactccccctatgaaagcacgacgaagtgtaaaatctgtgaatgggcattcgaaagtgagccactgtttctgcagcacatgaaggatacgcacaaaccaggtgagatgccgtacgtatgccaggtatgccaataccgctccagtctttattccgaagtagacgtccactttcgaatgatccacgaggataccaggcacctcctgtgtccatattgtcttaaagtcttcaagaacggcaatgcatttcagcaacattacatgaggcaccaaaaacggaacgtatatcattgcaataagtgtaggctgcagtttctttttgcaaaggataagatcgagcacaaactgcagcaccataagacttttcgaaagcccaagcaacttgaagggctgaagcccggtacaaaggtgacaattagggcctcaagagggcagcccaggaccgtccccgtttcctccaacgacacaccgccatccgctctgcaggaggccgcaccattgacaagcagtatggatccgctccccgtctttctgtatcccccagttcaacgttcaattcagaaaagagcagttcgaaaaatgtccgttatggggcgtcaaacctgtctggaatgcagtttcgagattcccgacttccctaaccacttccctacctatgttcactgctctctttgccgctactctacgtgctgcagcagagcttacgctaatcatatgattaataatcatgtgcccaggaaatccccaaaatacctggcattgttcaaaaattcagtgtcaggaattaagctggcctgtacctcctgcaccttcgtcacatcggtgggtgacgcaatggccaagcatctcgtgttcaatccgtcccataggtcctcctcaatcctgccccgagggctcacttggattgctcatagtcgccatgggcagactcgcgatcgagtccacgacaggaatgtgaagaacatgtaccctcctccatcatttcccactaataaggcggctacagtaaaaagtgcaggggctacgccagccgagccagaggagttgctcaccccactggccccagctttgccttcgcctgctagcacagccacgcctccgccaactcccacgcacccacaagcgcttgctttaccacccttggccaccgaaggcgctgaatgtctcaacgttgacgaccaagacgaaggctcccccgtaacccaagagccagagctggcttctggcggtggtgggtctggaggcgtcggcaagaaagaacagctttccgtaaagaaactaagagtagtgctcttcgcgctgtgctgcaataccgagcaggcggcagaacacttcaggaatccacaacgcagaatacgccgttggctgaggcggttccaggcatcacagggagagaacctggaaggtaagtatctatcgttcgaagctgaagaaaaattagcagagtgggttttgacccagagagaacagcagttgcccgtgaacgaagagaccctctttcaaaaagctacaaagattgggcgaagcctggaaggagggtttaagatttcatacgagtgggccgtgcggtttatgcttcggcaccacttaacgccccatgccagaagggccgtcgcccatacattgcccaaggacgtggcggagaatgctggcttgtttatcgattttgtgcagaggcaaattcataaccaggatctgccactgtcaatgatagtggccatagacgagatatccttgttcttggatacggaggtcctcagttccgatgacaggaaggaaaacgccctccaaacggttggcactggcgagccctggtgtgatgtagtgctggccatcttagcagacgggacagtactgcccactctggtattttaccgcggtcagatggatcagccagctaatatgcccgactcgattctcttggaagcgaaagagtctgggtactcagacgatgaaattatggagctgtggtccacaagggtgtggcagaagcacaccgcatgtcagaggtccaaggggatgttggtcatggattgtcaccgcacacatctgtccgaagaggtccttgccatgctctccgcctcttctactctccccgctgtggttccagctggatgctcatcaaaaatccaacccttggacgtgtgcattaagcgcactgtcaaaaacttcctccacaagaagtggaaagagcaggcaagggagatggccgacactgcatgcgatagcgatgtgctgctacaactggttctggtgtggcttggcgaagttctgggcgtgattggggactgccctgagctggtgcagagatccttccttgtagcaagtgtactgcccggtccagatggaaatatcaactccccaacgcgcaatgcagacatgcaggaggagctgattgccagcctggaggagcaactcaagttgagtggagagcattctgagagctccactcctcggcctagatcttcacccgaagagaccattgaacctgagtcactccaccaactattcgagggggagtccgagacagaatcgttctacggctttgaggaggctgatttggatctgatggaaatatag

SEQ ID NO: 28625 - DNA, 2904 bp, Artificial Sequence
  Description of Artificial Sequence: Synthetic coding sequence
atgggccctgggcaacccgcaagcacatgtgtgcatttggcccctcgcacgcagctagatggacgttccgatccgaaggtacttcagactcagaaccagcttcagtttaaccgtaatgtcccgactcattcatctaacttggcaatcagatactcctgtccccatgctatcaggatcgagaagctcaagcattcatataacgaatcatatcactgtaaagacgccgactgcagagtgggacctgatcttggatcctcagtctctttcagtgtgatctcccaagaacggctctcatacgctgtgcatctggccaggagagatgttaaaagaagacaattcgagaagcatatcaaggagcatcacctgcgctcacaaccccagtcctcgcagaagtgtggccatacaaagtataagattccagaccacagagtggagcggaaagaatcaaagtcgcaggccgcttgtcagtgctctcaccagccatctaaagtggagatctccagctctggcgcaaaggtgtacctctacagctcccaccctggtcagagcgacctgacagtcccaaattctccacctacacacgatccaggactgcagccacatcccaggatcggggatcataagaacatttctgagcagaaatccctgctcgaagtgcagaggctgcagaaggaactgtcctcttgcattcataaaatagaggaggtaactaagaaggataggctagaagaggccctggaccccgatgaagagcgacgcattagaatacggcgacaggaacaggctgctcgctcagccagaatgctctatgtgctccaacagcaggtgaaagaaatacaagaggagctggacaaactgagtccccataaaataaagcacaccaaaaagagctgggccatgagtaagctggccgcagcacacagaggcgctattagagctctgcagatgtttgttacccagtttaccgaccgaggcgagcaccccctccccgctagatgcaaggagctaggaagcctgatccgtcagctgtctctatgcagtgttaagctggatgcagacccaagcgtgcccgacgtagttattgatatacttcagcagattgaagcccttgaatccctccttgaaaaaaagctttcccccaaaaaagttaaaaagtgtttttccgaaatccgatctaggttccctattgggagccagaaggccctagaaagatggccatccacaagtccgaagggcgagaggagacctcttacagccaaagacaccttcccccaggaaacctcccgcccaagtgtggccaaacagctgctggccgataagtatcagcctgatacagaacttccagaaacgcaacggcttcagtctgagttggacgtgctggacgccgacatcgtgttggaggagggacccttcatcctcgaccagagcgccagctttaaggacgaggtgctggccgtagccaaaacaaaggctgggaagaagaaacccgtaacagaaaacgtgccgttcaggaaaaaagataccttggcgccagctaggcagcaaggactcaggaaggctgagcgcggacgacaatctcaacctcactctaaatcaagggtgcagcagacaacagttagctctagactgaagatgaatagacagcccgttaaggatcgtaaggctccctggattccacccaaccccacttccccaccagcaagtcccaaatgcgcggcatggctgaaggtgaagacctcccccagggacgccactaaggagcctctgcagcaggaagatccgcaggaggaaagtcacctgactggggctgtcgagcacgaggccgcaaggctagcgtggctggacgccgagacttccaaaaggctaaaggagctggaggaactaaaggcaaaagagattgacagcatgcagaagcagcgactggactggctggatgcagagacgtcccgaagaaccaaggagctcaacgaactaaaggcggaagaaatgtaccggctgcagcagttgtccgtgagtgccacacaccttgccgacaaggtggaggaggcggtactggacagactgaagcccctcctggtgaaggcacaacgggtgaactcgacaaccgaggccaatatacacctaaaagacgggtcttccgtgaatacagcgaaggcccagcctgctcaagaagtcgcggctgtggattttgaatccaacaatatccgtcagttggatgacttcctggaggactgtgcatccgaactgtgggccgtgacccatgctaagatcctgggcagcgagacccttgccacagtggaggactctaaagattcacccgaccttgagatcatgatgcgaagaatggaggaaatggagaaataccaggaatcggttcgccagagatataataaaattgcttacgcagaccctaggctgtggatgcaggaagagaataatgaccagaaaatctctgcaatcagtgagaaaccgctgagtccacaccccattcgcataactaaaacggtcgaccgtaaggacccagcagtgaatatcatgcttgagcgcccatgtaatggtaactctctggacgaaagtgtcggaacagaagaggggtcggagaaacgagaagctcccctcctgagcttggccgaagactcacagcagaaagagggtagggcacccctgttcgtcccaccaggaatgcagcactctattggcgactactgttccaggttcgagcagtacctccgcattatctcccacgaggccgtgggatccttcaacccatggctcatcgctgaaagcttctctgaagagcttgtggacgaggcccttggcgctgtggccgcagaactacaggacatgtgcgaggactatgcggaggccgtcttcacatccgagttccttgaagcagctacatag

SEQ ID NO: 28626 - DNA, 6839 bp, Artificial Sequence
  Description of Artificial Sequence: Synthetic coding sequence
atgtatagatcgagcgcccgatccagcgtttccagccataggccaaaggatgatggcggtgggggaccaaggtctggacgtagctctggctccagctctggccctgctcgtagatctagcccacccccacctccttccggctcatcttcacggacacctgcaaggcggcctcgcagcccaagtggtcatcgcggtcgaagagcttcccccagcccgccaaggggcaggagggtgagccccagcccaccacgggcacggcgtgggtcaccttccccaccccgagggcgacgcttgtttcctccaggacccgcagggttccgaggaagctctcgtggggaaagtagggccgattacgccagagatggcagaggcgaccatcccggtgattctggttcacgcagaagatcacccggtctttgtagcgattccctggaaaaatcactcagaatcacagtgggcaacgatcacttttgtgtctccacacccgaaagaaggagattgtccgataggttaggctcacccgtggacaatctcgaggatatggacagagacgatttgaccgacgattccgtatttacacgatcaagccagtgttccaggggcctggaacggtacataagccaggaagaggggccactgagccccttcctgggccagcttgatgaggattacagaaccaaagaaacgtttctacacaggtccgactattctcctcatatctcatgtcatgacgagctgctgagaggcaccgagcggaatcgcgaaaagctgaaaggatactcaattaggtcagaggagcgctcccgtgaagccaagaggcccaggtatgacgatactgtgaaaatcaactcaatgggtggcgatcacccctcttttacctccggcacccggaactatcgccagaggaggcggtctccatccccgaggtttttagatccagagtttcgtgagctggacctggctcgcaggaagcgggaggaagaggaggaaagaagccgatcgctgtctcaggagcttgtaggggttgatggcggaggcacaggctgttctattcccggattatctggtgtcctaacggcttcagaacctggctatagtctgcacagaccagaggaagtttccgtcatgcctaagaaaagcattttgaaaaagcggattgaggtcgacataatggaaccttccatgcagttagagtctttttcctcctccacgtcctccagccaagaccaccccctgtactccggccatccttccctccctctcagtggcgcaatcgctgccttcgcatccgagatcgaaaacaaggggactatggtggagacagcactcaaggagccacagggtaacctgtaccagtggggacctctcccaggcattcctaaagacaacagccctctgcgtgagaagtttggttctttcctttgccacaaggacaacttagacctgaaggctgagggcccagagcggcatactgactttctgctgccacatgaacgggcttcacaggatggaagcggtttctcccgtatcctgtctatgcttgcagatagcaccagtactcaggagaaaagacgccgatcctttcctgatatagaggatgaggaaaaatttctgtatggcgatgaagaggaggacctcaaagctgaatctgttccaaaaccacttggttcaagcgagtcagaagtcatgaggcaaaaagcaagctccttgccttcatcagctcctgccgttaagctggaatcactggaagagactaatccagaatatgcaaagatccatgatctgctgaagaccatcggactggacattggcgtcgcagagatctcacagctagcggcaagaactcaggagaggttgcacggaaagaagccctccctcagatcatccgctgatcgaagaagtagcgtggatagatacttctctgcggaccattgctcgtctgtggaccatcgattcagcgccgacagatgcagctctgtggatcattgtttttccgccgaccgaaggtccagcgatcctcaccgtttggagtcccgcgaggctcatcatagtaacacacactcacctgaagtcagccacccccaccctccatcccccgtggatccatacttgctcaccaagaattctccacctttcttaaagtctgaccatcccgtgggccatatttctggaccagaagtggtcggcagtgggtttcagtcctcagtcgctgtgcgctgtatgctcccctctgcgccaagtgctcctatcaggcttccccacacagcggcactcagtcagttccatatgccaagagcctctcagtttgctgcagctaggatccctcctaattaccaggggcctgctatcccacccgcttcatttgacgcataccgccactacatggcttacgcagcctctcggtggccgatgtatcccacatcacaacctagcaaccatcccgtgcctgagccccacagaatcatgcctatcactaagcaggcaactcggtcccgtcccaacctacgtgtaatcccaactgtgacgcccgataagccgaagcaaaaggaatctttgcggggaagtataccagcagcccaggtgccagttcaggtgtctatcccttcattgataaggtataatcccgagaagataagcgacgagaagaatcgggcaagtcaaaaacaaaaggtcatagaggagagggaaaaactgaaaaacgaccgcgaggctcgtcaaaagaagatgtactatcttcgcactgagctggaacgcctccacaagcaacagggagaaatgttgaggaaaaaaaggcgcgaaaaggatggacataaggacccattgctagtcgaagttagtcgcctgcaggataatataatgaaggacattgccgagcttcgccaggaggccgaagaagcagagaagaaacagagtgagctggataaagtcgctcaaattcttgggattaacatctttgacaagtctcaaaaatccctgtccgactcacgggagccaactgagaaacccggtaaagctgaaaaatcgaaatctcctgagaaggtctcatcattcagcaacagctctagcaataaagagagcaaagtaaacaacgaaaagtttagaactaagtccccaaaacccgctgagagcccccagtcagctactaagcagctggaccagccgacggctgcatatgagtattacgacgcaggaaatcattggtgtaaagactgcaataccatttgcgggactatgttcgacttcttcacacacatgcataataagaaacacacacaaactcttgatccctacaatcgaccttgggcctccaagacgcagagcgaagctaaacaggacgcaattaagagaaccgataagatcaccgtccctgccaaagggtccgaattcctcgtgccaataagtggattttactgccagctctgcgaggagtttctgggagacccaatctccggggaacagcatgtcaaggggcatcagcacaacgaaaaatacaagaaatatgttgacgagaaccctctttacgaagagcgccgaaatttggaccgtcaggccggactggcagtcgttctcgagaccgaacggagacgacagtctgagctaaagcgaaagctcagcgaaaaacctaaagaggaaaaaaaggagaagaaagcgaaagctgtgaaagaggtgaaggaggatgacaaggtctctgagaagctggaggaccaactgagcgaaggtcggaacagtcccgaaaaggccgaaaacaagcgcaacacaggaataaagctacagcttaaggaagaggttaaaaaggagtcaccaacatcctccagcttcggaaagtttagctggaagaaacccgagaaggaggaagagaagagttcactcgtgactccttcaattagcaaggaggaaatactcgaaagctctaaggacaaggaggatggaaaaacggaagcaggtaaagccaaaccaataaagatcaaactgagcggaaagactgttgtggctcacacttctccgtggatgcctgtggtgactacgagtactcagaccaagattcgcccaaacctgccgatccctagcaccgtgctgcgaaagtcatgctctgctaccatgagtaaaccagctcccctaaacacttttctgagcatcaaatcaagcgggacaactgccaaaccccttccagtggtaaaggaatcctccgccgatctactcttgccgccagatatcatttctaaggccttcgggggagaagaagtcatactgaagggctccccggaggagaaagttgtattggccgaaaaaagtgagccatctcacctcccggaacagatcctgcccccaccccctccgccacccccacctcctccacctcctcctcccgtgatcccacaccccgcagcgcctagcgcagcacaggcgaatgcaatattggctcctgttaagtcaaatcctgtcgtgagccaaaccctcagcccgggttttgttgggcctaacatactaaatcccgtgcttcccgtggccattatggcttctgcccagcctgcagcaatcccttctgatgagacggccccaggagtctctgagagcgaccgcgaccagaccctgttctcagtgctcgtccgaccacccccaccactatcttctgtgttctcagaacaggcgaaaaagctggaaaaacggaacagctgcttagccaccgccaatgccaaagatctctatgacatcttttactcttccggcggaaagggagcaccagagacaaagggagcccctgaaacaaaactctccgggggaccccttgccaacggagaaaacagtaacttatcacggaccaagtcttcggatactagtagcaccagtccactgaattcgtcggctagccaggaagaactgcaccaggacgaaggcctggtagcagctccgatagtctctaactccgaaaagccaatcgcaaagacactggttgcgctgggcaaatggagtgtcgtggagcatgtgggcccaaaatcgacagggagcacctatggcttcctccagccattgacaaggctttgccaaagccggccttacgaaaccattacgccaaaaaccgacactttagccatttggacgtcgtcctcttttcaatcagacaccagccgggacatctcccccgagaaaagcgaactggacctgggtgagcccggacctccaggggtggaacccccaccccaacttctggacattcaatgtaaagagtcccagaaacttgtggaaatacatctgagggagagtgtgaatcaagacaaagaaagtcaggaactgagaaaatctgaagactgtagagagtcagaaattgagaccaacacagagctgaaagagagggtgaaagagctttccgaagggattgtggacgagggcgtctcaacatcaattggaccccactcaatcgacgacagcaacctgaatcacggcaacagatatatgtgggaaggagaagtgaagcagcctaacctgctcatgatcgacaaggaggccgaacagtctaataagctcatgaccggctcggaaacgccatcaaaagtcgtgatcaagctgtcgcctcaagcctgctcttttacgaaagccaagctcgacagttttcttagcgaggccaggtcactacttaacccccaggacacgccagtcaagatttctgctcctgaactgctgttgcacagccctgcgagatccgccatgtgtctcactggatcaccacaggagcagggtgtgtctgtagtatcagaagagggcttggaaaattcggcgcctgaatcagccagcaggactagcaggtatcgcagccttaagttgaaaagagagcggtccaaggatttccaagtaaaaaagatctacgaactcgcagtgtgggatgagaataaaaagagacccgagacatgggagagcccagagaaacccaagaccgaggcactggagttgcaggacgtccacccagaactcaccgttaccatagagagcaaggccctggaggacttcgaagcaacggatctcaaggtagaggaactgacagccctcggcaacctgggtgatatgcctgtggatttctgtacgactcgggtgagcccagctcacaggtcacctacagtgctctgtcagaaagtgtgtgaggaaaactccgttagcccgatcggttgcaactcctctgaccccgcagactttgagcccatcccctctttctctggatttcccctggatagtcccaaaactttggtgttggacttcgaaaccgagggggagaggaattcacctaatccgcgaagcgtaaggataccatctcctaatatcctgaagaccggactcacggaaaacgtcgacagaggtctgggcggtttggagggcacccatcaggcgctagatctgctggccggtggcatgatgcccgaggaggtaaaagagtctagtcagctcgataagcaggagtcattggggctcgaactcaagacgatcaattccgctgggctgggtccctccccttgtctgccagatcttgtggattttgtgacacgcacgagcggcgtgcaaaaggacaaactctgcagccctctgagcgaaccaggagatccaagcaagtgtagttcactggaacttggaccacttcagcttgagattagcaatgcctcaactaccgaagtcgccatcctccaggtggacgacgatagcggtgacccactaaatctggtgaaggcgcctgtgtcgaggagcccacccagggaacaggttattgaagataacatggttccacaggggatgcccgagcaagagactaccgtaggcgcaatccaagaccatactgaatcttctgtgcacaatta

SEQ ID NO: 28627 - DNA, 1932 bp, Artificial Sequence
  Description of Artificial Sequence: Synthetic coding sequence
atggggcaggagtccagtaaaccagtatggccaaatccgacagggggatatcaaagtaatacgggaaggagatacggcaggcggcacgcatacgtatcgtttagaccgccaacaagccagagagaacgaatcgcatctcagcggaaaactaattcagaggtgcctatgcaccggtcggcaccctcacaaactacgaaacggagtcggtcgcccttctcaacgacccggcgtagttgggatgacagcgagagtagcgggacgaacttgaacatcgataatgaggattactcacgctacccaccccgagaatacagagcatctggatcaagaaggggcatggcttatgggcatatcgattcgtatggtgctgatgatagcgaagaggagggggctggccctgtggaaagaccgcctgtaagaggaaagaccggtaaatttaaggatgacaagctctatgatcccgagaaaggggctagatctcttgccggtcctcctccacattttagttcgttttcgagagatgttagggaggaaagggacaagctggatcccgtgccggcagcccgttgctccgcttcaagagcagactttctccctcagtcctccgtcgcttcacaatcgagctcggaaggcaaactcgctaccaaaggggatagctcagaaagagagaggcgcgagcagaatctccccgcacgtcctagtcgcgctcctgtaagtatttgcgggggaggagagaacacatctaagtcagccgaggagcccgtcgttcgccctaagattaggaatctggcatcgccgaattgcgtcaagcctaagatctttttcgatacagacgacgacgacgacatgccgcattcaacatcccggtggagggacaccgccaatgataatgaagggcactctgatggcctggctaggcgtggtcgaggcgaatcttcctccgggtatcccgaacccaagtatcccgaggataagcgggaggctcgcagtgaccaagtgaagcccgagaaggtaccacggaggcgcagaacgatggcagatcccgatttttggacccatagcgacgactactacaaatactgcgatgaagactccgacagtgacaaggagtggatagctgccttacgcagaaagtatagatctcgcgaacagacgctgtcttcatccggcgaatcctgggagaccctgcctggcaaggaggagagggagccaccgcaggcaaaagtttcagcttccacaggcaccagccccggacccggagcgtcagctagcgcgggagcaggggctggagcaagcgcgggatccaatggtagtaactacctggaggaggtacgagagccgagcttgcaagaagagcaggccagcctcgaagaaggcgaaattccctggctgcagtaccacgagaatgacagtagcagtgagggtgataatgactctgggcatgagctcatgcaacctggggtatttatgctggacggcaataataatttggaagatgactcaagtgtgagcgaagaccttgaagtagactggtctctgttcgacggattcgctgatggtttaggagtggcagaggcaatcagttacgttgacccacaatttctcacctacatggctttggaggagcgtctggcacaggccatggaaacggccctcgcccatctcgaatcactagcagtggatgttgaggtcgctaatccacctgcaagcaaagagtccatcgatgcactgccagagattctggtgacagaggaccatggggcagtcggccaggagatgtgttgcccaatttgctgctccgaatacgtgaagggcgaagtggctacagaactgccatgccaccattatttccacaagccatgcgtgagtatctggctgcagaagtctggtacatgcccagtctgcaggtgcatgttcccccctccactgtag

SEQ ID NO: 28628 - DNA, 1113 bp, Artificial Sequence
  Description of Artificial Sequence: Synthetic coding sequence
atgcccacagaaaccttgcagaccggctccatggttaagcctgtgagtccggctggtacatttacctctgccgtgcctctgcggatcctgaataagggtccagattacttccgacgtcaggcagagccgaaccctaaaagactgtcagccgtggaaaggcttgaagccgacaaagccaaatacgtcaagtcacaggaggtcattaacgctaaacaggaacctgtgaagcccgctgtgctggcaaaaccaccagtctgtccagctgcaaaacgggcactggggtctcccaccctgaaggtctttggtaaccacgccaaaaccgaaagcggtgtccagagggaaaatctgaagctggagatcctgaaaaatatcatcaactcgtccgagggatccagttccggcagcggacataaacatagttctagaaattggccccctcaccgaagtgaggccacggacctgcacagacatagcttcgctgagagcttgaaagtctaccctactcagggcaggcggtccccgcaggagggcggaagccatgtcgggcgaaggctcctggagcagtccgccgagagcttcctgcacgtttcccactcatcaagcgacattaggaaagttacctccgtgaaaccactaaaagccattccatgctcttcctccgccccacctttaccgccaaagccaaaaatcgcggcaatcgcttccatgaaaagtcccgaggccgatccagtggaacctgcctgtggggtctccaggcgccctagtctccagcgttccaagtctgacctatctgaccggtatttccgcgtggacgccgacgtcgagcgtttttttaactactgcggtctggatccggaagaactggagaaccttggcatggaaaatttcgctagagccaactcggacatcattagtctgaacttcagatccgcatccatgataagctcagactgtgagcaatcccaggactcaaactcggatcttcgaaatgatgattcagcaaacgatagagtgccttacggcatctcagccatcgagaggaatgccaggattattaaatggctgtactcaataaaacaggcccgagagagtcagaaagtatcccatgtgtag

SEQ ID NO: 28629 - DNA, 3126 bp, Artificial Sequence
  Description of Artificial Sequence: Synthetic coding sequence
atggctgccgctgccgctgcgggagccgcatcgggactacccggtcctgtagcccaagggctcaaagaagctctcgtcgatacactgacagggatcctatctcctgtccaggaggttcgtgctgctgcagaggagcagattaaggtcctggaggtgactgaagagttcggggtgcacctggctgagctgaccgtggacccacaaggggcactcgctatcaggcagttggccagtgtcatactgaagcagtacgtcgagacgcattggtgcgcccaatctgaaaaattccgaccccctgagacaacagaaagagccaagattgtgataagagagttgctgccaaacggcctgcgcgagtctatctctaaagtgcggagttccgtggcctacgcagtcagcgctatcgcccactgggattggccagaggcttggccccaactgtttaaccttctgatggagatgctggtcagcggtgatttgaacgccgtgcacggcgctatgcgggtcctgacagaattcaccagggaggttactgatacccaaatgccgctggtggctcccgtcatcttgcccgagatgtataagatcttcactatggccgaggtgtatggaattcggacgaggtcccgcgctgttgagatcttcactacttgcgctcacatgatatgcaacatggaagagctcgagaaaggtgctgccaaggtgcttatcttccctgttgtccagcaattcactgaagcctttgtgcaggctctccagattcccgatggccctacctcagattccggtttcaagatggaggtgcttaaggccgtgaccgcactggtgaaaaacttcccaaaacatatggtatcatctatgcagcaaatactcccaattgtttggaataccctcacagagtcagcagccttctatgtccggactgaggtaaattacactgaggaagtggaggaccccgtagatagcgatggtgaggtcctcggattcgaaaatctagtgttctccatttttgaatttgtgcatgcacttctggaaaatagtaaattcaaaagtacagttaaaaaagctttaccggagcttatctattatatcatcttgtatatgcagattaccgaggagcaaataaaggtgtggaccgccaaccctcagcagtttgtcgaggatgaagatgacgacacttttagctacaccgtcagaatagcagcccaggaccttttgttagccgtggccacagatttccagaacgagagtgctgctgccctggcagcagcagcaacacggcacctgcaagaagctgaacagacgaaaaattccggaacggagcactggtggaagatccacgaagcctgtatgttggctttgggcagcgtgaaggccataattactgattctgtcaaaaacggtaggatccactttgacatgcatggttttctgactaacgtcattcttgcggacctgaacctgtcagtgagtccctttctcctcggcagagctttgtgggctgccagccgcttcacggtcgcgatgagcccagaactcatccaacagtttcttcaggcgaccgtcagtggcctccatgaaactcagccaccaagcgtgcgcattagtgctgtgagggccatctggggatactgcgatcagctcaaagtcagcgaatccacccacgtcctccaacccttcctgccgtcgatcctggacggcctgatacatctggctgctcagttctcctccgaggttctcaacttggtcatggagacgttgtgtatcgtgtgtacagtcgaccccgagttcacagctagcatggaatctaagatctgcccatttacgatcgcaattttcctgaagtactctaatgaccctgtggtggccagcttagcccaggacatattcaaagagctttcgcaaatcgaagcatgccaaggacctatgcagatgaggcttattccaactttagtgagcataatgcaagcgccagccgataaaatacctgcgggattgtgcgctacggccatagatatactgacaacagttgtgcggaataccaagccgcctctgagtcagctccttatatgtcaagcgttcccagcagtcgctcagtgcacactgcatactgatgataacgccacaatgcagaatggtggagagtgccttcgggcttacgtgagtgtgacgctcgagcaagttgctcagtggcacgacgaacagggacacaatgggctgtggtacgtcatgcaggtcgtgagccagctccttgaccctcgaacctcagagttcaccgctgcatttgtgggacgcctcgtaagcaccctgatctccaaagcgggtcgtgagctcggagagaatcttgatcagatcctgagagcaatcttgagcaagatgcaacaggctgaaaccctctctgtcatgcagagtttgataatggtgttcgcacacctggttcatacacagttggaacccttgctggaatttctttgctctctccctgggccaaccggcaaacccgctctggaattcgtcatggctgagtggacaagccggcagcacctgttttatggccagtatgagggcaaagtctcttctgtggcgctgtgtaagcttttacaacacggcataaacgccgatgataaacggttgcaggacattcgcgtgaaaggcgaggagatttattcaatggacgaaggtatcaggactcggtcgaagtccgccaaaaacccagagcggtggacaaatattccacttctcgttaagatccttaagctgatcatcaatgagctctctaacgtcatggaagccaacgctgctcggcaagccactcctgctgagtggtcacaagacgactccaatgatatgtgggaggatcaagaggaagaggaggaagaggaagaagacgggctggcagggcagctcctgagcgacatcttagcgacaagcaaatacgaggaagactattacgaggacgacgaggaggatgatccagatgcactgaaggaccccctgtaccaaatcgacttacaggcgtatcttaccgattttctgtgccagttcgcacagcaaccatgctatatcatgttcagtggacatctgaacgataacgaacggagggtcctgcagaccattggtatttag

SEQ ID NO: 28630 - DNA, 156 bp, Artificial Sequence
  Description of Artificial Sequence: Synthetic coding sequence
atgagttctcacaaaacatttcggattaaacgattcctggcaaaaaaacagaagcaaaaccgtcctattccccaatggattcgcatgaaaacagggaataaaattaggtacaacagtaagcgacgtcactggcgacggaccaagttaggtctctag

SEQ ID NO: 28631 - DNA, 3627 bp, Artificial Sequence
  Description of Artificial Sequence: Synthetic coding sequence
atggacagcctccccgacgagtttttcgttcggcacccagccgtcgaggatcaaaggaaggaggagacagagaataagctggagaagtcaagcggtcagctgaataaacaggagaacgacatacctacagacctggttcccgtgaacctgctcttggaagtgaaaaagctcctgaacgcaatcaacacgctcccaaagggagtcgtcccacacataaaaaagttcctgcaggaggacttcagtttccagactatgcagcgggaagttgccgctaattcccagaacggagaagagatagtgcccgctctcacactgagatttttgatcacacagctcgaagccgcacttcgcaacatacaggctggaaactacactgctcatcagataaacatcgggtactatctgactctgctcttcctgtacggcgtagccctgacagaacgagggaagaaagaggactatacagaggctgagaataaatttttagtgatgaaaatgatgatccaggagaatgaaatctgcgaaaattttatgtcactcgtttactttggacgcggattattacggtgtgcccagaaaagatacaacggagggttactggagttccataaatccctccaggagattggtgacaaaaatgaccattggtttgacattgaccccaccgaagacgaagacctccctacaactttcaaggacttactgaacaattttataaaaaccactgagtctaacatcatgaaacaaaccatatgtagctacttagactgtgagagaagctgcgaggcagatattctgaaaaatacgtcttataaagggtttttccaactcatgtgtagtaagagctgttgtgtgtactttcacaagatctgttggaaaaaatttaaaaacttaaaatatccgggagaaaatgatcagtccttttccggtaaaaagtgcctcaaggagggttgcaccggcgacatggttcggatgctgcagtgtgacgtgcccggtattgttaaaatactgttcgaagtggtaaggaaagacgaatatattactattgaaaacctcggagcatcttatagaaagttaatcagtctcaagataactgataccgacatcagacccaaaatctcgttgaagttcaatacaaaggatgagatgccaattttcaagctggactacaattatttctaccaccttctccacattatcatcataagtggaaccgatattgtaagacaaatattcgacgaggctatgcccccaccactccttaagaaggagttactcatccacaagaacgtgctagagtcatactataaccacctctggactaatcacccactgggcggttcatggcatctgctgtatcccccaaataaagagctcccacagagtaaacagttcgacctgtgcttattactcgccctgatcaagcacctgaacgtattccccgcaccaaaaaaaggatggaacatggagccacctagcagcgatatctccaaaagcgcagacatcctcagattatgtaaataccgggacatcttgttatccgaaatccttatgaacggacttactgagtcacagttcaacagcatctggaagaaggtgagcgatatcctcctgaggttgggcatgatgcaggaggacatcgacaaggtaaaggaaaaccctatcgagaatatctctctggactatcaccagctttctgtctatctcgggatcccagtgccagagattatccaaaggatgctctcctgttatcagcagggtatagcccttcaatcaatcaccggctcacagcgcattgagatcgaagaactgcagaatgaggaagaggagctgtcgccaccactaatggagtacaacatcaatgtgaaatcacatcctgaaattcagttcgccgaaatcaataaggatggtacctccatccccagcgaatcctccacggaaagcctcaaggatctgcaagaagtgaagtctaaacaacgcaaaaagaagaaaaccaagaacaagaagaataaagactctaaggaagaccaggtgccttatgtggtggagaaagaagagcagctccgcaaagagcaggccaatccccactccgtctcaaggctgatcaaggatgatgcttctgatgttcaagaggattcggccatggaggataaattttacagccttgatgaactgcacatcctcgatatgatagagcagggttctgcaggtaaagtgaccaccgattatggcgagacagaaaaggaaagactggcacggcaacggcagctgtacaagcttcactatcaatgtgaggattttaaacgacaactgcgtacggtaacatttcggtggcaggagaaccagatgcagatcaagaaaaaagacaagatcattgcgtccctgaatcagcaggtggcattcggcattaacaaggtgagcaagctgcagcgacaaatccacgccaaggacaatgagatcaagaatctaaaagagcagctatccatgaagaggtcgcagtgggagatggagaagcacaatctggagtccacaatgaaaacttatgtaagtaagctgaatgcggaaacgtcacgcgctctgaccgccgaagtctacttccttcagtgcagacgggactttggcctactgcacttggaacagacagagaaggagtgcttgaaccaactggcgagggtgacacacatggctgcatcaaaccttgaaagtctgcagctaaaagcagccgtggatagctggaatgcgattgtcgccgatgtgagaaacaagatagcctttttgaggacccagtacaacgagcagatcaacaaagtgaagcaggggtttgctctttcaaccttgccccctgtccagcttcctccacctcccccatcaccggagatccttatgcaacagttcctgggccgtcccctcgtcaaagagtcgttcttccggccaatactgaccgtaccccagatgccggctgtatgccccggtgtcgttagcgcaacggggcagccacgagcgcctctgatgactggcattgcctgggctctgcctgctccagtgggagacgccgtcccccctagtgctgggttgcggtcagatccatctattatgaactgggaaaggattaccgatcggctgaagaccgcttttccacaacagacccgcaaagaactgactgatttccttagaaaactcaaagatgcctatggcaagagtctgagtgagctcacattcgacgagattgtctgtaaaattagccagttcatcgaccccaagaagtcccagagtcagggaaagtccgtgagcaatgtaaactgtgtctcaccctcacactctcccagccagcctgatgccgctcagccacccaaaccagcctggcggcctctcacatctcaggggccagccacttgggaaggggcttccaacccagacgaggaggaagaggaggaggaaccctgtgtgatatgtcacgagaacctgtctcccgaaaatctgtcggtgcttccatgcgcgcacaagttccatgcccagtgtataagaccttggttgatgcaacaaggaacctgtcccacatgtagattacacgttctgttgcccgaagagttccccggtcacccatctagacagctccctaagatctag

SEQ ID NO: 28632 - DNA, 996 bp, Artificial Sequence
  Description of Artificial Sequence: Synthetic coding sequence
atgtcacgccagctgagccgcgctcgccctgccactgtgttgggtgcaatggagatgggacgccgtatggacgcccctaccagcgctgccgttacgcgcgcattcctggaacgcggacacacagaaattgacacagcatttgtgtactctgagggccaatcagaaacaatcctggggggactcggactacgccttggcggaagtgactgccgtgttaagatagatacgaaggccatccctctctttggtaactctctcaaaccagattccctgcgcttccaactagaaacctctctgaaacggttgcagtgcccaagggttgatctgttttacctgcacatgccagatcactctaccccagtggaagagacactacgagcatgccaccagctccatcaggagggaaaattcgtggaacttggattaagtaactacgctgcatgggaagtagctgagatttgcactttgtgcaaatcaaacggctggatcctgcctacagtatatcagggtatgtacaatgcgatcactcgccaagttgagaccgagctcttcccatgcctgcgtcattttggcctgcgtttttacgcttttaaccccctagccggagggctcttgaccggaaaatacaagtacgaagacaagaatggaaaacagcctgtcggcagattctttggaaatacttgggccgaaatgtaccgcaatcgctactggaaagaacaccattttgagggaatcgcacttgtggagaaagcgctgcaggctgcttatggagcttctgctccctcaatgacaagtgcaaccctgaggtggatgtaccaccactcacagctccaaggcgctcacggcgatgccgtcattctcggcatgagttctctggagcagctagagcagaacctggcagctgcagaggaaggcccactcgagcccgctgtcgtggatgcatttaaccaggcatggcatctcgtaacacacgaatgccctaattactttcggtag

SEQ ID NO: 28633 - DNA, 1131 bp, Artificial Sequence
  Description of Artificial Sequence: Synthetic coding sequence
atgtcccctgaggtggccctgaaccgaatttcaccaatgctcagccctttcattagctccgtcgtcaggaacggtaaggtcggactcgacgcaactaattgccttcggatcaccgatctgaagagtgggtgcacttccctcaccccaggcccaaactgcgatcgattcaaattgcatatcccctatgcaggtgaaactcttaagtgggatataatctttaatgcccagtatcctgagctgccgccagactttattttcggtgaggatgcagaatttctaccagatccaagtgcccttcagaatctcgcctcctggaatcctagcaaccctgagtgtcttttgctcgtcgtgaaggagcttgttcagcagtaccaccagtttcagtgttcgcgtctaagagagtccagccgcttaatgttcgagtaccagacacttcttgaggaaccgcagtatggcgaaaatatggagatctatgccggaaagaagaataattggaccggggagttctctgccagattcttactgaagcttcccgtggacttttcaaacatacctacctacttgctgaaggatgtcaacgaggaccctggagaggatgtggcgcttttgtcagtcagttttgaggatactgaagccactcaggtttatcccaagttgtacctgtcaccccgtatcgagcatgccttgggcggaagtagcgccctccatattccagccttcccagggggtggctgcttgattgattacgtcccccaggtgtgccacctcttgaccaacaaagtccagtacgttatccagggataccataaacggagggaatatattgcagctttcctgtctcatttcggcactggcgtagtcgaatacgatgcagaagggttcacgaagctcacactcctgttaatgtggaaagacttttgtttccttgtgcacattgatttacccctgtttttcccgagagatcagccaacactgacttttcaaagcgtgtaccacttcaccaatagtggacagttgtattcacaggcccagaaaaattatccttattctccccgttgggatggtaacgagatggctaagcgagcaaaaagggagagcaacagagatggcgaagaaagctcatcggcctag

SEQ ID NO: 28634 - DNA, 1881 bp, Artificial Sequence
  Description of Artificial Sequence: Synthetic coding sequence
atggacgagcaggaggcccttaacagtattatgaacgacctggtggcactgcaaatgaacaggcgacacagaatgcctggctacgagactatgaagaataaggacactggacacagcaacaggcagtccgatgtccgaattaaattcgaacacaacggcgagcgcaggattattgcattcagccgccctgtgaagtacgaggatgtcgagcacaaagtaacgacagtctttggacaacctctggatttgcattacatgaataatgagctgagtatcctactcaaaaaccaggatgatctcgataaggcaatagacattctagatcgctcgagctctatgaagtctctcagaatactgctattatcccaggataggaaccacaatagtagcagtccccattctggagtctcccgccaggtgcgcatcaaggcaagccaatctgccggagatataaataccatctaccagccacctgagcccagaagtagacatttgtccgtttcctcccagaaccccggtcggtcatccccccctcctggatacgtgcccgagaggcagcaacacattgccagacaggggtcatatacctctatcaactctgaaggtgaatttattcctgaaacttcagagcaatgcatgttagatcctctctcgagcgcagaaaactctcttagtgggtcctgtcagtccctggatagatcagccgactctccctcattccgcaagagccgtatgagcagggcccaatctttccccgacaacagacaagaatacagtgaccgcgaaacccagctctacgacaagggtgtgaaaggcggtacctatccccgtcgttaccacgtgtctgtgcatcacaaggactattctgacggccgaaggacctttccacggatacgtcgacaccagggcaacctgtttacgttagttccatcttcccgctccctgtctacaaatggcgaaaacatggggctcgcagtgcagtacctggaccctcgcggtagattacggtctgcagactcagaaaacgctctctccgtgcaagagcggaacgtcccgacaaagtccccatcagcacccattaattggaggcgtggcaagcttctcggccagggagcctttggacgcgtgtacttatgttacgatgttgacactggaagggaactcgcctcaaagcaggtccagttcgatccagactcccctgaaacctcaaaagaggtctcagcactcgagtgcgagatccagttgctgaaaaacttgcagcacgaaaggattgtacagtactacggctgtctcagggaccgggctgagaaaacactgactatcttcatggaatacatgcctggaggttcagtcaaagatcagctgaaagcttacggcgcactcactgagtccgtgaccaggaaatatacaaggcagattctggagggaatgtcctatctgcactcgaacatgatagtccaccgggatatcaagggggcaaacattctgcgcgactctgcgggaaatgtaaagctgggggatttcggcgctagcaagaggttacagactatctgcatgtctgggaccggaatgcggagtgtgacagggacaccttattggatgtcgccagaagtaatttcaggtgaggggtatgggaggaaagcagacgtctggagcttgggttgtactgttgtggaaatgctgaccgaaaaaccaccctgggccgaatatgaagctatggctgccatcttcaagatcgcaacccaaccgaccaaccctcaactgcctagccatattagcgaacatggcagggacttcctccgccgaattttcgtggaggcaagacagcgtccatccgccgaagaactgctgacacatcacttcgcgcagctgatgtattag

SEQ ID NO: 28635 - DNA, 1701 bp, Artificial Sequence
  Description of Artificial Sequence: Synthetic coding sequence
atggatctgcaccgagcagcctttaaaatggagaactcttcatatttaccaaatcccctggccagtccagccctgatggtgctggcctcaaccgcggaagctagtcgggatgctagcatcccctgccaacaacctcggcctttcggcgtcccagtgagtgtagacaaagacgtgcacataccttttaccaacggatcctatactttcgcttccatgtaccacaggcaggggggagtcccaggtacgttcgcaaatcgagattttccaccatctctgctccacctgcatccacagttcgcgcctcccaatttagactgcaccccaatctccatgctgaaccacagtggcgttggagcatttcggcctttcgcctctacagaggaccgggagtcgtatcagagcgcctttacgcccgcaaagaggcttaagaattgtcacgatacagaatccccgcacctgaggtttagcgatgctgatggaaaagagtatgattttgggacccagcttccgagcagctccccaggcagtttgaaggtggatgacaccggaaagaaaatattcgctgtgtcaggcctgatcagcgatagggaggcaagctcaagtccggaggatcggaatgaccgatgtaaaaagaaggctgcggcactctttgactcgcaagcacccatctgccccatctgccaggtgctgcttcggccatctgaactgcaagaacacatggagcaggagctcgagcagctggcccagctgccttcctctaagaactccctgttaaaggatgccatggcacccggaacgcctaagtcactgctgctctccgcctctattaagcgggagggggagagccctaccgcgtcacctcatagttcggctactgatgacctgcatcattctgacaggtaccagaccttcttaagagtgcgcgcaaacaggcagacgaggctaaatgcgcgaatcggcaaaatgaagcgtaggaagcaggatgaaggtcaaagagagggatcttgcatggctgaggatgatgccgtcgacatagagcacgagaataataataggttcgaggagtacgaatggtgcggccaaaaacgtatcagggccacaaccttgctggaaggaggctttcggggaagtggcttcataatgtgttccggtaaagaaaaccctgattcagatgctgatctggacgtagacggcgatgacaccttggaatatggaaagccacagtatacggaagccgacgtgattccttgcaccggcgaagagcccggtgaagccaaagaaagggaggcgttgcgcggagctgtgctgaacgggggaccaccctcgacccgcattacccccgagttttccaaatgggctagcgacgagatgccatctactagtaacggggaaagttcgaaacaggaggcgatgcagaagacctgtaagaattctgacatcgagaagattacagaagactccgccgtaactacgtttgaggccctcaaagcacgagtgcgagagctcgagcggcagctctcgcggggagaccgttacaagtgcctgatttgtatggatagctactcgatgccgctgacaagcatccagtgctggcacgtccattgtgaggaatgttggctgcgtaccctgggagctaaaaaactttgtcctcagtgtaataccatcactgcccctggagatttgaggcgcatctacctgtag

SEQ ID NO: 28636 - DNA, 456 bp, Artificial Sequence
  Description of Artificial Sequence: Synthetic coding sequence
atggagggatgcgtcagcaacctgatggtctgtaatctcgcgtacagcggcaaactcgaggagctgaaagaatcaatcctggcagataagtctctcgcaactagaacagaccaagatagtaggaccgcgctccactgggcctgttcagcgggacatactgagatcgtggaatttctgctgcaattgggggtcccagtgaacgataaagatgacgcaggatggagcccattgcatattgctgcctccgcgggaagggacgaaatcgtgaaggcgctgctggggaagggcgcacaggttaacgctgtcaaccagaatggatgtaccccattacactacgctgcttctaaaaaccggcacgagatcgccgtgatgttattagaggggggtgctaaccctgacgcaaaagaccattacgaagccaccgccatgcatagggcagctgccaaagacacatag

SEQ ID NO: 28637 - DNA, 2220 bp, Artificial Sequence
  Description of Artificial Sequence: Synthetic coding sequence
atgggctttagcaacatggaggacgacggcccagaggaggaggaaagggttgccgagccacaggccaactttaacacgccacaagcgctgcgcttcgaagaattactggccaacctcctgaacgaacagcatcaaattgcaaaagagttgtttgaacagctcaaaatgaaaaagccctcggcaaaacagcaaaaggaggttgagaaggttaaacctcagtgtaaggaagtccaccagacactcatcctggaccctgcccagcgtaagcggctgcagcagcagatgcagcagcacgtgcagctcttgactcaaatccatctcctggctacttgtaatccaaatctgaatccggaagcctcgtctactagaatctgtctcaaggaactgggaacatttgcacaatcatcaatcgccctccatcaccaatacaatcccaaatttcaaaccctcttccagccatgtaatctgatgggagctatgcaacttatcgaggacttctctactcacgtgtcgatcgactgcagccctcacaagacagtgaaaaaaaccgccaatgagttcccctgtttgccgaaacaagtagcttggatactggctacatctaaggttttcatgtaccctgaactgctccccgtctgcagcctgaaggccaagaacccccaagataagatcctgttcaccaaagcagaggacaatctgttagcactgggactgaaacacttcgagggtactgagttcctgaatccattgatctccaagtacctgctgacctgtaagaccgcgaggcagcttaccgttaggataaagaacctgaatatgaaccgagctcctgataatattatcaagttttataagaaaacaaaacagctgcccgttctgggaaaatgttgcgaggagatccagccccaccagtggaagcctcctatcgagcgggaggagcatcgattgccattttggctgaaggcaagccttccctctatccaggaagagctgaggcacatggcagacggagcacgagaagtaggcaacatgacagggaccactgaaatcaactctgatcagggcctggagaaggataactcagaactgggatccgaaactcgatatccgcttttgctgccgaaaggcgttgtgctcaaactgaaaccagttgctgatcgctttcccaaaaaggcatggcggcagaaacggagtagtgttctaaagccattactgatccagccctccccgagcttacagccatccttcaatcccggtaagactcctgcgcagtctacacatagcgaagctcctcctagtaaaatggtgttgcgcataccccaccctatacagccagcaaccgttctccagaccgtgccaggtgtgcctccgctaggggtttcaggcggtgaatctttcgagagccccgctgccttacctgctatgcccccagaagccagaaccagttttcccctctctgagtcccagacccttttatcatcagcccctgtccctaaggtaatgatgccttctcccgcttctagtatgttccgcaagccatacgtgcggagacgccctagtaaacgtagaggagcgcgtgcattcaggtgtatcaagcctgccccagtgatccatcccgcaagcgtgatcttcaccgtacccgcaaccacagtaaaaatagtctcccttggaggcggatgcaatatgatacagcccgtgaatgcagccgtggcccagtcccctcagacaatccctattgctacactcctggtcaatcctacaagtttcccttgtcccctgaatcaacctctagtggccagctccgtttccccactgatcgtgtcaggcaacagtgttaatctccccattccctccacacccgaggataaggcccatatgaacgttgatatcgcgtgtgccgtggctgacggggaaaatgccttccagggtctggagcctaaacttgagccacaggaacttagtcccctcagtgccaccgtcttcccaaaagttgagcacagccccggacccccacctgttgacaaacagtgccaggagggattgagtgaaaactcagcttacaggtggaccgtcgtgaaaaccgaagagggtcgacaggcgctggaaccgctaccacagggaatccaggagagtctgaataattcaagtcccggtgatctggaagaggtggtcaaaatggaacccgaggatgcaactgaagagataagcggattcctgtag

SEQ ID NO: 28638 - DNA, 1692 bp, Artificial Sequence
  Description of Artificial Sequence: Synthetic coding sequence
atgagccgtccatcctctagggccatttacctccatagaaaggagtatagccagaacctgactagtgagccgaccctgctgcagcaccgcgttgagcacctgatgacctgcaaacagggatcacagcgcgtacagggacctgaggacgccctccagaaactgttcgagatggatgcccagggcagggtctggtcacaggatcttatcctgcaggttcgagatggttggctgcagctgctcgatatagaaacaaaggaggagctggactcataccggctcgattctatccaggccatgaatgtagcacttaatacatgcagctataatagcatcctgtccatcacggtgcaggagcccggactcccagggacttcaacacttctgtttcagtgtcaagaggtgggagccgaaaggttgaaaaccagtctacaaaaagcacttgaggaggagctggaacagaggccgaggctgggagggctgcagcccggacaggatcgttggcgcggacccgctatggagcggccactgcccatggagcaggcccgatatctggaacccggtatcccgccagagcagccacatcagaggactttggaacactctcttccaccttccccacgccctcttcccagacatacgagcgcgagggagccatctgcatttactctgcctcctccccgacgtagctctagccctgaggatcccgaaagagacgaggaagtgcttaatcatgtgcttagagatatcgagctgtttatgggcaagcttgagaaggcccaggctaagaccagcaggaaaaaaaaattcgggaagaaaaataaagaccagggagggcttacacaagcccaatatattgattgttttcagaagataaagcactcctttaaccttctcggtagattggctacgtggctcaaggagacctccgcccctgagctcgtacacatcttatttaagtccctaaattttatacttgcacggtgtcccgaagccggactcgctgcccaggttattagtccccttctcactccgaaggcaatcaatctgctccagagttgtttgtctccaccagaatccaacctatggatggggttaggcccagcctggactacgagtagagcggactggaccggtgatgagcccctcccttatcagcccacatttagcgacgactggcagctgcctgaacctagttcacaggcccctctggggtaccaagacccggtctcccttaggccgagtagtcccaaacccgctcagccagccctgaaaatgcaagtcctgtatgagttcgaggcgcgtaaccccagagaactcaccgtggtccagggggaaaagctggaagttctggaccacagtaaacgctggtggctggtgaagaatgaagccggacgctcgggctatatcccatccaatatcctggaacccctccagcctggaacacctgggacgcagggacagagcccctccagagtgcctatgctaaggttaagctctcggccagaggaggttaccgattggctgcaggctgaaaacttctccaccgcgactgtccgaactctaggctctctaaccggcagccaactacttcgtattcggccaggagaactgcagatgctgtgtccccaagaggcacctcggatcctttctcgtctggaagctgtacggaggatgctgggaatttctccatag

SEQ ID NO: 28639 - DNA, 525 bp, Artificial Sequence
  Description of Artificial Sequence: Synthetic coding sequence
atgacttgttgtcagacatccttctgtggctatcctagctttagcatcagcggcacctgtggctcttcatgttgtcaaccctcatgttgtgaaacctcttgttgtcaacccagaagctgccagaccagcttctgcggtttcccatccttttcaacgtccggcacttgctcttcctcatgttgtcagccctcatgttgcgagacatcttgctgccagccttcatgctgtgagactagctgttgtcaaccttcctgttgccagatctcttcctgcggaacaggctgtgggataggtggagggataagctacgggcaggaggggtcatctggggcagtgtccacaagaatcagatggtgcaggcccgactcccgagttgagggaacatatctgcccccttgttgcgtcgtgagctgcacaccgccttcctgctgccagttacaccacgctcaggccagctgctgtagaccaagctactgtggacagtcatgctgcaggcccgtgtgttgttgcgagcctacctgctag

SEQ ID NO: 28640 - DNA, 1173 bp, Artificial Sequence
  Description of Artificial Sequence: Synthetic coding sequence
atgagaggagacagggggagagggaggggagggaggttcggctcgaggggtggtcctggcggagggtttcgtccatttgttccacatatcccgttcgatttctatctgtgtgagatggcgtttcctagagtaaagcccgcaccggatgaaaccagcttctctgaagcactgctgaaacgcaaccaggatctcgcccctaattccgccgagcaggcatccatactgagcctggtgactaaaattaacaacgtcattgataatcttatagtggctccaggcaccttcgaggtacagatcgaggaagtccgacaagtgggctcttacaaaaaggggaccatgacgacagggcacaatgtcgccgatctcgttgtgatcctgaagattctgccaaccctcgaagcggtcgcagctttgggcaacaaagtggtcgagagcttacgggcacaggatccaagcgaggtattgacaatgctaaccaatgagaccggctttgaaatttctagcagcgacgccaccgtcaagatcctcatcacaactgttcctcccaacctgcgcaaactggaccccgagctgcatttggacatcaaggtgctacagtccgcactggccgcaatccgacatgccaggtggtttgaggagaatgccagccagagcacggttaaggttctgatccgactccttaaggatcttaggatacggttccccggattcgaaccgctcacaccatggattttggacctgttggggcactatgctgtgatgaacaacccaacgcgccagcccctcgcccttaacgttgcctatcggcgatgcctgcagatccttgccgcaggtctgtttctgcccggttctgttggaatcactgatccatgtgaatccggtaacttcagagtacatactgtaatgacactcgaacagcaagatatggtatgctatacagcgcagaccctagtgcgcatcctgagccacggtggttttaggaagatactcggtcaggaaggcgatgcatcttacctcgcctctgagattagtacctgggacggtgtcatcgtgacgccttcagaaaaggcgtatgagaaacccccagagaaaaaagagggcgaggaggaggaagagaacaccgaggaaccaccacagggtgaggaggaggagagcatggagactcaggaatag

SEQ ID NO: 28641 - DNA, 3606 bp, Artificial Sequence
  Description of Artificial Sequence: Synthetic coding sequence
atgcccagaggcgaagccccagggcctggacgcaggggcgctaaggacgaagctctcggtgaagaaagcggcgaaagatggagcccggaattccatttacagaggaaactggctgactcaagccatagtgagcagcaagacagaaaccgggtatcagaggaactgattatggtggtacaggaaatgaaaaagtatttcccatctgaacgtaggaataagccctccacactggacgcgttgaactatgcccttcgatgcgtgcactcggtgcaagcgaactccgagttttttcaaatcctatcacaaaacggagcccctcaggcagatgtgagcatgtacagtctggaggagctggccaccattgcatctgagcatactagcaaaaacaccgatacgttcgttgctgttttcagcttcctgtctggaaggttggtgcacatttctgagcaggccgctctgatcctgaaccgcaagaaggatgtactcgcaagctctcactttgtggatctactcgcccctcaagacatgcgcgtcttttacgcccacacagcacgagcgcagctccccttttggaataactggacacagcgggctgctagatacgaatgcgccccagtaaaaccctttttttgccgaataaggggcggagaagatagaaagcaagagaaatgccatagtccctttcggataatcccttacttaatccatgttcaccacccggctcagcctgaactcgaaagcgaaccatgctgcctgaccgtagttgagaagattcattccggctacgaggccccaaggatccccgttaacaagagaatattcacgacgacacatacaccgggttgtgtcttcctggaagtcgacgaaaaagctgtacctctcctggggtatctgccccaggacctcattggaacaagcatccttagttatctccaccctgaggatcgaagcttgatggtggctattcaccaaaaagtgttaaaatacgctggccacccaccctttgaacatagcccgatccgattttgcacgcagaatggcgattatattatcctggatagctcttggagttcattcgtgaacccatggagcaggaaaataagctttatcattggacggcacaaggtgaggacaagccctctcaacgaggacgtcttcgcaaccaagatcaaaaagatgaatgacaacgacaaagatattaccgaactgcaggaacaaatttataagctcttactgcaaccagtgcatgtatcggtgtcgtcgggatacgggtcactcgggtctagcgggtcccaggaacagctcgtcagtatcgcctcatcttccgaggccagcggccaccgggtggaggagacaaaggctgaacagatgaccctacagcaggtttatgcctctgtcaataaaattaagaacctcggccagcaattgtacatcgagtccatgactaaatctagcttcaagcctgttacaggtacaagaaccgaacccaatggaggaggagaatgcaaaaccttcacatccttccaccaaacactcaaaaataactccgtgtacactgagccctgcgaagatttaaggaatgacgagcacagtccatcctaccaacaaataaactgtatcgatagcgtaatcaggtacctcaagtcctacaacatccctgccctaaaaaggaaatgtatctcctgtacaaacacaactagcagttcaagcgaggaagataagcaaaatcacaaagcagacgacgtgcaggcactacaggccggactgcaaatacccgcaatcccaaagtcggagatgccaaccaacggcaggtcgatcgataccggtgggggagccccacagattctcagcaccgctatgttaagcctggggtccgggatcagtcagtgcggatacagcagcaccatcgtgcatgtaccacccccagaaacggctcgtgacgctacactgttctgcgagccttggaccctcaatatgcagccagcaccactaacatccgaggagttcaaacatgtgggcctcactgccgctgttctgtctgctcacactcaaaaagaggaacagaactacgtcgataaattccgagaaaagatcctgagctcaccttactcatcctacttacagcaagaaagcaggagcaaagccaagtatagctattttcagggtgactctacttccaagcagactaggtccgcgggttgtaggaagggaaagcataagagaaagaagctgcctgagcctcccgatagctccagttcgaacacaggctccggaccaaggcggggagcacatcagaacgcacagccctgttgcccatctgctgcgagtagccctcataccagtagcccaactttccctcctgcagcgatggtgcctagtcaagcaccatacctcgttccagcattcccactgcctgccgctacttcccctggccgtgaatatgctgccccaggaaccgctcctgagggactgcatggcctgcccctcagcgaggggctccaaccgtatccggcttttccctttccgtacctggacacattcatgacagtttttttgcctgacccacctgtttgcccactgttatcgcctagctttctgccctgtcccttcctcggagccaccgcatcctccgccatcagccctagcatgtctagcgccatgtcccctactcttgatcctcctccgtctgtgacttctcagagaagagaagaggagaagtgggaggctcagtccgagggacaccccttcattacctcaaggtccagcagtccgctgcagctgaacttgctacaagaagagatgcccaggccatcggagagcccagaccaaatgagacggaacacatgtccacagacggagtattgtgtaaccggaaacaacggcagcgaatcatcacctgcaactacaggagctttgtcaaccggcagtccccctagggagaacccgagccatcccacagcctctgctttgtcgaccggatctccacctatgaagaacccaagccaccctaccgcctctgccctgagtacaggcagccccccaatgaagaacccttctcatcccaccgctagcaccctatcaatgggcctgcccccatctcgtactcccagccacccaaccgctacagtgctgagtaccggatctcccccaagcgaatcccctagcagaaccggaagcgcagcttccgggagtagtgattctagcatctacctcacctcctctgtctactcaagcaaaatcagtcagaatggtcagcagtctcaggacgtacaaaagaaagaaacattccctaatgtggccgaggagcctatctggcgaatgatcaggcaaactccagaacgcatcctgatgacctaccaggtgccagagagagtcaaggaggtcgtgcttaaagaggacctagagaagctcgaatccatgagacaacagcagccccagttcagtcacggccagaaggaagaactcgccaaagtttacaattggattcagtcacagacggtaacccaagaaatcgatatacaggcctgcgtgacctgcgagaatgaagactccgccgacggagcggctactagctgcggtcaggtcctggtggaggactcgtgctag

SEQ ID NO: 28642 - DNA, 1296 bp, Artificial Sequence
  Description of Artificial Sequence: Synthetic coding sequence
atgtccgatcagattaagtttattatggattccttgaataaagaacctttcagaaagaattacaatctgatcacttttgactctttggagccgatgcagttgttgcaagtgctgtccgatgtcctggcggaaatagaccctaagcagttggtggatatccgcgaggaaatgccagagcagactgctaaaaggatgctgtccctcctgggtatcctgaaatacaagccaagcggtaacgcaactgacatgagtacctttagacaaggactcgtgattgggagcaagccggtgatttaccctgtgttgcattggttgctgcagcgtacaaacgagcttaagaagcgagcctaccttgcaaggttcctgattaaactcgaggtcccatcagaattcttgcaggacgagacggtggcagacaccaataagcagtacgaagagctcatggaggcattcaagaccctccataaggagtacgagcaactgaagattagcggcttttcaaccgctgaaatacgtaaggacatatcggctatggaggaggagaaggaccaactgatcaaaagagtcgaacacctcaaaaagcgggttgagactgcacagaatcaccagtggatgttgaagatcgcccgacagctgagagtggaaaaagagcgggaagagtaccttgcacagcagaagcaggaacagaagaatcaactcttccatgctgttcagcggctgcaaagagtgcaaaaccagctcaaatctatgcgacaggccgcagcagacgctaagcccgaaagtctcatgaaacgcctggaggaagagataaagtttaatctatatatggtaactgagaagttcccaaaggagctcgagaacaaaaaaaaagaactacactttttgcagaaagtcgtatctgagccagcaatgggacactcagatttactcgagctggagagtaagatcaacgaaattaacaccgaaataaaccaactgatcgaaaaaaagatgatgcgaaacgagcccattgaaggaaaactgagcctttatcgacagcaagcatccataatatcccggaaaaaggaagctaaagccgaggaactacaggaggcaaaggagaaactggcctccctggaacgggaagcctcggtgaagagaaaccagacaagggagtttgacgggacggaggtccttaagggagacgagaggcaggacctgacactctcgccacggctggagtgtggcggagtaatcatggcttactgtagcctgaagcttcttggctctagcgacccgcctaccagcgcctcttag

SEQ ID NO: 28643 - DNA, 1119 bp, Artificial Sequence
  Description of Artificial Sequence: Synthetic coding sequence
atggccagtagtgcatccgctcgcactccagccggaaaacgggtcatcaaccaagaggagctccgaaggcttatgaaagagaagcagcggctgagcaccagccgcaagaggatagaaagtccgtttgccaaatataataggcttggccagctttcctgcgccctgtgcaatacgccagtaaaatctgaactcctctggcaaacccacgtccttgggaaacagcatcgggaaaaggtggctgaactgaaaggcgctaaagaggcatcccagggatcctcagcctcgtccgcccctcactctgtgaagcggaaggcgccagacgccgatgaccaggacgtgaagcgagctaaagcgacattggtacctcaagtccagccgtccacctccgcctggaccacgaacttcgacaaaatcgggaaggaatttatccgagcgaccccgtcaaaaccctctgggctctccttgttacctgattacgaggatgaggaggaggaagaagaagaagaggaaggagatggcgagagaaagcggggagacgcttccaaacctctaagtgacgcccagggcaaggaacatagcgtgtcctcgagcagagaggtgacttcaagtgttctacctaacgattttttttccacaaaccccccaaaggcaccaataattccacattcagggagcattgaaaaagcggaaattcacgagaaggtcgtggaacgacgagagaacacagcagaggcgctgcctgaagggttttttgatgaccccgaggtggacgcaagagtgaggaaagtagatgcccctaaggaccagatggacaaagagtgggacgagtttcagaaagcaatgaggcaggtgaacacaatatccgaagctattgtagcagaggaagatgaggaaggcaggctcgatcgacagatcggtgaaattgatgagcagatcgaatgctacagacgagttgaaaagttgcgaaatagacaggatgagataaaaaacaagctcaaagaaatactgacaatcaaggaactgcagaagaaagaagaggagaatgcggattcagatgatgaaggtgaacttcaggatctgctgtcccaagattggcgggttaaaggggctctcctgtag

SEQ ID NO: 28644 - DNA, 1782 bp, Artificial Sequence
  Description of Artificial Sequence: Synthetic coding sequence
atgtctcggcctagttctcgcgctatatacctccatcgcaaggagtactcccagaacctgaccagcgagccaaccctgttgcaacatcgcgtggagcatctgatgacatgcaaacaaggctctcagagagtgcagggaccagaagatgccctgcagaagctgttcgagatggacgcccagggccgtgtttggagtcaggacttaatcctccaggtacgggatgggtggctacagctcctcgacattgaaacgaaagaggagcttgattcataccgacttgatagcattcaggccatgaacgtggcactgaatacatgttcctacaattcgattctttcgattaccgtgcaggagcctggccttccaggaacctccacactactttttcagtgccaggaggtgggtgccgaacgcctcaaaaccagcctccaaaaggcgctggaagaagaactggagcagcgcccacggttgggtggtcttcagcccggtcaggacagatggaggggccctgccatggaaaggcccctgcctatggaacaggctcggtatctggaacctggtatacctcctgagcagccacaccagcgcacccttgagcactccttaccccctagtccccgacctcttccaagacacacgtccgcacgtgagccctccgccttcaccctccctccaccgaggagaagcagctctcctgaggaccccgaaagagatgaagaggtcttgaaccacgtcctacgggacatcgagctgttcatgggaaaactggagaaagcgcaagcaaaaactagccggaagaagaaattcggcaagaagaacaaggatcagggcggacttactcaagctcaatatatagattgctttcagaagattaaacattcatttaatctgctggggaggctggccacgtggctgaaagagaccagtgccccagaactggtgcacatcttgtttaagagcctgaattttatcttggcacggtgtcctgaggccggactggccgcacaggttattagcccgcttctgacacccaaagcaattaatcttctccagagttgcctgtctccacctgagagcaacctgtggatggggctgggacctgcttggactacatcccgcgctgactggaccggcgatgagccattaccctatcagcccacctttagcgacgactggcagttacctgaaccctcctcccaggcacccttaggatatcaggatcctgtatccctgaggcggggaagccatcggttaggctcaacgagccactttcctcaggaaaagacccacaatcacgaccctcagccaggcgacccaaactcccgtccttcttcccccaaacctgcgcagcctgccctaaaaatgcaggtcctctatgaatttgaggctagaaatcctagagagctgactgttgttcaaggggagaaactggaggtcctggaccacagcaaaaggtggtggcttgttaagaatgaagccggaagaagtgggtatattccttctaatattcttgagcctctccagcctggaacccccggtactcagggtcaatctccgagtagagtaccaatgcttagacttagttcccggccagaggaggtcacagattggttgcaggccgaaaactttagtaccgccaccgtccggacccttgggtcattgactggatctcagctcctgcgcatcaggccaggggagttgcagatgctctgccctcaggaagcccctcggatcctctcccggcttgaagccgtgcgacgcatgttgggaatatcaccgtag

SEQ ID NO: 28645 - DNA, 1050 bp, Artificial Sequence
  Description of Artificial Sequence: Synthetic coding sequence
atgaagttgacttctgagaagttaccaaagaatccattctacgcctctgtgtcccagtacgccgcaaagaaccaaaagttctttcaatggaagaaggagaaaaccgagtcagactacactcatgctaacctcgtggataaggccctccaactgctgaaggagaggatcctgaagggcgacactcttgcttactttctccgcggacagctgtacttcgaagagggctggtacgaagaagcccttgagcagtttgaggagattaaggagaaggaccaccaggcaacctaccagctcggtgtcatgtactatgatggactggggacgacgctggacgctgaaaagggggtggattatatgaagaagatactggactcaccctgtcccaaagcacgccacctaaagttcgccgcagcatacaacctgggtagggcctattacgaaggaaagggggtcaagcgttccaacgaggaggcggagcggctatggctgatcgccgctgataacgggaacccaaaggcctcagtaaaggcacagagcatgctgggtctctattactctactaaggaaccgaaggagcttgagaaggccttctattggcattcggaggcgtgcggaaatggcaatctggagtctcagggagccttgggcttgatgtacctctacggacaaggcataagacaagacaccgaagcagcactgcagtgcctgcgggaggcagcagaacgcggtaacgtttacgcccagggtaatctcgtcgaatattattacaagatgaagtttttcaccaaatgtgtggccttttcgaagaggattgccgattacgatgaggttcacgacatccccatgatcgcgcaggtgacggattgcctgccagaatttattggacgtggaatggccatggcctccttctaccacgcccgttgcctacagctgggactgggcattactcgcgacgagacgaccgccaagcattactattccaaagcctgtaggttgaatcccgcacttgccgatgagctgcatagtcttttaattcgtcagcgtatttag

SEQ ID NO: 28646 - DNA, 1236 bp, Artificial Sequence
  Description of Artificial Sequence: Synthetic coding sequence
atgggactgaagaagatgaaagggctatcttacgatgaagcttttgctatggccaatgatccactggaaggttttcatgaagtgaacctggcttcacccacgtcccctgatctcctgggtgtatatgagtccggcacgcaagagcagaccacctctcctagcgtcatctatcgcccacatccttcagctctgtctagcgtaccaatacaggcaaatgccttagatgtgtcagaactccctacacaacctgtctactcttctccgaggaggcttaattgcgcggagatcagcagcatttccttccacgtgaccgatcctgctccatgcagcacaagcggggttactgcgggactaacaaagctgactacacggaaggacaattacaacgctgaaagagagttccttcaaggggcaacaattactgaagcgtgtgacggatcggatgatatctttggactttcaacagattccctgtcacggttgcggtctccctccgtgctcgaagtcagggagaaggggtatgagcggctgaaagaggaactggccaaggcccagcgcgagttgaagttgaaagacgaagaatgtgagaggctctcaaaagtccgagatcaactcggacaggagctggaagaactcaccgcctcattgttcgaagaagcccacaagatggtgcgcgaagcgaacattaagcaggccacagccgaaaagcagttgaaagaagcccagggaaagattgacgttctgcaggctgaggtggcagccctaaaaactctggtgctgtccagctcccccacttcacctacgcaggagccccttcctggaggcaagactcccttcaaaaaagggcacacacgaaacaaaagtacttctagcgccatgtccggaagtcatcaagaccttagtgtgattcagcctattgtgaaggactgcaaggaggccgacctaagcctttacaacgaattccgcctgtggaaggatgagcccacaatggaccgaacctgcccttttttagacaaaatttatcaagaggacatatttccgtgcctgaccttctcaaagtcagagctggcttctgccgtgcttgaagcagtagaaaataataccctttcaatcgagcccgtcgggctgcagcccatccggtttgtaaaggcttctgccgtggagtgcggaggaccaaaatcgctgctgtacgtaacatttctgcacaccttcgatacctttagtagggattcctag

SEQ ID NO: 28647 - DNA, 2148 bp, Artificial Sequence
  Description of Artificial Sequence: Synthetic coding sequence
atgttcgggcgaaagagaagtgttagcttcggcggttttggctggatcgacaaaaccatgctagccagtctgaaggtgaagaaacaggagctcgctaacagttccgatgctacacttcctgacaggccattgtcaccaccactcacagctccgcctaccatgaaatcttcggagttttttgaaatgctcgagaagatgcaagatgactacattccgtacccatctattgatgaagtcgtggagaaaggtgggccttatccccaggtgatccttccccagttcggagggtactggattgaggacccagagaacgtaggtactcctacctcccttggatccagtatctgcgaggaagaggaggaggacaacctttcacctaatacatttggctacaagttagagtgcaaaggcgaggccagagcctatcgcagacatttcttgggcaaggatcatctgaacttttactgcacaggatccagtctgggcaacctgatactaagcgtgaaatgtgaggaggccgaaggcatagaatacctccgggtaattttacgaagtaaacttaaaacagtccatgaaagaatcccgttagccggtctcagcaagctgccctccgtgccccagatcgccaaagccttctgcgacgacgccgtcggtctacgcttcaatccagtgctctatcccaaagccagccaaatgatcgtctcctacgacgaacatgaggttaacaacacctttaaattcggggtgatctatcagaaagcacggcaaacattggaagaagaactgttcggaaacaatgaggaatccccggcattcaaggagttcctggacttgctgggcgatacaatcaccctccaggactttaaggggtttagaggcggattggacgtcacccatggccaaacgggtgtggagagcgtctataccacctttcgcgacagggagatcatgtttcatgtcagcacaaaattgcccttcaccgatggtgacgcccagcagctgcagaggaaaagacatattggcaacgacatagtcgctattatctttcaggaggagaacacccccttcgtgccagatatgatagcatcaaactttttacatgcatatatagtcgtgcaggttgaaacccccggtaccgagacaccgtcttataaggtttcggtcactgcccgagaggacgtgccaacattcggtccccctctgccttctcccccagtgtttcagaaagggcctgagtttagagagttcttgctgacaaagctgaccaacgccgagaacgcttgttgtaagtccgacaagtttgccaagcttgaggatagaaccagggccgcactgctggataacctgcacgatgaactccacgctcacactcaagcaatgcttggactggggccagaggaggataaattcgagaatggcggtcatggtggctttctcgagtctttcaagcgcgcaatccgggtacggtcccactcgatggaaaccatggtggggggtcaaaagaagtcccatagcgggggtattcccggtagtctgtcgggcggaatctcccataattctatggaagtgactaagactacgttctctccaccagtggtcgccgctacagttaaaaatcagagccgtagccctattaaaaggaggtcagggctttttcccagactgcataccggtagcgagggacaaggggactcccgcgctagatgcgactccacatcctctacccccaaaacacccgacggcggtcactccagtcaggaaattaaatctgaaaccagctctaacccaagttcaccagagatctgccccaataaggagaaaccttttatgaaactgaaagaaaatggacgcgctatctcccgatcttccagttcaacctcttccgtgtcttctaccgctggggaaggcgaagccatggaagaaggggactctggtggctctcaaccttccaccacatccccgtttaagcaggaagtgtttgtttactccccaagtccaagtagtgagagtccctcactgggggctgccgcaacgcctataataatgagccgctcaccgacagatgcaaagagcagaaattctccacggagtaatctgaagtttagatttgacaagttgtcccatgcgagctccggcgctggtcattag

SEQ ID NO: 28648 - DNA, 2271 bp, Artificial Sequence
  Description of Artificial Sequence: Synthetic coding sequence
atggaggaggagctgaaatgccccgtgtgcgggagtctatttcgggaacctattattttaccttgctctcacaacgtttgcctgccatgtgcccgaaccatagcagtgcagactcctgatggcgagcagcacctgccacagccgttactgctcagccgcggtagtggcctccaagcgggagcagctgctgccgcatctctggaacatgacgccgctgctggacccgcttgcggaggggctgggggttctgcggcaggtgggctgggcggaggcgctgggggtggcggtgaccacgcagataaacttagcctttatagcgagacagattccggctacggtagctatacaccatctctgaaaagccccaacggagtcagggttttacccatggtccctgcaccgccaggatcgtctgcagccgctgctcgaggagctgcttgttcatcattgagtagtagctcaagctcaattacttgtccacagtgtcacaggagcgcttcattagaccaccggggtctgcgcggatttcagaggaatagactcctcgaggctatcgttcagaggtaccagcaagggaggggcgctgtgcctggaacttcggccgctgcggctgtggcgatttgtcaactgtgtgaccgcaccccacccgagcccgcagccactctttgtgagcagtgcgacgtcctttattgttccgcctgccagttaaaatgccaccccagcagaggcccttttgctaagcacagactggtacagccccctccaccccctcctccacctgccgaggccgcttctggtccaaccggcactgctcaaggggcaccgagtggcggtggcggatgtaagagcccaggtggggcaggagctggtgctacaggcggaagcacagcacggaaatttccaacctgccccgaacacgagatggagaactactccatgtactgtgtgagttgtagaactccagtgtgctacctttgcctcgaggagggccgacatgcaaaacacgaagtgaaaccactgggagccatgtggaaacagcataaggcccaactctcccaggccctaaatggagttagcgacaaggctaaggaggccaaggaatttttagtgcagctgaagaatatattacagcagatccaagagaacggtttagactatgaggcctgtctggttgcccagtgcgatgcactggtggacgcgctgacacgacaaaaggcaaaactcctgacgaaggtgaccaaagaacgggagcacaaattaaaaatggtatgggatcaaatcaatcactgcacactgaaactgcggcaaagcaccggcctgatggagtattgtctggaggtgattaaagagaatgatccttcgggcttccttcagatctccgacgcgttgattaagcgcgttcaggtgtctcaagagcagtgggtgaaaggggcattagagcctaaagtttcggctgaatttgatctcacactcgattctgagcccctgctgcaagcaatccaccagctagacttcatccagatgaaatgcagggtcccccctgtgcccctcctgcagctcgaaaagtgctgtacaagaaacaacagcgtgactctggcctggcggatgcccccattcacgcactcacctgtggacggatatatacttgagctggacgacggcgcaggcggtcagttcagagaagtgtatgtcgggaaggagaccctgtgtaccattgacggcctgcatttcaactctacgtacaacgccagggtgaaagcttttaactcttccggcgtgggaccatatagcaagacggtggttctacagacatcagacgtcgcctggtttaccttcgaccccaacagtggccatcgggatatcattctgagcaatgataaccagacggctacctgctcatcctatgacgatcgcgtcgtcctcggcaccgccgctttctccaaaggtgtccactactgggagctacatgttgacagatacgataatcaccccgaccccgcatttggagtggcacgggcatccgtggtgaaggacatgatgttgggcaaggatgataaggcctgggcaatgtatgtagacaataataggagttggtttatgcattgcaactcccacactaatagaaccgagggtggcgtttgcaaaggggctaccgtgggagtcttactggaccttaataaacacactcttacatttttcatcaacgggcagcaacagggtccaaccgctttcagccatgaggttcagcctagcgtgacaagcctgttttag

SEQ ID NO: 28649 - DNA, 2352 bp, Artificial Sequence
  Description of Artificial Sequence: Synthetic coding sequence
atggaggaggaactgaagtgtcccgtgtgcggttcactgttcagggagccaattattctgccctgcagtcataacgtatgcctcccttgcgctagaaccattgccgtgcagaccccagatggggaacagcaccttccacagcccctgctcctttctcgcggttcaggactacaggccggtgccgcagcagccgcaagcttggaacatgacgcggcagcaggcccagcctgcggcggagctgggggttccgctgcgggaggtttggggggaggcgcaggcggaggcggtgaccacgcagataaactgtcactctatagcgagacagattcaggttacgggtcctacacgccttcactgaagtctcctaatggggtgagagtccttccgatggtcccagccccaccaggttcttctgccgctgccgctcgcggtgccgcatgctccagcctgtctagcagtagctcatctatcacctgcccgcagtgccaccgaagcgccagtcttgaccaccgcggactgaggggcttccagcgcaataggctgcttgaagccatcgtacagcgctatcaacagggtcgcggagcagtaccaggtacatccgccgctgccgctgtcgctatttgccagctgtgcgacagaacaccaccagagcctgccgctacactctgtgagcaatgtgatgtgctgtactgtagcgcttgtcaactgaagtgccatccgagccgcggacctttcgctaagcaccggctggtgcagcctcccccacctccacctccacccgctgaggccgcatccgggccaactggcactgctcaaggtgccccatcaggcggaggcggatgcaaaagcccaggcggagccggagcaggcgctaccggaggttctactgccagaaaattccctacgtgtcctgaacacgaaatggagaactactccatgtactgtgtgtcatgccgcacgccagtatgttatctgtgcctggaagaagggcgacatgctaaacacgaagtgaagcccttgggggctatgtggaagcagcataaggcccaactgagccaggcgctgaacggggtatccgacaaggctaaagaggccaaagaattcctcgtacaactaaagaatatcctccaacagatccaggaaaatggacttgactacgaggcctgtctcgtggctcagtgcgacgctcttgtggatgcactgacacgacagaaggctaaactgcttacaaaagttacaaaggagagggagcacaagctaaagatggtatgggaccagatcaatcattgtactttgaaactgcggcaaagcacaggcctgatggagtattgcttagaggtaattaaggaaaacgatccctctgggtttctgcaaatcagcgacgccctgatcaagcgagtccaggtgagccaggagcagtgggttaagggcgcactggagccgaaggtgtcagccgaattcgaccttactctggattctgagccactccttcaagccattcatcaattagattttatccaaatgaaatgtagagtgccacctgtgcccctgttacagctggagaaatgctgcaccaggaacaatagtgtgactctggcctggaggatgccccctttcacacatagccccgtcgacggttacattctggaactcgatgacggtgccggtggccagtttcgagaagtttatgttggcaaggaaaccttatgtactatcgatggcctgcattttaattccacttataatgcccgtgttaaggcctttaattcatccggtgtggggccttactcaaaaacggtggtccttcagacttccgacgtcgcgtggttcacttttgatcctaatagtggccaccgcgacatcatcctgtctaacgataaccagaccgccacctgttctagttacgatgacagggttgttctggggacagcggctttctccaaaggggtacattattgggaactgcatgttgaccgctatgataatcaccccgaccccgcatttggcgtcgccagagcctctgtggtcaaagatatgatgcttggtaaagatgataaagcctgggccatgtacgtggacaataatcgttcttggtttatgcactgtaacagccataccaaccgtaccgagggcggtgtgtgcaagggggctacagtcggcgtacttctggaccttaataagcacactctgaccttctttatcaatggacagcagcaggggcctaccgccttttcgcatgtggacggagtttttatgccagctttgtcattgaaccgaaacgttcaggtcacattacatactgggcttgaggtgcctaccaatctcggacggccaaaactgtctggcaattag

SEQ ID NO: 28650 - DNA, 471 bp, Artificial Sequence
  Description of Artificial Sequence: Synthetic coding sequence
atggtaccggtcttcacatcctcagcgctgcccgtgaaggacgttgaggataagccggaacagcagacacggacacgggaaaccgacaagagtcccacaagtaccgagcccagacaacaacccagcgccctcttcgctcggggaaataggaaggccgttaagtcacctcagagatcctcctcaaaaattaaagagaataaacatccttttgccctgtatggatggggagagaagcagactgacaccggcagtcaaaaaacacacaacgtgtgcgcctctgcacccgtccacgaaatccacgagtccgccctccgcgctaaaaatcggcgtcaagttgaaaagaggaaactggtagctcagcgccagcgcgcacactctgttgatgtcgaaaagaatcgcaaaatgaaagcttcatcctcagagaatccttggatgactgagtacatgaggtgctacagtgccagggcttag

SEQ ID NO: 28651 - DNA, 813 bp, Artificial Sequence
  Description of Artificial Sequence: Synthetic coding sequence
atgtcaccgggatccggagttaagagcgaatacatgaagcgataccaggagccacgctgggaggagtatggcccatgctatcgtgaactgctgcactaccgcttggggcgaagactcttggaacaggctcacgccccttggctctgggatgactggggcccagccggttctagcgaggacagtgctagtagcgaatccagcggggcaggtggacctgcgcctaggtgcgcgcctccttctccgcctccacccgtggagcccgcaactcaagaggaagctgagaggagggcccgtggcgcacccgaagagcaagacgcagaggccggagatgccgaggcagaagatgccgaagatgcagccttaccggctctacctgtcaaggatgtggaggacaaacctgagcagcagaccagaaccagagaaacggacaaatctccaacttctaccgaacccaggcagcagccctccgcattgtttgctcggggtaaccgcaaggcagtgaaatcaccacaacgttctagttccaagattaaagagaataaacatcctttcgctctctatgggtggggagagaaacagacagacactggctctcaaaagactcacaacgtttgtgcctccgctccagttcacgaaattcacgagagcgccctgagagccaaaaaccggcgacaggtggaaaaaaggaaattggtagctcagcgccaacgggctcatagtgtcgacgtggaaaaaaacaggaagatgaaagcgtcatcttccgaaaatccttggatgactgaatacatgcggtgctattcggcgagggcatag

SEQ ID NO: 28652 - DNA, 1158 bp, Artificial Sequence
  Description of Artificial Sequence: Synthetic coding sequence
atggcagctcccgatctctcaactaacctccaggaggaggccacttgtgcaatttgccttgattattttacagacccggtgatgaccgactgtgggcacaacttttgcagggagtgtattcgaagatgctgggggcagccggagggtccctatgcttgtcccgaatgccgagagctgtccccacaacggaacctgagacctaaccgcccactcgctaagatggcggagatggccagacgactacatccgccttcacccgtcccacaaggcgtttgtccagctcatcgcgaaccacttgcggctttttgcggtgatgagctgaggcttttatgcgccgcttgcgagcgatcgggagaacactgggctcacagagtgaggcctttgcaggatgctgcagaggatctgaaagcaaagctggagaaatctctggagcatcttcgtaaacagatgcaagatgccttactgtttcaggcccaagctgatgagacctgcgtactctggcagaaaatggtggaaagccaacggcagaacgtactcggtgaatttgagaggctgcgtcgccttttggctgaggaggagcagcagcttctgcaacgattggaggaggaggaattagaagttctgcccaggctgcgtgaaggagcggctcacttaggccagcaaagcgctcacctcgctgagttgatagctgaattggagggccgttgccagctaccagcactcgggctgttacaggacatcaaggatgcactgaggcgggtccaggacgtcaaattgcaacctcctgaggtagttcccatggaactcagaactgtatgccgagtgcccggactggttgaaacactgcgccgttttcgcggacggtgcggaggccctaggtggggcgatgattctagacgcggacccgctaaagaccttgggtcccagcccagagtgctctgtccagccacggcatcttcaaaattgacagtgtcctggtggtgggtggtcggtaaaaccagctctgcacatacaagcgatatcagctgcgtgggcatctttacccctaataatagctctacttccggcaatgagttgggcattcagggttttcatagcgcattgaaccgcatcgcatcagcagacacaaccggggtctctacagacccgacagattag

SEQ ID NO: 28653 - DNA, 1251 bp, Artificial Sequence
  Description of Artificial Sequence: Synthetic coding sequence
atgcccctgtataatgatagttttcacgaaatctcccacaaaggccgtcgccacactctggtgctgaagtccatccagcgagctgatgcgggaattgtgcgcgcttctagcctgaaagtgtccaccagcgcaaggttagaggtacgtgtaaagccagtggtctttctaaaagccttggacgacctgtctgccgaagagaggggcactctcgctttacagtgtgaggtgagcgaccccgaggctcatgttgtttggcggaaagacggagtgcagctgggaccttctgataagtatgactttctgcacacagcagggacaaggggcttggtggtacatgatgtgagcccagaagatgcaggtttgtacacttgccatgtaggttctgaggagacccgcgcaagggtcagagtgcacgatctccacgtcggcattacaaaaaggctcaaaacaatggaggtgctcgaaggagagtcttgttcattcgaatgcgtcctgtctcacgagtccgccagcgacccagcaatgtggacagttggaggaaaaaccgtgggctcgtcctctaggttccaggccacaaggcagggcagaaagtacattctggtagtgagagaggctgctccgagcgacgctggagaagtggtcttcagcgtcaggggccttacatcgaaggcttctctcatcgtcagagaacggccagcagcaatcatcaagccactggaggatcagtgggtagctcccggagaggacgtcgagctcagatgtgagctgtctagggccggaactccggttcactggcttaaagatcgcaaggcgattagaaaaagtcagaaatatgacgtcgtctgtgaggggaccatggcaatgctggtcatccggggagctagtctaaaagatgccggagagtacacatgcgaggtagaagcctccaagtctacagccagcctgcacgtggaagagaaagccaattgctttacagaagaactcactaatcttcaggtagaggaaaagggtaccgccgtgtttacatgcaaaacagaacatcctgccgcaaccgtgacatggagaaaaggcctactggagttacgcgcaagcggaaagcatcagccatcccaggagggcctgactttgcggctcacaattagtgccttggagaaggccgactcggacacctacacctgcgatattgggcaagcacagtccagggcccaactgctggtccagggagaggcggcaaagtgcgccagagcgtag

SEQ ID NO: 28654 - DNA, 2130 bp, Artificial Sequence
  Description of Artificial Sequence: Synthetic coding sequence
atggagaaacaccggggagtcctggaatgtcaggtcagccgtgccagcgcccaggtaagatggttcaaaggctcccaagaacttcagcccggtcccaagtacgagttggtgtctgatggcctctataggaaactgatcatatctgatgttcacgccgaggatgaggacacctatacttgtgatgctggtgacgtcaaaacatcagctcagttcttcgtggaggagcaatctatcaccatcgtaagagggctgcaggacgtcaccgtgatggagcccgctcctgcctggttcgaatgtgaaaccagcatcccaagcgtgcgaccacccaaatggttgctcggcaaaacagtgctgcaggcgggaggcaatgtgggcctcgaacaggaaggaactgttcaccgcctgatgctgcgcagaacctgcagtaccatgactggtccggtgcacttcaccgtgggtaagagtcgctcctcagccagactggttgtaagcgatattcccgtggtactgactaggcccttagagcccaagaccggtcgagaactgcagtccgtcgtgctaagctgcgactttcggcctgctcctaaagccgttcaatggtataaggacgacacaccacttagccctagcgagaaatttaagatgtcacttgaggggcagatggcagagctgcggattctcaggctgatgcccgcagacgctggcgtctatcggtgtcaggcagggagtgcgcactcttctaccgaggtgactgtcgaggcaagggaggtgaccgtgaccggtccccttcaggacgccgaggccacggaagagggttgggctagcttttcctgtgaactgagccatgaagacgaagaggtagagtggagtcttaacggaatgcccctatataatgactcttttcacgagatttcccacaaaggtcgaaggcatactctggttttgaagagcattcagagggcagatgctggtattgtgcgcgctagcagcttgaaagtgagcaccagcgccaggctggaagtacgcgttaagccagtcgtgttcctgaaagccctggacgacctgagcgccgaggagagggggaccttggcattacagtgcgaagtgagtgatcccgaggcacacgtcgtgtggcgcaaggatggggttcagctggggccttctgataaatatgattttctacataccgctgggactcgcggactggtggtgcacgatgtaagtcccgaggatgctgggttatatacatgtcatgtaggctccgaggaaactagggccagggttagggtacacgacttacatgtggggatcaccaaaagactgaagactatggaggtactagagggcgagagctgctcgttcgagtgtgttctttcacacgaaagtgctagcgacccagcaatgtggaccgtagggggaaaaaccgtcgggtcgtcaagtcgcttccaggccacccggcaaggacggaaatatattctcgtcgtgcgagaagccgcaccttcagacgcaggtgaggtcgtgttctccgtgagaggcctcacatccaaggcatctctaatcgttcgagagcgacccgcagccattataaagcctttggaggatcaatgggtcgcccctggtgaagacgtggaactgcggtgcgaactctctcgagccggtacacctgtacattggttgaaagaccggaaggcaatcaggaaaagccagaagtacgatgtggtgtgtgaagggaccatggcgatgctcgtgattcgtggggcaagtcttaaggatgcaggtgagtacacctgcgaggtggaggccagtaagtccaccgcatctctgcacgtagaggagaaggcaaactgctttaccgaagagctgaccaacctgcaggttgaggaaaagggaaccgcagtttttacctgcaagactgagcacccagccgcaacagtgacttggcgcaaggggctgctcgagctgagagcctcaggtaaacaccagccctcacaggagggcttgaccctgcggctcacgatcagtgccctggaaaaggccgatagtgatacctatacatgcgatattgggcaagcccagagtcgagcccagctgcttgttcaaggggaggctgccaaatgcgcaagagcttag

SEQ ID NO: 28655 - DNA, 16809 bp, Artificial Sequence
  Description of Artificial Sequence: Synthetic coding sequence
atgctggtgattagaggagcttctctcaaagacgcaggagagtatacatgcgaggtggaagcaagtaagtccaccgcgtctcttcacgtggaggagaaggccaattgcttcaccgaggagctcaccaatttgcaggtggaggaaaaaggcacagcagtattcacgtgcaagactgagcaccctgcggcaaccgtcacttggaggaaaggcttgcttgagctcagagcatccggaaagcaccagccgagccaagaaggcctgacccttaggcttacaatcagcgcccttgagaaggccgattctgatacctatacttgtgacatcggccaggcccagagtcgagcacaacttctggtccagggcagacgggtgcatattatcgaggatctggaggatgtagacgtgcaagagggaagctcagcaaccttccgctgccgtatctcccccgcaaactacgaacccgtacactggtttctggataagacacctctgcacgcaaacgaactgaacgagatcgatgcacaaccaggcggatatcacgtgctgactttaaggcagctcgccttgaaggactctggaacaatctactttgaggccggtgaccagagggcctcagccgcacttcgggtgaccgagaagccctccgtgttctcccgcgaacttactgacgctaccatcaccgaaggagaggatttgacactggtatgcgagacctcaacctgcgacatccctgtctgttggacaaaggacggtaagacccttcgcggatctgcgcgttgccagctgagccacgaggggcaccgtgctcagctattgatcactggggcaacgctgcaggattcaggacgctataaatgtgaggctggcggagcctgctccagctccatagtcagagtgcatgcccgacctgttaggtttcaagaagccctgaaagacctggaagttctggaaggaggcgctgcaaccctacggtgtgtcctgtcctcggtggcggcacctgttaagtggtgctacgggaacaacgttctgaggccaggcgacaagtactctctgagacaggagggggctatgctggaactggttgtccgaaatcttcggcctcaagactccggcaggtacagctgcagtttcggagaccagacgacatctgctaccctgaccgtgacagccctgccagcacagttcataggaaaattgagaaacaaagaggcgacagaaggcgcaactgctacattgaggtgcgagctgtcgaaagccgcacccgtggagtggagaaaaggtagtgagactttacgcgatggagacagatactgtctgcgccaggacggggcaatgtgtgagcttcagatccgaggcctggccatggtggacgccgctgagtactcgtgtgtctgcggagaagagaggacgagtgccagtttaactatccgtccgatgcccgctcacttcataggtcgcctgcggcaccaagaatcaatcgaaggtgctacagctacactcagatgtgaactcagcaaagctgcccctgttgagtggcgtaaggggcgagaaagtttgcgggacggagacaggcactcactgcggcaggatggcgctgtctgtgaactgcagatctgtggactcgctgttgccgacgctggggaatacagttgtgtgtgcggagaagagagaacttccgcgacattgaccgtaaaggcccttcccgcaaagttcactgaaggacttcgcaacgaggaggctgtggagggggcaaccgcaatgctctggtgcgagttaagcaaggtcgccccagtcgagtggaggaaagggccagagaacctgcgggatggcgaccgttacatcctccgtcaagaaggcacccgctgtgagctccagatttgtgggctggcaatggctgacgccggtgaatacctctgcgtgtgcggccaagaaagaacgagcgctacactgacaattagagcgctcccagctcgttttatcgaggacgtcaaaaatcaagaagctcgggagggggcaacagccgtgcttcaatgtgagctgaactcagctgcgccagtagaatggagaaagggctccgagaccctgcgagatggagatcgctatagccttcggcaggacggcaccaagtgcgaattgcagattaggggcctcgccatggcagatacaggagagtattcttgcgtgtgtggacaggagcgcacctccgcgatgctgaccgtcagagccttgccgattaaattcacggagggcttacgcaacgaggaggctactgagggagccactgcagtgctgagatgtgagttgtcgaagatggcacctgtggaatggtggaaagggcatgaaactctgcgggatggggacaggcactccttaagacaggacggagctaggtgtgagctgcagatacgcggactagtagccgaggatgccggagagtacctgtgcatgtgcggtaaagaaaggacaagtgctatgctcacagttagagccatgccatcaaaatttatagagggtctgagaaatgaagaagctacagaaggcgacaccgctacattatggtgtgaactgtccaaagctgcacctgtggaatggagaaagggccatgaaaccctcagggacggtgatcggcattcattaagacaagatggctcgaggtgtgagctccagatccggggactcgctgtagttgatgccggtgaatactcctgtgtgtgcgggcaggagagaactagcgccaccttgaccgtgcgcgctctgcctgctcgttttatcgaagatgtgaagaatcaagaagctcgagagggagccacggcggtgctgcagtgcgaactgtcgaaagctgctcctgtcgagtggagaaaaggatccgagacactgcgaggaggagatcggtacagtctaaggcaggatggcacacgctgcgagctgcagatccatggcctgtccgtggccgatacaggagagtattcttgtgtgtgtggtcaagagcggacatcagcaaccctgactgtgagagcactcccagcaagattcactcaagatctgaaaaccaaggaagcctcagaaggagcgactgccaccctgcagtgcgaactaagtaaggttgctccagtggagtggaaaaagggtcccgaaactctacgggacggcggtagatattccctcaaacaggacggcacccggtgtgaactccagatacatgacctgtcagttgccgatgcaggagagtactcatgtatgtgtggccaagagcggaccagtgccacgctgactgtacgagccctgcccgcacggttcacagaggggctcaggaatgaggaggcaatggaaggcgctactgccaccctacagtgtgagctgagcaaggccgctccagtcgaatggaggaaaggcctcgaggccctgagggacggagataagtattccttgaggcaggacggagcagtttgtgagctccagattcacgggctggcaatggccgacaacggagtgtactcatgtgtctgcggacaggaaaggacttctgctacattaaccgtccgcgctcttcctgctagatttatagaggacatgcggaaccagaaggccactgagggggctactgtcactctgcagtgcaaattacgcaaggcagctcccgtggaatggagaaaaggccctaacacgctgaaagacggggacagatacagtttaaaacaggacggaacctcatgtgagcttcagatcagaggactggtgatcgccgacgcaggcgaatactcgtgtatttgcgagcaggagaggacttccgcgactctgactgtaagagcactgccagccaggttcattgaggatgtaaggaatcacgaagccacggaaggggcaacagcagtcctccagtgtgagctgagcaaagccgcaccagttgagtggaggaagggaagcgagacactgcgggacggagaccgctattccctgagacaagacggcacccggtgcgagctgcagattcgtgggctggctgtagaggatacaggagagtatctgtgcgtctgtgggcaggaaaggacctccgctactcttactgttcgggctctgcctgctaggttcatcgacaacatgacaaaccaagaggccagggaaggagccaccgccactctgcactgcgaattgtctaaagtcgcgccagtcgaatggaggaagggccctgaaaccctccgggatggggaccggcattccttgcggcaggacggtactaggtgcgaactgcagatacgcggactatctgtcgcagacgcgggagaatattcctgtgtgtgcgggcaagagcgaacttcagcgacacttaccattcgcgaagccacggaaggagcaactgcaatgctccagtgtgaactttccaaagtggcccctgtggagtggcggaagggtcccgagacactgcgggatggcgacaggtataatctgaggcaggacggcacccgatgcgagctccagattcacggcctttctgtggccgacacaggggagtacagctgtgtgtgcggacaagagaaaacctccgcaaccctcactgtgaaggcccctcagccggtcttccgcgaaccattgcagtctctacaagccgaggagggctcaacggccacactgcagtgcgagttgtctgagcctacagccacagtggtatggagcaaaggcggactccagttgcaagctaacggcaggcgagagcctagattgcaaggttgcaccgcagagctcgtccttcaagatcttcagcgggaagacacgggtgaatacacctgtacctgcgggagccaggctacaagcgccactttgaccgtcacagctgcccctgtgagattcttacgcgaactccaacaccaggaagtggacgagggaggcactgcccacttgtgctgcgagttgagtagggctggcgcaagcgtggaatggaggaagggatcacttcagctgttcccgtgtgctaaatatcaaatggtgcaggatggcgcagccgcagagctgcttgtaaggggtgtagaacaggaggacgctggcgactatacatgtgacacgggacacactcaatccatggccagcttgtccgtacgggtacccaggcctaagttcaaaacaaggctgcagagcctcgagcaggagaccggtgacatcgctagattgtgctgccaactgtcagatgccgaatctggtgctgttgtgcagtggctaaaagagggcgtggagctccatgcgggtccaaaatacgagatgcgatcccagggtgctactagagaacttttaattcaccaactcgaagctaaggacacgggagagtatgcctgcgtgacaggcggacagaaaacagctgcctcacttagagtcaccgagccagaggtgactatagtgcgcggattggtcgatgcggaggttactgcagacgaagatgtcgagttctcttgcgaagtgagccgggctggagctaccggcgtgcagtggtgccttcaggggttacctcttcagtctaatgaagtcaccgaggtggctgtgagagacggacggattcacacactgaggctgaagggagtgacacctgaggatgccggtaccgtgtccttccatttgggcaatcacgcttccagcgctcaactcactgtgagagcacctgaggttactatcctggaaccacttcaggatgtccagctgtctgagggacaggacgctagtttccaatgcaggttgagtagggcctccggtcaagaagcacgatgggcattgggtggagtcccactccaagccaacgagatgaacgatattaccgttgaacagggcacccttcacctgttgaccctccataaagttactctggaggatgccggaacagtctccttccatgtgggtacttgcagttccgaagctcaactcaaggtgaccgcaaagaacactgtcgttcgcggtctggaaaatgtggaggcattggaaggaggcgaagctctattcgaatgccagctgagccagcctgaagtcgccgcacacacatggttgcttgacgacgagcccgtgcacacgtccgaaaatgccgaagtcgtgtttttcgaaaatgggcttaggcatctgttactgcttaaaaatctaaggccccaggattcctgtcgtgtgacatttctggccggagacatggtcacaagcgccttcctcaccgtaaggggctggcggttggagatcttggagccattgaagaacgccgctgtccgcgctggagcccaggcatgtttcacctgtacgttgtctgaagcagttccagtcggtgaggctagctggtacatcaatggcgctgccgtccagcccgacgacagtgactggaccgttaccgcagacggttctcaccatgccctgttactacgaagtgctcaaccacaccacgccggagaagtgacatttgcctgtcgcgacgccgtggcatctgctaggctgactgtcttggggctgccagatccgcctgaggacgccgaggtggtggctcgtagctcccacaccgtgaccctctcctgggccgcacctatgagtgacggcggagggggattatgcggatatagagtggaagtgaaggaaggcgcaacaggacagtggagactgtgccacgaactcgttccgggacctgagtgtgttgtggatgggctcgcccctggcgagacataccggtttcgggtagctgcagtcggaccagtaggcgctggtgaacccgtgcacttgccacagacagtgcgcttggcggagccgcctaaacctgtacctccgcagcctagcgctccggagtctcgacaggtagctgccggagaagacgtgagtttggagttggaggtcgtagctgaggctggggaggtcatctggcacaagggcatggagaggatacagcctggcggacgatttgaagtagtttctcagggcaggcagcaaatgcttgtcattaaaggcttcacagccgaggatcagggcgaataccattgcgggttggcccaggggtccatctgtcctgccgctgcaacatttcaggtagcactgtctcctgccagcgttgatgaagcccctcagccctccctgcctcctgaggccgctcaagagggtgatttgcaccttttgtgggaggctctcgcacggaagaggagaatgtcccgcgagcccacactcgacagcatttcagagctcccagaggaggacgggaggtcgcagcgccttccccaagaggccgaagaggtggcaccggatctgagcgagggatatagtaccgccgatgaactagcccgaacgggcgatgctgacctgagccataccagttcggatgacgagtccagggcaggcactccgtcactggtgacctatctgaagaaggcaggcaggccaggcacatctcccctcgcctcaaaagtgggcgctccagccgcaccatccgtcaagccgcagcagcagcaggaaccactagccgctgtcagacctcccctcggcgacctatccactaaagaccttggagaccccagcatggacaaagctgctgttaagatccaggctgctttcaagggatacaaggtccgcaaggaaatgaaacagcaagagggacccatgttctcccatacgtttggtgacaccgaagcacaggtgggcgacgctctgaggctagagtgtgttgtggccagcaaggcagatgtgcgagccagatggctcaaggatggggtggaacttacagatggccgtcaccaccatatcgaccaactgggagacgggacttgtagtctcctaatcactggcctggacagggcagacgctgggtgttatacgtgtcaggttagcaacaaatttgggcaagtgacacactcggcgtgcgtggtcgtaagtgggtctgagtccgaggcggagtcgagcagcgggggtgagctagatgacgcatttcggagggcagctagacgtctgcacaggctgtttcgcacgaaaagtcccgcagaagtgagtgatgaggaattgtttctgtcggcggatgaggggcctgcagaacctgaggaaccagccgattggcagacatacagggaggatgaacacttcatttgcatcagattcgaagccctcactgaggctcggcaggcagtaacccgcttccaggaaatgttcgccacactcggtataggcgtggagattaagttggtggaacagggacccagaagggtggagatgtgtatttccaaggagaccccagccccagtcgtgcctcctgagccgcttccttccttactcaccagtgatgccgctcccgtgtttctgaccgagctgcagaatcaggaagtgcaagatggttacccagtcagttttgattgtgtggtcaccggccagcctatgccttcggtccgctggtttaaggacggtaagctgttagaagaggacgatcactatatgatcaacgaggaccaacagggcggtcaccagttaataattacagctgtggtgccagctgatatgggtgtgtacagatgtcttgctgaaaattcaatgggcgttagctccacgaaagcagagctgcgggtggatctcactagcactgattacgacactgcagccgacgcaaccgagagttcatcatactttagtgcacaagggtatctgtcgtctcgcgagcaggagggaactgagagtactacagatgagggacaactgccgcaggtggttgaggaactgagagacctgcaggtggcccctggcactagattagcaaaatttcagttgaaggtcaaggggtaccccgctccacggctctattggtttaaggacgggcagcctttgaccgcgagtgctcatataagaatgacagacaagaaaatattacacacgctggagatcatatccgtgactcgggaagacagcgggcagtatgccgcatacatctctaacgcaatgggtgccgcatactcaagtgctcgtctcctcgtaagagggccagatgagcctgaggagaaaccagccagcgatgtccacgaacagctagttcctccccgtatgctagaacggtttaccccaaaaaaggtcaaaaagggttcttctataacctttagcgttaaagtggaaggaagaccagttccaactgtccactggttgagggaagaagcagagaggggggtactatggattgggcctgatacccccggatatactgtggcctccagcgcgcagcaacacagtctcgtactgctagacgtaggcaggcaacatcaaggtacctacacctgcatcgcctctaacgcagctggtcaggctctctgtagcgccagcctgcacgtgagtgggctcccaaaggtggaggagcaagagaaagtcaaagaggcactcatctcaacctttctgcagggcactacacaggctatcagcgcccagggcttggaaactgcatctttcgctgatctgggcggacagcggaaagaggaacctcttgcagccaaggaagcactgggccatcttagccttgcagaagtgggcacggaagagtttttgcagaaattgactagccaaatcacggagatggtgtcagcaaaaatcacccaagcgaaacttcaagtccctggtggcgactctgatgaagacagtaagacaccgagtgcgagtccccgacacgggagaagcagaccctcttcttcgatacaagaaagctcctcagaatctgaggatggggatgctcgaggtgagatttttgatatttacgtggtgacagcagactacctgccacttggagcggaacaggatgctatcactctgcgagagggccagtatgtggaggtcctggatgctgcccacccactgcgctggctggttcgcaccaaaccgactaagtcctcacccagcaggcaagggtgggtcagtcctgcgtacctcgatagacgcctgaaactttctccggagtggggagcagcggaagccccagaattccctggcgaggccgtgagcgaagatgagtataaagccaggctgtccagtgtgatacaggagttgctttcttctgagcaggccttcgtcgaagaactccagttcctccagtcccaccacttgcaacatctggaacgctgtccacatgttccaatagcagtagccggtcagaaagcagtcatcttcagaaacgtgcgggatattggcaggttccactcctcttttctgcaggagcttcagcagtgcgacaccgatgatgatgttgccatgtgcttcattaaaaaccaggcagccttcgagcaataccttgagttcctggtcggccgtgtgcaggctgagagcgtcgtggtttccaccgcaattcaggagttctacaagaagtatgccgaggaggcattactggctggcgatccatcacagccaccccctccgccactccaacattatctcgagcaacctgtggagagggtgcaaaggtaccaggcccttctcaaagaattgatcaggaataaggcacggaaccggcagaactgtgcacttcttgaacaggcatacgccgtcgtcagcgcgcttcctcagcgggctgagaacaaactgcacgtgagtctcatggagaattaccctggcaccctgcaggccctcggcgagccgattagacagggtcacttcattgtatgggagggagcgcctggcgcaaggatgccatggaaaggccacaatagacacgtattccttttccgcaatcatctcgtcatctgcaaacccagaagggatagtcggactgacaccgtgtcatacgtttttaggaatatgatgaagctgtcctctatcgatctcaacgatcaggtagagggcgacgaccgggctttcgaagtgtggcaggaacgcgaagactctgtgcgtaaatacctcttacaggctagaacagcaattatcaaatccagttgggtaaaggagatctgcggtatccagcaaagactcgctctcccggtgtggcggccacccgattttgaagaggagcttgctgactgtaccgctgagttgggcgaaacagtgaaactagcatgtcgcgttaccggtacccccaagcccgtaattagctggtataaagacggcaaggcagtccaagtggacccccaccacattctcatcgaggacccggatggaagttgcgccttgatactggacagtcttaccggcgtggattcaggtcagtacatgtgctttgcagcaagcgccgcaggaaactgtagcaccctgggaaagatcctggtgcaggtgcccccaaggtttgtcaataaggtgcgggcttcaccatttgtcgaaggagaagacgcccaatttacctgtaccatcgaaggagctccatatccccagattcggtggtacaaagacggagcactgctgaccaccgggaataagttccagactctatctgagccccgtagcggattgcttgttctggtgatcagagccgctagcaaagaagatctggggctctatgagtgcgagttggttaacaggctgggctcagcacgagccagtgctgagctcagaatccaatccccgatgctccaggctcaggagcaatgtcatcgggagcagctcgtggccgcagtggaggatacaacactggagcgcgcagaccaggaggtcacgtccgtcctcaagaggctgcttggacctaaagcccctgggccatccacaggtgacctgacaggccctgggccatgcccccgaggggctccagccctccaggagaccggctcccaacccccagtaacagggacatccgaggccccagccgtgcctccaagagtccctcagcctctcttacacgaggggcctgagcaagagcctgaggccatcgccagggctcaagagtggacagtacccatacgaatggaaggcgctgcctggcctggtgccggtaccggagaactattgtgggacgttcattcacatgtcgtgagggagactacccaacgcacgtacacctatcaggccatcgatactcacaccgctcgaccaccgagcatgcaggtaacaattgaagatgtccaagcccaaaccggcggaacagcccaattcgaggccattatagaaggggaccctcagccttctgttacctggtacaaagactctgtccagctcgttgattccaccagactgtcacagcagcaagagggaactacctactcacttgtattgcgacatgtagctagcaaagacgccggagtctacacatgcctggcacagaatacaggcggacaagtcttatgtaaagccgaacttctcgtattaggcggagacaacgaacccgattcggagaagcagtcccacaggcggaagttgcactcattttacgaggtgaaggaagagataggtagaggagtgttcggatttgtcaaacgcgttcagcacaagggtaataaaattctatgcgccgcaaagttcattccactccgctcacggacacgcgcacaggcttacagggagcgtgacattcttgccgctttgtcccacccgcttgtgaccggcctgctggatcagttcgaaacccgcaaaaccctgatactcatcctggaactatgttctagcgaagagctattagatagactgtaccgcaaaggcgtcgtcaccgaggccgaggtgaaagtctacatccaacagctagtggaagggctgcattacctacacagccacggcgtcctgcatctggatattaagccttccaatatcctgatggttcatccggctagggaggatatcaagatctgcgattttggtttcgctcagaacatcaccccagcagagctgcagttttctcaatatgggagtccagaattcgttagccctgaaatcatccagcagaaccctgtgtccgaggcaagcgatatctgggcaatgggcgtgatttcgtatctgtccttgacctgtagctcccccttcgcaggtgagtccgatcgcgcaacactgctgaacgtgctggaggggcgtgttagctggagcagtccaatggcggcacacctgtcagaggacgctaaggactttattaaagctaccctgcagcgcgctccccaggcccgtccatctgccgcacagtgtctgagccatccttggttcctcaagagcatgcccgctgaagaggcacacttcatcaatacaaaacagttgaaattcttactcgccagatccagatggcagcggagtcttatgtcctacaaatccatccttgtcatgaggagcatacccgagctgttacgaggacctccggatagcccctccctaggcgtggccaggcacttatgccgcgatactggcggaagcagcagtagctcaagcagctccgacaacgaactggctcctttcgcacgggcaaagagccttccccctagtcctgtaactcactctccactcctgcacccacggggatttctccgcccatcagccagcctccctgaggaggctgaggcctcggaaagatcaaccgaggccccagcacctcctgcttctcctgaaggagccggaccccctgctgcacaagggtgtgtgccacggcactccgtaatcagatccctgttttaccatcaagcaggcgaatctccagagcatggggctctcgcacctgggtccagaaggcaccctgctcggagacggcatctccttaaggggggatatatagccggtgcgctgcccggtttgcgggagcccctgatggaacacagagtgctggaagaggaggcggctagagaagagcaggccacccttctggctaaagcgccttcatttgagactgccttgcgccttcccgctagcggaacccacttagcacccggacattcccattccctcgaacacgactctccatccacccctcgaccaagtagtgaagcctgcggcgaagctcaacggctcccaagcgccccttccggtggcgctcccattcgtgacatgggacatcctcagggcagtaaacagctgccaagcaccggcggtcaccctggcacggcgcaacctgaaagaccctcgccagacagcccctggggacagccagctccgttctgtcaccctaagcaagggagtgctccccaggaaggatgctccccacaccccgctgtggccccatgtccgcctgggtctttcccaccaggcagttgtaaagaggccccactggttccaagtagcccctttttaggccaacctcaggcccctcctgcccctgccaaagccagcccgccactggacagtaagatggggcctggtgacatctcgcttcccggtcgcccaaagcccggaccatgctctagcccaggatccgctagccaggcttcatcatctcaggtcagttccctcagggtcgggtcctcacaggtgggaacagagcccggacccagtctggatgccgagggatggacacaagaagcagaagacctttcagactctaccccaacgctgcagcgaccacaggaacaggcaaccatgcggaagttttctctcggaggtcgcggagggtatgctggagtggccggatacggaacatttgccttcggcggagacgccggaggcatgttgggacagggaccaatgtgggcgaggattgcctgggcagtctcccaatcggaagaagaggaacaagaagaagcacgagcagagagccagtcggaagagcagcaagaggccagagccgagtcacccttgccacaagtctcggcccgacctgtccccgaggtcggcagagcgcctaccaggtcttcccctgaacctactccatgggaggatatcggccaggtcagcctcgtccagattagggatctgtctggcgatgccgaagcggctgacacaatctcacttgatatctccgaagttgatccggcttatctgaacctaagtgacctgtacgatatcaagtacttgccttttgagtttatgatttttcgcaaggtgccgaagagcgcacagcccgagccaccgtctccaatggcagaagaggaattagcagagttcccagagcctacctggccatggccaggtgagcttgggccacatgcgggactggaaatcacggaagagagtgaagacgtggacgcattactagccgaggctgccgtgggtaggaagcggaaatggtcttcgcccagccgctcccttttccactttcctggaaggcacttgcctttggacgaacccgcagagttaggtctgcgcgagcgagtgaaggcctctgtcgagcacatctctcgaattctgaagggccgtccagaagggttggagaaggaggggccaccacggaagaagccaggattagcttcctttcggttatcggggcttaaatcgtgggatcgggcaccgacattcctgcgcgaactctctgatgagaccgtggtgctgggccagtctgtgaccctcgcctgtcaggtgagcgcccagccggctgctcaggcgacttggagtaaggacggagcgccactggagagctcctcacgcgtgttgataagtgcaaccctaaagaacttccagctgctcactatactcgttgtcgtcgccgaggatctcggtgtctacacttgttcagtgtccaatgcccttggtacagtgacgaccaccggggtacttcgcaaggctgagagaccctcatcttccccctgcccggatatcggggaggtgtatgcggacggggtgttgttggtgtggaaacctgtggagagctacggccctgtaacctacatcgtccaatgctctttggagggcggatcttggactacacttgctagcgacatctttgactgctgctacctcacttccaagttgtcacgtggcggaacctatacattccgcaccgcatgcgtttccaaggccggaatgggcccatatagcagtccctctgagcaggtgctcctcggtggtccctcacatctggcaagcgaggaggaatcccaaggaaggagtgcccaaccccttccttccaccaaaacttttgcgttccagacccagattcaacggggacggttctcggtggtgaggcagtgttgggagaaagcaagcggaagggcactggccgcaaagatcatcccctatcaccctaaggataagacggctgttctgagagaatacgaagctctgaagggactccggcacccgcacctggcccagctgcacgccgcatatctgtctccccgacacctggtgcttattctggagctgtgttccggacctgaactgttgccatgcctggccgaacgcgcttcgtattcggagtctgaggttaaagattatctgtggcagatgctgtccgccacccagtatctacacaatcagcacatcctacatcttgatctgcggtcagagaatatgattattacagaatacaacctgctcaaggtggtcgatctgggcaacgctcagtctctttcacaggaaaaggtcctgccctctgacaagttcaaggactacttggagaccatggcaccagagctgttggaggggcagggagctgtgccccagacggacatttgggcaatcggggtgactgcattcattatgctgagcgccgagtacccagtgtcctcagaaggggctagggatttacagagaggcctcaggaaaggcttggttcgcctgtcaagatgctacgcgggtctgtccggaggagccgtggccttcctgcggtccactctgtgtgcacagccttgggggaggccttgcgcctcctcctgtttacagtgtccttggctcacagaagaaggaccggcatgctccaggccagcacctgtaacctttccgacagctcggttacgggtgttcgtacgtaaccgagaaaaaaggagagccctgctgtataaacgacataacttggcacaagttagatat

SEQ ID NO: 28656 - DNA, 11220 bp, Artificial Sequence
  Description of Artificial Sequence: Synthetic coding sequence
atgcttgtgattcgaggagctagtctgaaggacgccggagagtacacgtgcgaggttgaagcctcaaagagtaccgccagccttcatgttgaagagaaagcgaactgttttaccgaggagctgactaatctacaggtggaggaaaaaggcacggcagtgttcacctgcaaaacagagcaccccgcagcaaccgttacttggcgcaaaggcctgctcgagctgagggctagcgggaagcatcagccatctcaggagggcctgaccttgcgtctgactatcagtgctctagaaaaagccgactccgatacctacacgtgtgacatcggacaggcacagagccgggcacagctcctggtgcagggcaggcgtgtgcacataattgaggacctggaggacgtcgacgtgcaggaaggtagctcagccacattccgctgcaggatatctcctgcgaactacgagcctgtacattggtttctggacaagactccactgcacgccaatgaactgaatgaaatcgatgcacagcctggaggatatcacgtgctgaccctccgacaactggcgctcaaggattctggcacaatatacttcgaggctggcgatcagcgcgcatcggccgctctgcgcgtcacagaaaagccttctgtgttcagtagagaactgactgacgccaccatcacggaaggggaggatcttacgctggtctgcgagacctcaacttgtgacatccctgtatgctggaccaaggacggcaaaaccctgcgaggttcagcaaggtgtcagctgtcccacgagggtcatcgggctcagctcctgataactggcgcaactctgcaagactccggccgttacaagtgcgaagcgggaggtgcttgtagttcttctatcgtgagggtccacgcgcgaccagtgaggtttcaggaggctctgaaagatcttgaggtgttagagggtggtgccgcaactcttaggtgcgtgttatcttcggtggccgctcccgtcaaatggtgctacggaaacaatgtgctcagacctggagataaatatagcttgcgccaggagggagccatgctcgaactcgtggtgcgaaatctccgccctcaggacagcggacgatatagttgttcctttggtgaccagacaacttctgctacattgaccgtcactgctctgccagctcagttcattgggaagttacgcaacaaagaggcgacggaaggggcaactgccactcttcgttgcgagctgagcaaggcagccccagtagaatggcggaagggaagcgagacactccgggacggagaccgctattgcctgcgccaggacggggctatgtgtgaactgcagatacggggactggccatggtcgatgctgcagagtacagctgcgtatgcggcgaggagcggacctctgcctctttaaccatacgtcccatgcccgctcattttatagggcgactgcgtcaccaggagagtatcgagggggctacggcaacactcaggtgcgaactcagtaaggccgcacctgtcgagtggcgcaagggacgggagtctctcagggacggcgatagacattcacttagacaggatggcgcagtgtgcgaactccagatctgcgggttagcggttgctgatgctggggaatacagctgcgtttgtggcgaagagagaacgagcgcgactctcaccgtgaaagcacttcccgcaaagtttactgagggattacgtaacgaagaggccgtggaaggcgcaaccgccatgctttggtgcgaactgtctaaggtggcacctgtggaatggcgaaaaggccctgagaatctgcgcgatggcgatcggtatattctcagacaggaaggcaccagatgtgaattacaaatctgtggattggctatggcagacgctggcgagtacctttgcgtgtgtggccaggaacgcacttctgccacccttacaatccgggctctgccagctcgatttattgaggatgtgaagaatcaggaggcgagggagggtgctaccgcagttcttcagtgcgagttaaattccgcggctcctgtagagtggcgcaaggggtccgagaccttgagagatggcgataggtattcattgcgacaggacggcaccaaatgcgagttacagataagggggctagcaatggcagataccggggaatacagttgcgtgtgcggtcaggagcggacatcagctatgttgaccgtgcgcgctttgccaattaaattcaccgaagggttgcgcaacgaagaggctacagagggcgctacagccgtgctcaggtgtgaattgagtaaaatggctccagtggaatggtggaaggggcacgaaacactgcgtgatggagatagacactccttgaggcaagatggggcaagatgcgaacttcagatcaggggccttgtcgctgaggatgccggagagtacctgtgcatgtgcggaaaggagcgcacaagtgccatgctgaccgtaagagccatgccatcaaagttcatagaaggattgcgcaacgaggaggctactgaaggagacactgctactctgtggtgcgaactttcaaaggccgcacccgtggagtggcgcaagggtcatgagaccctgcgggacggcgatcgtcacagtctcagacaggatggcagccgttgtgaattacaaataagagggctggcagtagtcgatgctggtgagtactcgtgtgtgtgcgggcaggaacggaccagtgctaccctgacagtcagggccttgcctgccaggtttatcgaagatgtgaagaatcaggaggctagggaaggcgcaacggccgtactgcaatgtgaactgagcaaggccgctccggttgaatggaggaaaggatccgaaacactgcgcggtggagatcggtacagcctgcgacaagacggaacacgttgtgaactccaaatccacgggctgagcgtcgcagacaccggtgagtactcatgtgtgtgcggacaagaaagaacatccgcaacgctcaccgtgagagcaccccagcccgtgttcagagaacctctgcagtccctccaggcggaagaaggatctacagctactctgcagtgcgaactcagcgaaccaaccgcaaccgttgtctggtctaagggcggtctccagttgcaggcaaatgggaggcgggagcctcggctgcagggctgtactgcggagctcgtgctgcaggatctccaacgtgaggacaccggggagtatacctgtacctgtggatcacaggcgacaagcgccacactgaccgttacagccgctccagtgagatttctgcgcgaactccagcaccaagaggtggacgagggcggaacagcgcacttatgctgtgagctctcaagggcaggagcgagcgtcgagtggaggaagggctcactgcaattgtttccctgcgcgaagtaccagatggtgcaggacggcgctgccgctgagcttctcgtcaggggtgtggaacaggaggacgctggcgattacacttgtgacactggtcacacccagagtatggccagtttgagcgtccgcgtgcccaggccaaagttcaaaacccgcctacagtcactcgagcaggagaccggggatatcgctcgcctttgttgtcagctctcagatgcagagagcggggctgtggttcaatggttgaaggagggggtggagctacacgccggtccaaagtatgagatgaggtctcagggcgctacaagagaactgttgatccatcaactggaagccaaggataccggcgagtacgcctgtgttactggtggccagaaaaccgcagcctccctccgagtgacagagcccgaagtgaccatcgttcgcggactggtggacgcggaggtgacggctgacgaagacgtggagttttcctgtgaagtgagtagggctggcgctactggtgtgcagtggtgcctccaaggcctgccactgcagtcaaacgaagtgacggaagtggccgtccgggacgggcgaatccacactctgcgtctcaaaggcgtgaccccggaggacgccggaacagttagcttccatcttggaaatcacgcgagcagtgctcagttgacggtgcgcgctcctgaggtaacaatcctcgagcccttacaggatgttcaactgtctgagggtcaagacgcttcattccaatgccggctgagccgggcatctgggcaggaagctcgctgggctctgggtggcgtccctctacaggcgaacgaaatgaacgacatcacggtcgagcaaggaaccctccatttgctgacgctccacaaggttacccttgaggatgctgggacagtgtcttttcacgtaggaacgtgctccagtgaggctcaactcaaggtgaccgctaagaataccgtcgtcagggggttggagaatgtggaggccctcgagggcggagaagctctgtttgagtgccagctgtcccagccggaggtggctgcacacacatggttgctcgatgatgagcccgtgcatacgtccgagaacgccgaggtcgttttcttcgaaaacggactccgccaccttctgctgctgaaaaacctgagaccccaggactcctgccgggtcacatttctcgcgggagatatggttacctctgctttcctcaccgtgcgaggctggaggcttgaaattctcgaaccactgaaaaacgccgctgtgagggcaggagctcaagcatgcttcacttgtacccttagcgaagccgtgcccgtaggggaagcatcttggtatatcaatggcgctgccgtgcagcccgacgactcagactggaccgtgaccgctgatggctcccaccatgccctgttgctccgatcagctcagccacaccacgcaggagaggtgacatttgcctgccgcgacgctgttgctagcgcgcgtctgacagtgttagggctgcctgatccacctgaagatgctgaagtagttgcaagatcttcccataccgtcaccctatcttgggccgcaccaatgagcgacggtggtgggggactttgcggttaccgcgtagaagtgaaagaaggggcaacaggtcaatggcgtttgtgtcacgagttggtaccaggaccagaatgcgtggtggacggtcttgctccaggggaaacataccgcttcagggtcgcagccgtagggccagtgggggcaggagaaccagtacacttgcctcagactgttagattggccgagccaccaaagccggtcccaccccagcctagtgcacccgagtccagacaggtggcggctggggaggacgtgtccctggagctcgaggtggtcgcagaggctggtgaggtgatctggcataagggcatggagagaatacagccaggcggtcggttcgaagtggtgtctcaaggtagacagcagatgctagtgatcaaaggtttcacggccgaggaccagggtgaataccattgcggactggcacaaggatcaatttgtcctgccgctgcaactttccaagtcgccttgtcaccagcatcagtggatgaggctccacagccttctttaccaccagaagcagctcaggaaggggacctccaccttctgtgggaagcacttgctcgaaagaggcgaatgtctagagaacccactctggacagcataagcgaactccctgaggaagatggccgttctcagcgccttccacaagaggcagaggaagtggctcctgacctcagtgaaggctatagtactgccgacgaactagccagaacaggtgatgccgacctgtctcacacttcctccgatgatgaaagtcgggctggcacacccagcctggtgacatatcttaaaaaagccggaagacccggtaccagtccactagcaagtaaagtgggagcccctgccgcacccagcgtgaagcctcagcaacagcaggagcctctggcagcagtgaggccaccattgggggacttgtctacaaaggacctgggggatccgagtatggacaaggccgcagtgaaaattcaagctgccttcaaagggtacaaagtgcggaaggagatgaaacaacaagagggcccaatgttttcacacacattcggcgacaccgaggcgcaggtaggggacgctctccgcctcgagtgtgtcgtggcttccaaggctgatgtgcgggctcgctggctcaaggacggagtggagctaacagacggccgtcatcaccatattgatcaattaggcgacggcacctgctctctcctcattacaggtctggaccgggctgatgccggatgttacacttgccaagtgagcaataagtttggacaggtgactcacagcgcatgtgttgtggtgagcgggtccgagtctgaggctgagagctctagtggcggtgaactcgacgacgcgtttcggagagccgcacggaggctgcacaggcttttcagaaccaagtcacccgctgaggtcagtgacgaagagctcttcttgagtgcagacgagggaccggctgaacctgaagagccagcagattggcagacatatcgagaggacgagcacttcatctgcattcgattcgaggccctgactgaggctcggcaggccgtcacgagattccaggaaatgtttgctacccttggaatcggtgtagagataaagctggtagaacaaggccctcgaagagtagagatgtgcatctccaaagagacccccgctccagttgtgccacccgaacctctcccaagcctgctgacctctgacgccgctccagttttccttactgaattgcagaatcaggaggtacaagacggctatcccgtctctttcgattgcgtggtgacagggcaacctatgccttccgtgagatggttcaaagacgggaagctgcttgaggaagacgaccattatatgattaatgaggatcagcagggtggtcatcagttgattataacagccgtcgttcccgctgacatgggcgtgtatagatgcttggctgagaatagcatgggggtgtccagtacgaaagcagaactcagggttgacctgacctctacagattatgatactgcagctgacgctacagaatccagttcttacttttcggcacagggatacctgagttcacgtgaacaggagggtaccgaatctacaaccgacgaagggcagttaccgcaggtggtagaggagctgagagacctccaagtggcgccaggtacccgtctggccaagtttcagctgaaggtaaaggggtaccccgctcccagactctactggtttaaggacggacaacctctcacggcatctgcacacattcgaatgaccgacaagaagatactccacactctggagattatttccgtgaccagggaggacagcggacaatacgctgcctatatctcaaacgcgatgggtgcggcatattcctcggcacgtctgctggtcagagggccagatgaaccagaggagaagcctgcttccgatgttcacgagcagctggtgcccccaaggatgcttgaacggttcacgcccaagaaagtcaagaaggggtcatctatcaccttttctgtgaaggtggaagggcgacccgtcccgacagtccattggctaagggaggaagctgagcggggagttctgtggatcgggcctgatacccccggatacacagtggcaagcagcgcacaacagcactccttggtgctgctggacgttggacggcagcaccaaggcacttatacctgcatcgcttctaatgccgctggtcaggctctgtgttctgcgtccctacacgtgagtggcctgccaaaggtggaggaacaggagaaagtcaaagaggccctcatttctacatttctccaggggaccactcaagctattagtgctcagggactggaaaccgccagttttgcagatctaggcggacaacgcaaggaagagccactggctgccaaggaggcccttggccatctttctctagctgaagtcgggaccgaagagtttttgcagaaacttacaagtcagattactgagatggtctccgcaaagataacccaagctaagctgcaggtgccgggtggcgactctgatgaagatagcaaaacgccttcagccagtccgcgacacggcagatctcgcccatcttcttcaatccaagaatccagctcagagtctgaagatggcgacgctaggggggaaatcttcgatatctatgtcgtgacagccgattacctgccccttggggctgaacaggatgccatcaccctccgcgaaggccaatacgtggaagtgttggatgctgcccatcccctgcgttggttagtccggaccaaaccaacgaaaagcagcccaagtcgccagggatgggtgtcacccgcatatctcgatcgcaggctgaagctcagcccggaatggggcgctgccgaggcaccagaattcccgggtgaggctgtttccgaagatgagtataaagcaagattgtcttctgttatccaagagcttctgtccagtgaacaggcttttgtggaggaactccagttcctgcaaagccatcacctgcaacacctggagagatgtcctcatgtccccatcgctgttgcgggtcaaaaggccgtcattttccgaaacgtcagggacatcggcaggttccactcatcttttctgcaggaactccagcagtgtgacacagacgacgatgtggcaatgtgctttattaagaaccaggcggcattcgaacagtacctcgaatttctagtgggcagagtgcaggccgaaagtgtggttgtctctactgcgatccaggaattttataagaaatacgctgaggaggccctcctagctggcgatccctctcagcctccgccaccgcctttacagcactacctggaacaacctgttgagcgtgtgcaaagatatcaggctcttctgaaggaacttattcggaacaaggctcgaaatcgtcagaactgcgctctcctagagcaggcctacgctgtagtgtccgcccttccgcagcgagctgagaacaagttgcacgtatccttaatggagaactatccaggcacactgcaagccctaggagaacctattaggcaaggccatttcatcgtctgggaaggcgcacccggagccagaatgccctggaagggacacaaccgccacgtgttcttatttcgcaaccacctggttatttgtaagcctagacgcgactcccgaaccgataccgtcagttatgtatttaggaatatgatgaagctcagtagtattgacctaaacgatcaggttgaaggggacgacagagccttcgaggtctggcaggaaagagaagattcagtgagaaagtatctgctccaggccaggaccgcaataatcaaaagcagttgggtgaaagagatctgcggcattcagcagagactcgccctgccagtatggcgaccgccagacttcgaagaggagctggcggattgcaccgccgaactgggggagacagtaaagctcgcatgcagggtcaccggaactcctaagcctgttatatcctggtacaaggatggtaaagcggtacaggtcgacccgcatcatatcctgattgaggaccctgacggttcctgcgccctgatacttgactcattgacgggagtggattctggtcagtatatgtgcttcgctgcatcagctgctggaaattgtagtaccctcgggaaaattctggtccaagtgccccctcgatttgtcaataaagtgagggcctctccttttgtggagggggaggacgcacagttcacttgcacaatcgaaggcgctccttacccgcagatccggtggtacaaagacggtgccctcctgacaacaggcaataagttccagaccctgagcgaaccaagatccggtctccttgtcctggtaatccgagcggcaagcaaggaggatttgggactctacgagtgtgaactggtgaacagactaggcagcgccagagccagcgccgaacttaggatccaatcaccaatgttgcaggctcaagagcaatgccatagggagcaattagttgccgctgtcgaggtcacagagcaggagactaaagtacccaaaaaaaccgtgatcattgaggagaccataaccacagtggtgaaaagcccacgcggacaaagaaggtcccccagtaagagcccatctagatctccttcacgatgcagcgcaagccccctgcgaccgggactgttagcccctgacctgttgtacctccctggagccggtcaaccaagacgcccagaggcagagcccggacaaaagcccgtcgttcctacattatatgtcaccgaagccgaagctcacagcccagccttacccggactgtccggccctcaacctaaatgggtcgaagtcgaagagaccatcgaggtacgagttaagaaaatggggccacagggggtcagcccgacaactgaagtacctcggagctccagtgggcatctgttcaccctgccaggtgctactccaggcggagaccctaacagcaataatagtaacaataaactgctggcacaggaggcttgggctcaaggaacagccatggtgggcgttcgggagccattggtgtttcgcgtggacgcaaggggttctgtggactgggccgctagcggaatgggtagtctggaagaggaagggaccatggaggaagctggggaagaagagggcgaagatggtgacgcgttcgttacagaagaatcccaggacacacactctctcggagacagggatcccaagatcctcacccacaacggcagaatgcttacactggccgacctcgaggactatgtgccaggagagggggagaccttccactgcggtggccctgggcctggggcacccgacgaccctccatgtgaagtttcggtgattcagcgagagattggggagccaacagttggacagcccgttttacttagcgtcggccacgctctggggcctagaggaccattaggtttgtttcgacccgaacccaggggggctagtcctcctggtccacaggtacgcagtctcgagggtacaagcttcttgttaagagaagcccctgccagacctgtaggttcggctccctggacacagtccttctgtactcgaattagaaggtcagcggactccgggcaatcctctttcacgacagagttgtccacacaaaccgttaactttggtactgtgggggagacagtgaccctgcacatctgtccggacagagatggggatgaggctgctcagccataa

SEQ ID NO: 28657 - DNA, 1071 bp, Artificial Sequence
  Description of Artificial Sequence: Synthetic coding sequence
atggctaccgccgctctcctgcggggagctactccagggagaggaggacctgtctggcggtggcgattgcgtgcagccccacgatgtcggctggcacattcaagctgctctcccggaggagacccaacagccggagccgcttgggcctgttttagactcgatgggagaaccctgctgagggtacggggaccggacgccgctcctttcctcctcggcctgctcaccaacgagctgcctctgccgtctcctgccgctgccggagccccacctgcagccagggctggttacgcccactttctgaatgtgcagggacgcaccctgtacgacgtaattctgtatgggttgcaggagcacagcgaagttagtggattcctgctggagtgtgactcgtcagtgcagggagctttacagaagcacttagctttgtaccggatccgtagaaaggtgactgtcgagccccaccccgagctgagagtatgggccgtgctcccctcgtcgccagaggcctgcggtgcggcaagtctgcaggaaagagcaggggcagctgccatactcattagggacccacgaactgccaggatgggctggagattacttacacaagacgaaggacctgcactggtcccgggaggacggttaggggacctgtgggactaccaccagcatagataccttcagggagtgccagagggcgtccgagacctgccacctggcgtggccctgcctctggagagcaatctggcctttatgaacggtgtatcctttaccaaaggatgttacataggccaggagctcaccgccaggactcaccatatgggcgtcatccgcaagcggctgttccccgttaggttcctggacccgcttcctacatctggaatcactccgggtgctaccgttcttacagcttcgggtcagaccgttggcaaattcagagctggccagggcaatgttggcctggcactcctttggtctgagaaaatcaaaggaccgttgcacattcgagcatccgagggggcacaggtggcactggccgcaagtgtccctgattggtggcctacagtaagcaagtag

SEQ ID NO: 28658 - DNA, 1395 bp, Artificial Sequence
  Description of Artificial Sequence: Synthetic coding sequence
atgagagccgcaaggcgcggtctacattgcgcgggagcagaacgccctcgcagaagaggtcggctgtgggactcttccggggtgccacagagacagaaaagacctggcccttggagaacccagacccaagaacagatgagtcgtgacgtgtgtatccacacatggccctgcacctactaccttgagcctaagcgacgctgggtgaccggccagctgagcctcaccagcctgagtctgaggttcatgaccgacagcaccggcgaaattctcgtctctttccccttgtcttctatcgtcgagatcaagaaggaagcgagtcactttattttttcctctatcactattttagagaagggacatgccaagcactggttttcctctcttcgcccaagccgcaacgtcgtgtttagcatcattgaacatttttggcgggagctcctcctgtcgcaacccggagccgtcgccgatgcatccgtgcctcgaacccggggagaggagttaactgggctgatggccggatcacagaagcggctggaggatactgctagggtcttacatcaccagggtcagcagcttgattcagtaatgcgtggtcttgacaagatggagtccgatctcgaagtcgcggaccgcctcctgacggagctcgaatctcccgcttggtggcccttcagctcgaagttgtggaagacccccccagagacaaagccacgtgaggacgtcagcatgacatcctgtgaaccctttggcaaggaagggatcttgattaaaattcctgccgttatctcccatcgcactgagtcacatgtaaagcctgggagactgaccgtgctggtgagtggcctcgaaattcacgactcatcgagcctgctgatgcatcgcttcgaacgggaagatgtggatgatatcaaggtccactctccgtatgagatcagcattaggcaacgatttataggcaaaccagatatggcctatagactcattagcgcaaaaatgcccgaggttatcccaatcctcgaggtacaattttctaagaaaatggaactattagaggatgcattggtgctgagatccgcccgaacatctagcccagctgaaaaatcctgctccgtttggcacgccgcttcaggtctgatggggaggaccctccatagggagcctcccgcaggagatcaggaaggcacagcgctgcatctgcagactagcttaccagctctgtccgaagccgatactcaggagctgacacagatactccgacggatgaagggtctggctcttgaggctgagagcgaactcgagagacaggacgaagcattggacggcgtggccgcagcggtggaccgggctactttaaccatcgacaaacacaacaggcgtatgaaaaggttaacttag

SEQ ID NO: 28659 - DNA, 669 bp, Artificial Sequence
  Description of Artificial Sequence: Synthetic coding sequence
atgacatcttgtgagccctttggcaaggaaggtatcttaattaagattccggcagtgatctctcacaggaccgaatcgcacgtaaaacccggtcgccttactgttctggtctccggtcttgaaattcatgatagttcatcgctccttatgcatagattcgaaagagaagatgtggacgacattaaagttcactctccttacgaaattagtatcagacagagattcatcggtaaaccggatatggcctaccgcctgatctccgctaaaatgcctgaagtgatcccaatcttggaggtgcaattttcgaagaaaatggagctgctggaagatgcccttgtgctcagaagcgccaggaccagctcacccgctgaaaaatcttgctcagtttggcatgccgctagcgggctcatgggcaggaccttacatcgcgaaccccctgccggtgatcaggaaggcacagctctgcatctgcagacatcactacctgcattgagcgaggcagacacacaggagctaacccagatactgaggagaatgaaagggttagctctggaggctgaatccgaactggagcggcaggacgaggcccttgatggcgtcgctgccgcagtcgaccgcgctacactcacgatcgacaagcacaataggcgcatgaaaaggctcacttag

SEQ ID NO: 28660 - DNA, 201 bp, Artificial Sequence
  Description of Artificial Sequence: Synthetic coding sequence
atgccccagtatcagacctgggaggagttttccagagccgctgagaaactctacttggctgatcccatgaaggcccgagtggtactaaagtatcgacactccgacggaaacctctgcgtgaaagtcacagacgatcttgtgcaatggcatctcaactactgcaccctgcgccatggcattgctgggggattggaaacatag

SEQ ID NO: 28661 - DNA, 249 bp, Artificial Sequence
  Description of Artificial Sequence: Synthetic coding sequence
atgcctcagtaccagacgtgggaggaattcagcagggcagcagagaaactgtaccttgcagatccgatgaaggctcgggtagtgcttaagtaccggcatagcgacgggaacttgtgcgttaaggtgacagacgatctggtgcgccagtgtctggccctgcttctaagactgcaatgcagtggcatgataattgctcactgtattcttgacctactggggtctagcgggcctttggcttcagccagctag

SEQ ID NO: 28662 - DNA, 651 bp, Artificial Sequence
  Description of Artificial Sequence: Synthetic coding sequence
atgcaggcaaatggtgctggtggcggagggggagggggtggcggtggtggaggcggtggcggtggagggggaggccagggtcagaccccggaactggcttgcctatcagcacagaatggggaatcaagcccatcatccagctcgagcgcaggggacctggcacacgccaatggactccttccctctgctccttcggccgcaagcaacaattccaatagcctgaacgtgaacaacggggtgcccggaggcgcagcggctgcgtcctcagctacggtggcagcagcttctgccacaactgccgcttcatcttctctggcaactcccgagctcggctcctctctaaaaaaaaagaagcgcctaagccagtccgacgaagacgttatacggctgatcgggcagcaccttaacggactgggccttaaccagacggtggacttacttatgcaggaatctggctgtcgcctggaacacccgtcggctaccaaattcagaaaccacgtgatggagggtgattgggataaggctgagaatgatctgaacgaactaaaacccctggtgcacagtcctcacgctattgtggcgcagactttctcggaaacctccattaatttttttccgcttacggcagcattttgtcacgtgaggggctag

SEQ ID NO: 28663 - DNA, 2340 bp, Artificial Sequence
  Description of Artificial Sequence: Synthetic coding sequence
atgcgcatcgaggagcgaaaatctcagcatctgaccggtctgaccgatgaaaaagtgaaggcctatctctcactgcatccgcaggtgctggacgagtttgtctccgagtctgtgtccgctgagaccgtcgagaaatggcttaagaggaagaataacaagtctgaagacgaaagcgctcctaaagaggtgtcacgatatcaagacaccaatatgcagggcgtggtatatgagctcaactcctatatcgagcagcgcttggacactggtggagataaccagctactgttgtacgaactcagctcaatcatcaagattgctacaaaggctgatggcttcgcactttattttctgggagaatgtaataattccctctgcatcttcactcccccaggcatcaaagagggcaaaccgagactgattccggcagggcctatcacacaggggactaccgtttctgcatacgtcgccaagtccagaaaaactctgctggtagaggacattcttggagacgagaggtttcctcggggtaccggattggaatccggtaccaggatccagtccgtgctgtgtctacctatagttacggcaatcggggatcttatcggaatactggaattgtaccgtcactggggtaaggaagctttttgtctctcccatcaagaagtcgccaccgctaacctggcatgggccagcgtggctatccatcaagtgcaggtatgccgcggtcttgctaagcaaactgaattaaatgatttcctgctggatgtaagtaagacatatttcgacaatattgtagccatcgactcactactcgagcatataatgatatatgcaaagaacttggtgaacgctgacagatgcgcacttttccaggtggatcacaagaacaaggagttatattcagacctgttcgacattggcgaagaaaaagaaggcaagcccgtcttcaaaaaaaccaaggaaattcgcttctccatcgagaaaggcattgctggtcaggttgctagaacaggcgaagtcctgaatatccccgacgcctatgccgatccccgttttaatcgagaagtggacctatacaccggctacactacccgcaacatcttatgcatgccaattgtgagcaggggaagcgttattggtgtggtacagatggtgaataagatttcaggtagtgccttcagcaagaccgacgagaacaactttaagatgtttgctgtattctgcgccctggcactccattgcgccaacatgtaccatcgaattcgtcacagtgagtgcatctatagagtgacaatggaaaagctctcataccattctatctgcacatcagaagagtggcaggggctcatgcagtttacgttgccagttaggctctgcaaagagattgagcttttccactttgacatcggaccttttgagaacatgtggccaggtattttcgtgtacatggttcacaggagctgcggcacctcttgttttgagctggagaaactgtgccggttcattatgagcgtcaagaaaaattatcgtcgcgtcccctaccacaactggaaacacgcagttaccgtggctcattgtatgtacgccattttgcaaaacaaccacacactgtttaccgatctggagaggaaagggctgctgattgcctgcctgtgtcatgatctcgatcaccgaggattcagcaattcttacctgcagaagttcgaccacccgcttgccgctctatattccaccagcactatggagcagcatcatttttctcagactgtcagcatcttgcaactggaggggcataacatcttctcaaccttgagctcttcagaatatgagcaagttcttgagattatcagaaaggctatcattgctactgacctcgctctttactttgggaaccggaaacagctagaggagatgtaccagacgggaagtctgaacctcaacaaccagtctcaccgtgatagagttatcggcctgatgatgaccgcgtgtgacttatgctccgttaccaaactgtggcccgtgacaaagttgacagctaatgacatttatgcagaattctgggcggaaggggacgagatgaagaagcttggcattcaacccatcccgatgatggaccgcgacaagaaggatgaggtaccacagggacaactcggcttttataatgcagtggcgattccttgttacaccaccctgactcagatcttgccccctacagaacctctcttgaaagcttgtagggacaacttatcccagtgggaaaaggtcatccgtggtgaggagacagccacttggattagctccccgtcagttgcccagaaggctgcagcctctgaagattag

SEQ ID NO: 28664 - DNA, 666 bp, Artificial Sequence
  Description of Artificial Sequence: Synthetic coding sequence
atggccgcagcttcaggcagtgttctccagaggtgcatcgtaagcccagccggtcggcactctgcaagtctgatattcctgcacggttctggggactctggtcagggcctccgaatgtggattaagcaggtgctgaatcaggacttgacatttcagcatatcaagatcatctacccgactgcgcctccacgattcaaaataacaaacgattgccccgagcacctggaatccatcgacgtcatgtgtcaggtcctgactgacctgatcgacgaagaggtcaagagtgggatcaagaagaaccgcattctgatcgggggattttctatgggcggttgcatggccattcacctggcctaccgcaaccatcaggatgtggccggagtattcgccctctcatccttcctcaacaaggcttctgcagtttaccaggcgttgcagaagtcaaatggcgtgctgccggagttgtttcaatgccatggcacggctgacgagctggttcttcactcctgggccgaggagaccaactccatgctcaaatcccttggagtgaccactaagtttcactccttccccaacgtgtaccacgagttgagtaaaacagaactggacatactaaagttgtggattctgaccaagttgcccggagagatggagaaacaaaaatag

SEQ ID NO: 28665 - DNA, 714 bp, Artificial Sequence
  Description of Artificial Sequence: Synthetic coding sequence
atggcagcagctagtgggtccgtcctccaacggtgtattgtgagccccgcagggaggcacagcgcaagcttgatctttctacacggttctggcgacagtggtcagggactgagaatgtggatcaagcaggtccttaatcaggatttgacattccagcatatcaagataatctatccaaccgctccccctaggtcctacacccctatgaaaggaggaatttcaaatgtgtggtttgatcgctttaagataaccaacgactgtccagaacacttggagtcaattgacgtaatgtgtcaggttcttaccgacctgatcgatgaggaggtcaagtcaggcatcaagaagaatcgtatcttgataggcggtttcagcatggggggttgcatggcaatacacttggcctaccgcaaccatcaagacgtagcgggtgtattcgctctgtcatcttttctgaacaaagctagcgccgtgtatcaagccctacagaaatctaacggcgtgctgccagaactttttcaatgtcacggcaccgccgatgagctggtattacattcctgggcggaggaaactaacagcatgcttaagagcctgggagtgaccaccaaattccatagcttccctaatgtgtaccatgaactgagtaaaaccgagcttgatattctcaaactgtggatattaaccaaacttcccggtgagatggagaagcagaagtag

SEQ ID NO: 28666 - DNA, 471 bp, Artificial Sequence
  Description of Artificial Sequence: Synthetic coding sequence
atggagaccgccaaggaaatgacccgtgagagtctgccgatcaagtgtcttgaagctgtaattctcggtatatacctcactaatggccaaccgagcatcgagcgttttccgatttccttcaagacttatttcagcgggaactactttcaccacgtggtgctgggaatctattgtaatggccgttacggatcgctcgggatgtctaggcgcgctgagttgatggataagcctctcacttttcgcacgctgagcgacctgatcttcgacttcgaagatagctataagaaatacctgcacacagtcaagaaagtcaaaattggtctgtacgtcccccacgaaccccattcatttcaacctattgaatggaagcaactagtgctgaacgtgtctaagatgctgagagctgatatacgcaaggagctggagaagtacgcaagagacatgcgtatgaaaggcttatgcagccattag

SEQ ID NO: 28667 - DNA, 936 bp, Artificial Sequence
  Description of Artificial Sequence: Synthetic coding sequence
atgacagggtcagccgcagatactcaccgctgtcctcatccgaagggagctaagggaaccagatctcggagctctcacgcaaggccggtgagtctggcaaccagtggcggtagcgaggaggaggataaggacggcggagtgctcttccatgtgaacaagagcggtttccccatcgactcacacacgtgggagcgcatgtggatgcacgtagccaaagtgcatccgaagggcggagagatggtcggcgctatccgcaatgctgcttttcttgctaaaccatctatcccccaagtgcccaattaccgtctctctatgacaatccccgactggcttcaggctatccagaactatatgaaaactctgcattatctgaccaacgggcagccctcgatcgagcggtttccaatatccttcaagacctacttctcagggaattattttcaccatgttgtccttgggatttattgcaatgggaggtatgggtccctcggaatgtcacgcagggcagagctcatggacaaacccttaacattcagaaccctatccgacttaatctttgattttgaggactcatacaagaagtacctccatacagtgaaaaaagtcaagatcggtctgtacgtaccacacgaaccccactctttccagcctatcgaatggaagcaactggtcctgaatgtgtcaaaaatgcttcgtgccgatattagaaaagaactggaaaaatacgcaagggatatgcgcatgaagattttaaaaccagctagtgcgcactcacctacccaggttcgttctaggggcaagtccctgtccccgcgtcgcagacaggccagtcctccacgtcggcttgggaggcgggaaaagtcacctgctctgcccgaaaaaaaggtggccgatctctctactttaaacgaggtggggtatcagatacgaatttag

SEQ ID NO: 28668 - DNA, 873 bp, Artificial Sequence
  Description of Artificial Sequence: Synthetic coding sequence
atgtggatgcacgtcgccaaggttcaccctaaaggcggtgaaatggtcggggcaatccgcaacgcagcattcttggcaaagcctagtatcccacaagtccctaattatcgcctgtccatgaccatccccgattggttgcaggctatacagaattatatgaaaacgttacagtacaaccataccggaactcaattttttgagattcgcaaaatgcgtcccctttccggcctcatggagacagctaaagaaatgacccgggagtctctgcctatcaagtgcttagaggcggtgatcctcggaatatatctcacaaatggccagccttccatagaacgttttccgattagtttcaagacctatttcagcggtaattactttcaccacgtggtcctgggaatttattgtaatggaagatacggatccctggggatgtcccgacgggcagaactgatggataaacctctcacattccgaaccttgtccgatctgatatttgacttcgaggactcctataagaaatatctgcatactgttaagaaagttaagatcggcctgtatgtgccccacgagccccacagttttcagcctattgaatggaagcagttggtgttgaacgttagtaaaatgctgcgtgctgatatccgcaaagagctcgaaaaatatgctagagacatgcgaatgaagatcctgaagcctgcaagcgctcactccccaactcaggtccggtcgcggggaaaatcgctctcacctagaaggcggcaggcctcccctccccgaagacttggcagaagggagaaatctccagcccttccagagaaaaaggttgcagatctttccactctcaacgaagtgggttatcagattcggatctag

SEQ ID NO: 28669 - DNA, 756 bp, Artificial Sequence
  Description of Artificial Sequence: Synthetic coding sequence
atgaccatccccgactggctacaggcgatacagaactatatgaagaccctgcagtacaaccataccggtacccagttctttgagatccgcaagatgagaccgctgtcagggctcatggagaccgctaaggaaatgacaagagagtcgctgcctattaagtgcctggaagcagtaatcctgggaatctaccttaccaacggacagccttccatcgagcggttccctatctcattcaaaacgtatttcagcggtaactactttcaccacgtagtgttggggatctactgtaacgggcgttacggcagcctgggcatgtcccgccgtgcagaactgatggacaaacctcttacattcaggactctgtccgacctgatctttgatttcgaggacagctacaaaaaatatctgcataccgtcaagaaagttaagatcgggctttatgtcccacacgagcctcacagcttccagcccattgaatggaaacagctcgttctaaatgtgtctaaaatgttacgggcagatattaggaaagaacttgagaaatacgctagagatatgaggatgaagattctgaaaccagctagcgcccactccccaacacaagtgcgttccagaggaaaatccctgtcccccagacggaggcaggcctcccctccccgaagactgggacggagagaaaagtctccggcattgcccgaaaaaaaggtcgccgatttaagtacactcaacgaggtgggatatcagatcaggatttag

SEQ ID NO: 28670 - DNA, 873 bp, Artificial Sequence
  Description of Artificial Sequence: Synthetic coding sequence
atgtggatgcacgttgcgaaagtgcatccaaagggaggggagatggtgggagctatccgcaatgccgcattcctagctaaacctagcattccccaggtgcccaactaccgtttgtctatgacaatcccagactggctccaagctatccagaattacatgaaaactctccaatataatcacactggcacacagttttttgagattcggaagatgagacccctgtctggcctgatggaaactgcaaaggagatgacaagggaaagcctgcccatcaagtgcctggaggccgttattctgggaatatatttgacaaatggccaaccatcaattgaacgctttcccattagtttcaagacatactttagcgggaattattttcaccacgtggtactcggaatatactgtaatggaaggtatgggtccttgggaatgtcgcgtcgtgctgagctgatggataagcctctgacatttaggacgctgtcagatctgattttcgatttcgaggactcctacaaaaagtatcttcacactgtgaaaaaggtcaagattggcctgtatgtgccccatgaacctcacagcttccaacccattgaatggaagcagcttgtgttaaacgtctccaagatgctgagagcagatattaggaaagaacttgagaagtacgccagagatatgaggatgaagatccttaagccagcaagcgcccatagccctacacaagtgaggtctcgagggaagtcactgtcaccccgtcggcgacaggcctccccacccaggcgccttggccgtcgagaaaagtcccccgctttaccagagaagaaggtggccgatctctcaaccttaaacgaagtgggctatcaaattagaatttag

SEQ ID NO: 28671 - DNA, 723 bp, Artificial Sequence
  Description of Artificial Sequence: Synthetic coding sequence
atggccggatcgcctgagcttgtcgttctagacccaccttgggataaagagttggctgctgggactgagagccaggctctggtctccgctacccccagagaggacttccgggtccgatgtaccagcaagagggctgtgaccgagatgttacaattatgtggaaggttcgttcaaaaattgggggatgcacttcccgaggagataagagagcctgccctgagagacgcccagtggactttcgagtcagcagtgcaggagaacatctccattaatggacaagcttggcaagaagcttccgataattgctttatggattccgatatcaaggttctggaggaccagtttgacgaaatcatcgtcgacattgctacaaagagaaaacaatacccacgcaagattctggagtgcgtaatcaagaccattaaggccaaacaggagatactgagcctgcctgcactgatcgagcagggtgagggtttctcgcaggtgcttaggatgcaacccgtcattcatctgcagcgcatccaccaggaggtcttttcctcttgtcataggaagcctgatgccaagcccgagaacttcatcacgcaaattgaaactactccaacggaaacagccagccggaagacaagcgacatggtgttgaagcggaagcagacgaaagactgtccccagcgaaagtggtatccgctcagacccaaaaaaattaatctcgacacgtag

SEQ ID NO: 28672 - DNA, 519 bp, Artificial Sequence
  Description of Artificial Sequence: Synthetic coding sequence
atggcagggtcccccgaattggttgttctggaccccccatgggacaaggagctggccgctggcacagagtctcaggcgctagtttctgccacacccagagaagattttagggttcgttgcacttccaaacgtgctgtgaccgaaatgcttcagctctgcggtcgctttgttcaaaaacttggagatgcactacccgaagaaatccgagagcccgcattacgagacgctcagtggactttcgaatccgcagtgcaagagaatatcagtataaacggacaagcgtggcaggaggcaagcgacaattgctttatggactcagacatcaaggtactagaagaccagttcgacgagatcatcgtggatattgccacaaaacgcaagcagtatccacgcaagattctggaatgcgtgatcaagacgataaaagcaaagcaggagatccttaagcagtaccacccggttgtccacccgctcgatctgaagtacgatccagatccagtcttagcttgcattaactag

SEQ ID NO: 28673 - DNA, 846 bp, Artificial Sequence
  Description of Artificial Sequence: Synthetic coding sequence
atggcagggtcccctgaactagtcgtgctagacccaccttgggataaggagcttgctgccggaaccgagtctcaggctctcgtttcagcgacacccagggaagattttagagtaagatgcaccagtaagcgagccgtgactgagatgctgcagctttgtggccgtttcgtccaaaaactgggggatgcattgccggaagagattagagagcctgccctgcgagacgcgcagtggaccttcgaatctgcggtccaagagaatatctcaataaacggtcaggcttggcaggaggcttcagacaattgcttcatggattcagacattaaggtcctggaagaccagtttgacgagattattgtcgacatcgccacaaaaaggaagcagtacccaaggaaaattctggagtgtgtcatcaaaactataaaagcaaaacaggagattcttaaacagtatcaccctgtcgtgcatcctcttgatctcaaatatgaccctgacccggctccacacatggaaaaccttaagtgccgcggtgagaccgttgccaaggagatttctgaagcaatgaaatcattgccagccctcatcgagcagggcgagggattttcccaggtgctgagaatgcagcccgtcatccacttgcagaggattcaccaggaagtgttttcatcctgtcaccgcaaaccggatgcgaagccagaaaattttataacccagatcgagactacgccaactgaaaccgcgtcccggaaaactagtgacatggtgttgaagaggaagcagactaaggattgcccacagaggaagtggtatccccttaggccaaaaaagattaatctggatacttag

SEQ ID NO: 28674 - DNA, 228 bp, Artificial Sequence
  Description of Artificial Sequence: Synthetic coding sequence
atggattcagacatcaaggttttggaggaccagtttgacgagattattgtagatattgccaccaagcgaaagcaataccccaggaaaattttggagtgcgtcatcaagacaatcaaggctaagcaggagatacttaaacaataccaccctgtggtccaccccctggacctgaagtatgatcctgacccgggtgcgaaacccggaggcttggctctgggagctgtgtag

SEQ ID NO: 28675 - DNA, 279 bp, Artificial Sequence
  Description of Artificial Sequence: Synthetic coding sequence
atggaggactatcaggctgccgaggaaactgcatttgttgtcgatgaggttagcaatatcgttaaggaagctatagagtccgctattggcggaaacgcataccagcactcgaaagtcaaccagtggactacaaacgtcgttgaacagacgctctctcagctcactaagctgggtaagccatttaagtatattgggaacggggtccttttcctgctctacttgcgcgatggcttcctcacccttataaggggtgcgagttctactagaaataacagttag

SEQ ID NO: 28676 - DNA, 204 bp, Artificial Sequence
  Description of Artificial Sequence: Synthetic coding sequence
atgcagaaaaatggagctggtttacatacagcctccagctgtttttgggatagctctaccgatggtatgattttcattcacgtgtgcgaggtcctactctgcgagatttacgactggaaattcccaatctttgaatgtaacgcctgtttgagcccattcaaaacctttaacaatcgattggccaaggtcttgtgtgtggcttag

SEQ ID NO: 28677 - DNA, 342 bp, Artificial Sequence
  Description of Artificial Sequence: Synthetic coding sequence
atggaagattaccaagcggctgaagaaaccgccttcgttgtggatgaggtgagtaacattgtaaaagaggcaattgagtcagctatcggtggaaatgcatatcaacacagcaaagtaaaccaatggaccacaaatgttgtggagcaaacattgtcccagctcactaagctaggaaagccatttaagtacatcgtcacctgcgtgattatgcagaaaaacggcgctggtttgcatacagctagtagctgtttctgggattctagtaccgacgggagttgtacagtgcgttgggaaaacaaaaccatgtactgcattgtcagcgccttcggcctgtcaatttag

SEQ ID NO: 28678 - DNA, 2037 bp, Artificial Sequence
  Description of Artificial Sequence: Synthetic coding sequence
atgtacgctgctgtggaacacggcccagtactgtgctctgatagcaacatcctatgtctttcgtggaaaggtcgagtccctaagtcggaaaaggagaagcccgtttgccggaggcgctattatgaagagggctggctcgcgaccgggaacggccgtggagtggtgggcgtgacttttacgagctcacactgccggagagatcgctccacgccccagagaatcaatttcaatctacggggtcacaacagtgaggtggtgttagtgagatggaacgagccttatcagaagctggcaacgtgtgatgctgatggtgggattttcgtgtggattcaatatgaggggagatggtctgttgagctggtgaatgatcgtggggcacaggtatctgatttcacttggagtcacgacggtacccaggcgctaatcagctacagagacggcttcgtactggtgggtagtgtctctggccagaggcactggagcagtgaaatcaacttggaaagccagattacctgtggcatttggacccccgacgatcagcaggttttatttggcacagcagatggacaggtcatagtgatggactgccacgggagaatgcttgctcacgtgctccttcacgagtctgatggcgtcctgggtatgtcgtggaattatccaattttcttagtagaggatagttctgagtcggacacagattccgacgattacgctccccctcaagatgggcctgccgcataccctattcctgtccagaacattaagccactgctgacggtgagctttacatccggagatatttcattaatgaacaattatgatgacctctctcctactgtgatccggtccggcctgaaagaagtggtggctcagtggtgcacacaaggcgatttacttgcggtcgctgggatggagagacagacccagctcggggagctccctaatgggcctctgctgaaatctgctatggtaaaattttacaatgtaaggggcgagcatatctttacactggatactctagtgcagcggcctattatctcaatttgctggggccatcgtgattctcgactgttaatggcgagtggcccagccttatatgtagtcagagtcgaacaccgtgtgtcctcactacagttactttgtcagcaggcaatcgcgtccactttgcgcgaggacaaggacgtgtcgaaattaacactgccacctaggctgtgttcctacctgtccacggcttttataccaacgattaaacctcctatccccgatccaaacaatatgcgggatttcgtgagctatccttcggccggtaatgaaagactgcattgtactatgaaacgtactgaggatgatcccgaggtgggagggccatgttacacactgtacctagagtatctggggggactcgtgcccatcttgaaaggaagacgtatttccaagctgagacccgaattcgtgataatggatcctcggacggactcgaagcctgacgaaatatatggcaacagcctgatttcaactgtgatcgactcgtgcaactgcagcgacagttctgatatcgaattatccgacgactgggctgccaaaaagtccccgaagatctcccgagcttctaagtctccaaaactccctaggatctccatagaggcccgaaaatcgcctaagttacccagggccgcacaggaactgagcaggagtcccagactgcctctgcgcaaaccatccgtgggcagcccgtcccttactaggagagagttcccctttgaagatattacccagcacaattatcttgcacaggtcacatctaacatctggggtaccaagtttaagattgtaggtctcgccgctttcctgcccacaaatctgggggcagtcatttacaaaacttcccttttgcatctccagccaaggcagatgaccatctatctgcctgaagtccgcaaaattagcatggattatattaatctgcccgtcttcaatccaaatgttttctccgaggacgaagacgacctcccgggtgacgccgtttggacagattag

SEQ ID NO: 28679 - DNA, 4631 bp, Artificial Sequence
  Description of Artificial Sequence: Synthetic coding sequence
atgtacgctgccgtagagcacggcccagtcctctgttccgattccaatatcttgtgtctttcatggaagggcagagtccccaagtccgagaaggagaagcccgtgtgcaggagaaggtattacgaagagggatggctcgccacaggaaacgggcgtggggtagtgggagtcacattcacttcaagccattgccgacgagaccgcagcaccccccaaaggattaacttcaatcttagaggacacaattcagaggtcgttctggtgcgctggaatgagccataccagaagctcgccacatgtgacgccgatgggggaatatttgtgtggatacagtacgaaggccgatggagcgtggagctggttaacgataggggcgcacaggtgagcgattttacatggagtcatgacggcactcaggcgcttatcagctatcgcgacggtttcgtgcttgtcggctccgtctccggccagcggcactggtcgtcggaaatcaatctggagagtcagatcacctgcggcatttggacgcccgacgaccaacaggtgttgtttggaaccgcagatggccaggtaattgtgatggattgtcatggccgaatgctagcacatgtcctccttcacgagagcgatggagttctgggaatgtcctggaactaccccattttcctggttgaggacagcagtgagagcgacaccgacagcgatgattatgctccacctcaggacggccctgctgcataccctattcctgttcagaacatcaagccgctcctgacagtgtcttttacatccggggacatcagcctgatgaataattatgatgatctctcccccacggtgatcaggagtggactaaaggaagttgtcgctcaatggtgtacacagggagatcttcttgcggttgccggaatggagaggcagactcagttgggcgagttgcctaacggtccattactgaagtcagctatggtgaagttctataacgtgaggggtgagcacatcttcaccctggatacacttgtgcagaggcccatcatttctatttgctgggggcacagggattctcgattgttgatggcctctggccctgccctttatgttgtgcgtgtcgagcatcgcgtttcgtctctgcaacttttatgccagcaggctattgcttccaccctacgggaggataaggacgtgtccaagctcacactcccccctagactgtgttcttatttaagcacggcttttatacccactatcaagccccctattcccgaccccaataatatgcgggatttcgtcagttaccctagtgccggaaacgaacggcttcattgcaccatgaaaaggactgaagacgaccccgaggttggtgggccttgctacaccctgtacctcgagtaccttggtggactggtgccaattttgaagggcaggagaatttctaagctccgacccgaattcgtcatcatggacccaaggacggatagcaaacccgacgagatctatggaaattccctgatatccaccgtgatagattcctgtaactgttccgattcatcagacatcgagctgtccgacgactgggcggctaaaaaaagccccaaaatctcccgggctagcaaaagccctaagttgccacggataagtattgaagcacgcaaatctcccaagttaccccgagctgcgcaggagctttctagatcgcctcggctgcccctgagaaagccaagcgttggaagcccgtctctgactaggagagagttcccatttgaagacattacacagcataactacttggcccaggtgacatctaatatctgggggacaaagttcaaaattgttggtctggccgcattcctacctaccaatctcggcgcagtgatctacaagacttccctgctgcaccttcagcctcggcagatgaccatatacttgccagaagtacggaagatctccatggattacatcaacctgcccgtgttcaacccaaacgtgttttccgaagacgaagatgacctacccgtgacaggagcatctggcgtccctgaaaacagccccccatgtacagtaaatattcccatagcacctattcacagcagtgcccaggccatgtcccctactcaaagcatcggtctggtccagtcattgctggctaaccagaacgttcaactggatgttctaaccaatcagacgaccgccgttgggactgcggaacacgccggagattcggctacccagtaccccgtttcaaacagatacagcaacccaggccaggtgatattcggatctgtcgagatggggagaattatccagaaccccccacctctgagcctgcctccccctccccaaggacccatgcagctcagcacagtgggacacggcgatcgggaccatgagcacctacaaaaatctgccaaagccctgcgccctacgccacagttggcggctgaaggcgatgccgtggtattcagcgcaccccaagaggtccaagtgacaaagatcaacccccctcccccataccccggaacaatcccggctgcacctaccacagcggcacctcctcctcctctccctccacctcagcctcccgtggatgtgtgcctgaagaagggagacttctccctctacccgacctccgtgcattatcagactccgttgggatatgaaagaatcaccactttcgactcttccgggaacgttgaagaggtctgtaggcccagaacacgcatgttgtgtagccagaatacatacactttgccagggcctggtagtagtgccactctaaggctcaccgctactgagaaaaaggtaccccagccatgcagcagtgccaccctcaaccgacttactgtccccagatattcaatcccaaccggtgatccaccaccttatccagaaattgccagccagttagcccagggtcggggagccgctcagcgatcagacaattcacttattcacgccactcttcggagaaacaaccgggaagctacgctgaagatggctcaactagctgattcccctcgcgctccccttcagcctttggcaaaatcaaaaggcggaccgggaggggtggtcacacagctgcccgcacggcctccccctgccctgtacacatgctcccagtgctctggaactggtccatccagtcaaccaggtgcgagcctggcccacaccgcctccgccagcccactcgcctctcaatcaagctacagtctgctgagtccccctgattccgccagagaccgcacagactacgtgaactctgcctttacagaggacgaggcactctctcagcattgccagctcgagaagccattgaggcaccctcctctgcctgaagccgctgtgacattgaagcgaccccctccttatcagtgggatccgatgctcggggaggacgtgtgggtgcctcaggagcgcacagcccaaaccagcgggccaaaccccttgaagctttcttccttaatgctctcccaagggcagcacctggatgtttctaggctgcccttcattagcccaaagtcccctgcttctcctacagcaacttttcagactggttacggtatgggggttccatacccgggatcttataacaatccaccgctccctggcgttcaggcaccctgtagtcctaaggatgccctgagccctacccaattcgcccagcaagaacctgcagtggtccttcaacccctttaccctccttcactgtcatactgcaccttacccccaatgtacccaggctcctcgacatgctcgtcactacagctgcctcctgttgccctgcatccatggtcttcctattctgcatgcccacctatgcaaaatccacaagggactctacctcctaagccccacctggttgtggagaagccgctggtcagcccaccccctgctgaccttcagtcgcacctgggcaccgaggtgatggttgaaacggccgacaattttcaggaggtgctgtcgctgactgaaagccccgtgccacagagaactgagaaatttggcaagaaaaaccggaagcggctggacagccgggctgaagaagggtcagtacaggccattaccgagggcaaggtgaagaaggaagccagaacgctgtcagacttcaacagtttaatcagttccccgcatctcgggagggaaaaaaaaaaagttaagagtcaaaaagaccagttgaagtccaaaaagttgaacaaaactaatgagtttcaggacagcagcgagtccgaacctgaactgttcatatctggggacgagcttatgaatcagtcacagggatctcggaaagggtggaaatccaaacgcagccctcgggctgctggtgaactggaggaggctaaatgtagacgtgcctctgagaaggaagatgggcgactgggcagccaagggtttgtttacgttatggcaaataagcagcctttgtggaatgaggccacacaggtttaccaactagacttcggaggacgtgtcacccaggaatcagcgaagaactttcagattgaactggagggcaggcaggtgatgcaattcgggagaatcgacggatctgcctacattctcgattttcagtacccatttagcgccgtgcaggccttcgcggtggccctcgcgaacgtgactcaacgcctcaagta

SEQ ID NO: 28680 - DNA, 3234 bp, Artificial Sequence
  Description of Artificial Sequence: Synthetic coding sequence
atggacagcaagatgaagaagatggctgaactgcagctctctgtggtatcggaccctaagaacagaaaggcaatcgagaatcagatccaacagtgggagcagaatctagaaaagttccatatggacctgttccggatgcgctgctatctggccagcctccaaggtggtgagctgcctaatcccaaatcactcctggcagcggctagcagacccagcaaattggcactgggcagactcggtattttgtccgttagttcctttcatgctctcgtgtgtagtcgggacgacagcgccctgaggaaaagaaccctgtccctgactcagcgaggcagaaacaagaaaggaatcttttccagtttgaaaggactggataccctagctcggaagggcaaagagaaaaggccatcaatcacacagatattcgactcctccggatcacacgggttttcggggacacagctgccacagaacagctctaattcctcagaggttgacgagcttctgcatatctatgggtccaccgtagatggagtaccaagggataatgcttgggagatacagacgtacgtgcactttcaagacaatcacggcgtcaccgttggaattaagccggagcacagagtggaggatatcctaaccttggcttgtaaaatgagacaactggaaccttcccactacggtttacagttaaggaagctggtggatgataatgtcgaatactgcattcctgccccttatgagtacatgcagcagcaagtatacgacgaaatagaggtgtttcctcttaatgtgtatgacgttcagttgactaagacagggtccgtttgcgactttggctttgcagtgacagcgcaggtcgacgaaaggcagcacctttctagaatctttatctcagacgtcctccccgacggtctcgcctacggcgaaggactccggaagggcaatgagatcatgaccctcaatggtgaggccgtgagtgatttagacctgaaacagatggaggccttgttttctgaaaagagcgtaggcctgactctaatcgcacgcccaccagataccaaagcaacactgtgtaccagctggtccgattctgatctgtttagccgtgatcagaaatccctgcttccgccacccaaccagtcgcaattgctggaagagttcctagacaacttcaaaaaaaacacagctaatgacttcagcaatgttcccgatattacaactggactgaaacgaagccagacagatgggacccttgatcaagtctcacatagggagaaaatggaacagacgtttaggtccgcagaacagatcacagcactttgccgctctttcaacgatagccaagccaacggtatggagggccctagagaaaatcaggacccaccgcctaggtctctggcccgtcacttgtctgatgctgatagacttcgtaaggtaatccaagaacttgttgacaccgagaaatcatatgtgaaggatttatcatgcctgttcgaactctatctggaaccactgcaaaacgagacctttctaacacaggatgagatggaatctttgttcggcagtctgcctgaaatgttggaatttcagaaggtcttcctggagaccctcgaggatggaatttcggcctcatcagactttaatacgctggagacaccatcccaattcaggaagctgctattcagccttggtgggtctttcttatactatgcagaccatttcaaattatacagcggattctgtgctaatcacattaaggttcaaaaggtactcgaacgtgcaaagacagacaaagcctttaaggcgttcctggacgccagaaatccgacgaaacagcactcgtccacactggaatcctatctgattaagccagtgcagcgggtgctcaagtaccccttactcctcaaggaactcgttagtctgacagaccaggagtcagaggagcattatcatctgacggaagcactgaaggcaatggagaaggtcgcatcccacatcaacgaaatgcagaagatttatgaagactacggcactgtgtttgatcagcttgtggcggaacagtcggggacagagaaggaggtgaccgagctgtcaatgggagaattgctgatgcacagtacagtgtcctggctcaaccccttcctttccctcggcaaagctagaaaagacctggaattgaccgtgtttgttttcaaaagggccgtgattctagtctacaaggaaaactgtaagttaaagaaaaagctgccatccaactctaggccagctcataatagtaccgatctggatccattcaagttccgttggctgatccccatctctgccctacaggtgcgcctgggaaacccggcaggtaccgagaacaactctatctgggaactgattcacactaagtcagaaatagaaggcagacccgaaacgatttttcaattgtgctgcagtgacagcgaatccaaaaccaacatcgtgaaggtgatacggtcgattctgcgcgagaattttcggcgacatatcaagtgtgagttgcccctggaaaagacctgcaaagaccgcctggtccccctcaagaacagagtccctgtttcggcgaaactggcctccagccgtagcctgaaggtgttgaagaattcaagttctaatgagtggacgggagaaaccgggaaagggacattgctggactctgacgagggcagcctcagctctggtactcaatccagcgggtgtcctaccgcggaaggacggcaggacagtaaaagcaccagtcccggtaaatacccccatcccggactcgctgattttgcagataacctgattaaggagtcagacatattatccgatgaggacgatgatcaccgtcaaactgtgaagcaaggcagtcccacaaaggatattgagatccagttccaaaggctccgcatttcagaggacccagacgttcacccagaagcggagcaacagccaggcccagagtctggcgagggccagaagggaggcgaacaacccaagctggtgagaggacacttttgccctataaagcggaaggctaattcaactaagcgggacagaggcacactcctgaaagctcagatccggcatcagtcactcgactcccagagcgagaatgccaccatcgacctcaactccgtgctggaaagggagttcagcgtccagagcttaacttctgtcgtgtcagaggagtgcttttacgaaacagagtcgcatggcaagagttag

SEQ ID NO: 28681 - DNA, 579 bp, Artificial Sequence
  Description of Artificial Sequence: Synthetic coding sequence
atgtcccagtgcgcgtgcctcgaggaggtccatctccccaatatcaaaccaggcgaaggccttggcatgtacatcaaatcaacatacgatggcctacatgttattacaggcaccacagagaatgttggatggcagttgaaaaatctggtcaagaagctaagagagaatcccactggagtcgtgctgctgctgaaaaaacggccaaccggttccttcaactttacccccgcaccgctcaagaacctgcgctggaaaccccctctcgtgcagacgagtccaccaccagctaccacacagtcacccgagtcgacgatggacacatctctgaagaaagagaaaagtgctatcttagacctgtatatcccaccacctcctgctgttccatattcccccagagacgaaaacgggtcattcgtatacggtggttccagcaaatgcaagcaacctttgcctgggcctaagggcagcgagagcccaaattcattcttggatcaagagagtcgccgacgtaggtttaccatagcagatagtgaccagcttcccggatacagcgtggagaccaacatcctgccaacgtag

SEQ ID NO: 28682 - DNA, 1668 bp, Artificial Sequence
  Description of Artificial Sequence: Synthetic coding sequence
atggaacctgtaacaaaatggtcaccgaaacaggtagtggactggaccagggggctggatgactgcctgcaacagtacgtgcacaaattcgaacgtgaaaagataaatggtgagcagctcttgcagatctcacaccaggacctagaggagctcggagtcactagaatcggccaccaagagctggtcctggaagccgtggacttattgtgtgcccttaactatggccttgagaccgataatatgaagaacctggtgctgaagcttcgcgcttctagccataaccttcagaattatatcagtagcagacggaaatccccagcttacgatggaaataccagtcgaaaggcccctaatgagttcctaacctctgttgttgagctcattggagcagcaaaggcccttcttgcatggttggacagggccccattcacgggaattaccgacttctccgtgaccaaaaataaaattatccagttgtgtttagatctaaccactaccgtacaaaaagattgctttgtggctgaaatggaggacaaagttctcactgtcgtgaaagtactaaacgggatatgtgacaagacaatccgtagcacaactgatcccgtgatgtcgcagtgcgcctgtttggaggaagttcacttacctaacatcaagcccggagaaggtctcggcatgtatatcaagagcacttacgacggcctgcatgtgatcactggcaccaccgagaattcgcctgccgacagaagtcagaagattcacgccggtgacgaggttatccaggtcaaccagcaaacagtcgtgggttggcagctaaagaaccttgttaaaaagctgcgggaaaacccgacgggtgttgtgcttttgttgaaaaaaaggcccaccgggtcttttaacttcacgcctgccccattaaagaacctgaggtggaagccaccactcgttcaaaccagccctccaccagccacgacccagtccccggagtcaacaatggacactagcctgaaaaaagaaaaatctgcaattctcgatctgtacattcccccaccacccgctgttccatactcgcctagagacgagaatgggtcgttcgtttatggaggcagctctaaatgcaagcaacccctgcccggaccaaagggaagtgagagcccaaactcattcctggaccaggaatccaggaggcggagatttactattgccgatagtgaccagcttccaggctactcagttgaaacaaacattttacccacgaaaatgcgtgaaaaaaccccgagctacggtaagccaagacctctcagtatgcccgcagatgggaactggatgggaatcgtggaccccttcgccagaccacgaggacacgggagaaagggcgaggatgccctgtgtagatatttttccaacgaacggatccctccaattattgaagaatccagttcccctccttacagattctccaggcccacaaccgaaagacacctggtccggggtgcagactatatccggggttccaggtgctacatcaattctgacctacatagcagcgcgacaataccttttcaagaagaaggaacaaagaaaaaaagtggctccagcgccactaaatctagcagcactgagccttctctgctggtgagctggttcaccagactcaagctcctgacacactag

SEQ ID NO: 28683 - DNA, 708 bp, Artificial Sequence
  Description of Artificial Sequence: Synthetic coding sequence
atgcgatctcgcgttttatggggtgccgctcggtggttgtggccgagacgcgctgtggggcctgcacgacgtccactctcaagtgggtcacctcccctggaagaactttttactcggggtgggcctctccgtaccttcctcgagagacaagccggaagtgaggcacatctgaaggttaggcggccagagttgctggccgtcataaaacttctgaatgagaaggaacgtgaactcagagagactgaacacttgctgcacgatgagaatgaggacctgcgcaagctggctgaaaatgagattaccctttgtcagaaggaaattacccaactgaaacaccagatcatcttgttactagtgccatcagaagaaacagacgaaaacgatttgatcctcgaggttaccgctggtgtaggaggcggactccgccacgcttcagcgtctattggaggaagtgaagcttatcgacacatgaagtttgaaggcggagtacaccgagtgcagcgcgtgccgaagacagaaaagcagggcagagtccataccagtacaatgacggtggctattctgcctcagcctacagagattaatttggtaatcaaccctaaggacttgcggatcgatacaaagcgggcaagcggagccggagggcagcatgtgaacacgactgatagcgccgtacgcatcgtgcacctccccaccgattggaagtag

SEQ ID NO: 28684 - DNA, 816 bp, Artificial Sequence
  Description of Artificial Sequence: Synthetic coding sequence
atgcgctccagggtcctttggggcgctgcacggtggctgtggccacgcagggcggtcggcccagccagacgtccgctgtcctccgggtcaccaccgctcgaggagctcttcaccaggggaggcccactgagaacctttctggaacgtcaagcaggtagtgaggctcatttgaaggtgagacgccctgagctactggcggtgattaagttgttaaatgagaaggagagagagctcagggagacggaacatctgctacacgacgagaacgaggacttgagaaagctggcagaaaacgaaatcacactgtgtcagaaggaaatcacacagctaaagcatcagatcatactgttgctggtaccgtccgaggaaaccgatgaaaatgatcttatcctggaggtgaccgctggggttgggggacaggaagctatgcttttcacttcagaaatattcgatatgtatcagcaatacgcagcgtttaagcggtggcactttgagacgctggagtattttccatctgagctgggaggacttcgccatgccagcgcctccataggcggtagtgaggcatatcgccatatgaagtttgagggcggagtgcacagagtgcagcgagtgcccaagaccgaaaagcaaggcagggtccatacttctactatgactgtggcgattctgcctcaaccgactgagatcaatttggtcatcaatccaaaagacttgaggatcgataccaaacgggcaagcggcgctggaggtcagcatgtaaatactactgatagcgccgtgaggatagtgcacctcccaacggactggaaatag

SEQ ID NO: 28685 - DNA, 1143 bp, Artificial Sequence
  Description of Artificial Sequence: Synthetic coding sequence
atgaggtctcgcgtcctgtggggtgctgccagatggctgtggcccaggcgtgcagtagggcctgccagacggccactttcttcaggaagccccccactggaggaattgtttacccggggtggcccactgcgaacgttcctggagaggcaagctggctcagaggcccacctgaaggtccgtcggcctgagctcctcgcagttattaagctcctaaacgagaaagagcgggagttgagggagactgaacacctcctgcacgatgagaacgaggatctgagaaagttagccgagaacgaaatcaccctttgccaaaaagagatcacccagctaaaacatcagatcatactgttgctggtgcctagcgaggaaacggacgagaatgatctcatattggaagtaacagcgggagtcggcggtcaggaggcgatgttatttacgagcgagatctttgatatgtaccagcaatatgcagcgttcaagagatggcacttcgagacactggagtatttcccctcagagttaggcggtttaagacacgcctctgcctcgattggcggaagcgaagcctatcggcacatgaagttcgagggaggagtgcatagagttcagagggtcccaaaaactgaaaaacagggccgagtgcatacaagtaccatgactgttgccatactaccccagcccaccgaaatcaatttggtcatcaatcctaaggatctcagaatcgacactaaaagggccagcggcgctggaggacaacacgtgaacaccaccgactctgccgtgcggattgtgcaccttccaaccggagtggtcagcgaatgtcagcaggagcgcagccaattaaaaaataaggaactagcgatgaccaaactgagggcaaagctgtattcaatgcacctggaagaggaaatcaataagcgccagaacgctcgtaaaattcaaataggcagtaaaggccgatcagagaagatcagaacctataacttcccccagaacagggtcactgatcatagaatcaacaaaactctgcatgacctggagacctttatgcaaggagactacctgctggatgagctagtgcagtcactaaaggagtacgctgattatgaaagcctggtggagataatcagccagaaagtgtag

SEQ ID NO: 28686 - DNA, 3561 bp, Artificial Sequence
  Description of Artificial Sequence: Synthetic coding sequence
atgtgtgaagtgatgcccacaattaatgagggcgatagactgggcccaccccacggagccgacgcagatgccaactttgagcagttaatggtcaacatgcttgacgagcgggagaagttactagaatctctccgcgagtcccaggagactctcgcagccacacagtctaggctgcaggatgctatacatgaacgcgatcagctccagcgccaccttaacagcgccctacctcaggagttcgctacactcactagggagttgtcaatgtgccgggagcagctcttggagagagaggaagaaatttcggagcttaaagccgaaagaaataatacacgactgctcctcgagcatctcgaatgcttggtctcccggcatgagcgctctctgagaatgaccgttgtgaaaaggcaggcacagagcccttctggggtttccagcgaggtcgaggtcctgaaagccttaaagtccttattcgaacatcacaaggccttggacgagaaggtacgtgagcgcctccgcgctgcactggaaagggtcaccacattagaagagcagttagctggtgcacaccagcaagtgtctgcactgcaacagggtgccggagtgagggatggagctgcagaggaggagggcacagtggaattgggtccaaagagactgtggaaagaagatacgggtagggttgaagagttacaggaattgctcgaaaagcagaattttgagctgagtcaggcacgcgagaggctggtcaccctgacaactaccgtcaccgagttagaggaagatctcgggacagctagaagggatctgataaaatcagaggagctgtcttctaagcatcagagggacctgagggaggcactggcccagaaagaagatatggaggaaaggataacaacgctggaaaagagatacttagcagcccagagagaggcgaccagtatccatgatctgaatgacaaactggaaaatgaactggccaataaggagtccctgcaccggcagtgcgaggagaaggccagacacttacaggagctcctggaggttgctgagcagaagctgcaacagaccatgcggaaagcagaaaccttaccggaggtcgaagcagagctcgcccagagaatcgctgcattaaccaaagccgaagagaggcatggtaatatcgaggaacacctccggcagctggagggacagctcgaggagaagaaccaagaactggctagagttaggcaacgcgagaagatgaacgaggatcacaataagagactgtcagacaccgtggaccggttgctgtctgaatctaacgagaggctgcagctgcacctcaaggagaggatggccgctcttgaggagaaaggtaggctgtcagaggagatagagaagctgcgccaggaggtggatcagctcaaaggcagagggggtccttttgttgacggcgtgcatagcagatcacacatgggtagtgccgctgatgttcgcttctctcttggcactaccacgcatgctcctcccggagtgcatcgtcgctacagcgcgctgcgtgaggagtcggctaaagactgggagacttcccccctcccaggaatgttagcacccgctgccggtccagcattcgactctgatcctgaaatttcagatgtcgatgaagacgagccagggggactggtgggctcggccgacgtggtttccccgtccgggcattcggacgctcagacactcgccatgatgctgcaagaacagcttgatgctatcaatgaagaaattcgcatgatacaagaagagaaagaatccactgagctgagggccgaggagatcgagactagggtcacaagcggaagcatggaggcactaaatctgaaacagctccgaaaacggggaagcatcccaacctctctcacggcactatcactcgccagcgcctctccaccgttatctgggagaagcaccccgaaattgacctctcgcagtgccgctcaggaccttgacaggatgggggtgatgaccctcccctcagacctgcggaagcacagaagaaaactgctgtcccccgtgtcccgggaggagaatagggaagacaaggctactatcaagtgtgagacatctcctccgtcttcaccacgtactctgaggctggagaagctcggacaccccgcactgtctcaggaggaaggaaaaagtgccttggaggaccagggatcgaaccccagttccagcaacagttcccaagattccctgcacaagggcgctaagcggaagggcatcaagagctctattggcagattattcggcaaaaaagaaaagggcaggctgatacagctttccagggatggcgctacgggtcacgtcctgctgacagattctgagtttagtatgcaggagcccatggtgccagctaagcttggaactcaagccgaaaaggatcggcgactgaagaaaaaacatcagctgctggaggacgccagaagaaaggggatgccatttgctcagtgggacggcccaactgtcgttagctggttggagttatgggtaggcatgcccgcttggtatgtggccgcatgtcgggctaatgtcaaaagcggcgctatcatgtctgctttgtccgacacagaaatccaaagagagatcgggatctcaaatgcattgcaccgccttaagttgcggctagccatccaggagatggtgagcttgacttcccccagcgctccgccaacctccaggaccagttctggtaatgtgtgggtcacccacgaggaaatggagaccctcgaaacatccacgaagacagatagcgaggaggggagctgggcccagaccctggcgtacggggacatgaaccacgagtggattggtaacgagtggctcccctctctgggattaccccagtatcgatcatatttcatggagtgcctcgtcgacgctcggatgttagaccacttgactaaaaaggatctgcgcgtgcatctgaaaatggtggattcattccaccggacctcattgcagtacgggatcatgtgtctgaaaagattgaattacgatcggaaggagttggagaagaggagagaggaaagccaacatgaaattaaagacgtgctcgtgtggacaaacgaccaggttgtccactgggttcagtccatcggactgagggactatgctggaaacctgcacgaaagtggggtgcatggggctcttcttgcgctggacgagaacttcgatcataacaccttagccctgattttacaaatcccaacccagaatacccaagccagacaggtaatggaacgcgagttcaataatctacttgccttgggcaccgacagaaaactcgacgacggggatgataaagtgttccgccgagccccttcctggcgtaaacggttccggccacgggagcaccacggtcgtggcggtatgttgagcgctagcgccgagaccctgcccgcaggcttccgagtgtcaactctcggcactttgcaacccccaccagcaccccctaagaaaatcatgcctgaagcacacagccactatttatatggccacatgctcagtgccttcagggactag

SEQ ID NO: 28687 - DNA, 1803 bp, Artificial Sequence
  Description of Artificial Sequence: Synthetic coding sequence
atgtcgcgagttgctaaatatcgcaggcaggtaagtgaagaccccgatattgactctttgctggagaccctgagccctgaggagatggaggagctggagaaggaattagatgtagttgatccagacggcagcgtgcctgtcggtctgcgtcagcgcaaccagaccgagaagcaaagtaccggagtttacaaccgcgaggccatgctcaacttctgcgagaaagaaaccaagaagctgatgcagcgcgaaatgtcaatggacgagtcaaaacaggtggaaactaagactgatgctaaaaacggcgaggagagaggcagagacgcctccaagaaggcgttaggtcccagacgagactccgaccttggcaaagaaccgaagcggggtggtcttaagaaatcttttagccgagaccgggacgaggctggtgggaagtctggcgagaagcccaaagaggagaaaataatcagaggaattgacaaagggagggttagagccgctgtggacaaaaaggaggctgggaaggacggcagaggtgaagagcgcgcagtcgcgaccaagaaggaggaagaaaagaagggcagtgaccggaatactggactgtctagggataaggacaagaagagggaagagatgaaagaggtggccaagaaggaagatgatgagaaagtgaagggtgagcgtcggaataccgacacacggaaggagggagaaaaaatgaagcgcgctggagggaataccgacatgaagaaagaagatgagaaggttaagcggggtacaggcaacaccgatactaaaaaggatgatgaaaaagtaaagaaaaacgagccgttgcacgaaaaggaggcaaaagatgattccaagaccaagacgcctgaaaagcagacgcccagcggccctacaaagccttccgagggacccgctaaggtggaggaagaggccgctcctagtatttttgacgagccccttgaaagggtgaaaaataatgacccagaaatgacagaggttaatgtaaacaactcagattgcatcactaacgaaatcctagttcggtttacagaagctctggagttcaatactgtggtgaaacttttcgctctcgctaacactagagccgatgaccacgtcgcctttgcgatcgccatcatgcttaaggccaataagaccatcacaagtctaaacctggactcaaatcacatcaccgggaaggggatattggccattttccgggctctgttacagaacaatacacttacagaattgagatttcacaaccagcgccacatctgtggaggcaaaacagagatggagatagccaagctcctgaaggaaaacaccactctgctgaaactgggctatcattttgagttggcaggacctcggatgaccgtaacgaatctgttgtcaagaaacatggataaacaaagacagaagagattgcaagagcaacgccaggcacaagaagccaagggagagaagaaggacctgctggaagtcccaaaagcaggcgcagtggcaaaggggagcccaaaacctagtccccagccgagccctaaacctagcccaaagaacagcccgaagaagggaggagccccagcggctccgccaccgccacccccacctcttgcacccccattaattatggaaaacttgaagaatagcttgtcgcccgctacccagagaaagatgggagataaagtgctccccgctcaggaaaagaacagtcgggaccagctgctggcagccattcggtcttcaaatctcaaacagttgaaaaaagttgaagtgcctaaactgctgcagtag

SEQ ID NO: 28688 - DNA, 828 bp, Artificial Sequence
  Description of Artificial Sequence: Synthetic coding sequence
atgggcactcggctgcctctcgtgctgcggcaactgcggagaccccctcagcccccaggaccgcctaggaggctgagagtgccttgcagagcaagcagcgggggaggcggagggggagggggaggcagggagggcctgctaggccagcgcagacctcaagatggccaggcaaggagtagttgttctcccggtgggaggacaccagccgctcgagattctatcgtaagagaggtgattcagaactcaaaggaggtactgagcctcctccaggagaaaaatcctgctttcaagccagttcttgccataattcaggcaggcgacgacaatctcatgcaggaaattaaccaaaatctggcggaagaagcaggtctgaatatcactcacatttgccttcctcctgattccagcgaggcagaaatcatcgatgagattctgaagatcaacgaggacacccgggttcacggccttgctctccagatttccgaaaatctgttttccaacaaagtattaaacgccctcaaaccagagaaggacgtggatggcgtcaccgacattaacttgggcaagctggtgcgaggtgacgctcatgaatgcttcgtgtccccggttgccaaggccgttatcgagctgctcgagaaatccggcgtaaacctcgacggaaagaagatcttagtggtgggagctcatgggtcgctcgaagccgctctgcagtgtctctttcagagaaagggtagcatgacgatgagtattcaatggaaaacacggcagctgcaaagtaaaactgaatcacggtcggtcacccgtctggagtgccggagagtgatttag

SEQ ID NO: 28689 - DNA, 999 bp, Artificial Sequence
  Description of Artificial Sequence: Synthetic coding sequence
tgagggagggaggggctactgggtcaacgtcgtcctcaggacggccaagcacgcagttcatgctcgccagggggtcgcacacccgcagctagagatagcattgttcgcgaagtcattcaaaactctaaagaagtcctctccctgctgcaggaaaaaaaccccgctttcaagcctgtcctggcaattattcaggccggtgacgacaatctgatgcaagagataaaccagaacttggctgaggaagcagggctgaacataacccacatatgcctgccacctgattcctcagaggccgaaatcatcgacgagatcttaaaaataaacgaagatacacgtgtacacgggctggccctgcagatctctgagaatctcttcagcaacaaggtgctgaatgcacttaagccagaaaaagatgttgacggtgtcacagatatcaatttgggaaagttggtgcggggagacgcccatgaatgctttgtcagtcctgtggccaaggctgtcatcgagcttctagaaaaaagcgttggagtaaatctcgatgggaagaagattctcgtggtaggcgctcatgggagcctggaggcagccctgcaatgcctctttcagcggaagggcagcatgaccatgtcaatccagtggaaaacgcgccagctccagtcaaaactacacgaagcagacattgtcgttttaggctctcctaagcccgaagagattcccctgacatggatacagccagggacaactgtgctcaattgctcccacgatttccttagtggcaaagtgggatgtggatctccgaggatacattttggtggcctcatcgaggaagatgacgtaatcctgctcgccgctgcgttaaggatccagaacatggttagtagtgggaggcgttggctccgggaacagcagcatagaaggtggaggctgcattgcctgaagctccagccactctctccagtgccctccgatatagaaatcagtcgtggtcaaaccccctag

SEQ ID NO: 28690 - DNA, 2937 bp, Artificial Sequence
  Description of Artificial Sequence: Synthetic coding sequence
atgggcacaaggctcccgctcgtgcttcgccaattgcgcaggccaccccagcccccaggtccaccacggaggttaagagtaccctgtcgggctagtagcggcggaggcggtgggggagggggtggcagagaggggctgctagggcagcggagacctcaagacggccaagcacgctccagctgcagtccaggagggaggacgccggcagcgagggatagcatagtacgcgaagtgatacagaattcaaaggaggtcttgtcacttcttcaggaaaaaaatccagcttttaagcctgttctggctatcatacaagccggagatgacaacctgatgcaggagattaaccagaatctcgcagaggaggctggactgaacatcacccatatctgcctcccccctgactcatccgaagccgaaattatagatgagattctcaagattaacgaggacacccgcgtacacggtcttgcactccagatcagtgagaacctcttcagcaacaaggtactcaatgctcttaaacccgagaaggatgtggacggggtcaccgacattaacttaggtaaactcgtgcgcggagatgcccacgagtgcttcgtatcgcccgtggccaaggccgtgatcgagcttctagaaaagagcggagttaatttagacggaaagaaaatcttagtcgtgggtgcccatgggagcctagaggctgccctgcagtgcctgttccagcgcaagggatccatgaccatgagcatccagtggaaaacacgccagctgcagtcaaagctgcacgaggccgacatcgtggtcctgggatcacccaagcccgaggagatccctctaacgtggatacaacctggtactacagtcctcaactgttcacatgatttcctctccgggaaggttggatgtggcagcccacgaattcattttggaggactaatcgaagaggacgacgtgattttgctggccgcagctctccgaatacagaatatggtgtcctcaggccgaaggtggctgcgcgagcagcaacaccggaggtggcggctgcactgtcttaaactgcaaccattgagtccggttcccagtgatattgagatctcaagggggcagacccctaaagcggtggatgtgttggctaaggagattggcctccttgcagacgagatcgaaatctacgggaagtccaaggccaaggttcgactatctgttctcgaaagattgaaagaccaagcagacgggaaatacgtcctggttgcaggcataacacccacgccactgggtgagggcaagtccacggtgaccatcggactcgtgcaagccctgacagcacatcttaacgtcaatagttttgcatgcctgaggcagccctcccagggccctactttcggtgtgaagggcggagccgcagggggagggtatgcccaagtcatccccatggaggagttcaacctccatctcacaggcgacatacacgcgattacagctgccaataatctattagccgcagcaatagacactaggattctccatgagaacacccagaccgataaggccctgtataaccggttggttccgctcgttaatggggtgcgtgaattcagcgagattcagctggcccgattaaagaagctgggaattaacaagactgatccaagtacgctgaccgaagaggaagtttcaaaattcgcacgtttggatattgaccctagcacaatcacttggcagagggtgctagacactaacgacaggtttctgagaaagatcaccattggacaaggaaacacggaaaaaggccactatcgtcaggcccaatttgacatcgcggtggcatctgagattatggcagtcttagctcttactgatagtctcgccgatatgaaagcccgacttggccgaatggtcgtggcaagtgataagtcagggcagcccgttaccgccgatgacctcggagtgacgggggcattgaccgtcctgatgaaagacgcaatcaaacctaatttgatgcagacactcgaagggaccccagttttcgttcacgccggaccttttgctaatattgcccacgggaatagcagcgtgctagccgacaagattgcactgaaactcgttggcgaagagggcttcgtagtcactgaagccggtttcggagccgatatagggatggaaaaattcttcaatatcaagtgcagagcctctgggctggtgcccaatgtggtcgtgctggtggcaacagtacgcgctctgaagatgcacggtggcggaccatctgtaactgcaggcgttcctcttaaaaaagaatacaccgaggaaaacatccagcttgtcgccgatggctgctgcaacctacagaagcagatacagattacccagctgtttggggtacccgtggtggtcgccctaaacgtgttcaaaacagacacccgggctgagatcgacctggtttgtgagctcgccaaacgagccggtgcatttgacgccgtcccatgttaccattggagtgttggcggaaagggttccgtcgacctggcccgtgctgtgagggaggccgcatctaagcgcagcagatttcagttcctgtacgatgtgcaggtgcctattgtagataaaattagaaccatagctcaggcagtgtatggtgcgaaggacatagaactgtctcctgaggcccaggcaaagattgacaggtacacccaacagggtttcggtaatctgccgatatgcatggcaaaaactcatcttagtttaagccatcagccggacaagaaaggcgtcccaagagatttcatcctgcctatctctgatgtgagggcaagcattggcgcaggattcatctatcctctggtcggaacgatgagcacaatgcccggtcttcccactagaccctgtttttacgacatcgacctggacaccgaaactgagcaggtgaagggactgttttag

SEQ ID NO: 28691 - DNA, 408 bp, Artificial Sequence
  Description of Artificial Sequence: Synthetic coding sequence
atgattcctaacggatatttgatgtttgaggacgagaattttatcgaatctagtgtggctaaactgaatgccctgaggaagtctggccagttctgtgacgtacggctgcaagtctgcggtcacgaaatgctcgcccacagagcggttctggcttgctgctccccttacctctttgagatctttaattctgacagcgatcctcacggcatcagtcatgtgaagttcgacgacttgaaccctgaggctgtggaagtcctgctgaattatgcatacacagcccaactgaaagcagataaggagctagtcaaggacgtctactcagcagcaaagaagctgaagatggatcgagtgaaacagcacctactgtatttctgcctgcactccactagcacaagttctctgctctag

SEQ ID NO: 28692 - DNA, 1929 bp, Artificial Sequence
  Description of Artificial Sequence: Synthetic coding sequence
atgataccaaacggctatctcatgttcgaagatgagaactttatcgagagctcagttgccaagcttaatgcactgaggaaaagcggacagttttgtgatgtgagactgcaagtctgtggccacgagatgctcgcgcacagggccgtgctcgcctgctgtagcccttacctattcgagattttcaattcagactcagatcctcacggaatatcccacgtgaagtttgacgaccttaaccccgaggctgttgaggtgctcctgaactatgcctacacggcacagttgaaagctgataaagaactggttaaggatgtctacagcgcagccaagaagctcaagatggacagagtgaagcaggtgtgcggagactatctcctgagtagaatggacgtgaccagttgtatctcgtatagaaactttgcctcctgcatgggcgacagcaggctactgaacaaggtcgacgcatatatccaggagcacctgttgcagatctcagaggaagaggaattcctgaaactgcccaggctcaaattagaagtcatgctggaggataacgtgtgcctgccatctaacggtaaactctatacaaaagtgattaattgggtgcagaggagtatatgggagaatggggatagtctggaggagctgatggaggaggttcagactttgtactattccgccgatcataaacttctggatgggaacttactggatggtcaggcagaagtgttcggaagcgatgatgatcacatccagttcgtgcagaagaagccacctagagaaaacggccacaagcagatctcctcttcttccacaggctgtctgtcatccccaaatgccacggttcagagtccaaagcacgagtggaagatcgtcgcatccgagaagaccagcaacaacacatatttatgcctggctgtcctagatggcatattttgcgtcatttttttgcatgggcgtaacagcccgcagagctcacccacctccactccaaagctgagtaagtcattgtcctttgaaatgcaacaagacgaactgattgaaaagccaatgagccctatgcagtacgcccgaagcggcctgggaacagctgagatgaatggcaagctaatagctgccggaggctacaatcgcgaagagtgcttgaggaccgtcgaatgctataatccacacactgatcattggtcttttctggcacctatgcgaacacctagggcgaggttccagatggcagtgctgatgggacaactgtatgttgtagggggatccaatggtcacagcgatgaccttagctgtggagagatgtacgatagtaacatcgacgattggatccctgtcccggagctgcggaccaacagatgtaatgctggcgtctgcgctctgaatggcaagctgtacattgtgggtggaagtgatccctacggtcagaaggggctcaagaattgcgacgtgttcgatcctgtgacgaagttgtggactagttgcgctcctctaaatatccgacgccatcagagtgcggtgtgcgaactcgggggttatttatacatcattggtggtgcggaaagttggaactgcctaaatacagttgagagatacaatcccgagaacaacacgtggaccctgatcgcccctatgaacgtggctcgccgaggggctggcgtcgctgttcttaacgggaagctcttcgtgtgtggaggctttgatggctcacacgcaatcagttgcgtcgaaatgtacgatcccactcggaacgaatggaaaatgatggggaatatgacaagcccaaggtccaacgcagggattgctaccgtagggaataccatttacgcggtggggggttttgatgggaacgagttcctcaacacagtggaggtatataacctcgagagtaatgaatggtccccgtacactaagatttttcagttctag

SEQ ID NO: 28693 - DNA, 408 bp, Artificial Sequence
  Description of Artificial Sequence: Synthetic coding sequence
atgagtaaaaataccgtcagttccgcaagatttagaaaggtggatgtggacgaatatgacgagaataaatttgtcgacgaggaagatggtggggacggacaggctggccctgacgagggggaagtggactcttgccttcggcaaggcaacatgaccgccgctctacaggccgcactaaaaaacccccctataaacacaaaaagtcaagcggtgaaggatcgcgcaggctccatagtcctaaaggtgctcattagttttaaagcgaatgacatcgaaaaagctgtgcagagcctggacaagaatggagtggatttacttatgaagtacatttataaaggattcgagagtcccagtgataacagttcagctatgctcttacagtggcatgagaaggtccctctcgtgtag

SEQ ID NO: 28694 - DNA, 849 bp, Artificial Sequence
  Description of Artificial Sequence: Synthetic coding sequence
atggccagttcctttcttcctgctggagcaattactggagactcaggaggggaactgtcctccggggacgactcaggtgaggtggaattcccgcactcccctgaaatcgaagaaacgtcctgcttggcagagctgttcgaaaaggccgctgctcatttacaggggttaatccaggtcgcttctcgtgaacagctgttgtacttgtacgcacgctacaaacaggtgaaggtcggcaactgtaatacgccaaagccttccttttttgatttcgaggggaagcaaaaatgggaggcatggaaggcccttggggacagctcccctagccaagccatgcaagaatacattgctgttgtgaagaagctggatccaggatggaatccgcagatacccgagaagaagggtaaagaggctaacacagggttcggaggaccagtaatcagttctctgtaccatgaggagacgatacgcgaggaggataaaaacatattcgattattgtagggagaataacatagaccatatcaccaaggccatcaagagtaaaaatgttgacgtaaacgttaaggacgaagagggccgagcacttttgcactgggcctgcgaccggggtcacaaggaactagtgacggtcctgctgcaacaccgggcagatattaactgccaggataacgagggacagacagctctgcactacgcctcagcatgtgagttcttggacatagtcgagttgcttcttcagagcggagcagatcccaccctgcgtgaccaggatggctgccttcccgaagaggtcacaggatgtaagactgtgtcccttgtacttcagaggcatacgaccggaaaggcctag

SEQ ID NO: 28695 - DNA, 9353 bp, Artificial Sequence
  Description of Artificial Sequence: Synthetic coding sequence
atgagatccagcaaatcgaaagaggtcccgctccccaatcctaggaactctcagagcaaagacactgtgcaagctgacatcacaacttcctgggatgcactcagccaaaccaaggccgctcttcgacacattgagaataagttggaggtagctcccacgtcaaccgcggtttgcgacagcgtaatggatacgaagaaatctagcacttcagccactcgaaaaattagccgcaaagacggcagatacctcgacgattcttgggtgaatgcccctatatctaaatccactaaatctaggaaggagaagagcaggagtcctttgagggctacaactctggagtcaaacgtcaagaaaaataacagggtggagtttcgcgagccattggtgtcatatcgcgagattcatggcgcaccctccaatttctcatccagtcatctggaatctaaacacgtttactgcgttgacgtgaacgaggagaaaacagaaagcggcaattggatgattggctccagggaggagcggaatatacggagctgcgatttcgagtcctctcagtcatctgtgatcaatgatactgtggtgcggtttcttaatgataggcccgctatcgacgccctgcaaaacagcgagtgcttgatacggatgggagccagcatgaggacagaagaggaaatgcccaacagaacaaaaggctccgagaacaatctgaagctgagcgtgaataatatggctcacgacacggatccaaaagccttaaggctgacggattcgagcccatcttccacttcaaccagcaactctcagcgactagacattctgaagcggagacagcacgacgtgaagctggaaaaactgaaagaacgcatccgcaagcagtgggagcattctgaggagaccaatggccgaggccagaagcttggccacattgaccatccagtcatggtcgtgaatgtagacaattctgtgactgctaaggtgcgaaaggtggctacagcacccccagcacccgcatacaaaggattcaatccctcggagaccaagattcggaccccagatggcaaggtgtggcaagaggcagaatttcagaatatgtcacgggaactctacagagacctggcactgcactttgctgatgatatcagtatcaaggaaaagcctgccgaaaagtccaaggaaaagaaagtagtcaaacccgtgcggaaggtgcagaaagttgctcagctgagtagcactgagtgtaggactggtagtagccacctgattagtaccagcagttggcgtgacgggcagaaactcgtcaagaagatccttggccctgctcccagaatggaaccaaaggaacaaagaacagcatcctctgacaggggcggtagggagcggactgcgaaaagcggcggacatatcggcagagcggagtccgaccctaggctagatgttctgcacagacacctgcagcgaaattccgaaagaagtcgttcaaaatcccgctctgagaacaacatcaagaagcttgctagctcacttccagacaacaaacaggaagaaaataccgctcttaacaaggactttttgccaatcgagatccggggtatactggacgatctgcaactagattctaccgcacataccgctaagcaggacactgtcgagttgcagaaccagaagtcttctgctccagtgcacgcccctcgatcacactcacctgtgaagcgtaaacccgacaaaatcaccgccaacgaagatcctcctgtaattagcaagcggagacactatgacaccgatgaggtcaggcaatacattgttcgccagcaagaggagagaaagagaaaacagaatgaagagaagaaggctcaaaaagaggcgaccgagcagaagaataaaaggttgcaagagttatatagaaagcaaaaagaagcattcacaaaggtcaagaatgtcccgccttccgagcccagcgctactcgaaggctgcaggagacgtattctaaactccttctggagaaaactttgcttgaggaaccaagccatcagcatgtgactcaagagacccaggctaagcccggttatcagccaagcggcgaatccgacaaagaaaataaggtacaagaaagaccaccctcggcttcatcaagttccgacatgagccttagcgagcccccacagcccctggcacggaaagatctgatggagtccacttggatgcagccagagaggctttctcctcaggtgcaccacagccagccccagccctttgccggtaccgcgggaagtctcctgtctcacctactgagtctggagcacgttggtatactgcataaagacttcgaaagcattcttcctactcgaaaaaaccacaatatggcctcccgcccattgaccttcacacctcagccttacgtgacttcaccagccgcttatacagatgcgctgctgaagccttctgcatcccagtataaatctaaactggatcgtatcgaggccttgaaagcgacagctgcctccttgtcctctcgaatcgagagcgaggcaaagaagcttgctggcgcatcaatcaactatggctccgcatggaataccgagtacgatgtgcagcaggcaccacaagaggatgggccatggacaaaagccgtgactccccctgtaaaagatgacaacgaagacgtgttcagcgccaggatccagaagatgctgggctcatgcgtttcccacgctacatttgacgatgaccttcccggagtcggtaacctctccgagtttaaaaagctgcccgagatgatccgtccccagtccgcgatttctagcttccgcgtccgaagcccagggccaaagcctgaagggttgctggcgcagctgtgcaagcgtcagaccgactcgtcttcctccgacatgcaggcgtgctctcaagataaagccaagatctctcttggcagttcaatcgattcagtgtctgaaggaccactgctatccgaaggatcactgtcagaagaagaaggagaccaagacggacagcccctcctgaaggtggctgaaattctgaaggaaaaagaattctgccctggcgaacggaattcctacgaacctattaaagagtttcaaaaggaagccgagaaattcctccccctcttcggccatattggcggaacgcagagtaaggggccatgggaggagctggctaagggcagcccccactcagtgattaatattttcacaaaatcctatcagctgtacggaaaaggatttgaggataagcttgaccggggaacctcgacttcgcggccattgaacgctacagccacaccactgagtggagtgagttacgaagatgacttcgtgtcctcgccaggtacaggcacttcgacggaaaagaagagtacactagagccacactccactctgagtcctcaggaggatcactccaacagaaagagtgcatatgatccgtcatcagttgatgtgacttcacaacattcttcaggagcccaatcggccgcaagttctcggtcctccacctcttcaaagggaaagaagggaaaaaaggagaagaccgaatggttagattccttcactggtaacgttcagaactcactgctcgacgaagagaaggccgagaggggcagtcatcaaggaaaaaagtccggaacgtcctccaagctgtcagtgaaggattttgagcagactctcgacacggactccaccctggaggatctgtctggacactcagtgagcgtctccagcgataagggacggtcacaaaagacaccaacatcgcctctttcccccagctcacaaaaatcccttcagtttgacgtggctggaacctcaagtgaaagatcaaagagttctgtcatgcccccaactattaccggctttaaaccgaacgccccattaactgatctgaatcctgcagcatccaggacgaccacagaaaatatggcacctattcccggatcaaaaaggttcagccccgcaggtctgcaccaccggatggcagcggagctgagctacctgaacgcaatcgaagagagtgtgcggcagttaagtgatgtcgagcgcgtccgcggaataagcctcgcacagcaggagtcggtgtccctagcccagattattaaggcgcagcaacaacgccacgagcgggacctggccctccttaaactgaaagcggagcaggaggcgctcgagtcacagcgccaactcgaagaaacacgcaataaggccgctcaggtacatgcagaatctttacagcaggtcgtgcagtcacagagagaggtaactgaagtgctgcaggaggccacctgcaagatcgcagcccaacagagcgagacagccagactaacaactgacgccgcaagacagatctgtgagatggccgaactgacgcgaactcatattagcgacgctgtggtggcatccggagccccacttgccatcctgtacgatcatcagcggcagcatcttccggattttgtgaaacagctccgcactcgcacagaaaccgaccgcaaatctccttctgtgagtctgtcccagagtaaagaaggcaccttggactcaaagcaccagaagtattccgccagctacgacagctattcagagagctctggctacaaaaatcatgaccgcaggagcagtagcggctcatcccgacaagaatctccatccgtgccctcttgcaaagaaaatgagaagaaactcaatggcgagaaaatcgaatcctcaattgacgaacaggtccagacggcagcagacgacagcctgcgatcagactctgtgccatccttgcctgacgagaaggactcaacttccatcgctacagagtacagcctgaaatttgacgaaagtatgacagaagatgagatagaggagcagagttttcggtccctcctgccaagcgaaagtcacagacggttcaatatggaaaagcgacgaggccatcacgacgattcagacgaggaggccagtcccgagaagacaacactatctacggcgaaagaacttaacatgccttttagtggcggtcaagattcattttcaaaatttaccatggaaatggtccggcagtacatgaaagaagaagagatgcgcgctgcacaccagtcaagtcttcttagactacgcgaaaaagccctaaaggagaaaactaaagctgagctcgcttggctggaacaccagaagaaacaccttcgcgacaaaggcgaagatgacaagatgccaccactgaggaagaaacagaggggccttctgctgcgtctgcagcaggagaaggcagaaataaaaagacttcaggaagctaataaagcggctagaaaagaacgccagctgatcctgaaacagcaggaggaaattgagaagattcgccagaccactattaagctgcaggagaaactaaagtcagccggagagtccaagctggactctcactcagacgatgataccaaagataataaagcaacttctcctggacccactgacctggaaaccagatctccctcacctatttccatttctagcagcgagacctccagcatcatgcagaaactcaaaaagatgcgatcccggatggacgaaaaatttctcacgaagcgcgaacagaagctgatgcagcgcagacagcacgctgaggaattgctcgaatggaagaggcggttggatgcggaggaagcagaaattagacagatggagaagcaggctctggctgcttgggacaaggagttaatcaaaccaaagacccccaagaaggagctagaagatcagcgaactgaacagaaagaaatcgcttcagaggaggagtctcccgtgcccctatactcccacctgaacagcgaatcgtctatccccgaggagcttggcagccccgcagttgagtacgttccctccgaatcaatcggacaggaacagccgggatcccctgaccatagcattctaactgaggaaatgatatgcagtcaagaactggagtcctccacaagtccgtcgaagcacagcttgccaaagtcgtgcacctctgtctctaaacaggagtcatccaaaggcagtcaccggactggcggacagtgtcaccttcccatcaagtcacaccaacactgttacagctggagcgacgagtctctaagcatgacacagagcgaaaccacgagtgaccaatccgacattgagggcagaatccgggcacttaaagatgagctgaggaaacgaaaaagcgtcgttaatcagcttaagaaggaacagaagaaacgccagaaggagcggctgaaagcccaggaggcctcgttgataaaacagctcgagagctatgacgaattcatcaaaaagaccgaggcagagctatctcaggatctagaaaccagccccacagctaaaccgcagataaagaccctgtcttccgccagtgaaaagcctaagatcaaaccactaacgcccctccatagatccgagaccgccaaaaactggaagtctctgacggaatcagagcggtcaaggggcagtctcgagtcaattgctgagcatgtcgacgcttcccttagtggaagtgagagaagtgtgagtgagagaagtttgtctgcgtatgccaaaagagtgaacgagtgggacagcagaacagaggatttccagactccttctcctgtgctgcgcagcagtcggaaaatccgcgaggagtctggtgacagtctggaaaacgtgcccgctctgcaccttctgaaagagctgaatgctacatccagaattctcgacatgtcggatgggaaagtgggagaatcgagcaagaaatccgaaatcaaggagattgagtacaccaagcttaagaaatccaagatcgaagatgctttttccaaggaaggaaagtccgatgtgctgctgaaactggtacttgagcagggcgattctagtgaaatcctttctaagaaagacctgccattggacagcgaaaacgttcagaaagacctagtggggctcgccatcgagaacctccataaatctgaggaaatgctgaaagagaggcagagtgatcaggatatgaaccactcccccaatattcagtcaggaaaggacatccatgaacagaagaacacgaaagagaaggacctgagctggagtgaacacctctttgcacccaaagagatcccgtactcagaagactttgaggtcagctcgttcaagaaggagatttccgcggagctatacaaagatgactttgaggtgtccagcctgctatctctgagaaaagactcccagagctgtcgagacaagccccagccgatgcgttcatccactagcggcgctacgagctttgggtccaatgaagagatcagtgagtgtttgtccgaaaaaagtctctctattcattctaatgtccattccgacaggttacttgagctgaagtcaccgaccgagctgatgaagtctaaggaaagatccgacgtggagcacgaacaacaggtcacagaatccccctctcttgctagtgtcccaacggctgatgagttattcgactttcacatcggggatagggtactgatcgggaacgtccaacccggaattctaaggtttaaaggagagacaagcttcgccaagggcttctgggctggggtcgagttagataaaccggaggggaacaataatggcacctacgacggaatcgcttacttcgagtgtaaggaaaagcatgggatttttgccccacctcagaaaatttcccacattccagaaaatttcgatgattatgtggacattaatgaggacgaagactgttactccgatgagcggtatcagtgttacaaccaagaacagaacgatactgagggcccaaaggaccgcgagaaggatgtgtctgagtacttttacgaaaagagccttcctagcgtgaacgacattgaggcttccgtgaaccgctccaggtccttgaagatcgagactgacaacgtgcaggacattagcggggtactggaggcacacgtccaccagcagagttcagtggattcacagataagcagtaaagagaacaaggatctgatttccgatgcgactgagaaagtttctattgcagccgaggatgacaccctggacaataccttcagcgaggaactcgaaaaacagcaacagttcacggaggaagaagacaatctgtacgcagaggcaagcgagaaattgtgtacaccactcttggacttattgactagagaaaagaatcagctagaagctcaactaaaaagttccctgaacgaagagaaaaaatccaaacagcaactggaaaaaatctccctcctcaccgattccttactgaaggtttttgttaaggatacagtgaatcagctccagcaaattaaaaagactagagacgaaaaaatccagctgtccaaccaggaactcctgggcgacgatcagaagaaggttacaccccaggatttgagccagaacgtcgaagagcaatcacccagcatcagcggctgcttcctgagctccgaattagaagacgagaaggaggaaatctcttctccggacatgtgtccacgccctgagtcccctgtatttggtgccagcggccaggaagagctcgccaagaggctggccgaattagagctgtccagggaatttctaagcgctctcggcgacgaccaggattggttcgacgaggacttcgggctgagtagtagccacaaaatccagaaaaataaggctgaggagacgatcgtcccgctgatggctgagcctaaaagagtcacccagcagccctgtgagaccctcctggcagtccctcataccgccgaggaggtggaaatactggtgcataacgcagcagaagagctgtggaaatggaaagagttaggacacgatctgcactcgatttccatcccgacaaaacttcttggctgcgctagcaagggtctggacatcgaatccactagtaagcgagtctacaagcaagccgtgttcgatttaacgaaggagatcttcgaagagatatttgcagaagacccaaaccttaaccagcccgtgtggatgaagccctgtcgcatcaacagcagctatttccgtagggtgaagaatcccaacaacctcgacgagatcaagtcctttatcgcaagcgaggtgttgaagctgttttcgcttaagaaagagccaaaccacaagaccgattggcaaaagatgatgaagtttggacgtaagaagagggatagggtggaccacatcctggtgcaggaactccatgaggaagaggctcaatgggtgaactacgatgaggatgagctttgtgttaaaatgcagctggcggacgggatcttcgaaacgctgatcaaagacacaatcgatgttcttaatcagatcagtgaaaagcaagggaggatgcttctcgtcta

SEQ ID NO: 28696 - DNA, 2946 bp, Artificial Sequence
  Description of Artificial Sequence: Synthetic coding sequence
atgtctgagcaggagcggattcaggagtgtcttaggaaggagatcagatccttgctaatttctacaaaagatgggctgtcgccacaggaattagagaaagaataccttcttatggtggggaaccacctgccactgcgcattctgggttacagatcaaccatggagctggtgctggacatgcccgacgtggtgagggtttgccctggtgccggaggaaccgtgatattgaaggcaatacctgacgaaagtactaaagggattgcaagcctcgttgctaagcaacgaagttctcataaacttaggaatagcatgcataagggtcgcccttcaatctacagtggcccaaggagccaccgacgtgtgccttatcggggtcgggtggcccctattctcccagccgtcgtgaagtccgaactgaaggacctattagctcttagcccggtgttgttgagcgactttgaaaaagcctttgccaaacgattcggccgaagttttcagtatatgcagtacggatttctatcaatgtttgaggtgttaaacgcagctagcgacgtaatcagcgttgaacagacccgagcagggtccctgttgatgctgaaaaaatcagttacagaggagaaaccgagaggttgccccgctggcaagatatttacacaaccgttcagaatgaaacagggatcctactctacaggcttccctgtcgctaagccgtgtttttcccaaccgacgtccaacatggaacccccaaagcagatcatgagcatggagaaaacaagtaagctcaacgttgtagaaaccagcagactgaatcacaccgagaagttaaatcagctcgagaacactttcaagagtgtgatcgctcagatcggtccaggtggaacaattagtagcgagttaaaacataagatcaagttcgtagtgagcaaatttcccgaagggttgttcatttccaagctactcggggagtacgaggtgattttcaaggagcaactgtcgccaaagaaactggggtttctcaacgtgacagagttggtcggcgcactcagcgacatcctccatgtcgagtttcgaaagggccaccaggacttactcgtttttgatgccgacaaaaagccactcccgcctgtgcagtccgataaaaagatagaagcaaaagcctgcgtttcttcaccacccagaaattctctgtccaccgcggcagtcaaggaaaccgtgtggaactgtcctagtaaaaaacaaaaggagccccagcaaaagatttgcaaaaagcctaacctagtggtgaagcctctccaactgcaagttgaaacaaacaagagcgagctgaaccttgccatggctaaccatgacattccacccgacgctgtgcccaataaaaagctctgcagactgcctcccttagacactagtagtcttatcggagtgttcgtggagtacattatctcgccctcccagttctatatccgcatatattcacgggacagcagtgagttactagaggatatgatgatcgaaatgaggagatgttactccaatcaactggtgagcgataggtatgtgatgccagaatgcttcatccaaccaggacacctgtgctgtgtgcgcatatctgaggataagtggtggtaccgcgtgatcatacaccgggttcttgagaaacaagaggtcgaggtgttttaccccgatttcggtaatatcgggatcgtccagaaaagcagcctccgctttttgaaatgctgctatacaaagctgcccgcacaagcaatcccatgttccctggcctgggtgcggccagtggaagagcactggacaagtaaggccattttgcaatttcagaagctgtgcggcctaaagcctctggttggggttgtggatgaatacgtggatggtattttaaacatctttctctgcgacacttcatcaaatgaggatgtctatttccaccacgtgttacgaacggaaggacatgccatcgtgtgcagggagaatatttcgtccaagggattttcagagcttaatcccctggccctctacacaacatccagtggcggacctgaggatatcgtactgacggagctggggtaccctagccagcagcattatttcaacgaggacaggaagataagtccacagtctaaagaatcagagctgaggattcttgatgagatccccacggggatgccgtgcctggaatcagtgacaataggagacgacatctgggacgaaaattggctgcctttacaggccaagatgggcaagggaggggatgctgcgtcacacctgtttaccgcatcgctgggtggcaaaaatcagtatagttcatgtaaggagatgccccagaaggactggtgctttagcacccctaaagacacgtgggacgatagctggcagccctccggccttgtgaacgggactaaagtggaggtacacaagcccgaggtgctgggagcccaggaaaaaaatactggtactaataggacacagaagcagctcgacattaatggaagctcagatagtagtacgctgcctaagttagaggagttttgtacgagcttgacccagtcagaacagtcagcggatggctcccagagtgaacccaataactctcaaactcaaccaaagcagattcagctttctacagccgctccgtgctccaccacggctgttgatgattcagctgagaaacctagcggctccgttgaatccagccctgagattttaaaaaatgaggactttagcagttctcgcgctatcactctgtataaagataagcggcaggagtctgtggatcagctctccctgattctgagctatgaatgccagatctctcagaaactgtatattcccaggtccaccgccaccgctgctcttggcgcagccgctagactggccacctcccgatctctgttgcattggtatccgagcgtcaaacggatggaggcttag

SEQ ID NO: 28697 - DNA, 648 bp, Artificial Sequence
  Description of Artificial Sequence: Synthetic coding sequence
atgtccgcaaagcgggctgaactgaagaagacccatctggttaaggagagacactgctggaccagcaaaaattacaaagctgtctgcctggagctgaagccggaaccaacaaagacgtttgactacaaagccgtgaaacaggagggccgtttcaccaaagctggggtgactcaagacctgaagaacgaacttcgggaggtcagagaggaactaaaggagaagatggaggaaatcaaacagataaaggatttgatggataaggattttgataaactacatgagtttgtggagattatgaaggagatgcagaaagacatggatgaaaaaatggatatcctgatcaatactcagaagaactacaaactccccctccggagagctcccaaagagcagcaggaactacgcctgatggggaaaacccaccgggaaccacagctacggcctaaaaagatggatggggcttctggagtcaatggagctccgtgtgccttacacaaaaaaacaatggctccccaaaagactaagcaaggctcactggaccctctgcaccactgcgggacctgctgcgagaagtgcctgttgtgcgctcttaaaaacaactacaacaggggcatttacgccgcagtcgggctgctcgacctgtggtag

SEQ ID NO: 28698 - DNA, 606 bp, Artificial Sequence
  Description of Artificial Sequence: Synthetic coding sequence
atgtcagcgaagagagcagagctaaagaaaacccatttatctaagaattacaaggccgtgtgcttggaactaaaaccagaaccgacgaagacgttcgactataaggccgtcaagcaggagggcagattcaccaaggctggtgtcactcaggatctaaaaaacgaattgcgcgaagtgcgggaggagctgaaggagaaaatggaggagatcaagcagattaaggacctgatggacaaggacttcgacaagctgcatgagttcgttgaaattatgaaagagatgcagaaagatatggacgagaagatggacatactgatcaatacccaaaagaactataagcttccattaagaagggcccctaaggaacaacaggaacttcgactcatggggaaaacccaccgggaaccacagctacggcctaagaagatggacggggctagcggggtcaatggtgccccttgtgccctgcataagaagaccatggcaccacagaagaccaagcagggctctctcgaccctcttcatcactgcggtacgtgctgcgtgagtgagaccctgccagaaccttctacaggcgctagacctctcgcaccggctccttggtag

SEQ ID NO: 28699 - DNA, 300 bp, Artificial Sequence
  Description of Artificial Sequence: Synthetic coding sequence
atgagtgcaaaaagagccgagctgaagaagactcacttgagtaagaattacaaggcagtttgcttagaactgaaacctgaacctaccaaagtacggagcccattcgaggcgatgcaagctgccagacctgaaatacacggcgaggtgactcgaagtcagggtagctttgccgaccccagcggccaggacttgagccaaactttcgattataaagccgtgaagcaggagggcaggttcactaaggctggtcggaccccacgcctgctcgaagaactgagcctgcttctgttgccactgtag

SEQ ID NO: 28700 - DNA, 639 bp, Artificial Sequence
  Description of Artificial Sequence: Synthetic coding sequence
atgtccgccaaacgggctgagctaaaaaagacacacctatccaagaactacaaagccgtgtgcctcgaattgaagccagaacccacaaaaacatttgattacaaagccgtcaaacaggaaggtaggtttacgaaggctggagtcacccaggatctgaagaatgagctgcgggaggtccgtgaagaactcaaagaaaagatggaagagattaaacaaattaaggatttgatggacaaggactttgataaactccatgagttcgtcgagatcatgaaggaaatgcagaaggacatggacgaaaagatggacatcctgatcaatacgcagaagaactacaaactccctcttcggagggcgcctaaagagcagcaggaactccgcctgatgggcaagacccaccgcgagccgcagttgcggccaaaaaaaatggacggggcttcaggggttaatggagccccttgcgccctgcataagaagactatggcaccacagaaaactaaacaggggagtctggatcccctacaccactgtggtacgtgttgtgaaaaatgtctcctgtgtgcacttaaaaacaactataacagggcgcagctccagaacctaccagcggtgcccattcatcacctacaggcaccatag

SEQ ID NO: 28701 - DNA, 402 bp, Artificial Sequence
  Description of Artificial Sequence: Synthetic coding sequence
tgatacgaattacgtgaggaacatctcgataagatttttaaacaccgcgaactccagcaaaagttggtggatgctaagctcgagcaagcccaagaaatgatgaaagaagcagaagagcgtcacaagcgggagaaggagtatctgctgaatcaagccgctgaatggaaactgcaagcaaaggtgctgaaggaacaggagacagtgctgcaagcgcaggtcagaccgggtgggagggggatgggcgtgctgtcttctctcagccccgataagaaggccggagccaaaggcggtcaacagaagtcttcctacgtcgccggtgacggagggatggggatagggaatgaagaacagcttcacatctatagctacttccaggtcaagatcaaggcccagtattactag

SEQ ID NO: 28702 - DNA, 687 bp, Artificial Sequence
  Description of Artificial Sequence: Synthetic coding sequence
atggcaagtgaggaattgcagaaagatctcgaagaagttaaggtgctcctggagaaggctacccggaaacgagtgcgggatgccttgacagcggagaaaagtaagatcgaaaccgaaatcaagaacaagatgcagcagaaatcccagaagaaggcagagctgctcgacaacgaaaaacctgcagctgtggtggccccaattaccactggctacacagttaagatttctaactatggctgggaccagagtgataaattcgttaaaatatacatcaccctgacaggcgttcaccaggttccgactgagaatgttcaggtgcatttcactgagaggtcctttgatttgctggtgaaaaacctgaatggtaagtcctactccatgatcgttaataacctgctgaaaccaatctcagtggaaggttcgagcaagaaggtgaaaactgacactgtgctgatactttgtcgcaaaaaagtggaaaacactcggtgggactatctgactcaggtggaaaaagagtgtaaggagaaggagaagccttcttatgataccgaaacagatccttcagagggtctgatgaatgtgctgaaaaagatctatgaggatggtgatgatgatatgaagagaaccatcaataaagcctgggtagaatcaagagagaagcaggccaagggcgacactgagttctag

SEQ ID NO: 28703 - DNA, 558 bp, Artificial Sequence
  Description of Artificial Sequence: Synthetic coding sequence
atgcagcagaagtcgcagaagaaagccgagctgctcgacaacgaaaagcctgctgccgtggttgctccaattacaacgggctacactgtaaagatcagcaactacgggtgggatcagtccgacaaatttgtcaagatctacattaccctaaccggggtgcatcaggttcccactgaaaacgtgcaggtccatttcaccgaacggagtttcgatttactcgttaaaaacttaaacggaaaatcatattccatgatcgtgaacaatcttctgaaaccaatctcagtggagggaagctccaagaaggtgaagaccgataccgtgctgatcctgtgcagaaaaaaggtggagaacaccaggtgggattatctgacccaggtcgaaaaggagtgtaaagaaaaagagaagccctcatatgacacggaaacagatccttctgaggggctgatgaacgtgcttaagaaaatttatgaggacggagatgacgatatgaaacgcacgattaataaggcttgggtggaatctcgggaaaaacaggcaaagggtgatacagagttttag

SEQ ID NO: 28704 - DNA, 1134 bp, Artificial Sequence
  Description of Artificial Sequence: Synthetic coding sequence
atggaacagctacccgatttgcatagccactttagcgacctcaacctggaggctcacatgtatgcctcacagtggttcctgactctgttcacagctaagtttccactctgcatggtgttccatatcatcgatctcctgttgtgtgaagggctcaacatcatttttcacgttgcccttgctctgttgaaaacgtcaaaggaagatctcctccaggccgacttcgaaggtgccttgaaattctttagggtgcagctaccgaagcggtatcgagccgaggagaatgcacggaggcttatggagcaggcttgcaatattaaggtgcctactaagaaactgaaaaagtacgagaaggaataccagactatgcgggagtcgcaacttcagcaagaggatcccatggacaggtataaacgcgagaaccgccgtcttcaagaggcttctatgcgtctggagcaggaaaacgatgatcttgcacacgagctggtgacatctaagattgccttacggaatgacttggatcaggccgaggacaaagcagatgtgctcaataaagagttgctgctgactaagcagaggctggtggaaaccgaggaggaaaaaagaaagcaggaggaggaaactgctcaactaaaggaggtcttccggaagcagctcgagaaagctgagtatgagataaagaagaccaccgctattattgcagagtataagcagatctgttcccagttgtcaacacgtcttgagaaacaacaggcagcctccaaggaggagctggaagttgtcaaagggaagatgatggcctgcaagcattgttctgatattttcagcaaggagggggcactgaaactggcagctacggggagagaagatcagggcattgagacagatgacgagaaagactccctgaaaaagcagctgagagagatggagctggagctggctcagaccaagttgcagttggtagaggccaaatgtaaaattcaggagctcgagcaccagaggggagctcttatgaatgagatccaagccgctaaaaattcctggtttagcaagaccctaaattctatcaagactgctactggtacccagcccctgcagccagcaccagtgactcagccccctaaggaatccacatag

SEQ ID NO: 28705 - DNA, 762 bp, Artificial Sequence
  Description of Artificial Sequence: Synthetic coding sequence
atgatcgagaactcttcgtggagtatgacctttgaagagcgtgagaaccgccgtctccaagaagccagcatgcggctggagcaggagaacgatgatctggcacacgagctggtgacatctaagatcgcactgagaaatgatctggatcaggcagaagataaagcagatgttttaaacaaagagctccttctcactaagcagagactggttgagaccgaggaggaaaagagaaagcaagaggaagagacggcacaactcaaggaggtcttccggaaacagctggaaaaggcagagtacgaaattaaaaaaactactgcaatcatagctgagtacaagcagatctgttcacagctttcaacccggttggagaaacagcaggcggcttccaaagaggaactggaggttgtgaagggaaagatgatggcatgtaagcactgcagcgacatcttctccaaggagggagcccttaagcttgccgcaaccgggagggaggatcagggcatcgagaccgatgacgagaaggactctctgaagaagcagctccgggagatggaactggagctggctcaaacgaagctccaactcgtggaggcgaagtgcaagattcaggagctggagcatcagaggggcgctctaatgaatgaaatccaagccgcaaagaatagctggttctccaaaaccttgaatagtatcaaaacagctaccggcacccagcctctacagccggctcctgtaacccagccacccaaggaaagcacctag

SEQ ID NO: 28706 - DNA, 759 bp, Artificial Sequence
  Description of Artificial Sequence: Synthetic coding sequence
atgggcaagtcttatgatggtcgggcatatgtgatcactgggatgtggaatccaaacgctcctgtgttcttggctttgaacgaggagactcccaaggataaacaggtatatatgacagtagcggtggatatggtggtcaccgaggtagtggaacctgttcgctttctcttggaaaccgttgtgcgcgtgtatcccgcaaatgagcgcttctggtatttcagcaggaagacattcactgagaccttctttatgcgcctcaaacagtcagagggaaagggtcacacgaatgctggcgatgctatctacgaggtagtcagcttacagagagaatccgataaggaagagccagttacgccgaccagtggcggagggcctatgtctcctcaggatgacgaggctgaagaggaatctgataacgagctgtcaagcggaactggagatgtgtccaaagactgtcccgaaaaaatcctgtatagctggggagagttgctgggaaaatggcacagtaacctaggcgctcgccctaaaggactctcaactctcgtgaaatcaggcgtacctgaggcactcagggcagaagtttggcaactgctcgccggatgtcacgacaaccaggccatgctggatcggtaccgtatacttattacaaaggtttgttggtccttactggaggtgcacagtcgaccatgtctgcccggatatcaccaatggaagctgcagaattcaaaatattgtaggatggccaatgttgctgcctag

SEQ ID NO: 28707 - DNA, 2484 bp, Artificial Sequence
  Description of Artificial Sequence: Synthetic coding sequence
atggaagttcgtgcatctctccaaaaagtgagtgggtcgagcgattcggttgcaaccatgaattcagaagaatttgtgctcgtcccccagtatgccgatgataattcaaccaagcacgaggagaaaccccagctgaaaatcgtcagcaacggtgatgagcagctcgaaaaggccatggaagaaatcctccgggactctgagaagcggccatcctccctgttggtcgattgtcaatcttcaagtgagataagcgaccattcatttggcgacattcctgctagccaaacaaacaagccgtcacttcaactaatccttgatccgagcaatacagagatctcaacccctcgcccttcatcccctgggggactcccagaggaggattctgtgctctttaacaagttgacttacttgggctgtatgaaggttagctctccaagaaacgaagtggaggccttgagggccatggcaaccatgaaatcctcctcacagtacccattcccggtgactctgtatgtgcccaacgtgccagaaggctcagtgcgtattatcgatcagtccagtaatgtggagatcgcttccttccctatttacaaagtcttattctgcgcccgaggccatgacgggacaacggaatctaactgcttcgccttcacagagtcatcccatggatcagaagagttccagatccacgtgttttcctgcgaaatcaaagaggccgtctcgcgaattctctattctttctgcactgcctttaagaggagttcaaggcaggtgtccgacgtgaaggattccgtgatcccaactcccgatagtgatgtgttcactttttctgtgtccctggaagtcaaagaggatgacggaaaggggaacttccggttgttagtgatacctatcccatttgaatatttctcccctgtgcccaaggaccgagacaagttctacttcaaactgaaacagggaatcgaaaagaaggtggtgattacagtgcagcaactatccaacaaagaacttgccatcgaacgctgttttgggatgctcctgagtccaggtagaaatgtcaaaaattctgatatgcatcttttggatatggaaagcatgggcaagtcgtatgacggcagagcctacgtgattacgggaatgtggaaccccaatgcaccggtgtttttagcgttgaacgaggagacccctaaggacaaacaagtgtacatgactgtggcagtagacatggtggtgaccgaagtagtggagcctgtaagattcctcctggagactgtggttcgggtatatcctgcaaacgagcgcttctggtacttctctagaaaaacctttacagaaacattctttatgagacttaagcaatccgagggtaaaggtcacaccaacgccggtgatgccatatatgaagtcgtaagcctacagagggagagcgataaggaagaaccagtgactcccaccagcggcggagggcctatgtcaccccaggatgacgaggccgaagaagaaagcgataatgaactgagtagcggaacgggcgatgtgagtaaagattgccccgagaagattctctattcttggggagagctgcttgggaagtggcactccaacctgggcgcacggccaaaaggcttgagtacactggtgaaaagtggggtgcccgaggctctgagggcagaagtgtggcagctcctggcgggatgtcatgacaaccaagctatgctagaccgctatcgtattctcattactaaagattccgcccaggaaagtgtgatcacccgagatatccatcgaacattcccagcccatgactactttaaggacactgggggagatggacaggagagtctgtacaagatttgtaaagcgtatagtgtttacgatgaagacatcggctactgccagggccagtccttcctggctgctgtgctgctcttacacatgcccgaagagcaggccttttgtgttctcgtgaagattatgtacgattacggcttgcgcgatctgtaccggaacaacttcgaggacctacactgcaaattctatcagctcgagagactgatgcaggagcagctccccgacttacacagtcactttagcgatttaaatctcgaggcccatatgtacgcttcccagtggtttctcaccctcttcacagctaaatttccgctgtgcatggtgtttcacatcatagacctcctgctctgcgaaggcttaaacattatctttcacgtcgccctggcgttactgaagacgtctaaggaagatctgttacaggccgatttcgagggcgcattgaagttctttcgggtgcagcttcccaaaaggtaccgggcagaagaaaatgccaggaggctcatggagcaggcctgcaacatcaaggtgcccactaagaaactcaagaagtatgagaaggagtaccagaccatgcgagagtcacagctgcagcaggaagatccaatggaccggtataaattcttctttctatag

SEQ ID NO: 28708 - DNA, 2580 bp, Artificial Sequence
  Description of Artificial Sequence: Synthetic coding sequence
atgggtaacagggaaatggaggagttgattccgctcgtgaatcgccttcaggacgcattctctgccctcggccagtcatgcttgctggaacttccacagatcgctgtggttggcggtcagtccgcgggaaaatccagcgtcctagaaaatttcgtaggcagggacttcctccccaggggatccggaatagtcactaggagacccctggtcctgcagctcgtgacgtccaaagccgagtacgcagagttcttacattgcaaaggaaaaaagttcaccgacttcgacgaagtccggttggaaattgaggccgaaacagaccgcgtgactggtatgaacaagggaattagcagcattccgataaaccttagagtatacagcccccacgtcctcaatctcaccctgatcgatctccccggaatcacaaaagttcccgtcggggaccagcctcccgacattgagtatcaaatacgggaaatgatcatgcagtttatcacaagggagaattgtctcatactcgctgtgacccccgcaaacacggatctggctaacagtgacgcacttaagctggccaaagaagtcgatccacagggtcttaggacaataggggttatcactaagctggacttgatggatgaaggtaccgatgctagggacgttctggagaataagttgctgccacttagacgaggatatgttggggtggtgaacagaagccagaaggacattgatggcaagaaggacataaaagctgccatgcttgccgagcggaagtttttcctgtcccatccagcatatcgccatattgcagaccgcatgggtaccccacacctgcagaaggtgcttaaccagcagctaacgaaccacattagagacactctccctaacttccgtaacaagctgcagggacagctcctttctatagagcacgaagtcgaagcatataaaaacttcaagcctgaggatcccacccgcaagacgaaagccctgctccagatggttcagcagttcgccgttgattttgagaagcgaatcgagggatctggagaccaggtggatacccttgaactgtcaggcggtgccaagatcaaccgtatctttcacgagcggttcccatttgaaatcgtcaagatggaattcaacgaaaaggagctgaggcgggaaatctcttacgccatcaaaaatatccacggaatacgcaccggccttttcacacctgacatggccttcgaggctatcgtgaaaaagcagattgtgaagcttaaaggaccatcgctgaagtccgtagatctggtgatacaagaacttattaatactgtgaagaagtgcacaaagaaattagcaaactttcccaggctgtgcgaggaaacggagaggatcgtggccaaccatataagagagagagagggaaagaccaaggaccaggttctgctcctaattgatatccaggtgagctacatcaacaccaatcacgaagatttcatcggcttcgccaatgctcagcagcgttctagccaggtgcacaaaaagacaaccgtgggaaatcaagttattaggaagggatggttgactatctccaatatcggaatcatgaagggtgggtccaaggggtattggttcgttctgaccgctgagtctctgagttggtacaaggatgacgaagaaaaagaaaagaagtacatgcttcctctagacaatctcaaagtgagagatgtagaaaagtcattcatgtcttcaaaacacatcttcgcactcttcaataccgaacagcgcaacgtctacaaagattatcggtttcttgaacttgcgtgtgattcgcaggaggacgtggacagctggaaggcatccctcctgcgggctggcgtgtaccccgataagtcagtcgcagaaaatgacgaaaacgggcaagcggaaaactttagcatggaccctcagttagagaggcaggtggaaactatccggaatttggtggactcctacatgtctattatcaacaaatgcattcgagacctcatacctaaaactattatgcaccttatgatcaataacgtgaaggacttcatcaacagcgagcttctggctcagctctactcaagcgaggaccagaatactctgatggaggagtccgcagagcaggcgcagcgaagggatgagatgctgcggatgtatcaggccttgaaagaggctctgggcatcatcggcgatatttcaaccgccactgtaagcacacctgcacccccaccagtcgatgatagctggattcaacactccagacgatcaccacctccttcacccaccacccagcgcagacctacgttgtccgcacccctggctagacctacttcagggaggggcccagcgcctgccatacccagtccagggccacatagcggagcccctccagtgcccttccgacctggccctctgcctcccttcccctcttcttctgattccttcggagcgccaccacaagtgccctcgaggcctactcgagcgccaccctcggtcccttcacgccgaccacccccaagccccaccaggcccactatcataaggccgcttgaatcttccctgctcgattag

SEQ ID NO: 28709 - DNA, 1761 bp, Artificial Sequence
  Description of Artificial Sequence: Synthetic coding sequence
tccgagtctttaagttccgccgtctttgttgagggccttaagaggcagggaggatgtgctagacttgaggaggcctgcctatccgaggcaggggaggacctgaccggcgtgcggttcagcctgcccggaaagaacttcccctgtgggtcctcttctagctctagcagatcacggaacagctcttcctctaattccagttcatcctctagtacaaccactacaaccacctcttccagtggagcccaagaccgtatgccagtcctggaaaggtattttcaccctgctgagctgggccgtcggtggactgggccagagggtgtgttgccatcgagtcccggatctcggccaggatgtcagcagggccctctcccctgggatcttccggagatgattcgcatggtaaagctggtatggaaatcaaaatccgaactgcaggcaacgaagcagagaggaatcttagacaacgaggacgcactaagatcttttcccggtgacattaggctaagagggcagacaggtgtacgggctgagaggagagggtcttacccgttcattgattttcgcctcttgaacagtactacatacagcggagaaattggcactaagaagaaggtgaagcggctgctgagtttccagaggtactttcacgcatctcggctcctgcggggtattatcccacaggcacccctccatttactcgatgaagattacctgggccaagcaaggcacatgctttccaaggtaggaatgtgggacttcgacatcttcctgtttgatagacttacaaatggaaactccttagttaccctactgtgccatctgttcaacacgcacggcctaatccaccatttcaagttggatatggtgacactccataggttcctggttatggttcaggaggactaccacagtcagaacccataccacaatgctgtccacgctgctgacgtgacccaggcaatgcactgctatttgaaagaacctaaattggcctcattcctaacccctcttgacatcatgctgggcctcctcgctgccgctgcacacgacgtcgaccatccaggtgtgaatcagcctttcctgataaaaactaatcatcatttggccaatctgtatcagaacatgtccgtgctggagaatcaccactggcgaagtaccattggcatgttgcgggaatcaagattattggcccatcttcccaaagagatgacgcaggacatcgaacagcagcttggaagtctgatactggctaccgacatcaaccgccagaacgaattcctgacccggctgaaggcacacttgcataataaagacttacgactggaggatgcacaggaccgccactttatgctacagattgcgctgaagtgcgcagatatatgcaacccttgcaggatttgggagatgtccaaacagtggtcagaaagggtatgcgaagagttctacagacagggagagctggagcagaagttcgaattagaaatttcgcctctgtgcaatcagcagaaggactccatcccaagtattcagattggcttcatgagttatattgtggaacctctcttcagagagtgggcacacttcactgggaatagcaccctgagtgaaaatatgctggggcatctcgcacataataaggctcagtggaagagcttactcccaagacaacacagaagcaggggctcttccgggtccggaccagaccacgatcacgccggacagggcaccgagtctgaagagcaagaaggggattccccatag

SEQ ID NO: 28710 - DNA, 525 bp, Artificial Sequence
  Description of Artificial Sequence: Synthetic coding sequence
atgactacaaaaaatctggaaactaaagtcaccgtcactagctctcccattcgcggagcaggggacggtatggagacagaggagccaccgaagtctgtcgaggtgactagcggagtgcagtcccgcaagcatcactccctgcagagtccctggaagaaagccgtccccagtgagagtcctggcgtcttacagctggggaagatgttgacagagaaggccatggaggttaaggcagtgcgaattttggtaccaaaggctgctataacccatgacattcccaataagaacacgaaagttaaatctctaggtcaccataagggagaattcctcgggcagtcagaaggagtcattgagccaaacaaggaactctccgaagtgaaaaatgtactcgaaaagcttaagaattccgagaggagactgctccaggataaggaaggactctccaaccaactaagagtccagactgaggtgagacgcgctctcattgataaaatgagcaccaccctctatgtctggactttctag

SEQ ID NO: 28711 - DNA, 1203 bp, Artificial Sequence
  Description of Artificial Sequence: Synthetic coding sequence
atgacaacgaagaacctggagaccaaagtgaccgtcacttcctcgcccattcggggtgctggcgatggcatggagaccgaagagccaccgaagtccgttgaggtgacaagcggcgtccagagtcgtaagcaccacagcctacagagtccctggaagaaggctgtgccatccgagagcccgggtgtgctgcagctcggaaaaatgcttaccgaaaaggctatggaagtaaaagctgtgcggatcctggtaccaaaagccgctattacccacgacattcccaacaagaacactaaagtaaaaagtctcggccatcataaaggggaatttttggggcagtctgagggagtgatagagcctaataaggagctgtcagaggttaagaatgtgctcgagaaactgaaaaatagtgaaaggaggctgctccaggataaggagggcctgtcaaatcagctacgtgtccagaccgaggtcaaccgagaattgaaaaaactcctcgtggccagtgtaggagatgatctccagtaccacttcgaaagacttgctagggaaaaaaaccagttgatcttggagaacgaagccctggggcgaaacaccgcacagctgagcgaacagttggagcgcatgagtatccaatgcgacgtctggcggagcaagtttcttgcttctcgagtcatggccgatgagctgacgaattcaagggctgctctccagcgccaaaaccgggacgctcatggcgctattcaagatctgttgtctgagagagaacaattccgacaggagatgatcgcgactcaaaagctactggaagaactgctggtttccctgcagtgggggcgtgagcagacatattctccttccgtccagccacattccaccgcggagctcgccctgacaaaccacaagttggccaaagctgttaactcccatctcctcggtaacgtgggaattaacaaccagaagaagatcccttctaccgtggaattctgttccactcccgcagaaaaaatggcggaaaccgtcctcaggatcttggaccccgtgacctgtaaagagagctcacctgacaaccctttcttcgagagcagccccactaccttgctggctaccaagaaaaacataggcagatttcacccctatacaaggtacgaaaacatcacatttaattgctgtaatcactgtagaggagaactgattgcactatag

SEQ ID NO: 28712 - DNA, 276 bp, Artificial Sequence
  Description of Artificial Sequence: Synthetic coding sequence
atggatgccgacagtgatgtggcgttagatatactgattaccaatgtcgtttgtgtgttccgcactcgatgccacctcaaccttaggaagatcgccttggaaggcgctaacgtaatttacaagcgggatgttgggaaagtgctgatgaagttgcgcaaaccaagaatcaccgccactatatggtcttcaggcaagataatttgtaccggtgccacctctgaggaagaggctaaattcggagctaggaggctggcgaggtccctccaaaagctttag

SEQ ID NO: 28713 - DNA, 492 bp, Artificial Sequence
  Description of Artificial Sequence: Synthetic coding sequence
atggatgcagatagtgatgtagctctggacatcctgataacaaatgtggtgtgcgtatttaggacacggtgccatctgaatctgcgtaaaatagcgctcgagggcgcaaatgtgatttataaaagagacgtgggtaaggttctcatgaagcttcgcaaacctaggattacggcaactatttggagcagcggaaagattatttgtacaggggctaccagcgaggaggaggcaaaattcggggcacgcagattggctcggtctctgcagaaactcggattccaggtaatttttaccgattttaaagtggttaacgtactcgccgtgtgtaacatgccttttgaaatcaggctacctgagtttacgaaaaataataggccacacgcctcctacgagcccgaattgcatcccgcagtgtgctaccggatcaaaagcctgagagccacactgcagatcttttccaccggctctatcactgttacaggaattctctag

SEQ ID NO: 28714 - DNA, 1023 bp, Artificial Sequence
  Description of Artificial Sequence: Synthetic coding sequence
atgcttgaagctccaggccctagtgatggatgtgagttgagcaaccctagcgcttctcgcgtatcgtgcgctggacagatgctggaagtccagcccggtctgtacttcggtggggcagccgctgtcgcagagcctgaccatctgagagaggctggcattacagccgtcctgaccgttgactccgaggagccatccttcaaggctgggcctggcgtcgaagacctctggcgtctgtttgtccccgctttggacaaacccgaaacagatctgctgagccacctcgatcggtgcgtggcctttataggccaagcgagagccgaggggagggctgtattggtgcattgccacgctggtgtcagcagaagcgtcgctattatcacagcttttcttatgaagactgatcagttgccattcgaaaaagcctacgaaaaactgcagatcttaaagccagaggccaagatgaatgagggattcgaatggcagctaaagctttatcaggcgatgggctatgaggtagacacaagcagcgcaatctataaacagtataggctgcagaaggtcacagaaaagtatccagaactccagaaccttccccaggagctcttcgctgtggacccgactacggtcagccaaggcctaaaggacgaagtactttacaagtgtagaaagtgcagacgctcactattcagatcctccagcatcctcgaccacagggaggggtcaggccctatcgcatttgcacacaagcgcatgactccctcaagtatgttgacaacaggaagacaggcccagtgcacgtcatatttcatcgagccagtgcagtggatggaaagtgcccttttaggtgtcatggatggtcaactgctttgcccaaagtgctcggcaaaactcggcagctttaattggtacggagaacagtgcagttgcggtcgctggataacaccggctttccagatccacaagaaccgggtggacgaaatgaagattttaccagttttgggctctcagacagggaaaatctag

SEQ ID NO: 28715 - DNA, 807 bp, Artificial Sequence
  Description of Artificial Sequence: Synthetic coding sequence
atgtggcccctgactgccttgctcttgctggctaccctggaaaagccaatcctaagccttcatcccccatggaccactatcttcaagggcgagcgcgtcaccctgaagtgtgatggataccacccattgctgctcgaactccagcccatcagtaccctttggtacctggggcatttgctcctgcccagccacaagaaatccattgaagtgcagacacccggtgtttaccgctgtcaaaccaggggagcgcctgtgtccgacccgatacatctgtccgtgagcaacgattggctcattctgcaggtcccgtacgccccagtgttcgagggtgagcccttggtgcttcggtgtcggggttggtatgataaggtcgtctacaagctgcattactaccacgacggccaggcagtgcggtacttccactcatcggccaactatactgttctgcaggccagggcgagtgacagcggtaggtaccagtgttccggcacaatgcggattcccgtggaatccgcaccgatgtttagcgccaaagtggccgtcaccgttcaggaggccaggcacgctgcagcagtccgcgttctgcaggtccaaccccgaggtgcacctctgaggctgggacgtagggtgcatagtcccggtgcgagaggacgcggagccaggattgtgctggtgcggggtggctacaggcacccgcagtgtcctgaaacgcaaagtgtggctgctgctcccggagcaggtttctcccccggacccggtttacatcaccggccatcctccatggggcgatctctagggtcctggtag

SEQ ID NO: 28716 - DNA, 936 bp, Artificial Sequence
  Description of Artificial Sequence: Synthetic coding sequence
atgtggcctctgaccgctcttctcttactggctaccctggagaagccgatactgtcacttcatccgccttggactactatctttaagggcgagagagttaccttgaagtgtgacggataccatcctctgctattggaattgcagccaatttccactttatggtaccttggccacctgcttcttccttctcacaaaaaatccatagaggtacagactcccggagtctaccgctgccagacaagaggcgcaccagtgagtgacccaatacacctgagtgtatctaacgactggttaattctgcaggttccctatgccccagtgttcgagggcgaaccactggttctgcggtgtagggggtggtatgacaaagtggtttacaagttacattattaccatgacggccaagccgtgagatattttcattcttctgctaactacaccgtgttacaggccagggccagcgactccggtcgataccagtgcagtggaactatgaggattccagtcgagtctgccccaatgttctcagccaaggtggccgtcaccgttcaggcagcaagatgcgccgcatcaaccggggctcctagtacacagtctcgaagtcccaggagccggtccagtaacaggacgggggctcgcagactgccccctcctgccgtgagcggaaacgccgtcaggggctgcagtagccgtggccgtgttttaccttggacaaggccgcctccacctccgcagcttcacggtccccagccctggttactggtgatcgggcgattcccgtctgagagccccaggtgtcctgataggtctcggtggagccctccttctggaactccacctcctccgggttgtagctctagacgggcagcccctcgccttaggggtcatccccctgcacttagaagaaggccgtggaacaaccgcttagagccctag

SEQ ID NO: 28717 - DNA, 957 bp, Artificial Sequence
  Description of Artificial Sequence: Synthetic coding sequence
atgtggccgctgacagctctgctcctattggtcccatcatccggacaggccgcaacactcgagaaacctattctgtccctgcacccaccctggaccaccatcttcaagggcgaacgggttacactgaaatgcgacggataccaccctctccttctggaactccagccgatttctaccctgtggtatctcgggcacctacttctgccgtcacacaagaagtccatcgaggtgcaaacacctggtgtatacaggtgccagacccggggagctcccgtcagtgacccaattcaccttagtgtatcaaacgattggctaatccttcaggtgccttatgcccctgtctttgaaggcgaacctctcgtgctccgttgcagaggctggtatgacaaggttgtatacaagctccactattaccacgatggacaggctgttcgttactttcattctagcgcaaattacaccgtcctccaggcccgagcctcagatagcggtcggtaccagtgttcaggaacaatgaggatcccagtggagtctgctccgatgttctctgccaaagtcgccgtcactgtgcaagctgcccgatgtgcagcctcaacaggggcaccgtcgactcagtctcgatccccacgcagccgtagcagcaaccgcaccggagccagaaggttacctccaccagctgtaagtggaaatgccgtgcgcggatgctcatccaggggaagagtgctgccctggactcgtcccccacctccaccccagctgcacggcccacagccttggcttctcgtgatcgggagattccctagtgaatctccacggtgcccagatcgttcacggtggtctcctccatccggaacgccccctcctccaggctgctcaagtcggagagcggcaccaaggctccgcggacatccacctgccctaaggagacgaccctggaacaacaggctggaaccatag

SEQ ID NO: 28718 - DNA, 1281 bp, Artificial Sequence
  Description of Artificial Sequence: Synthetic coding sequence
atgtggccattgaccgccttgttacttctagtgcctagtagtgggcaggccgcaacactagaaaagccaatactgtcacttcatccgccatggacgactatcttcaagggggagcgtgtgacactcaagtgcgatggctaccatcctctgctgctggagctgcagccaatttctacactctggtacctggggcatctgcttctgccaagccacaagaagtcaattgaggtacaaacacctggcgtgtataggtgtcagacaaggggcgctccagtaagtgaccccattcatctgtccgtcagtaacgattggctcatcttacaggtaccttatgcccctgtatttgaaggagagcctctcgttttgcggtgtcgcggttggtacgacaaggtggtgtacaagctgcactactaccatgacggccaagccgtgcgctattttcacagcagtgcaaactatactgtgctccaggcacgtgcctctgactctgggcgttatcaatgttctggcactatgagaattcccgtggagagtgcccctatgtttagcgcgaaggtggccgttacagtgcaggaactgttcagggcccctgtgcttcgtgtgatgggcccaagagaggccagaggcgctgccttgggaggcgtagtcttaagatgcgataccaggctgcacccccagaagagagacacacccttacagtttgccttctataaatactctcgtgctgtgagacggttcgactggggagctgagtatacggtcccagaacccgaagtcgaagaattggagtcctactggtgtgaggccgcaaccgcaacccgttccgtaaggaagcggtcaccatggctgcagttacctgggccaggtagcccactggacccggcttcaacaacagcccctgccccatgggcagccgctctcgccccaggcaatagacctttatcattccggaaaccaccggtgtcccgctccgtccccttagttacttcggttagaaacaccacgtcaacagggctccagtttcccgcttccggtgcgcctaccgctggtcccccagcctgtgcccctcctacacctctcgagcaatccgccggagctctcaaacccgatgtcgatttgctgcttcgagagatgcagctgttaaaagggcttctgtcccgcgtagtcctggagctcaaagaaccccaggccctgcgggagctgcgtggaacacctgaaacgcccacttctcacttcgcggtgtctccgggaacccccgagacgaccccagtcgaaagttag

SEQ ID NO: 28719 - DNA, 369 bp, Artificial Sequence
  Description of Artificial Sequence: Synthetic coding sequence
atggccggaggctgtagagcaccctctagcgctcccactgtaagtctgcctgagctacggtcactactggcctccggcagggccaggctctttgatgtcaggtccagggaagaggcagcagcgggtaccatccccggagctttgaacattcctgtctcggagcttgagtctgccctgcagatggagcctgcagcattccaggcactgtacagcgccgagaagcctaagctggaggacgagcatctggtgttcttttgccagatgggaaagaggggactccaggccactcaactcgccagatctctgggctacaccggcgcaagaaactacgcaggagcttatcgcgagtggctggagaaagagagctag

SEQ ID NO: 28720 - DNA, 225 bp, Artificial Sequence
  Description of Artificial Sequence: Synthetic coding sequence
atggctggcgtgtcagagctggaatcggccctccaaatggaacccgctgcttttcaggctctctatagcgccgaaaagcccaagttggaggatgagcacctggtattcttctgccagatgggcaaaaggggactgcaggccacgcagcttgcacggtcattaggatatactggagcccgtaactacgccggtgcctatcgggagtggctggagaaggagtcctag

SEQ ID NO: 28721 - DNA, 1794 bp, Artificial Sequence
  Description of Artificial Sequence: Synthetic coding sequence
atgtcaagcaaagggtcctccacagacgggaggaccgacttggcaaacgggtcactttcaagctccccagaggaaatgtctggcgcagaggaaggcagggaaacttcatctggaatcgaggttgaagcctcggatttaagccttagcttgaccggagatgatggcggaccgaaccggacctccaccgaatcccgtgggacagacacagagagcagtggcgaggacaaggattcggattcaatggaagatacgggacactacagtatcaacgatgaaaatagggtgcatgatagaagcgaggaggaggaagaggaagaagaggaggaggaggaggagcagccacgacgaagggtccaaaggaaaagagccaatagagatcaggattctagtgacgacgagcgggctctggaggactgggtatccagtgaaacctccgcccttcccaggccacgatggcaggcacttccggcactgagagaaagggaactcgggagcagcgctcggtttgtgtacgaagcgtgtggggcacgagtatttgtacagagatttagattacagcatgggctggagggtcacaccggctgcgtaaacaccctgcattttaaccagcggggaacatggctggcttctggttcagatgatctgaaggtagtagtgtgggactgggtccgtcgccagccagtcctggactttgagtcaggccataaatcgaacgtgtttcaggctaagtttcttccaaacagcggcgactccacattggcaatgtgcgcaagggacgggcaggtccgcgtcgcagaacttagtgcaacccagtgttgtaaaaatactaagagggtagcccagcataagggagcctcacataaactggctctggagccggattctccctgtactttcctctctgcaggggaggatgccgtggtattcacaatagatctgaggcaggatcggcctgcctctaaattggttgtgaccaaggagaaagagaagaaagtgggtctttacacaatctatgtgaaccccgcaaatactcaccagttcgccgtgggagggagagaccaatttgtaagaatttatgatcagcgcaagatcgatgagaatgagaataacggggtccttaagaagttttgcccccatcatctggtcaattcagagagcaaggccaacattacttgtctcgtgtacagccacgatggaactgagttacttgcctcctacaacgacgaagacatctatctcttcaactcctcccattcagatggcgctcagtacgtaaagagatataagggccaccgcaacaacgccactgtgaaaggagtgaacttctatggacccaagtctgaattcgtggtctctggaagcgactgtggccacattttcctgtgggaaaagagctcctgccagattattcagtttatggagggagacaaggggggagttgtaaattgccttgagccccaccctcacctcccggtactcgcgaccagcggactggaccatgacgtgaagatttgggcgccaaccgctgaggcctcaactgagctgacgggtctgaaggacgtcatcaagaagaacaagcgggagagggacgaagattctctgcatcagaccgacctgttcgactctcacatgctgtggttcctgatgcaccatctgagacagcggagacaccatcggaggtggcgagagccaggcgtgggcgctaccgacgccgattccgacgagagccctagcagcagtgatacgagcgacgaggaagaaggacccgatcgcgtccagtgcatgccttcttag

SEQ ID NO: 28722 - DNA, 1794 bp, Artificial Sequence
  Description of Artificial Sequence: Synthetic coding sequence
atgtcttctaaaggatcatctacagacggtaggaccgatctggcaaacggttcgctttcttctagtcccgaagaaatgtccggggcagaagaaggacgggagacctccagcggcatcgaggtcgaggccagtgacctttccctttcgctgaccggagatgatggcggtcccaacaggacaagtaccgagagccgtggaactgacaccgaatcctctggagaagataaagacagcgattccatggaagatactggccattatagcatcaacgatgaaaaccgggtgcacgatcgatctgaggaggaggaagaggaagaagaggaggaggaggaagaacaacctcgtcgcagagttcagcgaaaacgtgctaatcgagatcaagattccagcgacgatgagagagcattggaggattgggtctcctcagagacttccgccctgccacggccaaggtggcaggcactgccagctctcagagagcgtgagctaggtagttcagctcgtttcgtgtacgaagcatgcggagcacgagtgtttgtacagcgctttcggttacagcacggactggagggtcacacaggctgcgtcaatactctacacttcaatcagcgcggtacctggttagcgagtggatctgacgatttgaaggtggtggtatgggactgggtccggaggcagcctgtgctggacttcgagagcggacataagtccaacgtgtttcaggcgaaatttcttcccaactctggagactcgacattggctatgtgcgcacgggatgggcaagtgcgcgtggctgagctgtctgccactcaatgttgtaagaacaccaaacgggtggcacagcacaaaggagcgtcccacaagctggccctagagcccgactcgccctgtacattcctgagcgcgggtgaagacgcggtggtatttactatagacctgcggcaggaccgtccagcttccaagcttgtggtaaccaaggaaaaggaaaagaaagtaggtttatacacaatctatgtcaaccctgccaacacccatcagttcgcagtcgggggtagggatcagttcgtgcgtatctacgatcaaaggaagatcgatgagaatgaaaataacggagtgctgaagaagttctgcccacatcatttggtgaacagtgagtcaaaggccaacattacatgcctcgtttatagccacgacggaaccgaactgcttgctagctataacgacgaagatatttaccttttcaatagctctcattctgatggcgcacagtacgtcaaaagatacaaagggcacaggaataatgctacagtgaagggcgtgaatttctatggacccaaatctgaatttgttgttagcggatccgattgcgggcatatattcctctgggagaaatctagttgtcagataatccagtttatggagggtgataagggaggggtcgtgaactgtttagagccccatcctcatctgcccgtgctggcaaccagcggccttgaccacgacgtgaagatctgggcccctaccgctgaagcctctaccgagctgacaggactcaaagacgttataaagaagaataaaagggagcgtgacgaggacagcttgcatcaaacagaccttttcgacagccatatgttgtggttcttaatgcaccatctgagacaacggaggcatcacaggagatggcgtgagcccggagtgggcgctacggacgctgatagtgacgagtcacccagctctagcgatacctctgacgaggaagaggggccagatcgtgttcagtgtatgccctcatag

SEQ ID NO: 28723 - DNA, 453 bp, Artificial Sequence
  Description of Artificial Sequence: Synthetic coding sequence
atgggcgtccagccccctaacttttcatgggtactgcctgggcgattggccggactggccctgcccagattgcccgcacactatcaattcctgttggatctgggggttaggcacctcgtgagtctaacagaacgcggtcctcctcacagtgattcttgtccaggcctgacactgcataggctgcggattccagatttctgtccccctgcccctgatcagatcgatagattcgttcaaatcgttgacgaggccaatgctagaggggaagcggtgggcgtccactgtgccctgggcttcgggagaacaggaactatgctggcgtgttatctggtaaaggagcggggattggccgctggagatgcaatagctgagattagacgattgcggccaggctccattgagacatacgaacaggaaaaagccgtgttccaattttaccagcggacaaagtag

SEQ ID NO: 28724 - DNA, 453 bp, Artificial Sequence
  Description of Artificial Sequence: Synthetic coding sequence
atgggtgtccagcctcccaactttagttgggtgttacccggacggctggctggcttagccctccctcggttaccggcacattaccaatttctgcttgatctgggcgtgaggcacctggtgagtctgacagaaagagggcctccacattctgacagctgcccgggactgacactgcatcggctgcgcattccagacttttgcccacctgccccagaccaaatcgaccgattcgtgcaaatcgtggatgaagccaacgctaggggcgaggccgtgggtgtccactgcgctctcggcttcgggaggaccggcacaatgctggcctgctaccttgtcaaggagaggggccttgccgcaggtgatgcgattgccgagatacggcgtctgagacccggttcaattgagacgtacgagcaggaaaaagcggtgtttcaattctaccagaggacaaaatag

SEQ ID NO: 28725 - DNA, 453 bp, Artificial Sequence
  Description of Artificial Sequence: Synthetic coding sequence
atgggggttcagccacccaattttagttgggttctacccggtcggctagctgggcttgctcttcctagactgccagcccattaccaatttctcctggacctcggagtccgccatcttgtctctcttactgagagaggacccccacacagcgattcatgccctgggttgactctccataggcttcgcattccagatttctgccctcccgctccggatcagatcgatcgattcgttcaaattgttgacgaggctaatgcaaggggtgaagccgtaggagtgcactgcgccttagggtttggcaggacagggaccatgctggcttgttacctggtgaaagagagaggattggccgctggggacgccatcgctgaaattcgtcggcttcgcccagggagcattgagacgtacgaacaggagaaggccgtgtttcagttttaccagcggacaaaatag

SEQ ID NO: 28726 - DNA, 4866 bp, Artificial Sequence
  Description of Artificial Sequence: Synthetic coding sequence
atggagggatgcatgggggaggagagctttcagatgtgggagctgaacagaaggctagaagcatatcttgcccgagtcaaggcattggaagaacaaaatgagctgctgtccgctgaactggggggtctacgggctcagtctgctgacacaagctggagggcccacgcggacgatgagctggcggcattgagggcgctggtagatcagcggtggcgggagaaacatgccgctgaggttgcgagagataacctggctgaagaactcgagggggtagcaggacgttgtcaacagcttagactggccagagagagaactaccgaggaggtggctcgtaatcgaagggccgttgaagccgaaaaatgcgcaagagcatggctttccagccaggtcgccgaattggagcgcgagctggaagctctgagagttgcccacgaggaggaacgcgtgggccttaatgcccaggctgcctgtgctccccgatgtccagctcctccccgtggacctcctgctcctgcccctgaggtggaggagctggcacgaagactgggagaagcctggcgcggagctgtcagaggctaccaggaacgtgtggcccatatggagacatcactgggacaagctagggagcggcttggacgggctgtgcaaggggcaagggaaggcaggttggaattacagcagttgcaggccgagcgtgggggattactagaacggagggcggcattggagcaacgtttagagggtcggtggcaagaaaggctccgagctacggagaaattccaactagcggttgaggcgctggaacaggaaaaacagggccttcagagtcagatcgcccaggtccttgaagggcgtcagcagctggcacacttgaagatgagccttagtctggaggttgccacctaccgcactttattagaagcagagaattcccgtttacagacacccggaggcggaagtaagactagtttatcatttcaggacccaaagttggagcttcagttcccccgaacgcccgagggtagaaggctgggctccctgctgccagtgctttccccgacctccctcccatcccccctgcccgcaactttagagacccccgtgcccgctttcctgaaaaatcaagaattcttgcaggcaaggacgccaacacttgcttctactccaatcccacccacaccccaagcaccctctccagccgtcgatgcagaaatacgcgctcaggacgccccattgtctctgctccagacccaggggggacggaagcaggcccctgagcccttaagggccgaagcccgtgtggcaatcccagcaagcgtactacctggtcctgaagaacctggcggacagcgccaggaagcgtcaacaggccagtccccggaggatcacgcaagcttggcccctcctctgtccccagaccacagttctctcgaggccaaagacggggaatcaggaggcagtcgggtattcagcatctgtcggggtgaaggggaaggccaaatttggggtttagtggagaaggagacagccattgaggggaaagttgtcagttcactgcaacaggaaatttgggaggaagaggatttgaaccgcaaggaaattcaggactctcaagttccattggagaaggaaacccttaagtccttgggagaggaaattcaggaaagtttgaagacattggagaaccagtcgcatgagacgctcgaaagagaaaatcaggagtgtccaagaagtctggaggaagacttggagaccttgaagtcacttgaaaaagagaataaagaactgctgaaggatgtggaggtggtcaggccccttgaaaaggaagctgttgggcagctgaaacctaccggcaaagaagatacccaaaccctgcagtccttgcagaaagaaaaccaagaactcatgaagtcccttgagggcaacctggagacattcctctttcccggaacagagaatcaggaactagtcagttcacttcaggaaaaccttgaatccctcacggccctggaaaaggagaaccaggagccgcttaggagcccagaggtaggagatgaggaggctctgcggcctctcacaaaggagaatcaggaaccattacggtcattggaggatgagaataaggaggcattcaggtcacttgagaaagagaaccaggagccattaaaaaccctcgaggaagaggaccagagtatcgtgaggccacttgagactgagaatcataaaagcctcagatcattggaggagcaggatcaggagacgttgcggacactcgagaaggagactcagcagcggagacggagtctcggtgaacaggatcagatgacgctccgcccacctgagaaagtggacctagagccgcttaaaagccttgatcaagagatcgctaggccccttgaaaatgaaaatcaggaatttctcaaatctctaaaggaggagtcagtcgaggcagtaaaatctctcgagacagaaatccttgaaagtctgaaatccgccggacaggagaacttagagactcttaagagtccagaaacacaagcaccattatggaccccggaagaaataaatcagggcgcaatgaaccctcttgagaaggagattcaggaacccctggaaagtgtggaggtcaatcaggaaaccttccggttgctggaagaggaaaatcaagagagtctgcggtctctgggagcatggaacctagagaatctcagatccccagaagaggtagataaggagagtcaacgcaacctggaggaagaagaaaatctcggcaaaggagagtatcaggaatctctgcggtcattggaggaggagggtcaggagctgccacagagcgcagatgtgcagaggtgggaagatactgtagaaaaggatcaggagctcgcccaggagagtccgcctgggatggccggagtcgagaatgaggacgaagcagaactcaatttacgagagcaagatggtttcacaggaaaggaggaggtcgtggagcagggcgagctgaatgcgaccgaagaagtgtggatccctggcgaaggtcatccagaaagtcctgagcccaaagagcagcgcggtttagttgagggtgcttcggtgaaaggaggagccgaaggtttacaggaccctgagggacagagccagcaggtgggagctcccggtctccaggcacctcagggccttcccgaggcgattgagcccctagtagaagacgacgtcgcacctggtggcgaccaggcctctcccgaggtaatgctggggagcgagccagctatgggcgagtctgccgcaggagctgagcccggtcctggccagggggtggggggtctcggcgatcctggacacctgactcgagaggaggttatggaacccccactggaagaggaatccttggaagccaaaagggttcaggggctggaaggccctcggaaggatctggaggaagccggtggactcggtactgaattctccgagctacccggaaaatccagagatccgtgggagccccctcgcgaaggaagggaagaatcagaggccgaggctccaagaggcgcagaggaagcattccctgccgaaactttggggcacacaggatctgacgccccatctccgtggcccttgggctctgaggaggccgaagaagatgttccccctgtccttgtgtccccctcaccaacctacacgccgatcctcgaggacgcgccagggcctcagccacaggccgagggctctcaagaggcttcatggggcgtccaaggcagggctgaggctcttggcaaggtggagagtgaacaggaggaactgggcagcggcgagatccctgagggacctcaggaagagggagaagagtcccgggaggagagcgaggaagacgaactgggagagaccctcccggactccacccccctgggcttttacctgcggagtccaacctcaccacgatgggatccaacaggagagcaacgccctcccccacagggtgagaccggcaaagaaggatgggatccggcagtgctggcctccgagggcctggaggctcctccatctgaaaaagaagagggtgaagaaggagaggaagagtgtgggagagactcggacctgtctgaagagttcgaagacctgggaaccgaagccccatttctgccaggcgtgcctggggaggtcgccgagccactcggtcaggtcccccagctgttgctggacccagccgcttgggatcgtgatggcgagtcggacgggtttgccgatgaagaggagtctggtgaagaaggagaggaagatcaggaggagggccgagaacctggtgctggcagatgggggccagggagtagcgtcggctcgctgcaggcccttagctcatcgcagagaggcgagttcctcgaatccgattccgtgtctgtctccgtcccttgggatgacagcctacgcggtgccgttgccggagcacccaaaacagctctggagaccgagagccaggatagcgctgagccgagcggttcagaagaagaaagcgaccctgtttcactggagagggaggataaggtgccgggacccttagagatcccttccggcatggaagacgcaggaccaggggctgatatcattggagtgaacgggcaagggccaaaccttgaagggaagtctcagcacgtcaatggcggtgtcatgaatggattggagcagtccgaggaggtaggacagggcatgcccctcgtctctgaaggggatcgtggatcaccttttcaggaggaagaaggcagtgcactgaaaacgagctgggctggggcaccggtgcacctggggcaggggcagttcttgaaattcactcagcgtgaaggcgacagggagtcttggagctctggtgaagactag

SEQ ID NO: 28727 - DNA, 378 bp, Artificial Sequence
  Description of Artificial Sequence: Synthetic coding sequence
atggagcggcatactagtcatcctaatcgaaaggtgccggcaaaggaagaggcaaatgccgtaccgttatgtcgggcaaagccctcaccgagctatatcaatctgcaggccagttctccaccagccacatttctgaatatacagaccaccaaactgccttccgttgatcacaagcccaaggaatgtctgggactgctagaatgcatgtacgctaacctgcaactccagacacagctggcccaacagcagatggccgttctggaacacctgcaggcttcagtcacccagctagcccctggacgaggctcgaacaattccagcttacccgcactctccccgaaccctctgctcaatcacttgccacaattctctaagtag

SEQ ID NO: 28728 - DNA, 378 bp, Artificial Sequence
  Description of Artificial Sequence: Synthetic coding sequence
atggaacgacacaccagccaccccaatcgcaaggttccagcgaaggaggaggccaatgcagtcccattgtgcagagcaaaacctagtcccagctacatcaacctccaagcctctagccctccagccactttcctcaatattcagacaacgaagttaccatcagtggaccacaagcctaaggaatgcctcggattgcttgagtgtatgtacgctaacctgcaactccaaacccagctcgcgcagcagcaaatggcagtgctggagcacctgcaggccagcgtaacacagttagccccagggcgtggctcaaataatagcagcctgccagctctgtctcctaatcctctgctcaaccacttgccgcagttcagcaagtag

SEQ ID NO: 28729 - DNA, 378 bp, Artificial Sequence
  Description of Artificial Sequence: Synthetic coding sequence
atggagaggcatacatcccaccccaataggaaagtcccagccaaagaggaagcaaacgccgtccccctttgcagggctaaaccttctccttcgtacattaatctgcaggcctcctctccaccggctacctttcttaatatacaaaccacgaagctgccctctgttgatcacaaacctaaggaatgtcttggcctgctggagtgcatgtacgctaatctccagctccagacccaattggctcaacagcagatggctgttctggaacacctgcaagcaagcgtgacccagctggccccaggacgagggtccaacaactcttctctccccgcactatcgcccaatccccttttaaatcatctccctcagttctccaagtag

SEQ ID NO: 28730 - DNA, 378 bp, Artificial Sequence
  Description of Artificial Sequence: Synthetic coding sequence
atggagagacacacatcacaccccaatcggaaggtgcccgcaaaggaggaggccaatgccgtccccctgtgcagagcaaagccaagcccaagttacattaatctgcaagctagcagtccacctgccacctttctgaacatccagaccaccaaactgccgtccgttgatcataaacccaaggagtgccttggactgcttgagtgcatgtatgctaacttacagcttcagacccagctagctcagcagcaaatggccgtgctcgagcatctacaggcttccgtgacccaactcgcgccaggcagaggtagtaacaacagtagccttccagctctatccccaaacccactgttgaaccacctcccccagttttccaagtag

SEQ ID NO: 28731 - DNA, 378 bp, Artificial Sequence
  Description of Artificial Sequence: Synthetic coding sequence
atggagcggcacacgagccacccaaatcgaaaggtacctgccaaggaggaggcaaatgcagtgccactctgccgggcaaaaccatctcccagctacataaacctccaggctagctcccctcccgcaaccttcctgaatatacagactactaaactgccttccgtggaccataaacctaaggaatgcctggggttgttagagtgtatgtatgccaacctgcagttacaaacacaattggctcagcagcaaatggcggtacttgagcatttgcaggctagcgtgacacagttggcccctggcagaggctctaataacagctctttgccggctctgagtcccaatccgcttttaaatcatctgccccagtttagtaaatag

SEQ ID NO: 28732 - DNA, 624 bp, Artificial Sequence
  Description of Artificial Sequence: Synthetic coding sequence
atggccgaggcgtctagtgccaacctcgggagtggctgtgaggagaagcgccatgaaggctcgtcatcagaatcagttccccctggtactaccatcagcagagtaaagctgctagataccatggtagatacctttttgcagaagctggtggccgcaggctcaagcccgcttctgcactgggacggctccgcgggaccacgccttccctcaggtggtcagagtgtgaagcaggcattctcctgggccgcttgcaggctcccacagggcagaaaggaagagatctccgacatcaaggaggagggaaatctggaagccgtcctgaacgcactggacaagattgtggaggaggggaaagtgcggaaagaacccgcttggcgaccttccgggattccagagaaagatctccactcagtcatggccccttactttttgcagcaaagagacactttgaggagacacgtgcaaaaacaagaagccgaaaatcagcaactggctgacgctgtgttggccggacgccgtcaggtcgaggagctgcaactgcaggtccaagcacagcagcaggcctggcaggcccttcaccgcgaacaacgtgagctggtcgccgtcctgcgcgaaccagagtag

SEQ ID NO: 28733 - DNA, 618 bp, Artificial Sequence
  Description of Artificial Sequence: Synthetic coding sequence
atggccgaggcctctagcgcaaacttggggagcgggtgcgaggagaaacggcatgagggctcctctagcgaatctgtacctcctggcactaccatatccagagttaagctgctggatactatggtggacacctttcttcagaagcttgtggccgctgggtcctaccagcggttcactgattgttataagtgtttttaccagctgcagccagctatgactcagcaaatatatgacaaatttattgcccagttgcagacttccatcagagaagagatttctgacattaaagaggagggcaacctcgaggcggtcctgaatgccctcgacaaaatagttgaagaggggaaggtacgcaaagagccagcctggcgcccatccgggatacctgagaaagatcttcactccgtaatggcaccttacttcctgcagcagcgtgacactctaagacggcatgttcagaagcaggaagctgagaatcagcagttggccgacgccgtcctggcaggcagacgtcaagtagaagagctgcagttacaggtgcaggcccagcagcaggcatggcaggccctccaccgtgaacagagagaactggtagcggtgctgcgcgaacctgagtag

SEQ ID NO: 28734 - DNA, 543 bp, Artificial Sequence
  Description of Artificial Sequence: Synthetic coding sequence
atggcagaggccagcagcgccaaccttggaagtggctgtgaggagaaacgccatgaaggttcaagctctgaatccgtgcctcccggaaccaccatcagccgagtgaagctgctagacaccatggtcgacacattcctgcaaaaactggtcgctgcaggaagttaccagcgtttcactgattgctacaagtgtttctatcagctgcagcctgctatgacccaacagatctacgataagtttatagcccaactgcaaacatctatccgggaagaaatctcagacattaaagaagagggtaacctggaggctgtgctcaacgctctcgacaaaattgtcgaggaggggaaggtgagaaaggagccagcttgcaacggtaccccatgtggcgcaatgtgtagaaacaggcgccctcggaccagcagttggcagatgccctcctggcagggcggtggaaggtggaggagctgtagttaccgtagtaggccgtcttcccggcctgggcgactatacaccgagaacagaggaagttggctgctgtgctag

SEQ ID NO: 28735 - DNA, 2253 bp, Artificial Sequence
  Description of Artificial Sequence: Synthetic coding sequence
atggaggatcttttcgaaacgtttcaagatgaaatgggcttctccaatatggaggacgacggaccagaggaggaggagagagttgctgaaccccaggccaactttaatacacctcaagccctcagattcgaagagttactggccaaccttctgaacgaacagcatcagatagccaaggaactgtttgagcaactgaagatgaaaaagccatctgccaaacagcagaaggaggtcgaaaaggttaagccccagtgcaaggaagtgcatcagacactgatcctggatcctgctcaacgaaaacgcctccagcagcaaatgcagcagcatgttcagctgcttacgcagatccatttgctggccacatgtaaccccaatcttaatcctgaagcgagcagcacccggatctgcctcaaggagctgggaacgttcgcccagagcagcatcgcccttcaccaccaatataaccctaagttccagaccttatttcaaccctgtaatttgatgggtgccatgcagctcattgaagactttagcacacacgtaagcatcgattgtagcccacacaagacggtgaagaaaaccgctaacgaattcccgtgtcttcctaaacaggtggcctggatcctcgcgacatcaaaagtgtttatgtaccctgaactcctccccgtgtgctcactaaaggctaagaacccacaagacaaaatcctttttaccaaggccgaagacaatctactggccctgggtctgaaacattttgagggcaccgagttcctgaatcccctgattagcaagtacctgctgacatgcaagactgccagacaactgaccgtaaggattaagaacttaaacatgaaccgagccccagataacatcataaagttttataagaagacaaaacagctgcctgttctgggcaagtgctgcgaggagatccagccccatcagtggaagccccctatcgaaagagaggagcatcgccttcctttctggctgaaagcctcgttgcccagcattcaggaggagttgaggcacatggcagacggtgcaagggaagtcggcaatatgaccggtaccacggagattaactccgaccaggggcttgagaaagacaattccgagctgggtagtgagacacgatatccactgctgctgccgaaaggcgtggtactgaaactcaaacctgtggccgataggttccccaagaaagcttggcgacagaagcgaagctctgtacttaaaccactgcttatccagcctagtcccagccttcagccatcatttaacccgggaaaaaccccagcccaatccactcatagcgaagcccctccttcgaagatggtgctgcgaattccgcatcccatccaacctgcgacggtgctccagacagttcctggagtgccacccctcggagtcagcgggggagagagctttgagagccccgcagccctccccgctatgccccctgaggccaggacctccttccccctctctgaatcccaaactctcctgtcctcagctccagtacctaaggtgatgatgccaagtcccgcttcctcaatgttcagaaagccttacgtccgaaggcgcccatctaagcggagaggcgctcgtgccttcaggtgcatcaaacccgcaccagtgatccaccccgcttctgtgatcttcacagtgcctgcaacaacagtgaaaatcgtgtccctgggcggaggctgtaacatgattcaacccgtgaatgccgcagtggcacaatcgccacagactatccctatcgctactcttctggttaaccctacttcatttccgtgccctttaaaccaacccctggtggcctcaagcgtttcaccactgattgtgagcggcaacagtgttaatttacctattccaagcacccctgaggacaaagctcatatgaacgttgatatcgcatgcgccgtcgccgatggagaaaatgcctttcagggtcttgaaccaaaactggagccccaggagctgagcccattgagtgccactgtattccctaaggtggagcacagccccggacctcctcctgtggacaagcagtgtcaggaaggcctgtcagagaactctgcatatcgatggacggtggtgaaaaccgaagaaggaagacaggctctagagcctctcccgcaggggatacaagaatccctaaacaactcatctccaggcgatctggaggaggtggtgaagatggaaccagaggacgccactgaggaaattagtgggtttctatag

SEQ ID NO: 28736 - DNA, 2667 bp, Artificial Sequence
  Description of Artificial Sequence: Synthetic coding sequence
atggccggagtcgggaggagtggcggaccatggggtcggaccagaggaggaagatctgggcgtttgggggtctcactcggagcgctgtcatcacttcccctggaggaattaccacgcccactgtgttgccgaagatgccggcgacattttgggttcgccctgcggggagagactattccagtatcagttgcgggaagtgcttctagtcagttcgcccctctggcactgcatctgagcctgcttctttctaggattagtgcatccaggctaacaaggtggcctcccccagacaaaagagagggttcagctgtcgaccccggaaaacgaagaagccttgccgctacacctagctcctccctcccttgtacgttgatcgccctgggtctgaggcacgagaaggaggccaacgaactgatggaggatctcttcgagacttttcaggacgaaatgggattctctaatatggaagacgatgggccagaggaagaggaacgcgtggccgagccacaggccaacttcaatactccgcaagccctgaggtttgaggagttactcgctaacctgctgaatgaacaacaccagattgccaaagagctttttgaacagctgaagatgaaaaagccctctgcaaagcagcagaaggaagtcgaaaaagttaagccacagtgtaaagaggtacaccagaccttgatcctggatccggcacagcgcaaaaggctccagcagcaaatgcagcagcatgtccaattgctgacacagatccacctgctcgccacgtgcaatcctaaccttaacccagaggcttcgagcacacggatctgtctcaaagaactgggcacctttgcccagtcaagtatcgccctgcatcatcagtataacccaaaatttcaaactctcttccagccttgcaaccttatgggagcgatgcagttgattgaagacttctccacccacgtgtctatcgactgcagccctcacaagactgtgaagaaaactgcaaatgagttcccgtgtctccccaagcaggttgcctggattttggctaccagtaaggtattcatgtacccagaattactgcctgtgtgtagcctcaaagccaaaaacccccaggataaaatcctcttcaccaaagcagaggataacttgctggccctgggcctaaagcacttcgaaggcaccgaattcttaaatccgctaatatctaagtacctgcttacctgtaaaaccgccagacagttgactgttagaattaagaatctaaacatgaaccgcgcaccagacaatatcataaagttctataaaaaaacgaagcagctgcctgttctcggaaagtgttgcgaagaaatccagccacaccagtggaagcccccaatcgagcgggaggaacatcggctacccttttggctcaaagcatccctcccctcaatacaagaagagctgaggcacatggccgatggggcaagagaagtcggtaatatgactggcaccactgagattaattcagatcaaggtttggagaaagacaacagtgagctgggctccgaaacccgctatccgttactcctgcctaagggcgtggtgctcaagcttaagccagttgccgatcggttccccaagaaagcctggcggcagaagcgatcctccgtgctgaaacccttgttgatccagcctagccctagcttacagcctagctttaacccagggaaaacaccagcgcagtctacacatagcgaagccccacctagcaagatggttcttagaattccacatcctattcagcctgccacggtgctccagaccgtgcccggtgtacccccactgggtgtgtctggtggcgagagcttcgagtctcctgccgcactgcctgctatgccccctgaagcacgtaccagttttcccctctccgagtcacagactctgttgagttcagcccctgtgcccaaagtaatgatgccaagccccgcatccagtatgttcaggaaaccttacgtgagacgcagaccctcgaagaggagaggggctagagctttcagatgcatcaagccagctccggtgattcacccagcctccgtgatctttactgttcctgcgacgaccgtgaaaatagttagccttgggggagggtgtaatatgatccaacctgtgaatgccgcagtggcacaatcacctcagaccatacccatcgctacactgctagtcaatcccacgagcttcccctgtcctctgaaccagcctctcgtcgcatcctctgtgtcgcctctgatcgtgtctggtaactcagtcaatctgccgatcccttcaacgcccgaggataaagcacacatgaatgttgacatcgcctgcgccgttgcggatggagagaatgcctttcagggcctggagccaaagttggaacctcaggaactgtctcctctttctgcaacagtgttccccaaagtcgaacactcacccggacctcccccagtggataaacagtgtcaagaagggttaagtgaaaactcagcttatagatggaccgtggtcaagaccgaagagggcagacaggcactcgagccgctcccccagggcatccaggaatcactgaacaatagcagtccgggagatcttgaggaggtagtcaagatggagccagaggatgcaacagaagagatcagcggttttctctag

SEQ ID NO: 28737 - DNA, 2607 bp, Artificial Sequence
  Description of Artificial Sequence: Synthetic coding sequence
atggccggtgtaggccgttctgggggtccatggggccgaacacgtggaggaaggagcggaaggctcggggtgtccctgggcgctctgtccagtttaccgctggaagaactccctcggccactgtgctgcaggcggtgccgtcgccactttggatttgcactgcgaggcgaaacaattcccgtgagtgtggccggtagtgcttcgtcacagttcgccccactcgctctgcatttgagtctgttgctgtcccggatctctgccagtagactgacccgctggcctccaccagacaagagggaaggctcagctgtcgatccaggcaagaggaggtctctggctgctaccccttccagctcactgccatgcacccttattgccttgggtctgcggcatgagaaggaggcgaatgaattaatggaagacttgtttgagacctttcaagatgaaatgggcttcagtaatatggaggacgatggtccagaggaggaagagagagttgcggaacctcaggccaacttcaatactccgcaggctctccgtttcgaagagctgttagctaatctgctgaatgaacaacatcagatagctaaggagctgtttgagcagctgaaaatgaaaaagccatccgccaagcagcagaaggaggtcgagaaggtcaaaccccagtgcaaggaggtccaccagaccctgattcttgaccccgctcagagaaagaggctgcagcagcaaatgcagcagcatgtacaacttctgacacagatccaccttctcgctacatgcaatcccaatctcaatccggaggcgtcatctactcgcatctgcctgaaggaattaggcacttttgctcagagtagcatcgccctgcaccaccagtataacccgaagtttcaaactttattccagccctgcaatctgatgggggctatgcagctaatcgaggatttttctacacacgtgagcattgactgttccccacacaagactgtaaaaaagacagctaatgagttcccctgcctgccaaagcaggttgcgtggatcctggccacctccaaggtgtttatgtatccagaactgcttccagtctgcagtctcaaggccaaaaatccccaggataagatcctgtttacaaaagccgaggacaacaagtacttactgacgtgcaaaacagcacgacagctgactgttcgtattaaaaatctgaatatgaatcgcgctcctgataacattataaaattctataaaaagaccaaacagttgcctgtgctagggaagtgttgcgaggagatccagccccaccagtggaagccccctattgaacgggaggagcatcgccttcccttttggctcaaagctagcctcccttccatccaggaagagctccgacatatggccgacggggcaagagaagtgggcaatatgacaggaacaaccgagatcaattcagaccagggcctcgagaaagataacagtgagctgggaagcgaaaccaggtatcccctgctgctgccaaagggggtcgttctaaagctcaaacctgttgccgacagatttccgaaaaaagcatggcgccagaagaggtcatctgttttaaagcctttactgatccagccttcaccttctcttcagcctagcttcaacccagggaaaacccccgctcagtcgacgcattccgaggcccctccgtccaagatggtgctgaggataccccatccaatacagcccgcaactgtgctgcagacagtgcccggtgttccacccctcggggtctccggaggcgaatccttcgagtcccctgctgctctacccgcaatgcccccagaagcaaggacttctttcccactgtcagaatcccagacactcctctcttccgcccctgtgccaaaagtgatgatgccgagccctgcgtcttccatgttccggaagccctatgtgaggcggcgtccctccaaaaggaggggagctcgcgcttttcggtgcattaagccagcccctgtgatccatcccgcatctgtgattttcaccgtgcctgccacgactgtgaaaatcgtaagccttgggggagggtgtaacatgatccagcccgtgaatgcggcagtggcccagtctcctcagaccattccaatcgctactttgttggtcaaccccacatcgtttccctgtcccctgaaccagccactcgttgcgagctctgtcagccctttgattgtgtccgggaacagcgtgaacctgcccataccctccacacccgaagacaaggcccacatgaatgttgacatcgcgtgtgcagtggctgacggggaaaatgcctttcaggggctggagccgaaactggaacctcaagaactgagccccctgagcgcaactgtcttccccaaagtggagcactcaccaggtccaccacccgtggacaaacagtgccaagaggggttgagcgagaatagtgcctacaggtggacggtcgtcaagactgaagagggcagacaggcactggaaccgctgccccagggtatccaggaaagtttaaacaattctagccccggagaccttgaggaggtggtgaagatggaacccgaagatgctaccgaggagataagtggatttctttag

SEQ ID NO: 28738 - DNA, 1575 bp, Artificial Sequence
  Description of Artificial Sequence: Synthetic coding sequence
atggccggaggagcccgagaggtgcttacattgcagctcggacactttgctggctttgtgggggcacattggtggaaccagcaggatgctgctctgggacgagccactgatagcaaggagccgcctggagaattatgccctgatgtgctgtaccggacgggaaggactctgcacgggcaggaaacatacacccctcggcttatcctgatggatctgaaaggctctctgtcttcgctgaaagaagaaggcggactctatcgggataagcagttggacgccgctattgcctggcagggcaaactgacaacccacaaaggaagtagtccattgcccaccgctaccacacctaaacctctcatacccaccgaggcatccatccgcgtatggagtgactttctaagagtccatctgcacccgcgaagcatctgtatgattcagaagtataaccatgacggcgaagctggccgtctggaagcttttggccagggggagtcagtcctaaaagaaccgaaataccaagaagaactggaggaccgtttacacttctatgtggaggagtgcgactacctacaaggcttccagatactatgtgatctacacgacggattttctggcgtgggtgctaaggctgctgaactgctgcaagacgaatatagtggtagggggatcatcacatggggtctgctccctggaccttatcacagaggggaagcacagcgaaacatttataggttattgaacaccgcctttggattagtccatttaactgcacacagcagtctggtgtgccctctgagtctgggcggttccctgggactcagaccagaaccccctgtcagctttccctatctacactacgatgcaaccctgccttttcactgttccgccatcctcgccactgcgctggacactgtcacggtaccatacaggttatgctcgtctcccgtttctatggtgcacctggccgatatgctttcattttgtggaaaaaaggtggtcaccgcgggtgccattattcctttccctcttgctcctggtcaatcattgcccgatagtcttatgcagttcgggggtgccactccgtggactcctttgtcagcttgcggcgagccctctggaacacgatgctttgcccaatctgtggtgttacgaggaatcgatagggcatgccacactagccagctgacgcctggaacccctcctccttccgcgctgcatgcttgtacgactggggaggaaattctggcacagtatttacagcagcaacagcctggcgtcatgagctcctcccacctccttctgactccctgccgggtcgcgcctccgtacccccaccttttcagcagctgtagtccgccagccgtagaatcaattcccgtattcggcgctctctgcagttcttcctcacttcaccagacactcgaggcccttgcacgggatcttacaaaattagacctccgtagatgggcttcgttcatggatgcaggcgtggagcacgacgatgtagctgagctcctacaagaactgcagtctctcgcccagtgttatcaaggtggggactcactagtagactag

SEQ ID NO: 28739 - DNA, 1479 bp, Artificial Sequence
  Description of Artificial Sequence: Synthetic coding sequence
atgcccccaacctgtagccctgggctcaggcgacaagactgggcgcctggcaggtgtgctggactgcatctacctccacgggctccatccagtcctgcactccaggccctagccggacaggccggagtaaggtcatcctggtcctttgccggtgtgccaggggctcagaggctgtggatggccgaggcccaatcaggtaccggtcagcttcaagagcagaaaaagggcctccttatagcggtgtccgtgtctgtggataagattatcagccattttggtgccgctcgaaatctggtgcagaaggcccagctaggggactctcgtctctcacctgatgttggacacctggtgcttaccaccctctgtccggcattgcatgctttagtggcagacgggctgaaaccatttcggaaggacttaataactggccagcggagatcttccccatggtctgtcgtggaggcaagtgtgaaaccgggaagtagtacccgatcgctaggcaccctttattcccaggtcagtagattggccccactctcctcttcaagatctcgcttccatgcgtttatcctggggttgttgaacactaagcagcttgaactgtggttttcatcccttcaggaggacgcgggactgctgtcccttttgtatctgcctacaggatttttctctttggcgagggggggatgccctagtcttagtaccgaattattgttgctgctgcagcctctgtccgtgctgacattccatctggatctgctcttcgaacatcatcatcatctccccctcggaccgcctcaggccccagctccacccggtccaccacccgctctccagcagacaatgcaagcaatgctccatttcgggggacggctggcccaatcactgcgcggtaccagcaaggaggccgcatcagatccatctgactctcctaacctccctacacctggcagttggtgggaacagttgacacaggccagccgtgtatatgctagcggtgggactgaaggttttccgctaagcagatgggccccaggcaggcatggcactgctgccgaagagggtgcccaggagcgcccactgcccaccgacgagatggccccaggaaggggcctctggcttgggaggctgtttggagtgcctggcggtcctgcggagaacgagaacggcgctctgaaatccagacgtccttcaagctggttgcctcccaccgtgtctgttctcgctttagtgaagaggggtgcgccaccagaaatgccttccccccaggaattagaggccagtgcgcctagaatggtccaaactcaccgtgccgttcgggctctctgtgatcatactgcagcccgaccagaccaactgagctttagacgaggggaagtgctccgcgtaattacgacagtggacgaggactggctcagatgcggccgtgacggtatggagggattagttccagtgggctatacttctctggtattgtag

SEQ ID NO: 28740 - DNA, 1302 bp, Artificial Sequence
  Description of Artificial Sequence: Synthetic coding sequence
atggcggaagctcagagtggaaccggtcaacttcaagaacagaagaaaggactcctgatcgccgtttctgtgtcagtggacaagatcatttcgcactttggggcagcgaggaacttagtgcagaaagctcagctcggcgactctcgcttgtctcccgatgtggggcaccttgtgctgaccaccctgtgcccagcgcttcatgcactggtagccgacgggttgaagcccttccgcaaggaccttatcactggccagcgcaggagcagtccctggagtgtggtggaggcaagcgtgaagccaggaagctcaacacgcagtctcggaactctgtactctcaggtaagccgcttggccccattatcatctagtaggtcccgcttccacgcctttatcctcgggttactcaatacaaaacagctagagttatggttctccagcctgcaggaggatgccggactactcagccttctgtatctgcctactgggtttttctcgctagctagaggcggatgcccttcactgagcaccgaactgctcctgttgttgcaaccactgagcgtgctcaccttccacctggacctgttatttgagcaccaccatcacctgccactcggccctccacaggcacccgctccgcctggcccacccccagccctgcagcaaaccatgcaggcaatgctccattttggaggcagactggcccagtccttgagaggaactagcaaggaggccgcatccgatccctccgatagtcctaatctcccaacgccaggttcctggtgggagcaactcacccaggcaagcagggtgtatgcctcagggggaaccgaaggcttccccttgtctcgatgggccccagggagacatggaacagcagcggaggagggggctcaggagaggccactgcctaccgatgagatggcccctggcagagggctgtggctcggcaggctgttcggagtacctggagggccagccgagaatgaaaacggtgcactgaagagcagaaggcccagctcttggctgcccccaaccgtctcagtccttgctttggtcaagagaggggctccccctgagatgcctagtcctcaagaattagaggcatcagccccaagaatggtgcaaacgcaccgcgctgtgcgtgcactctgtgaccataccgccgctcgacccgatcagctgtcatttcggaggggagaggtgttaagggtgatcactacggtggacgaggattggctgagatgtggacgcgacgggatggagggactcgtgcccgtgggctataccagcttggtgctatag

SEQ ID NO: 28741 - DNA, 2709 bp, Artificial Sequence
  Description of Artificial Sequence: Synthetic coding sequence
atgctcagtccccagcgcgctctgctgtgtaacctgaatcatattcatcttcaacacgtctctctgggcttgcatctcagtagaagacccgaactgcaggagggccctctgtctacgccccctccccctggagatacggggggtaaggaatcccgaggtccatgctccggtaccctcgtcgacgccaactccaatagccccgctgtcccctgtcgctgttgccaggagcatgggccagggttggagaaccgtcaggatcccagtcaagaggaagaaggtgcagcctcaccttccgatccagggtgcagttcatccctatcctcctgttccgacctgtctccagatgagagccccgtcagcgtttacctgcgggatttacccggagacgaggacgcacatccgcagccttcaatcatccccttagaacagggctcccccctagccagtgcaggcccaggcacttgctcgccagactccttctgctgttctcctgacagctgcagcggtgcgagctctagtcctgaccccggactcgatagtaattgtaacgcgctcacgacatgccaggacgttcctagcccagggttggaagaggaagatgagagggcagaacaggatctccctacgtctgagctgctggaagcagatgacggcaagatcgatgccggaaaaaccgaaccttcctggaagattaacccgatttggaaaatcgataccgagaagaccaaagccgagtggaagaccaccgagaacaataacactggctggaagaacaacggcaacgtgaacagctcatggaagtcagagcctgagaaatttgacagtgggtggaagacaaacacacgaattacagatagtggcagcaagaccgatgccggtaaaattgacggagggtggcggtccgacgtttccgaggaacccgtgccgcaccgcactataacctccttccacgagctcgcccagaagcggaaaagggggccaggtttgcccctcgtgcctcaagccaagaaggatcgatccgactggttaatcgtgttttctcctgatacggagctccccccaagtgggtcacctgggggaagttctgcccctcctcgagaggtgactactttcaaggaattgagatcgcgctctagggccccagcccctcctgttcctcctcgtgatcccccagtgggctgggccctggtgcccccaagaccacccccacctccagttccgcctcgaagaaaaaagaatcggcctggcttgcagcccatcgctgaggggcagagtgaagaaggccgagccgtaagtcccgctgcaggcgaagaagccccagcagcaaaagagccaggtgcgcaagcagggcttgaggtgcgcagttcatggtcctttgccggagtgccaggcgcacaacgactctggatggctgaggcacagtctggcacaggacagctgcaggaacagaagaagggactgctgatcgccgtgagtgtgtccgtggataagatcatctcccattttggggcagcgaggaacctggttcagaaagcccagttaggagacagtagactgtcacccgatgtgggacacttggtcctgactaccctatgtcccgctttgcacgccctggtcgcggatgggctcaagccgttcagaaaggacctgatcactgggcaacggagatcaagcccatggtccgttgtggaggccagcgttaagcctggaagctcaactagatccctcggaaccttatattcccaagtctcacgtctcgcccctctctcctccagccgtagccgattccatgccttcatattgggcctcttgaacacaaagcaactcgagctttggtttagttcactgcaggaggacgcaggccttcttagtttgctgtacctaccaacagggtttttttccctggccagaggcggatgcccttccctttctaccgaactgttgctcctgctgcagccacttagcgttcttactttccaccttgacctactgtttgagcaccaccatcacctgcccctaggtccaccgcaggcacccgctcctccgggtcctccaccggctctccaacagacaatgcaggccatgctacactttggtggtaggcttgcacagagccttcggggaaccagtaaggaggccgcttctgacccctccgacagccccaacttacccactccgggtagctggtgggagcagttaacccaggcctctagagtatacgcctctggcggaactgagggcttcccactgtctaggtgggctccaggccgacatggcacagcagccgaagagggtgctcaggagcgaccgctacccactgatgaaatggccccaggacgaggactttggcttgggcgactttttggggtccccggaggccctgccgagaatgagaacggggctctgaaaagtcgcagaccctcgagctggctgcctcctactgttagtgtcctggctctggtgaagagaggtgcccctccagagatgccgtccccgcaggagctggaggcttccgcacctcgtatggtgcagactcatcgggctgtgcgagcactgtgtgaccataccgctgcacgacccgaccagctgagctttagacggggtgaagtacttagggtgatcacgactgtggatgaagactggctccggtgtggaagagatggcatggaaggactggtgccagttggatatacatcactggttctttag

SEQ ID NO: 28742 - DNA, 2391 bp, Artificial Sequence
  Description of Artificial Sequence: Synthetic coding sequence
atgcttagtccccagagagccctcctgtgcaacctcaatcacattcatctgcagcacgtgagcttgggtctgcatctctcccgccgtccagagctgcaggagggacccctgtcaacaccaccaccccctggggatacaggagggaaggagagcagagggccatgttccggtaccttagtagacgcaaactcaaactcacctgctgtaccctgtcgatgttgccaagagcacgggccagggttggaaaatcggcaggatccatcacaggaagaggaaggtgctgcaagtcccagcgatcccggatgtagctcatcactttcgtcctgttcagacctcagtccagatgagtctccagtgtctgtctatctgcgcgacctgccaggggatgaagatgcacacccacaaccatctataattccattggaacagggctcccccctggctagcgctggccctggaacatgctcccccgacagcttttgttgttcaccagattcctgctccggggcttcctcctcccccgatcctggcctagactctaattgcaacgcccttacgacgtgtcaggatgtcccctccccgggactcgaggaagaagacgaacgggctgaacaagacctgcccacttcagagcttctggaagcagacgatggcaaaatcgacgccggtaaaacagaaccgagctggaagatcaatcctatttggaaaatcgacacagagaagactaaggcggagtggaaaaccactgaaaataacaacacaggttggaagaataacggcaacgttaactccagttggaaaagcgagcccgaaaagttcgatagcggttggaagacaaataccaggattacggacagcggaagtaagactgatgcgggtaaaatcgacggtgggtggcgatcggacgtgagtgaggaacctgtgccccatagaacaattacgtctttccatgaattggctcagaagcgaaagcgcggtcctgggctgccactcgtgcctcaggctaagaaggaccgtagtgactggttaatcgtcttttcacctgataccgaactcccaccctccggctccccaggaggatcctccgcccctccaagagaggtcaccacttttaaggagctgcgctcaaggtcgcgcgctccagctcccccagtcccaccacgggatcctcccgtcggctgggctctggtgcccccacggcctccccctcctccggtgcccccaagacggaagaaaaacaggcctgggctccaaccgatcgccgaaggacagtccgaggagggccgtgctgtgtccccggctgccggtgaggaggccccagccgcaaaggaaccgggagcccaggcaggactggaggtgagatcttcctggagttttgcgggtgtgcctggagctcagcgcctatggatggcagaggcccagtctggcactggtcagctccaggagcagaagaaaggcctgttgatagccgtatctgtttctgttgacaagattatatcccacttcggagctgcaaggaatctagtacagaaagctcagctcggcgatagtaggctgtcccccgatgtagggcacctcgttcttactaccctttgcccggctttgcacgcactagttgctgatggcctgaaacccttcagaaaagatctgattaccgggcaaagaagatctagtccttggagcgtggtggaggcgagcgttaagccagggtcttctacccggagcctgggtacgctatattcacaggtgtcacgcctcgcccctctatcatccagtcggtctagattccacgccttcatcctggggctgctgaatacaaagcagctggaactgtggttctcttcattgcaagaagacgccggaagttggtgggagcagctgactcaggctagccgcgtgtacgcctcaggcggaactgagggcttcccgttgtctcgttgggcgccaggaaggcacgggacagccgcagaagaaggcgcacaggagagacctctcccgactgacgaaatggcacccggaaggggcttgtggctaggtcggctgtttggtgtcccgggtggtccagccgaaaatgagaatggcgcactgaaatctcgtagaccatcgtcctggctgcccccaacagtatccgtgctggccctggtcaagagaggcgctcccccagagatgcccagcccccaggagctggaggccagcgctccacgcatggtacagactcacagggcagttagggccttgtgtgatcacactgctgcccgtccagaccagttatcttttcggcgtggagaagtactccgagtgatcaccacagtggatgaagattggctcagatgcggacgggatgggatggagggactcgtcccagtgggctatacctccctcgttctgtag

SEQ ID NO: 28743 - DNA, 513 bp, Artificial Sequence
  Description of Artificial Sequence: Synthetic coding sequence
atggcaagtgtcagctccgccacattctccggacacggcgcaaggagtctcctccaattcttgaggttggtggggcagttgaaacgggtgcccagaaccggatgggtgtatcgcaatgtccagaggcctgagtctgtgagcgatcacatgtaccgcatggccgttatggccatggttatcaaggacgatcgcctgaataaagaccgggaggccatgaagcaaattacgcagctgctaccagaggatctccgaaaagaactgtacgaactctgggaggagtatgagacccagtcaagtgcagaagctaagtttgtgaagcagctggatcagtgtgagatgattttgcaagcatctgagtacgaggatctggagcacaagcctggtcgattacaggatttttacgacagcacagcgggtaagttcaatcaccccgagattgtgcaactcgtgagtgaattagaggccgagagatctaccaacattgcggctgccgcaagcgaaccccattcctag

SEQ ID NO: 28744 - DNA, 396 bp, Artificial Sequence
  Description of Artificial Sequence: Synthetic coding sequence
atggaggcccaggctcagggccttctggagacagaacccttgcagggcaccgatgaggatgcagtagcttctgccgacttttcatcgatgttaagtgaggaggaaaaggaagagttaaaagctgaacttgtacaattggaggatgaaataactaccctcagacaagttctctccgccaaagaacgccacctcgtcgagatcaagcaaaaactgggaatgaacctgatgaacgagctgaagcagaatttttcaaaatcctggcatgatatgcagacaactacagcttataaaaaaacacacgagacattgagccacgccggacagaaggccaccgccgcatttagcaatgtgggcacggccatcagcaagaagttcggcgatatgcgccgaaagtag

SEQ ID NO: 28745 - DNA, 435 bp, Artificial Sequence
  Description of Artificial Sequence: Synthetic coding sequence
atggaagctcaagcccagggccttttggagaccgaacctttacaggggacagatgaggatgcggtcgctagcgccgatttttcctccatgctgtccgaggaagaaaaggaagagctgaaggcggagctcgtgcagctcgaggacgagatcactactctgcgtcaggtgttgagcgctaaagaaaggcatctggtggagatcaagcagaaacttgggatgaaccttatgaatgagcttaagcagaacttcagtaaatcttggcatgacatgcagactactacggcctacaaaaaaactcacgaaaccctgtcgcatgcagggcaaaaagctacggccgcattcagcaacgtgggcaccgccatcagtaagaaatttggggatatgtcctattcaattcgacattcaatatcaatgccagccatgagacgaaagtag

SEQ ID NO: 28746 - DNA, 948 bp, Artificial Sequence
  Description of Artificial Sequence: Synthetic coding sequence
atggcctcctgtcccgacagcgacaactcgtgggtacttgccggaagtgagtcccttcccgttgagacactaggacctgcgtctcgcatggatcccgagtcggagcgcgcactacaggctccccattcaccctctaaaactgatggcaaggagctggcagggacgatggatggtgagggtaccctgtttcagaccgaatctcctcagtctggctccatactgacagaggagactgaagttaagggtacattagaaggtgatgtttgtggcgtggagccgcctggcccaggcgataccgtagtccagggagatttgcaggagacaacggtcgtcaccggccttgggcctgatacacaggatctggagggccaatcaccacctcagtccttgcccagtacccctaaggcggcttggattagagaggaagggaggtgtagttcaagtgacgatgacacggatgtggatatggaaggtctcaggagacgaaggggcagggaggccggtccccctcaacccatggtacccctggcagtggaaaatcaggccggaggtgggctgtccgagagtgaaacagggccaatggaagaagtagaacgacaggttctgcctgacccagaggtcttggaggccgttggagatcgacaggatgggcttcgggagcagctccaggccccagtaccgcctgactccgtaccctcactccagaacatgggtctgctactggataaactcgcaaaggagaaccaggatataaggctactgcaagcccaactgcaggttgggaccggcaggagaggttgggccagggtgacccacctcggacaggcaagcgtgttggcaagttctcccaagcgcaacgtgtcgtacctgcctacacatccggaccctccactcagccactattcccagggtgtttttcccgtgttgggttcacaccctctctgctag

SEQ ID NO: 28747 - DNA, 2196 bp, Artificial Sequence
  Description of Artificial Sequence: Synthetic coding sequence
atggccagctgcccagatagtgacaactcatgggtgctagcaggctcggagtccctgcctgtcgaaacgctcggcccagcatcgcgaatggaccctgagagcgaaagggctctccaggctcctcattcaccttctaaaacggatggcaaagagctggctggaacaatggacggcgagggaaccttatttcagactgagagcccccagtccggcagcatcttgactgaagagacagaggtcaaaggaacgctcgagggggacgtgtgtggtgtcgaaccacccggacccggtgacacagtggttcaaggcgacctccaggaaaccaccgtcgttaccggactgggacccgatactcaggatctggaggggcagtctcctccccagtctctgccttccacacccaaagccgcttggattagggaagaggggagatgttcgtcctcggacgacgacactgacgtggatatggagggacttcggagacgaaggggcagagaggcaggccctcctcaacctatggtccctcttgccgtcgaaaaccaagctggcggagaaggggctgggggagagctgggcatatcactaaacatgtgcttactgggagccctggtgctgcttgggttgggagtgctcctgtttagtggcggtcttagcgaatccgaaactggccctatggaagaggtggagaggcaggtgctgcccgaccccgaagtgctagaggccgtaggcgatcggcaggatggcttacgagagcagctccaggcaccagtccctcctgatagcgtgccatcccttcagaatatggggctcctgctggacaagctggctaaagagaatcaggacatcagactgttgcaggcccaactccaggcacagaaggaggagttgcagtctctcatgcaccagcccaagggactagaagaagagaatgcacagctgaggggtgccctacagcagggtgaggccttccagcgtgcactggagagcgagctgcagcagttaagggctcgcctccaggggctagaagcggactgcgtcaggggacccgatggcgtgtgtctgagcggtggacggggaccccagggagacaaggccatcagggagcaggggcctagagagcaagaacctgagctgagcttcctcaaacaaaaagagcagttggaggcggaggcccaggccctgcgtcaggaactcgaacgccagcgtagattactggggtctgtgcagcaagatctcgagcggtctcttcaggacgcttcgaggggtgaccctgcccatgctgggctggcagaactgggccatcggctggcacagaagctacaagggctggagaattggggccaggaccccggagtgtcagcgaatgccagcaaagcctggcatcagaaaagtcatttccagaacagtagggaatggtcaggcaaagaaaagtggtgggacggccagcgggaccgtaaagcggagcactggaaacataaaaaggaagagagtggcagggagaggaagaagaactggggtggccaggaagaccgcgaacccgctggaagatggaaggaaggacggccaagggttgaggagtccggatctaaaaaagagggaaagcgccaaggccctaaggagccaccccgaaagtcgggcagcttccacagtagcggtgaaaagcaaaagcaacccaggtggagagagggcactaaagacagtcacgatccattgccctcttgggccgagctgctaaggccaaaatacagggcccctcaaggatgcagtggagtggacgaatgcgcacgccaagaaggactcactttttttggcaccgagctggcacctgtgcgccaacaagaacttgcctctctactcaggacatatttggcccgattgccatgggctggacagctgactaaggagctgcctctcagtcctgcattttttggagaagacggaatctttcggcacgaccgccttcggttccgagattttgtcgatgccctcgaggattccctggaagaggtagcagtgcagcagaccggggacgatgacgaagttgacgacttcgaagatttcatatttagccatttcttcggggacaaggctctcaaaaagaggtccggaaagaaagataaacattctcagtcgccaagagccgcagggccacgtgaaggacactcccatagccatcatcaccaccataggggctag

SEQ ID NO: 28748 - DNA, 2109 bp, Artificial Sequence
  Description of Artificial Sequence: Synthetic coding sequence
atggacccagagtcagagagagcgcttcaagcaccccacagtccctccaagactgacggaaaggaactggccggaaccatggatggcgaaggaactctgtttcaaactgagagccctcagtcaggatccatacttacagaggaaaccgaggtaaaggggaccttggaaggtgacgtgtgcggcgtcgaacctccaggtcctggcgacacagtagtgcagggcgacttgcaggaaacaaccgtcgtcaccggactgggcccagacacccaggacttggagggccagtcacccccacagagcttgccaagtacacctaaggccgcatggattagggaagagggcagatgcagctcatcagatgacgacacagatgtcgacatggagggtctgcgaagaaggagaggacgggaagctggacccccacagcccatggtcccactcgccgttgagaaccaggccggaggggaaggggctggtggagaactcggtatctctcttaatatgtgtctgctgggggctctcgtcttactaggcctgggagtgctccttttctctggagggctatcagaatccgaaaccgggccaatggaggaagtagagcgacaggtcctgcccgatccagaagttcttgaagctgtcggagatcgacaggacggccttagagagcagctgcaagccccagtcccaccagattcggtgcctagtttacagaacatgggtctgctactcgacaagctcgcgaaggagaaccaggacataaggctgttacaagcgcagctgcaggcccaaaaagaggagctccagtccttgatgcatcagccaaaaggcctggaggaggagaatgctcaattaagaggagcacttcagcagggggaggcattccagcgggcattggagtctgagctccaacagctgcgtgcacggctgcagggattggaggcagactgcgttcgcggtccagatggagtgtgtctgtcaggtgggagggggcctcagggagataaggcgattcgagagcaaggaccacgtgaacaggagcctgaactgtccttcctcaaacagaaggagcagctcgaggctgaggctcaggctctgcggcaagaactggaaagacagcggcgattgcttggcagtgtccagcaggatctggaaaggagtctgcaggatgcatcaaggggtgaccctgctcatgccggattagctgagctcggtcataggctcgcccagaaactgcagggccttgaaaactggggccaagatcctggagtgagcgcaaacgcaagtaaagcctggcatcagaaaagtcatttccagaattctagagaatggtcaggaaaggaaaagtggtgggatggacagcgcgacagaaaggccgagcactggaagcacaaaaaggaggaaagcggccgagaaaggaagaaaaactggggcggtcaggaggatcgcgagccagccggaaggtggaaggaaggcagaccacgcgtggaggagagcgggagtaaaaaagaagggaagcgtcaggggccaaaggaacctcccagaaagtcggggtctttccatagctccggagaaaagcagaagcagcccaggtggcgcgagggaacaaaggacagccacgatcctttgccatcctgggctgaactactgcgcccaaagtatcgagccccacaagggtgctccggggttgatgaatgtgccagacaagaagggctgactttctttggcacggagctcgcccctgtgcgacagcaagaactggcaagcctgctgaggacatacctcgccagactgccatgggccggtcagctgacaaaagagctgcctctgtctccagccttttttggtgaagacggcattttcagacacgataggctgcgcttccgggattttgtcgatgcgttggaggacagccttgaggaagtcgctgtgcagcagactggcgatgatgacgaagtggacgattttgaagacttcattttctcccactttttcggagacaaagccctaaaaaagagatctggaaagaaggataagcactctcagtcaccccgagcagccggacctcgtgaagggcattcccatagtcaccatcaccatcatcgcggttag

SEQ ID NO: 28749 - DNA, 2427 bp, Artificial Sequence
  Description of Artificial Sequence: Synthetic coding sequence
atgatctggcgaaacaattggaagtccactacaggcagattaaacgtgaaactacagtccgataaactgcagcacggctgtgggcctgactactcctccgcctggctgcctgcaaatgagagcctttggcaggcaaccacagttccttccaatcaccggaataatcatattcggaggcattcgatcgcctcagacagcggagatacggggattggcacatcatgcagtgactccgtggaggaccactcaacttccagcgggaccctttcctttaaacccagccaatctttgatcactctccctaccgcccacgtgatgccttcaaattcctccgctagcatctccaaactgcgggagtccctgaccccagatggtagcaaatggtcaaccagcttgatgcagacccttggcaatcactcaaggggggaacaagattccagtctggatatgaaagattttagacctctacggaagtggagttccctgtcaaaactgactgcccctgataattgcggccagggcggtacagtatgtcgagaagaatcacggaatggcctcgagaagatcggcaaagctaaggccctgacttctcagctgcgcacgatcggcccttcatgtcttcatgacagtatggagatgttgagacttgaagataaagagattaacaagaagcggagctcgaccctcgattgtaaatacaagtttgagagctgcagtaaggaagatttccgggctagctctagcacactcagacggcagccagtcgacatgacttattcagcattgcccgagtccaaacccattatgacaagctcggaggcgttcgagcctccaaagtacctcatgctcggacaacaggctgtgggcggtgtacctattcaaccttcagtgagaacacagatgtggctgacagagcaactgaggaccaaccccttggagggaaggaataccgaggactcctattcactcgcaccttggcagcaacaacagattgaggatttccggcagggctcagaaacacctatgcaggtactcaccggcagttctcgccagtcctactctccaggctaccaggattttagcaagtgggagagtatgctgaagatcaaggaaggcttgttgcgtcaaaaagagatcgtgatcgaccggcagaagcaacagatcacccatctgcatgagcggatcagggacaatgagctgcgcgctcagcacgcaatgttgggccattatgtgaactgcgaggactcctacgtggccagcctccagcctcagtacgagaatacaagtttgcagactcctttttcagaggaatccgtgtctcatagtcagcagggagagttcgaacagaagttagcaagcaccgagaaagaggttctccaactgaatgagttcctgaaacagagactgtctctgttttctgaggaaaaaaagaaacttgaagagaaactcaagacacgggaccgttacatctcttcactgaaaaagaagtgtcagaaagaaagcgaacaaaacaaagagaagcagcgtcgaatcgagaccctggagaagtatctggcagacctgcctaccctggatgacgttcagtctcagtctttgcagcttcagatactcgaggaaaagaataagaatctgcaagaggcactcatcgacaccgagaaaaaactggaagaaatcaagaaacaatgccaggacaaggaaacccagctgatctgtcagaagaaaaaggaaaaggagcttgttaccacagttcaaagcctccaacaaaaggtggaacggtgtctggaggacggtattagactgcccatgttggacgctaagcaactgcagaatgagaatgacaatttacgccagcagaatgaaactgccagtaaaatcatcgattcccagcaggatgagattgaccggatgatcctcgagatacaaagcatgcagggcaagctttccaaggaaaagcttaccacacagaagatgatggaagagctggagaaaaaagagaggaatgtgcagcgtcttacgaaggcactgttggagaaccagcggcagaccgacgagacatgttccctcctggaccaggggcaagagcccgatcagtccaggcagcagacggtgctgtccaaacgccctttgttcgacctaaccgtaattgatcaactcttcaaggagatgagctgttgcttgtttgatctcaaagcactctgctctatactgaaccagcgcgctcagggtaaggagcccaatcttagccttctgttaggcatcagaagcatgaactgcagcgcagaagaaacagagaacgaccactctaccgagacacttaccaaaaaactgtctgacgtctgtcagttaagacgcgatatcgacgaactaagaactacaatcagcgatagatacgcccaggacatgggagacaactgtatcactcagtag

SEQ ID NO: 28750 - DNA, 2418 bp, Artificial Sequence
  Description of Artificial Sequence: Synthetic coding sequence
atgtgggggagatttttggctccggaggctagcgggagggatagcccagggggtgcgagaagtttcccagcaggacccgattatagctcagcatggctgcctgccaacgaatcattgtggcaggcaacaaccgtgccttccaaccaccgcaataaccatataagaagacactccattgcatctgattcgggcgacacagggatcggcacctcctgctccgattcagtggaggatcatagtacaagctctgggacactgtcattcaaacccagccaaagccttattacacttcctaccgcccacgtgatgccctccaactcctctgcctccattagcaagctcagagagtctctcactccggacgggagcaagtggagcacatcattaatgcagaccctcggaaatcacagtcgcggagaacaagactctagcctcgatatgaaggactttcgcccactgagaaagtggtcatccctcagcaagctgaccgccccagacaattgtgggcaaggcggaactgtttgccgcgaggagagtcgcaatggtctagagaagatcggaaaagccaaggctctgacgagtcagctccggaccatcggacctagttgtttacacgactccatggagatgctacggctggaagataaagagatcaacaagaagaggagctcgaccctggactgtaaatacaaattcgaatcctgtagtaaagaggattttagggcctcctcctccaccctccggcgacagcccgtggacatgacttattccgccctccccgagagtaagcccattatgacaagctcggaggccttcgagccccctaagtacttgatgctgggtcaacaagccgtcgggggtgtccccatccagccatctgtgagaactcagatgtggttgacggaacagctaagaacgaaccccctagagggcagaaacacggaggatagttattcacttgcaccctggcagcagcagcagatcgaggactttaggcaggggagcgagacaccaatgcaggtccttaccggaagttctcgacagtcctactctccaggctaccaggattttagtaagtgggagtcaatgctgaagattaaagagggactcctgcgccagaaggaaattgtcattgatcgccagaaacaacagattactcatcttcatgaacgcataagagacaatgaactgagagctcagcacgccatgctcggacattatgttaattgcgaggatagctacgtcgcttcactgcaaccccagtacgaaaacacaagtctgcagactcccttttcggaggagtcagtttctcacagtcagcaaggcgagttcgagcagaagctggcaagtacggaaaaggaagtcttgcagctaaacgagtttctgaagcaacgcctttctctgttttcagaggaaaaaaagaagctggaagagaagctgaaaacaagggacaggtacatcagcagcttaaaaaagaagtgtcagaaagaatccgaacagaacaaagagaagcagaggagaattgagacgctggaaaaatatctggcagatctcccaaccctggatgatgtccagagtcagagcctccagctgcagatactggaagagaagaataaaaacctccaggaagcattgatcgacacagagaaaaagttggaagaaatcaagaaacagtgccaggataaagaaacacagctgatctgccagaaaaagaaagagaaagagctggtgacaaccgtgcagtcactccagcagaaggtggaacgttgcctggaggatggcattcgcctgcctatgttagacgcaaaacagctgcagaatgagaacgacaaccttagacaacaaaacgagacagctagcaagatcattgactcgcagcaggatgagattgaccgcatgatcctggagatccagtcgatgcaggggaagttgtcaaaagaaaagctgaccacccagaaaatgatggaagaacttgagaagaaagagcgtaacgtccagcgcctcactaaagcactccttgagaatcagagacaaacagatgaaacgtgcagcctgctggaccagggtcaggaacccgaccaatcacgacaacagaccgtcttatcaaaacggcctctcttcgatctgacagtcattgatcaactgttcaaggagatgtcctgctgcctatttgacttgaaggcactgtgtagcattctgaaccagagggcacagggaaaggagcccaacttatccctgttactagggatccgctctatgaactgctcagctgaggagactgaaaacgaccacagtacagagacgttaacaaaaaagctgtcagatgtctgtcagttgaggcgggacatcgacgaacttagaacaaccatttccgaccgctatgctcaggatatgggcgacaattgtattacccagtag

SEQ ID NO: 28751 - DNA, 1488 bp, Artificial Sequence
  Description of Artificial Sequence: Synthetic coding sequence
atggtggaagaacacgaactgagaaaggagcggatacaggaggactataatgacaaatattgggatcaacggtacaccattgtgcagcagcagattccatcctttcttcagaagatggccgacaagatcctatcaacaggaaagtatctgaatgttgtaagggaatgtggccatgatgtgacatgccccgtggccaaggagatcatttataccttaaaagagcgtgcctacgtagagcaaattgaaaaagcttttaattatgctagtaaagttctgcttgatttcctgatggaggaaaaggagctggttgcccatttacggagtatcaaacggtacttcctcatggaccagggagacttttttgtgcattttatggacctcgcagaggaagagctgaggaagcctgttgaagacataaccccgccaaggttagaagcactgctggagctggctcttcgaatgtcaactgctaacactgacccattcaaggacgatttaaaaatcgatctgatgccccacgatttaatcacccagttactgcgcgtgctcgctatcgagactaaacaggaaaaggcaatggcgcatgcagatccaaccgaactcgctttatcgggtctagaagcatttagttttgactatatcgtaaagtggcccctgtctcttatcattaatcgcaaagctttgactcggtaccagatgttatttaggcacatgttttattgcaagcatgttgagcgccaattgtgttccgtgtggatcagtaacaaaaccgccaaacagcactcccttcattccgcccagtggttcgccggtgctttcacactaaggcagaggatgcttaacttcgtgcagaacatccagtactatatgatgttcgaggtgatggagccaacctggcacatcctggagaaaaacctaaagagtgcttctaatatagacgacgtcctgggccatcacacaggattcttagacacgtgcttgaaggattgcatgttaaccaatccagaactgctgaaagtttttagcaagctgatgtctgtgtgtgtaatgtttaccaattgtatgcagaaattcacccagtcaatgaagctggacggcgagctcgggggacagaccttggagcattccactgtcttaggcctgcccgctggcgctgaagagcgtgcgagaaaggaactggctcgtaagcacctcgctgagcacgctgatactgtgcaactggtctcggggttcgaggccactattaacaagtttgataagaatttctctgcgcatttactggacttactggcacggctctccatatacagtacctcagactgtgaacacgggatggcttcagtgatctctcgcctggatttcaacgggttctacactgagcgcctggaacggctgagtgcggagcgctcacagaaggctaccccgcaggttcccgtgctgagggggcctccagctccagcccctagagtcgcagttacggctcaatag

SEQ ID NO: 28752 - DNA, 2709 bp, Artificial Sequence
  Description of Artificial Sequence: Synthetic coding sequence
atgtccgagttcagaattcaccacgacgttaatgaactgttgagtcttctgagggtccatgggggagatggcgcagaggtgtacattgacctgctgcagaagaaccgaacaccatacgtgaccaccacagtgagtgctcatagcgcgaaagtcaagattgcagagttctcaagaacccctgaggactttctcaaaaaatacgacgagctcaagtccaagaacaccagaaatctcgatccactcgtctacttgctctccaaactgaccgaggacaaggaaacactgcaatatttgcagcagaacgcgaaggaaagagccgaactggcagccgcagctgttggtagttccactacaagcataaatgtgcccgcagctgcatccaaaatcagcatgcaggagttggaggagctgcggaaacagctgggatccgtggcaaccgggtctaccttacagcagtcgcttgaacttaaacgcaagatgcttcgagacaaacaaaataagaagaattccggccagcatttgcctatctttccggcatgggtatatgagcggcctgctcttattggcgacttcttgatcggggcaggcatttcaactgacaccgccctgcctatcggaacattgcccttggcgtctcaagagtcagcagtcgtcgaggatctgctgtatgttctagttggagtggatggacggtatgtgtctgcacagcccctggccggtaggcagtcaaggacgttcctggtggatcctaacctcgatctctctattcgggagcttgtacatcggatcctcccagtcgccgcaagttactccgcagtgactagatttattgaggagaaaagtagtttcgagtatgggcaggtgaaccacgcacttgccgctgcaatgaggaccctcgtcaaggaacatctgatcttggtctcacagctggaacagctgcatcgacagggtctcctgagcttgcagaagctgtggttttatattcagccagctatgaggaccatggacattctagctagtcttgcaacaagtgtggacaaaggagagtgccttggcggttccaccctgtccctgttgcatgacagatcttttagttacacgggcgactcgcaagctcaggaactgtgcctctaccttaccaaagccgcttccgctccctatttcgaggtgctggagaagtggatctaccgagggatcattcacgacccttattctgagttcatggtggaggagcatgaactgaggaaggaacgcatacaggaggattacaacgacaaatactgggaccaacgatacaccatagttcagcaacaaataccatcatttctgcagaagatggcagacaagatccttagtaccggaaagtatctcaatgtggttagagagtgcgggcatgatgttacttgccctgttgcaaaggaaatcatttacacactcaaagaaagggcctacgtcgaacaaatagaaaaagcgttcaattacgcctccaaagtgctgttggactttctcatggaagaaaaggagttagtcgctcatctgaggtccattaagagatattttctcatggatcagggggatttttttgtgcatttcatggatctggctgaggaagagttgcgtaaaccagtggaggacattacccctccgcgtcttgaggccctgctggagctggcattgaggatgagtaccgccaatacagatccttttaaagatgatcttaagatcgatctgatgccccacgacctcatcacgcagctgcttagggtcctggccattgaaaccaagcaagagaaagccatggcccacgctgacccaacagagcttgcactgtcagggctagaagcattctcctttgattacatagtgaagtggcccctatctctgattatcaaccggaaggcactcacacgatatcagatgctgtttaggcacatgttctactgtaagcacgtggagcgacaactgtgctccgtgtggatctctaacaaaaccgcaaagcagcatagcctgcattctgcccagtggtttgcgggtgctttcacactgaggcagagaatgctgaacttcgtgcaaaacattcagtattatatgatgttcgaagtcatggagccgacctggcacatcttggaaaagaatctgaaatcagccagtaacattgacgatgttctgggccaccatacagggtttctcgatacctgtctgaaggattgtatgctcaccaaccccgaacttcttaaagtgttctcaaagctcatgtctgtatgtgtcatgttcaccaattgcatgcaaaagttcacacaaagcatgaagctggacggagagctgggagggcagacattggagcacagcactgtgctgggtctgccagcaggagcagaagagcgggcacgaaaagagttagcacggaagcatttggcggaacatgccgacacagtgcagctcgtgtccgggttcgaagccactatcaataagttcgataagaatttcagtgcccatctactcgacttgttggcacggctcagcatatactcaaccagcgactgcgagcatggaatggcttccgtgatttcacgcctcgactttaacggcttttatacagaacgtctcgaaaggctcagtgccgagcggtcgcagaaggctacaccacaggttccagtccttcggggacctcccgctcctgcccctcgggttgccgttacggctcagtag

SEQ ID NO: 28753 - DNA, 1620 bp, Artificial Sequence
  Description of Artificial Sequence: Synthetic coding sequence
atggatgcaatggcgtcacctggaaaggataattacagaatgaaatcctacaaaaataaagccttgaatccccaagaaatgagaagaaggagagaagaagaaggaatacagctgcgcaaacagaagcgcgaggagcaactttttaaacggagaaatgtctatttacctagaaacgatgaaagcatgcttgagagccccattcaggatcccgacatttcgagcactgtccccattccagaggaggaggtggtgaccaccgacatggtgcagatgatcttttccaacaatgctgaccagcagctcaccgcgactcagaagtttcgcaaactgctgagtaaagagcccaaccctcctattgatcaggtgatacaaaaacccggagtggtacagagattcgtgaagttccttgagcgcaacgaaaactgtactctacagttcgaggccgcttgggccctgactaatatcgcatccggaacattcctgcacacgaaggtcgtcatcgagactggagcagtcccaatatttatcaagctcctgaattctgaacacgaggacgtacaagagcaagcagtgtgggcactgggtaacatcgccggagataacgcggagtgtcgggatttcgtactaaattgtgaaatcctcccacccctcctggaactactgacaaattcaaaccgtttgacgacgacacgcaatgccgtgtgggcgctctcaaatctgtgcaggggcaagaatcctccgccaaacttctcaaaagtttcgccatgcctaaatgtgctgtctcggctcctgttttcgtccgatcccgatgtgctggccgatgtttgttgggctttgtcctatcttagcgatggacccaacgataaaatccaggccgtgatcgattcaggcgtctgcagacggctggttgagctcctgatgcataacgattataaggtagtgtctcctgcactccgggcagtagggaatattgtgaccggcgatgatatccagacccaggtgatcctcaactgcagcgcactcccatgcctactgcaccttttatcatcccccaaagagtccatcagaaaggaagcctgttggacagtgagtaacatcacggcgggaaatagagcacagatccaagctgtgatcgatgcgaacatatttccggttttgatcgagatcctgcaaaaagccgaatttaggacacggaaagaagcagcctgggccatcacgaacgccaccagcggcggaacacctgaacagatcaggtatctcgtggcgcttggatgtattaagccgctctgtgatctgttgactgtcatggacagcaaaatcgtacaagtagccctgaatggcctggagaatatccttcgcctcggcgagcaggagtctaaacagaacggaattggcatcaatccctactgcgcacttattgaggaggcctacggcttagataagatagaatttctccagagtcacgaaaaccaggaaatataccagaaggccttcgacctgatcgaacactacttcggtgtagaggaagacgacccatcaattgttccacaggtggatgaaaaccagcagcaattcatttttcagcaacaggaagctcctatggatgggtttcaattatag

SEQ ID NO: 28754 - DNA, 453 bp, Artificial Sequence
  Description of Artificial Sequence: Synthetic coding sequence
atgcgtggagaccggggacggggaagagggggacgtttcggcagtagaggaggtcctggcggtgggttccgcccttttgtacctcacattcccttcgatttctatctctgtgaaatggcctttcccagagtcaagcccgctcccgacgaaacctcattcagcgaagccctgcttaaaagaaatcaggatctcgctcctaactccgctgaacaagcctcaatcctgtcactggtgacaaaaatcaacaatgtgatcgataacttgattgtagctcctggaacatttgaagtccagattgaggaagttaggcaagtaggcagctacaagaaaggtaccatgacaaccggacacaacgtcgcggaccttgtcgttatcttgaagattctcccgacttgtgagtgcgcttgcttctggtcttgggagcagaacattgcactcggcctgggggtttag

SEQ ID NO: 28755 - DNA, 348 bp, Artificial Sequence
  Description of Artificial Sequence: Synthetic coding sequence
atggcatttccacgagtaaagcccgctcctgatgagacgagttttagtgaggcactccttaagcgaaaccaagacctcgcccctaattctgccgagcaggcctccatcctcagtctggttacgaaaataaataatgttatagataacctgatcgtggcccctgggacgtttgaggtgcagatagaggaggtaaggcaggtcggaagttataagaagggcactatgacaaccggccacaacgtggcggatctcgtggttatcctaaaaatcttgcccaccctggaggcagtggccgcacttggcaataaagtggtggaaagcttgagggcacaggatccctccgaatag

SEQ ID NO: 28756 - DNA, 312 bp, Artificial Sequence
  Description of Artificial Sequence: Synthetic coding sequence
atgtctgattgttacaccgaattagaaaaggccgtaattgtcctcgtggagaatttctataaatacgtgtctaagtacagcttggtaaaaaataaaattagtaaatctagcttccgcgagatgctgcagaaggagctgaatcacatgctaagtgacactggcaatcgaaaggctgccgataagctgatccagaatctggatgccaaccacgatggcaggataagttttgatgaatactggactctcataggagggataacaggcccaattgcaaagttaatccacgaacaggaacagcaatccagttcctag

SEQ ID NO: 28757 - DNA, 312 bp, Artificial Sequence
  Description of Artificial Sequence: Synthetic coding sequence
atgagcgactgttataccgaacttgagaaggccgttatagtgctggtggagaatttctacaaatatgtctccaagtatagccttgttaagaacaaaatttcaaagagttcattcagggagatgctgcaaaaagagcttaatcacatgctctctgatacgggtaaccgaaaagctgccgataaactcattcagaacctagacgccaaccacgatggccgtattagcttcgatgagtactggacactgattggaggcatcacagggccaatcgccaagttaatccatgagcaagaacagcagtccagcagctag

SEQ ID NO: 28758 - DNA, 312 bp, Artificial Sequence
  Description of Artificial Sequence: Synthetic coding sequence
atgtcggactgctatactgagctggaaaaagccgtgattgtgctggttgaaaacttttataaatatgtcagtaaatattccctcgtcaagaacaaaattagcaagagtagttttcgggagatgctccaaaaggaactgaaccacatgctttcagatacgggcaatcgcaaggcagccgacaaactgatacagaacctggacgctaaccacgacggcaggatttcctttgatgagtactggacactcatcggagggattaccggacctatcgccaagcttatccatgaacaggagcagcagtctagtagctag

SEQ ID NO: 28759 - DNA, 312 bp, Artificial Sequence
  Description of Artificial Sequence: Synthetic coding sequence
atgtcagactgttatacagaactcgaaaaagcagtgatcgtgcttgtggagaacttttacaagtatgtgtcaaagtactccctagtgaagaacaaaatatcaaaatcatcctttagggaaatgctccaaaaggaactgaaccacatgctgtccgacacgggtaaccggaaggccgcagataagttaattcagaacctcgacgctaaccatgatggtagaatctcctttgacgaatattggactctgataggtggcattaccgggcctattgccaaactcatacacgagcaagaacagcagtcaagctcttag

SEQ ID NO: 28760 - DNA, 306 bp, Artificial Sequence
  Description of Artificial Sequence: Synthetic coding sequence
atgagcaatacacaggctgagcgcagcatcatcggaatgatcgatatgttccataaatatacaggcagggacggaaaaatagagaaaccttcactgttaactatgatgaaagagaacttccccaatttcctttccgcatgtgacaagaaggggatccattacttagcaaccgttttcgagaagaaggacaagaacgaggacaagaagatagacttttctgagtttcttagcctcctgggggacatagctgctgactatcacaagcagtcacacggggcagctccttgttcaggcggatcacagtag

SEQ ID NO: 28761 - DNA, 306 bp, Artificial Sequence
  Description of Artificial Sequence: Synthetic coding sequence
atgagcaatacacaggctgagagatccatcattggaatgattgacatgttccacaaatacactgggcgagacgggaaaattgagaaaccctctttgcttacaatgatgaaggaaaacttcccaaactttttgtctgcctgcgataagaaaggcatacattatctagccaccgtgtttgaaaagaaagataaaaatgaggacaagaaaattgatttttccgaatttctgtcattactgggcgatatagcggctgactatcataaacaatcgcacggcgcagctccatgctcaggaggatcacaatag

SEQ ID NO: 28762 - DNA, 222 bp, Artificial Sequence
  Description of Artificial Sequence: Synthetic coding sequence
atgtcctaccaacagcagcagtgtaagcaaccctgtcagcctccccctgtgtgccccacacccaaatgccccgagccttgcccacccccaaaatgtccggaaccttacctacctcctccctgccctccagagcactgcccccctcctccgtgtcaggataagtgcccacccgtgcagccttaccccccttgtcaacagaaatacccgcctaagtccaagtag

SEQ ID NO: 28763 - DNA, 219 bp, Artificial Sequence
  Description of Artificial Sequence: Synthetic coding sequence
atgagttaccaacagcaacagtgtaagcagccatgccagccccctcccgtgtgcccgaccccgaagtgcccggagccttgcccaccgccaaagtgcccggaaccgtgcccgccacccaaatgccctcagccctgcccaccgcagcagtgtcagcaaaagtgcccccctgttaccccgtccccaccctgccagccgaaatgccccccaaaaagtaagtag

SEQ ID NO: 28764 - DNA, 219 bp, Artificial Sequence
  Description of Artificial Sequence: Synthetic coding sequence
atgtcataccagcaacagcaatgcaagcagccttgccagcctccacctgtgtgccctaccccaaagtgtccagagccgtgcccaccccctaaatgccctgagccttgtccacctcctaagtgcccgcagccatgtcctccccagcagtgtcagcagaagtgcccacctgtcaccccaagccctccttgccaacctaagtgccctcctaagtcgaagtag

SEQ ID NO: 28765 - DNA, 219 bp, Artificial Sequence
  Description of Artificial Sequence: Synthetic coding sequence
atgtcgtaccagcagcagcagtgcaaacaaccttgccagccgccacccgtttgccccacgcccaagtgcccagaaccatgtcccccacctaagtgcccggaaccctgcccctcacctaagtgccctcagccctgcccacctcagcagtgtcagcaaaaatatcccccagttaccccatcccctccttgccagcccaagtgtcctccaaagagcaaatag

SEQ ID NO: 28766 - DNA, 219 bp, Artificial Sequence
  Description of Artificial Sequence: Synthetic coding sequence
atgagctatcagcaacagcagtgcaagcaaccgtgtcagcccccaccagtatgtcctactcccaagtgcccagagccctgtccgcctccaaaatgccctgaaccttgcccatctccaaagtgtccgcaaccatgtcccccacagcagtgtcagcaaaagtaccccccagtgaccccatccccaccatgtcagcctaagtgcccacctaagagtaaatag

SEQ ID NO: 28767 - DNA, 219 bp, Artificial Sequence
  Description of Artificial Sequence: Synthetic coding sequence
atgagttaccagcagcaacaatgtaagcagccctgccagcctccccctgtttgccccactccaaagtgtccggagccatgcccaccccctaaatgcccagaaccctgcccaagccccaagtgtccacaaccatgtcctccacaacagtgtcagcaaaaatacccgccagtgacaccctcacctccgtgccagcctaaatgtcctccaaaatccaagtag

SEQ ID NO: 28768 - DNA, 8552 bp, Artificial Sequence
  Description of Artificial Sequence: Synthetic coding sequence
atgcctaaactgctgcaaggggtgatcacagtaatcgatgtcttctaccaatatgcaacccagcatggtgagtatgatacgctgaataaagccgagctgaaggagctgctcgagaacgagtttcatcagattctgaagaaccctaacgatccagacactgtggatataatcctgcaaagtttagatagggatcataacaaaaaagttgacttcaccgaatacctcctgatgattttcaagcttgttcaagcaagaaataagataatcggcaaggactactgtcaggtgtctggcagtaagctcagagacgacactcaccaacatcaggaggagcaggaagagaccgagaaggaggaaaataagaggcaggagagtagcttttcccactcttcctggagtgctggagagaatgactcctatagcaggaacgtgcgcggatcgttgaagcctgggaccgagagcatctccaggcggctatcctttcagcgggatttcagcggccagcataacagctatagtgggcagagctctagttacggggaacagaacagcgattctcatcaaagtagcggtcgtgggcagtgcgggagtggcagtgggcagtctcctaactacggtcaacatggctctggctccggtcagtcatccagtaatgacacacacggcagcggatcaggccaatccagcgggttctcacaacataagagttccagcgggcagtcctccggatatagtcagcacggcagcggcagcggacactcttctggatacggtcagcatggatcacgctccggccagtcgtctagaggggagcgccaccgcagctctagcgggtctagctcctcatacggacagcacgggagcggctctaggcaatcattaggacacggcagacaagggtcagggtcccggcaatcgcccagccacgttcgccacggatctgggtccggacactccagctcccacggacagcatgggagtggctcctcatactcctatagccggggacactatgagtctggtagcggacagacgagtgggttcggacagcatgagagcggcagcgggcagtcttcgggatattcaaagcacggatctggcagcggtcactcatcttcccagggccagcatggctcaacctctgggcaagcgagtagttccggccagcacggtagcagcagtagacagagttcgtcatacggccaacacgaaagcgcttcaaggcactcttcaggcagaggacaacacagttcaggcagcgggcagagccctgggcacggtcaacgtggctccggcagcggacagtctccatctagtggccagcatggtacaggtttcgggaggtcaagctcctcaggaccatatgtgagcggctcgggttactcatctgggttcgggcaccacgaaagttctagtgagcattcatccgggtacactcagcatggctcagggtccggacacagctcaggccatggacagcacgggtcacgctcaggacagtcctcacgcggagagcgtcagggatcttctgctggctcttcctcctcctatggccaacatggctccggatctcgccagtccttaggtcactccaggcatgggagcggctcaggacagtcccccagtcctagtcggggacgtcatgagtccggatccaggcaatcctccagctacggcccacatggctatgggagcggacgaagttcttcacggggtccttacgagagcggcagcggacattcgtctggtttggggcatcaggaaagcaggtccggtcaatcttcaggatatggccagcatggttcttcttccggtcactcttctacacacggccagcacggcagcacatcagggcagtcctccagctgtggacagcacggcgctacatcgggccagtcatcctcccacggacaacacggaagcggaagctcacaaagcagtagatatggccagcagggctctgggagcggtcagagtccatcacgcggacgtcacggcagtgatttcggccattctagctcttacgggcagcacggctcaggatccggctggtctagcagcaatggaccacatggatctgtgagcgggcaatctagcggattcgggcacaagagtggctccggacagagtagcggctatagtcagcacggcagcgggtcttcacacagttccggctatagaaagcacggtagcaggtccggtcaatcctcaagaagcgagcagcacggatcctcttccgggcttagctctagctacgggcagcacgggagtggatcccaccagagctcaggacacggcagacagggatccgggtccggtcacagtccatctcgggtgaggcacggctcttcatccggccactcttccagccatggacaacacggcagcggcacaagctgcagtagctcctgtggtcactatgaaagcgggagcggccaggcttccggctttggtcagcatgagagcgggtccggccagggttatagccagcacggatccgcgtccggtcacttctccagccagggccgacatggctccacctccggccagagcagctcgtctggtcagcacgattcatccagcggtcaatcctcgtcgtatggccagcacgagtcagcatcacaccacgcatctgggaggggccgacacgggagcggttccggccaatcacctgggcacggccaacgtggctcgggaagcggacagagcccttcttacgggcgacacggcagtggctcagggaggagcagctcaagcggcagacatgggtccggctctggtcagtcaagcggcttcgggcacaagagctccagtggccagtcgtcggggtacacccaacacggttccgggtcggggcactcttcttcttatgaacagcatggcagcagatctggacagagtagcaggtcagaacagcatggatcctcctccgggtcctctagttcctatggacaacacggtagtggctcgagacaatctctcgggcacggccagcatggaagtgggtccggacagagcccctctccgagccggggaagacacggaagtgggtccggccaatcaagctcctacgggccataccggagcggctccggctggtcgagctctcggggaccgtatgagagtggaagcggccattcttccggacttggtcatcgcgaaagtaggagtggtcagtcgagcggatatggccagcacgggtccagcagcggccactctagcacccatggccagcacgggtcaactagtgggcagtcttcaagctgcggacaacacggagcctcatccgggcagtcaagcagccacggccagcacggctctggatcatcccagtcctctggatacggcaggcagggttctggctcagggcagagccccggacacgggcagagaggctctggctctagacagagtccatcttacgggcgacacggcagtggcagcggtcgcagcagcagtagcggccagcacggatctggcctcggcgaaagctccggctttggacaccacgaaagctcctccggtcagtcatcctcctacagtcagcatgggtctggcagcggtcacagttccggatacgggcagcacggttcacggtccggtcagtcaagcaggggggaaagacacggtagttcttcgggcagctccagtcactacggtcagcatggatccggttcccggcagagctcgggccatggcagacaaggcagtgggagcggacattccccgtcaaggggcaggcacggtagtgggttaggccactcttcctcacatggccaacacggctcaggatctggaagaagtagtagccgcggtccatatgaatcgcgttctgggcattcgtccgtgtttggccagcacgaatccggctccggacacagctcagcttactcccagcacgggagcgggtcgggccatttctgcagtcaaggccaacatggatcaacaagcgggcagtcttcaactttcgatcaggaaggcagtagcactggtcagagctcgtcctacggacaccgagggagcggctctagccagagctctggatatggacgccatggcgcaggttctggacagagcccaagccgcggtcgccacggttccggctccggtcatagctcatcctacggccagcacggaagtggtagcggctggtcttcctcgagcggcagacacggaagtggttcgggccagtcgtccgggtttgggcaccacgagtctagttcatggcagtcgtcaggttgcacgcaacacgggtccggctctggccattcaagttcatacgagcagcatggctcccgttccggccaaagctctaggggtgagaggcacgggtcatcaagcggcagttcttcaagctacggccagcatggctcaggctcccggcaaagtttgggacacggccagcatggtagcggctcgggtcagtcaccttcaccatctcgcggtaggcatggaagcgggtctggccaatcaagtagttacagcccttatggatccggctcaggctggagcagttcccggggaccctacgagtccggcagttcgcacagtagcggcctgggtcacagggagagccgttctggacaaagctctggttacggccaacatggatcaagctccggtcactcatcaacccacggacaacatggctctacctctggacaaagtagctcttgcggacagcatggcgcttcaagtgggcaaagttcgagccacggacagcatgggtccgggtcatctcagtcaagcggttacggcaggcaaggcagcggcagcggccagtcccctggacatggacagcggggatccgggagtcgccagagtccttcctatggaaggcacggttcaggttcaggacggtctagcagcagtggccagcacggatctggactgggggagtcctccgggttcgggcatcatgagagtagtagcggccaatcaagctcgtatagccagcatggcagtgggagcggacacagctccgggtatggccagcacggctcccgctccggacagtcgagtaggggtgagcgccacgggtcatcttcacggtcatccagcagatacggacagcatggctcaggtagccggcagtccagcggacacgggcgtcagggtagtggctctgggcaatcgccttcccgtggacgacacggatccggcctggggcactcatcctcccacggacaacacgggtctgggtccggtagatcttcttcgagaggcccatatgagagcagatctggacactcctcggtgtttgggcagcacgagtccggatcaggacactcatcagcatactcacagcacggttctgggagcggccacttctgttcccagggtcagcacggcagtaccagcggccagtcttcaacatttgaccaggaaggatcctccaccggtcagagctcatctcacggacaacacgggtcgggtagctcccaaagctctagttatgggcaacagggttctgggagcggccaaagtccttcaaggggccgtcacggcagcggctccggacactccagctcatacggtcagcacgggagtggctccggctggtcttcatccagtggtcggcacggatctggatccggacaatccagcggcttcggtcatcatgagtcaagttcctggcagagctccgggtacactcaacatgggtccgggtctggacattcctcttcctatgagcaacatggctctcggtcggggcaaagttcccgtggggagcagcacggatcctccagtggcagtagcagctcgtacgggcagcacggatccgggagtaggcagtctctcggacacggacaacatggttcagggagcggacagtccccaagtccttcccgtgggcgacacgggtcaggttctgggcagagcagcagttacggcccttatggctctggaagtggttggtcaagtagcagaggaccttacgagagcgggagcggacattcttctggacttggccaccgggagtcaagaagcggacagtccagtgggtacggtcagcacggatcctccagcggccatagctctacacacggacagcacggatccgctagcggtcagagttctagttgcgggcagcatggagcatcctctggccagtcatcgtcccacggacagcacgggagtggctccagtcaatcctccggttatggcagacagggaagcggctctggacagtcccccggtcacggccagcgagggtctggcagccgtcagtcgccaagctacgggagacatggcagcggcagcgggagaagctcctcatctggccagcacggcccaggcctgggcgaaagtagcggatttggccaccacgaaagctcttcaggtcaatcatcttcatactcccagcacggcagcggcagcggccacagttccggatacggacaacatgggtcccggagtggccagagttcacgaggcgaaagacatggcagctccagcggaagcagcagtaggtacggccagcacggctccggcagcagacagagttctgggcacggacggcagggatctggatcgggccattcaccctctcgcggaagacatgggagcggcagtggccactcgagcagccatggccaacacggcagtgggagcgggagatctagtagccggggaccgtacgaatcccgtagtggtcattccagcgtgtttggccagcatgaatcaggaagtggccattcttcggcttattcgcaacatggcagtggcagcgggcatttctgtagtcagggccaacatgggtctacctcaggacaatcttccactttcgatcaggaagggtctagtactggtcagtcatcatctcatggccaacacggttctggctcatcccagagctctagctatgggcagcagggctcgggctcggggcagtctccctcacgaggccgtcatggaagcgggagtggccattccagctcctacgggcagcatggatcgggctcgggctggagttcttcaagtggccgtcacggatcgggcagcggccagtcaagcggatttggacatcacgagtcatcatcctggcagtccagtgggtacacccagcatggcagcgggagcggacattcaagcagctatgaacagcacggaagtaggtctgggcagtcaagtagaggggagcggcacgggtcttcctccggctccagtagctcctacggccagcatggatccggaagccgccagtctctgggtcacggacaacatggctctgggagcggacagagcccgtcgccatctcgcggtagacacggctccggatccggtcaatcgagctcatattctccgtacggcagcggaagtgggtggtccagctctcgagggccatatgaaagcggctcaggtcacagtagcgggcttgggcatagggagtcaaggtcaggccagagttcgggttacggacaacacggttccagctccgggcattcttcaacccacggacagcatgggagcacttccggccagagctcgagctgcgggcagcatggggcaagcagcggccagagcagctctcacggccaacatggttcgggctctagccagtcaagtggctatggtaggcaggggtccggctcaggccaatctcctggccatggtcagcggggatcaggaagccgacagtctccctcatacggaagacacggctcgggatccggaagatcttcatccagcggccagcacggttctggacttggcgagtcctcaggcttcggtcaccacgagtcatccagtggacagagttccagctattcacagcatggttccggttcaggtcatagctctggatacggtcagcacggttcaaggtcaggtcagagtagcagaggagagagacacggatcttcctctggatcctctagccattacggacaacatggctcggggagcaggcaatcctcagggcacggacggcaagggtcagggtcagggcagagcccctcacgagggcgtcacggctctggcttgggtcacagcagttcgcacggccagcacggctcgggctcgggaaggtcttcttctcggggaccctatgaaagccggctaggtcatagcagtgtcttcggccagcatgagagcgggagtgggcactcttccgcctacagccagcacgggagcggttctggccatttttgtagtcaaggccagcatgggtccacttctggtcaaagctcaacatttgatcaggagggatctagtaccggacagtcatctagctatgggcacaggggctcaggttcttcccaatcctccggctatggacgtcatggggctgggagcggccagtctctctcacacggcaggcatggatccggctccggccagagcagcagttacggacagcacggcagtggctctggccagtcctcagggtattcacaacatggctccggtagcggccaggacggatatagctattgtaagggtggcagcaatcatgacgggggatcctccggctcgtattttctgtcatttccttcctcaacttctccttacgagtacgtccaagaacagaggtgctacttctaccagta

SEQ ID NO: 28769 - DNA, 876 bp, Artificial Sequence
  Description of Artificial Sequence: Synthetic coding sequence
atgagtagtggtgccgatgggggtgggggagccgctgtcgccgctcgatctgacaagggttccccaggtgaagacggatttgtgccttccgcccttgggacccgcgagcactgggatgctgtttatgagcgcgagctgcagacctttcgggagtacggagatactggagagatttggtttggagaagaaagtatgaaccgccttatccggtggatgcaaaaacacaagatccccctggatgccagcgtgttggatattggcacaggcaatggcgtgttcctggtggaactggccaagtttggattcagtaatatcactggtatagactactctccctctgctattcagctgtctggctctatcatcgagaaggagggactctctaacattaagctcaaggtggaggattttctgaatttgtccacacagctctccgggttccatatatgcatcgacaagggaacttttgatgccatcagcctgaaccccgataatgctattgaaaagcgcaaacagtacgtgaagtccctaagcagggttctgaaggtgaagggtttcttcctgatcacttcttgtaattggacgaaggaggagctcctcaacgaattttctgaaggttggtcaactgtggccggtttctggctgactgccgctcttacctcatgggcccaagccatcttcagtaccagcgcgtcccgggtaggaggcacaaccgggactcatcaccacgcctggatcatctttgttttcctcgctgagacacggttctgccacgtggtgcaggccggattagagctgttgggtagctcggactctccaacgtggccgccaaaggtgctgggactgtatcacgcgagaccgagtctggcattctag

SEQ ID NO: 28770 - DNA, 633 bp, Artificial Sequence
  Description of Artificial Sequence: Synthetic coding sequence
atggcgccatggggcaagcggctggctggggtgcgtggagtgcttctcgacatttccggcgttctttacgattcaggcgcaggcggagggactgctatcgccggtagtgttgaggccgtggccagactgaaacgaagcaggctgaaagttagattttgtacgaatgaaagccaaaaatccagggccgaacttgtgggacagctacagaggctcgggttcgatatctcggaacaagaagtcacagcaccagcccctgccgcttgccagatactaaaggagcaaggattgcgaccatatctgctcattcacgacggggtgcggagcgagttcgaccaaattgatacttctaaccccaattgcgtcgtgattgctgacgccggagaatccttttcatatcagaacatgaataatgcgtttcaggtgctcatggagctggagaagcccgttttgattagcttgggcaagggtaggtactataaagagacatccgggcttatgctggatgtgggcccatacatgaaggccctcgaatatgcctgcggcatcaaagccgaagtggtcggaaagccctccccggagttcttcaagtccgcacttcaggctataggtgtggaagcccaccaagctcaatag

SEQ ID NO: 28771 - DNA, 813 bp, Artificial Sequence
  Description of Artificial Sequence: Synthetic coding sequence
atggccccttgggggaagcggctggcaggcgttaggggagtgctgctcgacataagcggagtgctgtacgacagtggagccggaggcggaactgcaattgctggtagcgtagaggcggtggcacgtctcaaaagatcccggctgaaggtacgattctgcacaaatgagagccaaaagtccagggctgagctggtaggtcaactgcaacggcttggtttcgatatctctgagcaggaggtcaccgccccagcgcctgccgcttgccagatcctcaaggagcagggattacgcccttaccttttgattcatgatggggtccggtccgaatttgatcagatcgatacgagcaatcctaactgcgttgtgatcgccgacgcgggtgagtcattttcctatcagaacatgaataacgcctttcaggtcctcatggagctcgagaagcctgtgctcatttcactgggaaagggtaggtattataaagagactagtgggttaatgctggatgtgggcccttatatgaaagcgctcgagtacgcttgcggaatcaaggctgaggtggtgggcaagccttcacccgagttctttaaatcagccttgcaagctatcggcgtggaagctcatcaggcagtgatgatcggggacgacatcgtgggcgacgtgggaggggctcagcggtgcggcatgagggcgctgcaggtccgtactggcaaatttagacctagcgacgaacaccatcccgaagtgaaggccgacggttacgtagataatctcgccgaggctgtggatctcttactgcagcacgctgataagtag

SEQ ID NO: 28772 - DNA, 3948 bp, Artificial Sequence
  Description of Artificial Sequence: Synthetic coding sequence
atggccgataccgacctgttcatggagtgcgaggaggaggaactggaaccttggcagaagatctctgacgtcatcgaagactccgtcgtcgaggactataactccgtggacaagacaaccacagttagtgtcagccaacagccggtaagcgcccctgtgcctatcgcagctcatgcctccgtggctgggcacctttcaacatccacgaccgtcagcagctctggcgctcagaacagtgattcaacaaagaaaacattagtgacactcatcgctaataataacgcacccggtactcaatttgtaaagcccaccgtgggggtgccacaagtcttttctcaaatgacaccggtcaggcccggttctaccatgcccgtgcgtcccacaacaaacacatttacaacggtaatccctgcgaccttaaccattagatccaccgtgccgcagagtcagtcccagcagacaaagagtaccccgagcacatccaccacccccactgccactcagcccaccagcctgggacagctcgcggtccaatcccccggacagtctaatcagacgaccaaccccaaattagcgccttcctttccttcccccccagctgtgagcatcgccagttttgtgaccgtaaagcgacccggtgtgacaggagagaatagcaacgaggtcgccaaactcgtgaacactctaaacactatacctagcttgggtcagagccccggtcctgtggtggtcagtaacaatagcagcgcgcacggttcacagcgtacatctgggccagaatccagtatgaaggttacctcttctattccagtgtttgaccttcaggatggcggacgcaagatctgccctcgctgtaatgctcagtttagggtcaccgaggcattgcggggacacatgtgctattgctgtcccgaaatggtggaataccagaagaaaggcaaaagtctggacagcgagccttccgtcccaagcgccgctaaacccccaagccccgaaaagaccgctcccgttgcgtcaaccccttccagcactcctatcccagctcttagtccccctactaaggtgcccgagcctaatgagaacgtgggagacgccgtccaaactaaactcattatgctggttgatgatttctattatgggagggacggcggtaaggttgctcagctgactaacttcccaaaggtagcaacctcgttcagatgccctcactgcactaagaggctgaagaacaacattcggtttatgaatcacatgaaacaccatgttgagctggatcaacagaatggagaagtggatgggcatacaatttgtcagcattgctacaggcagttttccactcctttccagttgcaatgccatctggagaatgttcattccccttatgaatccacaacaaagtgcaaaatctgtgagtgggcgttcgagtcggagcccctgttcctccagcacatgaaggacactcataagccaggcgagatgccgtacgtttgccaggtttgtcaatacagaagttccctctattctgaggtggatgtccactttcgcatgattcatgaggacaccaggcacttattgtgtccgtactgcctgaaagtgttcaagaacggaaacgcctttcagcaacattacatgcgccaccagaagcgaaatgtttatcattgcaacaagtgcaggctgcagttcttgtttgcgaaagataagatcgaacacaagttacaacaccataaaacattcaggaagcctaagcagctggaggggctgaaacccggaactaaggttacgatccgcgcttccagaggccagccaaggaccgttcccgtaagctctaacgacacacctccctcagcactgcaagaggcggctcccttgacatcatctatggatcctctgcccgtgtttttatacccgcctgtccagaggtctatacagaaacgggctgtgcgcaaaatgagcgttatgggcaggcaaacatgtctggagtgctcttttgagatcccagattttcccaaccactttccaacctacgttcattgttctctttgtagatacagcacctgctgtagccgagcgtatgctaaccacatgataaataaccacgtgccccgaaaatcgcccaagtatctggccttgtttaaaaactcagtctccggaatcaaactggcatgcacctcttgcaccttcgtgacctccgtcggagacgcaatggcgaagcacctcgtttttaatccctcacaccggtcatccagcattctacctagaggcctgacttggatcgcgcacagccggcacgggcagacacgagatagagtccacgatagaaacgtcaaaaacatgtacccccctcctagcttccctactaataaggccgcaaccgtcaagagcgctggcgctacccccgctgagccagaagagttacttactcctttggcccctgcactcccttcgcccgcttccacagcaacacctcccccaactcccacccaccctcaagctctcgctttaccacctctggccactgaaggcgcagaatgccttaatgtcgatgaccaggacgaaggaagcccggtcacacaggaacctgagctcgcttctgggggtggcggttccgggggtgtcgggaaaaaggagcagttgtccgttaaaaaactgcgagttgtactctttgctctttgctgcaatacagaacaggccgcagaacatttcaggaaccctcagagacggattcgtaggtggctgcgcagattccaagccagtcagggtgagaacctggaggggaagtatctcagctttgaggctgaggagaagctcgccgaatgggtactgactcagagagaacagcagctgccagttaatgaggagaccctctttcaaaaagctaccaaaatcgggcgtagcctggagggcggattcaaaattagctacgaatgggccgtgcgattcatgcttcgacaccatttgactccgcacgcgaggcgcgcagtagctcataccctcccgaaggatgttgccgagaacgctggattgtttattgacttcgtgcagcggcagatccataatcaggatctgcccctgagcatgatcgtcgccatagacgaaatttccttatttttagatacagaagtcctctcttccgacgatagaaaggagaacgctctccaaactgtgggcactggtgagccatggtgtgacgttgtgctggcaatcctggcggacggaactgtgttgcctaccctggtattttacagaggacagatggatcaaccggctaatatgcctgactccattctgttggaggccaaggagtctggctattctgacgacgaaatcatggaactctggtctacacgagtctggcagaagcatacggcatgtcagcgctcaaagggcatgctcgtgatggattgtcaccggactcacttgagtgaagaagttctcgcaatgctgtctgctagttccacgctgcctgccgtggtccctgctgggtgctcgagcaagattcagccgctggacgtctgcattaaaagaactgttaagaacttcctgcataaaaaatggaaagaacaggcccgagagatggcagacacagcctgcgattccgacgtgcttctgcagctcgtgctggtctggctgggagaagtgcttggagtgattggggactgcccagaattggttcagcggtccttcctggttgcgtcggtgctcccaggaccagacggaaacattaattcacccacacgcaatgccgatatgcaggaggaactgatagcctctctagaggagcagctcaagttgagcggagagcacagcgagtctagcactcctcgtcccaggagttcccccgaggagaccatcgagcccgagagtctccatcagctatttgagggagagagcgagacggagagcttctatggtttcgaggaagcagacttggatctgatggagatctag

SEQ ID NO: 28773 - DNA, 2406 bp, Artificial Sequence
  Description of Artificial Sequence: Synthetic coding sequence
atgggggataccgtcgtggagcccgctccactaaagcccacctccgagcctacaagcggacctcccggtaacaatggcggaagtctgctgagtgtcatcaccgaaggcgttggagagctatccgtgattgacccagaggtggcccaaaaggcctgtcaggaggttctggaaaaagtgaaactccttcacgggggagttgccgttagcagccgcggtacaccccttgagctagtgaacggcgacggtgtggacagcgaaatcaggtgtctggatgacccccctgctcagatcagggaagaggaagacgagatgggtgctgctgtggccagtggtacggcaaagggcgctcggcgacgcaggcagaacaactctgcgaagcagagctggttgttacggttgtttgagagcaaattgttcgacatctcgatggccatctcctacctgtacaattccaaggagcccggtgtgcaggcatacattggcaatcgcctcttctgtttccggaatgaggatgttgacttttatttgcctcagctcctgaatatgtatatacatatggacgaggatgttggggacgcgattaaaccctatatagtgcatagatgccgccagtctattaacttttcattgcagtgcgccttattactaggggcatactctagtgatatgcacatctccacccagagacacagccgtgggactaaactccgcaagttgattttgtcagatgagctaaagcctgcccatcgcaagagggagctgccctccctttcccctgctcccgataccggcttaagtccctctaagagaacacatcaaagatcaaagagcgatgctaccgcaagtatctcattgagcagcaatcttaagagaacagccagcaaccccaaggtggagaatgaagacgagcctgttcggttggccccagaacgagaatttattaagtcacttatggcaatcgggaagcggcttgctacactgccgaccaaggagcagaagacccagcgcctgatttccgagctcagcctgcttaaccacaagttgccagcccgtgtatggttgcccaccgccggattcgaccaccatgtcgtcagagtgcctcatacccaggctgttgtgcttaacagtaaggataaagcaccttatttgatttacgtggaggtgcttgaatgcgaaaattttgacacaacatcagtgcctgcacggatccctgagaatcggatacgctcaaccaggtcagtggagaatttgccagagtgcgggattacacatgagcagagagccggaagcttttccacggtgccaaattatgacaacgacgacgaggcttggtctgtagacgacattggtgaactgcaggtggagctgcccgaagtgcatacaaattcctgtgataacatttctcaattcagtgtcgatagtatcacgtcccaagagtcgaaggaaccggtgttcatagccgctggggatataagacggagattatcggagcagctggcccatacccccactgcgtttaagcgtgatccggaagaccctagcgctgttgcactgaaggagccttggcaagaaaaagtccgtcgaattcgggaaggcagtccctatggccatctgcctaactggaggttactgagtgtcatcgtcaaatgcggagacgacctgagacaggaattgctagccttccaagtactgaagcaactgcaatccatctgggagcaggagagagtcccactgtggattaagccatacaaaattcttgtgatctctgcggattcgggtatgatcgaaccagttgttaatgctgtgagcatccaccaggttaaaaagcagtcgcaactaagcctgctcgattactttctgcaggaacacggttcttacaccaccgaggctttcctgtcagcccagagaaattttgtgcagtcttgtgccggatactgcctggtgtgctatctcctgcaggtcaaagataggcataacggaaatattctgctggacgccgagggtcacatcatccatatcgacttcgggttcattctgtcctcttcacccaggaaccttggcttcgaaacctcagcatttaaactgacaaccgagttcgtggatgtgatggggggtctggatggagatatgttcaactattacaaaatgctgatgctgcaggggctgatcgctgcacggaaacatatggataaggtggtgcagatcgtggagatcatgcaacaggggtcacagctgccatgttttcatggatcttccaccattaggaacttgaaggaaaggtttcacatgagcatgaccgaagagcaactgcagctgctcgttgagcagatggtggatggcagtatgcggagcatcacaaccaagctctatgacgggtttcagtacttgaccaacggtattatgtag

SEQ ID NO: 28774 - DNA, 2451 bp, Artificial Sequence
  Description of Artificial Sequence: Synthetic coding sequence
atgggtgacactgtcgttgagccagcacctcttaaacccacatccgaaccaacctctggaccccctgggaataatgggggaagtctactttctgtaatcaccgaaggggtgggagagctgtcggtaatcgacccagaagtcgctcagaaggcctgccaggaagtgctagaaaaagtaaagttgcttcatggcggtgttgctgtgtcatcgagaggcacacctctagaacttgttaacggcgatggggtggattccgagataagatgccttgacgacccccctgcccaaattagagaagaagaggatgaaatgggtgcggcagtggcctccggcactgcgaagggggcacgccgtcgacgccaaaataacagcgctaagcagtcatggctgttgcgcctgtttgaatcaaaactgtttgacatttccatggctatcagctacctgtacaacagcaaagagcctggagttcaggcatacatagggaatcgactattctgctttcgaaacgaagacgttgatttttacttacctcagttactgaacatgtatatacatatggacgaagatgtaggggatgcaattaagccctacattgtacaccgctgtcgacagagtatcaactttagtctgcagtgtgccctgctgctgggcgcatattctagtgacatgcacataagcacccaacgtcactcaagaggcactaagctcagaaagcttatcttgtctgatgagttaaaacctgcccaccgtaaacgcgagttacccagtctttctcctgccccagacactggcctgtctccgtcgaaacgcacccaccagcggagtaagtcagacgctacagcctctatctctctgagtagcaatttgaagcgcaccgcgagcaatcccaaagtggagaatgaagatgaagaacttagctctagcactgagtccattgacaactctttcagtagtcccgtgcggctggcaccggagcgggagttcatcaagagtctgatggccattggaaagcggctagcaactctccccactaaggaacaaaagactcagcggttgatatcagaattgtcactgcttaaccacaagcttccagcacgagtgtggttgccgacagcgggatttgatcaccacgtggttagggtgcctcatacccaggccgttgtgctgaattccaaggataaggcaccttacctcatttacgtggaggtcctcgagtgcgagaacttcgacacaacctcagtccctgcccgaatccccgagaaccgaatccgctccaccagaagcgtcgagaacctgcctgaatgcggaatcacacacgaacagagagctggctcatttagcactgtgcctaactacgataatgatgatgaagcctggtcagtcgacgacataggcgaacttcaggtggaattgccagaggtgcatacaaattcctgcgacaacatcagccagtttagtgtggattctatcacgtctcaggagtctaaagagcctgtgttcattgccgcaggcgacatcagaaggagacttagcgaacaactcgcgcacacacccacagccttcaagcgagacccagaagaccccagcgccgtggccttgaaggaaccttggcaggagaaggtacggagaatacgggagggctctccgtacggccacctgcccaattggcgcctgctcagcgtcatcgtcaagtgcggcgatgatctaagacaggaacttctggcattccaggtgctcaagcagctccagtctatttgggaacaggaacgggtacccctatggatcaaaccttataagattctcgtaattagcgctgactccggtatgatcgaacctgttgtcaatgcagtttcgatacatcaggtgaagaaacagtcccagctgagtctccttgattatttcttgcaggagcacggcagctacaccaccgaggccttcctgtctgcccagagaaatttcgtgcagtcttgtgcgggatattgcctcgtctgttatcttttgcaggttaaagaccgacataatggtaatatactcctggatgccgagggccacataatccatatcgattttggcttcatcctgagttcatctccacgcaatctgggattcgaaacatctgcttttaagttgactaccgaattcgtagacgttatgggcggactggatggcgatatgttcaattactacaagatgctgatgctccagggtctgatcgccgctcggaagcatatggataaagtagtccagattgtggagatcatgcagcagggtagccagctgccctgttttcacggaagctcgactatccgaaatctgaaggagcgcttccatatgtcgatgacagaggaacagctgcagttgttagtggaacagatggtagatgggtccatgcggtccatcaccaccaagctgtacgacggattccagtatctcactaacggcatcatgtag

SEQ ID NO: 28775 - DNA, 2406 bp, Artificial Sequence
  Description of Artificial Sequence: Synthetic coding sequence
atgggggataccgtggtggagccagctccacttaaacctacgagtgagcctacctcaggaccacccggtaacaatggaggttcccttttgagcgttattaccgagggcgtgggcgaactctccgtgatagatccggaggtcgcccagaaagcctgccaggaagttctggagaaagtgaaattgctgcatggaggggtggccgtctcatcaagagggactccgctggaattagtcaatggtgacggcgttgactctgagatccgctgtcttgatgaccctcctgctcaaattagggaggaagaggatgaaatgggggcagccgttgcaagcggtaccgcaaagggcgcacggaggagacggcagaacaattcggcaaagcagtcttggctcctaaggttgtttgaatccaagttatttgatatttcaatggctatctcttatctgtacaacagcaaggagcccggagtccaggcatatatcggcaatcgactgttttgctttcgtaacgaggacgtggatttctacttaccgcaattgcttaatatgtacattcacatggacgaggacgtgggagatgcgattaagccttatatagtccatcggtgtcggcagtctatcaatttctcactccagtgtgcgctgctactcggggcatacagttctgatatgcatattagcactcagcgccattctaggggcacgaaattgcggaagctaattcttagcgatgaacttaaaccagctcatagaaagcgcgagctgccatcattaagtccagcccctgacacagggctgagcccttctaaaagaacgcatcagcggtccaagtccgatgccacggcttctatttcactctcatctaatttaaaacggacagccagcaaccctaaagtggagaatgaagacgaaccagttaggctggctccagaacgggagtttattaaatctttgatggccattgggaaacgcctcgctacactgcccactaaagaacagaagactcagagactgatttccgaactgtctctgctaaatcataaacttcctgcccgagtgtggctaccaacggcaggcttcgaccatcatgtggtgcgggtgccccacactcaggccgtcgtcctcaatagcaaggacaaggccccatatctgatttacgtggaggtgctcgagtgcgagaattttgataccaccagtgtccctgcacggatccccgaaaaccggattcgttcaactaggtcagttgagaatcttccggagtgcggcattacccacgagcagagagccggttcctttagtacggttccgaattacgacaacgacgacgaggcgtggtctgtggatgacattggggagttgcaggttgagctgccggaggtacacactaactcttgcgacaatatctctcagttttctgtggactctattacctcacaggaatctaaggagcccgttttcattgcggcaggcgacattcgtagaaggctgtcagagcaactggcccatactcctacagccttcaaacgagatcccgaagatccttcagcagtagctctcaaggagccgtggcaggagaaagtgaggagaataagggagggcagcccttatggacatctcccaaactggagactgctgtcagtgattgtcaagtgcggagacgatttgaggcaggaactgcttgcctttcaagtcctaaagcagttacagtctatatgggagcaagagagagtccctctgtggataaaaccgtacaagattctggtaatcagcgccgattctggcatgatcgagccggtggtgaatgccgtgtcaatccatcaagtgaaaaagcagtcacagctgagcctgctcgactactttttgcaggagcatggcagctatacgaccgaagccttcttgtccgcacagcggaattttgtacagtcgtgtgccggatactgtctagtatgctatcttttgcaggtcaaggacagacataatgggaatatcctgcttgacgccgagggtcatataattcatattgacttcggcttcatcctaagtagctctccgagaaatctgggttttgagacctctgcctttaaactgacaaccgagtttgtggacgtgatggggggtttggatggcgacatgtttaactactacaagatgctgatgcttcagggacttatcgcggcacgcaagcacatggacaaggtggttcagattgtcgaaatcatgcagcagggctcccagctgccttgctttcacggcagtagtaccatcaggaacctcaaggaaaggtttcatatgagcatgaccgaggagcagttgcagttgttagttgagcaaatggtcgacggctctatgaggtctattactacaaaactgtatgacggctttcagtatttgactaacggcataatgtag

SEQ ID NO: 28776 - DNA, 2487 bp, Artificial Sequence
  Description of Artificial Sequence: Synthetic coding sequence
atgcgcttcctggaggccaggagcttggctgtggccatgggcgacaccgtggtggagccggctcccttaaagcccacttcagagccaacgagtggtccaccgggaaataacggtggcagtctgctgagcgttatcacggaaggcgtgggggagttgtcagtaattgatccagaggtcgcccagaaggcatgtcaggaggtgcttgagaaggtgaaactgttacatggcggagtcgctgtgtccagtcggggtacccctctggaactcgtcaatggggacggagtggactcagagatccgctgtttggacgacccacccgctcagattcgggaggaggaagacgagatgggggcagccgtggcaagtggtactgccaaaggcgctaggcgcagaagacagaacaattctgccaaacagtcttggcttctgcgattgttcgagtctaagctgtttgacatcagcatggctatcagctatctgtacaatagcaaagaacccggtgttcaagcatatatcggcaacaggctgttctgctttcggaacgaggacgtcgacttttacctgccccagcttctcaacatgtacatacatatggatgaagatgtgggcgacgccatcaaaccatatattgttcaccggtgccggcagtctataaacttcagcctccaatgcgctctccttttgggtgcttatagctccgatatgcacatctctactcaacgccattcacgaggtacaaagcttcgcaagcttatattgagcgacgagctgaaacccgcacaccgaaagcgggaattgccatctttgagccctgcgcctgacactgggctgagccccagcaagaggacccatcagaggagcaaatctgatgccacagccagcatcagcctctcctcaaacctcaaacgcactgcctctaacccaaaggtagaaaacgaggatgaggaactgtcatcctccacagagagcattgataattcattcagtagcccagtacgtctggcgccagagcgcgagttcattaagtccctgatggccattggcaagagactcgcgacactgcctactaaggaacaaaaaacccagagacttataagtgagttgtccctcctgaaccacaaactgccagcaagggtgtggctgccaacagcaggttttgatcatcatgttgtgcgagtgccccacacccaggccgtggttctgaattcaaaagataaagccccatatctgatttacgtggaggtcctggaatgcgagaactttgacactacttccgtacccgcaagaattcccgagaaccggattagaagcactcggtccgtcgagaaccttcctgagtgcgggattacccatgaacaacgcgcaggctcgttctcgaccgtgcccaattatgataacgacgacgaggcgtggtcagtagatgacatcggcgaactccaagtggagctgcctgaggttcataccaacagctgtgacaacatatcacagttctccgtcgattccatcacctcccaggagagtaaggagccagtgttcattgcagccggtgatattcggcgtagactgtcagaacagcttgcacatacccccacagcctttaaaagggacccagaagacccatccgccgtggcgttgaaggagccttggcaggagaaggtaagaagaatcagggagggcagtccctatggccatctgcctaactggcggctgctgagcgtgattgttaaatgtggggacgacttacggcaggagttattggccttccaagtcttgaagcagctccagtctatctgggagcaagaacgggtgcccctgtggatcaaaccctataaaatcctggtgatttctgccgattccgggatgattgaacccgtggttaatgccgtatcgattcaccaggtaaagaaacaatcacagctgtctctgttagactactttctgcaggagcatgggtcttatacgacagaggcctttttgagtgctcagcgaaatttcgtccagagctgcgccggatattgtttggtgtgttacctcttgcaggtaaaagatcgccacaacggaaacattttgctagatgctgaagggcatattatacacatagactttggtttcatcctgagctcttctcctcgcaacctcgggtttgaaacctcggctttcaaattgacaacagagtttgttgacgtcatgggcggtctggatggagacatgttcaactactacaagatgctcatgctacagggcctgatcgccgcacgcaagcacatggataaggtcgtgcagatagtagagataatgcagcagggctcccagttaccttgtttccacggatccagcaccatccgtaatctgaaggagcgattccacatgagcatgacagaggaacagctgcaactgctcgttgagcagatggtcgacgggtctatgcggtcgatcacgaccaaactgtacgatgggttccaatatctaaccaacggcatcatgtag

SEQ ID NO: 28777 - DNA, 1143 bp, Artificial Sequence
  Description of Artificial Sequence: Synthetic coding sequence
atggtgcttgagagcacaatggtctgtgttgataattcggaatacatgaggaatggcgattttctgcctactagactgcaggctcagcaggacgccgtgaatatcgtttgccacagcaaaactcggagtaatcctgagaataatgtggggctcatcacactggcgaacgactgtgaagttctgactactttgacacctgacacgggcagaatcttgtccaagcttcatactgttcagcctaaaggaaaaataaccttctgtaccggcattagggtggcccatctggccctgaagcaccgccagggcaagaatcataagatgaggatcatcgcgtttgtggggagccccgtggaagataacgaaaaggatctagttaaactcgctaaaagactgaagaaagaaaaagtcaacgtcgacataattaacttcggcgaagaagaggtcaatacagagaagctcactgcttttgttaacacactaaacgggaaggatggcaccggttctcatttagtgacagtcccgccaggtccaagtttggctgacgctctgataagttcccccatactggctggcgagggcggagcaatgcttgggctcggggcaagtgacttcgaattcggggtggacccatccgccgatccagaactggctctggctttgcgcgtttccatggaggaacagcgccagcgccaggaggaggaagctcggagggcagctgccgcatcagctgcggaggcaggcatagctaccacggggaccgaaggtgaacgcgatagcgacgacgcacttctgaagatgactatttctcagcaggaattcggtcgcacaggtttacctgaccttagctctatgacggaggaggagcaaatagcctatgctatgcagatgagcctgcagggcgctgaattcggacaggccgagtctgcagatattgatgcgtcttcagcgatggacacgtctgagcccgcaaaggaagaggacgactacgacgtgatgcaagaccccgagtttctccagagtgtgcttgaaaatcttcccggagttgaccccaataatgaggctattaggaatgcgatgggcagtctggcaagtcaggcgacgaaggacgggaagaaagacaagaaggaggaggacaaaaagtag

SEQ ID NO: 28778 - DNA, 1134 bp, Artificial Sequence
  Description of Artificial Sequence: Synthetic coding sequence
atggtgctggaatctacaatggtctgcgttgataattccgaatatatgcgtaacggggacttcttgcccacccgactgcaggcccagcaggacgccgtgaatatcgtctgccattccaagacacgcagtaacccggagaataatgtcggactgatcacgctcgccaatgactgcgaggtgctgaccaccctgacaccagatactgggcgtatcttatccaagctgcataccgtgcagccgaaaggcaagattactttttgcaccgggatccgggtcgcgcacctggctctgaaacaccgacaaggaaaaaaccacaaaatgaggattattgcttttgtggggtcccccgttgaggataacgagaaggacttagtgaagctggctaaacggctgaagaaggaaaaggtaaatgttgacataattaatttcggtgaggaggaagtaaatactgaaaagctgaccgcatttgttaacacactaaacggcaaggacggcaccggctcccacctcgtgaccgtgccacccggaccaagcctggccgacgctctgatctcttcacctatactggctggagaaggcggagctatgctgggcctcggcgcatctgactttgagtttggggtcgatccctcagctgatccagagttagcccttgcattacgtgtgagcatggaggaacagcgccaaaggcaggaggaggaggccagacgcgcagcggctgccagcgccgcagaggctggcattgccacaaccgggacggaggatagcgatgatgccttactcaagatgacgatctctcagcaggaatttggcagaactggcttgccggacctgtccagcatgactgaagaggaacaaatcgcctatgctatgcagatgtcactgcaaggggcagagtttggtcaggcagagagcgcagatatcgacgcttcttctgctatggacacctctgaaccagctaaggaagaagacgactatgatgtgatgcaagaccctgagtttctgcagagcgtgcttgagaatttgccaggagtggaccccaacaatgaggccatcaggaacgcaatgggatcgctggccagccaagctaccaaagacggaaagaaggacaagaaagaggaggataaaaaatag

SEQ ID NO: 28779 - DNA, 933 bp, Artificial Sequence
  Description of Artificial Sequence: Synthetic coding sequence
atgagaccagctagacactgggagacgaggttcggcgcacgggattttggaggatttcaggactgcttctttcgcgaccgactcatggatacggcacgcatcgccgtggtcggggctggcgttgtcggactgagtaccgccgtgtgcattagtaagttggtcccgcgttgctctgtgactatcatatcagataagtttactcccgataccaccagcgacgtggctgccggtatgttaatcccacatacatatcctgacacaccaattcacacacaaaagcagtggtttagagaaacgtttaatcatctgtttgccatcgccaactcagccgaagccggtgacgctggagtgcacctcgtcagcgggatcaagggtagcggcggatggaccctgaccaggagaattgaggacctgtgggagttgcacccctctttcgatattgtcgttaactgtagcggtctcggaagtcggcaactggcaggcgacagcaagatcttccctgtcaggggtcaggtcttacaagtacaggccccttgggtggaacatttcataagggacggctcaggactcacatacatctaccctggaacatcacacgtgacactcggcggtacaaggcagaaaggcgattggaacttgtccccggatgcagaaaatagtcgggaaatcctttccagatgctgcgctttggagcctagcttgcatggggcatgtaacatccgcgaaaaggtgggcctcaggccttatcgacccggagtacggctgcagactgagttgctggctcgcgatgggcagcgactgccagtggtgcaccactacggacacgggtccggcggtatctccgtgcactgggggactgcactagaggcggcaagactggtaagcgagtgtgtacacgccctcagaacaccaattccgaaatccaacctctag

SEQ ID NO: 28780 - DNA, 1110 bp, Artificial Sequence
  Description of Artificial Sequence: Synthetic coding sequence
atgcgccctgcaagacactgggaaacccggttcggagcgagggatttcggaggattccaggattgcttctttagggaccgcctgatggatacagcacgaattgccgtggtgggtgccggagttgtgggactgagtacagccgtgtgcattagcaaacttgtgccccgttgcagcgtgacaatcattagcgataagttcacgcctgataccacctcagatgttgccgctgggatgctcattccccacacatacccagatacacctatccacacccagaaacaatggttccgcgaaaccttcaaccaccttttcgccatcgcgaattccgcagaagccggtgacgccggagtgcacttagtctctggatggcaaatatttcagtccaccccgacagaggaggttcccttctgggcggacgtcgttctgggcttccgtaaaatgacggaggccgagctgaagaaattcccccagtatgttttcggtcaagcctttactacactgaaatgtgagtgtccggcttacctgccgtggctggagaagcgcatcaagggaagcgggggttggacattgacgcggcgtatcgaggacctgtgggaactccacccttcattcgatattgttgtgaactgctctggcctcggatctaggcagctggcaggcgattccaagatcttccctgtgaggggccaggttctgcaggtgcaggctccatgggtggaacactttattcgggatggcagtggtctgacatatatatacccgggaaccagccatgtgacgttgggtggcacccgtcagaagggcgactggaatctgtcacctgatgcagaaaacagccgcgaaatcctgtctcgatgttgtgctctcgagccttccctccacggcgcttgtaatatcagggagaaggtggggcttcggccttacaggccaggtgtcagattgcagactgagttactggcaagggatgggcaacggctacccgtagtccaccattacggccacggatcggggggaatttctgtgcattggggcaccgctctggaggcggctaggctcgtgtctgaatgtgtgcacgctttaaggacaccgataccaaaatcgaacctgtag

SEQ ID NO: 28781 - DNA, 1026 bp, Artificial Sequence
  Description of Artificial Sequence: Synthetic coding sequence
atggacaccgcgcgtattgctgtcgtaggagcaggggttgtcgggctgtctacagcagtgtgcatctctaaactggtacccagatgcagtgtgaccataatctctgacaagtttacgccagatactacatcagatgtggccgctggaatgcttatcccacatacttaccccgacacacctatccatacccagaagcagtggttccgcgaaaccttcaatcacctgttcgccatcgctaattctgccgaggctggagatgccggtgttcacttagtgagcggctggcagatatttcagtctacacctaccgaagaagtgccgttctgggcagatgtcgtgctaggcttccgtaaaatgacagaagctgagctgaagaaatttccccagtacgtgttcgggcaggctttcacaaccctcaagtgcgaatgccctgcctacctgccgtggcttgagaagagaattaagggaagtggcggttggaccttgacccgacgcatcgaagacctgtgggagctccatccttcattcgatattgtagtgaactgcagcgggctgggatcccggcagctggcaggggacagcaagatttttccagtccggggacaggtgttacaggtgcaggcgccttgggtggagcattttattcgtgacggatcaggactgacatacatatacccaggtaccagccatgtgacactgggaggaacacgccagaagggagactggaacttgagccctgatgcggagaatagcagggagattttgagtcggtgctgtgccctcgaaccatccttacacggagcctgcaatataagggaaaaagttggcctgaggccgtacagaccgggtgtgcgtctgcagaccgaacttcttgctcgggacggtcagcgccttcctgtggtgcatcactacgggcatggctccggcggtatctcagtccactggggaacagcacttgaagctgcaaggctagtttccgagtgtgtccacgcccttagaacccccattccaaaaagtaacctctag

SEQ ID NO: 28782 - DNA, 1074 bp, Artificial Sequence
  Description of Artificial Sequence: Synthetic coding sequence
atggggacaattcaggaggctggcaaaaagaccgacgtaggcgtgagagaaatcgccgaggccccagaactaggcgctgccctcaggcatggtgagctggagcttaaggaggagtggcaggacgaggagttccctcgactcttacccgaggaagctggcacttccgaagacccagaggatccaaaaggagatagccaggccgctgcaggcacccccagcaccttggcgttatgtggacagcggcctatgagaaaacgcctcagtgcccctgagttgcgactgtctttaaccaaaggacctggtaatgatggagcatccccgacacagtccgcccctagtagcccggacgggtcctcagacctggagattgacgagctggagacacccagcgattcagaacagctggactccggtcacgagttcgagtgggaggatgaactgcccagagccgaaggactgggaacgtctgaaacggccgagaggctcggcagaggatgtatgtgggatgttacgggcgaagacggacaccactggagagtgttccgtatgggccctcgcgagcagagggtcgacatgactgtcatagagccctataaaaaggtgctatcgcacggtgggtaccacggtgacggccttaacgccgtgatactgtttgcttcctgctacctcccacggtcgagcattcccaattacacttacgttatggagcatctcttccgctacatggtcggcaccctcgagttgctagtggccgaaaactatctactcgtgcacctttctggaggaacaagccgcgctcaggtgccaccactttcttggattagacagtgctatcgaacgttagacaggagacttagaaaaaacctcagagcactagtcgttgtacacgctacctggtacgtgaaggctttcctcgccctcctacgaccgttcatatctagtaagtttactcgaaagattcgatttttggattccctaggcgagttggcacagctcatcagcctggatcaggtgcacatacctgaggccgtccgccaacttgaccgcgacttgcacggaagtggtggcacttag

SEQ ID NO: 28783 - DNA, 1269 bp, Artificial Sequence
  Description of Artificial Sequence: Synthetic coding sequence
atgcttaagttcctcgcaaagggcgaggttccaaaaggctcatgcgaggacgagccgatggactctaccatggatgacgctgtggccggagattttgccctcatcaataaattagatatacagtgcgacctcaagactctgagcgacgacataaaggaatctctagagagcgaaggtaaaaacagtaagaaggaggagcctcaggaacttttgcagagtcaagactttgtaggcgagaagctcggatccggcgagccttcacactcagtcaaggtgcacacagtgccaaaacctggcaaaggagccgatttaagcaagcccccttgtcggaaggctaaggagattcgcaaggagaggaaaaggctcaagctgatgcagcagaaccctgccggagaacttgaaggttttcaggcccagggccatcccccttcccttttccctcctaaagctaagagcaaccagccgaagtctctggaggacctgatttttgagtctctgccagaaaatgcaagtcacaagctcgaggttcgcctggtgccagtgtcctttgaggaccccgagttcaaatcctctttctcccagtcttttagcctgtatgttaagtatcaggtggctatccatcaggatccacctgatgagtgtggtaaaaccgaatttaccagattcctatgttcatctccactggaagccgagactcctcctaacggccctgattgcgggtatggcagctttcaccagcagtactggctcgatggcaagatcatcgccgttggagtgattgatatccttcccaactgtgttagctcagtatatttgtattacgatcccgactactcgttcctgtcactgggtgtttattctgcactgcgggagatcgccttcaccagacagttgcacgaaaagacgagccaactttcttattactatatgggcttctacatccatagctgtcccaaaatgaagtacaagggccagtatcgacccagcgatctgctgtgccctgagacatacgtgtgggtgccgatcgagcaatgtttacctagcctggagaatagcaagtattgtcggttcaaccaggaccccgaggccgtggatgaggatcgcagcaccgagcccgataggctgcaagtgttccataaacgggcaatcatgccttatggcgtatataaaaaacaacagaaggatccctccgaggaggcagctgtgctgcaatatgcctcattggtgggccagaagtgctctgaaagaatgctgttgtttcggaattag

SEQ ID NO: 28784 - DNA, 1557 bp, Artificial Sequence
  Description of Artificial Sequence: Synthetic coding sequence
atggccttctgggcaggagggtcccctagtgtggttgattacttcccatctgaggacttttatcgatgtggttattgcaaaaacgagtcaggttcacgctctaacggcatgtgggcccattccatgaccgtgcaagattatcaggacctcatcgaccgcggatggcggagaagcggtaagtacgtatataaaccagtaatgaaccagacttgctgcccccagtacacgattcggtgccggcctctgcaatttcaacctagtaagtcccacaagaaagttttaaaaaagatgttaaaattccttgccaaaggagaagtgcccaaaggttcatgtgaagacgaacctatggatagcactatggatgacgccgtcgccggtgattttgctctcattaataagctcgatattcaatgtgatctgaaaacactctccgatgacataaaggaaagtttggagagcgaggggaagaattcgaagaaggaggagccccaggagctgctgcaatcccaggattttgtaggagagaaactgggctccggggagccatcccattcagttaaagtgcataccgtgcctaagccaggcaaaggagccgacctgtcaaagcccccttgtcgcaaggcgaaggaaataagaaaagagcggaagagactgaagttgatgcagcaaaacccggctggagagctggaagggtttcaagcacaaggtcaccctccaagcctttttcctcccaaagctaaaagcaatcagcctaagtctctggaggacctaatcttcgagagcctgccggaaaacgcctcacataaactcgaagtccgactggtacccgtctcatttgaagaccctgaattcaagtcctcattctcccaatccttcagtctctacgtcaaatatcaagtggctattcatcaggacccgcctgatgagtgcggcaaaacagaattcactagatttttgtgtagctcccccttggaagccgaaactccccctaatggacccgattgtggctatggcagctttcaccagcaatactggctcgatggaaaaattatcgctgttggcgtgatcgacatactgccaaattgtgtgtcctctgtgtacctctattacgatccagactacagctttctgtctcttggcgtgtacagcgctttgcgcgagatcgcgttcacacgccagctgcacgagaagacttcgcagcttagctattactatatgggtttttatatccatagctgccctaagatgaagtacaagggacagtataggcccagcgacctgctctgcccggagacgtatgtgtgggtgccgatcgagcagtgcttaccatctctcgagaatagcaagtactgtcggttcaaccaagatcctgaagccgtggatgaggatcggagcacagaacctgaccggctgcaagtgtttcataaacgggctatcatgccatacggcgtgtataaaaagcagcagaaggatcccagcgaggaggccgcagtgttgcagtacgcaagcttagtgggccagaagtgtagtgaaagaatgctcctgttccgtaactag

SEQ ID NO: 28785 - DNA, 3003 bp, Artificial Sequence
  Description of Artificial Sequence: Synthetic coding sequence
atggccgagcgcaagcccaacggcggatcaggcggagcttccacctcatcaagcgggactaatctgttgtttagcagcagtgcgacggagtttagcttcaacgtccctttcatacctgtgacacaggcctctgccagccctgcatccctgctgctgccaggggaagacagtacagacgtgggcgaggaggatagttttctggggcaaacttccattcatacttccgctccccagaccttttcttactttagccaggtcagttcttcctcagacccattcggaaacattggacagtcgccccttactactgccgcaacatctgtgggccagtctgggttccccaagccactcaccgcgctcccattcaccacaggcagtcaggatgtgtccaatgccttctcgccgtctataagcaaggcacaacctggcgcaccaccaagctctttaatgggcataaactcctatctgccatcgcaacctagttccctgcccccatcttatttcggcaaccagccccaggggatcccgcagcctggatacaatccataccgccatacaccagggtccagccgggctaacccctatatcgctcctcctcagctccagcagtgccagactcccggtccccctgcccaccctcctccctccggccctcctgtgcaaatgtatcaaatgcctcctggaagtctcccacccgtccctagctctgtgcaaagccccgctcagcaacaggttcctgcaaggccgggtgccccttcagtacaggtcccctcaccctttttgctgcagaaccagtacgagcccgtccagccacattggttctactgtaaggaagtagagtacaagcagctttggatgcccttcagtgtattcgattctttgaatttggaggaaatttataactcagtgcagccggaccccgagtctgttgtgttgggcaccgatggcggacgctatgatgtctatctgtatgaccggatacgcaaggcggcttactgggaggaggagcctgctgaggtacgcaggtgtacttggttctacaaaggggatacagattcccggttcatcccttatactgaagagtttagcgagaagctggaagccgaatacaaaaaagccgttacaactaaccagtggcataggaggctggaattcccaagcggagaaaccatcgtgatgcacaatcctaaagttatcgtacaattccagccttccagtgtgccagacgagtggggcactacccaggatggccagacccgcccaagagtggtgaaacgtgggatagacgacaacctcgacgaaatcccagacggcgaaatgccccaggtcgatcatctggtctttgttgtacatggaatcggcccagtatgcgacctgcggtttagatctatcattgagtgtgtcgatgactttagggtcgtgtcgctgaaactcctgcgcacgcactttaagaaatctctcgatgatgggaaggtatctcgcgtagagtttctacctgtgcactggcacagcagcctaggtggggacgctaccggagtcgacaggaacatcaagaaaatcacccttccttccattggccgtttcaggcatttcacaaatgagaccctacttgatattctgttttacaatagcccaacttactgccagaccatcgtggaaaaggtgggaatggagataaaccacctgcatgccttattcatgtcccgaaatcctgatttcaagggtggagtgtccgtcgctggccactctctcggaagtctgattctgtttgacatactctccaatcagaaggatctgaatttgtccaagtgtcccggaccactagcagtggccaatggcgtcgtgaagcagctgcacttccaggagaagcaaatgcctgaagagcccaaattaaccctggatgaatcatatgatttggtggttgagaacaaagaggtcctcaccctgcaggagaccttagaggcgcttagcctcagtgagtacttcagcacctttgagaaggaaaaaatagatatggagtcgctgcttatgtgtaccgtcgacgatcttaaggagatgggtatccctttaggacccagaaagaagattgccaacttcgtagaacacaaggccgctaagcttaagaaggccgcatccgaaaagaaggctgtggctgccaccagcaccaaggggcaagagcagtctgcccagaagactaaggacatggccagtctaccatccgagtccaacgaaccgaagcgtaaactgccggtgggcgcttgcgtgtcgtcggtgtgtgtcaattatgaaagttttgaggtgggggctggacaggtgagcgtggcgtacaattcactggatttcgagcctgaaatcttcttcgccctgggatctcccatcgcaatgttcctgacaataagaggggttgacaggatcgacgaaaattattcgctgccaacctgtaaaggattttttaatatctaccaccccctagacccggtggcctatcgcctggaaccaatgatcgtgcctgatctggatctcaaagccgtgctgattccccaccataaaggtaggaagaggctgcatctggagctaaaggaatctcttagtcggatggggagcgatctgaaacagggatttatctcatccctgaagtcagcgtggcaaactctgaacgaatttgctcgtgcgcacacctcttctactcagcttcaggaagaactggagaaggtagccaaccaaataaaagaagaggaagaaaaacaagtggtcgaggccgagaaggtggtcgaaagccctgatttctccaaggatgaggactacctcgggaaggtgggaatgttaaacggtgggaggcgcattgattatgtactccaggagaaaccaattgagtcctttaacgaatacttatttgctctgcagagtcatctgtgttattgggagtccgaagataccgccctcctgctgctgaaagagatttacagaaccatgaatatctctcctgagcagccccagcactag

SEQ ID NO: 28786 - DNA, 495 bp, Artificial Sequence
  Description of Artificial Sequence: Synthetic coding sequence
atggttaactcagtggtcttcttcgacatcacagtagacggaaagcccctgggcaggatcagtatcaaactttttgcggataaaatcctcaaaacagcagaaaactttagggcactgtcaaccggggagaaaggctttcgttataaaggcagttgtttccacagaatcattcctggattcatgtgccagggaggagacttcacccgtcacaacggtactggagacaagagcatatatggcgagaaatttgatgatgagaatctcatccggaagcacaccggcagcgggatcctgtccatggctaacgccggacctaataccaacggcagccagtttttcatttgtgcggcaaagaccgaatggttggacggcaagcacgtcgcttttggcaaggtgaaagaaagagtgaacatcgtcgaggctatggaacactttggatacaggaacagcaaaaccagcaagaaaatcaccattgctgactgcgggcagttttag

SEQ ID NO: 28787 - DNA, 426 bp, Artificial Sequence
  Description of Artificial Sequence: Synthetic coding sequence
atgaagatcctggacgtgggttgcggaggaggcctgctgacagagcccggaggatctctcttcatcactaccatcaacaaaacccagcttagctacgcattgggaatcgttttttcagaacagattgcttccatcgtgccgaagggcacccacacttgggagaaatttgtgtccccggagactctggagtctatcttggaatctaacggcctttccgtgcagaccgtcgttgggatgttgtacaatcccttttccggatattggcattggtctgaaaacacctcacttaactatgccgcatacgcggtcaagagtagagttcaggaacaccctgctagcgccgagtttgtgcttaaaggggaaacagaggagctccaggctaacgcctgcacgaatccagctgtccacgagaagttgaagaagtag

SEQ ID NO: 28788 - DNA, 426 bp, Artificial Sequence
  Description of Artificial Sequence: Synthetic coding sequence
atgaaaatcctcgacgttgggtgtggaggcggactgctgactgaacctggaggaagcctatttattacgaccatcaacaagacacagctgagttatgcactgggcatcgtttttagcgaacagattgcttctatcgtgcccaaaggaacgcacacatgggaaaaattcgtgtccccagagactctggagtccattctggagtctaatggcttatccgttcagactgtagtcggcatgctctacaatcctttctctggctactggcattggagcgaaaatacttctctcaactacgccgcatatgccgtgaagagtagagtccaggaacatcctgccagcgccgaattcgtcctgaagggggaaactgaagagctgcaagcaaacgcttgtacaaatccagccgtccatgaaaagttaaagaaatag

SEQ ID NO: 28789 - DNA, 2157 bp, Artificial Sequence
  Description of Artificial Sequence: Synthetic coding sequence
atgttaatgaccctggagatgaccgaactcactgatcctcaccacactatgggtgactataaagtcgcccatcctcaggacccacatcacccatctgaaaaaccagtgatccattgtcacaaatgtggggagccctgtaagggtgaagtgctgagagtacagaccaagcatttccacattaagtgttttacttgtaaagtatgtggttgcgatctggcacaggggggatttttcattaagaacggggagtacctgtgcactctggactatcagcggatgtatgggactcgctgtcatggttgtggggaattcgtggagggtgaggtggttacagccctcgggaagacctaccaccccaattgcttcgcctgtactatctgtaagcgccctttcccacctggtgacagggtaacttttaatggtagggattgcctatgtcaactgtgtgcccagcctatgagcagctctccgaaggagacaactttctcttcaaattgcgcagggtgtgggagggatattaaaaatgggcaggcgctcctagcccttgacaagcagtggcatctgggatgttttaaatgcaaatcttgtggtaaggttttgacaggagagtacatcagcaaggatggggctccatattgtgagaaggactaccagggcctgttcggggtgaaatgcgaggcctgccaccaatttattacgggaaaagtgctggaggccggtgataaacactatcatcccagctgcgcccgatgcagccggtgtaaccagatgtttaccgagggcgaggagatgtacttacagggtagcacggtgtggcacccagactgtaagcaatcgacaaagacagaggagaagctgcggccaacacgtacttcctcggaatccatttacagcagaccgggatcctccataccagggagccctgggcacacgatttatgctaaggttgataacgagattctggattataaagacctggccgcaattcccaaggtgaaggctatttacgacattgagcgtcctgatttgatcacatacgagcctttttatacctccgggtacgatgataagcaggagagacagagcctgggcgagagtcccagaacactgtctcccaccccttccgctgaaggctaccaggatgtgcgagaccggatgattcatcgatctacatcacaaggttctatcaattccccagtgtattcacgccattcctacacaccaacaacatcgcgctcaccacagcatttccaccggccaggtaatgaaccatcttcagggaggaactccccacttccatatcgtcccgactcccgcccactgaccccgacttacgcacaggccccaaagcactttcacgtgcctgaccagggcattaacatatatcgaaagccacccatttataaacagcacgctgctttggcagcccaaagtaagtctagcgaggacattattaagttttctaaatttcccgctgcacaggccccagatccaagcgaaacccccaagatcgagaccgatcactggccaggacccccttctttcgctgtcgtcgggcctgacatgaagcgaagaagcagcggtcgcgaagaggacgacgaggaacttctgcggaggcgccagctacaggaggaacagctcatgaaactgaacagcggcttgggacagctcatcctaaaggaggagatggaaaaggaaagcagggagcggtcttctctgctggcgtccagatacgactccccaataaattcggcctctcatatcccatctagtaaaacggccagcctacccggatacgggagaaacggcctgcacaggccagtcagcactgacttcgcccagtataattcctacggcgacgtgagtggtggcgtaagagattaccagacattgccagacggtcacatgcctgccatgcgcatggaccggggtgtgagcatgcctaatatgctcgagccaaaaatctttccatatgagatgctaatggtgacaaaccggggtcggaataaaattctgagggaagtggacaggacacggcttgaaaggcatctggccccagaagtctttcgagaaattttcggtatgtccatccaggaattcgaccgactgcctctctggaggcgaaacgacatgaagaaaaaggctaagctgttctag

SEQ ID NO: 28790 - DNA, 1593 bp, Artificial Sequence
  Description of Artificial Sequence: Synthetic coding sequence
atgttcacagaaggagaggaaatgtaccttcagggaagcaccgtgtggcaccccgattgcaaacagtctacaaaaacggaggagaagctccgactgccaaatatccggagaagttccagtgacttcttttattccaaaagtcttatccgtagaactggaagaagcccatcactccagccgacgcggacctccagcgaaagcatatactctcggcctggttcatcaatccccggatcccccggacatacaatttacgccaaggtggataacgaaatcctcgactataaggatttggccgctattccgaaagtgaaagctatttacgacattgaacgtcccgatttgattacctacgagcctttctatacgtccgggtacgacgacaagcaagagcgccagtccctgggggaatcaccacggactttgtctccaacgccctcagcagaaggataccaggatgtccgggatcggatgatccacaggagcacatcacagggaagtattaactcgccagtgtacagccgccattcttacacccctacaacgagccgcagccctcagcattttcatcgaccagaactgctctccccaggcgtgcagcgattgagttacctgcgcacatccagtctcagccctacacacagcgattcccggcctaacccgcctttcaggcaccatttcatccctcatattaagggcaacgaaccgtcaagtggcaggaacagccctctgccgtatcggccagactcccgacccctgactccaacctacgctcaggctcctaaacactttcacgtgcccgaccaagggatcaatatctacagaaagccccctatatacaagcagcacgcagcgctcgccgcacaatctaaaagttcagaggacattatcaaatttagcaagtttcccgctgcacaggcccctgacccatcagagacccccaagatcgagacagaccactggccgggacccccatcattcgcagtggtcggtcctgacatgaagcgcaggtccagtggacgtgaggaagatgacgaggagctactacggaggaggcagctgcaagaggagcagttgatgaaactcaatagcgggttggggcagctgatacttaaggaagaaatggagaaggaaagtagggagagatcttcgcttctggcatcacgttatgactctccaattaactccgcatcacacatcccgagcagcaagaccgcctctctaccaggctacggtcggaatgggctccacagacctgtgtctacagatttcgctcaatacaacagctatggcgatgtaagcggaggggtccgcgattaccagacattgccagacggacatatgccggctatgagaatggataggggcgtttctatgcccaacatgctcgaacctaaaatattcccctacgagatgttgatggtaacgaaccgcggaaggaacaagatactcagggaagtagaccggactcgcctcgagcgccacctagcccctgaggtgtttcgcgaaatcttcggaatgagtatacaggagttcgaccgactcccactttggcgccgaaatgacatgaagaagaaagctaagttgttttag

SEQ ID NO: 28791 - DNA, 2109 bp, Artificial Sequence
  Description of Artificial Sequence: Synthetic coding sequence
atggttaaggaaaaggtggctcaccctcaggacccacaccacccatccgaaaaacctgtgatccactgccataagtgcggcgagccttgtaagggagaagtgctgagggtgcagaccaagcacttccacataaagtgcttcacatgcaaggtgtgcgggtgcgatcttgcccagggcggatttttcataaaaaacggcgaatatctgtgtaccctggactaccagaggatgtacgggacgcggtgtcacggatgcggcgagttcgtcgaaggcgaggtggttacagccctgggcaaaacttatcacccaaactgcttcgcgtgcacaatatgtaagagacctttccctcctggagatcgggttacgttcaacggacgcgattgcctgtgccaactttgcgcccagcccatgagcagttcaccaaaggagacaaccttcagcagcaattgtgcagggtgcgggcgagatattaaaaacggccaggccttactggcactggacaagcagtggcaccttggttgttttaagtgcaaaagttgcggtaaagtcctaacaggcgagtacatctctaaggatggggctccctattgcgaaaaagattatcagggcctgttcggggtgaaatgcgaagcttgccaccaattcattacagggaaggtcttagaggccggtgataagcattatcatccctcctgcgctcggtgtagtcggtgcaatcagatgtttaccgaaggcgaagaaatgtatctgcagggctccaccgtttggcacccagattgtaagcagagcacaaagactgaggagaaactgagacctactcgcacatcctctgagtccatttactctagacctggttccagcattcccggttcacctggtcacacaatctatgcgaaagttgacaatgagatcctggactacaaggatctggccgctatccctaaagtgaaggccatctacgatatagaacggcctgaccttatcacctacgagccgttctacaccagcggctacgatgacaagcaagagcgacagagcttgggcgagtcccccaggactctgagtccaactcccagcgcagagggttaccaggacgtgagagaccgaatgatccatcggtctacctctcaagggagtatcaattctcccgtttacagcagacacagttatactcccaccacgagtagaagtccccaacattttcaccgcccaggaaacgaacccagttctggacgtaattcacccctcccctataggcccgactcacgccctctgacacccacgtacgcccaagccccaaagcacttccatgtgcctgaccaagggataaatatctatcgcaagccccctatttataaacagcacgccgcattggccgcacagtctaagtcttcagaagacatcatcaagttctcgaagtttcctgctgcccaggcccctgacccctctgagacccctaaaattgagacggaccactggcccggacccccttcatttgccgtggtgggaccagatatgaaacggaggtcgtctggcagagaggaggacgacgaggagctgttgcgtagaaggcagctgcaagaagagcagttgatgaagctcaattctgggctcggccagctgattcttaaagaagagatggagaaagaatctcgcgaacgcagctcccttcttgcgtctcgttacgatagtcctattaatagcgcaagccacattcccagttctaaaactgcatccctcccagggtatggcaggaacggactgcacaggccagtgagcaccgatttcgcccaatacaacagctacggcgacgtatcaggcggagtgcgcgattaccagaccctgccagatggacatatgcctgcaatgaggatggatcggggagtctccatgccaaacatgttagaaccgaagatcttcccatacgagatgctcatggtgaccaatcgcggacgcaacaagatcctgcgcgaggtggatcgtacccgactcgagagacacttggctcctgaggtctttagggaaatcttcggaatgtcaatacaggagtttgatcgcctcccactgtggcggaggaacgatatgaaaaaaaaagccaagctgttctag

SEQ ID NO: 28792 - DNA, 1206 bp, Artificial Sequence
  Description of Artificial Sequence: Synthetic coding sequence
atgttcaccgagggagaagagatgtatctgcagggtagtaccgtgtggcaccctgattgcaagcagagcaccaagacagaggagaagctccgggctaaggtggataacgagatcctggattataaggatttggccgctatcccaaaagtgaaggcaatctatgacatcgaaagacccgatcttattacctacgaaccattttacacaagcggctatgatgacaaacaagagaggcagtcattgggagagtccccccgaacacttagccctacgcctagcgcggagggttatcaggacgtgagggacaggatgatacaccgtagtacgtcccagggtagcatcaacagccctgtgtactctcggcattcatatacccccactacaagcaggagcccgcagcacttccaccgacccgatcagggcattaacatctacaggaagccacccatctacaaacagcacgctgcactcgcagcccagtctaaatcatctgaggacattatcaagttctctaagtttcccgctgcgcaggcgccagatccctctgaaacccccaaaatcgaaaccgaccattggcccggaccccctagcttcgctgtagttggacccgacatgaaaaggcggtctagtggacgcgaagaggatgacgaagagttgctgcgcaggaggcagctacaggaggagcagctcatgaagcttaactctggcctggggcagcttatcttgaaggaggaaatggagaaggagagtagagaacggagctctctcctcgcctctcggtacgattcacctattaactccgcatctcacatcccgtcttcaaagactgcgtcgctgcccggatacggcaggaatgggctgcacagacccgtgagtaccgattttgctcagtacaactcatatggtgatgtgtcaggcggagttcgggactatcagacattaccagatggccacatgccagctatgagaatggatagaggtgtaagcatgccaaacatgctggaaccaaaaatattcccgtatgagatgctgatggtcacaaacaggggcaggaacaagatcctcagggaagtggatcggacaagacttgagcgtcatctggctcccgaggtgttccgcgaaatctttggcatgagtatccaggaatttgacagacttcctctctggaggcgcaatgatatgaagaagaaagcgaagctcttctag

SEQ ID NO: 28793 - DNA, 1968 bp, Artificial Sequence
  Description of Artificial Sequence: Synthetic coding sequence
atggtcaaagagaaggtagcccacccacaggacccccatcacccatctgaaaaacccgtcatccattgccacaagtgtggggagccgtgcaaaggcgaagttctcagagtgcagacaaagcactttcacatcaaatgctttacgtgtaaagtgtgcggatgtgatctcgctcaggggggtttcttcattaaaaatggtgagtacttgtgcaccctggattaccaacgcatgtacggcactcggtgccatggttgtggagagtttgtggaaggcgaggtcgtgacagcacttggcaagacttatcaccccaactgcttcgcctgcactatctgtaagaggcccttccctcctggggatcgtgtaactttcaacggccgtgactgcctgtgtcagctctgcgcccagcccatgagctcatcacccaaagagaccacattctcaagtaactgtgcgggatgtggaagggacatcaagaatggccaggccctgttagcgctggataagcagtggcatctgggatgctttaagtgcaaaagctgcggaaaagtattaactggagagtacatctccaaggacggagcaccctactgtgagaaagactatcaggggcttttcggcgttaaatgcgaggcatgtcaccagttcatcaccggcaaggtcttagaagcaggcgacaagcattaccacccaagttgcgccagatgcagccgctgcaaccagatgttcaccgaaggcgaggagatgtatcttcaaggctccacagtgtggcaccctgactgtaagcagagcactaaaactgaagaaaagctaaggccaactcggacttcctcagaatccatctattccaggccaggaagcagcattcctggctcccctggacataccatctacgccaaggttgacaacgagatccttgactacaaggacttagcagctatcccaaaagtcaaagctatatacgacattgagcgacccgacctgatcacatatgaacccttctatactagcggctatgacgacaaacaggaaagacagtccctaggagagtccccccgaacattgtccccaacaccgagcgccgaggggtatcaggatgtgcgcgaccgtatgatccaccgttccaccagtcagggaagcatcaactcgccggtatactctcgacactcgtatacacccacaacatctcggtcaccccagcactttcatcggcctggtaatgaaccaagctccggcagaaatagccccctgccgtaccgacccgactctcggcctttaacaccaacttatgcccaagccccaaagcattttcacgtgccggaccaggggatcaatatctacaggaagcctccaatctataagcagcacgggccagacatgaagcgcagaagttctggccgagaagaagatgatgaggagctgctgcgcagacgacagctacaagaagaacagctcatgaaactgaactcgggactaggtcagctgatactcaaggaggaaatggagaaagagagtcgcgagcgctcttctttgttggcgtcacgctacgattctccaatcaattctgcctctcatatcccgtcttctaaaaccgctagcttgcccggatatggccgaaacggcctgcatcgtccagtgtctacagacttcgcccagtacaacagttacggggacgtgagcggaggtgtgagggatttccagaccctgcccgatggccacatgcccgcaatgaggatggatcgcggtgtcagcatgccaaatatgctggagcctaagatatttccatatgagatgttaatggtgacgaatcgcggtagaaacaagattttgcgagaagttgacagaacccggctggaacgccaccttgccccagaagtttttagagagatctttggcatgtcgattcaggagttcgaccgactcccattgtggcgccgtaacgacatgaagaagaaagcaaagcttttctag

SEQ ID NO: 28794 - DNA, 2541 bp, Artificial Sequence
  Description of Artificial Sequence: Synthetic coding sequence
atgcccgctttcctaggcctcaagtgtctgggtaaactttgttcttccgaaaagtctaaggtgacctcctctgagcgcacatccgctaggggcagcaaccggaaaaggttgatcgtggaggataggagggtgagtggaaccagcttcactgctcaccgacgcgcaactatcactcatctgctctatctctgtcctaaggattactgccccagagggcgagtgtgtaatagtgtggaccctttcgtcgcccaccctcaggatcctcaccatccctccgaaaaacctgtcattcattgccataagtgcggagagccatgtaaaggagaagtccttcgggtccaaacaaagcatttccatatcaagtgcttcacctgcaaagtgtgtggatgcgacctggcacagggcggattttttataaaaaacggagaatacttgtgtacgctggactaccagagaatgtacggcaccaggtgccacgggtgtggggagtttgtggaaggagaggtggtgactgcacttggaaaaacttaccatcctaattgtttcgcctgtacgatatgcaaaagacctttcccacctggcgaccgtgtaacatttaatgggagggactgtttgtgtcagctgtgtgcacagccaatgtcttcttcaccaaaggagaccaccttttcatccaattgcgctgggtgcggcagagacattaagaatggccaggcattacttgcactcgataagcaatggcacctgggttgcttcaagtgcaagtcctgcggcaaggtgctgaccggagaatacatcagcaaagacggcgcaccatattgtgagaaagactaccaaggcctattcggagtcaaatgtgaggcatgccatcagtttatcaccggaaaagtactagaagccggagacaaacattatcaccctagttgtgctcggtgctcccggtgcaatcagatgtttacggagggagaagagatgtaccttcagggcagtactgtgtggcacccagactgtaaacaatcaacaaagaccgaggagaagttacggctgccaaatattcgacggtctagctcggattttttttattcaaagagccttattagacgcactgggcgttctccgtcgcttcagcctacacgaaccagcagtgagagcatttattcgcgccctggcagcagtatcccgggaagccccggacacacaatctacgccaaggttgataacgagattctggattataaggacctggctgccatccccaaagtcaaggcaatttatgatatcgaacgacctgacctcatcacctacgagcccttctacacctccggttatgatgacaagcaggagcgccagagccttggagaaagcccgcgaactctttcccctaccccctcggcagaggggtaccaggacgtgcgcgacagaatgatccaccgctccacatcgcaggggagtataaactcgcctgtgtacagtcgtcacagttacacgccgacaacatcccgctcccctcaacactttcaccgccctgagctcctgtctcccggagttcagagattgtcttacctgagaaccagtagcctgagccctactcacagcgattcacgccctaacccacccttcaggcatcacttcatcccgcacatcaaaggtaacgaaccctcctccggcagaaattctcctctcccgtataggcctgactctaggccgctaacccctacctatgcccaggccccaaagcattttcacgtgcccgaccaaggaatcaacatttaccgaaagcctccaatatataagcagcatgcagcactagcggcacagagtaagagcagcgaggacataattaagttttccaagttccctgccgcacaggccccagacccttcagaaaccccaaagatcgagaccgaccactggcccggtcccccttccttcgccgtggtcgggcctgatatgaagcgcagatcctctggtcgggaagaagatgatgaggaactcctgagacgacgccagctgcaagaggaacagctgatgaagttaaatagcggtctggggcagctcatactcaaagaggagatggagaaagaatctcgggaacgcagctcgctacttgctagtcgctatgactcccccatcaacagcgcatcacatatcccttcctctaaaaccgcctccctccccggatacggccgtaatggactacataggcccgtgagcacagactttgcccagtacaacagctatggcgacgtgtcaggaggcgtgcgggagtatcagactttgccggacggacacatgccggctatgaggatggaccgcggagtgtcaatgcctaacatgctagagcccaagatctttccttatgagatgctgatggtgacaaatcgcggaagaaataagatactaagagaagtggaccgaacccgtctggaacggcacttggcacccgaggtttttagggaaatttttggcatgtcaatacaagagttcgaccgcctcccgctctggaggcgcaacgatatgaaaaaaaaagctaaactgttctag

SEQ ID NO: 28795 - DNA, 2109 bp, Artificial Sequence
  Description of Artificial Sequence: Synthetic coding sequence
atggtaccggacccagtggctcatcctcaggatccgcaccatcctagtgaaaaacccgtgattcactgccacaagtgtggtgaaccatgtaaaggcgaagtactccgggttcagaccaaacactttcacatcaaatgcttcacatgtaaggtgtgtggatgcgatctagctcagggcggattttttatcaaaaacggagaatacctgtgtaccctggactatcagagaatgtacggcacgcggtgtcacggctgtggcgagttcgtggaaggtgaagtcgtgaccgctctgggaaaaacttatcaccccaattgtttcgcctgcacaatttgcaaacgaccattcccccctggagaccgagtgaccttcaatggaagagattgtttgtgccagctctgtgctcagcccatgtcgtcgagtcccaaggagactacctttagttcgaattgcgccggatgcgggcgagacataaagaacggccaggccctgctggctttggacaagcaatggcatctcggctgctttaagtgcaagtcttgcggtaaagtcctgaccggagagtatattagcaaagatggggctccttattgtgagaaagattaccaggggttattcggggtgaaatgcgaagcctgccatcagttcattaccggcaaggtgctcgaggctggagataagcactaccacccctcctgcgcccgttgttcacgctgcaatcaaatgtttacagagggggaagaaatgtatcttcaaggtagtaccgtgtggcaccccgactgcaagcagtccaccaagaccgaggaaaagcttcgaccaacaagaacgagcagcgaaagtatttattctcggcctggaagcagtatcccaggttcacccggacacacaatatatgccaaagttgataacgagatcttagattacaaggacctggccgctattcctaaagtgaaggctatttacgatattgagcgtccagacctgatcacctatgaacccttctataccagtggatatgatgataagcaggagcgacagtcactgggcgaatcccctaggacactgagccccacccccagcgctgaggggtatcaggacgtacgggatcgaatgatccacagatccacatctcagggctccattaactcacccgtgtatagccggcatagttacacccctacgaccagtagatcacctcagcactttcaccgcccagggaatgagccatccagcggaaggaatagccctctgccatatagaccagattccagacccctaactcctacatacgctcaagcacctaaacacttccatgtccctgaccaaggcattaatatttacagaaagcccccaatatacaagcagcacgcagcccttgctgctcagtctaaatccagtgaagacataatcaagttttctaagttcccggctgctcaggctcccgatccaagtgaaacacccaaaatagaaacagaccattggcccggtcccccttctttcgccgttgtcggcccagatatgaaaaggcgctcttctgggagggaagaggacgacgaagaacttctgaggcgtcgacaactccaggaagagcagctcatgaagcttaattccggcctgggtcaattaatcctcaaggaggaaatggagaaggagagtagagaaaggagctccctgctcgcttcacggtacgactctcctatcaactcagcgtcccatattccttcaagcaagaccgcctcccttcccggatacggcaggaacggtctgcaccgccctgtctccactgattttgctcaatataattcttatggcgacgtgtctggcggagtccgggagtatcaaaccctgcccgacggacatatgcccgcaatgagaatggacagaggcgtgtccatgcctaacatgctggagccgaagatttttccatatgaaatgctcatggtcacaaaccgagggagaaacaagattctgagggaggttgaccgtacacgcctcgaaaggcatctagccccagaggtgttcagagaaatcttcggtatgagcatccaggaattcgatcgtttacccttatggagaaggaatgacatgaaaaaaaaggccaagctcttttag

SEQ ID NO: 28796 - DNA, 1368 bp, Artificial Sequence
  Description of Artificial Sequence: Synthetic coding sequence
atgtttaccgagggcgaagaaatgtacttgcaaggttctacagtgtggcaccctgactgcaaacagagcaccaaaactgaggagaaactgcgcctgccgaacatccgacgatcaagcagtgacttcttttacagcaaatcccttatcagaaggacaggtcgctcgccaagcttgcagccaaccaggacttcctccgagagcatttactccaggccaggtagcagcatcccaggtagcccagggcacacgatctacgctaaagttgacaatgagatcctggactacaaagatttagctgctattcctaaggtgaaagccatctatgatatcgaaaggcccgacctcataacctacgagccgttttatacatccggctatgacgacaaacaggaaagacaatcgctgggcgagtcacctcggactcttagtcccacccctagtgcagaaggataccaggacgtgagagacagaatgattcataggtccacaagccagggaagcattaatagccctgtgtacagtcgtcacagctatacgccaactacctctcggtcacctcaacattttcatagacccgaccaggggatcaacatttatcgaaagccccctatctataagcagcatgccgctctggcagctcagtccaaaagctctgaggatatcatcaagtttagcaagttccccgctgcacaagctcctgacccctccgagactccaaaaatcgaaaccgaccactggcccggtcctccaagttttgctgtggtgggtccagacatgaaaaggcgctccagcggaagggaggaagatgacgaggaactcctgcggcgaaggcaactacaggaggagcaacttatgaaacttaattccggtctggggcagctgatcctaaaggaggaaatggaaaaagagtcacgtgaacgcagcagtcttctggcttccagatatgacagtcctatcaatagtgcttcacacatacctagttccaagacagcgagcctgccgggatatggaagaaacggcctgcaccggcctgtctctacagatttcgcacagtacaatagctacggcgatgtgtctggcggagtccgggattttcagactctgccagatggccacatgccggcaatgcgaatggacagaggcgtgagcatgcctaacatgcttgagcccaaaatatttccctatgagatgcttatggtcacaaatcggggacggaataaaatcttgcgcgaggttgatcggacccgactggaacggcatctcgcgcctgaggtgtttcgggaaatctttggcatgagtatacaggaatttgatcgcctgccactgtggaggagaaacgacatgaagaaaaaagccaagctgttttag

SEQ ID NO: 28797 - DNA, 2241 bp, Artificial Sequence
  Description of Artificial Sequence: Synthetic coding sequence
atgcttatgacgctggaaatgacggagctcaccgacccccaccacacaatgggcgactacaaggtggctcacccacaggacccgcatcatcccagcgaaaagcctgttatacactgtcacaagtgcggcgaaccttgcaagggcgaagttctccgcgtgcagacgaagcacttccacattaaatgctttacgtgtaaagtctgtgggtgcgatctggctcagggaggcttcttcatcaaaaacggggaatatttgtgtactctcgattaccagaggatgtatggcacgcggtgtcacggatgcggagagttcgtggagggggaagtggtgacagccttggggaaaacctaccatccaaattgcttcgcgtgtactatctgcaaaaggcctttccccccaggcgaccgcgtgaccttcaacggaagagactgtctctgccagctctgtgctcagcccatgtccagttcacctaaggaaacaaccttttcaagcaattgtgctggctgcggcagggatattaagaacggccaggccttactggctctagacaagcagtggcacctgggctgctttaaatgtaaaagctgcggcaaagtgttaactggagaatatatatctaaagatggggcaccttattgcgagaaagattatcaaggcctgtttggcgtcaagtgcgaggcatgccatcagtttattaccggcaaagtcctcgaagctggagataaacattatcaccctagttgcgccagatgcagtaggtgcaatcagatgttcactgagggcgaggagatgtacttgcaaggcagcactgtgtggcacccagactgcaagcaatccaccaaaacagaagagaagctcagactgccaaacatccggaggtcctcttcagatttcttttacagtaaatcgctgatccggcgaaccgggcgaagcccctcccttcaaccgactaggacctccagtgaaagcatctactcacgtcctggtagtagtattcccggtagccccggacatactatttacgctaaagtcgacaacgaaatccttgattacaaggatcttgccgcaattccaaaagtaaaggccatctacgatatcgaacgcccagacctgatcacttacgagcccttttacacgtcagggtatgatgacaagcaggagcgacagagtttgggcgagagccctcgcaccctatccccgacaccctctgcagaaggataccaggatgtccgagacaggatgattcatcgaagcacctctcaaggatccatcaatagtcctgtttacagcaggcatagctacactcctacaacttcacggagcccacagcattttcatcgccctggcaatgaaccatctagcggcagaaacagccctctcccttaccgtcccgattccagaccactcacgcccacctatgcccaggctcccaagcatttccatgtaccagatcaggggataaatatttaccgcaaacccccaatctacaagcagcatgccgctttggcggcacagtctaagtcatcagaggacataattaagttcagcaaatttcccgctgcacaggcgccagaccctagcgagactcctaaaattgaaaccgaccactggccaggtcctcctagtttcgctgtcgtcggtcccgacatgaaacgacgatccagtggacgggaggaagatgatgaggaactcctgcgcaggcgtcagctacaggaggaacagctgatgaagctgaactccggcctcggccaactcattctgaaggaggaaatggagaaagaatcacgcgaaagatcctccctgctagcttcccggtacgatagccctataaactctgctagccacatcccttcaagtaagaccgcctcactgcccggttatggtagaaacgggctccatcggccagtaagcactgattttgcacagtacaactcctacggagatgtttccgggggagtccgagacttccagactctaccagatggacacatgcctgctatgcgcatggatcgcggagtgtccatgcctaacatgttagaacccaaaatctttccctacgaaatgctcatggtgacaaaccggggtcgtaacaagattcttcgggaagtcgatcggaccaggctagagcggcatctcgcgcctgaagtgttccgagaaatctttggaatgagcatccaggaattcgataggctccccctttggcgcaggaatgatatgaaaaaaaaggccaaactgttctag

SEQ ID NO: 28798 - DNA, 915 bp, Artificial Sequence
  Description of Artificial Sequence: Synthetic coding sequence
atggctgaggcctccgccgctggcgcagacagcggagccgctgttgctgctcaccgattcttctgtcatttttgcaaaggggaagtcagtccaaagctgcccgagtatatttgccccagatgtgaaagcggatttatcgaggaggtgaccgatgattcctcttttctcggaggagggggatccagaatagataataccacgaccacccactttgccgagctttggggccacctggaccatacgatgtttttccaggattttaggcctttcttgagcagcagtccgctggaccaggataatcgagctaacgagcggggtcatcagacgcatactgatttttggggggctaggcccccacgccttccattaggaagaagatatcggagccggggttctagtcgaccggatcgcagccccgcaattgagggaattctacagcacatcttcgcgggattttttgcgaactcagcaatccctgggtctccacatccgttttcgtggtccggaatgctgcacagtaatcctggggactacgcgtggggccagactggcctggatgcgatcgtaacccagttacttggtcaattggagaacacgggccctccacccgctgacaaagagaagattacaagcctacccacagtgacggtgacccaggagcaggtggacatgggtctggaatgccctgtttgtaaggaggactatacagttgaagaagaggtgaggcagctcccttgcaaccacttctttcattcttcttgtatagttccatggctggaactgcacgacacttgtccagtttgccgcaagagtctcaatggtgaggactctaccaggcagtctcagagcaccgaagcttccgcgtcaaatcggttctcaaacgacagccagctgcacgataggtggaccttttag

SEQ ID NO: 28799 - DNA, 636 bp, Artificial Sequence
  Description of Artificial Sequence: Synthetic coding sequence
atgagttgcacaatagaaaaaatcctcaccgatgcaaaaacccttttagagagacttcgcgagcatgatgccgcagccgaaagtctagtcgatcaaagtgcagcccttcacagacgtgtggcagccatgcgagaggcaggaactgcactgccagatcaggtgcggcagcggtaccaggaggatgccagtgacatgaaggacatgtccaagtacaagccccacattctgctgtcccaggaaaacacacagatacgggacctccagcaggagaatcgggagttgtggataagtctcgaagagcaccaagacgcgcttgagctgataatgagcaaataccggaagcagatgttacagctgatggttgccaaaaaagctgtagacgctgagcccgtgctcaaggcgcatcaaagccactcagccgaaattgagagtcaaatcgatcgtatctgtgagatgggggaggtgatgcggaaggccgtgcaggtcgacgatgaccagttttgtaagatccaggagaagttagctcagctggagctggaaaataaggaattgcgcgagttattgtcgataagctcggaaagcctgcaagcacggaaagaaaatagcatggacaccgcaagccaggccatcaagtag

SEQ ID NO: 28800 - DNA, 2451 bp, Artificial Sequence
  Description of Artificial Sequence: Synthetic coding sequence
atggtcctgatgttccaaatcagatacataagccagacacaggggctgccagctgaatatctcctgagcgccggaacaaaaactacccgcttcttcaaccgagatcccaatctcggataccccctgtggcgcttaaaaactcccgaggagcacgagctggagactgggatcaagtccaaggaggcaagaaagtacatctttaattgcctggatgacatggctcaggttaacatgtccacagacttggagggcaccgatatgttggccgagaaggcagataggcgggaatacatcgatctgctgaagaaaatgctcaccatcgatgccgataaacgtatcacaccactcaagactttgaaccatcagtttgttaccatgactcatctactggactttcctcacagtaaccacgtgaagagttgcttccagaatatggaaatctgcaaacggagagttcatatgtacgatacagtgtctcagatcaaatctccctttactactcacgtggcaccaaataccagtacaaatctgactatgagcttcagcaatcaactaaacaccgtgcataaccaagcttctgtcttggccagtagtagcacagctgcagcagctacgctttccctcgccaacagcgacgtgagcctgttaaattaccagtctgcactgtacccttcgagcgctgcaccggtgcctggggttgcacagcagggcgtgtctctgcagcccggaactacacagatttgtactcaaacagatccttttcagcagaccttcattgtgtgtccgcctgctttccagacaggattgcaggccacgaccaagcactctgggttcccagtcagaatggataatgcagtgcccattgtgccccaagcaccagccgctcagcccttgcagattcagtccggcgtactcactcagggatcctgcactcctcttatggttgctaccttacacccacaggttgctaccataactccacagtacgctgtgccttttacactaagctgtgctgcaggcaggccggctctggtggagcagaccgcggctgtgttgcaagcttggcctggaggtactcagcagatcctacttcccagcacttggcagcagctcccgggagtggcgctccataactccgtacagccaaccgccatgatacccgaggcaatgggttctggacagcagctggcagactggaggaatgctcactctcacggaaatcaatactccaccatcatgcagcagccctccctcttgacaaatcatgtcacactggccactgcccagccgctcaatgttggagtggcccacgttgtgcgccagcaacagagctcatcactcccttcaaagaaaaataagcagtccgcccctgtttcctcaaagagtagcttagacgtactcccatcccaagtttacagcctggtcggctccagtcctctgcgtacgacgtcgtcctataatagtctcgtgccagtacaggaccagcatcagcccataatcatcccggacaccccctctccccctgtgagcgtgatcacaatccggtccgacacggacgaggaagaagataacaaatacaaaccctctagcagcggtttaaagccaaggagcaacgtcatctcctatgttacggtaaatgattccccagattcagattcatcactgagctcaccatacagcactgatacactctcagccctgcggggaaattccggatccgtgttggagggacctggaagggtggtggcagatgggaccggtacacgcactatcatcgtcccccctctaaaaactcagctaggtgactgcacagtggccacccaggctagcggactcctctcaaataaaactaagcctgtggctagcgtttcagggcaaagcagcggatgctgcatcactcccactggctacagggctcagcgaggaggcacgtctgcagcacagcctctgaatctgtcacagaaccagcagtcgtcagcagcccctacatcgcaggaacggtcctcgaatccagctcctagacgccagcaggccttcgtggccccactcagccaggccccatacacctttcagcatggatcccccctgcactcgacaggtcaccctcacctggcacccgctcctgcccaccttccctcccaggcccatctctatacctacgccgctccgacatccgctgcagcgctggggtcaacgtcttctattgctcatctcttcagtccccaaggctccagcagacacgctgcagcttatacaacccaccctagtaccttggttcaccaggtaccggtttccgtggggccttctctgctgacttccgcctccgtagctccggctcagtaccagcaccagttcgcaacccaatcctatattggcagctctcgtggctcaacgatttacaccgggtacccactcagccctaccaaaatctcccaatacagctacctgtag

SEQ ID NO: 28801 - DNA, 3498 bp, Artificial Sequence
  Description of Artificial Sequence: Synthetic coding sequence
atggccagccagttgcaggtgttttcccctccctcagtttcttcctcagcgttttgctccgctaaaaagctcaagattgagccttcaggctgggacgtgagtggccagtccagtaacgacaagtactatactcattcgaagaccctgcccgctacccagggtcaggccaacagttcacaccaagtagctaactttaatatcccagcgtacgaccaaggactgctgttgcctgctccagctgtggagcacatagttgtaacagctgccgattcatccggctcagcagcaacgagcacatttcagagttcccagaccctgacccatcggagtaatgtgtcactattggagccataccagaagtgcgggctcaagagaaagagtgaggaggtagactctaacggcagcgtccagatcattgaggaacatcctcctctgatgctacagaatcgcaccgtggtgggtgcagctgcgacaactactacagtcacaacaaaaagcagcagcagcagcggagaaggcgattaccagctggtccaacacgaaattctctgcagcatgacgaattcttatgaggtgctggaattcctcgggcgtggcacttttggtcaggtggctaagtgttggaaacgatcaactaaggaaattgtggctattaaaatcctcaagaaccatccgagttatgcccgacaggggcaaatcgaggtgagcattctaagcaggttgtcttccgagaatgccgacgaatacaacttcgtgcggagctacgagtgttttcagcacaagaatcatacgtgtctggtatttgagatgctggaacaaaatttatatgatttcctaaaacagaataaatttagcccattgcctcttaagtacattaggcccatcctgcagcaggtggccacagccctcatgaagctgaagtcacttggattgattcacgccgacctgaaaccggagaatataatgctggtcgatcctgtaagacaaccgtatagggtcaaagtaattgatttcggatccgcgtctcatgtgtctaaggctgtatgctccacttatcttcagagcaggtattaccgggcacccgaaatcatcctgggcctgcccttttgcgaggccatcgacatgtggtctctgggatgtgtgattgctgagctgtttctcggctggcctctgtaccccggagcgagtgaatacgatcagatccgctacatcagccagacgcaaggtctcccagccgagtaccttctatcggctggcactaaaaccactaggttttttaatagagacccaaatctcggatacccactttggcgcctcaagacccccgaggagcacgagctcgagaccggaataaagtcgaaggaggccaggaaatacatcttcaactgtctcgacgatatggcccaggtcaatatgagcacagacctggagggcaccgacatgctggcagaaaaggcggatcgcagagagtatatcgatttattgaaaaagatgttgacgatcgacgcagataaaagaattacaccattaaagactctgaatcaccagttcgttaccatgacccacttgctggactttccgcattctaaccacgtgaaatcttgctttcaaaatatggagatctgcaaacgacgagtccacatgtacgatactgtgtcgcagataaagagtcccttcactacccatgtggctccgaatactagcaccaacctcactatgagcttttctaatcagcttaatacagtacacaatcaggcgtcagtcctcgcatcgagcagtactgccgcagcagccacactgagtctagcaaacagtgacgtctcactcctcaattaccagtccgcgttgtatcctagcagcgccgctcccgtccccggagtggcgcaacaaggcgtcagtctgcagcctggcaccacccaaatatgtacgcagacggaccccttccaacagactttcatagtgtgccctcccgcatttcaaaccggcttgcaggctacaactaagcattctggctttccagtacgaatggacaatgctgtacccatcgtgccccaggcccctgcagcccagcctctgcagattcagtccggggtgctcacacagcaggcttggccagggggaactcagcagattctgctgccctcaacctggcaacagcttccgggagtggcactccataacagtgtgcaacccacagccatgattcccgaggcgatggggagtggccagcagctggccgactggcggaacgctcacagccatggtaatcagtattctacaattatgcagcagccctccttgctaacaaaccatgtaacactggccactgcacagccattgaatgttggagtggctcacgtggtccgccagcagcagtccagcagcctgcccagtaaaaagaacaagcagtccgccccagtctcatcaaaaagctcacttgacgtcttaccctctcaggtctacagtctggtgggatcttcccctctccgcacgactagttcctataattcactggttcccgtgcaggatcagcatcaacccatcattattcctgacaccccctccccaccagtttcggtcattaccatccggagtgacacggacgaagaggaggataataagtacaaaccgagttcctccggactcaagcctcgcagcaacgtgattagctatgtcaccgtcaacgacagccctgattcagattccagcctttcatccccatactcaacagacacactgtccgcactcagaggcaactctggcagcgtcttggagggaccgggaagggtggtggcagatggcactgggacgcggaccattatcgtgcctcctctaaagacccagctgggcgactgtactgtggctactcaggcttctggtctgctgtctaacaagacaaagccagtggcatctgtgagtggacagtctagcgggtgttgcataacaccaaccggctatagagcgcagcgcggtggcacgtctgccgcacagcctctgaacctgtctcagaatcaacagtcatctgccgcacctacttcacaggaacggtctagcaacccagcccctaggagacagcaggctttcgttgctccactgtcacaggcaccttacaccttccaacatggaagccccttgcattccactggtcacccacacctcgccccagctccggctcacctaccctctcaggcacacctctacacatatgcagcaccaacaagtgcagccgctctcggcagcacttcaagcatcgcccacctgttctctccacagggttcctccaggcacgcagctgcctatactacacacccctctaccctcgtccatcaggtgcctgtgtcagtcgggccttctctccttacctcagcctctgttgctccagcacagtaccagcatcagtttgccactcaatcctacatcggcagcagtcgtgggagtacaatatacactggttaccccttgagtcccaccaagataagccaatattcttatttgtag

SEQ ID NO: 28802 - DNA, 3498 bp, Artificial Sequence
  Description of Artificial Sequence: Synthetic coding sequence
atggcatcccaactacaggttttctcacctcctagtgtatcctcctcggccttctgtagcgctaagaagttgaagattgagcccagcggatgggatgtctccggccagtctagcaacgacaaatactatacacacagtaagacccttccggcaacccagggccaggctaatagtagtcaccaagtggcgaacttcaacattcccgcatacgaccagggcctgttacttccggcacccgctgttgaacatattgtggttaccgcagccgactcctccggatcagccgcaacatctaccttccagtcttcccagaccctgacccaccgttccaatgtaagcctcctggagccgtaccaaaagtgtgggttaaaaagaaaatccgaggaggtggattctaatggcagtgtacagattatcgaggagcacccaccgctcatgctgcaaaatagaaccgtggtaggggcagcggcaactacaaccaccgtgaccactaaaagttccagctcttctggcgaaggtgattatcagctggtgcagcacgaaatcctgtgctcaatgacaaactcgtacgaagtcttagagttcctggggagggggacattcggacaggtcgctaagtgctggaagagaagcactaaggagatagtggccatcaagattctcaagaatcaccctagctacgcgcgtcagggtcaaattgaagttagcatactttctcgcctcagctctgaaaacgccgacgagtataatttcgtgcggtcttacgaatgcttccagcacaaaaatcacacttgtctggtctttgagatgcttgaacaaaatctgtatgactttctgaagcaaaataagttctctccactcccactgaagtacataagacccattctgcagcaagtggctacagccctgatgaagcttaagtccctggggttgattcatgcagacctgaaacccgagaacatcatgctggtggatcctgtgcgccaaccgtaccgcgttaaggtgatagacttcggctccgcctcccacgtgtcaaaggccgtctgctcgacctatctgcaaagcagatactatagagcccctgagatcatcctcggattgccattttgcgaagcaatcgacatgtggagtctgggctgcgtcatcgccgagctgtttcttggctggcccttgtaccccggtgcgtcagaatatgatcaaatacggtacatttctcagacccagggattgcctgccgagtacttgctgagtgctggaacgaaaactactcggttcttcaaccgcgatcctaatctcggttaccccttgtggcgccttaaaacccctgaggagcatgaattagagacgggaatcaagtccaaagaggccaggaaatatatttttaactgcctggatgatatggcgcaggtcaatatgagtaccgatctcgagggcaccgacatgctcgccgaaaaggctgatcgacgggagtacattgatttgctcaaaaagatgctcacaatcgatgcagataaacgcatcactcctttgaaaacattgaaccaccagttcgtgaccatgacacacttactggatttcccacattctaatcatgttaaatcctgcttccagaatatggagatctgcaaaagaagggtacatatgtacgacacagtgagtcagataaagagcccctttacgacacacgttgccccaaacacatcaacgaacctgacgatgtctttctctaaccagcttaacactgttcacaaccaagcttctgtgcttgcctctagttcaactgcggcagccgctacgttgtctttagctaattcagatgtctctctcctcaactatcagtcagcactgtaccccagcagcgccgcacccgtgcctggcgtagcccagcaaggagtctcgctccaaccaggcacaacccagatctgcacgcagaccgatccctttcagcaaacattcatcgtttgcccacctgctttccaaactggactacaagcgactacaaaacactccggcttccctgttaggatggacaacgccgttccaatcgtccctcaggctcctgctgcccagcctctgcaaatccagagcggagtacttacccagcaagcctggcctggcggaacccaacagatccttctaccttccacctggcagcaactccccggagttgctcttcataactccgtccagccaaccgctatgatccctgaagctatggggtcaggacagcaattggcagattggaggaacgctcattcccatggcaatcagtacagcactattatgcaacagccatctctgctaacgaaccatgtaacattggcaactgcacagcccttgaacgttggcgtcgcccatgttgtgagacagcagcaaagtagtagccttccaagcaaaaaaaacaaacagtcagctccggtgtccagtaaatcgagcttggatgtcctgccctcccaggtgtattcactggtgggatctagccccctccggactacatcgtcatacaattctttggtgcccgtgcaagaccagcatcagcccatcattatccctgatacgccgtccccccctgtgagtgtgatcacaatacgaagcgacaccgatgaggaagaagacaataaatataaaccatcctcttccggtctgaagccaagatccaatgtgatctcatacgttacagtgaatgactctccagatagtgacagctctctgagctcaccctattcaaccgacacgctctctgctcttagagggaactctgggagcgtgttagagggccctgggcgagtggtagcggacggcaccggtacccgaacaattattgtcccccctcttaaaacgcagctgggggattgcaccgttgccacgcaggcttccggcctcctcagcaataagacgaagcctgtggcgtctgtctccggtcaaagctccgggtgctgtataacacccactggctatcgagctcaaaggggagggactagcgcagcgcagcctctgaacctgagccagaaccagcagagcagcgctgccccaacatcacaggagcgcagtagcaacccagcgccaaggaggcagcaagcttttgtagcccctttgagccaggccccatatacgttccaacacggctccccactgcattccacaggtcatccccacctggcccctgctcctgcccaccttccttctcaggcacacctgtacacttacgccgctccaaccagcgctgctgcactgggcagtacgtctagtatcgctcacctcttttcccctcagggcagttcaaggcacgccgcagcctacaccactcacccatctactctcgttcaccaggtccccgtgagcgtcggaccttcattactcacgtctgcctctgtcgcacccgcacagtaccaacatcagttcgccactcaaagctacatcgggtcctcccgcggaagcaccatatacacgggttaccctctctcaccaactaagatatcccagtacagctatctgtag

SEQ ID NO: 28803 - DNA, 3633 bp, Artificial Sequence
  Description of Artificial Sequence: Synthetic coding sequence
atggcatcacagctgcaggtgttcagcccaccctcagtgtccagtagtgccttttgttccgccaagaaactcaagattgagcctagcggctgggatgtctcaggccaaagctcgaatgataaatattacacgcactctaagaccctcccggcaactcaaggacaggctaactcttctcatcaagtggctaattttaatatcccggcatatgaccaggggctgctccttcctgcacccgctgtcgagcatatagtggtgactgctgcagatagcagcggatcggccgctaccagtactttccagagttctcagaccttaactcacagaagtaacgtttctctcctggaaccctatcagaaatgcggtttgaaacggaagagtgaggaggtggattccaatggatctgtccagattatagaagagcaccctcctctgatgctgcagaataggacagtcgtgggtgccgcagctactaccacaacggtcacgactaagtcaagcagctccagcggagaaggtgattaccaactcgttcaacatgagatcctttgttcaatgaccaactcatatgaagtcttggaattcttagggaggggcacgttcggtcaagtggctaagtgctggaaacggtccacaaaggagattgttgctattaaaattcttaagaatcacccctcatacgcgagacaggggcagatagaagtctccattctctcacggctgtcaagcgagaatgctgacgagtataattttgtccggagctatgagtgtttccagcacaagaatcacacttgtctggtgtttgagatgctggagcagaacctgtatgacttccttaaacagaacaagtttagcccgctgccactaaaatatatccggcctattctgcagcaggtggctacggcattgatgaaactgaagtcattagggctcatccacgcggatctcaagcccgaaaatattatgctggttgaccctgtgagacaaccttatagagtgaaggttatcgactttgggagcgctagtcacgtatccaaagccgtttgttctacctacttacagtctcggtattacagggcgcctgagatcattttgggcttgcctttctgcgaggctattgacatgtggtcactaggctgcgtaatcgcagaactgttcttgggctggcccctgtaccccggtgcctcagagtatgatcagattagatacattagtcagacacaaggcctccctgccgaatatttgctttccgctggcacaaaaacaacccgattcttcaatagagacccaaacctcggctacccgctctggcggctgaagactcccgaagagcatgagctcgaaaccggaatcaagagtaaagaagccagaaagtatatcttcaattgtcttgacgatatggcgcaggtgaacatgtccaccgacttagagggcaccgacatgctggccgagaaagccgaccgtcgcgagtatattgatctgttaaaaaaaatgttaacaatcgatgcagataagagaatcactccacttaagacacttaatcaccaattcgtcacgatgactcatcttctcgactttccccattctaatcacgtgaaaagctgctttcagaatatggaaatttgcaaaagaagagtacatatgtatgacacagtgagtcagattaagtctcctttcaccacgcacgtggctccaaacacatcaactaacttgacaatgtccttctccaaccagcttaacaccgtccacaaccaggcaagcgtgcttgcgagttcgtccacagccgctgctgccacactctccctggctaattcagacgtttctctactcaactaccagagcgccctgtacccttcaagcgcagcccctgttcccggtgtcgcccagcagggagtgagtctgcagcctggcacaactcagatctgtacccaaactgaccccttccagcagactttcatcgtctgccctcccgcttttcagaccgggctccaggcaacaacaaagcatagtggctttcctgtgcgtatggacaacgccgtgccaattgtgccacaggctccagcagcccagccccttcagatccagtccggggttctgactcagggaagctgcacacccctgatggtggcaacccttcacccacaggtggcaactattacaccacagtatgccgtaccctttacacttagttgcgctgccggtaggcctgccttagtcgaacagaccgccgctgtgctccaggcttggccgggtggaacgcagcaaatcctgctaccaagcacctggcagcagctcccgggagtggccctgcacaacagcgttcagcccactgcaatgattcctgaggcaatgggctcaggccagcaactggccgactggcggaacgctcacagtcacggaaatcagtacagtactatcatgcagcagcctagtttgttgaccaaccacgttactctggccacagcacagccactcaacgttggtgttgcacacgtagttcggcagcagcagtccagcagccttccatcaaaaaagaacaaacagtctgcgcctgtgtctagcaagtcctctctcgacgtgctgccttcacaagtgtattccctggtcgggtcctcccctctcaggacgacatcatcttacaacagcctcgtaccagtccaggatcagcaccagcctataatcatcccagacactccctctcctccagttagtgtgatcacaatccgctccgatactgatgaagaggaggataacaagtataagcctagcagtagcggactgaagccaaggtctaacgtgatcagttacgttacagtgaatgactctcctgacagtgactcgtctctctctagcccatatagcaccgataccctgtctgccctacggggaaactccgggagcgtgctggagggccctggaagagtcgttgctgatggaaccggaacacggactattattgttccccctctcaaaacccagcttggggactgcacagtggctactcaggccagcggactcctgtctaataagacaaaaccagtggcgtcagtaagcggccagtcttccggatgctgtatcacacctacagggtatcgcgctcagcggggtggaacctctgccgctcaacccctgaatctctcccagaaccagcagagttccgctgcaccaacttcacaggagcgcagttctaaccccgcaccccgaaggcaacaggcgtttgtggctccattgtctcaagccccttacacgttccagcacggttctcccctccattctaccggccatcctcatctggccccagcccctgcacacctacctagtcaggcacacctgtatacttatgcggcacccaccagcgctgccgctttgggatctacgtctagcattgctcatttgtttagtccccagggttcctcccgtcacgctgccgcttacacaactcatccctccactctggttcatcaggtgcctgtgagcgttggaccgtctttactaaccagtgctagcgtggccccagcacagtaccaacaccagtttgcaacacagtcctatatcggatcatcacggggttccaccatttacacagggtatcctctgtcaccaacgaaaatcagtcagtactcctatctatag

SEQ ID NO: 28804 - DNA, 3228 bp, Artificial Sequence
  Description of Artificial Sequence: Synthetic coding sequence
atggcgagccaattgcaggtgttctcgccaccgtccgtgtccagctcagccttttgcagcgcaaagaagctcaagatcgagcccagcggatgggatgtatccgggcaatcatccaatgataagtattatacccactctaagacacttcctgcaacccagggccaggctaactcctcccaccaggtagccaattttaatattccggcttatgatcaggggttgttgctgcctgcacccgctgtggagcatatcgtcgtcaccgccgctgattcctccggatcggctgccacaagtacatttcaatcctcgcagacattgactcatagaagcaacgtaagcctgctggaaccatatcaaaagtgtggcctcaaacggaagtctgaagaagttgattcaaacggcagtgtccaaataatagaggaacacccacccttgatgctgcaaaatcggaccgtggtgggcgctgcagccacaacgactacggtcacaaccaagagtagctcctcatcaggggaaggtgactaccagctggtgcagcacgagatcctgtgttccatgactaattcctacgaggtactagaattccttggacgaggcacttttggccaggtagccaagtgctggaagaggtcgactaaggagatcgtggcgattaagatcctgaaaaaccatccatcttacgccagacaaggacagatcgaagtgagcattcttagccgccttagtagtgaaaacgctgacgagtataattttgttcgctcatacgaatgcttccagcataaaaaccacacctgcctggtattcgagatgctggagcagaacctgtacgattttctgaagcagaataaattcagccctctccctttgaagtacatccggcctattctgcagcaggtcgcaacagcactcatgaagctcaagtcacttgggctcattcatgccgatttgaagcccgagaacatcatgttggtggatcccgtgagacagccctacagggtcaaagtcattgacttcggatccgccagccatgtatctaaggccgtctgttctacttaccttcaatctcggtattacagggccccagaaattattctcggcttaccattctgtgaggccatcgacatgtggtctctgggctgcgtgatcgccgaactattcctaggatggcccctttaccctggggcatcagagtacgatcaaatccgctacatatcccagacgcagggattgcctgctgagtatcttttgtcagctggaacgaagacaacacggttttttaatagggatcccaacctgggttatccattgtggcgactgaaaactccagaagagcacgaacttgaaactggcataaaaagcaaggaggcccgtaaatatatcttcaactgtcttgacgatatggctcaggttaatatgtctacagatctcgaaggaaccgatatgcttgccgagaaagcagatcgtcgggaatacatcgatctgctgaaaaagatgctcactatcgacgcagacaaacgcattactccgctcaagaccctaaaccaccagttcgtcactatgacacacctgttggattttccgcactccaatcatgtgaaatcttgctttcagaacatggagatttgcaagaggagggtgcatatgtacgacactgtgtctcagatcaagagcccttttactacacatgtcgcccctaacacatccaccaatttaaccatgtcttttagcaaccagctcaataccgtccataaccaggccagcgtgcttgcttcaagcagtaccgcggcagcagccacactaagcctagctaatagcgacgtgtcattactgaactaccagagcgctctgtacccatcctcagctgcacccgtgccgggagtcgctcagcagggagtgtccttgcagccaggtaccacccagatctgcacacaaaccgatccattccagcaaacatttatcgtgtgccccccagcctttcagaccggactgcaggccactaccaaacactccggattcccagtgcggatggataatgcggttcccattgttcctcaagcgccagctgctcagcctcttcaaatccagtcaggggtattgacgcagggttcatgtacacccctgatggtagccacattacacccacaggtggccaccattacaccacagtacgcggtaccttttactctaagttgcgctgccggtagacccgctctagtcgaacaaactgccgctgtgctgcaggcatggcctggtggtacccagcagattctgttgccttcaacctggcagcaactccctggagtggccctgcacaattcggttcagcctactgccatgattcccgaagccatgggatctggccaacagctcgcagattggagaaatgcccatagtcatggaaatcaatacagtaccatcatgcagcaaccttcgcttctgaccaatcacgtgacattagcaaccgcccagccactgaatgttggggtcgcccatgtcgttcggcaacagcagtcatcaagcctacccagcaaaaagaacaaacagtctgccccagtgtcctctaagtcgagtctcgacgtactgccaagccaggtctacagtcttgtgggctcttcgccactgaggactacctcctcatacaatagcctggtgcctgtgcaagaccagcaccagcctattattattcctgacacaccttccccccctgtgtcagtaatcacaatccgcagcgatacagatgaagaagaagataataagtacaagccatcgtcttccggtctgaaaccccgtagcaatgtgatcagttatgtaaccgtcaacgattctcctgattctgactcttccctgtctagtccttactcgactgatacgctgagtgccctgcggggaaactctggcagcgtcctagagggcccaggacgcgtggtggcagacggaactgggacaaggaccataattgtgccgcctctgaaaacacagctcggcgactgcactgttgccactcaggcgagcgggcttctttctaacaagacgaaaccagtggcctccgtgagtgggcagagctctgggtgttgtatcacacctacaggttacagggcccagcgtggtgggaccagtgctgcccaaccgctcaatcttagtcaagtcagtgcgatgggatattgcctcttatttggaccgtgtaccgtggtgaccttttggcgaactctgctgctcgcgggatgctag

SEQ ID NO: 28805 - DNA, 543 bp, Artificial Sequence
  Description of Artificial Sequence: Synthetic coding sequence
atgcaggcagaagggcaggggacgggcggatcaacaggcgatgccgatggacccggaggcccagggattcctgacggacctggagggaatgccggtggcccaggcgaagcaggagctaccggtggaagggggccaagaggcgcaggagctgctcgcgctagtgggcctagaggcggagcccctcgagggccacacggtggggctgcatctgcccaggacgggaggtgcccatgcggagctcggcgacccgattcccggctcttgcagttgcacataaccatgccattctcctcacctatggaggcggaactcgtaaggcgcatcctgagccgggacgccgcacccctcccgaggccaggagctgtgctcaaagactttactgtatcaggcaatcttctttttatcaggttgaccgccgctgatcatcgccagctgcaactgtctataagcagctgccttcagcagctctccctgctcatgtggattacacagtgctttttgccagttttcctggctcaggcccctagcgggcagcgtagatag

SEQ ID NO: 28806 - DNA, 717 bp, Artificial Sequence
  Description of Artificial Sequence: Synthetic coding sequence
atgtctgaggacctggccaagcaactggcgtcatataaagcacagttgcagcaggtcgaggctgcattgtccgggaacggagagaacgaagaccttctgaaactcaaaaaggatctgcaagaagtcatcgaactgacaaaagacctgctttcaacccagccttctgagacactggcatcatctgatagcttcgcctcaacccagccgacacatagctggaaagtgggtgataagtgtatggccgtgtggtcagaagatggacaatgttatgaggctgaaatcgaagagattgacgaggaaaatggaactgcagccataacctttgccggttacggaaacgctgaggtcaccccgctattaaacctgaagcctgtcgaggaagggaggaaggcgaaggaagactctggaaataagccgatgagcaagaaagagatgatcgctcagcagcgcgagtataaaaagaaaaaagctctgaaaaaggcccaaaggattaaagaactggaacaggagagggaagatcagaaggtgaagtggcagcagttcaacaatcgcgcatattctaaaaataagaaaggccaagtcaagaggtctatctttgcctctccagaaagcgtgactggaaaggtgggcgttgggacatgcggcattgccgataagccgatgactcagtaccaggatacttcaaagtacaatgtccgacatttgatgcctcagtag

SEQ ID NO: 28807 - DNA, 717 bp, Artificial Sequence
  Description of Artificial Sequence: Synthetic coding sequence
atgtccgaagaccttgctaaacagcttgcctcatataaggctcagctgcagcaggtggaagctgccctaagtggaaatggcgagaacgaagatctgctgaaactgaaaaaagatcttcaggaagtcattgaattgacgaaggacctgctgtccacccagccatcagagacactggctagtagtgatagtttcgcaagcacacagcctacccactcctggaaggtgggagacaagtgtatggccgtttggtcggaggacggtcaatgctacgaagctgagatcgaggaaatcgacgaggagaatgggacagcagctataacatttgctggttacgggaacgcagaagtcacccccctgttaaatctgaagccagtggaggaagggagaaaggctaaggaagattccggcaacaagccgatgtccaagaaggaaatgatcgcacagcagcgcgaatataaaaaaaagaaagctctcaagaaggctcagcgaatcaaggagctagagcaagaacgcgaagaccagaaagtcaaatggcaacagttcaacaatcgggcatatagcaaaaataagaaagggcaggtgaaaagatcgattttcgcctcccctgaatccgtcacaggcaaggtcggcgttggcacttgtgggattgccgacaaacccatgacgcagtaccaagatacatctaaatacaacgtccggcatttgatgccacagtag

SEQ ID NO: 28808 - DNA, 2229 bp, Artificial Sequence
  Description of Artificial Sequence: Synthetic coding sequence
gatttatccagcggtggcggtattgagccacagtgctcatctgaggtgtattttagggccagagaacggggatgcgaaaacgtagcttggtctcttgggctcaggtcgcattgcttcctggaagcagagttgcatcccctgccttggttcctacctactaatgtttgtagccctttgcccggagccgcacacaaattggtttgctacttcactaattgggcccactcaagacccggtcctgcctctatacttccacacgacctagatccctttctatgtactcacctgattttcgctttcgcctccatgaataacaatcagatcgtggccaaagatctccaggatgaaaaaatcctttaccctgaatttaacaagctgaaagagcggatgtggcagcagctgccaacaggcgtgaagaatcctgcccaccaacccagtctctcccaccacagaaatagagagctgaaaaccttgctgtcaatcggcggttggaatttcggaacatctagatttactaccatgctttccacctttgctaaccgggagaaattcattgcttccgttatctccctgcttcgtactcacgacttcgatggactggacctgtttttcctgtatcctggcctccggggttcacctatgcacgatcgctggacgtttctgtttctgatagaggaacttctttttgccttccgcaaagaggctttgctgactatgcggcctagactgttgctgagcgcggcagtttctggcgtgccacacattgtgcagaccagctacgacgtgcggtttctaggacgactgttggacttcataaatgttctgagttacgatctgcatggatcttgggaaagatttactggtcacaactcccccctgttctccctaccagaggaccctaaatctagcgcctatgcgatgaactattggcgcaagctcggggctccttcggaaaagttaataatgggtatccccacttatggcaggaccttccggctcttgaaagcctcaaagaacggacttcaggccagggccattggtccagctagtcctggcaagtatacgaaacaagaaggattcctagcctattttgaaatttgtagctttgtgtggggtgccaagaaacactggatcgattaccagtacgtcccttatgccaataaaggcaaagagtgggtaggatacgataatgcaatctctttttcctataaagcctggtttattcgtagggagcacttcggaggtgctatggtgtggacactggacatggatgacgtccgtgggactttctgtggtacagggccattcccgttagtgtatgtgctgaatgatattctggtgcgagcggagtttagttctacctccttgccacagttctggctatcctcagctgtgaactcctcgagcactgaccctgagagactggccgtgactacagcttggactaccgatagtaaaattctgcctcccggtggagaggcaggggtcacagaaatacatggcaagtgtgagaatatgacgattacaccacgaggaactacagtgactccgacaaaagaaactgtaagcctggggaaacacacagtcgctctgggagagaaaacagaaatcaccggcgctatgactatgacttccgtgggccatcagtcaatgacacccggagagaaggctctgaccccagtgggtcaccagtctgtgaccaccgggcagaagaccctgacatccgttggatatcagtctgtaacacctggcgagaaaacactcacacccgtgggacaccagtcagtgactcctgtcagtcatcaaagtgtttctcccggaggtacaaccatgacccctgtgcattttcagactgagactcttcggcagaacactgtggccccacgacggaaggccgttgccagggaaaaggtaacagtcccctccagaaacatctctgtgactcctgagggccagacaatgcctctgcgaggcgaaaacttaaccagtgaggttggtactcatcctaggatgggaaatctcggacttcagatggaagccgaaaatcgaatgatgctgagtagttctcccgtcatccagttaccagaacagacacctctagccttcgacaataggttcgtccccatctacggcaaccacagcagcgtgaattcagtaaccccacagaccagtccactttccctgaagaaggagataccagaaaattcagccgtggatgaggaggcctag

SEQ ID NO: 28809 - DNA, 2037 bp, Artificial Sequence
  Description of Artificial Sequence: Synthetic coding sequence
atgtggaagctgctcctgtgggtgggtctagtgctggtgctgaagcaccatgacggcgctgctcacaaactggtgtgctacttcacaaattgggcccacagccgccctggccctgcctctattctgcctcatgatctggacccatttctatgcacccatctcatattcgctttcgcttcaatgaataataatcagattgtagccaaggacttgcaggatgaaaagatcctttacccagaatttaataagttaaaggaaaggaatcgcgaattaaaaacgctgttgagcatcggcggatggaactttggaacaagtaggtttacaactatgcttagcacgttcgccaatcgcgagaagtttatcgcctcggttatcagtttgcttaggacccatgatttcgacggcctagatctgttcttcctgtatccaggcctgcggggttcccccatgcacgatagatggacattcctctttctcattgaagagctgttgtttgcttttcgcaaagaggctctgctcaccatgcgccctcgactgctgctgagtgcagctgtgtccggtgtgccacacatcgtacaaacctcatatgacgtgcgcttcctcgggaggctgctagacttcatcaacgttctgagctacgacttgcatggctcctgggaacggttcacaggacataattctccattgtttagcctgcctgaagacccaaaatcaagtgcatatgccatgaattattggcgcaaactcggcgctcccagcgaaaagctgattatgggcatacccacctacggcagaacctttcgactcctgaaggcctccaagaatggcctgcaagccagggcaattgggccagcctcccccggaaagtacaccaagcaggaggggttcttggcctatttcgagatatgtagctttgtctggggcgcaaagaaacactggatcgactatcaatacgtaccatacgcaaataaagggaaagaatgggtaggctacgataacgccatttccttttcctacaaagcctggtttattaggcgagagcactttgggggagctatggtgtggaccttagatatggacgatgtgcgcggtactttctgtggtacaggccctttcccactggtgtacgtcctcaacgatatccttgtgagagcggagttctcctccactagtctgccacagttctggctgagttcagccgtgaactctagctcaactgacccggaaaggcttgcagttaccacagcttggacgaccgatagtaagatcctgcctccagggggagaggctggcgtaactgagatccacggcaaatgtgagaatatgaccattacgcctcgaggtacaacagtgacacccacaaaggagacagtctccctcggtaagcataccgtcgctctgggcgagaaaactgagattacaggagcgatgacaatgactagcgtcgggcatcagagtatgactccgggagaaaaagcgctcactccggttgggcatcagagcgtgaccacaggtcagaagactctaacatccgtcggatatcagtcggtgacaccgggagaaaagactctgacccccgttggccaccagtccgtcacaccagtcagtcatcagtcagtgagccctggcggtacaactatgaccccagttcatttccagactgagaccctgcgacagaacactgtggcacccagaagaaaggctgtggccagagaaaaagtcacagttccttcaagaaacatctctgtgacaccagaagggcaaacgatgcccctgcggggagaaaatctgactagcgaagtcggaacgcacccacgcatgggaaatctaggattgcagatggaagctgaaaaccggatgatgctgtcatctagtcccgtcatccagctgcctgagcagaccccactggcattcgacaacaggttcgtcccgatttacgggaatcattcctccgtaaattccgtcacccctcaaaccagcccactcagcctgaagaaagaaatccccgaaaattcagctgtagacgaggaggcttag

SEQ ID NO: 28810 - DNA, 1005 bp, Artificial Sequence
  Description of Artificial Sequence: Synthetic coding sequence
atgggaggtgcagtcagcgcgggagaagacaatgacgaactcattgacaatctcaaggaggcccagtacatccggacagagctcgtggaacaagccttccgcgcaattgatcgggcagattattatctggaagagtttaaggagaatgcctataaagacctggcatggaagcacgggaatattcatctgagtgccccttgtatttactcagaggtgatggaagctcttgacctgcaacccggtctgagctttttgaacttggggtcaggcacgggctacctctcaagcatggtgggcttaattctgggcccttttggggttaatcacggtgtggagctccattccgatgtgatcgagtacgcaaagcagaaactcgacttctttatcaggactagcgacagcttcgataaatttgacttctgtgagccctcatttgtgactggaaactgtctggagatatccccagattgtagccaatatgatcgtgtgtactgtggtgctggtgtccagaaggagcatgaggagtacatgaaaaacctattgaaggtgggcggaattctggtgatgcccctggaagagaaaccctgccactctgaatccgggaaatctcgcctggtgcagcttcccccagtggccgttcggtctctgcaagatctggcgcgaatagcaatcagaggaactattaaaaaaataatccatcaggaaaccgtatctaaaaatggtaatggcctcaaaaatacacccagatttaaacggcgacgtgtgagacgccgtaggatggagaccatcgtgttcctggacaaagaggtatttgccagtcggatctcaaatccatctgacgacaatagctgtgaggacctggaggaggagcgccgtgaggaagaggaaaaaactccacccgaaaccaaacccgatcctcctgtgaactttctcaggcagaaggtgctatccctgcccctacctgacccgctgaaatactacctgctctactaccgcgagaagtag

SEQ ID NO: 28811 - DNA, 1785 bp, Artificial Sequence
  Description of Artificial Sequence: Synthetic coding sequence
atgtcgagacccagctctcgcgcaatctacctgcacagaaaggagtactcccaaaacctgacctccgaacccacattacttcagcatcgagtggagcacttaatgacttgtaaacaggggtcgcaaagggtccagggcccagaagacgctctccagaagctctttgagatggacgctcagggaagagtctggtctcaggatctgatcctccaagtccgggacggatggctgcagctgctggacatcgagactaaggaagagctggattcctataggctggactcgatccaggcgatgaacgtagctctcaacacatgctcttataactccattctctccataactgtgcaggaacccggtctgcctgggacgtctacgctgctttttcagtgtcaggaggtgggtgccgaaaggctgaaaactagtctccagaaagccctcgaagaagagcttgagcagagcaggcccaggctgggagggttgcaaccagggcaggatcgatggagaggacccgcaatggagcggcctctgcccatggaacaggcacgctacctggagcccggtattcctcctgaacaaccccaccagaggacacttgagcattccctccccccatccccgcgtccactcccgagacataccagtgcacgcgagccgagcgcttttacactacccccaccaagacgctcatcttctcccgaggatcccgaaagagacgaggaggtgctcaaccatgtgctgagggacatcgagctgtttatgggaaaactggagaaggcccaggccaaaacctcgcgcaaaaaaaagttcggcaagaaaaacaaggaccagggcggactaacccaggctcagtacattgattgttttcagaaaattaaacactcttttaaccttcttggccgtctggccacctggttgaaggagacttcagcgcctgaattagtgcatatattattcaagtctcttaatttcatcctggcaaggtgccccgaagccggactcgctgctcaagtaatctctccgctcttgacacccaaagccataaatttgctgcagtcctgcctgtctccccctgagtcaaatctgtggatgggcttaggccctgcatggacaacctcaagggccgattggacaggggatgagcctctgccttatcagcctacctttagcgacgattggcagcttcccgagcctagctcccaggcaccccttggttaccaggaccccgtgtccctgagacggggtagccacagactcgggagtactagtcattttccacaggaaaagacacacaaccacgatccgcaacccggagacccaaacagccgaccatcaagccccaaacccgcacaacccgcactcaagatgcaggtgctctatgagtttgaggcaagaaaccctcgcgagttgacagttgtgcagggagagaaattggaggtactggaccattctaagcgatggtggcttgtgaagaacgaggccggaagatccggttatattccctctaatatcctggaacccctgcagcctggtacgccaggcacgcaggggcagtcacccagtcgagtgcccatgctgcgtctctcctccaggcccgaagaggtgaccgattggttgcaggcggagaacttttccacagccactgtaaggaccctgggaagcctgacaggtagccagcttctgcgaatccggccaggggagctgcagatgctgtgtcctcaggaggcccctcgcattttatccaggctggaggccgttcgtaggatgttggggattagcccctag

SEQ ID NO: 28812 - DNA, 1500 bp, Artificial Sequence
  Description of Artificial Sequence: Synthetic coding sequence
atgagttttggaagtgaacattacctctgttcaagcagcagctaccgaaaggtcttcggggacggatcgagactttctgccagactctctggcgcagggggtgccggaggatttcggtcccagagcttgagtcgcagcaacgtggcaagtagcgcagcatgttcctccgcttctagccttggactgggcctggcttaccggagacctcccgcatcagacggtcttgatttgagccaggctgcggctaggacaaatgaatataagatcatccgaactaacgaaaaggagcagctgcaaggtttgaacgatcgcttcgccgtgttcatcgaaaaagtccatcagttggagacgcagaatagagccttggaggcagagctcgctgcacttcggcagcggcacgccgagccatcacgtgttggggagctgttccaaagagaactccgcgatcttagggcccagctcgaagaggcatcctctgcacgcagccaggctctgctggagagggacggcctcgccgaagaggttcagagattgcgcgctcgatgcgaggaggagtctagaggacgtgagggcgctgagcgggcattaaaggctcagcaaagagacgtggacggagcgaccctggccagactcgacctggaaaagaaggtggagagcctactggatgagctcgccttcgtcaggcaagtgcacgatgaggaggttgctgagctgctggcaactctccaagccagttcccaggccgcagctgaggtcgatgtcactgtggcaaaaccggatctcacctcagccctgagagagattcgcgctcagtacgaaagtttggctgcgaagaatctgcagtcggcggaggagtggtacaagtctaagttcgcgaatctgaatgaacaagcagcaagaagtacagaggccatcagagcctcacgtgaggaaattcatgagtatcgacgccagctgcaagcgagaacaattgagatagaggggctgcggggagcgaacgagagcttagaacgacagatccttgaactggaagagcggcattcagccgaagttgcaggataccaagattccattggacagcttgagaacgacctgcgtaacacaaaaagcgagatggccagacatttaagggagtaccaagatcttttgaatgtgaaaatggctctcgatattgaaattgccgcttacaggaagctgctggagggcgaggagactcggttcagcactagcgggctgtctatatcaggccttaatccgctgcctaatccatcctatctcctgcctccaaggatactgtccgcaactaccagtaaggtcagcagtacgggactttctttgaaaaaagaagaggaggaagaggaggcctcgaaagtggcatcaaaaaaaacaagtcaaattggcgagtcctttgaagagattctggaggagaccgtgatctccacaaaaaagacggaaaaatccaatatagaagaaaccaccatctccagtcagaagatttag

SEQ ID NO: 28813 - DNA, 1131 bp, Artificial Sequence
  Description of Artificial Sequence: Synthetic coding sequence
atggagagttacgacgtcatcgccaatcagccagtcgtcattgacaacggcagcggggtaattaaggctggcttcgcaggcgaccagatcccgaagtactgcttcccaaactacgtgggacgcccaaaacacgtcagagtcatggctggcgctctggagggcgacatcttcatcggtccaaaggctgaggaacacaggggcttgctctctattcggtacccaatggagcacggcatcgtcaaggattggaatgatatggagcgcatctggcagtatgtctattctaaggaccagctgcagaccttctccgaggagcaccccgtcctgctgacggaagctccgctgaatccccgaaagaaccgtgagcgagcagctgaggtcttcttcgaaactttcaacgttccagcactgtttatttccatgcaagcagtgctctccctatatgcaacgggcagaactaccggtgtggtactggatagtggtgacggcgttacccacgcagtgccaatttacgagggcttcgcaatgccacatagtattatgcggatagatatcgcgggtcgggacgtgtctaggttccttaggctttacctacgaaaagagggatatgattttcacagcagctctgagttcgaaatagtaaaggctataaaggaaagggcttgttacctaagcattaatccacaaaaagacgagactctagagaccgagaaagcacagtattacctgcccgatggctctacaatagaaataggcccttcacgttttagagcccctgagttactcttccggcctgatctcattggggaggaatcagaagggattcatgaggtcctggtgttcgccatacaaaagtccgatatggatctgagacgaactctgttctctaatattgttctaagtggaggctcaacattatttaagggattcggcgatcgcctgctaagtgaagtcaaaaagctcgctcccaaagatgtgaagattcgcatctcagctccacaggaacggctgtattcaacctggataggcggatctatcctggccagcctggatacgttcaaaaaaatgtgggtgtctaaaaaagagtatgaagaagatggcgctcgttcaattcatcggaaaacattttag

SEQ ID NO: 28814 - DNA, 783 bp, Artificial Sequence
  Description of Artificial Sequence: Synthetic coding sequence
atgtccctacagaagacgccacccaccagggtttttgtggaacttgtgccctgggccgacaggagtcgggaaaacaatctagcctccggcagggaaactctcccgggactgcggcaccctttgagtagcacccaggcgcagaccgccacacgtgaggttcaggtgagtggcacctcggaggtttccgcaggacctgacagggcacaggtggtcgtgcgcgtgtccagcacgaaagaagccgcagccgaagccaaaaagtccgtatgtaggaggctggactatattacccagagcctccagcagcagggtgtgcaagccgagaatatcacagtcacgaaggactttcggagggtggaaaatgcataccacatggaagcagaagtttgcattacctttactgagttcggtaagatgcagaatatatgtaattttcttgtggagaagctggattccagcgtggtcatctctccaccccaattctatcacacacccggatccgttgaaaatctgagaagacaggcctgcctggtcgcagtggagaatgcttggcgcaaggcacaggaggtgtgtaacctggttggtcagacactgggtaagcccctgctcattaaagaggaagagacgaaggagtgggagggccaaatcgacgatcaccaatcaagtcggctcagctcctcactgaccgtccaacagaaaatcaagtccgcaaccatccacgcggcaagtaaagtattcattaccttcgaggtgaaaggcaaggagaagagaaaaaaacacctgtag

SEQ ID NO: 28815 - DNA, 891 bp, Artificial Sequence
  Description of Artificial Sequence: Synthetic coding sequence
atggagccctcaggaggtgaacaggagccaggggcagtaaggtttctagacttgccttgggaggacgtgctgcttcctcacgtcctcaaccgggtgccactgagacagcttctgaggctccagagagtatctagggcatttaggtccttggttcagctgcacctggccggactgaggcgattcgacgcggcacaagtggggcctcagattccaagggcggctttggcgagactgctgcgagatgctgagggcctccaagagctggctctggcaccctgccacgagtggctcagcgatgaggatttggtccctgtgctggcaagaaacccacaactgcgatcggtcgccctcggcggttgcgggcagttgagcagaagagctcttggagcgctggctgaaggctgtcccagactacaaagactcagcctcgcccattgcgattgggtggatggactagccctccgaggcctggccgacagatgcccagcgttggaggaactcgatctgacagcgtgtcgccagctgaaggacgaggccatagtatatttggcgcagcggaggggcgctggccttcgctccttgtcgttggctgtcaatgccaacgtgggggatgctgccgtgcaggagttagccaggaattgtcccgaattgcatcatctcgatctgaccgggtgtctccgggtcggatcggatggggtgcggactttggctgagtattgtcccgtgctccggagccttcgtgtccggcactgccaccatgtcgctgagtcctcattgagtcggctgcgaaagagaggcgtcgatattgacgtggaacctccactgcaccaggccttggttctcttgcaggacatggccggttttgcaccattcgtgaatctgcaggtttag

SEQ ID NO: 28816 - DNA, 2100 bp, Artificial Sequence
  Description of Artificial Sequence: Synthetic coding sequence
atggctgatgctggcattcgcagggtggtgccctctgacctgtacccattggtgctgggcttcctacgcgacaaccagctctccgaggtggccaataaatttgccaaagccacgggtgccactcaacaggacgccaatgcctcttccttgctggacatttacagcttttggctcaaaagtgccaaagtcccggaaagaaagctacaggccaacggcccagtggcaaagaaggctaaaaaaaaggcgtcgagctctgactcagaagattcttccgaagaagaggaggaggtgcagggaccaccagcaaaaaaagctgccgtgccagcgaaacgtgtcggtctccccccagggaaggcggcagcaaaggccagtgaatcctcgagtagtgaggagtcctccgatgacgacgacgaggaggatcagaaaaagcagccagttcagaaaggggtgaagcctcaggcaaaggctgctaaagctcctccaaagaaggccaaatccagtgatagcgacagtgactccagttctgaagatgagccgcctaagaaccagaaacctaagataacacctgtaactgtgaaagctcaaactaaagctcctcccaagcctgctcgagctgcgcctaagatagctaatggaaaggccgcaagctcttctagcagtagcagttccagctcctccagcgatgattcggaggaagaaaaagcagcagcaacacctaagaaaactgtaccgaagaagcaggtggtggcaaaggcgcctgtgaaagcggctaccactccaactcggaagtccagctcaagcgaggactcgagttccgacgaggaagaagagcagaagaaacctatgaaaaacaagcccggtccttactcaagcgtgccacctccatctgccccaccaccaaaaaaaagcctgggaactcaaccaccaaagaaagcagtagaaaaacagcaaccagtggagtcctcagaggatagcagcgatgaaagtgactcgtccagcgaagaagagaagaaacctccaactaaagccgtcgtcagcaaggccacaacaaaaccaccccctgctaagaaggcggctgagagttcgagtgactccagcgactcggactctagcgaggatgacgaagctcccagcaaacctgcaggcaccacaaaaaattcgtccaataagccagctgtaactactaaatctcccgcagttaagcccgctgcagcccctaagcagcccgtgggaggcggtcagaaactgctcacaagaaaagctgatagctcatccagcgaggaggagtcttctagctctgaagaggagaagactaagaaaatggtagcgacgacaaagcccaaagcaactgctaaagccgctctttccctgcctgcgaagcaggcgcctcagggctctagagattcatcctcagactctgactcctcttcttccgaggaagaggaggagaagaccagtaagagcgctgtgaagaagaagccgcagaaggtggccggaggggctgccccaagtaaaccagcgagcgccaaaaagggaaaagcagagtcttccaattcttcatcctccgatgactcctcggaagaggaggaggagaaactgaagggcaagggcagtcccaggccccaagcacctaaagcgaacgggacctctgccttaacagcacagaatggtaaggctgccaaaaacagtgaggaagaggaggaagaaaaaaagaaagcagctgtcgttgttagcaagtccgggtcattaaaaaaaagaaaacagaacgaagccgcaaaagaggctgaaacaccccaagcaaaaaaaattaaactgcagactccgaacacttttcccaaacgtaagaagggagaaaagagagccagctccccttttcgccgagtccgggaggaggagattgaagtggacagtcgagtcgcagacaactcattcgatgcgaaacgcggagcagcaggggattggggggagcgcgctaaccaggtattaaagttcacgaaggggaaatctttcagacacgagaaaactaagaaaaagagggggtcataccgcggtgggtccattagcgtgcaagtgaattcgattaagttcgactcagaatag

SEQ ID NO: 28817 - DNA, 1275 bp, Artificial Sequence
  Description of Artificial Sequence: Synthetic coding sequence
atggaggagaacaacctgcagtgttcttcagtggtggatggaaactttgaggaagtcccaagagagaccgccattcagtttaaaccaccgctataccggcaaaggtatcaattcgtaaaaaacctggttgaccagcatgagcccaaaaaagtggctgacctggggtgcggagacacatcactgctgcggcttctgaaagtaaatccttgcatcgaacttctggtcggagtggacatcaatgaggacaagcttagatggaggggggattccctggctccattcctgggagatttcctaaaaccccgtgacttaaaccttaccataactctctaccatggctctgtggtcgaacgagatagccggctcttaggcttcgatttgataacatgtatagagctcattgaacaccttgattcaggcgacctcgcccgtttccctgaggtggtcttcgggtacctgtccccctctatgattgtcattagcaccccgaactccgagttcaaccccctcttcccaagcgtgactctgcgtgattctgaccacaagttcgaatggacacgcatggaattccaaacatgggccctgtatgtggctaatcggtacgactattcggtcgagttcaccggagtaggggaaccccctgccggtgcagagaatgtagggtattgcacacaaatcggaattttcaggaagaatggtggtaaagccaccgagtcgtgcctaagcgaacagcacgatcagcacgtatacaaagccaggcaaggattaaccatgctgcctcggttggtgcttaattttcatcctcaggcgattctccttccccatcttccaaagatgttgaggcttcaggtgttcaccacgagttacccttcacttcagcaggagcgattctttaagctggttcttgttaacgaggtatcccagcaggtggagtcgctgcgagtgtcacacctgcccagaagaaaggaacaggccggtgaaaggggggataagcctaaggacattggcggaagcaaagcaccggtaccatgctttgggcctgtatttacagaggtagaaaaagctaaaattgagaactcccccacccctttctgtgtgggtgataagttctttgttcctctgcagaggctacttgcctaccctaaactaaacaggctgtgtgccaatgaagagatgatgaggtcggtgatcgctgactccataccactgagctcagatgggtccgccgtggtggctgacctccgcaattatttcgatgagcagttcgagttttag

SEQ ID NO: 28818 - DNA, 1182 bp, Artificial Sequence
  Description of Artificial Sequence: Synthetic coding sequence
atggaagagaacaatctgcagtgttccagcgtcgtcgatgggaattttgaggaggtccccagggagaccgctattcaattcaagcctccgttgtatcgtcaacggtatcagtttgtaaagaatttagtggaccagcatgagcccaaaaaggttgccgacctggggtgcggagatacatctctcttacggcttttaaaggtcaacccctgtatcgagctgttggtgggcgtcgatattaacgaagataaacttcgctggaggggggatagcctagccccattcctgggtgactttctgaaaccgcgtgatctgaaccttaccatcaccctctaccacggatcagtcgttgagcgggactcacggctcctgggcttcgatctgatcacctgtatcgaacttatcgaacatctggattccggggatctggccaggtttcctgaagtggtgtttggatacctgtctccgtccatgatcgtcatcagtacacccaattccgagttcaacccgttattcccctcagtaaccctgcgagattccgaccacaagttcgagtggacacgcatggagtttcagacgtgggccctctacgtggcaaacagatacgactacagtgtcgaattcacaggggtcggcgagccccctgccggtgccgagaacgtaggatactgcacccagataggcattttccgaaaaaatggcggaaaggctactgagagctgcctgagtgaacagcatgatcaacatgtgtataaggctgtgttcacgacaagttaccccagcctccagcaggagcggttttttaagcttgtgcttgtgaatgaggtgtcacagcaagtcgagtctttaagagttagccacttgccaagacggaaggagcaggctggagaacgaggcgataagcctaaagacatcggtggaagcaaagcccctgtgccgtgcttcggcccagtgtttactgaagttgagaaggcaaagatagagaactcacctaccccattctgcgtgggagacaagttctttgtcccactgcaacgattactagcctatccaaaactaaatcggttgtgcgcgaatgaagaaatgatgcgcagcgtgatcgcagactcgattccacttagtagcgatggctctgccgtggtggccgacttgcggaactacttcgacgagcagttcgagttttag

SEQ ID NO: 28819 - DNA, 1701 bp, Artificial Sequence
  Description of Artificial Sequence: Synthetic coding sequence
atgtccgcttcaacgggaggcggtggagacagtggcggtagtgggggaagtagctcgagcagccaagcctcttgcggacccgaaagcagcggatccgagctggctctcgccacccctgtgccacaaatgcttcagggattgctgggctcagatgacgaagaacaggaggatcccaaggactattgcaaaggcggatatcaccctgtcaaaatcggggacgtcttcaatggtcgctatcacgtggtgaggaagttgggttgggggcatttctcgaccgtgtggctttgctgggacattcagagaaaaagattcgttgccctcaaggtggtcaagagcgccggtcattatactgagactgccgtcgacgaaattaaactgctcaagtgtgtcagagattctgatccaagcgacccgaagcgtgaaacaatcgtgcagctgatagacgatttccggatctccggagttaacggcgtgcacgtgtgcatggtgctggaagtgctagggcatcagctgctgaagtggatcattaagtcaaattatcaggggttaccagtgccatgtgtgaagagcattgttcgacaagtactgcacggactggactatctgcatactaagtgtaagatcatacacaccgatattaaacccgagaacatcctgctgtgcgtgggcgacgcatacatcaggaggctggcagcggaggccacagagtggcagcaggccggagcaccccctccttcccgctctattgttagtactgccccacaagaggtactcacagggaagctgagcaagaacaagcggaaaaagatgaggcggaagcgcaaacaacagaagcgattactggaagaaagactacgtgaccttcagcgcctcgaagcaatggaagctgccactcaggcagaagactcaggcctcaggttagatggtggttccgggtcaacgtccagttcaggatgccatcctgggggagctcgcgcaggaccttcccccgcaagcagtagcccggctcccggtggaggcagatccctgtccgccggtagccaaaccagcggtttcagcggctctttattctcccctgcgtcatgttccatcctctccggatccagcaaccagcgcgaaaccggaggccttctcagcccgtctacccccttcggagcgagcaacctgctggtgaatcctctggaacctcagaatgccgacaagataaagatcaaaattgccgatctcggaaatgcttgctgggtccataagcacttcactgaggacatccagactagacagtaccgggctgtcgaagtcttgattggcgctgaatacggccctcctgcagatatttggtctactgcctgcatggcgttcgaactggcaacaggcgattatctctttgaaccacactccggggaagattatagcagggacgaggaccacatcgcgcacatcgtggagctgttgggcgatattcctcccgcatttgccctctctggcaggtatagtagagagttcttcaatcgacgaggagagcttcggcacattcacaacctcaagcattgggggctctacgaggtgctcatggagaagtacgaatggcccctggagcaggcaacgcagttcagcgcgtttctgctgcctatgatggaatatattcccgaaaagcgggcatctgctgccgattgcctgcagcacccatggctgaatccgtag

SEQ ID NO: 28820 - DNA, 150 bp, Artificial Sequence
  Description of Artificial Sequence: Synthetic coding sequence
atggccggaccacgcgtggaggtggatggatctatcatggaaggcggtggtcaaatcctgagagtgtcaactgccctatcttgcctgctcggattgccactgcgcgtgcagaagatcagggccggtagaagcacccccggtttgagatag

SEQ ID NO: 28821 - DNA, 1101 bp, Artificial Sequence
  Description of Artificial Sequence: Synthetic coding sequence
atggccggtccacgagtcgaggtggatggatcaatcatggagggtggtggacaaattctgcgggtgtccactgccttgagctgcctcctagggttacccttacgcgtgcaaaagatcagagccggtaggagcactccaggcttgcgacctcagcatttatccggccttgagatgattcgggatctttgcgatgggcaactggagggtgccgaaattggctcaaccgagatcaccttcacgccagaaaagataaaagggggaattcatacagccgacaccaagaccgctgggtccgtttgtttactaatgcaggtgtcgatgccgtgcgtcctttttgccgcttctccatctgagctgcacctgaaaggcggaactaacgcggaaatggcccctcaaatagattacacagtaatggtgttcaaaccaatagtggaaaaattcggcttcatcttcaattgcgacattaagactagagggtactacccaaaaggcggtggtgaggtgatcgtgaggatgtccccagtgaaacaactgaatcccatcaacctcaccgaaagaggctgcgtcaccaaaatctacggccgtgcgtttgtggccggagtgcttccattcaaggtcgctaaagacatggccgcagccgcagtgcgctgcatccgcaaggagattcgggacctgtacgtgaacattcagcccgttcaggaaccaaaagaccaggcctttggaaatggtaatggcatcattatcatcgccgagaccagcactggctgtctattcgcaggatcctcactggggaaaaggggggttaatgcggataaggtgggaatcgaggccgcagagatgttgctggccaacttgcgacatggtggtacagtggatgaatacctgcaggaccaactaatcgtattcatggcattggctaacggggtgtcacgcattaaaactgggcctgtgaccctgcacactcagactgccatacattttgctgagcaaatcgctaaggccaaattcatcgtcaaaaaatcggaagacgaagaggatgccgcaaaagacacatatataatcgaatgtcagggcatcggcatgaccaacccgaacctatag

SEQ ID NO: 28822 - DNA, 1155 bp, Artificial Sequence
  Description of Artificial Sequence: Synthetic coding sequence
atggaggggctgggtagaagctgcctgtggcttagaagagaactctctccacctcgcccacgcctgttgctgctcgattgtcgcagtagggaactgtatgagagcgcgcgtatcggaggagcactgagcgttgcgctgcccgctctcctgctccgcagattacggaggggaagcctaagcgtgagggctctcctgccaggcccacccctccaacctccaccgccagcccctgtcctgttgtacgatcaaggcggaggtcgccgacggaggggcgaagcagaagctgaagcagaagaatgggaggccgaatccgtgctaggcaccctcctgcagaagctgagggaggaaggttacttggcctactatctccaggggggattcagccggtttcaggcagagtgcccgcacttgtgcgagacaagcctcgccggtcgcgcaggatcatcgatggcgcctgtgccaggtcctgttccagttgtaggactcggttccctctgtctgggttccgactgctccgatgccgagtccgaagctgatcgggacagtatgagttgtggcttggacagtgagggagccactcccccacctgtgggcctcagagccagttttcccgtccagatactacctaacttgtatttaggctccgccagagatagtgcaaacctggaatccttagccaaactggggataaggtacatactgaatgttactcctaatctccctaacttttttgaaaaaaacggggatttccactataagcagataccaatcagtgatcactggtcacagaacctttcacgcttttttcctgaagccatagagtttatagacgaggcattatcccaaaattgcggagtgttagtgcactgcctagctggcgtatccaggagtgtgaccgttacagtggcatacctgatgcagaaactccacctgagtctgaacgacgcgtacgatctagtgaaacggaagaagtctaacatttctcctaacttcaattttatgggtcaactgctggacttcgaaagaagtctgcgtttagaggagaggcacagtcaagagcagggatccggcggtcaggcttccgccgcaagcaatcctccatccttttttaccactccgactagcgatggcgctttcgaattggcgcctacctag

SEQ ID NO: 28823 - DNA, 804 bp, Artificial Sequence
  Description of Artificial Sequence: Synthetic coding sequence
atggccgaaccagtgcaggaggagctgagcgtgcttgcagccattttctgccgtcctcacgagtgggaggtcctttctcgtagtgagaccgacggcaccgtattcagaatacacactaaggccgaggggttcatggacgttgacataccgttggagctggtgttccatctgcctgtcaattaccccagctgccttcccggtattagcattaacagcgaacagttaacccgcgctcagtgtgttactgtgaaagaaaacctactggaacaggcggaaagcctgctgtctgagcccatggttcatgagctcgtgctctggatacaacagaacttgaggcacatcctatcacagccagaaacagggtcaggctcagagaaatgtacttttagcacctccaccacaatggacgacggtctgtggatcacgctcttacacttggaccacatgcgggctaaaacgaaatacgtgaagatcgtggagaagtgggccagtgatctgagattaaccgggaggctgatgtttatgggcaagatcatcttaatcctgctgcagggagaccgaaataacctgaaggagtacctgatcttacagaagactagcaaagtagatgtagattccagtggcaagaagtgtaaagagaagatgatttccgtcttatttgagaccaaggtgcaaacagaacacaagagatttttagcgttcgaggttaaggagtactctgcgcttgatgagcttcagaaggagtttgagacagcaggcctcaagaagcttttcagcgaatttgtactggcactggtcaaatag

SEQ ID NO: 28824 - DNA, 2010 bp, Artificial Sequence
  Description of Artificial Sequence: Synthetic coding sequence
atggcaatcgtgcagaccctgccagtgccattagaaccagcgcctgaggccgctactgcccctcaggctcctgtgatggggagtgtgtcctccctgatcagcgggaggccatgtcccggtggtccagcaccacctcggcaccacggcccacctggacccactttttttcgccagcaggatggtcttctcagggggggttatgaggcccaggaacccttgtgccctgctgtccctcccaggaaggcagtcccagtaaccagttttacgtacatcaacgaggacttcagaacagagtcccctcccagccccagtagcgatgtagaggacgcccgagagcaaagagcgcacaatgctcacctgagaggaccaccgcctaagcttatccctgtgagtggaaaattggaaaagaatatggagaaaatccttatcagacccaccgcctttaagccagtactcccaaagcctagaggcgcaccaagcctgccaagtttcatgggtccacgggcaacaggattgagcggaagccaggggagtctaactcagctgttcggaggacctgctagttccagctcatcatcttcctcctccagcgccgctgataagccactggccttcagcggctgggcctcaggctgcccatcaggcactctgtccgattccggtagaaactcactgtcctctctccccacctactccactggcggagcggaacctacaacctcctcccctggagggcacctgccttcacacggctctgggcgtggagctctaccgggtcccgcacggggtgttcccactggccctagtcatagtgatagcgggaggagctccagctccaagtcaaccgggtcgttgggaggcagagtggcaggaggcctgcttgggtcgggcactagagcctctccagacagttcatcgtgtggcgaacgtagccccccaccaccccctcccccaccatctgatgaagcactgttacattgtgtccttgaggggaagctgcgagacagagaggctgagctgcagcaactacgcgacagcctggatgagaacgaggccactatgtgccaggcttatgaggagcggcagagacattggcaaagggagagggaggctttgagagaggattgtgcagctcaggctcagagggctcaaagagcccagcagctgctacagctccaggtgttccagctccaacaggagaaacggcaattgcaagacgattttgcgcagctgcttcaagagagagagcaactagaacggcgatgcgctacactcgaacgcgagcaacgcgaactgggcccaagactggaagagaccaagtgggaggtatgccagaagtccggtgaaatctcactgttaaaacagcagctgaaagagagccaggcagaactggttcagaaaggatcggagctggttgcgctgcgggtagccctgagagaagcccgagctaccctccgggtcagcgagggaagggcaagaggcctccaggaggctgctagagctcgcgagctggaattggaagcttgcagccaggagttacagcggcaccgccaggaagccgagcagcttagagaaaaagcaggacaactggatgctgaagcagctggcctgagagagccgccagttccaccagctaccgccgatccatttttgttagcggagagtgatgaggccaaggtgcagagagcggcagctggcgtcggcggttcattacgggcacaggttgagagactgcgggtggagctgcagagagagcgccgtaggggcgaagagcaaagggactcgtttgagggtgagcgtctagcctggcaggccgagaaagaacaagttatcaggtaccagaagcaattacagcacaactacattcagatgtatagacgcaatcgccaactggagcaggagctgcaacagctttcgttagagttggaagcccgtgaactggccgacctgggtctggctgaacaggctccatgcatatgccttgaagaaattacagctaccgaaatttag

SEQ ID NO: 28825 - DNA, 2010 bp, Artificial Sequence
  Description of Artificial Sequence: Synthetic coding sequence
atggcgattgtgcaaacattgcccgtgcccctggagccagcacccgaggcagctaccgcccctcaggcccctgtcatgggaagtgtgagcagtctcatctccggacgtccttgccctggcggtcccgcacccccacggcaccacgggcctccgggtcccaccttctttcgccaacaggatggcttgctgagaggaggctatgaggcccaagaaccactgtgtccagccgtcccccctaggaaagccgtgccggtcacgtcgttcacctacataaacgaggattttcgcaccgagtccccgccatctcccagctccgacgtggaagacgcacgggagcaacgcgctcacaacgcacaccttaggggccctcctcctaagctgatccccgtatcgggcaaactggagaagaacatggaaaaaattctaataaggcctacggcctttaagccagtgctcccaaaaccgaggggtgctccttctttacccagctttatgggcccacgggcaacagggctaagcggtagccagggcagcctgacacaactgttcggagggccagctagctctagctccagttcaagctcatcttctgctgccgataagccacttgctttctcgggctgggccagcgggtgcccgagcgggaccctgagcgatagcggtaggaacagcttgagtagcctgcctacctacagcaccggaggggctgagcctaccacgtccagtcccggaggtcatctgccgagtcacggatctggcagaggggcactcccagggcctgcccgaggggtccccaccggcccttcccatagcgatagtggtcgttcaagtagcagtaagagcactggctctctgggaggcagggttgcgggagggcttcttggaagcgggacaagggcatccccagatagttccagctgcggggagcgatccccacccccacctcctccgcctccctcagacgaagctctattacattgtgtcttggagggtaaattaagggatcgcgaagccgagctccaacagctgcgggattcactcgacgagaatgaagctaccatgtgccaggcgtatgaggaacggcagagacattggcagagagaaagagaggccctgcgcgaagattgtgccgctcaggctcaacgggcacagcgggctcaacagttgcttcaactgcaggtcttccaattgcagcaggagaaacggcagctgcaggacgacttcgctcaactcctgcaagaaagggagcagttggagcgcagatgcgcgacattagagagggagcagcgagaactgggtccccgtctggaggagaccaaatgggaggtgtgccagaagagcggagagatctcgttattaaaacagcagctgaaagaatcccaggctgaactagtgcagaaggggtccgagctggttgcgttacgcgtggccttgcgtgaggcacgggctaccctccgcgtatccgaagggagagctcggggactgcaggaagccgctcgggctcgagagctggagcttgaggcctgctcacaggagctgcagagacaccggcaagaggcagaacaacttcgggaaaaagccggtcagctcgacgccgaagcagcaggtctacgggagccccctgtgccccctgccactgccgacccatttttactcgctgagagcgacgaagcgaaagtgcaacgtgctgccgcaggggtgggaggttctctgcgcgctcaggtcgaacggctcagggtggagttgcaacgggagcgcaggcgcggagaggagcagcgggacagcttcgagggggagcggctggcctggcaggcagaaaaggagcaggtaatccgataccagaaacaactgcagcataactatattcagatgtaccggaggaacagacagctggagcaagagttacagcagctcagcttggagctcgaggcaagagagctggctgatctgggcctcgccgagcaggctccctgcatctgtctggaggagataactgccaccgaaatttag

SEQ ID NO: 28826 - DNA, 1059 bp, Artificial Sequence
  Description of Artificial Sequence: Synthetic coding sequence
atgaaactgaaagaattggagcggccagccgttcaagcctggtcaccagcatcccaatatcccctttacctggccactggaaccagcgcccagcagttggatagtagtttttccactaacgggaccctggaaattttcgaggtggatttcagggatcccagcctggacctaaaacaccggggagtcctgtctgccctctcccgttttcacaagttggtatgggggagctttgggagtggactcttagaaagcagtggggtcatcgtgggcggaggggacaacggaatgctgattttgtacaacgttactcatatcctgagctctggaaaagagcctgtgatcgcccagaaacagaagcacactggggctgtgcgtgcccttgatctaaatcccttccagggtaatctgttagcttccggggcaagcgattcagaaatattcatctgggacttgaataatctgaatgttcccatgacacttggcagcaagagtcaataccacgagcagccccctgaggatatcaaagctctcagctggaataggcaggcgcagcatatcctcagcagtgcacacccaagcggcaaggccgttgtctgggatttacggaaaaatgaacccatcattaaggtcagcgaccatagtaaccgaatgcactgcagcggtctggcttggcatcccgatattgctacgcaactggtgctatgttcagaagacgacagactgcctgtaattcagctgtgggatctgagattcgcgtcctccccacttaaggtgctcgagtctcactcacggggtatcctatcagtctcatggtcccaggccgatgctgaactgctgctcacgtccgctaaagactcccagatcttgtgtcgcaacctgggatcttctgaggtggtgtacaagcttcccacccagtcgtcctggtgttttgatgttcagtggtgtccccgagacccctccgtgttcagcgcagccagctttaatggatggatatcactgtactcggttatgggacgctcgtgggaagtgcaacacatgcgtcaggcggataaagtctag

SEQ ID NO: 28827 - DNA, 3540 bp, Artificial Sequence
  Description of Artificial Sequence: Synthetic coding sequence
atgaaacttaaggaactggagcggccagctgtccaggcttggagtccagcctcccagtatcctctctatctggctacaggcaccagcgcccagcagctggactccagcttctctaccaacgggacactcgagatcttcgaggttgacttccgcgatccatctcttgacctgaaacatcgaggtgtgctgtctgccctgtcccgattccataagctggtctggggctcgttcggaagcggacttctggaatcctccggagttattgtggggggaggagataacgggatgctgattctctacaatgtcactcacatcctcagctcaggaaaggagccggtcattgcgcagaagcagaagcacactggggctgtgagggccctcgatctcaacccgttccaggggaacctgctcgcctccggagcttccgatagtgagatcttcatttgggacctcaacaatctgaacgtgccaatgactctgggatccaaatcccaacagccgccagaagacatcaaagcattaagctggaatcgtcaggctcaacatattttaagcagcgcccacccctccggaaaagcagtggtctgggacctcaggaaaaatgagcccattataaaggttagcgatcattctaatcgtatgcattgctccgggctggcctggcaccccgacatcgcgacacagttggtgttatgcagtgaggacgatcggcttccggttatccagctatgggatctccggtttgcgagtagcccattaaaagtgctggagtctcactcccgaggcatcctttcagtcagttggtcacaggccgacgccgaattgctgttgacatctgctaaggacagtcagattctgtgccggaatctgggttcctcagaggttgtgtataagctacccacacagagtagttggtgttttgatgtacagtggtgtcctagggacccatccgtgtttagcgccgcatcatttaatggctggatttcactatacagtgtgatgggtcgttcttgggaggtgcaacacatgcgacaggctgacaagatctctagcagtttcagcaagggtcaacccttgccacccttgcaagtacctgagcaggtcgcgcaggctccactcattccacccctcaagaagcccccaaagtggattagaagacctaccggcgtaagttttgcttttggaggtaaactggtcacgttcggactacctagtacccctgctcacctcgtgccccagccttgccccagattggtgttcatctcccaggtgacaactgagtcagaatttttaatgagatctgccgagctgcaagaagcattaggtagcggcaatctgctaaattattgtcagaacaaatcacagcaagctctcctgcagagcgaaaaaatgctgtggcaatttctgaaggttacgttggagcaggatagtagaatgaaattcctcaagttactgggatatagcaaagatgaactccaaaagaaggttgcgacttggctgaaaagtgacgtgggactgggggagtctccccagcctaagggaaacgaccttaatagcgaccgacaacaggccttttgctcccaggcttccaaacataccactaaagaggctagcgcttcctctgccttctttgacgagctagtgccacagaacatgactccatgggagatcccaatcaccaaagatatagatggcctgctcagtcaggccttactcttgggggaactgggtcccgcagtagagctgtgcctgaaggaagaacgctttgccgacgccattattctggcacaggctggagggacagacctcctgaagcagactcaggagcgctacctcgctaagaaaaaaaccaaaatctccagcctgctcgcatgtgttgttcagaaaaactggaaggatgtggtatgcacttgctctctcaagaactggagagaagctcttgcattgctcctgacatactccggcacagagaagtttccagagctatgtgatatgctgggtaccaggatggagcaggagggttctcgagctctcacctctgaggccagactgtgctacgtgtgctccggcagtgtagagcggctcgttgaatgttgggcaaagtgccaccaggccctgagccccatggcccttcaagatcttatggagaaagtgatggtgctaaaccgatctctggagcagctgcgtggtccacacggcgtctccccgggaccggctacaacctatagagtgacacaatacgctaacttgctggctgcccagggatccctagctacagctatgagttttctgccacgggactgcgctcagccacccgtgcagcagttgcgggatcgcctgttccatgcccaaggtagtgccgtgttaggccagcagagcccaccttttccttttcctcgaatcgtcgtcggagcgactctccatagcaaggagacctcaagctaccgtctgggtagccagccctcccatcaggttcccacccctagcccacggccacgcgtcttcaccccacagagctcgcccgcaatgccactggccccatctcacccatcaccataccaagggcctaggacacagaacatatcagactacagggccccaggaccacaggccatccagcccctgcctctgagccccggtgtcagaccagcaagcagtcagccacagttgctgggcggacagcgagttcaggtgcccaatcctgtgggctttcccggaacgtggcccctccctggctctcccttgccgatggcttgcccaggtataatgagaccagggtctacgtcactgcctgagacaccaagactcttcccccttctccccctccggcctctcgggcctgggaggatggtgtcgcatacaccagcccctcctgcttcttttcccgtgccatacctgcccggagatcccggtgcgccatgctcttctgtgctcccaaccacaggcatactgacgcctcacccaggaccacaggacagctggaaagaagcaccggctccgagaggcaacctacagagaaacaagctgcctgagacatttatgccaccggcacccatcacagcaccagtgatgtccttaacaccagagctacagggaatcttgccaagtcagcctccagtgagtagtgtgtctcatgctccacctggcgtaccaggcgagttgtcactgcagctgcagcatctgcctcccgaaaaaatggagcggaaagagctcccgcctgagcaccagtcgcttaaatccagttttgaggccctgctgcaacgctgtagcctgagcgcaacagacctcaaaactaagagaaaactggaagaagcagcacagaggctggagtatctctatgagaagctttgcgaaggcaccctctcccctcatgtcgtcgctggtctccatgaggttgcccgttgcgtcgacgcgggatcgttcgaacagggactggcagtacacgcacaggtcgcaggttgcagcagcttttctgaggtttctagttttatgcctatcctcaaggccgtcctgattatcgcccataaactactcgtgtag

SEQ ID NO: 28828 - DNA, 1635 bp, Artificial Sequence
  Description of Artificial Sequence: Synthetic coding sequence
atggacgataagggtgacccttccaatgaagaggctcccaaggctatcaagcctacttccaaggaattcagaaagacatggggcttccgcaggaccaccattgcgaaacgcgagggagccggagatgccgaagcagatccgctcgagcccccacctcctcagcagcaactaggtttatcccttcggagaagtgggagacagcctaaacgcaccgaacgggtagaacaattccttactattgcaagacgacgcggacgcagaagcatgcccgtgtccctcgaggatagcggagaaccaacgtcatgccccgctacagacgccgagacagctagcgagggatcagtggaatctgctagcgagacacgctctggcccacagagtgctagcactgcggtgaaagagcggcctgctagctccgagaaggttaaggggggagacgatcacgatgacacctctgattctgactccgatggactgacattgaaagagctccagaataggctgcgacgcaagcgggaacaggagcctaccgagagacccctcaaggggatacagtcacgactccgtaagaagaggcgcgaagagggcccagccgagacagtgggtagcgaggccagtgatactgttgagggcgttttgccctcgaaacaagagccggaaaatgatcaaggcgtcgtatcccaggctggtaaggacgaccgggaatcaaagctggagggaaaggctgctcaagacatcaaagatgaggaacctggcgatcttggacggccaaagccagaatgtgaagggtatgatcccaatgccctgtattgcatttgtcggcagccgcacaacaatagatttatgatttgctgcgacagatgtgaggagtggtttcatggtgactgtgtgggcataagcgaggccagggggaggctgctggaaagaaatggcgaggactatatttgcccgaattgtactattctgcaggtccaggacgagacccatagtgagacagctgatcagcaggaggctaagtggagacccggagatgctgatggtacagattgcacatctatcggtacgatcgagcagaagtcatctgaagatcagggtatcaagggcagaattgaaaaggctgcaaacccatccggaaagaaaaagctgaagatctttcagcctgttattgaggcgccaggggctagtaagtgcatcggccctggctgttgtcacgtcgcccagcccgactcagtgtattgtagcaacgattgcattctcaagcacgctgcagccacaatgaaatttctgtcctcaggtaaggagcaaaagcccaaaccaaaggagaaaatgaagatgaagcctgagaagccttccctgcccaaatgtggggcacaggccggtattaagatcagttcagttcataaacggccagcccctgagaagaaggagaccactgtaaagaaagccgtcgtcgtacccgcaaggagcgaggccctgggcaaggaggctgcttgcgaatcatctacacccagctgggctagtgaccataattataacgccgttaaacctgaaaaaaccgcagcgccaagtccttctctgttgtacaaatgcagtgggaaatactcctactccttgcaccccagtttaatcgcatag

SEQ ID NO: 28829 - DNA, 1689 bp, Artificial Sequence
  Description of Artificial Sequence: Synthetic coding sequence
atggatgacaaaggggacccatctaacgaggaagccccaaaggccatcaagccaacatccaaagaatttcggaagacctggggattcagacgaaccacaatagccaagagagaaggagccggtgatgccgaagcggacccactggaacctccccctccgcagcagcaactcggccttagcctcaggcgtagcggccgacagcctaagcgaactgagcgggttgagcaatttctcaccatcgctagacgccgaggacggaggagcatgccggtgagcctggaggacagtggcgaaccaacatcttgtccagctacagatgctgaaactgcttccgaggggagcgttgaatctgctagcgaaactcgcagtggacctcaatcagcatccacagccgttaaggaaaggcctgcttcttctgagaaagtcaagggcggtgacgatcacgatgacacatctgactccgactctgatggcctgactctgaaagagcttcaaaatcgcctcagacggaaaagagaacaagagcctaccgagcgtcccctaaagggtatccagtctcgtctgaggaaaaaacgccgagaggaaggacccgcagaaactgttggctcagaagctagcgacaccgtagagggagtgttgccctccaaacaggagcctgaaaacgaccagggggtggtgtcacaggccggtaaggacgatcgggaatccaagctcgaaggaaaagcagctcaggacattaaggatgaggagccaggcgatttaggccgacccaagccagagtgtgagggatatgaccccaatgccctctattgcatctgccgccagccccataataaccgattcatgatatgctgcgacaggtgtgaagaatggtttcatggtgactgcgtgggaatctccgaggcaaggggcagactgctggaacgtaatggtgaggactatatctgccctaattgtaccatcctgcaagtccaagatgagacccactcagaaaccgccgatcagcaagaagcaaagtggcgccctggggacgcagatggaaccgattgcactagcataggtaccattgagcagaaatcgtcggaagaccaaggaattaaaggccgaattgaaaaggccgctaaccccagtggcaagaaaaagctgaagatctttcagcctgtcatcgaggcacctggagcctctaagtgcatcgggcctggctgctgccatgtggcccagcctgactccgtctactgttcaaatgactgtattctgaagcatgctgcggcaacgatgaagtttctttctagcggaaaagagcagaagccgaagcccaaggagaaaatgaagatgaagcctgagaaaccctctctgcccaagtgcggcgcacaggccggtatcaaaatttccagcgttcacaagagaccagctcccgaaaagaaggaaaccaccgtgaaaaaggcggtggtggtgcctgccaggtccgaagctctgggcaaagaggccgcttgtgaatcttcaactccttcctgggcctccgatcacaactataatgctgtcaagccagagaaaactgctgccccttctcctagtctcctctataaatgcatgtaccacctgggggtgggacttctcgacccttcacgttccttttggatcgctatcccctgggcttgcccaggcctgggggtggccgcattgtgttag

SEQ ID NO: 28830 - DNA, 1689 bp, Artificial Sequence
  Description of Artificial Sequence: Synthetic coding sequence
atggatgacaagggcgatccctctaatgaggaggctcctaaagccatcaaacccacaagcaaagaatttagaaagacctggggctttaggaggacaactatagcaaagagggagggagccggagatgctgaggcagacccccttgagccaccacctcctcagcagcaactggggttaagcttaaggaggagcgggcgtcagccaaagcgtaccgagagagtagaacagtttctgactatcgccaggagacggggtcgccgatccatgcccgtgagccttgaggacagtggagaacccacctcttgtccagcgactgacgcggaaactgcctctgaggggtcagtcgagtcggcttccgagacccgaagtggaccccaatccgcctcaacagcagtgaaggagagaccggcatctagcgaaaaggtgaaaggtggcgatgatcacgatgacaccagcgattctgattctgacggtctcacattaaaggaattgcaaaatagactgcgccgtaagagggagcaggagcccacagaacgaccattgaaggggatccagagcagactcagaaagaaacggcgagaagaaggcccagccgaaactgtcggcagtgaggccagcgataccgttgaaggcgttctgccatccaaacaggagcctgaaaatgaccaaggtgtggtttcccaggcgggtaaagatgatcgggaatccaagctcgagggcaaggccgctcaggacatcaaagatgaagagcctggtgacctgggacgccctaagcccgagtgtgaagggtatgaccctaatgcactgtattgcatttgccgacagccacataataataggttcatgatttgctgtgataggtgtgaagagtggtttcacggggattgcgtgggaatctcagaggctagagggaggcttctggaacgcaacggcgaggattatatttgccctaactgcactatcctgcaggtgcaggacgagactcattccgagactgccgaccagcaagaagcaaagtggcgaccaggtgacgcagacggtactgactgtacatccatcggcaccatcgaacagaaaagttccgaagaccagggcatcaaggggcgtatcgagaaggccgctaatccttcgggtaagaaaaagttgaagatcttccagcctgttatcgaagcacccggtgcctcaaagtgtatcggccctggctgttgtcacgtggcgcagcctgattctgtatattgcagcaacgattgtatactgaagcatgcggcagcgaccatgaagtttctctcttccggcaaagaacagaagcctaagcccaaggagaaaatgaaaatgaagcctgaaaagccatccctgccaaagtgcggcgctcaggccggtataaagattagcagcgtacacaaaagacccgcacctgagaagaaggagaccacagttaagaaagccgtagttgtgccggctcgcagtgaagctcttggcaaggaggccgcttgcgaatctagcactccatcctgggcatccgaccataattacaacgctgtgaagccagaaaagacagccgctccatcccccagcctactgtacaaatgtatgtaccatctcggtgtggggctgttagatccttccagaagcttctggatcgccattccgtgggcttgtcctggactgggggtggcagctttgtgctag

SEQ ID NO: 28831 - DNA, 1272 bp, Artificial Sequence
  Description of Artificial Sequence: Synthetic coding sequence
atggaggataagcgtagcctttccatggcgaggtgtgaggagcggaattcccgagggcaggaccacggcctagaaagggtcccatttcctccacagcttcagagtgaaacatatctgcatcctgcggacccttccccagcttgggatgacccaggatcaactggatcgcccaatcttcgacttctgactgaagaaatagcttttcagccccttgccgaggaggccagcttccgcagaccacatcccgatggagatgtccctcctcagggagaagataatcttctgagcttgccctttccgcagaagctgtggcgccttgtttccagcaatcagttctcttcaatttggtgggacgactccggcgcatgtcgcgtcattaaccagaaactgtttgagaaagaaatcctcaaaagagatgtggcccataaggtctttgccactacctcaattaaatccttttttaggcagctgaatctctatgggtttagaaaaagaaggcaatgtacattccgcaccttcacgcggatcttcagcgcgaaacgcctggtgtctatactaaataaattggagttctattgccatccttattttcagcgcgactctccacatctccttgtgagaatgaagcggagggtaggggttaagagcgcgcctaggcatcaggaagaagataagccagaggccgctggttcttgtctggcgccagctgacacagagcagcaggaccatacgtcaccaaatgaaaacgaccaggtcaccccccagcaccgcgagcccgcaggcccaaacacccaaattagatctggcagtgctcctcctgccacacctgtgatggtgccagactctgccgtggcatccgataacagccccgtgactcagcctgcaggcgagtggtcggaaggttcccaagctcacgtcacacctgtggccgcagtgcctggccctgccgcactgccctttttgtatgtgccgggtagtccgactcagatgaattcttacggccctgttgtagccctgcccacggctagcagatccacgctggccatggacaccaccggcttgcctgccccagggatgcttcctttctgccacttgtgggtacccgtaactctagtggcggctggggctgcccagcctgccgctagcatggtgatgttccctcatctgccggctctgcaccatcactgccctcactctcatagaacatctcaatacatgcctgcgtctgacggcccacaggcgtaccccgattatgccgatcaaagtacttag

SEQ ID NO: 28832 - DNA, 675 bp, Artificial Sequence
  Description of Artificial Sequence: Synthetic coding sequence
atgccaacactgtttaaaggggtgtggggggtcgtggaacacagccgtgccctgggcaggttctgtccagcatgtctgcctagcggcccacacttgcacacccaaccagcactgggaacggcagagatgacactgctcagttctcagtctagtagccttgtggctccttctggaagtgtgtccgcagaaaacccagagcaaaggatgctcgagaaacgagccaaggtgatcgaggaactgctgcaaacggaaagggattacatcagggatcttgagatgtgtattgagagaattatggtcccaatgcagcaggcccaagtgcccaacatcgacttcgagggactttttggaaatatgcagatggttattaaggtgtcaaagcagctcctcgcagcactagagatctctgacgcagtggggccagtgttcctgggtcaccgcgacgaactggagggcacgtataagatttattgtcaaaatcacgatgaggccattgccctcctggaaatttatgaaaaagatgagaagatccagaagcatctccaggatagtttggctgatcttaattccctggtgttgaaaaaaggatgtactaactatatcaatctgggtagcttcttaatcaagccggtgcaacgggtgatgcgatacccactccttctgatggagctgtag

SEQ ID NO: 28833 - DNA, 1878 bp, Artificial Sequence
  Description of Artificial Sequence: Synthetic coding sequence
atgagactgccagaacggcacggaggacctcaaggaagcctctgtctgatggatccatgctgtccactgtcccttgccctgcaggacctagtcgagagggattgcaatggtgacacaccaaacctgtccttctacaggaacgagatacgatttttgcccaacgggtgttttatcgaggacattctgcagaactggactgacaattacgatctcctggaagataaccacagctacatccagtggctgttcccccttagggagccaggagtcaactggcatgccaaaccactaactcttcgcgaggtggaggtattcaaatcatcccaggaaatacaggaacggctcgtccgggcatatgaactcatgctgggattctatggtatcaggttggaggaccgagggactggtactgtcgggagagcccagaattatcaaaaaagatttcagaatctcaattggaggagtcacaacaatctccgaattacacggatccttaagtctctgggggaacttggcctggagcacttccaggcaccactggtccgcttcttcctcgaggagactctggtccgcagagaattgccaggcgtccggcagtccgccttagactatttcatgtttgccgtgaggtgtagacaccagaggaggcaacttgtgcactttgcctgggagcatttccgcccaagatgcaagttcgtgtggggaccccaagacaagttgaggagattcaagccatctagtctgccccatccactggagggtagccgcaaagtggaagaagagggctccccaggcgaccccgatcacgaggcttccactcagggtaggacatgcggccctgaacattctaagggagggggacgcgtcgacgaggggccacagccaagatcagtggagccgcaggacgccggtccgctggaaaggagtcagggagatgaagccggtggtcatggcgaagaccggcctgagccactcagccccaaggaatccaagaagcgcaagctggagttgtctcggcgagagcagcctccaactgaacccggaccgcagagcgcaagcgaagtagagaagattgcactgaacttggaagggtgcgcactctcccaaggttcccttagaacagggacccaggaagtagggggacaggacccgggagaggcagtccagccctgtcgacagccacttggcgcaagggtagcagacaaggtacggaaacgcagaaaagttgacgagggagcgggagactctgctgctgtggcgtccgggggagctcagacccttgctctggcaggcagcccagctccatccggacacccaaaggcaggccactctgagaatggcgtagaagaggacaccgagggcaggacagggccaaaagagggtactccaggatcaccctccgagacccctggtccaagccccgctggcccagcgggagatgagccggcagaatcgccaagcgagacccctggccctcggcctgccggtccagcgggagatgaacccgctgagtctcctagcgaaacacccggaccgagaccggcaggtcctgccggagacgaacccgcagagtctccttcagagaccccgggtccgtctcccgctgggccaactagagatgagcctgcagaatcgccctctgagactcctggccctcggccagctggccctgcaggcgacgagcccgctgaaagtccctctgaaactccagggccacgcccagctggccctgcgggtgacgagccagccgaatcccccagtgaaactccgggaccctcacccgcaggtccaaccagggacgaacccgctaaagcaggcgaagccgcagaactgcaagatgcggaggtagagagctccgctaaaagcggcaagccgtag

SEQ ID NO: 28834 - DNA, 1386 bp, Artificial Sequence
  Description of Artificial Sequence: Synthetic coding sequence
atggatgaccctgattgcgacagtacctgggaagaagacgaggaagatgcggaggatgctgaggatgaggactgtgaggacggggaggcagcaggtgccagggatgctgacgcaggagacgaggacgaggagtctgaagaacccagagccgctagaccttcttccttccagtcccggatgactggaagccggaattggcgggctaccagggatatgtgtcggtacagacataactatccagatctggtggagcgggactgcaatggggacactccaaatctttccttctataggaatgagattcgattccttcccaatggttgttttatcgaggacattctgcagaattggaccgataactatgacctgctggaagacaaccattcctatatccagtggctattccctctacgggagccaggagtaaattggcacgcaaagccgctgacactaagggaagttgaggtgtttaagtcctctcaggagattcaggaacgcctggttcgcgcatacgaactcatgctcggcttctacggaatccggcttgaggaccggggaacaggaacagtcgggcgagcacagaactaccagaagcgatttcagaacctgaactggagaagtcataacaacctaagaattactcggatcctaaagtccctgggcgagctgggattagagcacttccaggctcctctggtcagatttttcctggaggaaaccctcgtgcgaagggagctgccaggtgtccgtcagagtgcactagattatttcatgttcgcagtgcgttgcagacaccagaggagacagttggttcacttcgcgtgggaacacttcaggcctcgctgcaagttcgtctggggaccgcaagacaagttgcggaggttcaagccttcatctcttccccaccctctagaagggagtaggaaagttgaggaagaggggtcgcccggagaccccgatcatgaggcatccacacaggggagaacttgtggaccggaacatagcaaagggggtgggagagtagatgagggcccacagcccaggtcagtggaacctcaggatgccggtccactggaacggtcccagggtgacgaggcagggggacatggagaagacaggcccgagcctctctcacctaaagaatctaaaaaaagaaagttagaactcagcagacgcgagcagccgcctactgagccaggaccacaatccgcgtcggaggtggaaaaaatcgcgctcaatctagagggttgcgccctgagtcaggggtcactgcgcactgggacacaggaggttggaggccaagatccaggggagagttcctgcccatgctgcaggggctggggcttgcgtagctgttgtggcctcccttccggatcagccagctag

SEQ ID NO: 28835 - DNA, 1539 bp, Artificial Sequence
  Description of Artificial Sequence: Synthetic coding sequence
atgccttccccctccagatctggtagatcccgctgtttaaaagcaccgaggcgcagcaggtccggactcagcggcccaacatctagctgctgggcttctactatccgactggaggatagggggacagggactgtgggccgtgcacagaactatcagaagcggtttcaaaatctcaactggcggagccataataatctgagaatcacccggatcttgaagtcactcggcgagttggggctggagcacttccaggcacccctggtgagatttttcttggaggaaaccctggtcaggagagaactccccggagtccgccagtctgcactcgactactttatgttcgccgtgagatgtcgccatcaacgcagacagcttgtgcatttcgcgtgggaacactttcgcccacggtgtaagttcgtctgggggcctcaggacaagctcaggaggttcaagccttccagtctcccacaccctctggagggaagcaggaaggtagaggaggaaggaagtcctggcgatccagaccatgaagccagtacgcaaggcagaacttgcggacctgagcactccaagggtgggggaagggtggacgaaggcccacagcccaggagcgtggagccccaggacgcgggtcctctggagcggtcccagggggacgaggcagggggacacggggaggataggcctgagcctctctctcccaaagagagcaagaagcgcaaactggagctgtccagaagggagcaacctcccaccgagcccggaccacagtccgcctctgaggtcgagaaaattgctctgaatctggaaggctgtgccctttctcagggctctctgcgtactgggactcaggaggttgggggacaggacccgggagaggctgttcagccatgtagacagcctctgggcgctagggtcgctgacaaagtgcgaaagcgtcgaaaggtggacgaaggggctggtgattcagccgcagtggcaagcggcggtgctcagacgctggctttagccggttcccccgctccatcgggccacccgaaagctggccacagtgaaaacggggtggaagaagacaccgagggtaggacaggcccaaaggaaggcactcctggatctccatcagagacgcctggaccatctcctgccggtcctgccggtgacgaacctgccgagtcgccgtcagagacgccgggacctcgacccgctgggccagccggtgacgaacctgccgagtcaccatctgagacgccaggcccttcccccgcagggccaaccagagatgagccagccgagtcaccttccgaaacccccggacctaggcctgcgggtcccgcaggggacgaaccagccgaaagccctagtgagactccgggacctaggcccgcagggcctgccggagatgaacccgcagagagcccaagcgagactcctggtcctagcccagccggtcccacccgggatgagccagcgaaagctggagaggccgcagagctgcaggacgctgaggtcgaatcttcagctaaaagtggaaagccctag

SEQ ID NO: 28836 - DNA, 312 bp, Artificial Sequence
  Description of Artificial Sequence: Synthetic coding sequence
atgggacagcaatcaagtgtgagaaggcttaaacgctctgtgccttgcgaatctaatgaggcaaatgaagccaatgaggccaacaagaccatgccggagacaccaactggcgactctgatccgcagcctgctcccaagaaaatgaagactagtgagtcgtccactatcctggtggtgcgctaccggagaaacgtaaaacgtacatctcctgaggaactcgtgaacgaccatgctcgagagaacagaataaaccccgatcaaatggaagaggaggaattcatcgagatcaccaccgagcggccaaagaaatag

SEQ ID NO: 28837 - DNA, 1776 bp, Artificial Sequence
  Description of Artificial Sequence: Synthetic coding sequence
atggaaaaagctgtcaatgatggatcccacagcgaagaactgttctgtcacttgaagaccatcagcgaaaaagaggacttgccccgatgtacatcagagagccatttgagttgcctcaagcaggatatcctgaacgaaaaaacagagttagaggcgacccttaaagaggccgaactcgtcactcatagcgtcgagcttctccttcctttgtttaaggacacgatcgagaagatcaactttgagaacgcaaacctgtcagcgttgaatctgaagatttctgagcagaaagaaatcttaatcaaagagctggacaccttcaaaagtgttaaactggccctcgaacacttactgcgaaagcgagattataagcagacaggcgataacttgtcatccatgctcctagagaaccttacagataacgaaagtgagaacactaatttaaagaaaaaagtctttgagaaggaagcccacattcaagaattgagttgcctttttcaaagcgagaaagccaatacactgaaagctaatcgctttagtcagagcgttaaagtagtccacgagagacttcagatccaaatccacaagagggaagccgaaaacgataaactgaaggagtatgttaagagccttgaaactaagattgcgaagtggaatctacagtcccggatgaacaaaaatgaggcaatagtgatgaaggaggccagtcgccaaaaaaccgtcgccctgaagaaagccagcaaggtgtataaacagcggttggaccattttaccggcgctatagaaaagctgacctctcagatacgagaccaggaagcaaagctgagcgagactataagcgcctccaatgcttggaagtcccattacgaaaagatcgtgattgaaaaaaccgaactggaggttcagatagaaaccatgaaaaagcaaattatcaacctgttggaggatctcaagaagatggaggaccacgggaaaaatagttgcgaggaaatcctacgtaaggtgcattccattgaatacgagaatgagaccctaaacctcgaaaacaccaagctgaagacaaccttagcagctctaaaggacgaggtcgtgtcagtggaaaacgaactgagcgaacttcaggaagttgagaaaaagcagaagaccctgatcgagatgtataagactcaggtccagaagttgcaggaggccgcagagattgttaaaagcaggtgcgagaacttgttgcataaaaacaatcagattaccaagacaaaaaataaaaatgtagagaaagtagacggtaaccacaatctcctgacaaagctatccttggaggaggagaactgcctgattcagctgaagtgcgagaacctgcagcagaaattggagcagatggacgccgaaaacaaagagctggagaaaaagctggctaatcaggaggagtgcctgaaacatagtaaccttaagttcaaggagaaatctgctgaatataccgcactcgcccgtcaactggaagcagctttggaggaggggcgtcaaaaggtggctgaggagatcgaaaagatgtcctcaagggagagcgccctgcagattaaaatattagatctagagaccgaactccgaaagaaaaacgaagagcaaaaccagttggtctgtaagatgaatagcaaggctcaacatcaagaggtttgcctgaaggaagttcagaacagcctggaaaagagcgaaaatcaaaatgagtccataaaaaactacctccaattcctgaaaacaagctacgtgactatgttcgagtag

SEQ ID NO: 28838 - DNA, 1935 bp, Artificial Sequence
  Description of Artificial Sequence: Synthetic coding sequence
atggagaaggcggtcaacgatggcagtcacagcgaggagcttttctgccaccttaagaccattagcgaaaaggaggatttaccaaggtgtaccagtgagtcgcacctaagctgcctgaaacaggatattctcaacgaaaagacagaacttgaggcgacactcaaagaagcagaacttgtaacacactctgtggagctgctgctgcccttatttaaggatacgatcgagaagatcaacttcgagaacgccaacctgtcagccctcaatctcaaaattagtgagcagaaggagatactgatcaaagagctcgatacttttaaatctgtgaaactggccctggaacacttgctgcggaaacgtgactacaagcaaaccggtgataacctatcatcaatgttattggaaaatctgactgataatgagtccgaaaacaccaatttgaagaaaaaggtctttgaaaaggaagcgcatattcaggagctctcttgtctgttccagtctgagaaagcgaacacattgaaggctaaccgatttagccagtccgttaaagtggtgcacgagagacttcagatacagattcacaagagagaagcggaaaacgacaaattgaaggagtacgtgaagtctctagagaccaagatcgccaaatggaatctgcagtctcgtatgaataaaaatgaggctatcgtgatgaaggaggcatcgcggcagaagaccgtggccttaaaaaaagccagtaaggtatataaacagaggctggatcacttcaccggtgcaattgagaagctgacttcccagataagggatcaggaggccaagctcagcgagaccatcagcgctagcaacgcctggaagtctcattacgaaaagattgtaatcgaaaaaaccgagctggaagtgcaaattgagacaatgaaaaagcagattatcaatctgctggaagacctgaagaaaatggaagaccacggcaagaactcctgcgaagagattttacgtaaggtgcatagcattgagtacgagaacgagacactcaatctcgaaaacactaaactgaaaaccacgctggctgccctcaaagatgaagtagtctcagtagaaaacgaactgagcgagcttcaagaggtggagaaaaagcagaaaaccctgattgagatgtataaaacccaggtacaaaagcttcaggaggccgctgagattgttaagtcaaggtgcgaaaatctcctccataagaataaccaaatcactaagactaagaacaaaaacgtcgaaaagatgcgtggacagatggaaagccacctgaaggagctcgagcgtgtgtgcgattcactgaccgcagccgaaagacggttgcacgaatgccaagagagcctgcagtgctgtaaaggcaaatgtgctgatcaagagcacaccattcgcgaactgcagggccaggttgacggaaatcacaacttgctgacaaagttgagtctcgaggaggagaattgcctaattcagctgaagtgtgagaacttgcagcagaaactcgagcaaatggacgctgagaataaggaactagaaaaaaagctagctaatcaggaggaatgcctgaaacactccaacctgaagtttaaagagaagtcagccgagtataccgccttggctcggcaacttgaggctgcgctggaggagggcagacagaaagtggctgaggaaatagagaaaatgtccagtcgcgagtccgccctccagatcaagattctggaccttgagaccgagctgaggaagaagaatgaagagcagaatcagctcgtgtgtaaaatgaactccaaagcccagcaccaagaagtctgcttgaaggaggttcaaaattcattggagaagtcggaaaatcagaacgagtcaatcaagaactatctccagtttcttaaaacatcctatgtcacaatgtttgagtag

SEQ ID NO: 28839 - DNA, 2526 bp, Artificial Sequence
  Description of Artificial Sequence: Synthetic coding sequence
atgatggcagacggagctgcagccggtgcaggtggcagcccttccctgagggaattaagggcaaggatggtggccgcagccaatgagatagccaaggaacgcagaaagcaggacgttgtgaatcgcgtggcaacccactcctccaatattcggtccaccttcaagcctgtgattgatggtagtatgctcaaaaatgacattaaacaacgccttgcaagagaacgcagggaggagaagcggagacaacaggacgcgaataaagagacacagttgcttgaaaaagaaagaaagaccaaactccaatacgaaaaacagatggaagagaggcagcgaaagttgaaggaaagaaaggagaaggaggagcagcggcgaatcgccgcagaagaaaagcggcaccagaaagatgaggcccagaaagagaaatttaccgcaattctgtacagaactctggaacggaggagactggcagacgattaccagcaaaaaagatggagctggggtggctcagcgatggcgaactctgagtccaaaaccgggaagaccgacaaagagaggtcatcatcacttaatagaagagattcaaatttgcactcctcaacagacaaagagcaggccgagcgcaagccgagagttacgggggtcaccaactacgtaatgcagtacgtcacagtgcctctgcggaagtgtacaagtgacgaactgagagccgtgatgtttcctatgtccactatgaagatacctcctcagacgaaagtagaggaaagccctctggagaaggtggagactcctcccaaggccagtgtcgatgcaccaccacaggtgaacgtggaggtcttctgtaacacaagtatggaagcatctcccaaggccggtgttggcatggcaccggaggtgagtactgattcattcccagtggtaagcgttgatgtctctcctgttgtgagtacctacgactcagaaatgtccatggatgcatcaccggaactgtctattgaggctctgcctaaggtggacttggaaacagtacctaaggtttctattgtcgcttcccccgaggccagccttgaagcccctcctgaagtgagccttgaggctttgcctgaggtcagcgtagaggccgctcccgaaggcagtcttgaagctccaccaaagggtagtgccgaggtggctccaaaggagtcagtgaaaggctcccccaaagagagcatggaggcatcccctgaggccatggtgaaggcctcccctaaaacatccctggaagcctctatggaagcaagccccaaggctaaggcccgagatgcccctaaaaagagcgagatggataaacaggccctcatccccattgccaaaaaacggcttagttcctataccgagtgttacaaatggtcatcatcgcccgagaatgcgtgcggcctgccctccccgataagtaccaacaggcagatccagaagaattgcccccctagtcccctgccattgataagcaaacagtccccacagacttcttttccatacaaaatcatgccaattcagcacaccctgtctgtccagagtgcaagctcaacagtgaaaaagaaaaaagaaaccgtcagcaagacaacaaacagatgtgaggccctctctcagcgacacatgatttacgaggaaagcggcaacaagtcaaccgcgggaataatgaacgccgaggcggctacgaagatcctgacggaactccgacggctggcacgggagcaaagggaaaaggaagaagaagagcggcagcgagaggaaatgcagcagcgagtgatcaaaaagagtaaggacatggctaaggaggcagttgggggtcaggcagaggatcacctgaaactcaaagacggtcagcagcagaatgaaaccaagaaaaagaagggatggcttgatcaggaggaccaagaagccccactgcagaagggtgatgctaagatcaaagcacaggaggaggctgataagcgtaagaaagaacacgaacgcataatgcttcagaacctgcaggaacggctggagaggaagaagagaatcgaggagattatgaagaggactcgaaaaacagatgtcaatgcttcgaaggtgacggaaaccagcagccatgatatatatgaggaggctgaggcagataatgaagaatcggataaggacagtctgaacgaaatgttcccatccgccatcttaaacggcacagggagcccaactaagttcaaaatgcctttcaataatgctaagaagatgacccacaagctcgttttccttgaggacgggaccagccaggtacggaaggaacccaagacgtacttcaacggtgacctcaagaactttaggcagaaatcgatgaaggataccagcatccaggaggtggtgagccgcccttcttcaaaacgaatgacgtcacatacaactaaaaccaggaaagcagacgagactaataccacaagtaggtccagcgcccagaccaaatctgagggttttcatgacattttacctaagtccagcgacaccttccgacagtag

SEQ ID NO: 28840 - DNA, 2577 bp, Artificial Sequence
  Description of Artificial Sequence: Synthetic coding sequence
atgacatccccacgggtcgccgctgccaatgagattgcgaaagagcggagaaaacaggacgtagtcaatcgcgtggctacgcacagctctaacattaggtccacatttaagccagttatcgacgggtccatgcttaaaaatgatattaaacagcggctggccagggagcgaagggaggagaaacgacgacagcaggacgccaataaggagactcagttacttgaaaaagaacggaaaactaagctgcaatatgagaagcagatggaggaacgccagcgcaaactcaaagagcgcaaggagaaggaggaacagcgtagaatcgcagcagaggaaaaaaggcatcagaaggatgaagcacagaaggagaagtttaccgctattctgtaccggaccttggagcgcagacggttggcagatgactaccagcagaaacgatggtcttggggtggatccgcaatggctaatagcgagtcaaaaactgccaataaaaggtccgcgtccactgagaagttggaacaggggacctctgcactgatccggcaaatgcccctgtcaagtgccggactgcagaactcagtcgccaagaggaaaaccgacaaggagcgttcttcctcactgaatcggagagactcgaaccttcattcttctaccgataaagagcaggccgagcgtaagccgagagtgacgggtgtaacaaattatgtaatgcagtatgtgacagtgccactgcggaagtgtacaagtgacgaactgcgcgcagtcatgttccccatgagtaccatgaaaattccccctcagactaaggttgaggagtctcccttagaaaaggtcgaaactcctcctaaggcatcggtggatgcaccacctcaagtgaacgtcgaggtgttctgcaatacatcaatggaggccagtccaaaagcaggagtgggcatggcgcctgaggtttccacggactctttccctgttgtcagcgtcgacgtgagtcctgttgttagcacttacgactccgaaatgagcatggacgcgtctcccgaattgagcatcgaggctttgcccaaggtcgacctcgaaacagtgcctaaggtcagcattgtcgcaagtccagaggctagccttgaggcaccaccggaggtgagtctggaggccctaccagaggttagtgtggaagccgcacctgaaggctccctcgaggccccacccaagggttccgccgaagtcgctcccaaggagagcgtaaagggcagccctaaagagagcatggaggcgtctcccgaagcaatggtgaaggcgagcccaaagacaagccttgaagctagcatggaggcgtcacccaaagctaaggccagagatgcgcctaagaagtccgagatggataaacaggccctgatccctatcgccaagaaacgactgagttcctataccgaatgttacaagtggtcgtcgtccccagagaacgcatgcggactcccttcaccaatttccacgaacagacaaatccagaaaaactgtcccccatctccactgcccttgatcagtaagcagagtcctcagaccagctttccctacaagatcatgcctattcagcacacactgtctgtgcaaagcgcaagctctactgtgaagaagaagaaagaaactgttagcaaaaccactaacaggtgcgaggcgttgagccagaggcatatgatttatgaagaatccgggaataagtcgacagccggaatcatgaacgcagaggctgctaccaagatcctgaccgagctgaggcgcttggccagagagcagcgggaaaaagaagaggaggaaaggcaacgtgaggaaatgcagcaacgggtcattaaaaagtctaaggacatggccaaagaggctgttggtgggcaggccgaggatcacctcaagctcaaggacggccaacagcaaaatgagaccaagaaaaagaagggctggctcgaccaggaagatcaggaggcacccctccagaaaggcgacgcgaagatcaaagcacaggaggaagccgacaagagaaagaaggaacacgagcgtattatgctgcagaatctacaggagcgcctggagaggaagaagcgcatagaggagatcatgaagcggacaaggaagaccgacgttaacgcatctaaggtgaccgaaacctccagtcatgatatttacgaggaggccgaggcagacaacgaggaatctgacaaagactcgttgaatgagatgttcccctcagcaattttgaatggcacagggtcccccactaaatttaaaatgcccttcaataacgctaaaaagatgactcacaagcttgtgttcctggaggatggcacatctcaggtgagaaaggagcccaagacctacttcaacggggatcttaaaaattttcgccaaaaatcaatgaaagacacttctattcaggaagtcgtatctcgccctagctccaagagaatgacatctcacaccaccaaaacacgcaaggcggacgaaactaacacaacgtcccgcagttcggctcagacaaagtccgagggatttcatgatatactccccaaatccagcgatacattcagacaatag

SEQ ID NO: 28841 - DNA, 948 bp, Artificial Sequence
  Description of Artificial Sequence: Synthetic coding sequence
atgccgctgaagctccggggtaagaagaaggccaagagcaaagaaacagccggactcgtcgaaggagagcccaccggagcagggggaggctcactttcggcctctcgggctcccgctcgtcgcttggtgttccatgcacagctggcgcatggttcagctacaggcagggtggagggcttttcgtccatccaggaactgtacgcacagattgccggtgcttttgagataagcccctccgaaattttatactgtacgctgaatactccgaaaatagacatggagcggctgttaggcggacagctgggtttggaggattttatattcgcccacgtcaaaggaatcgaaaaggaagtcaatgtgtacaaaagcgaggacagccttggactgactatcacggataacggggtgggatatgcctttataaagcgaataaaggacggcggagtaatagatagcgtgaaaacgatatgtgtcggcgatcatattgagagcatcaacggggaaaatatagtcgggtggagacattacgacgtagccaagaaactgaaagagttaaagaaggaggagcttttcacgatgaagttgattgagccaaaaaaagcattcgagatagaactccggtctaaggccggaaaatcctccggtgaaaaaataggctgtggacgggctacactcagattgcgctcgaaaggccctgctacggtggaggaaatgccttccgagacaaaggcaaaggcaatcgaaaagattgatgacgttctggagctttatatggggatccgcgatatagacctcgcaactacaatgttcgaggcgggtaaggacaaagttaaccccgacgagtttgccgttgccctcgacgaaactctgggcgactttgcttttcctgacgagtttgtcttcgacgtgtggggagtgataggggacgctaaacgcagggggctctag

SEQ ID NO: 28842 - DNA, 2487 bp, Artificial Sequence
  Description of Artificial Sequence: Synthetic coding sequence
atgactggatcaaacagtcatataacgatccttacccttaaggtcctgcctcactttgagtcgcttggcaagcaagagaaaatacccaacaaaatgtctgcattcagaaatcattgtccacacctggactctgttggggaaattactaaggaagaccttattcagaaaagtctagggacatgtcaggattgcaaggtgcagggccctaatctctgggcttgcctggaaaataggtgttcgtacgtgggttgcggagagtcacaggtggaccatagtactattcattctcaggaaactaaacactacctcactgtgaacctgaccactctgagggtgtggtgctatgcctgttctaaagaggtattcttggaccgaaaactgggaacacaacccagtctcccacatgttaggcagccccaccagattcaagagaattctgtacaggacttcaaaatcccaagcaatactactctgaagacccccctggtggctgtctttgacgacctggatatcgaagccgatgaggaagatgaattacgtgccagagggcttaccggattgaagaatattggcaacacctgttacatgaatgcagcactgcaggccctgagtaactgccctcccctcacgcaattttttctcgactgtgggggtcttgcgagaaccgacaagaaaccagccatctgcaaaagctacctgaaactgatgacggagctctggcataaatctaggcctgggagcgtcgtaccgaccaccctgttccagggcattaaaactgtcaaccctacatttagaggatattctcagcaggacgctcaggagttcttacggtgtctcatggacctattacacgaggagctcaaagagcaggtaatggaagttgaggaggatcctcaaactatcactacggaggagacaatggaggaggataagtcacaatctgacgtggatttccaaagttgcgaatcctgctctaactccgatagggccgagaatgagaatgggtcccggtgtttttccgaggacaacaatgaaactacaatgctgattcaggatgacgagaacaattcagagatgagcaaagattggcagaaggaaaagatgtgtaataagattaataaagtgaactctgagggggagtttgataaggaccgcgactcaatctctgagaccgttgacctgaataatcaagagaccgtgaaggtgcagatccactcccgagcttcagagtacattacggatgtacacagcaatgacttatctaccccacagatccttccctccaatgagggagtaaatcctcgcttgagtgcaagcccccctaaaagtggcaacctgtggcccggactcgctccaccacataagaaggcacaaagtgcatcgccgaaaaggaagaagcaacacaagaagtacaggagtgtcatttccgatatctttgacggcacaataatctcgagcgtgcagtgtctaacttgtgacagagttagtgtcacattggagacctttcaggacctgtctctcccaatccctggcaaggaggatcttgcaaagctgcattccagtagtcatcctacaagcattgttaaagcaggcagttgcggagaagcctacgccccacaagggtggatcgcttttttcatggagtacgtcaagtcctggttctggggtccagtggtgacactgcaggactgtctggccgctttctttgcccgagatgaacttaagggagacaatatgtactcgtgcgagaaatgtaagaagttgcgcaatggtgtaaagttttgtaaggtccagaattttccagagattttgtgcatccatcttaaacgttttagacatgaactgatgttctccacaaaaattagtacgcatgtgtcttttcccttggaggggctggaccttcaaccgttcctggctaaagatagcccagctcagatcgtgacctacgatctgttgtcagtaatttgtcatcacggtaccgcatcatccggacactatattgcctactgcaggaacaatttgaacaacttatggtacgaatttgatgatcagtccgtgaccgaagttagtgagtctacagtccagaatgcagaagcgtacgtccttttttacagaaaatcctcagaggaagcacagaaggagaggcgcagaatcagcaacctgctgaatatcatggaaccctccttgctgcagttttatatctctcgacaatggctgaacaaatttaaaacattcgccgagccgggacccatctctaacaacgatttcctctgtatacatggaggagtcccccctcgaaaagctgggtacattgaagatttagtgcttatgctcccccagaatatttgggataatttatattctcgctacggaggaggacctgctgtaaaccacttgtacatttgccacacttgccaaatcgaggctgagaagattgagaagagaagaaagaccgaactcgagatttttatcagagtcaaaaagtag

SEQ ID NO: 28843 - DNA, 2829 bp, Artificial Sequence
  Description of Artificial Sequence: Synthetic coding sequence
atgacgggctcgaatagccacatcacaattctgacgttaaaggttttgccccactttgaatctctcggtaaacaggaaaagatcccgaataaaatgtctgcctttaggaaccattgcccgcaccttgactctgttggcgagattaccaaagaagacttaattcagaagtctctgggcacctgtcaggactgcaaggttcagggccctaacttgtgggcatgtcttgaaaataggtgttcctatgtaggatgcggtgaaagccaggtggaccacagcacgattcactctcaggagaccaaacactacttaacagtgaatctcacaaccctgagagtgtggtgctatgcctgttcgaaggaagtgttcctggatcgcaagcttgggacacagccaagcctcccccacgttagacagccccatcagattcaggagaactctgtgcaagactttaaaatcccatccaataccacactgaagacacctctagtggccgtgtttgacgacctcgatatcgaggccgacgaagaggatgaactccgggcaagaggcctcacagggctgaagaatattgggaatacctgttatatgaatgcagcattacaagctctgtcaaattgcccaccactcacccagtttttcctggactgcggcggtctagctaggactgacaagaaacccgctatttgcaaaagttacctgaaattgatgaccgagttatggcataagagccgaccgggaagcgttgttcccactaccctgttccaaggtattaagaccgttaaccctacattcagggggtattcccaacaggatgcacaggaatttctgcgctgcctcatggacctcctgcacgaggaactgaaggagcaggttatggaagtcgaggaggacccccagaccatcacaactgaggagaccatggaggaggacaaaagtcagtccgatgtggatttccagtcgtgcgagagctgcagcaactctgatcgcgcagaaaatgaaaatggcagcagatgtttctccgaagataataacgagaccactatgttaatacaggatgacgaaaataactcagagatgtccaaggattggcagaaagagaaaatgtgtaacaaaattaacaaagtgaattcagagggcgaatttgacaaagatagggattctatctcagagacagtagacctgaacaaccaggaaactgtaaaggttcaaatccattcacgggcatctgaatacattacagatgtccattccaatgatctctcaacgccgcagatcctgccatccaacgaaggagtgaaccccagactgtcggcttcaccacccaaatccggcaacctctggcccggtctggcccctcctcacaagaaggctcagagcgcttctccaaagcgcaagaagcagcataaaaagtaccggtcggtcatctctgatattttcgacgggaccataatctcatcggtccaatgtctaacttgcgatagagtgtctgtgacactggaaaccttccaggacctaagcctcccaatccccggaaaagaggaccttgccaaattacatagcagctcgcaccccacaagtatcgtgaaggccggttcttgtggtgaagcctacgccccacaaggctggattgctttctttatggagtacgtgaaaaggttcgtggtctcttgcgtacccagttggttctggggccctgtggtaaccctgcaggattgcctcgccgctttcttcgccagggatgaactgaaaggcgataacatgtattcctgtgagaagtgtaagaaactgcggaacggtgtgaaattttgcaaagtacaaaactttccagaaatactttgcattcatcttaaaagattccgccacgagcttatgttttctactaaaatctccactcatgttagtttccctctcgagggcctggacctccagccctttcttgccaaagatagccctgctcagatcgttacttatgacctcttgtcagtaatctgccaccacggtacggcctcatcaggacactacattgcttattgtaggaacaatctcaacaatctttggtatgaattcgatgatcagtctgtgactgaggtgagcgagagcacggtacagaacgcagaggcgtacgtgttattctacaggaagtcatccgaggaagcccagaaagaacggaggagaatctccaatctgctgaacattatggagccaagcttattgcaattctatatatcacgacagtggttgaataaatttaagacctttgcagaacctggccctataagcaataatgactttctgtgcatccacggcggtgtgccccctaggaaggccggatacatcgaggatctggtgctcatgctcccacagaatatttgggacaatttgtacagccggtatggagggggtcccgctgtgaatcatttatacatttgtcacacatgccagatagaggccgagaagatagagaaacgtcgaaaaaccgagctcgaaattttcatcaggctaaaccgcgcttttcaaaaagaggacagcccagccaccttttactgcatctccatgcagtggttccgggaatgggagagctttgtgaaaggaaaggatggtgacccacctgggccaatcgacaacacaaagatcgctgtcacaaaatgcggtaatgtcatgttgcgtcagggagccgattcgggccagatttccgaggaaacatggaacttcctgcagtctatctacggcggtggccctgaagttatcctcagaccaccagttgttcatgtggaccccgacatcctccaagccgaagaaaagatagaggtggaaactaggtccctttag

SEQ ID NO: 28844 - DNA, 2736 bp, Artificial Sequence
  Description of Artificial Sequence: Synthetic coding sequence
atgagcgccttccgaaatcattgtcctcaccttgattcagtcggagagattaccaaagaagacctcatacagaagagcctcggaacatgccaagactgtaaggtccagggccctaatctgtgggcgtgccttgagaatagatgcagctacgtgggctgcggcgagtcccaggtagaccactccacaatccattcccaggagactaaacattacctgacagttaacctgactactctaagagtatggtgctatgcgtgctctaaggaggtgttcttagaccggaagctgggcacccagccttctctgccacacgtgcggcaaccccaccagatccaggagaattccgtgcaggactttaagataccatctaatacgacacttaagacacctctcgttgcagtcttcgacgatctcgatattgaagccgacgaagaagatgaattgagagcccgtggtctgactggtttgaagaacatcggcaatacatgctatatgaacgccgcattgcaggctctgtctaattgcccacccctgactcaattctttctggattgcggaggcctagctaggaccgataaaaagcccgctatctgtaagagttacctcaaactaatgactgagctgtggcacaaaagtcgcccaggttctgtggtgccaaccactttgtttcagggtatcaagaccgtgaatccgacttttcgcggatatagccagcaggatgcgcaggaattcctgcgctgcctgatggatctgctgcatgaggagctcaaagaacaggtgatggaggtggaggaagacccccagacgatcactactgaagagactatggaggaagacaagtctcaaagcgacgtcgattttcagtcttgtgagagctgtagcaatagtgaccgtgcagaaaacgagaatggaagtagatgtttctccgaggacaacaacgagactactatgctcatccaagacgatgaaaacaactcagagatgtcgaaggattggcagaaagagaagatgtgtaacaaaatcaacaaggtgaactctgagggcgaattcgacaaggacagggactccatatctgagaccgtggatctgaacaatcaggagacagtgaaggttcagatccatagccgggctagcgaatatattactgacgttcactcaaacgacctgagcacacctcaaatacttccaagcaacgaaggggtgaaccccagacttagcgcatcaccaccgaagagcggtaacctgtggccgggattggctccccctcataagaaagcccaaagcgcatcacccaaacggaagaaacagcataaaaagtataggagcgtgattagcgatatctttgacggcacaattatcagctccgtgcaatgtctgacctgtgatagggtcagcgttaccctcgagaccttccaggacttatcactccctatccccggtaaggaggatctcgccaagctccacagtagctcccaccctacaagcatagttaaggctggctcatgtggagaggcatacgcaccccagggatggattgcatttttcatggagtacgtgaaaaggtttgtggtgagctgtgtcccatcttggttctggggcccagtggtcaccctgcaggattgcctggccgctttcttcgcccgagatgagttgaagggcgacaatatgtatagctgtgaaaagtgcaaaaagctcagaaatggcgtgaaattttgcaaggttcagaattttcccgagattctctgcatccatctgaagagatttcggcacgaactgatgtttagcaccaaaattagtacccacgtgtcctttccccttgagggtctggatttacagcctttcctggctaaggacagcccggctcaaatcgttacatacgaccttctctctgtcatatgtcaccacggcaccgcaagtagcggccattatatcgcatactgtcggaacaacctcaacaatttatggtacgagttcgatgaccagtcagtgaccgaggtgtcagagtcaacagtgcaaaacgcagaggcctatgtgctgttctaccggaaaagttcagaggaggctcaaaaagaaaggaggcgcatcagcaatctgcttaatatcatggagccaagtttgttgcagttctatataagcagacagtggctcaacaagtttaaaaccttcgcagaaccagggccaattagtaataatgatttcctatgcattcacggtggggtgccacctcggaaggcgggttacatcgaggacctggttttaatgctacctcaaaatatctgggataatttgtactcacgctatggtggtgggccagcagtgaatcacctgtatatctgtcatacctgtcagatcgaagccgagaagattgaaaaaagaagaaaaacagaactagaaatcttcatacgcttaaacagggcattccaaaaggaagatagtcctgcaacattttattgcatctcaatgcagtggttccgcgagtgggaatcattcgtcaagggcaaggacggggatcctccgggacccatcgacaatacaaaaatagctgtgactaaatgcggaaacgtgatgctgcgccaaggcgcagacagtggccagatctccgaggagacctggaatttcttacagtccatctacggcggtggacctgaagtaatcctcagaccaccggtggtccacgtggatcctgacatcttacaagcggaagagaaaattgaggtcgagaccagatcactgtag

SEQ ID NO: 28845 - DNA, 465 bp, Artificial Sequence
  Description of Artificial Sequence: Synthetic coding sequence
atggccccacccgtccgttactgcatccctggtgagagactctgtaacctcgaggaaggttccccaggttcgggaacatacacaagacacggctatatctttagctctctggctgggtgcctcatgaagtcttcggaaaatggcgcattgcctgttgtcagcgtcgtgcgtgagaccgagtcacaactcctgcctgatgtcggggcaattgtgacgtgtaaggtggagatttataagtcctttagaccaggcgatatagtgctcgcaaaggtcatctccctcggggatgcccagtctaattatttgcttaccaccgccgagaacgaattgggagtcgtcgtagcccacagcgaatccggcatccaaatggtgcccatatcatggtgcgaaatgcagtgtcccaagactcacaccaaggaatttcgaaaggtggccagggtgcagccagagtttctacagacttag

SEQ ID NO: 28846 - DNA, 513 bp, Artificial Sequence
  Description of Artificial Sequence: Synthetic coding sequence
atggcccctcctgttcggtattgtatccccggagagaggctttgtaacctcgaggaggggagtccaggctccggtacctatacaagacatgggtacattttttctagcttagcagggtgtttgatgaagtcaagtgagaacggggctgtatcaagcattaacagccgttttgccaaagtgcacattttgtatgttggctccatgcctcttaaaaattcctttagagggactattagaaaggaagacgtgagggcgactgagaaggataaggtcgagatctacaagtcattcagacccggagatatcgtgctggccaaagtgatttccttgggcgatgcccagagcaactatctgctgacaaccgccgaaaacgaacttggcgtggtggtggcccactctgaaagtggtatccagatggttcccatttcttggtgtgagatgcagtgtccaaaaacgcacacaaaggaattccgaaaagtggccagagtccagcctgagtttctgcaaacctag

SEQ ID NO: 28847 - DNA, 537 bp, Artificial Sequence
  Description of Artificial Sequence: Synthetic coding sequence
atggcacctcctgtgagatattgcattccaggcgagaggctgtgtaatctagaggagggaagtcctggtagcggcacatatacgagacatggatacattttttcaagtctcgcaggctgtcttatgaagagcagtgaaaatggagcacttcccgtcgtgagtgtggtacgtgaaacagaaagtcagctgttgcctgacgtgggagccattgtgacatgtaaagtgtcctctattaattcccgctttgctaaggtgcatatcctgtatgtggggtccatgccactgaaaaactcatttagaggcaccatcaggaaggaagatgttagggctacagaaaaggacaaaatctccctgggcgacgcacaatctaattatcttctgacaactgccgaaaatgagctcggcgtggtcgtagcccacagcgaatccggaatccagatggtgcccatcagttggtgcgagatgcagtgccccaaaacccatacaaaagaatttaggaaagtggcacgcgtccaacctgagttcctccagacatag

SEQ ID NO: 28848 - DNA, 2811 bp, Artificial Sequence
  Description of Artificial Sequence: Synthetic coding sequence
atggccgctgctcgggatccacctgaggtgagtctgagggaagctactcagagaaaattacgaagattcagcgagctgcggggtaagctggtcgctcgtggcgaattctgggacattgtggcaattaccgccgctgacgaaaagcaggagttggcttataatcagcagttgtctgaaaagcttaaaaggaaggagctgcctctgggggtacagtaccatgtttttgtggaccccgcaggtgccaagatcgggaatggaggtagcacgttgtgcgctcttcagtgccttgagaaactctatggagacaaatggaatagttttactattctcctgatccactctgacgaatggaagaaaaaggtgtccgagagctatgtaattacaatcgaaaggcttgaagacgacctccagattaaagagaaggaactcaccgagctcagaaacattttcggctccgacgaggcattctccaaggtcaacctaaactatagaacggaaaatggcttgagcctcctgcatctttgctgtatatgtggcggtaagaaatctcacattaggacactcatgctgaaggggcttagaccttctaggctgacacgtaatgggttcaccgcacttcatctggcagtgtacaaggacaacgccgagctgatcacctctctgttacacagcggcgctgacatccagcaggtcgggtacggtggtttaacagctttacatatcgcgaccattgctggccacctcgaggccgcagacgtcttgcttcagcacggagcgaatgttaacattcaggacgcggtattcttcactcccctgcacatcgctgcatactatgggcatgagcaggtgacccgactactgctgaaattcggagcagacgtcaacgtctccggagaggttggggatagacccctacacctagcttcagcaaaggggtttctcaatatcgctaagctgctcatggaagaaggtagtaaggctgacgtgaatgcacaggacaacgaggaccacgtaccactgcatttttgctcccgcttcggccatcacgacatcgtgaaatacttattacaatctgatctggaagtccaacctcacgtggtgaatatttacggagatactccattgcatttggcatgctacaacggcaagttcgaggtcgccaaagagatcatccagatttccggaaccgagtccctcactaaggagaatatcttcagcgagactgcctttcactccgcgtgcacatatggcaagagcatagacctggtgaagttcttgctggatcagaacgttattaatatcaatcatcaggggagggacggacacaccggtttacactctgcatgttaccacggtcacatacgactcgtgcagtttctcctcgacaacggggctgatatgaacctggtggcatgcgatcctagcaggtcctctggggagaaggacgaacaaacatgcctcatgtgggcttacgagaaagggcacgatgccatagtgacattattgaagcattacaaacgacctcaggacgaactcccgtgtaacgaatattcccagcccggaggcgacggcagttatgtgtctgtgccatccccattagggaagatcaagtccatgacaaaagaaaaggctgatatcctcctcctgcgggctggtttaccatctcactttcaccttcagctgagcgaaattgaatttcacgaaattattggttccggctcctttgggaaggtctataaaggtagatgtcgcaataaaatcgtagcaatcaagcgctacagagccaacacttattgctccaagagcgacgtcgatatgttctgccgggaggtgtctatcctctgtcagctaaaccacccctgcgtgatacaattcgtaggagcatgcttgaatgacccgtcacagttcgctatagtgacacagtacatctcgggagggtcactgtttagcttattgcacgagcagaaacgtatactcgatctccagagcaaattgatcatagccgtagatgtggcaaaaggtatggaatacctgcataacctgacacagcctataatacaccgggatctgaattctcacaacatcctcttgtatgaagacggccacgctgtggtcgctgactttggcgagtcacgcttcctgcagagtctcgatgaggataacatgaccaaacagccagggaatctgaggtggatggcacccgaagttttcacccagtgcacgagatacactataaaagccgacgtattctcttacgcactgtgcctgtgggaaatcttgacaggcgagatcccctttgcgcacctgaagcctgccgcagctgctgccgatatggcttaccatcacatccgccctccaatcggctactctatcccaaagcccatttcctcccttcttatcaggggatggaatgcttgcccggaaggacgtcccgagttctcagaggtggttatgaaactggaagaatgcctgtgtaacatcgaactcatgtcaccagctagcagcaactcgagtgggtccctcagtccatcttcttcctccgattgcctcgtgaatagaggtggcccaggaaggtctcacgtggctgctctgagatctcgctttgaattggagtacgccctgaatgcgaggtcgtatgctgccctctcccagtccgctggtcagtactcctcccaggggctgagtttagaagagatgaaacggagcctgcagtacacccctattgacaagtatggctacgtgagcgacccaatgagctcaatgcattttcactcctgcagaaacagttcatcattcgaagatagcagttag

SEQ ID NO: 28849 - DNA, 510 bp, Artificial Sequence
  Description of Artificial Sequence: Synthetic coding sequence
atggcggcagcacgcgacccccctgaggtgtcattgagagaagctactcaaagaaagctccgcagattcagtgaactccggggtaagttggtggccaggggggagttttgggacatcgtcgctattactgcagccgatgagaaacaggaacttgcttacaaccaacagctgagcgaaaaactgaagcgaaaagaactcccattaggggtgcagtatcatgtgttcgtagatcccgctggggctaagataggcaacggaggatccactttgtgcgcactccagtgcctggagaagctttacggtgacaaatggaattctttcacgatcctcctgatccacagcgtaagcttccagatttaccagaacgccctggccaaacatcctgttagcttcaaggcctattggatccaggatgtgctgtggcaccttgctcagctgtggagcattccagactggggactaatgttccagctgggcaagacagccctcctggttgtcttgaccagctag

SEQ ID NO: 28850 - DNA, 1785 bp, Artificial Sequence
  Description of Artificial Sequence: Synthetic coding sequence
atggctgctgctcgcgatccgccagaggtttcactccgggaagcgacccagcgcaaactgcgtcgtttctccgagctgcgcggtaagctagtggctagaggtgagttctgggacatcgtcgccatcaccgctgcagatgaaaagcaagaactcgcctacaaccaacagctgtctgaaaaactgaaacgtaaagaactgcctctgggagtgcagtatcatgtgtttgtggaccctgccggtgccaagatagggaatgggggatcaaccctgtgtgctcttcagtgtctggaaaagctatatggtgacaagtggaatagtttcaccatacttcttatacatagtggcggttatagccaaagactgccaaacgcctccgcccttggaaagatttttacagctcttcctttgggaaaccccatatatcaaatgttagaactcaaactggcaatgtatattgacttcccactcaacatgaatccaggtatcctcgtgacatgtgccgacgacatcgaactgtattctattggcgaatttgaatttatcaggtttgacaagccaggatttaccgctcttgcgcacccctcatccttgactattggtacgacccacggcgtgttcgtactggacccttttgatgacctcaaacaccgggacctggaatatagaagttgccatcgtttcctccacaagccgtctatcgaaaagatgtatcaattcaacgccgtgtgcagacccggaaatttctgccagcaagatttcgccggtggtgatatcgccgatctgaaactggattcagactatgtatacacggactcattattctatatggaccacaagtcagcaaaaatgctgttagccttctacgaaaaaatagggaccttgtcctgtgaaattgatgcttatggggacttcctgcaagccctcggtcccggagccacggtagagtacacgcgcaataccagcaacgtgatcaaggaggagagcgagctggtggaaatgagacagcggatttttcacctcttgaagggaaccagtctgaacgtcgtggttctgaataacagcaaattttatcacatcggcacaacagaggagtacctgttttacttcacatctgacaacagtctgaaatcagagctgggcctgcagtcgatcacattctctatcttccccgatattccagaatgtagcggtaaaacgtcttgtataatccagagcatcttggacagccgctgttcagtggccccaggatcagtggttgagtacagcaggctcgggcctgatgtgagcgtgggcgagaactgcattataagtggatcttatatcttgacaaaagcagccctccctgcccactctttcgtgtgctctttatccctgaagatgaaccgatgcttgaagtacgccaccatggcgtttggagtgcaggacaatctgaaaaagagcgtcaaaaccctgagcgatattaaacttctgcagttcttcggcgtttgtttcctaagctgtcttgacgtgtggaacctcaaggtaacagaggagctgttttctggaaacaagacatgcctcagcctttggactgccaggattttccccgtgtgctcttcactcagcgactccgtgataacttcactgaaaatgttgaacgccgtgaagaataaaagcgccttttcactcaattcctacaagctactttctatagaggaaatgttgatatataaggacgtagaggacatgatcacctacagggaacaaatttttctcgaaatttctctgaaatcctcacttatgtag

SEQ ID NO: 28851 - DNA, 588 bp, Artificial Sequence
  Description of Artificial Sequence: Synthetic coding sequence
atggcgcctcctgtgcggtattgtatccctggggagagactgtgcaacttagaggaaggttcacctggtagcgggacttacacacgccacggctatattttttcctcacttgccggatgcctcatgaaatcttccgagaatggggctctgcccgtggttagcgttgtgagggagactgaaagccagctccttccagatgttggcgcaattgtgacctgtaaagtctcttcgattaacagcagatttgctaaggtccacattctttatgtaggaagtatgccactcaagaactcctttagggggacaattcgaaaggaagatgtacgagcaacagagaaagacaaggtggagatctacaagagttttagacctggggacatcgttctcgcaaaagtgattagcctgggagacgctcagtccaactacctcctgacaacagcggagaatgaactgggcgtggtcgttgcccactcggagagtggaattcagatggtgccaataagctggtgcgaaatgcaatgcccgaagacacacaccaaagagtttcggaaggtagccagggtacagcccgagtttctccaaacatag

SEQ ID NO: 28852 - DNA, 1626 bp, Artificial Sequence
  Description of Artificial Sequence: Synthetic coding sequence
atgaccggcgagaagatccgctctctgaggagggatcataagcccagtaaggaagagggggatcttctcgaacctggggacgaggaggctgctgctgcccttggaggaacattcaccagatctagaatagggaagggaggaaaagcttgccacaaaattttttcaaatcatcaccatcggcttcagctgaaggccgcaccggctagcagcaatccccctggtgctcctgccctacccttacataacagttcagtaaccgcgaattcacagtctccggctctgctggccggtaccaatcctgttgctgtggtggctgatggcggttcttgtcccgctcattacccagtccatgaatgtgtctttaagggcgatgtgagacgcctgagttcccttatccggacgcataacatcggccaaaaggataatcatggaaatactccacttcatctggcagtgatgctgggtaataaggagtgtgcccacctactactggctcataacgccccagttaaggttaagaatgcccagggctggtcaccgttagctgaagcaatcagctacggggacagacagatgatcacagccttactacgcaaactcaagcagcagtcaagggaatctgtggaggagaaacgcccaaggctccttaaggcgctcaaggagctgggcgacttctatttggaattgcattgggactttcagtcgtgggtgcccctgctgtcacggatattgccttcagacgcctgcaagatctataagcaaggcattaatatccggcttgacacaactctgatcgacttcactgacatgaagtgccagcgaggcgatttgagttttatcttcaacggagatgcagccccaagtgagtcattcgttgtcctggacaatgagcagaaggtgtaccagaggattcaccacgaggaatctgagatggagactgaagaggaggtcgatatcctcatgtccagcgatatctacagtgctaccctttccacaaagtcgataagcttcacccgcgcacaaactggctggttatttagagaggacaaaactgaacgcgtgggcaactttcttgcggatttctatcttgtgaacggcctagttctggagagtcgcaagagaagggagcacctttccgaggaagatatccttaggaacaaggcaattatggagtctctttcaaaagggggaaacattatggagcagaatttcgagccaataagacgtcagtccctcacacccccaccgcagaataccattacctgggaggaatacatctccgccgaaaacggaaaggcccctcacctggggagagaacttgtgtgcaaggagagcaagaagacgtttaaagccaccattgcaatgagccaagagttccctctggggattgaattgctgctgaacgttcttgaggtagttgcccctttcaagcactttaataagctgagggaattcgttcaaatgaagcttcctcctggctttccagtgaagctggatatccccgttttccccacgattaccgcgacagttacctttcaggaattccggtacgatgaattcgatggctccatattcacaatcccggacgactacaaggaagatccttctaggttcccggatctgtag

SEQ ID NO: 28853 - DNA, 840 bp, Artificial Sequence
  Description of Artificial Sequence: Synthetic coding sequence
atgccatgcaggcgggaagaggaggaggaggctggggaagaagctgaaggcgaagaagaggaggaggactctttcttactgttgcagcagagcgtggccctcggaagcagcggcgaagttgataggctggttgctcagatcggggaaaccttacaactggacgccgctcagcattcaccggcttccccctgcggacctcctggagctccactgagagccccaggcccacttgcagccgctgtgcccgcagataaagccaggtcccccgctgtgcccttgctgttgcccccagccctggctgagacggtgggcccagcccctcctggcgtcctccgatgcgcactaggggatcgaggtagggtgcgcggaagggccgcaccctactgcgttgccgaactcgccacagggccttcagcactcagtcccctgccaccccaggctgatttggacgggcctcccggagcgggaaaacaaggtataccacaaccattgagcggaccatgccgccgtggctggctaagaggtgctgccgcttcaaggcgcttgcagcaaaggcgtggctcacaacccgagacccgcaccggcgacgatgatcctcacagactgcttcagcagctcgtgctgagtggaaatcttatcaaggaagccgtgaggcggcttcactcacgacgcctccagcttagggctaaattgccccagagacccctgcttggacccctgtctgctcccgttcacgagccgccatcgcctagatcaccccgtgccgcttgctcagatcccggagcatccggcagagcacagctgcgcacaggtgacggcgtcctggtgcccggttcttag

SEQ ID NO: 28854 - DNA, 1209 bp, Artificial Sequence
  Description of Artificial Sequence: Synthetic coding sequence
atgcctctccacagttccctcggtaataagtctgagactctttctcagaagaaaaataacaataacaaagaaaagaccaaaagaaacagcagaaaccccccacgcacggccctgaaggaaggcaaaatggaagaactgagtcaggccctagccagctcgttttctgttagccaagacttaaattctaccgccgctccccacccccgattatctcaatataagtctaagtattcttccctagaacagtcagaaaggagacgcaggctgctcgagctgcagaagagcaaacggctggactatgtgaatcacgcacgaaggttagccgaagacgactggacaggtatggaaagcgaggaggagaacaagaaggatgacgaagagatggatattgacaccgtgaagaaactgcccaagcattacgccaaccagttgatgctttccgaatggttgatagacgtcccatctgaccttggccaagaatggattgtggttgtgtgccctgtcggaaagcgcgctctgatcgtggcctcacgcggatccacttcggcgtacacaaagagcggctactgtgtgaaccggttcagttccctgctccctggcggaaataggcgcaactccaccgcgaaggattacaccattctcgattgcatttataacgaagtaaatcagacctattacgtgctcgacgtgatgtgttggaggggccaccccttttacgattgtcagaccgatttccgcttctactggatgcatagcaagctgccagaggaggaggggctgggggaaaagaccaaactaaaccccttcaagttcgtcggcttaaaaaacttcccttgcactcctgagagtctttgtgacgtgctcagtatggattttcccttcgaggtcgacggattgttgttttaccataaacagacacattattcacccggtagtactccattagttggttggctccgcccatatatggtatctgacgtcctgggggttgccgtacctgcgggacctttgacgacaaaacccgattacgccggtcatcagttgcagcaaatcatggagcataaaaagtcacagaaggaggggatgaaggaaaaactcacgcacaaagccagcgagaacggccattatgaactggagcacctttctacgccgaaactgaaggggagtagccactcacctgatcacccaggatgtttgatggagaactag

SEQ ID NO: 28855 - DNA, 1107 bp, Artificial Sequence
  Description of Artificial Sequence: Synthetic coding sequence
atgtctctgttcgggaccacgagtggatttggtacctccggaacctctatgtttgggagcgccaccaccgataatcataatccaatgaaggatatagaagtgacctccagtcctgacgacagcatcggctgcctcagctttagtccccctaccctgccgggaaatttcctaatcgccggaagctgggcgaacgacgtcagatgttgggaggtacaggacagcggccagacaattcctaaggcccagcaaatgcataccggacctgtgctggacgtctgctggtccgacgatggctccaaggtgttcactgcatcctgcgataagaccgcaaaaatgtgggatctcagctccaatcaggccatccagattgctcagcatgatgcacctgtgaaaactatacactggatcaaagcacctaactatagttgtgttatgaccgggagctgggataaaaccctgaaattctgggatactaggagctccaatccgatgatggttctgcagctgccagagaggtgctactgcgctgacgtgatttatcccatggccgtagtcgccactgctgaaaggggactcatcgtttaccagctggagaatcaaccgtccgaattccggaggatagagagcccactgaaacaccagcatcgatgcgtggccatcttcaaagataagcagaataaacctaccggcttcgctctgggtagtattgaaggacgagtggccatacactacatcaatccacctaatcctgccaaagacaactttacatttaagtgccaccgatccaatgggactaacactagcgctccacaggatatctacgccgtaaacgggatcgccttccaccccgtgcacggcacgttagctacagtcggctccgatgggaggttctccttttgggacaaggatgctcgaacaaagctgaagacgtctgaacagctggaccagcccatttccgcttgctgctttaatcataatggcaacatcttcgcttacgcctccagttacgattggtcaaaggggcacgagttttacaacccccaaaagaagaactacatctttttgcggaacgcagcggaagaactgaagccccgaaacaaaaaatag

SEQ ID NO: 28856 - DNA, 552 bp, Artificial Sequence
  Description of Artificial Sequence: Synthetic coding sequence
atgcgcaaaagtagttgtgttgagtctttcgatgatcagcgcagaatgtccttacacctacacggtgccgactgcgatcccaaaacccagaacgaaatgaatatctgtgaggaggaattcgtggaatacaagaacagggatgcgatcagcgctctcatgcctctgtttagcgaggaggagtcttcagacggatccaagcataacaatggcctgccagatcatatatctgcacagctccagaatacttacaccctcaaggctttcaccgtcggcagcaagtgcgtcgtgtggagctctctcagaaacacctggtctaagtgtgaaatcttagaaactgccgaagaggggacccgcgtgttaaacctctccaatggcatggaagaaatcgtgaatcccgaaaacgtgtggaatggaattcctaaattagataagagtccacccgaagccgtctctcagagggtggggaaggatttatactttatgtctgttggcgacacaactatcaaggagaaagggttcggaggcgatggggatctgactgttgacctatag

SEQ ID NO: 28857 - DNA, 1821 bp, Artificial Sequence
  Description of Artificial Sequence: Synthetic coding sequence
atgccctcacctcagctattagtcctctttggctcccagaccggcaccgcccaggacgtgagcgaacgcttgggccgagaagcccgtaggcggagattgggatgtagggtccaagccctcgattcgtatcctgtggtgaatctgattaacgagcccctggtcatattcgtgtgtgccactaccggccagggagatccgccagataatatgaagaatttttggaggtttatctttcggaaaaatctgcctagcactgctctgtgtcagatggactttgctgtactggggctgggtgacagctcttacgcaaagtttaacttcgtcgccaagaaactccatcgtcggcttttgcagctcggagggagcgctctgctgcctgtatgcctgggcgacgatcagcacgagcttggtcccgacgctgccgttgacccatggctcagagatctgtgggatcgagtcctgggcctttatcctcctccacctgggctcaccgagatcccaccaggcgtgccactcccttccaagtttacactgcttttcctgcaagaagcaccttccaccggttccgaaggtcagcgcgtggcccatcctggtagtcaagaacccccatccgaatcaaagccttttctagcgcctatgattagtaatcagagagtgaccggaccatcacacttccaggatgttaggctaattgagttcgacatcttggggagcggcatcagttttgctgcaggcgacgtcgtcctgatccagccatctaacagcgcagcacacgtccaacggttttgccaggtgcttggcctggacccagatcaacttttcatgctgcagcccagggagcccgacgtgagctctccgactcgcctgccccagccttgctccatgcgccatctggtgagtcattatctggacatcgccagcgttcccaggcggtcattcttcgagctcctcgcatgtctcagtctccacgagctcgagcgcgaaaagctgttagaattctcctctgcacagggccaggaggaattgttcgagtattgtaatcgaccaagaaggactattctggaggttctgtgcgattttcctcacaccgccgcagctatacccccagactatctgttggacctgatcccagtgattcgccctagggcatttagcattgctagcagtctgctgacccaccccagccgcctgcagatcctggtcgccgtagtccagttccagacgcgcctcaaagagcctcgccgtggtttgtgctccagctggctggctagtttggacccgggtcaggggcctgttcgagtgcctctctgggttagacctggcagcttggcctttcccgaaactccagatacgccagtgataatggtgggtcccggaacgggggtggccccttttcgcgcagccatccaagagagagtcgcccagggtcagacagggaacttccttttcttcggatgcagatggcgggaccaggatttctactgggaagccgagtggcaggagctagaaaaacgggactgcctaacactcattccagctttctctcgcgaacagcctcctgccttgttcagcgcgctccaggagcagaaggtctacgtccagcataggctgcgcgaacttggatctctggtgtgggaactgctggatagacaaggtgcttatttttacctcgcgggaaatgccaaaagtatgcctgcagatgtttccgaggcacttatgtcaatctttcaggaggaaggaggtctgtgctcccctgacgccgcagcttacctggctcgattgcagcagacacggcgattccagaccgagacctgggcatag

SEQ ID NO: 28858 - DNA, 420 bp, Artificial Sequence
  Description of Artificial Sequence: Synthetic coding sequence
atggcagaatccgactgggataccgtaaccgtgttgcggaagaaagggcctaccgccgctcaggcaaaatcgaaacaggcaattctcgcagctcagcggcgtggggaggacgtggaaactagcaaaaagtgggctgccggacaaaataaacagcactccattaccaaaaatacagctaaactggatcgtgagactgaagaattgcaccacgatcgggtgaccctcgaagtgggcaaagtgattcagcaggggaggcaaagtaaagggttgacgcaaaaggatctcgcaacaaagatcaatgaaaaaccccaggtgatcgctgattatgagtctggccgtgctataccaaataaccaggtgctcggcaagatagagagggctatcggcgaatgtccctctacacttcgacgtgtgaggtag

SEQ ID NO: 28859 - DNA, 426 bp, Artificial Sequence
  Description of Artificial Sequence: Synthetic coding sequence
atggccgagtctgactgggacaccgtcactgtcctgaggaagaaggggcctacggctgcccaggctaagagcaaacaggccatcctagctgcccagcgaagaggggaggacgtggagacgagcaaaaagtgggcggctggccagaataaacagcattctattacgaagaacacggcgaaactcgacagggagacagaggagctgcaccacgatagggtcaccctggaagttggaaaagtgatccagcaagggcgacagagtaagggcctgacccagaaggacctggctacaaaaataaacgaaaaaccccaggtcattgcagattacgagtcaggacgcgctattccgaataaccaggtgctcggcaagatcgagcgcgcaattgacgttggcactcggagcgcccgagtgctccgggcacagtag

SEQ ID NO: 28860 - DNA, 150 bp, Artificial Sequence
  Description of Artificial Sequence: Synthetic coding sequence
atggcgacccaacgcaagcacctcgtaaaagatttcaatccctatatcacttgttatatttgcaagggatatttgatcaagcccacaaccgttaccgaatgtctccatacaagcgctgaatcgtattggatgagtacctggatgtcttag

SEQ ID NO: 28861 - DNA, 960 bp, Artificial Sequence
  Description of Artificial Sequence: Synthetic coding sequence
atgatggtgctgaaggttgaggaattagttacagggaagaagaacggaaatggcgaagccggagaattcctccccgaggacttccgtgatggggaatatgaggcagctgttactctggaaaagcaggaggaccttaagaccctgctggcccacccagtgacacttggagaacaacaatggaagagtgagaaacaaagagaagccgaactgaaaaaaaagaagttggaacaaaggagcaagttggaaaatctcgaagacctggagatcatcatacagctgaaaaagaggaagaagtatagaaagactaaggtccctgtggttaaagagcctgagccagaaatcattactgaacccgtggacgtccctaccttcctgaaagcggcactagagaataagctaccagtcgttgaaaagttcctgtccgacaaaaacaatcccgatgtttgtgacgaatacaaacggacagccctccaccgagcatgcctcgaggggcacctggcaatcgtggaaaagcttatggaagctggagcacagattgagttcagagatatgctggagtccactgccattcactgggcatcacggggagggaacctggacgtgctaaaacttttgctaaacaaaggcgctaaaatatcagccagagataagctactctctacagccctgcatgtggccgtgcgaacaggtcactacgaatgcgcagagcacttaatcgcctgtgaggcagatcttaatgccaaagatagagagggggatacaccactgcacgacgctgtcaggctgaatcgctataagatgatacggctgttgatcatgtacggagcagacttgaacatcaagaattgcgcaggcaagaccccaatggacctcgtactgcattggcagaatggaactaaagctatctttgactctctgagggaaaactcatacaaaacttcgcgaatcgccaccttttag

SEQ ID NO: 28862 - DNA, 1089 bp, Artificial Sequence
  Description of Artificial Sequence: Synthetic coding sequence
atgtcaggctatcaacgacggccaggtgcgacccctctttctagagctaggtcacttgccatcccagacgatgataggttcgaggatctagaagaggccaacccattttcctttcgtgaattcttgaaaactaagaatcttggtctgtccaaagaagatccggcaagccgcatctacgcaaaagaagcctcgcgacattcattggggctcgaccataactcccccccttctcagacaggcggatacggccttgagtaccagcagcccttcttcgaggatcctacaggagcaggcgatttgctcgacgaagaggaggacgaggacaccgggtggtctggggcttacctcccttccgccatcgaacagacccaccctgaaagagttcccgctggtaccagtccctgttcaacatatttgtcttttttctccacaccctctgagcttgctggccctgaaagccttccttcgtgggccctgagcgatactgactcacgtgtttcacctgcctcccccgcaggctccccatccgctgatttcgcagtgcacggcgagtccctcggtgatcgacacctcaggacactgcagatttcctacgatgccttgaaggacgaaaattccaaactccgcagaaaactgaatgaagttcagtcgttctctgaagcacagaccgagatggtcagaaccttagagcgcaagctggaagccaagatgatcaaggaggaaagcgactaccacgacctcgaatccgtggtccagcaagttgagcaaaatctggagctgatgactaagcgcgcagtgaaggcggaaaaccacgtggttaagttgaagcaggagatttccttgctgcaggcccaggtttccaatttccagcgcgagaatgaggcattgcggtgcggacagggggctagtcttaccgtcgtgaagcaaaacgcagacgtggcattgcagaatttgagagtcgtgatgaacagcgcccaggcctctattaagcagctggtgtccggggcagagacactgaacctggtagccgagatcctgaagtccatagaccgcatctctgaagtgaaggacgaagaagaggacagctag

SEQ ID NO: 28863 - DNA, 5462 bp, Artificial Sequence
  Description of Artificial Sequence: Synthetic coding sequence
atggagtccaattttaatcaggagggcgtgcccaggccctcctacgtattctccgccgatcccatcgccaggccaagcgagatcaacttcgacgggataaaattggacctctcccatgaattctcgttggtggctcccaacacggaggccaactccttcgaatctaaggattacttgcaggtgtgcctgcggatcagacctttcactcaatcagaaaaggagctcgaaagtgaagggtgtgtacacatcttggattcgcagacagtcgtgctgaaagaaccacagtgtatactgggccgactatcggaaaaatcatctggacagatggctcaaaaattctcatttagcaaggtcttcggccctgccaccactcagaaggaattttttcaggggtgcattatgcagcctgtcaaagacttgctgaagggtcagtccagactaatcttcacctacgggctgacaaatagtggtaagacctacacctttcagggaacggaagagaatattgggatcctaccacgcaccctgaacgtcctgtttgactcgctgcaggaacgactgtacaccaagatgaacctgaagccgcacagatctcgggagtatttgcggttatcctcagagcaggaaaaggaagaaatcgccagcaagagcgcccttctgagacagatcaaggaggtaactgtgcataacgacagtgatgacacactatacggcagcttaacaaactccctgaacatttccgaatttgaagagtcgattaaggactacgagcaggcaaaccttaacatggcaaacagcatcaaattcagcgtatgggtctcgtttttcgagatttacaatgagtacatctacgatctgttcgtcccagtgagtagtaagttccaaaaaagaaagatgctccggctgagccaagacgttaaagggtacagcttcatcaaggacctgcagtggattcaggtgtccgactcaaaagaggcctatcggctgctcaagctggggatcaaacaccagagcgtggctttcaccaagctgaacaatgcctccagcaggagccactccatctttactgtgaagattcttcagatcgaggacagcgaaatgtcgagggtgatccgtgtgtccgagctgagcctatgcgacttggccggaagcgaaaggaccatgaagacgcagaacgagggggagaggcttcgtgagactggcaacattaatacatcactgcttactcttgggaagtgcatcaatgttctaaagaattcagagaagtctaagtttcagcaacacgtaccttttagagagtcgaagcttactcactattttcaatcgttcttcaacgggaaaggaaagatttgcatgatcgttaacatttctcagtgttacctggcttatgatgagacgctgaacgtgttgaaattttccgcaatcgctcagaaggtctgcgtccctgacactctgaattcatcgcaagagaagctctttggtcctgtaaaatcctcccaggacgtcagtctggacagcaacagcaactcaaaaatcctaaatgtgaagagggccaccatatcttgggagaacagtctcgaagacttaatggaggacgaggatttagtggaagagctggagaatgctgaggagacccaaaatgtggaaactaaacttctggatgaggatttagataagacactggaagagaacaaggcttttatttcccatgaggaaaaacgaaagctcctggatctgattgaggacctcaagaaaaaactgataaatgaaaaaaaagaaaaactgactctggagtttaagatccgtgaggaggtgacccaggagttcactcagtattgggctcagagagaggccgactttaaagagaccttacttcaggaacgcgagatcctcgaggagaacgcggagaggaggttggcgatattcaaagacctggtgggcaaatgtgacacgagggaagaagccgctaaagatatctgcgcgaccaaggtggaaaccgaggagacacataattacgtaggttttgaagatataatcgactcactacaggataacgtggctgacatcaaaaaacaggcagagatcgcgcacttatatatcgcatcactgcccgacccacaggaggcgaccgcctgcctggagttaaaatttaaccagattaaggcagaattggctaaaaccaagggtgagctgattaaaactaaagaggagctgaagaagcgagagaacgaatcagatagtctgatccaggaactcgaaactagtaacaagaaaattataacgcagaaccaaaggatcaaggagttgataaacattatcgatcagaaggaagataccatcaatgagttccagaacctgaaatcacacatggagaatacctttaagtgcaatgacaaagccgacacctcctccctaattatcaacaacaagctcatttgtaatgagactgtggaggtcccaaaagatagcaaatcaaaaatttgctctgagcgcaagcgcgttaatgaaaatgagttgcagcaggacgagccgcctgccaaaaagggctccatacacgtgagttctgcgattaccgaggatcagaagaaatcagaagaagtgcggcctaatatcgccgagatcgaagatataagggtactgcaagagaacaacgaggggttgagagcatttttattaacaatcgaaaacgagttgaaaaatgagaaagaagagaaagcagaactgaacaagcagatcgttcattttcaacaagagttgtctctgagcgagaaaaagaatttgaccttgagcaaggaggtgcagcaaatccagtcgaattacgatattgccatcgctgagctgcatgtacagaagtctaaaaatcaggaacaagaggaaaagatcatgaaactcagtaatgagatcgagaccgcaacacgcagcatcaccaacaacgtgtcacagatcaagcttatgcacacaaaaatcgacgagctcagaaccctggactcagtgtcacaaatcagcaacatcgatttacttaatctacgagacctgtctaacggatctgaggaagataacctacccaatacccagttggatctccttgggaatgactatctggtgtctaaacaggtgaaagagtaccggattcaagagcccaatcgagagaactcctttcattcttccatcgaagcaatttgggaagagtgcaaggagatcgtcaaagcctctagtaagaaaagccatcagattgaggaactcgagcaacagatcgagaagctccaggcggaagtcaagggttataaagacgagaacaatagacttaaagagaaggaacacaagaaccaggacgatctgctgaaggagaaagagaccctgattcagcagctcaaagaggagttgcaggaaaaaaacgtaaccttggatgtacaaatccaacatgttgtggaggggaagagagcactcagcgagttaacacagggggtaacgtgctacaaggctaagataaaagaactcgagaccattctggaaacccagaaagttgaatgctcccactccgctaaactggagcaggacattcttgagaaagaatctatcatcctgaagctggagcgcaatctaaaggagtttcaggaacatctgcaggattctgtcaaaaacacgaaggacctgaacgtgaaagagctgaagctgaaggaggaaataacgcagctaaccaacaacctccaggacatgaaacatttgctccagctgaaagaggaggaagaagaaaccaatagacaggaaaccgagaagctcaaagaagaattgtctgcgtctagcgcccgaacccaaaacctgaaggcggatctccaacgaaaggaagaggattacgctgacctgaaagagaagctcacagatgctaagaagcaaattaaacaagttcagaaggaagtgagtgtgatgcgggatgaagacaagctactccgaattaagattaatgagctggaaaaaaaaaagaatcagtgctcgcaggagctggatatgaagcaaaggaccattcagcaactgaaggagcagctgaataatcagaaagttgaagaggctatccagcagtacgaaagggcatgtaaagacctgaatgtgaaagagaaaatcattgaggacatgagaatgaccctcgaggagcaggaacagactcaggtggaacaggaccaggtacttgaggccaagctggaggaggttgaacgcctcgctacagagctggaaaaatggaaggagaagtgcaacgacctcgagaccaaaaacaatcaaaggtcaaacaaggaacacgagaacaataccgatgtgctgggcaaactaaccaacctgcaggatgaactccaagagagtgaacagaaatacaacgcagatagaaaaaagtggcttgaggagaagatgatgcttatcacgcaggcgaaggaagctgagaacatccggaacaaagaaatgaagaagtacgcagaggatcgtgaacggttctttaagcaacagaacgaaatggagatcctgactgcacagctgacagaaaaggacagcgacctgcagaagtggcgcgaggagcgcgatcagctggtggccgcactggagattcagcttaaggcgctgatcagctccaatgttcagaaggataatgagatagagcagctcaagcgtattatctcagaaacaagtaaaattgaaacgcagattatggacatcaagccgaagagaatttcaagtgccgatcctgacaagctgcagacagagcctctgagcacctcatttgagatttcacgcaataagatagaagacggcagtgtggtgctggactcctgtgaggtctctactgaaaacgatcaaagtacccgcttccctaagcctgaactggagatccagttcacacccctgcagcctaataaaatggccgtcaaacatcctggctgcactacgcctgtgactgtgaagatcccaaaagctaggaaacggaagtcaaacgaaatggaggaagatttggtcaaatgtgagaacaagaagaatgccactcccagaactaatttaaaatttccaatctcagatgacagaaattcgtctgtgaaaaaagagcagaaggtcgctattcgcccatcctccaaaaagacttactcactgaggtcccaggcgagtattatcggcgttaatctggccaccaagaagaaagagggaactcttcagaaattcggagattttctgcagcatagccccagcatcctgcagagcaaggccaaaaagattattgagactatgtcttcctccaaactctcaaacgtggaagccagtaaagaaaacgtttctcagcccaagagagcgaaacggaaactatacacatccgaaatcagcagccccattgacatcagcgggcaggtcattctgatggaccagaagatgaaggagtccgaccaccagataatcaaaagacgtctgcgaacaaagacagccaagta

SEQ ID NO: 28864 - DNA, 1485 bp, Artificial Sequence
  Description of Artificial Sequence: Synthetic coding sequence
atgaagctaggtaagaagcccatgtataagccggttgacccatattccaggatgcagtccacctacaattataacatgcggggaggcgcttaccctccacggtacttttatcccttcccggtgccgccactgttgtaccaggtcgagctgtctgttggcggtcagcagttcaatggtaaaggcaaaacaagacaagccgctaagcacgacgccgctgcaaaggccctacgaattctacagaacgaacccctgcccgaaaggttagaggtcaatgggagggagtcagaggaagaaaatctcaataagtcagaaatttcacaggtttttgaaatcgccctaaagaggaacctgcctgtgaacttcgaggtggccagggagtccggcccacctcatatgaaaaatttcgtgactaaggtatcagtgggtgaatttgttggtgagggcgagggcaagtccaaaaaaatttcaaagaaaaatgcggcaatcgcagtgttagaggagctcaagaaactgccccctctccctgccgtggaaagagtgaagcctcgtattaagaagaagactaagcctattgtcaagactagcccagagtatgggcaagggattaaccctatttcacgcctcgcccagatacagcaagcaaaaaaagaaaaagaaccagagtacacactgctaactgaacgcggactcccccgtcgtcgggaatttgtgatgcaggtgaaggtcggcaaccatacagctgaggggaccggaaccaacaagaaggtggccaaacgtaatgctgccgagaacatgttggagatcctagggttcaaggtgccccaggcacagcctactaaacctgctctcaagtctgaggagaagacacccattaagaaacccggagacggacgtaaagtgacgtttttcgagccgggtagcggtgacgagaatgggacttccaacaaagaagacgaattccgaatgccttacttatcgcatcagcagcttccagccggaattctcccaatggttccagaggtcgctcaggctgtcggtgtatcccagggccaccacaccaaagacttcactagggctgcacccaacccagctaaggcaacagtgacagcgatgatcgcacgggagctgctgtacggcggaaccagcccgaccgccgagactatcttgaagaataatatttcttcgggccacgttccccatgggccactgactcgccctagtgagcaactggactacctcagccgtgtgcaaggattccaagtcgaatacaaggactttcctaaaaataacaagaatgagtttgtatccctgattaactgcagtagccagccgccactgatctctcatggaatcggaaaagacgtggagagctgccacgacatggcagcgttgaatatcttaaagcttctgagcgaactcgaccagcagtccaccgagatgcctcgcaccgggaacggcccaatgtccgtgtgtgggagatgctag

SEQ ID NO: 28865 - DNA, 1509 bp, Artificial Sequence
  Description of Artificial Sequence: Synthetic coding sequence
atgaagctgggtaaaaagcccatgtataaacccgttgacccttactccaggatgcaaagtacctacaattataacatgcgaggaggcgcatatcctcctcggtacttctacccattccccgtgccgcctctgctgtatcaagttgagctgtccgttggcggacaacagtttaatggcaaaggaaagactcggcaagccgctaaacacgacgcggctgcaaaggccctccgaatccttcagaacgagcccttacctgagagattagaggtgaacggaagggagagcgaggaagaaaacctgaacaaaagcgagatctcgcaggtgttcgagattgctctgaaacgtaacctgcctgtcaactttgagagcttcccacttaagcaggtggctagagagagcggacctccacatatgaagaacttcgtcaccaaggtctcagtgggagaattcgtgggggaaggcgaaggaaaaagcaagaaaatcagcaaaaaaaacgcagccattgcagtgcttgaggagttaaaaaaactgccgcctctgcccgcagtcgaaagagtgaagcccaggatcaagaaaaaaaccaagcccatcgtcaaaccccagacaagccctgagtacggccaggggattaacccgatcagtcggcttgcccaaattcaacaggcaaagaaggagaaggagccggaatacactctgctgacagaacgcggactgccacgtagaagggagttcgtcatgcaggtaaaggtgggaaaccacacagccgaaggcaccggaaccaataagaaagtggcaaaacggaatgccgcagagaatatgttagaaattctgggctttaaagtcccccaagctcaacccaccaagcctgccttaaagtctgaggagaagacacctatcaaaaagcccggagatggtcgaaaagttaccttcttcgaaccaggctccggagacgagaacggcaccagcaacaaagaggacgagttccgcatgccttacttgagccatcagcagcttccagctggcatcttgccaatggtgcctgaggttgcccaggccgtgggagtgtctcagggacatcacacaaaagactttacccgggctgctccaaaccctgcgaaggccaccgtcactgctatgatcgctagagaacttctatacggtggaacgtcccccaccgccgagacgatcttaaaaaacaacatctccagtggccacgtgccccacggccctctgactagacccagtgagcaactggattacttatcccgcgtgcagggttttcaggtggaatataaagactttcctaagaataataaaaacgagttcgtgagcctgataaattgttcctcccaacccccacttatttctcacgggattggcaaggacgttgaaagttgccatgacatggcagccttgaacatccttaagttgctgtccgagttagatcaacaaagcaccgagatgccgaggaccggaaatgggcctatgtccgtatgcgggcgatgctag

SEQ ID NO: 28866 - DNA, 1491 bp, Artificial Sequence
  Description of Artificial Sequence: Synthetic coding sequence
atgaaactggggaaaaagccaatgtacaagccggtggatccatactcacgtatgcagtctacttataattacaatatgcggggaggggcttatcctccacggtacttttacccttttccggtacctccgttactgtaccaggtggagctgtcagttggaggacagcagttcaatggcaagggaaagactcgccaagctgctaagcatgacgcagcggctaaagcactgagaatcctgcagaacgaaccgctgccagagagactggaggtcaatggcagggaatccgaggaggaaaatcttaacaaaagtgaaatctctcaggtattcgagattgctctaaagaggaatcttccagtgaacttcgaagtggcaagagaaagtggtcctccacatatgaaaaacttcgtgaccaaggtctctgttggtgaattcgtgggtgagggcgaaggaaagagcaagaaaataagcaaaaagaatgccgcaatcgccgtcctagaagaactgaagaaactcccccctctacctgctgtggagcgggtgaaacctcggatcaagaaaaagactaaacctatcgtcaagccacaaacctcacccgaatacggacaggggattaaccctattagccgtcttgctcaaattcagcaagctaagaaggaaaaggaacctgagtacaccttgctcaccgagcggggactgccaaggagacgggagttcgtgatgcaggtgaaggttgggaatcacaccgctgaaggaaccggcactaacaaaaaagttgcaaaaagaaacgctgccgaaaacatgctggagattctggggtttaaggttccacaggcacaacctacaaaacccgctcttaaatcggaagaaaaaaccccaataaaaaaacctggcgacggcagaaaagtgaccttttttgaaccgggttccggcgacgagaatgggaccagcaacaaggaagatgagttcaggatgccatacctctctcatcaacagttgcccgctggcatcttgcctatggtgcccgaagtggcccaagccgttggagtgtctcaggggcatcatactaaagattttactagggccgctcccaacccggcaaaggccactgtgacggccatgattgccagggaacttttatacggaggtaccagccctacagctgaaaccatattgaagaataacatatcttcaggccatgtcccccacggccctctaacaaggccctcggaacagctcgattaccttagccgggtgcagggctttcaggtagaatataaggactttcccaagaataataagaatgagttcgtgtccctaatcaattgcagtagtcagcccccactgatttctcacggaatcggaaaggacgtggagagctgccacgacatggccgcattaaacatcctgaaactgttgagcgagctcgaccagcagtccactgagatgccccgaaccggcaacgggccaatgagcgtctgtggcagatgctag

SEQ ID NO: 28867 - DNA, 1473 bp, Artificial Sequence
  Description of Artificial Sequence: Synthetic coding sequence
atgagcgaagtcacaaaaaactccctcgaaaagatcttgccacagcttaaatgccatttcacttggaatctgtttaaggaggattcggtttcgcgtgacctggaggacagagtgtgcaaccagattgagtttttgaatacagaatttaaagcgactatgtacaatctgctcgcatatatcaaacatctggatggaaacaatgaagctgccctcgagtgccttcgccaagccgaggaacttatccagcaggagcatgccgatcaggcggagatcaggtccctcgtgacatggggcaattatgcttgggtatactatcacctgggcaggctgagcgatgctcagatctacgtggataaggtcaagcagacgtgcaagaaatttagcaacccgtacagtatcgagtattctgaactcgactgtgaggaaggctggactcagttaaagtgtggcagaaacgagcgtgcaaaagtgtgcttcgagaaggcactggaagaaaagcctaacaatccagagttttcttccggcttagccatcgccatgtaccatctagataatcaccccgagaagcagtttagtacagacgttttaaaacaggccatcgagctttcccctgacaatcaatatgtgaaagtgctgctcggattgaagctgcagaaaatgaataaggaagctgaaggggaacagtttgtggaggaggcgctagaaaaatcaccttgtcagaccgatgtgctgcgatctgctgctaaattttatagaaggaagggagatttggacaaggccatcgagctctttcaacgtgtgcttgagtcaactcccaacaacgggtatctgtatcaccagatcggttgttgctacaaggcgaaggtgagacaaatgcaaaacacaggtgagagtgaggccagcggcaacaaagagatgatcgaggccctgaagcaatatgctatggactattctaataaggccctcgaaaagggcctgaatccacttaacgcttattccgacctcgcagagttcctggaaaccgaatgttatcagacccccttcaacaaggaggtgcccgatgccgagaagcaacagtctcaccagcgttattgcaatctacagaagtacaacggaaaatccgaagacaccgcagtacagcatgggttggaaggcctgagcatctccaagaaatcaactgacaaagaggaaataaaggatcagccgcagaatgtgtcggagaacctgctgcctcagaacgcccctaactactggtacttgcaggggctgattcacaagcagaatggagaccttctgcaagctgctaagtgctatgaaaaagagctgggaaggcttcttcgcgatgctccctcaggcatcgggagcattttcctttcagcctccgaattagaagatggctcagaagagatggggcagggggcagtctcaagctctccgcgtgagctgctgtctaacagcgaacaactgaactag

SEQ ID NO: 28868 - DNA, 1473 bp, Artificial Sequence
  Description of Artificial Sequence: Synthetic coding sequence
atgagcgaggtcactaaaaattcgctggaaaaaattctccctcaactgaagtgtcattttacatggaatctgttcaaggaggactccgtgtctagggatttagaagaccgtgtttgcaaccagattgagtttctgaacaccgagttcaaagccaccatgtataatctactggcctacattaagcatctggacggcaacaacgaagcggcacttgaatgcttgagacaggccgaagagctcattcagcaggagcacgctgatcaggctgaaatacgctctttggttacttgggggaattacgcttgggtgtactaccatcttggtcgactctccgacgcccaaatttatgtggataaggtcaagcagacctgtaaaaagttttccaatccatactctattgagtacagcgaactggattgtgaggaaggctggacccagctgaaatgtggacggaatgaacgagcaaaggtgtgtttcgaaaaggctcttgaggagaagcctaataatcctgaattctcgagcgggctggctatcgccatgtatcacctcgacaatcatcccgagaaacagttcagcaccgatgtccttaagcaggctattgagctgagtcccgataatcaatacgtgaaggtcctgctgggcctgaaactacaaaaaatgaataaggaagccgagggtgagcagtttgtcgaggaggcactggagaagagtccttgtcagaccgatgtgctacgctcagctgctaagttctatcgcaggaagggcgacctggataaagctattgagctctttcagagagtgctggagagcacccccaacaacggatatctgtaccaccaaattggatgctgttacaaagccaaagtgcgacagatgcagaacacaggcgagtccgaggcttctgggaacaaggagatgatcgaagcactgaagcagtacgccatggattactctaataaagccttggagaagggcttgaatccactgaacgcttactctgatctggccgaatttctagagacagaatgctaccagactcccttcaataaggaagtcccagacgcagaaaagcaacaatctcatcaacggtactgcaatttgcagaagtacaatgggaagagtgaagatacggccgtgcagcatgggttggaggggctttcgatcagcaagaagagcaccgacaaggaagaaatcaaggaccagccgcagaatgtgtccgaaaatcttctcccccaaaatgcccctaattactggtatctgcagggcctgatccacaaacagaatggcgacctgctgcaagcagctaaatgctatgagaaggaactggggagactgttaagggacgctccgagcggcatcggcagcatcttcctgtccgcttctgagctggaggacggatcagaggagatggggcagggagcagtctcttcgtcacccagggaactgctttctaactctgaacagctgaattag

SEQ ID NO: 28869 - DNA, 1509 bp, Artificial Sequence
  Description of Artificial Sequence: Synthetic coding sequence
atgaaactgggcaaaaagcccatgtataagcctgtggatccatactccaggatgcagagcacctataactataatatgcgcggtggagcttatccgccaagatatttttacccatttccggtcccccctcttctttaccaggtagagctgagtgtgggtggccaacaattcaatggaaaaggaaagacccgacaagccgctaagcatgatgccgctgccaaagccctgaggatcttgcaaaacgagcctctgccggaacgcctggaggtgaatgggcgtgagtcggaggaagaaaacctcaacaaatccgagatatcccaggtcttcgagatcgccctaaagcgaaacctgcccgttaattttgagagctttcccttaaaacaggttgcgagagaaagcggacccccacatatgaagaattttgtgacaaaagtttccgtgggtgagttcgtcggtgagggcgagggtaaatccaagaaaatttctaagaaaaacgccgcaattgcggttttagaggagcttaaaaaactgcccccactgccagccgttgagagagttaaaccacgaattaaaaagaagaccaaaccaattgttaagcctcagaccagcccagagtatggccagggtattaaccccatctctcggcttgcgcaaatccagcaggccaagaaagagaaagagccagagtacactctgctgaccgaaaggggactgccgagacgtagagagttcgtgatgcaagtaaaagtgggtaatcacaccgccgaggggacaggaacaaacaagaaggtcgcaaaacgaaacgccgcagagaacatgctggagattctggggttcaaagttccccaggctcagccaaccaaacctgcacttaaatcagaggagaagacccccataaagaagccaggcgatggaagaaaggtcacgtttttcgagccaggcagtggcgacgaaaatggcaccagtaacaaggaggatgagtttaggatgccttaccttagccatcaacagcttccagcaggaattctgcctatggtgcccgaggtcgcccaggcggttggcgtgagtcagggccatcacacgaaggacttcactcgcgctgcgcctaacccggctaaggctacagtcactgcaatgatcgccagagagttgttatacggcggaacatcacccacggcagagactatcttaaaaaacaacatatctagcggacacgtacctcacgggcctctgacccggccaagcgaacagctggactatctgagtagggttcagggttttcaggtggaatacaaggacttcccgaagaacaataaaaatgagttcgtgtctctgatcaactgtagcagtcagcctcccctgatctctcacggaattgggaaagacgtcgagtcatgtcatgacatggcagctctcaacatcttaaagctcctgtcagagctggatcagcagtcaaccgaaatgccccgaacaggaaacggtccgatgtcagtctgcggaaggtgttag

SEQ ID NO: 28870 - DNA, 654 bp, Artificial Sequence
  Description of Artificial Sequence: Synthetic coding sequence
atggctgaaggaagtcagagcgcaccagaggccggaaatgacatgggcaacgatgatgctattggaggcaatgtgtcgaagtatatcgtcctcccaacaggttactgcggccagcccaagaaagggcacctgatattcgacgcctgcttcgaaagtgggaatttggggagggttgaccaggtgtcggagtttgaatatgatctgttcattaggcctgatacatgcaatcctagattccgggtctggttcaactttaccgtagaaaacgtcaaggagagtcagcgagtcattttcaacattgtgaacttcagcaaaactaaatccctgtaccgcgatgggatggctcccatggttaaatccacaagtaggcccaagtggcaaagactgcctcccaagaatgtatactactaccgctgtcccgaccaccgcaaaaattacgtaatgtcatttgccttttgtttcgatcgcgaggaagatatctatcagtttgcttattgttatccatatacttacaccagatttcaacactatttggatagcctccagaaacgaaatatggattattttttcagagaacagctcggtcaaagcgtgcagcagcggaaactcgacctgctgaccatcacatcacccgctgggcgatggagttggtag

SEQ ID NO: 28871 - DNA, 963 bp, Artificial Sequence
  Description of Artificial Sequence: Synthetic coding sequence
atggcggagggcagtcaatctgcgccagaagcaggaaatgacatgggcaacgacgatgctatcgggggaaatgtcagcaagtatattgtgttacccacaggatactgcgggcagccgaagaaagggcacctcatattcgatgcctgtttcgagtctggcaacttgggacgcgtggaccaggtttctgagtttgagtatgacctattcatcaggccagatacatgcaatccccgtttcagagtgtggttcaattttaccgttgaaaacgttaaagaatcacagagagtaatttttaatattgttaactttagcaaaacaaagtcactgtacagggatggtatggcccctatggtcaaatcaacctcaagacctaaatggcaaagactgccccctaagaacgtttactattaccgatgtccagatcacagaaagaactatgtgatgtcatttgctttctgtttcgaccgtgaagaagatatttatcagttcgcttattgctatccgtacacctacaccaggtttcagcactatcttgattctctgcagaagcgaaatatggactacttcttccgagagcagttaggccagtcagtacaacagcgcaaactggaccttcttactatcacatctccggataatttaagggaaggtgctgagcaaaaggtggtgtttatcactggacgcgtccatcccggtgaaactcctagttctttcgtgtgccagggcatcattgacttccttgtgtctcaacatccaattgcctgtgtgctcagagagtacctagtcttcaagatcgctcccatgttaaatcccgacggagtctatctgggcaactataggtgcagcctcatgggatttgacttgaatcgccattggctggaccctagcccttgggtgcacccgactttgcacggggtgaaacagctgatcgtgcagatgtacaacgatcctgtcagcaactag

SEQ ID NO: 28872 - DNA, 1512 bp, Artificial Sequence
  Description of Artificial Sequence: Synthetic coding sequence
atggccgagggctctcaatctgcacccgaagcgggaaatgatatgggtaatgatgacgccataggcggaaatgtttccaagtacattgtcctgcccactggttattgcggccagcctaagaaaggccacctgatctttgacgcttgtttcgaatccgggaacctgggtcgggtggatcaggtttcagagtttgagtacgacctctttattagaccggacacttgcaaccctcgattccgagtttggttcaactttactgtggagaatgtgaaggaatcacagagagtcatttttaacatagtgaacttttctaaaaccaaaagtctgtatcgtgatggtatggcgccaatggtgaagtcaaccagcaggccaaaatggcaaaggctgccccctaagaacgtatactactacagatgccctgatcaccgtaaaaactatgtcatgtctttcgcgttctgcttcgaccgcgaagaagatatttaccagttcgcctattgctacccatacacctatacgaggtttcaacactacctggacagcctccagaaacggaatatggattacttctttagggaacagttgggtcagtcagtgcagcagcgcaagctggacctgctcacaatcacgagtcctgacaatttgagggagggcgctgagcagaaggtggtcttcatcaccggccgtgtgcatccaggggaaaccccttcctcctttgtctgccaggggattatcgatttcctggtgtcacaacatcccattgcatgcgttttgcgggaatatcttgtgtttaagatcgccccaatgttgaatccagatggggtgtatctgggtaactacaggtgcagtttgatgggattcgatttgaatcgacactggctggatccctctccatgggtccatcccacactccacggtgtgaaacagctgattgtccagatgtacaatgaccccaagacgagtctagagttctacattgatatccatgcccattctactatgatgaacgggttcatgtatggtaacatttttgaggatgaagaaaggtttcagcggcaggccatcttcccaaagctgctttgtcagaacgccgaagacttttcctactcgagcacatcatttaatagggacgccgtaaaggctggcacaggtaggcgtttcctgggaggcttgctggaccataccagctactgttacacacttgaagtgtccttctactcttacatcatttccgggacaactgcagcagtgccatataccgaagaggcttacatgaagttgggccgaaacgtggcacgcactttcttggactattacaggctgaacccagtcgttgagaaggtggctatccccatgccacggctgcgcaataaggagatcgaggtccagcgaaggaaggagaagtctcctccgtacaagcaccccttattgagagggcctgcatctaattaccctaattcaaagggtgacaagaagtctagcgtgaatcacaaggacccatctactcctttctag

SEQ ID NO: 28873 - DNA, 1734 bp, Artificial Sequence
  Description of Artificial Sequence: Synthetic coding sequence
atgtcacaggtgcaagtccaagtccagaacccatccgcggctctgtctgggagtcagatcttgaacaaaaatcagtcccttctcagccagcctttaatgtctatcccctccacgacatccagcctaccttccgaaaacgccggtagaccaatccagaacagcgccctgcccagcgcctccattacctccacttcagctgcagcagagtcaattaccccgacggttgaattaaacgcgttgtgtatgaagctgggtaaaaagccgatgtacaagccagtggacccatacagtcggatgcaaagcacctacaattataatatgcggggaggagcctacccccctcgctatttctaccccttccctgtgcccccacttctctatcaagtggaattgtctgtgggtggacaacaatttaacggcaaagggaaaacacggcaggccgctaaacatgacgccgctgccaaggcactacggattctgcaaaatgaacccctgccggaacggctggaggttaacggacgggaatctgaagaggaaaatctgaacaaatccgaaatcagccaggtcttcgagattgccctgaaacggaatctgcccgttaactttgaagtggcccgagagagtggacccccacacatgaaaaacttcgtgactaaagtttccgtcggagagttcgtgggagagggcgaaggcaagtccaagaaaatctcaaaaaaaaacgccgcaattgcagtgctggaggaattgaagaagctcccccctttaccagcggtggagcgggtcaaaccaaggatcaagaagaaaactaagcctatcgtgaaaccacagacatcacctgaatatggtcaaggtattaaccccatcagccggcttgcgcaaatccaacaggctaagaaggagaaggaacctgaatataccctcctgactgaacgcggtttaccacgccgacgagaatttgtcatgcaagtgaaggtgggtaaccatactgctgagggtactggaacaaataaaaaagtcgcaaaacggaacgctgcggagaatatgcttgagatactcggattcaaggttcctcaggcccagcccacgaagccagccctgaagtccgaggaaaagacacccattaagaaaccaggggatggacggaaagtaacctttttcgagccgggttcaggcgacgagaacgggacgtcaaataaggaggacgagttccgcatgccataccttagccaccaacagctacctgcgggaatcctgcctatggtcccagaggtggcccaggcagtgggggtgtctcaggggcaccatactaaagatttcactcgcgcagctcctaatccagcgaaggctactgtgacagccatgattgcacgagaactcctgtacgggggtacgagtcccactgctgagacaattctcaaaaataacatcagctctggacatgttccacacggcccactcacaagaccgtccgaacagctagactatctttcaagagtgcaaggttttcaagtggaatacaaggacttccctaaaaataacaagaacgaattcgtatccctgatcaattgtagctcacagccaccacttattagtcatggcatcggcaaagacgtggaatcttgtcatgatatggcagcccttaacatcctcaaacttctctcagagctcgaccagcagagtaccgagatgccacgcaccggtaacggaccaatgagcgtctgtggcaggtgttag

SEQ ID NO: 28874 - DNA, 852 bp, Artificial Sequence
  Description of Artificial Sequence: Synthetic coding sequence
atgtccggagctgtcctcctcgaaagggaacggttgactagtggcacaacttggcataccgccggacttctctggcaactgcggccatctgacgttgaagttgaattactggctcacactcgtagagtagttagccgggagttggaggaggagacgggcctgcatactggatggattcaaaatggcggattgtttattgcgtccaatagacagcgccttgatgagtataagcgcctgatgtctctagggaaggcctatggggtggagagccacgtcctctctccagctgagaccaagaccttatatccactaatgaacgtggacgacctctatggcacactttacgtgccacatgatggaaccatggatcccgctgggacctgcaccactttggcccgagccgcttccgccaggggggctcaggtgattgaaaactgtcccgtcaccggtattcgcgtctggacggacgattttggcgtgaggagggtagctggagttgagacacagcacggcagcatccagacaccttgtgtcgtgaattgtgctggcgtgtgggcttccgccgtggggcgaatggcaggggttaaggtgcccttagtggccatgcaccacgcttatgtcgtgacagagcggatcgaagggattcagaatatgccgaacgttcgggatcatgacgcctccgtttatctgagactccagggtgatgcgctcagtgtcggaggatacgaggccaatccgatcttttgggaggaagcggtgaagtaccggccacgtgcagctgggggattatgcctgaaaacatctaccgaaaaagtgtgtgctgtgtggagtgacgatctccgacgagcctag

SEQ ID NO: 28875 - DNA, 1107 bp, Artificial Sequence
  Description of Artificial Sequence: Synthetic coding sequence
atgtcatatttcgggaaattttacctggtgggcttggacgccagaaaggccgctgattggcttttctctgcggacgtctctagaccaccaggcagcacagtatacacgtgtatgttgaatcataggggtggtactgaatccgacctaaccgtaagcaggctggctccctcccaccaggcgtctccactggcccctgccttcgagggagacggttactacttagcaatgggcggtgctgtggcccagcataactggtcccatattaccactgtgctgcaggaccagaaatcccagtgccagttgattgacagctcagaagatttggggatgatctcgattcaaggtccggcaagccgagccatcctccaggaagtgctggatgccgatttgagcaacgaagccttccccttcagcacccacaagctgttacgcgcagctggacacctggtcagagctatgcgcctgtcatttgtaggcgaactgggttgggaacttcatattcccaaggctagttgtgttcctgtgtatcgggcagttatggccgcaggcgcaaagcacggattaattaacgcaggataccgcgctatcgattcccttagcatcgagaagggctaccgtcattggcacgcagatttgagacctgatgacagccccctggaggctggattggcctttacatgcaagctcaaaagccctgtgccgtttctggggagagaggccctggaacagcagagggccgctgggttgcggagaaggcttgtctgctttacaatggaagagccactgtggacacggccacatccggcagtgtcaggcgctccggcttttagtactgcttcttctagcaaggtccctatgttcggtcttgaggccatttggcgtaacggacaggtggtggggcatgtgaggcgtgctgatttcggcttcgccatcgacaagactattgcttacggctacatccatgacccctccggtgggcctgtgagcctcgattttgtcaaaagcggagactacgctttagaaaggatgggggtgacttacggagcccaagctcatctgaagtccccttttgaccctaacaacaagcgggtcaagggcatctactag

SEQ ID NO: 28876 - DNA, 2757 bp, Artificial Sequence
  Description of Artificial Sequence: Synthetic coding sequence
atggccagtctatcccgcgctctaagagtggccgctgctcatcctagacagtccccaacacgcggtatggggccatgtaatctttcttctgctgctggccctactgctgagaagtcagttccgtaccagcgcacgctgaaggagggccagggaacaagcgtggtggcccaagggccttcccgccctctccctagcacagccaacgtggtcgtcattggaggaggaagtctgggctgtcagacattatatcacctggcaaaattagggatgagcggcgcagtcctgttggagagagagcggctgacatccgggaccacttggcatactgcaggcctgctatggcagctacggccttcggatgtcgaagtggagctgctggcccatacaaggagggtcgtttcacgggaactcgaggaagaaaccggtctccatactggttggatccagaatggtggcttgttcatagcgagtaacagacagaggctggacgagtacaaaagactgatgtctctgggaaaggcatacggagttgaatcacatgttcttagcccagctgaaaccaaaaccttgtaccccctgatgaacgtggacgatctgtacggcacgctgtacgttccacatgacggtactatggacccagccggaacttgcaccaccctcgcgagagccgcttctgccaggggagcacaagttattgaaaactgtccagtgacgggcataagagtttggacagatgattttggtgtccgacgagtcgcaggggtggagacacagcatgggtctattcagacaccttgcgttgtgaattgcgccggtgtgtgggcgtccgctgttggccgtatggccggagtcaaggtcccgcttgtggccatgcaccacgcctatgtggtcaccgaacgtatcgaaggcatccagaatatgccaaacgtgcgagaccacgacgcaagcgtgtacttacggttacagggcgatgcacttagcgtggggggatatgaggctaatcccattttttgggaagaggtgtccgataaatttgcattcggcctatttgatttagactgggaagtattcacccagcatattgaaggagccattaatcgcgtacctgtgcttgagaaaacaggcataaagtcaacagtgtgtggaccagaaagcttcaccccagatcacaagccactgatgggcgaggcacctgagcttagaggcttctttttgggatgtggatttaactctgccggtatgatgttgggcggaggctgtggacaggaactggcacattggattattcacggacgccctgaaaaagacatgcatgggtatgatatccgaagatttcatcactccctgaccgaccatccacgctggattcgtgaaagatcacacgagagctatgctaagaattattccgttgtgttccctcacgacgagcccttggcgggtaggaacatgcgtagggaccctcttcatgaggagcttctgggacagggttgcgttttccaggagcgccacggctgggaaaggccaggttggttccatccccgtggtccagctccggtgctcgagtacgattattacggcgcttacggttcacgggctcacgaggactatgcctaccggagactgctggctgatgaatacacattcgcctttcctcctcatcacgacactatcaaaaaggaatgtttagcatgccgcggagccgcagccgtgttcgatatgagctacttcggcaaattctacctggtcgggcttgacgcccgtaaagcagcagactggctgtttagcgccgatgtaagccgccctcctgggtcaaccgtgtacacctgcatgctaaatcatcggggagggacagagtctgatttgactgtgagtcggctcgcccctagtcaccaggcgtctccgctggcccctgcatttgaaggcgacggttattacctcgctatgggcggagctgttgctcagcacaattggagccacattaccacggtgctgcaggaccagaaatcacagtgccagctcattgacagtagtgaggatctgggcatgatctcaattcagggccctgcttcgcgagctattcttcaggaggttctcgatgcagatctgtccaacgaggcatttcccttcagcacccataaacttctgagggctgctgggcatctggttcgcgctatgcgcctgtctttcgttggggagctgggctgggagcttcatatccccaaggcttcatgcgtaccagtttaccgagcagtgatggcagctggggctaagcacggtctcattaacgccggataccgcgctatcgattcactgagtattgaaaagggatatcggcactggcacgccgatctgaggcccgacgactctcccttagaggccggactggccttcacctgcaaactgaagtcccccgtgccatttctaggacgggaagctctggagcagcagcgggctgctggcctcagacgtcggctcgtgtgtttcactatggaggataaagtgcccatgttcgggctagaggctatctggcgaaatggacaggtggtgggacacgtgaggcgcgctgatttcgggtttgctatcgataaaacaatcgcttacggctacatacacgatccttcaggcggtccagtctctttggatttcgtgaagtccggcgactatgcgttggagcggatgggcgtgacgtatggagcccaggcccacctcaaaagcccctttgaccccaacaacaagcgtgtcaagggcatatattag

SEQ ID NO: 28877 - DNA, 720 bp, Artificial Sequence
  Description of Artificial Sequence: Synthetic coding sequence
atggagggaactgtggaaagccagacacctgatcttagggatgtagagggcaaggtaggcaggaaaacacctgaaggcctacttagaggtctgagaggcgagtgcgagctgggaactagcggcgcacttctcctgccgggtgcctccagtactggtcatgatctcggcgacaagataatggcactaaaaatggaactggcatatctgcgggcaatcgatgtaaaaatactccaacagctcgtgactctcaacgagggtatcgaagcagtgcggtggctcctggaagagcgcggtaccctgacctctcattgttcaagcctgacctcttcccagtactcgctgacaggtggatctccaggcagatctcgcaggggatcctgggactctttaccggacaccagcactaccgacaggctcgacagtgtatcaatcggctccttcctcgacactgtggcaccgagtgagctagatgagcaagggccacccggagcacctcgcagcgaaatggattgggcgaaggttatcgctggcggtgagcgagctcgtaccgaagttgatgttgccgcaacaaggctggggtcactccgcgctgtctggaagccacctggagaacgtttgcagggcggaccccctgaaagtcccgaagacgagagcgctaaactggggtttgaggcacactggttttgggaacaatgtcaggacgacgtgacatttctatag

SEQ ID NO: 28878 - DNA, 294 bp, Artificial Sequence
  Description of Artificial Sequence: Synthetic coding sequence
atgagcagtgggaatgccaaaattggccatcctgcgccaaacttcaaggcaacagccgacgagggcatatcgtttagaggtctattcatcatcgatgacaaggggatcttacgccagattactgtcaacgatctccccgtgggtcgatccgtcgacgagactctgagacttgtgcaggcttttcagtttactgacaagcatggcgaagtgtgccctgccggatggaaaccgggttcagacaccatcaagcccgatgttcagaaatccaaagaatattttagcaagcagaagtag

SEQ ID NO: 28879 - DNA, 1668 bp, Artificial Sequence
  Description of Artificial Sequence: Synthetic coding sequence
atggacagaagcaagaggaatagtatcgctggttttccaccacgcgtggagcgcctggaagagttcgaggggggaggcggaggagagggcaatgtttcacaggtgggcagagtgtggccgagttcgtatcgagccttgatttcagcgttttccaggcttacacgcctggacgatttcacctgcgagaaaattggctcaggctttttcagtgaggtattcaaagttagacaccgagcctcaggacaggtcatggccctaaagatgaataccctgtcctctaatcgggctaatatgttaaaggaggtacagctaatgaatagacttagccacccgaacatcctgaggtacatcaattctggcaatctggaacagttactagacagcaatctgcacctgccttggacagtccgcgtgaaacttgcgtacgacatcgcagtgggcctctcctacctccactttaagggaatcttccatcgggatttgacaagtaagaattgcttgatcaaacgcgacgaaaatggatatagcgcagtagttgccgactttggactggctgagaaaattcccgatgtctcaatggggagcgaaaagttagccgtcgttggcagccctttctggatggcgccagaggttctcagggatgagccttacaacgagaaggcagacgtgttttcttatgggatcatcctttgtgagattatcgctaggattcaggctgatccggactatctccccagaacggagaattttggactggattatgatgcgttccagcatatggttggagattgtcctcccgattttctccaattgacattcaactgctgtaacatggatccaaaactgcgaccgtcttttgtggagattggtaagaccttggaggagatcttgagccgattacaggaagaggaacaagagcgggaccgcaagctgcaacccacagcaagaggtctgctggagaaagctccaggtgtgaagagactatcttcactcgatgacaagattccccataaatccccatgtccccgacgcaccatctggctttctcggagtcaaagcgacattttttccaggaaaccgcctcggacagtgtccgtcctcgatccgtactacaggccgagggacggcgcagcacgaacccctaaagtaaacccattttctgcccgacaggatcttatgggcggaaagatcaaatttttcgatctcccatcaaaatctgtgatcagcctcgtttttgatttggatgcacctggtcctggcacaatgcctctagctgattggcaggagcctctggcacccccaatcaggaggtggcggagcctccctggcagccctgagttcctccaccaggaggcctgtccatttgtcggaagggaggaaagcttatcggatggcccacctccaagactgagcagtttgaagtaccgagttaaagagatcccacccttcagggcatctgcacttccagccgctcaggctcatgaggcaatggactgttccatacttcaggaagagaacggctttgggtccaggccccagggaactagtccttgtcccgctggcgcttcagaagagatggaagtcgaggagcgccctgcaggcagcacaccagcaactttctctacctcgggaattggactccagacacagggtaagcaggacgggtag

SEQ ID NO: 28880 - DNA, 1629 bp, Artificial Sequence
  Description of Artificial Sequence: Synthetic coding sequence
atggatcgttctaagaggaacagtattgccggatttccacccagagttgagcgactcgaggagtttgaaggcggaggcggaggagagggcaacgtgagtcaggtgggccgagtctggccgtcttcgtatagagctctcatctccgcattttcccgcctgactcgactggatgatttcacatgcgagaagataggttcaggtttcttcagcgaagtgtttaaagtccgccatagggctagtgggcaagtgatggcgcttaagatgaatacacttagctctaatagagctaatatgctaaaggaagtgcaactcatgaaccggctgagtcaccctaacatcttaaggtttatgggcgtgtgtgtgcaccagggccagctgcacgcgctgaccgaatacatcaactctgggaacctggaacagctgctggacagtaatctgcatctcccatggaccgtcagggttaagctcgcctatgatatagccgtcggactctcatacttgcacttcaaagggatctttcatagagacctgaccagcaagaattgcttgatcaaaagggatgagaatggctacagcgcagtcgtcgctgatttcggcctagcagagaagatccctgacgtcagcatgggttcagagaaattggctgtggtcggcagcccattctggatggctccggaagtcctgcgagatgagccgtacaacgaaaaagccgatgtgttcagctacggcattatcctctgcgaaatcatagcacggatacaggccgatccagactatctgccgcgtaccgagatggaccctaagcttcgcccttcttttgtcgagattgggaagaccctagaggaaatcttgtcaaggctgcaggaggaggagcaggagagggaccgtaagttgcaacccacagctcggggactactcgagaaggcccctggagtgaaaaggctgtccagtttggacgataagattccacataaaagcccatgtcctaggcgcaccatctggctgagcaggtcccagtcagacattttcagtaggaaaccccctagaacggtctccgtgctcgacccctactacagacctcgcgatggtgccgctcgcacaccaaaagtcaaccctttctcggctagacaagatctaatgggtggcaaaatcaagtttttcgacctgccaagcaagagtgttatctccctggtctttgatttggatgcgccaggtcctgggacaatgccattagccgattggcaagagcctctggcccctcctattcggaggtggagatcattgccagggtctcccgaatttctgcaccaggaggcgtgtccctttgtggggagggaggagtcgctcagcgatggtcccccacctcgcctgagttccttgaagtaccgcgtgaaggaaattcccccttttcgtgccagcgcactcccagcggcacaagcccacgaggctatggactgctctattctgcaggaagaaaatggatttggaagccggcctcagggcacatctccatgcccagctggcgcttcagaagagatggaagtcgaagaacggccagccggaagtacccctgctacgttttctacgagcggaatcggcttacagacacaggggaaacaggacgggtag

SEQ ID NO: 28881 - DNA, 1716 bp, Artificial Sequence
  Description of Artificial Sequence: Synthetic coding sequence
atggatagaagcaagcgcaactcgattgccggttttccaccccgtgtggaacgactggaggaattcgagggcggaggaggaggtgaggggaatgtgagtcaggtaggaagagtctggccgtcgtcgtatcgggcacttatcagcgccttcagtcggttgacgaggttggatgacttcacttgtgagaagattgggagcggcttcttttcagaggttttcaaagtcaggcacagagccagcggtcaggttatggccctgaagatgaatacattgagcagcaatcgagcaaacatgttgaaggaggttcaactaatgaacagactcagtcacccgaacatattgaggtttatgggagtgtgcgttcaccaaggccaactccatgctctcaccgagtatatcaattctggaaatctcgaacagctcctggacagtaacctgcatctgccatggacggtgcgtgtcaagctggcatatgacatcgccgttggtctatcttacctgcacttcaaaggcatctttcatcgggaccttacttccaaaaactgcttgattaagagggatgagaacgggtattcagccgtcgtggccgatttcggtcttgccgagaagattcctgacgtttccatgggctccgagaagcttgccgttgttggaagccctttctggatggcacctgaagtgctcagagacgagccatacaacgaaaaggccgatgtcttctcctacggcatcatcttgtgcgagattatagccagaatccaagccgacccagattatctgccacgcaccgaaaatttcggcttggactacgatgcttttcaacacatggtcggagattgcccgcctgacttcttacagctgacatttaactgctgcaatatggacccgaagcttagaccaagttttgtggaaatcgggaagacgctggaggagatactgagtcggttacaagaagaggagcaggagcgggaccgtaagttacagccaaccgccagggggctgctcgagaaggcccctggcgtgaagcgcctgagtagcctagatgacaagatcccacataaaagtccatgcccaaggcgtacgatctggctgtctcgatcccagtctgatattttcagccggaaaccaccaagaaccgtttccgtgctggacccttactacagaccacgtgatggagctgccagaactccgaaagtgaatccctttagtgcccgacaggacctcatgggtggaaaaattaaattcttcgatctcccaagtaagagcgtcatctctcttgtatttgaccttgacgcgcctgggcctggcactatgccgttggcggactggcaggaaccactcgccccacctattaggcggtggcgtagtctcccaggatctcccgaattcctccatcaggaagcttgtccctttgttgggagggaagagagtctttctgatgggcctccaccacgactgagtagcctgaagtaccgggtgaaagaaatcccaccattcagagcttcggccttgcccgctgcccaggcccatgaagcaatggactgtagtattttgcaggaggaaaacggcttcggcagccgaccgcaggggacttctccctgccctgctggagctagcgaagagatggaagtagaggagcgacccgctggcagcacacccgctaccttctcaacttccggcataggacttcagacacagggcaagcaggacggctag

SEQ ID NO: 28882 - DNA, 1416 bp, Artificial Sequence
  Description of Artificial Sequence: Synthetic coding sequence
atgctgggcagttggggctgttataggtatgctaaactgtttagctgttctctgtccacacatgccagattcataaaaattctagacagcgtgcttcatcacttggtcccggcatgggatcacaccctagggacatttagcgaaataaaacaagtgaaacagtttttgctgttgtccagacagcgacctgggctggtggcccagtgcctgcgtgattctgaatctagtaagccgtcatttatgcctcggctctacattaatcgccgtctggccatggagcatagggcatgcccatccagggatccagcctgtaagaatgccgtcttcacgcaagtatatgaaggtctgaagccatcggacaagtatgagaagcctttagattaccgatggccgatgcggtacgatcagtggtgggagtgcaagttcatcgccgagggcataatcgaccaggggggaggcttccgagatagcttggctgacatgtccgaggaactctgcccgtcatcagccgacaccccagtcccattgccctttttcgtgagaaccgccaatcagggtaacggtaccggggaggcccgtgacatgtacgtgcccaacccaagttgtagggatttcgcaaaatatgaatggatcggccaacttatgggagcagcgctgcgcggtaaggagttcctggtattagccttacctgggttcgtttggaagcagctctcaggagaggaggtatcttggagcaaggactttcctgccgtagacagtgtgcttgtaaagctgctggaagttatggagggaatggacaaagagacattcgagtttaagtttggaaaagagttgacctttacgaccgtgttgagcgaccagcaggtggtggagctgatcccgggtggcgcagggatcgtggtgggctacggagaccgtagccgtttcatccaattagtacagaaggcaagactggaggagagcaaagagcaggtagctgccatgcaagcaggactgcttaaagtggtgcctcaggcagtgctggatctgcttacttggcaggagcttgaaaagaaagtgtgcggcgacccggaggtgacagtagatgctctcagaaagctgacacgtttcgaggattttgaaccctctgactcaagggtgcagtatttttgggaggcgctgaataatttcactaacgaggacaggtcccgctttctcaggttcgtcacaggacgtagcaggttgccagcaaggatctacatctatcctgataaattgggttacgagactactgacgccctgccggagagcagcacatgttcatccacactttttttgccccactacgcctctgccaaagtttgcgaggaaaagctgcgatacgccgcttacaactgtgtggcaatagatactgatatgtcaccctgggaagaatag

SEQ ID NO: 28883 - DNA, 825 bp, Artificial Sequence
  Description of Artificial Sequence: Synthetic coding sequence
atggccgctccagaagctgaagtactgagttccgccgcagtgcctgacctggagtggtatgaaaaatcagaggagacccacgctagtcaaatagaattgttggaaactagcagcactcaggagcctctgaacgcgtctgaggcgttttgtccgagggactgtatggtgccagtggtcttccccggacctgtctcacaggaggggtgctgtcagttcacgtgcgaactgctgaagcatatcatgtatcaaaggcagcagcttccattgccttacgagcagctgaaacatttctacagaaaaccatcgcctcaggctgaggagatgctcaagaaaaagcctcgtgcaacaacagaagtgagcagcagaaaatgtcagcaggcactggctgagcttgagagcgtgctgtctcacttggaagacttttttgcccgaacattagtgcctcgggtgttgatcctccttggaggtaacgcgctgtccccaaaagaattctatgagctggacctgagtctacttgctccttatagcgtagaccaaagcctctctactgccgcatgccttaggaggctcttccgcgctatcttcatggccgatgcgttcagcgagcttcaggcccctcccctgatgggtacagtggtaatggcccagggtcaccgcaactgcggagaagattggttccggccaaagcttaattatcgtgtcccgtctagaggccacaagttaacggtgacgctgtcctgcgggcgaccgtcaattaggacaactgcctgggaggattacatttggtttcaggcacccgtgactttcaaaggtttccgagagtag

SEQ ID NO: 28884 - DNA, 2586 bp, Artificial Sequence
  Description of Artificial Sequence: Synthetic coding sequence
atggccggaccagggccaggcgctgtcctggagtctccccgtcagttacttggaagagtgcgttttttagccgaggcggctagaagtctgagagcaggaagacccctccccgctgccttagcatttgtgcccagagaggttctctacaagttgtacaaagatcctgcaggaccaagccgtgtcctgttgccagtctgggaggctgagggcctaggtctgcgcgttggcgctgccggtcctgccccaggaactggtagtgggcctctgagagcagctagagatagtattgaactcagacgcggagcatgcgtgcggacaacaggcgaagaactgtgtaacggccatgggttatgggttaaattgactaaggaacagttagcagagcacctcggcgattgtggccttcaggaagggtggctgctggtatgccgccctgctgaaggaggagccagactggtcccaattgatacgcctaatcacttacagcgacaacaacagttgttcggggtcgactacaggcccgttttgcgatgggagcaagttgtcgacttgacgtactcccaccggttgggtagcagacctcagccggcagaggcctacgcagaagccgtacagagactgctgtatgtacctcccacttggacatacgagtgcgatgaagacctaatccattttctttatgatcatctggggaaagaggacgaaaatctcggcagtgttaagcagtacgtggagtcaatagacgtctcttcttatactgaggaatttaacgtttcatgcctgaccgatagcaacgccgacacttactgggaatcagatggatcccagtgccaacactgggtgaggctcacaatgaagaaggggactatagtaaaaaagctgttgctcactgtggacactaccgatgataactttatgcctaagagagtcgtggtatacggaggcgagggagacaaccttaagaaattgtccgatgtcagcattgacgagacactgatcggtgacgtctgtgttcttgaagatatgactgttcacttacctatcatcgagattagaatcgtggagtgtagggatgacgggattgacgtgcggttgcggggagtgaagataaaaagtagtagacagcgagagctggggttgaacgctgatctcttccagccaacttcccttgttaggtaccccaggctggagggtactgaccctgaagtcttgtatcgacgggctgtgttactgcagcgattcataaaaattctggacagtgttctgcaccacctcgttccagcatgggaccacacactgggaactttttctgagattaagcaggtcaaacagtttctcctgttatccagacaacgaccaggcctggtggctcagtgcctacgcgactctgaaagttccaaacctagcttcatgcctcggttatatatcaataggcggttggcaatggaacacagggcctgcccatctcgggacccagcctgtaaaaatgccgtattcacacaggtctacgaaggtcttaagccttcagataaatacgaaaaacctttggattaccgctggccaatgaggtatgaccagtggtgggagtgtaagtttatcgcagagggtattatcgaccagggcggtggttttagagactctctagccgatatgtccgaagaactgtgccccagctcagccgacactcctgtgcctctcccattctttgtgcggaccgccaaccaggggaacggaactggtgaagctagggatatgtatgtgccaaatccgagctgccgggacttcgccaagtacgaatggattgggcagctcatgggcgcagccctgagaggcaaggagtttttggtgctagcgcttcctggtttcgtctggaaacagctctctggggaagaagtgtcttggagcaaggatttcccagctgtcgactcagtcctcgtgaagctgctcgaggtcatggaaggaatggataaggagacttttgagtttaaattcggaaaggaactgacctttactaccgtgctctcagaccaacaggtggtggagctcattcctgggggagccggaattgtggtaggatacggggatcgatctagattcattcagttggttcagaaagccagactagaggaaagtaaagagcaggtggccgctatgcaggctggcctgctcaaggtggtgccacaagccgtcctggacctgctcacctggcaggagctcgagaagaaggtgtgtggagatcctgaagtgacagtggatgccctgcgcaagttgactcgctttgaagactttgagcctagcgacagtcgtgtccagtacttttgggaagctttgaacaactttaccaatgaggatcggagccgcttcctccgtttcgtgaccggcaggtcacgactcccagccagaatatacatctatccagataagctgggctacgagacaactgatgccctccccgagtccagtacatgtagctccactctctttctgccgcactacgcgtcagctaaggtttgcgaggagaaactcagatacgcggcttacaactgtgtcgctattgataccgatatgagtccctgggaggaatag

SEQ ID NO: 28885 - DNA, 1197 bp, Artificial Sequence
  Description of Artificial Sequence: Synthetic coding sequence
atggaaagcgtcctcagcaagtacgaggatcaaatcaccatttttactgactatctggaagagtacccggacaccgacgagctggtgtggattctaggaaagcaacacctgctgaagacagagaagtctaaattactctctgatatttctgcaaggctctggtttacctaccggaggaagttttcacctatcggcggtactggcccttcctctgacgccggatgggggtgtatgctaaggtgcggacagatgatgctcgcacaggctctgatctgtcggcatctcggcagagattggagctgggagaaacagaaggagcagccaaaagagtaccagagaatcctacagtgctttcttgacagaaaggactgttgctacagcattcaccaaatggcccagatgggtgtcggagagggcaagtccatcggggagtggttcggaccaaacaccgtcgcccaggtgctcaaaaaattggctctttttgacgagtggaattcccttgcagtgtatgtgtctatggacaacactgtagtgatcgaagacatcaaaaaaatgtgcagggtgctgccactgtccgctgataccgccggagacaggccaccagactcccttactgcatcaaaccaaagtaaaggcaccagcgcctattgttccgcttggaaacctctactgctgattgtgcctctcagactaggtattaaccagataaacccagtgtacgtggacgcctttaaggagtgtttcaagatgcctcagagtctcggggcattaggagggaagcctaataatgcctactattttatcgggtttcttggagatgagctgatctttttggatccccatactacccagacctttgtcgacactgaagagaatggaacagtgaatgatcagactttccactgcctccagtcaccacagcgcatgaatatcttgaatctggacccctcagtcgccctggggttcttttgcaaggaggagaaagattttgataactggtgctccttggtgcagaaagagatcttaaaggagaatttgaggatgttcgaattagttcagaagcatccaagtcattggcctccttttgtgcctcctgcaaagccagaggtcactactacaggagcagagtttatcgattcgaccgaacaacttgaggagtttgacttagaagaggatttcgaaatcctctccgtgtag

SEQ ID NO: 28886 - DNA, 1701 bp, Artificial Sequence
  Description of Artificial Sequence: Synthetic coding sequence
atggacctccaccgtgcagcttttaagatggaaaactcttcatacctccctaaccccctggctagcccggctcttatggtactcgcaagcactgctgaagcttccagggatgcctccatcccctgccagcagcctcggcctttcggggtgccagtaagcgtagataaagacgtgcacatacccttcacaaatggctcctataccttcgcctcaatgtatcacaggcagggaggggtccctgggacatttgctaatcgggacttccctccctcactcctgcatttgcatccccagtttgctccacctaatctagactgcacacctatcagcatgctgaaccacagtggggtgggggcatttagaccttttgcttccacggaggacagggagtcatatcaaagtgcattcacacctgctaaacgcctgaaaaactgccacgacacagagtcaccccacctgaggttctccgatgccgatggtaaagaatacgacttcgggactcagctcccctcttcttccccgggatcattaaaggtcgatgataccggaaaaaaaattttcgccgtgagtggcttaatttcagacagggaagcgagttcctccccagaggacaggaatgatcggtgtaagaagaaagcggctgccctgttcgactcacaggctccgatttgtcctatatgccaggtcctcctgaggccatccgaactgcaggaacacatggagcaggaactagagcagctggctcagcttccttctagcaaaaactctctccttaaggacgccatggccccaggcacaccaaaatcacttcttttaagcgcatccattaaacgggagggtgaatcaccaacagcaagcccccactctagcgcaactgacgacctgcaccactctgataggtatcaaaccttcttgagagtgagggccaatcggcagacccggctcaacgctaggattggtaaaatgaaaagaagaaaacaggacgaaggccagagagagggctcttgcatggccgaggatgacgccgtggacatagaacatgaaaataacaatcgcttcgaggaatatgagtggtgcggccagaagcgaattagggctacaaccctgttggagggaggattcagaggcagcggattcattatgtgcagtggaaaagagaacccggattctgacgccgatctcgacgttgacggcgatgataccctggagtacggcaaaccacagtatactgaggccgatgtgataccatgtaccggagaggaaccgggagaagcaaaggagagggaagcccttagaggggcagtgctgaatgggggaccacccagcactaggataactcccgaattttctaaatgggcttccgatgagatgccatccacaagcaatggagagtccagtaagcaggaagcaatgcagaaaacgtgcaagaattccgacatcgagaagatcacagaggacagtgccgtcacgacttttgaggctttgaaggcaagagtgagggaattggaacggcagctgtctaggggcgacaggtacaaatgcctgatttgcatggacagctactccatgccactcacaagcattcaatgttggcacgtccactgcgaggagtgttggcttaggacgcttggggctaagaagttgtgtcctcaatgtaacaccataaccgcgccaggcgatttaagaaggatttacctctag

SEQ ID NO: 28887 - DNA, 930 bp, Artificial Sequence
  Description of Artificial Sequence: Synthetic coding sequence
atgcccagggcacgctcagggaggaggagcaggggcgctggtggacgcgaggagacctttctgcgagtcagagcaaatcggcagaccagactgaacgccagaattggtaaaatgaagcgcagaaaacaggatgagggacaggtttgcccattatgcaaccgccctctggccggatccgaacaagaaatgtctagacatgtggaacattgtcttagcaaaagggagggctcttgcatggcagaggacgatgcagtggatatagaacatgaaaacaataacagattcgaagaatacgagtggtgcggacagaagagaattcgggctacaacgctgctagagggtggcttccgagggagcggttttatcatgtgctcgggcaaggaaaaccccgatagtgacgcagatctggacgtggatggcgacgacaccctggagtacgggaagcctcagtacaccgaagcagatgtgatcccttgcaccggtgaagagcctggtgaagcaaaagagcgggaggccttgcggggtgccgtactcaacgggggacccccatcaacgagaattactccagaattcagcaagtgggcctcagacgcagaaatgccgtcaacttctaatggcgaaagctctaagcaggaagccatgcaaaaaacgtgtaagaacagtgacattgagaagattacggaggattccgcggtgactacatttgaagctctgaaggccagagtgcgggaactcgagagacagctgagtcggggagatagatataagtgcctcatttgtatggactcttattccatgccgttgactagcatacagtgttggcatgtgcattgcgaggagtgttggctgcgtaccctaggggctaaaaagttgtgtcctcagtgtaataccatcaccgctcctggtgacttgcgaaggatatacctgtag

SEQ ID NO: 28888 - DNA, 1125 bp, Artificial Sequence
  Description of Artificial Sequence: Synthetic coding sequence
atggagtccgttttgagcaagtacgaggaccagatcaccattttcacggactacctggaagaataccctgacaccgacgagctggtctggatccttgggaagcagcacttgctgaagacgggcggtacgggcccaagtagcgacgccggttggggctgcatgttgcgatgcggccagatgatgttggcacaggcgcttatctgcagacacctgggtagggactggtcttgggaaaaacagaaggagcagccaaaagagtatcaaagaatcctgcaatgttttttggataggaaagactgctgctactctatccatcagatggcacagatgggcgtgggggaaggaaagtcaataggcgagtggtttggaccgaatactgtggcgcaagtgctgaaaaagttggccctgtttgacgaatggaatagtttggctgtgtatgtatccatggacaacaccgtcgtcatcgaagatatcaagaagatgtgtcgcgtgctccccctcagcgcggacacggccggtgatcgtccgcctgattcgctgaccgcctccaaccagagtaaaggcacatcagcctactgtagtgcatggaaaccactgttattgatcgtgccccttagacttgggatcaatcagattaatccggtgtatgtagatgcctttaaggagtgtttcaaaatgccccagtctcttggtgccctgggtggtaagcctaacaacgcatattacttcattgggttcctgggtgatgagttaattttccttgacccacatacaactcagacctttgtcgatactgaggagaacggcaccgtcaacgatcagactttccactgtttacagtcgcctcagcggatgaatatcctgaacctggacccttctgtggccctgggcttcttctgtaaggaagagaaagacttcgacaattggtgtagcctcgtccagaaagagatcctgaaggagaatcttcgaatgttcgagctggtccagaaacatccgtctcactggcctcccttcgtgccgcctgcgaagcccgaagtgactaccaccggggctgagttcatagactctactgaacaactggaggagttcgacctcgaagaggatttcgagatcctctcagtttag

SEQ ID NO: 28889 - DNA, 558 bp, Artificial Sequence
  Description of Artificial Sequence: Synthetic coding sequence
atggagggctgtgtgtccaacctgatggtctgtaacttggcatactctggaaaactggaagagctgaaagaatccatcctcgccgataaatcgctagcaactcgcaccgatcaggacagtaggacggcccttcactgggcttgttccgccggacacaccgagatcgtagaatttctccttcagctcggtgtgcctgtaaacgacaaagacgatgcagcttctaagaatagacacgagatcgcggtgatgcttctggagggtggagccaatcccgacgctaaagatcattatgaggcaacagctatgcatagggcagctgccaagggaaatctcaagatgatacacatcctgctgtactacaaagcctcaacgaacatacaggataccgaaggtaacactcccctacacctggcttgcgacgaggaaagagttgaggaggctaaattgcttgtctcacaaggagccagtatatatatagagaataaggaggagaaaacgcctctgcaggtcgccaaaggtggattgggccttatcctgaaacgaatggttgagggctag

SEQ ID NO: 28890 - DNA, 333 bp, Artificial Sequence
  Description of Artificial Sequence: Synthetic coding sequence
atggaaggatgcgtctctaatttaatggtgtgcaacctcgcctattcaggaaagctggaggagcttaaagagtccatactcgctgacaagagcttggctacacggactgatcaggactccaggactgccctgcattgggcttgcagtgcgggtcacaccgaaatagtggaattcctgctgcagctgggcgtccccgtcaatgataaagatgacgccgcatctaaaaaccgacatgaaatcgccgtcatgctcttggagggcggagcaaatcccgatgccaaggaccattatgaagccacagccatgcatagggctgctgcgaaggatacctag

SEQ ID NO: 28891 - DNA, 546 bp, Artificial Sequence
  Description of Artificial Sequence: Synthetic coding sequence
atggtgctgggagctggttggggttgggcctatcagttgcacctcttacaagcactcaagcgtaaacccgatctctttctttgtgaaagattggatgttaaggctgtattccaatgtgccgtcctggcccttaagttccccgaggccccaacagtgaaagcctcctgtggattcttcactgaattactgcccagatgtggtgaggtcgagtctgtcggaaaagtcgtgcaggaggacgggaggatgcttctgattgccgtccttgaagccattggcggacaggcttccagatctctcatggactgctttgcggacatcctgttcgcattgaataaacactgctttagcctgctgtccatgtggataaaagaggcattgcagccgcctgggttcccgtccgctagactctcgcccgagcagaaggatacattctcccaacagattctaagagagagagtgaacaaacgtagagtaaaagaaatggtgaaggaatttacccttctgtgccggggtctccacggaactgactatacggcagattactag

SEQ ID NO: 28892 - DNA, 2892 bp, Artificial Sequence
  Description of Artificial Sequence: Synthetic coding sequence
atggaacgccgagaggagcagcccggtgctgctggcgcaggcgctgctcctgctctggacttcaccgttgagaacgtggaaaaagccctgcaccagctctattatgacccaaatatcgagaacaaaaatctggcgcaaaaatggctgatgcaggcccaagtgtctcctcaggcctggcactttagctggcagctgctccagcccgataaggtgccggagattcagtatttcggagcctcggctctccatattaagatctcacgctattggtctgatatcccgactgaccagtacgagtccctgaaagcgcagctgttcacacagataacccgtttcgccagcggcagtaagatcgtgttgactaggctgtgcgtggcattggcatcgctggccctcagcatgatgccggacgcgtggccttgtgcggtagccgatatggtcagattgtttcaagccgaggactcgcccgtcgatggccaaggacgctgtttggcactcctggagctcctgacagtcctccccgaagagttccagacatctcgcctgcctcagtataggaaaggtcttgtgcgaacctccctggcagtggagtgtggtgctgtgttccccctgctcgagcagttactgcaacagccttcatccccgagttgcgtcagacagaaagtgctgaagtgtttctcgtcctgggtgcagctggaagtgcctctgcaagattgcgaggccctcatccaggccgctttcgcggcactccaggactccgagctgtttgacagctccgttgaggcgatagtcaacgctatttctcagcctgatgcccagcgctacgttaataccctgctcaagctgatccctctggtcctcggccttcaggagcagctacgccaggccgtccaaaacggagacatggagaccagtcacgggatctgtcggattgccgttgccctcggagagaatcattctagggctctgttggatcaagtggagcactggcagtcttttttggcactagttaatatgatcatgttttgtactgggattcctggtcactaccctgttaatgagacaacatcctccttgacacttactttctggtacactttacaggatgatatcctgagctttgaggcggaaaagcaagctgtttaccagcaggtctatagacctgtgtacttccagctggtggacgtgctgctccataaggcccagtttccctccgacgaagagtatggattctggagctctgacgagaaagaacagttcagaatttacagagtggacatcagcgacactctcatgtatgtgtacgagatgttaggcgctgagctcctgtctaatttgtacgacaaattgggaagactgcttacgtctagcgaagagccgtattcttggcagcacaccgaggctcttttgtacgggtttcagtctattgcagagacaattgacgtcaactactcagacgtagtgcccggactgatcggtctgatacccaggattagcatttccaacgttcagctcgctgatacagttatgtttactatcggtgctttgtccgaatggctcgctgatcatccagtaatgattaattccgtgctgcccctggtgctccacgctttaggtaacccagagctgtctgttagcagcgtgtccacactaaagaagatatgtcgggagtgcaaatacgacctcccaccgtacgcggctaacattgtggctgtctcccaggacgtcttaatgaaacaaatacataaaacatcgcaatgtatgtggctcatgcaggcactcggttttctcttaagtgctctgcaggtggaagagattcttaagaatttgcattcactcataagtccttacatacagcagctggagaagctggctgaggagatcccaaatccttcaaataaattagccatcgtccacatcttggggctgttgagcaacctctttactacactcgatatcagtcaccacgaggacgaccacgagggccctgagctgcggaagctgcccgtcccccaggggccaaaccccgtggtggtggtgctgcagcaggtgtttcagctcattcaaaaggtcctttccaagtggctgaatgatgcccaagtcgtggaagcggtatgtgccatctttgagaagagcgtcaagacactactggacgattttgctcccatggtaccacagttgtgcgaaatgctgggcaggatgtatagcaccatccctcaggcctccgcgttggatcttacacgccagctcgtgcatatcttcgctcacgaacccgcacatttcccacctattgaggcgctgtttctgcttgttacttccgttacccttaccttgttccagcaaggtccaagggatcaccccgacattgttgatagttttatgcagcttctggctcaggccctgaaacggaaacccgacctctttctgtgtgaaaggctggacgttaaggccgtctttcagtgcgcggtcctcgccctgaaatttcctgaagcaccaaccgtcaaggccagctgcggctttttcacggagttgcttccgcgatgtggtgaagtggagtcagtgggcaaggtggtgcaggaagacggcaggatgttgttgatcgccgtgctcgaggcaattggtggccaagcttcaagatcactgatggattgttttgctgacattctgttcgctcttaataaacactgtttcagccttcttagcatgtggatcaaggaggcgctccagccccctggtttccccagcgccagactgagcccggagcagaaggacactttttcccagcaaatactgcgggagcgtgtgaataagcgcagggttaaagagatggtaaaagagttcactttgctctgtcgcggtctgcatggcactgattacaccgcggactattag

SEQ ID NO: 28893 - DNA, 2907 bp, Artificial Sequence
  Description of Artificial Sequence: Synthetic coding sequence
atgcggctcctgcgccataccgagtctgaacaatggttccaccgtttccccctttgccccagcctcactttttgggccccagtggccatgtggccccagacgcactgcgtgggcggtaggagcagcgggttaacaaagtggacttactccttcagtgccagtctgcaggacggtagcttcccatatgattctgtgccttggcagcaaaacacaaatcagccgccaggctcactgagtgtagtgacaacagtctggggggttactaataccagccagtctcaggctgatgttctcattccacacgctacatgcaggcccggacctctcctgataacagcatgggagccttacggacagtgtcaacaacctcacgaatcccgtcgccaaccccacggtgtgggccacgatcaccagcagcctcggcctcagctgccgaccgtgtgcggcgctgccgcagctgttttgtcccagggttggcctcgctccgccctgcaccctgccgagcacgtctggccagcccagttaccaagacaaagaggattatggggacagcctgccgctgccgcagctgccgcagctgtcgccgcagccgcagctacagctacagccacggccacagccacagtggccgctttacaagagacccaaaataaggacattaaccagtacggaccagcccctgtgcttttgcctgatctgttaaaagatgggctcggcgatgaggagcgcggagcccctatcggaatgcaaaactccatgaacccagcctccatggcagctggcatgacaccctcaggaatgtccggcccaccaatggggatgaaccagcccaggcctcctggcattagtccatttgggacccatggacagagaatgccacagcaaacctaccccggtcccagacctcagtctctccccatacagaatattaagaggccctacccaggcgagcctaactacggcaaccaacagtacggcccaaactcgcagttcccaacccaaccaggtcagtatcccgctcctaatcctcctcgtccacttacctcaccaaactaccctggacagcggatgccgagccaacccagctccggtcagtatccaccaccaactgtcaatatgggacaatactataagcctgaacagttcaatgggcagaacaacacatttagcgggtccagctatagtaactattcacagggaaatgtaaaccgaccaccacgacccgttccggtcgccaactatcctcactcccctgttcccggtaaccccactcccccaatgacacctggctcatctattcccccttacttatcccccagtcaagatgttaaaccgccttttccgcctgacataaaacccaacatgagcgccctgccccctcctcccgatcataatgatgagctgcggttgacgtttccggtacgagacggagttgtcctggaacctttcagattagaacataatctcgctgtgtccaaccatgtgttccaccttaggcctacggtacaccagacactgatgtggagcgatcttgaactgcaatttaaatgttaccaccatgaggaccgccaaatgaacaccaactggcctgcctccgtgcaggtctcagtgaacgccacaccattgacaattgaaaggggggataacaaaacaagtcacaagccactccatctgaaacacgtctgccaacctggcagaaataccattcaaattacagtgaccgcatgttgctgttcacatctgttcgtgttgcaactcgtccatcgaccttcggtgagaagcgtgttacaaggactactgaagaagcgcctgttacccgcagagcattgtatcaccaagaagaggaatttctctagcgtggccgctagctctggcaacaccacgctgaatggcgaggatggagtggaacagacagccattaaagtatcactgaaatgccccataacttttaggcgcatacaacttcctgcccgtggacatgattgtaagcacgttcagtgcttcgacctggagtcatacttgcagctaaactgtgagcgaggaacctggcggtgtcctgtttgtaaaactgctctgctagagggtcttgaagtcgaccagtatatgtggggcattctcaacgccattcattccgagtttgaagaggtaacaattgatcccacctgtagttggaggccagtacccattaagagcgatttgcatattaaagatgatcctgacggaatcccatcaaagcgcttcaaaacaatgtcaccttcacaaatgataatgcccaatgtgatggaaatgattgccgcactagggcctggcccttccccatacccactacctccaccacctggcggaaccaatagcaatgattatagttctcagaataattatcaggggcatggcaatttcgactttcctcacgggaacccagggggaacttccatgaatgacttcatgcacggtccccctcaactgtctcaccctccagatatgccaaacaacatggcggctctcgaaaagcccctttcccacccgatgcaggagacaatgccacatgcaggctcgtccgaccagcctcatccaagtatacagcaaggactgcacgtaccccacccatcctcccagtcgggcccacccctacatcattcaggggcaccgcctccccctcccagccagcccccaagacaacctccacaggccgctccctctagccatccccatagcgatttaacctttaatccatcaagtgccctggaggggcaagctggcgctcagggagcttccgacatgccagagccgagcctcgatctgctccccgaacttacgaacccagatgagctgctcagttacctggacccacccgacctcccttctaactccaatgatgatctgctgagcttattcgagaacaactag

SEQ ID NO: 28894 - DNA, 603 bp, Artificial Sequence
  Description of Artificial Sequence: Synthetic coding sequence
atggcaatggagatgcgcctacctgttgctagaaaacccctgagtgagagactcggtcgtgatacaaaaaagcacctggtcgtgcccggagatacaattacaactgacacaggctttatgcgaggacatggaacttacatgggtgaagaaaagctcatcgcgagcgtggccggtagcgtcgaacgggtgaacaaactcatctgcgtaaaagcgctgaagacaaggtatatcggcgaggtgggcgacatcgtggtcggcagaattactgaggtgcagcaaaagagatggaaggtcgagaccaatagtaggctcgatagtgtgctccttctatccagcatgaacctgccaggtggggaactgcgcaggcgttctgccgaggacgaactcgcgatgcgcggattcctgcaggaaggagatttgatcagcgcagaggtccaagctgtcttctctgatggggctgtgagtctgcatacacgaagcctcaagtatggtaaaactcacttccacgacctcccgtgcggagcgtcagtaatcctgggcaacaacgggtttatctggatttatccgacccctgagcacaaagaggaggaagcaggaggttag

SEQ ID NO: 28895 - DNA, 792 bp, Artificial Sequence
  Description of Artificial Sequence: Synthetic coding sequence
atggccatggagatgagactgccagtcgcacgcaagccactttcagagagactgggacgcgacaccaaaaaacatctggtcgtgcccggagacacaattacaaccgataccggttttatgagagggcacggcacctacatgggagaggagaagctgatagctagcgttgccggaagcgtcgagagagtcaataaactgatctgcgttaaagccctaaaaacacgctacattggcgaggtgggcgatatcgtggtcgggagaatcacagagcgacgtcgttctgctgaggacgagctcgccatgcgaggcttcctccaggaaggtgacctaatctcagccgaagttcaagccgtctttagcgacggcgcagttagtctgcacactagatccctgaagtatgggaagcttgggcaaggagtattggtacaagtgagcccgtctctggttaaacgtcagaaaacacacttccacgaccttccatgtggggctagcgtgattcttggtaataatggcttcatttggatctatcccacaccagagcataaggaggaagaggccggaggtttcatcgctaatctggagcccgtaagcctggccgaccgtgaggtgatcagtagattgcgcaattgcatcatttctcttgttacgcagcgcatgatgctctacgatacgtctatcctttattgttacgaggcatctttaccccatcaaatcaaggatatcctaaaacctgagattatggaggagatagtcatggaaacacgccagcggctgctggagcaggaaggctag

SEQ ID NO: 28896 - DNA, 858 bp, Artificial Sequence
  Description of Artificial Sequence: Synthetic coding sequence
atggccatggaaatgcgcctccctgtggctagaaagcctctgtccgagagactcggacgcgatacaaaaaaacatctcgtcgtccctggtgatacgattaccacagacaccggctttatgaggggtcacggaacctatatgggggaagaaaagttaattgcatcagtggcaggcagtgtcgagagagtcaataaactgatttgcgtcaaagctctgaaaacacgttacatcggcgaagtcggtgacatcgtagtcgggaggataacagaggtccagcagaaacgatggaaggtggagaccaatagccggcttgattccgtgctgctcctgtcctcaatgaatctccctggcggagagctgcgacgacggtctgccgaggacgaattagccatgcggggatttctccaagagggtgatctgatctccgctgaggtgcaagcagtgttcagcgacggagccgtgtccctgcacaccagaagtctcaaatacggcaaggtgtctccatctttagtgaagaggcagaaaacacattttcatgacctaccatgcggcgcatctgtaatcctagggaataacgggttcatatggatttaccctacgcctgaacacaaggaagaagaagctggtggctttattgccaatctggagcccgtttccctggctgatagagaggtaatcagtagactgcgtaattgcatcatttccttggttactcagcgcatgatgctgtacgacacctcaatcctctactgttatgaggctagtctgccacaccaaatcaaagatattctcaagcctgagatcatggaggaaattgtcatggagacgcggcagaggctgctggagcaggaaggatag

SEQ ID NO: 28897 - DNA, 882 bp, Artificial Sequence
  Description of Artificial Sequence: Synthetic coding sequence
atggcaatggaaatgaggcttccagtggctcgaaaacctctgagtgaacgtcttggcagggataccaagaaacatctggtggttcccggagataccatcaccactgatacaggtttcatgcgaggtcacgggacttacatgggcgaagagaagctcatcgcaagcgtggcagggtctgttgaacgcgtaaataaacttatctgtgtcaaggctttgaaaacaaggtacatcggagaggtaggcgacatagtcgtaggcaggattactgaggtgcaacaaaaacgttggaaggtcgaaacaaacagtagactggattctgtgctgctcctcagctccatgaatctgccgggaggagagctgcgccgaaggagcgctgaggacgagctggccatgcggggtttcctccaggagggcgaccttatatctgcagaagtgcaggccgtgttttctgatggggcagtcagtctccacactcgatcccttaaatacggcaaactgggccagggagttcttgtacaggtttctccttcactcgtcaaaagacagaagactcacttccacgacctgccttgcggcgctagtgtgatcctgggaaacaacgggttcatatggatctacccgactcccgaacacaaggaggaggaggcaggcggattcatagcaaatctcgagccagtgtctttagcagatagagaggtcatatctcgcctgcggaattgcataatttccctagtcacacagaggatgatgctgtatgacacctccattctgtattgctacgaagcaagtctgccacatcagattaaagatatattaaaacctgagatcatggaggagatcgtcatggaaactaggcagagattgctagagcaagagggctag

SEQ ID NO: 28898 - DNA, 3195 bp, Artificial Sequence
  Description of Artificial Sequence: Synthetic coding sequence
atggccagcgagtccgaaacactgaacccttctgcacggattatgacattttaccctaccatggaggaatttcgcaacttctccagatacattgcctatatcgagtcacaaggcgctcatcgcgcaggtctcgcgaaggtcgttccgccaaaggagtggaagcctcgcgcatcgtatgatgacattgatgatctcgtgatccctgctccaatccagcaactggttacagggcagagtgggctttttacgcaatataatattcagaaaaaggccatgactgttagagaattcaggaaaattgccaattccgataaatattgtacgccgaggtactctgaatttgaagagttagagaggaagtattggaaaaatctgacgtttaatccaccgatatatggcgcagatgttaacgggaccctctatgaaaaacacgtcgacgaatggaacatcgggaggctcagaactatcctggacctcgtggagaaggagtctggcatcactatcgagggcgtgaatacaccttatttgtattttggcatgtggaaaacatccttcgcgtggcatactgaggatatggatctttactcaatcaattacttgcacttcggggagcccaaaagttggtattcagtgcctcctgagcacggaaagagattagaacgactcgccaaaggattttttccaggcagcgctcaaagctgtgaggcttttcttcgacacaagatgaccctgatttctcctcttatgctgaaaaaatatggcatcccattcgataaagtgacccaagaggcaggagaattcatgatcacctttccgtatgggtatcacgcgggatttaaccacggattcaactgcgcagaaagcaccaattttgctacaagaaggtggatcgagtatggtaaacaggcggtgctgtgtagctgccgcaaagatatggtgaagatttccatggatgtgtttgtgaggaagtttcagcctgaaaggtacaagctgtggaaggccggtaaagacaacaccgtgatagatcacaccctacccacaccggaagccgctgagttcctgaaggagagcgaacttccaccgagagcaggaaatgaagaggagtgtccagaggaggatatggaaggcgttgaggatggcgaagagggggatttaaagacaagcctagcgaagcaccggatcggcacaaaaagacaccgggtctgcctggaaattccccaggaggtgtcgcagtctgaattgtttcccaaagaggatctgagcagtgaacagtatgagatgaccgagtgccccgcagcccttgccccagtgaggccaactcatagctcggtgaggcaagtagaggacgggctcaccttccctgactattccgattcaacagaagtgaagtttgaggaactcaaaaacgtcaagttggaggaagaagacgaggaggaagagcaggccgctgctgcactcgatcttagcgttaatcctgcatctgtgggaggccgattggtcttcagcggctcgaaaaagaagagttcttcgtctttaggcagcggatctagccgagactccatcagctccgactccgagaccagcgagcccctaagttgtcgggcacagggccagacgggcgtgcttacggttcattcctatgcaaaaggcgatggacgagtgacggttggagaaccttgcacgcgtaaaaaaggatctgcagctcgcagtttttctgaacgcgaattagctgaagtggctgacgagtacatgttctcacttgaagagaacaaaaaatccaaaggaagacggcagcctctatccaaactgccgaggcaccatccccttgtactgcaggagtgtgttagcgatgatgagaccagcgaacagcttacaccagaggaggaagctgaagagacagaggcgtgggcaaaaccactcagccagctgtggcagaaccgtccccctaactttgaagcagagaaggaatttaacgaaaccatggcccagcaagctccgcattgcgccgtgtgcatgatattccagacgtatcatcaggtggaattcgggggattcaatcaaaactgcgggaatgcttccgatctggcaccccagaagcagaggaccaaacctctgatcccagaaatgtgctttacatctacgggctgtagcacagacatcaacctctctactccctatctcgaagaagatggcacctcgattttagtctcatgcaagaaatgtagcgtccgggtgcatgcctcttgttatggggtccctccagcaaaagcctctgaggattggatgtgcagcagatgttccgccaatgccttggaggaggactgctgcctttgctcccttaggggcggagctctgcaaagagccaacgacgacaggtgggttcacgtctcctgcgctgtcgccattctcgaagcgaggtttgtaaacattgcagagagaagcccagttgacgtgagcaagatccctctccctaggtttaaactaaagtgtatattttgtaagaaacggaggaaacgtacagcaggatgttgtgttcagtgctctcacggacgttgtcccactgctttccatgtgtcctgcgcccaggcagcaggcgtaatgatgcagcccgacgattggccttttgtcgtttttataacatgctttcggcacaagatccccaaccttgagcgcgcaaaaggcgcactacagagcatcaccgctggacagaaggtgatttccaaacataagaacggtaggttttaccagtgcgaggtggttcggctcacaacagaaaccttttatgaggtgaattttgacgacggcagttttagcgataatctgtacccagaggatatcgtttcacaggactgcctccaatttggtccacccgcagaaggagaagtggtgcaggtgcgctggacagatggacaggtgtatggagctaaattcgtggctagccaccctatccagatgtaccaggttgagtttgaggacggcagtcaattagtcgttaagagggacgacgtatatactttagacgaggagctccccaagagggtgaagtcccgtctgagtgtggcttcggatatgcggttcaatgaaatctttactgagaaagaagtcaagcaggaaaagaagcgccagagagtgataaacagtcgatatcgggaggattacattgagcccgctctgtaccgtgcaataatggagtag

SEQ ID NO: 28899 - DNA, 2745 bp, Artificial Sequence
  Description of Artificial Sequence: Synthetic coding sequence
atgggggactcccgagatttgtgtccacatctggactctatcggggaggttaccaaagaagatctccttctgaagagtaagggaacttgccagagctgcggggtcactgggccaaacctttgggcatgcctacaggttgcatgcccctacgtgggttgtggagaaagttttgctgatcacagtacaatacatgcccaggctaaaaagcataatcttactgttaatctgacgacttttcggttgtggtgttacgcctgtgagaaagaggtgttcctggaacagcgactggccgcacctcttttggggagttcctctaagttctccgaacaggacagtccacccccttcccatcccctgaaggcagtgccaattgctgtcgctgatgaaggcgaaagtgaatccgaagacgatgacttgaagccccgaggtctaacgggcatgaaaaacttaggcaactcctgttatatgaatgctgctctgcaagctttgtctaactgccctccccttactcagtttttcttagaatgtggcggactggtcaggactgacaaaaagcccgctctttgtaagagttatcagaagttggtatcggaggtatggcataagaagcgcccttcatacgttgttcccaccagcctgtcccacggaataaagcttgttaatcccatgtttcgcggttatgcccaacaagatacacaggaatttctccgttgtctgatggaccaactgcacgaagagctgaaggaacccgtggtggcaaccgtcgctctaaccgaagctagggattcggactcttctgatacagatgaaaagcgcgaaggggaccgaagcccttcagaagatgaattcttgagctgtgacagctctagcgatcggggagagggcgatggccaaggcagagggggaggctcaagccaggccgagaccgagctactgatccctgacgaagccggtcgggcaataagcgagaaagagcgaatgaaggaccgtaagttctcgtggggccagcagcgaacgaattctgagcaggtcgatgaagatgctgacgttgacaccgccatggctgcactggatgatcaaccagctgaagctcaacctccctctcctcgaagctctagcccctgtcgcacacccgagccagacaatgacgcacatctccggagctcctcccgcccttgctccccagtgcatcatcacgagggtcacgctaaacttagcagctcaccgcctagagcatctccggtccggatggcccctagctatgtgcttaagaaggctcaggttctatctgccggttcacgcagacgcaaggagcaacgatataggtctgtgattagcgatatatttgatggctcaatcctcagtctggtgcagtgcttgacttgcgaccgggtaagcactaccgtcgaaactttccaagatctctccttacctatacctggcaaggaggatcttgccaaactccatagcgctatctaccagaacgtgccagccaagccaggagcttgcggcgattcctacgcggctcagggttggcttgctttcattgtcgagtacatcaggcgctttgtcgtatcatgtaccccatcctggttctgggggccagtggttacgctagaggactgtctggccgctttcttcgccgcagacgagttgaaaggagataatatgtacagctgcgaaaggtgcaaaaagctgcggaatggcgtgaagtactgcaaagtgctcaggctccctgaaatcctgtgcatccatctcaaaagattcaggcatgaagtaatgtactcattcaagatcaactcccacgtctcattcccattggagggcctggacctgcggccatttctggccaaggagtgcaccagccagattactacttatgatctcctgagcgtaatctgtcaccatgggactgccggtagtggacactatatcgcctattgtcagaatgtgatcaacggacagtggtacgaattcgatgatcaatatgtgaccgaagtccatgagactgtggtgcaaaacgctgagggctacgtattgttctacaggaaatctagcgaagaggccatgcgggagagacagcaggttgtgtccctggccgctatgcgggagccctcactgctgcgtttctacgtgtctcgggaatggttgaacaaattcaacacctttgctgaacctggccctatcacgaatcaaaccttcctctgcagccacggagggatccccccacataagtaccactacatcgatgatctggtcgttatactgccacaaaacgtttgggagcacctgtataatagatttggtggcggacccgctgttaaccacctctatgtctgttcaatttgccaggtggaaatcgaagctttggccaagcggcgtcggattgagatcgacaccttcattaagctgaataaagcattccaggccgaggaaagtccaggtgtgatctattgcatctcaatgcaatggttccgggaatgggaggcatttgttaaaggaaaagacaacgagccccctggccctatcgataactctagaatagcacaagttaagggttcggggcacgtacagcttaagcagggggcagattatggacagattagcgaggaaacttggacctatcttaactctctgtatggcggaggacccgagatagctattcgccaatctgtggcccagcctttgggtcctgagaacctgcacggcgaacaaaagattgaggcagagaccagagccgtctag

SEQ ID NO: 28900 - DNA, 1215 bp, Artificial Sequence
  Description of Artificial Sequence: Synthetic coding sequence
atggattttaacatgaaaaaactcgccagcgatgcgggaatcttctttacccgagccgtgcagtttacagaagagaagtttggtcaagccgagaagactgaattagatgcccacttcgagaatctgcttgccagagccgacagtaccaaaaattggactgagaagatcctcagacaaactgaggtgttgcttcagccgaacccatcagccagggtcgaagaattcctttacgagaaactggaccgcaaggtgcctagcagagtgacaaatggagagctccttgcccagtacatggcggacgccgctagcgaactggggccaaccacgccttatggtaagactttaattaaagtggcagaggctgaaaagcaactgggtgccgctgaaagagacttcattcacaccgcctctatttcatttcttacccctctgcgcaactttcttgagggcgattggaagactataagtaaggagagaagactgctccaaaacagaagacttgatctcgacgcttgtaaagctagactgaagaaggcaaaagcagccgaagccaaggccacctgtgaaggcgacacagttcccgacttccaggaaacccgcccaaggaactacattctctctgcttccgctagcgctctgtggaacgacgaagtggataaagctgaacaggagctccgggtcgcgcagacggaatttgatcggcaggctgaagttacacgcctcttgcttgagggcattagcagcacccacgtcaatcacctgagatgcttacacgagtttgtaaaaagccagacaacttattatgcccagtgttatcgacatatgctcgacctgcaaaagcagcttggctcctctcagggggctatattcccaggaacattcgtgggcacaacagagcctgcttctcctccactgtcttcaacgagccctaccaccgccgctgccactatgcctgtagtgcctagcgtggctagcctggctcctcctggcgaagcgtccctgtgtttggaggaggtagccccacccgctagcggaactcgcaaggcccgagtgctttatgactatgaagctgccgactcaagcgagttggccctgcttgctgatgagcttattactgtctatagcttaccgggaatggatcctgattggctgattggggagcgaggcaataagaagggcaaagtgcctgtgacctatctggaactactaagctag

SEQ ID NO: 28901 - DNA, 1188 bp, Artificial Sequence
  Description of Artificial Sequence: Synthetic coding sequence
atggactttaatatgaaaaaattggcatccgacgctggcatcttcttcacccgtgccgttcagttcaccgaggagaaatttggccaggccgagaagaccgagcttgacgcccactttgagaatctgctggctagggccgattctacaaaaaactggacagagaagatactgaggcagaccgaggtcctcctgcaaccaaacccctctgcaagagtggaagagttcctgtatgagaaactggaccgcaaggttccatcccgcgttaccaatggcgagctgctggcacaatatatggccgacgccgcttcggagctcgggccaactacaccctacggaaagaccttgattaaggtggcagaagctgagaagcaactgggggctgctgagagggactttattcacaccgcgagtatatcctttctgacccccctgcgcaacttcctggagggcgattggaagaccattagtaaggagcgcaggctgctccagaatcggagactggatttggacgcgtgtaaagccaggcttaagaaagctaaggccgcagaagccaaagctacgactgtcccggacttccaggagaccaggcccaggaactatatcctctctgcatctgcaagcgctttgtggaacgatgaagttgacaaggcggagcaagaattgagggtcgcccagaccgagttcgataggcaagctgaggtcacccgactcttgcttgaggggattagcagtacacatgtgaatcacctgagatgtctccacgagttcgtgaagtcccagaccacatattatgctcagtgctaccggcacatgctggatcttcaaaaacagttgggacgtttccccggaacctttgtagggaccacagaacccgcttctccccctctctcaagcactagtcctaccaccgccgctgctacgatgccagtagtcccctcggttgcatcgttggcacctcctggggaagctagcctgtgcctggaggaggtggctccacccgcatccggcacacgtaaagctcgtgtcttatacgactatgaggccgctgattcctctgaactggctctgcttgcagacgaactcatcacggtctactcactccccggtatggatcctgattggctcatcggggagcggggtaacaagaaggggaaagtgccagtaacctacctcgagctgctcagctag

SEQ ID NO: 28902 - DNA, 1188 bp, Artificial Sequence
  Description of Artificial Sequence: Synthetic coding sequence
atggattttaatatgaaaaaactggctagcgacgccggtatcttctttaccagagcagtccagttcaccgaggagaagtttggccaggctgagaagaccgagctcgatgcacacttcgagaacttgctggccagagccgatagtacaaagaactggactgaaaaaattcttaggcaaaccgaagttctattacaaccgaacccaagcgcacgggtggaggagtttctttatgaaaaactcgaccgtaaggtgccaagccgcgtgactaatggagagctgctggctcagtacatggctgatgcagccagtgagcttggccctaccaccccctacgggaagacgctgatcaaagtcgcagaggccgagaagcagttaggcgcagccgagagggatttcattcacactgcctccattagctttttgacaccgctgcggaattttctggagggcgattggaagacaatctcaaaagaacgccgattgctacaaaaccggcgactggacctggacgcctgtaaggctcgcttgaaaaaggccaaggcagccgaagctaaggccactaccgtgccagactttcaggaaacaaggccaagaaattacattctgtccgcttccgctagcgccttgtggaacgacgaagtggataaggctgaacaagaattgcgtgtggcacaaaccgagtttgataggcaggctgaggtcacaagattgttgctggagggcatttcatccactcatgtcaatcaccttagatgtctacatgagttcgtgaagtctcaaacaacctactatgcccagtgttatcgccacatgctggacctccagaaacagctcggcagattccccggtaccttcgttggaactacagaaccagcatcacctcctcttagctccacatctcccacaacagcggctgctacgatgcctgtggtgcctagtgtcgcttcattagcgcctccaggcgaagcgagtttgtgtctggaggaggttgctcccccagcctcagggacacgtaaggcacgggtgctgtacgattacgaagcagcggattcgtccgagctggctctcctggctgacgagcttattaccgtctattctctgcctgggatggacccagattggttgatcggtgaacgaggcaataagaagggtaaagtgcccgtgacctatctcgaactattgagctag

SEQ ID NO: 28903 - DNA, 615 bp, Artificial Sequence
  Description of Artificial Sequence: Synthetic coding sequence
atgtcttggacatgcccacgatgtcagcagcctgtcttctttgccgaaaaggtgtctagtctgggcaagaattggcaccgtttctgtctgaagtgtgaacggtgtcactctatcctctctcctggcggtcacgccgagcacaacggccgtccttactgtcataaaccctgctatggagccttgttcggcccaagaggagtcaacattggaggggtcggcagctacctgtacaatcccccaacacccagccctgggtgtactactccactctctcccagctcttttagccccccacggcctaggactggcctccctcagggcaaaaaatctccaccgcacatgaagacatttaccggagagacttcgttgtgtcctggatgtggggagccggtctattttgctgagaaggtcatgtcattaggaaggaactggcacaggccatgcctgaggtgccaacgctgccacaaaaccctcacagcgggtagccatgctgagcacgatggcgtgccctactgtcatgttccatgttatggctacctttttgggccaaaaggagtgaatataggcgacgttggctgttatatatatgacccagtcaagattaagttcaagtag

SEQ ID NO: 28904 - DNA, 1221 bp, Artificial Sequence
  Description of Artificial Sequence: Synthetic coding sequence
atggaatcactcagaggatacacacatagcgacatcgggtacagatcactcgctgtcggagaagacatcgaggaggtgaatgatgagaagcttactgtcacatcactgatggctaggggtggagaggacgaggagaataccaggtccaagcccgaatacggaacggaggccgaaaataacgttgggacagaggggtctgtacccagcgatgaccaggacagagaaggaggaggtggccatgagccagagcaacaacaggaagagccgccactgactaaaccggagcaacagcaggaagaacctccactgttggaactaaagcaggaacaagaggagcctcctcagacgaccgtggagggaccccagccagccgagggtccccagacagcggagggacctcagccaccggagcgcaagcggaggcgtcgcaccgcgttcacccagtttcagctgcaggaattggagaatttttttgatgaaagccagtatccggacgtagtggccagggagcgtctggcggctaggctcaatctcaccgaagatagagtgcaggtgtggtttcaaaacagaagggccaagtggaagagaaatcaacgggtactcatgctgaggaacacggctaccgccgatttggctcaccccctcgacatgtttctcgggggtgcatattacgctgctcccgcattggaccccgcactttgtgtgcatctcgtgccacaactgccccgtcctcccgtcttacctgtgccccctatgccccctcgaccgcctatggtgcccatgccgcctcgaccacctatcgctccaatgccacccatggcgcctgtgcctccgggaagccgtatggcacctgtccccccaggccctaggatggctccggtgccaccttggcctcctatggctcccgtgcccccatggccccctatggccccagttcccaccggaccacctatggctcctgtgccccctggaccacccatggccagggtccccccaggtccgccaatggcaagggtccctccaggcccaccaatggcacccttgccgcctggccctcctatggctccgctgccccctggcccacccatggccccattgccacctgggcctccaatggccccactgccccctagaagccatgtcccccacaccgggctcgcaccagtacatattacttgggccccagtgataaatagttactacgcctgccctttcttttag

SEQ ID NO: 28905 - DNA, 873 bp, Artificial Sequence
  Description of Artificial Sequence: Synthetic coding sequence
atgtctccctcagcaaagaagcgcccaaaaaacagccgggtgagcaaaatgcaagatgaaaaactgagagacgagaccgagcagcccgtgtcgaaagtgatcgagagaaatcgcctgcgcacagtgctcaaaaacttaagccttctaaaactgttaaagtcaagtaaccgtcggattcaagagctgcacaagctggccaagcgatgctggcactccctcctgtccgtcccaaagattctgcggatatcctcaggagaaaattctgcctgtaataagacaaagcaaaacaatgaggagttccaggagattgggtgttctgaaaaagaacttaagagcaaaaaactggaaagtacaggggacccgaagaaaaaggagtacaaggaatggaaaagccaggttcagtctgggatgcgaaacaaggagaaaacttctctcgcggctatgccgagaaaagagaagcacatcgaaccagaagttcctaggacctcccgggatgactccttaaatccaggggtacagggtcggcagccactgactgagggcccaagggttatctttatcaagccttatcgtaaccgcacccctatgggacacatgaagcagttggatgttgccgatcagtggatatggtttgagggattaccaacacgcatacacctgccagctccacgggtgatgtgccgctcctctactctgcgttgggtgaagcgaagatgtacgaggttctgctctgcctcactggagatgcccatgtggcacccttacaaggtcgatgtcacatggacgcgggcacgaggcgcttcacggggatggcgcagccgacaccaattgaaaggaaggaatggttggcgcaactctagggtctacaagtag

SEQ ID NO: 28906 - DNA, 1644 bp, Artificial Sequence
  Description of Artificial Sequence: Synthetic coding sequence
atggcagggactaagaacaagaccagagctcaggccaagacagagaagaaggccgctatccaggccaaagccggtgcagaacgagaggctaccggagtcgtgcgtccagtcgccaaaactcgagctaaggcaaaagccaagacaggatccaaaactgatgcagtcgctgagatgaaggcggtgtctaagaacaaagttgttgccgaaaccaaggagggtgccctcagcgagcctaaaacgctggggaaagcaatgggcgatttcacacccaaggcaggaaatgagagtacgtcatcaacctgtaaaaacgaggccggtactgacgcctggttttgggcaggagaagaggctacgatcaacagctggttttggaacggcgaagaagccggaaattccttctccaccaaaaatgataagcctgaaataggagcacaggtctgtgcggaagagctcgaacccgctgccggagcagactgtaaacctcgctcgggagccgaggaggaggaagaagaaaatgtgatcggaaactggttttgggagggcgacgacacctcattcgatcctaatcccaagccagtttctagaatcgttaagcctcagcccgtgtatgaaatcaatgaaaaaaaccgtccaaaagactggtccgaggtgaccatctggcccaacgccccagctgtcacaccggctgtgcttggcttccgcagccaggccccaagtgaggccagcccaccttcttacatcgtgctggcgtcggcggaagaaaacgcgtgcagcctccctgtggcgacagcatgcagaccaagcagaaacacccggtcatgcagccagccaattcccgagtgcagattcgattcagatccctgtatccaaaccattgatgagattagacgtcaaatcaggattcgggaagtcaatggtatcaagccatttgcctgtccctgcaaaatggaatgctatatggattctgaagaattcgagaagctggtttcgcttcttaagtccacaaccgaccctctgatccataagattgctcgaatcgccatgggagttcacaacgtgcaccctttcgcccaagagttcatcaatgaggtgggtgtcgtgacgctgattgagtctctacttagctttccgagccctgaaatgcgcaaaaagacagtaattactctgaacccaccctctggtgatgaacgccaaagaaagatcgagctccacgtgaagcatatgtgtaaggaaaccatgagtttccccctgaattccccaggacagcaaagtggactgaaaattttaggccaactcactacagacttcgtacaccactatatcgtggctaattacttcagtgaactattccatctcctctcatccggcaattgtaagacaagaaacttagtcctgaagctgttacttaatatgtccgagaaccctacggcagcaagagacatgatcaacatgaaagctttagccgctctgaaacttatctttaatcagaaagaagccaaggcaaacctggtgtccggggttgccatattcattaatatcaaagagcacatcaggaagggcagtattgtcgtagtagaccacttgtcctataacacactaatggcaattttccgagaagtcaaagagataatcgaaacgatgtag

SEQ ID NO: 28907 - DNA, 1881 bp, Artificial Sequence
  Description of Artificial Sequence: Synthetic coding sequence
atgtgctccactttgaagaagtgcggaacctacaggacggaagtcgccgagtgccatgatcacggaagcacttttcagggacgaaagaaaggaggcagttcttttagagacaactttgacaaacgctcttgccactacgagcatggcggttatgagcgacccccatcccactgccaagaaaatgatgggtctgtcgagatgcgagatgtacataaggaccagcaattgcgtcacactccgtattcaatacggtgcgagagacgcatgaagtggcacagcgaagatgagatacgtatcaccacctggcgcaatagaaagccccctgaaaggaagatgtcacaaaatacacaggatggttatacccgaaactggttcaaggtgaccattccgtatgggatcaaatatgacaaagcgtggctaatgaattcgatccagtcgcattgtagcgacagatttaccccggttgactttcactacgtccggaaccgcgcttgtttctttgtgcaagatgcaagcgccgctagtgccctcaaagacgtcagctataagatctatgacgacgagaaccagaagatctgcattttcgtcaaccactctaccgccccatatagtgtgaaaaataagcttaagccgggacagatggagatgctgaagttgactatgaacaagcggtataacgtctcccagcaggctttggatctgcagaatctgagattcgaccccgacctgatgggcagggatattgacattatactgaatcgcagaaactgtatggccgcaactctaaagattatcgagcgtaacttccccgagctgttgtcacttaacctgtgcaacaataagctgtaccaactggacggcctatccgacatcaccgaaaaggcgcctaaagtcaagaccctgaacctttcaaagaataaattggagtccgcctgggagctcggtaaggtcaagggtcttaaactggaggagctgtggctcgaggggaaccctctctgctcaacgttctccgatcagagcgcttacgtatccgccatacgcgactgctttccaaaattacttagactagacggccgtgagctctcagctcctgtcatcgtagacatcgattccagtgagacaatgaagccctgtaaggagaatttcacaggctcagagacacttaagcaccttgttttgcagtttttgcagcaatattacagtatttatgactctggggaccggcagggactgcttggcgcataccacgacgaagcatgtttttcgttagccatcccgtttgaccccaaggacagtgcgccttctagtctgtgtaagtatttcgaagactcccgtaacatgaagacactgaaagatccctacctgaaaggggagttactccgccgaacgaagcgggacatagtggattctttatctgctctgcccaagacccaacacgacctgtcctccatcttagtcgacgtgtggtgccagactgagcgcatgctctgctttagcgtgaacggtgtctttaaggaagtagagggccagtcccagggttccgtgcttgcgtttacaaggactttcattgccacccctggttcttcctcttccctgtgtattgtaaatgatgagctgttcgtgagagacgctagcccacaggagacacagtcagctttttccatcccggtctctacactgagctctagtagtgaaccatccttgagccaggaacagcaggagatggtgcaggccttcagtgcccagtccgggatgaagctggagtggtcccagaagtgcctgcaagacaatgagtggaattacacccgcgcagggcaggcttttactatgctccagactgaaggcaaaattccagcggaggccttcaaacagatctcttag

SEQ ID NO: 28908 - DNA, 1881 bp, Artificial Sequence
  Description of Artificial Sequence: Synthetic coding sequence
atgtgttctaccctcaagaaatgcggaacctacaggactgaagttgctgaatgtcacgatcacggaagcactttccaggggcgaaagaaggggggatcgagcttccgtgacaattttgacaagcgtagttgtcactacgaacacggaggatacgagcggcctccaagccactgccaggaaaacgatggaagtgtggagatgagggatgtacataaggatcaacaacttcgccacactccttattcgatccgttgcgaacgccgaatgaagtggcactccgaagatgaaattcggattacaacctggaggaaccgaaaaccccctgaaaggaagatgtcccagaatactcaggacgggtacacccggaattggtttaaagtgacaataccctatggcatcaagtatgacaaagcttggctgatgaattccattcagtcacactgtagcgatcgcttcacccccgtggatttccactatgtgcggaacagagcctgcttcttcgttcaagacgcatctgcagccagcgctctcaaagatgtgtcctacaagatttacgacgatgaaaaccagaaaatctgcatctttgtgaatcactccacagccccttattccgtgaagaataagctgaaaccaggacagatggagatgctgaaactgactatgaataagaggtataatgtgtcacaacaagctcttgacctgcagaatctgcgttttgaccccgacctcatgggcagggacatcgacattatcctgaacaggcggaattgcatggccgctacattaaagattattgaacgcaattttccagagctgctgtctctgaatctgtgcaacaacaagctgtaccagctggacggtctcagcgatatcaccgagaaagctcccaaggtaaaaacactgaacttgtctaagaacaagctggagtctgcctgggagcttgggaaggttaagggccttaagctggaagaactgtggttggagggcaatcccctgtgcagcactttctccgaccagtccgcatatgtaagcgccattagagactgcttcccgaaactactacgcttggatggacgcgagctaagtgctccagtgatcgtggatatagattccagcgaaaccatgaaaccttgcaaagaaaatttcaccggaagcgagactctgaaacacctggtcctccaattcctgcagcagtactatagcatctacgattctggagatcggcagggactgctcggggcataccacgacgaggcatgttttagtttagctataccctttgatccgaaagactcagccccatcctctttgtgtaaatacttcgaagacagtcgcaatatgaagactttaaaggacccatacctgaagggcgaactcctgcggagaaccaagcgtgacatcgtggatagcctgtcagctctgcctaagacacagcacgatctgagcagtatcctggtggatgtttggtgtcagaccgagcggatgctatgtttctcagtcaacggagtgttcaaggaggtggagggccaatcccagggatccgtccttgcttttacacgcacatttatcgcaacgcccggtagcagtagtagtctttgcatcgttaacgacgaattgttcgtaagggatgcttcccctcaggaaactcagagtgctttttcgatccccgtctccaccttgtcctcgtcctctgagccctccctctcccaagaacagcaggagatggttcaggctttttctgctcagagcggaatgaaacttgaatggagtcagaaatgcctccaagataatgagtggaattacacgcgggctggccaagcctttacgatgttgcagaccgagggaaagattcctgcagaagcctttaagcaaatctcatag

SEQ ID NO: 28909 - DNA, 1230 bp, Artificial Sequence
  Description of Artificial Sequence: Synthetic coding sequence
atgaagtggcactccgaagacgaaatccgtattaccacatggcgcaataggaaaccgcctgagagaaagatgtcccaaaacactcaagacggttacactcggaactggtttaaggtcactattccatatgggattaaatacgataaagcttggctgatgaactccatacagtcacactgtagcgataggtttacccccgtggatttccactacgtaagaaatagggcatgctttttcgtgcaggacgcgagtgcagcgtctgcactgaaagatgtttcatacaagatttacgatgatgagaatcagaaaatctgcatctttgtgaaccattctacggccccatacagcgtgaaaaataaactgaagccaggtcagatggaaatgctcaaactcactatgaacaagagatacaatgtgtcccagcaggcgctggacctgcagaatctaaggttcgatccggatctgatggggagggacattgatatcattttaaatcggcgaaactgcatggccgctacattaaagatcattgagcgcaattttccggagttgttgagcctgaacctctgtaataataagctctatcagctcgatggcttgtccgacattacagagaaagcgccaaaagttaagacactcaacttatccaagaacaaactggagtctgcttgggaactgggcaaagtcaaaggcctcaagttagaggagctgtggctggaaggtaacccactctgctccacattttccgaccagagcgcctatgtcagcgcaatcagagattgctttccaaaactgctgaggctcgacggacgtgagcttagcgccccagtgatcgtggatattgactcttctgaaacgatgaaaccttgcaaagagaatttcacaggttccgaaacccttaagcacttggttttgcaatttctgcaacagtactatagcatttacgactccggtgatcgacagggcttgcttggtgcctaccacgacgaggcatgtttctcccttgcaatcccattcgatcctaaagacagcgctccctcgtctctttgtaagtactttgaggatagcaggaatatgaaaactctcaaagacccttatctcaaaggggagctcctgaggcgtacaaagagagatatcgtcgactccctgtcggctttgcctaagactcaacatgatctctcctcgatcctggttgatgtgtggtgccaaaccgttccaagtgggcagtag

SEQ ID NO: 28910 - DNA, 1326 bp, Artificial Sequence
  Description of Artificial Sequence: Synthetic coding sequence
atggcctcggtggccgcagctcgtgcggtgcccgtcggaagtgggttgcggggtctgcaacgcaccttgccacttgtagtcattctcggcgctactgggacggggaagagcactcttgcattacagctcgggcagcgcttgggaggagagattgtgtccgctgatagcatgcaagtgtatgaaggactagacataattacaaacaaagtgagcgcccaggaacagcggatctgccggcatcacatgatttcctttgtagaccctctcgtcactaattacacagtggttgactttcgtaacagggctaccgcactcattgaagatattttcgccagagacaaaatccccatagtcgttggaggcaccaactactacattgagagtctcctgtggaaggtgctagtgaacacaaagccccaggaaatgggcacagagaaggtgatcgaccgtaaggtggagcttgagaaggaggacgggctcgtgctgcataaaagactgagtcaggtggacccggaaatggctgcaaaactgcatccgcacgataaacgcaaagtcgcccgaagcctccaggtgttcgaagagacaggtatctctcattctgagttcctccacaggcagcacacggaagagggtgggggtccactggggggtcctctgaagttttcgaacccgtgcattttatggttgcacgccgaccaggccgtgctggatgaaaggctcgacaaacgagtagatgatatgctggcagctggactcctcgaagaactgcgggacttccacagacgctataaccagaaaaacgtcagcgaaaattctcaggactaccagcacggcatcttccaaagtatcgggtttaaggagtttcacgaataccttatcactgaaggcaagtgcacactcgagacttccaatcagctgctgaaaaaggggcctggcccaatcgtccccccagtctatggactcgaggtctccgacgtttccaaatgggaggaatccgtacttgagcctgccttggagatcgtgcagtcgtttatccagggccacaaaccgaccgctaccccaataaaaatgccttacaatgaggcggaaaataagcgatcctatcacctgtgtgacttatgcgaccgtatcattattggtgacagagagtgggccgctcacatcaaaagtaaatcccatttgaaccaactgaagaaaagacggaggttggacagcgatgctgtgaacaccatcgagtcgcagtccgtatctcctgatcacaataaggaaccaaaggagaagggcagccctgggcagaacgaccaagaactcaagtgttcggtatag

SEQ ID NO: 28911 - DNA, 1158 bp, Artificial Sequence
  Description of Artificial Sequence: Synthetic coding sequence
atggccagcgtcgcagccgcaagggccgtaccagtgggtagcggcctgcgaggactccagcgcactttacctcttgttgtgatcttgggcgcaacaggtaccggtaagagcacgctggccctgcagttgggtcagaggttgggcggagaaatcgtttctgccgacagcatgcagcctcaagaaatgggtacagaaaaggtgatcgaccgcaaggttgaattggagaaggaggatggactggtccttcataaacgactgtctcaggtagatcccgaaatggcagccaaactgcacccccacgacaagcgcaaagtggctcgatccctgcaagtgtttgaggagaccggaatttcacatagtgagtttctgcaccgtcagcataccgaggagggtggcggtcccctcggaggtcccctaaagttttcaaatccttgcattctctggctacacgctgatcaagctgacgagcggctcgacaagagagtagatgatatgttagccgcaggtctcttagaagagctccgcgattttcaccgcaggtacaaccagaaaaacgtgtccgaaaattctcaggattatcagcacggcattttccagtccatcggctttaaggagttccatgagtacctcatcactgaaggcaagtgcacccttgagacgagcaaccagctactgaaaaaagggatagaggctctgaagcaggttaccaaacgttatgctcgcaagcagaacaggtgggtgaagaatcgcttcctgtcaagacctgggcctatcgtcccaccagtgtatggtctcgaagttagcgatgtatcaaaatgggaggagtctgtgctcgagccagctcttgagattgtgcagtcctttatccagggacataagcctacagctacgcctattaaaatgccttataacgaggctgagaataaacgcagctatcacctgtgtgacctctgtgatcggatcatcatcggggacagggagtgggccgctcacataaagagtaagagtcacctaaatcaactcaagaagagacgaagactggactccgatgctgtgaacacaatagagagtcagtctgttagccctgatcacaataaagagcctaaagaaaaggggagtccagggcagaatgatcaggaattgaagtgcagcgtgtag

SEQ ID NO: 28912 - DNA, 987 bp, Artificial Sequence
  Description of Artificial Sequence: Synthetic coding sequence
atgaaaaggcccaaggagccaagtggcagtgatggcgagagcgacggccctatcgatgtgggccaggagggacaattgtcacaaatggccaggcccctaagtacacccagctcctcacaaatgcaggcgaggaagaaacacagggggattatcgaaaaaagacgacgggatcgcattaactcctcgctatcagagctgcgcaggctggtcccaacagctttcgaaaagcagggatccagcaaactggagaaggcagaggtcctacagatgacagtggaccacctcaaaatgctacatgcaaccggcggaaccggattttttgatgcaagggctttggccgtggatttcagatcgattggctttcgtgagtgtctgactgaggtaataagatacctaggggtgttagaagggccttctagcagggccgatccagtcagaatccgactgctgagtcacctgaattcttacgctgctgagatggaaccctcaccaacacccactgggcctctcgcattccctgcctggccttggagcttcttccatagttgcccaggtcttcccgcattgtctaaccaactcgcaattcttggcagggtcccatccccggtgctgccaggtgtatcctctccagcttaccctataccagctctgagaacggccccactgaggagggcaacagggatcattctccccgctaggcgcaacgtcctcccctcacggggagcatctagtactcggagagcacgtcctctcgaacggccagccacccctgtccccgtggctccgagttcgcgagcagctcgctctagccacattgcacctctactccaatcctcctcgcctaccccaccgggaccaaccggatctgccgcatacgtggcagtgccgacaccaaatagctcctcacccggtcctgccggacgccctgcaggggctatgctgtaccattcctgggttagtgaaattaccgagataggagctttttag

SEQ ID NO: 28913 - DNA, 2262 bp, Artificial Sequence
  Description of Artificial Sequence: Synthetic coding sequence
atggagacctttgaacctatctcacaagaacccctgtcgcaggcgtcttacgataaggcaccggacccagtaccagaactgcaggattcgttctatgcagaattgcagagggccgaatctctccaggagaaatctatcaaggaggccaagaccaagtgtagaaccatcgccagcctgctgaccgccgctcccaaccctcattccaaaggagtcttgatgttcaaaaagcggaggcagcgagccaagaaatatacactcgtgagcttcggcgcagctgccggaactggcgctgaagaagaggacggcgtgccaccaactagcgagtcggagttagacgaggaggccttctccgatgcacgctccttaaccaaccagtccgattgggacagcccatacctcgatatggagctagcacgcgcaggcagccgggctagcgaaggccagggcagcgggttgggcggacagttatcagaagtatccgggcgaggcgtgcagctgtttgagcaacagaggcaacgggctgactcgtcgacacaagaactcgcccgtgtcgaacccgctgcaatgctgaacggcgagggactgcaatcccctcccagggcccaaagcgccccacccgaggcggctgtgctgcctccctcgcccctccccgctcccgttgcctctcctcgtccattccaacccggagggggtgcacccacccccgcaccctctatctttaaccggtcagcgcgaccttttacacctggcctgcagggccagagacccaccaccacatccgtgattttccggcctctggcaccaaagcgggcaaacgattctctgggaggtctgtcccccgctcctcctcctttcttgagctctcaggggcctactcctctgcccagcttcacatctggcgtcccctcccacgccccagtatcgggaagcccgtctactccacgatcatctgggcctgttaccgcgacttcaagcctgtacatccccgcaccaagccgccctgtaacaccaggaggggctccggagccaccagctccaccttccgcagccgcaatgacttcaaccgcgagtatatttcttagcgcccctctcaggccttcagctcggcctgaggcccctgctcctggtccgggtgcccctgagccacctagcgcccgagaacaacggatatccgtgcccgcagccagaaccggcattttacaggaggctcgccgaagaggcacacgcaagcagatgttccgcccaggcaaggaggagacaaagaattccccaaacccagagctgcttagtctggtccagaatctcgacgagaagcctagggctgggggagccgagagtggtccagaggaagatgccttgtccttaggcgctgaggcttgcaactttatgcagcccgtgggggctaggtcctacaaaactctgccacacgtgaccccaaagacaccgcctcctatggccccaaaaacgccgcctccaatgacccccaagactcctcccccagtagcacctaaaccaccctctcgcggactgctggacggactggtgaatggagccgcatcgagtgctggtatccctgagccccctcgcctgcagggcagaggaggagaactgttcgcgaagaggcaatctcgggcagataggtacgtggtggagggcacaccgggtcctgggttgggccctagaccacgatctcccagccccacacctagcttgccacccagctggaagtacagtcccaacatccgggctccccctcccatcgcttataacccattgctgtcgccattctttccacaggccgctcgtacactgcccaaggcacaatcccagggccctagggctacgccaaaacaggggattaaggctctggacttcatgaggcaccagccgtatcaactcaagaccgcaatgttctgtttcgacgaggtgcctccaacaccgggaccaatagccagtgggtctcctaagactgccagggtgcaggagatccgaaggtttagcacccccgcaccccaacccactgctgagcctcttgcaccaacggtgctggctcctcgggctgctacgactctggacgagccaatctggcgtactgaactggcgagcgccccagtaccctcgcctgcaccacccccagaggcaccccgagggctcggcgcatctccctcatcttgcggtttccaggtggctaggcctagattttctgccaccagaactggattgcaagctcatgtgtggcggcctggcgcaggtcaccagtag

SEQ ID NO: 28914 - DNA, 1041 bp, Artificial Sequence
  Description of Artificial Sequence: Synthetic coding sequence
atggagtccgtgagctgcagcgcagctgcagttcgcaccggcgacatggagtcccaacgggacctgtcattagtgcccgaacggctccaaagacgcgaacaggagcgtcaactcgaggttgaacggagaaagcagaaaaggcagaatcaggaggtggaaaaagagaatagtcactttttcgtagcaacattcgtcagagagcgtgctgcagtggaagaactccttgagcgcgcagagtctgtggagagattggaagaggccgctagtcgcctgcaaggactgcaaaaactcattaatgattcggttttctttcttgccgcttatgacctgcgccagggccaggaggccctagcccgattacaggccgcactggccgagagaaggaggggcttacaaccgaagaagagattcgcctttaagactcgcggtaaggacgccgcatcatccactaaggttgatgcggctcctggaattcccccagccgtggagtctatccaggattcacccctgcctaaaaaagctgaaggagatctcggtccgtcatgggtctgtggtttcagcaacctcgagtcacaagtcctggaaaaaagagcttccgagctgcatcagagggatgtactcttaacagaattaagcaattgtaccgtccggctgtatgggaatccaaatacgcttcggcttacaaaggcccactcatgcaagctgctgtgcgggccagtctctaccagtgtcttccttgaggattgcagcgattgcgtgttggccgtggcctgccaacagctgagaatccatagtactaaggacacccgcatattcctccaggtgacttcaagagcaatagtggaagattgctctggaattcaattcgccccttatacgtggtcatatccggagattgacaaggatttcgaatcatccggactcgataggagtaaaaataattggaatgacgtcgacgatttcaattggttggccagagacatggcttctcccaactggtctatcctgccggaggaggaacggaatatccaatgggattag

SEQ ID NO: 28915 - DNA, 1569 bp, Artificial Sequence
  Description of Artificial Sequence: Synthetic coding sequence
atgtcaccgcagaaacgcgtcaagaatgtccaagcccaaaacagaacttcacagggctctagttcgtttcagaccaccctctctgcatggaaggtcaagcaagatccctcaaacagcaaaaacatttctaaacacggtcagaacaacccggtcggtgactatgagcacgccgatgaccaagcagaggaagatgcattgcaaatggcggtcggatatttcgaaaaagggcctattaaagcatcccaaaacaaggacaagaccctggagaagcacttgaagaccgtcgagaatgtcgcctggaagaatggactggcatctgaagagattgacattctgctaaacattgctctttcaggaaaattcggaaatgcagtaaacacccgaatcttaaagtgtatgattcccgctactgtgattagcgaagacagcgtggtgaaagcagtgagctggctgtgcgttggcaagtgtagcggtagcactaaggtgctcttttaccgatggcttgtggcaatgtttgattttatcgataggaaggagcaaataaatttgctgtatgggttcttcttcgcatccctgcaggacgacgcgctttgtccctacgtgtgccatcttttatatctgttgacaaagaaagagaacgttaaaccgttcagggtgaggaagctgctggacctccaggcaaaaatggggatgcagccgcacctacaggctctactttcactctacaagttcttcgccccagccctgatatctgtctccctccccgtcagaaagaaaatctatttcaagaatagcgaaaacctatggaagaccgctctgcttgccgtgaagcagcgcaatcgcggtccaagtcctgagccactcaaactgatgttagggcctgccaacgtgcgcccactgaaacgcaagtggaattcactaagcgtgatccctgtcctgaattcatccagctatacaaaagagtgtggaaaaaaggagatgtcactttcagactgtttgaataggtccgggagtttcccactggagcaattgcagtccttcccccagctcctgcaaaatatccactgtcttgagctcccgtcacagatgggtagcgtgctgaacaactctctgctccttcactacatcaactgcgttagggacgaacctgttctactaagattctactactggctttcacaaaccctacaagaggagtgcatttggtacaaggtgaataattatgagcacggaaaggaatttaccaacttcctcgatactatcatccgagcggagtgctttctgcaggaggggttctactcttgtgaagcattcctctacaagtctctgcccctctgggatggcttatgttgcagaagccaattcttacaactggtgagctggataccattcagcagcttctcggaagtgaaacctttactctttgaccacctggcgcagctgttcttcacatctaccatttatttcaagtgtagcgtgctccagagcctgaaggaactcttgcaaaattggcttttgtggctgagcatggacattcatatgaagccagtcacgaattcccctctgtag

SEQ ID NO: 28916 - DNA, 2271 bp, Artificial Sequence
  Description of Artificial Sequence: Synthetic coding sequence
atgtctccccagaagcgcgtgaaaaacgttcaagcacagaatagaacctcgcagggcagctctagctttcagaccacactgagcgcttggaaagtgaaacaggatccctccaactcgaaaaatatctccaagcatggccagaacaatccagtgggagattatgaacacgcagatgaccaagccgaggaggatgcactgcagatggcagtcgggtacttcgaaaaagggcctatcaaggcttcccagaataaggataaaaccctggaaaagcatttaaaaactgttgagaatgtggcctggaagaatggtttggcatccgaagagattgatattttgcttaacatagccctgtctggcaagttcggaaatgctgttaacacgcgtattttaaaatgtatgatcccagcgaccgtgatcagtgaagatagcgtggtgaaagctgtatcctggctttgcgtgggcaagtgttccgggtcaactaaggtcctgttctatcggtggctggtggctatgtttgatttcatcgatcgtaaggaacagatcaaccttctttacggttttttctttgcaagtctgcaggacgatgcactgtgcccctatgtgtgtcacctgctgtacctactgaccaagaaagaaaacgtgaagccctttcgtgtacgaaaacttctagacttgcaggctaagatgggtatgcaaccccatctccaagccctactgagcctttacaagtttttcgctcccgcactgattagtgtttctctccctgtgagaaagaagatctattttaagaacagtgagaacctgtggaagacagctttgcttgccgtcaaacagaggaaccggggaccaagtccagaacctctgaagctgatgcttgggccagccaacgtgcgccctctgaaacgaaaatggaatagcctgtccgtgattccagtgctcaactccagttcctatactaaggagtgcgggaaaaaagagatgtctttatccgactgtctgaaccgctccggcagttttccgctggaacagctacagtcttttcctcagctcctgcagaatatccactgtttagagttgcccagccagatggggtctgtcttaaacaatagccttctgctacattacatcaattgtgttcgggacgagcccgtgctgctcaggttctattactggctgtctcaaacactccaggaggaatgtatctggtacaaagtgaacaattacgagcatggaaaggagttcacaaacttcttggatacaattatcagagcagagtgcttcctgcaggaggggttctactcctgcgaggcttttctgtacaaatcactgccactgtgggatgggctatgctgccgtagtcagttcctgcagcttgtcagctggattccatttagcagcttttccgaggtcaagccacttttgttcgatcatttggctcagctgttctttacgagcactatctacttcaaatgctcagtccttcagtctctgaaggaactattgcagaattggctgttgtggctgagcatggacattcacatgaaaccagtgacgaactccccactggaaactaccctcggaggctctatgaattcagtgagtaaactgattcactacgtaggctggctcagtacaacagctatgaggctagaatcaaacaacacattcctgctgcacttcatactggatttctatgagaaggtttgcgacatttacatcaactacaatctaccactcgtggtgctattccctccaggaatattttacagtgccctgctcagtttggacacatcgattcttaatcaactttgcttcatcatgcaccggtacaggaaaaatctgaccgccgctaagaaaaatgaactagttcagaagacaaagagcgagttcaatttctcctcaaagacataccaggagttcaaccattacctgacctctatggttgggtgcttgtggacaagcaagccgtttgggaagggtatttacattgaccctgaaattttggagaagaccggggttgcagagtacaagaactctctgaatgttgtgcaccatccaagctttctgtcgtacgcagtgtctttccttctccaggaatcacctgaggagcggacggtgaatgtaagctccatacgcggtaagaagtggtcctggtatctcgactatttattcagtcagggactgcagggtctgaaactgttcattcgttcttctgtacaccattcctccatcccccgagccgaggggatcaattgtaacaaccagtattag

SEQ ID NO: 28917 - DNA, 933 bp, Artificial Sequence
  Description of Artificial Sequence: Synthetic coding sequence
atggctgatgcagcggctactgcaggagccggtggctcagggacacgatctgggagcaaacaatcaaccaacccagcagacaattatcacctggcaaggagaagaaccctgcaggtggtggtctctagtcttctcacagaagccggattcgaaagcgctgaaaaggccagcgtcgagacactgacagaaatgctacagagctacatctctgagattggcaggagtgcaaaaagctactgcgaacacacagcccgtacccagcccactttaagcgacatagtcgtgacattggtagagatgggattcaatgtagataccctccctgcatacgcaaagcgatcgcagaggatggttattactgcgcctccagtaactaaccagcccgtcactcccaaggcactgactgcgggtcagaaccgacctcaccctccccatattccttcacacttccccgagtttcctgatccccatacatatatcaagacacctacttacagagagcccgtctcagattatcaagtgctgagagaaaaagctgccagccagcggagagatgttgagcgagcacttacccgcttcatggctaagaccggcgaaactcagtcactatttaaagatgatgtgtcaacattcccacttatcgctgctcgtccatttacaatcccttacctcacagcactgctgccatcagagctagagatgcagcagatggaggagactgattcctccgagcaggatgagcagactgatacagagaacctcgcgctgcatatttccatggaggattccggggctgaaaaggagaatactagcgtgcttcagcagaatcccagcctaagcggctctagaaatggtgaggagaacatcattgacaacccctacctaagaccagttaagaagccaaaaatccggaggaagaagagcctcagttag

SEQ ID NO: 28918 - DNA, 1935 bp, Artificial Sequence
  Description of Artificial Sequence: Synthetic coding sequence
atggaagagaccatgaaattggcaacaatggaagatactgtcgagtactgcttgtttctgataccagacgagtcccgtgatagtgacaagcacaaggagatcttgcagaagtacatcgagcgcattattacccgctttgccccaatgctggtgccatatatctggcaaaatcagccctttaacctgaagtataaacctggcaagggtggggttcctgcccatatgtttggtgtgactaagttcggcgacaacatagaagatgaatggttcatagtgtatgtaatcaaacagatcaccaaagagtttcctgagctcgtcgctcgaatcgaagacaacgacggcgaattcctccttattgaagccgcagattttctcccaaagtggttggacccagagaattctacaaatagagtattcttttgccacggggagttatgcatcatccccgctcctagaaagagtggcgctgagagctggctgcccactaccccgccaaccatccctcaagctctgaatattattacggcacactccgagaagatcctggcttccgagtcaatcagggcagccgtgaacaggagaattagagggtatccagagaaaatacaggcatccctacacagggctcattgctttctgccagcaggtatagttgctgtgcttaagcagcgccctcgattggtggcagcagccgtgcaggccttctacctcagggacccaatagacttgagagcctgtcgggtgtttaagaccttccttcccgagacccgcatcatgacctctgtgaccttcacaaagtgcctgtatgctcaactggtccaacagaggtttgtgccagatcggaggtctggataccggcttcctcccccatccgatccccagtaccgtgcccatgagctcggaatgaagttagcccacggctttgagatcctgtgttcaaaatgctcgccacacttctctgattgtaaaaagtccctggttaccgcatcacctctgtgggccagttttcttgagagcctaaagaaaaatgattattttaagggactcatcgaaggatctgctcagtatagggaaaggctggaaatggcagagaattatttccagctctccgtggactggcccgagtcatctctggcgatgagtccaggagaagaaatcctcacattgctgcagaccatcccgtttgatattgaggatctgaaaaaggaagctgccaacctcccacccgaggacgacgatcagtggctcgatctcagtcccgaccagctcgatcagcttctgcaagaggccgttggtaaaaaggaatccgagtccgtcagtaaggaggaaaaggagcagaactacgatctgacggaagtgtccgagtctatgaaagccttcatctcgaaagtttccacacacaaaggggctgagctgccacgcgagccgtctgaagcacccattaccttcgacgcggactcttttcttaattacttcgacaaaattctcggcccaagaccaaacgagtccgacagcgacgatttagacgacgaggactttgagtgcctagattccgatgatgaccttgatttcgagacacacgagcctggggaggaggcttcgctcaaaggcacactggataatctgaaatcatacatggctcagatggatcaggagcttgcacatacatgtattagcaaatcattcacgactagaaaccaggtggaacccgtctcacagaccactgacaacaatagcgatgaagaggacagtggcaccggcgagtccgtaatggccccagtggacgtcgatctgaatctggtctccaatattctggaaagttattctagccaggccggactggccggtccagcgagtaacctcctgcagagcatgggcgtgcagctgcccgataataccgaccaccggcctacaagtaagcccacaaagaactag

SEQ ID NO: 28919 - DNA, 2163 bp, Artificial Sequence
  Description of Artificial Sequence: Synthetic coding sequence
atgagcgtctcaggcaagaaggagtttgacgtaaagcagattcttcggttgaggtggcgatggttttcgcacccattccaaggatcaaccaatacggggagctgtttacaacaggagggctatgagcatcgtggcaccccagtccaaggaaggctgaagtcccattcccgcgatcggaatggtttaaagaaatccaacagtccagtacaccacaatatactagcccctgttcccggacctgctccggctcaccagcgagcagtgcaaaatcttcagcagcacaaccttatcgtgcactttcaggccaatgaggacactccaaagtccgtccctgagaaaaacctctttaaagaagcctgcgaaaagagggcccaggatttggagatgatggcagacgataatattgaagactcaaccgcccgattggacacacagcacagcgaggatatgaacgctacccggtccgaagagcagtttcacgttatcaatcacgcagagcagactttgcgcaaaatggagaactaccttaaggagaaacagctgtgcgatgttctgctgattgcgggtcatctccggattccagcccatcgattggttttgtctgccgtcagcgactactttgctgcaatgttcacgaacgacgtgctagaggcaaagcaagaggaagtcagaatggaaggagtcgatccaaacgcgttgaattcactggttcagtacgcatacacaggcgtcctgcagctcaaggaggatacaatcgaatcgctactcgccgctgcctgtctgctgcagcttacccaagtgatcgatgtttgctcaaatttccttataaagcagctgcatccatccaattgtctaggcatccggagttttggggatgctcagggctgtacagaactgctaaatgttgcccacaaatatactatggaacacttcatcgaagtgataaaaaatcaagaatttctattgctgcccgctaacgaaatctccaaactactttgttccgatgacataaacgtacccgatgaagaaacgatctttcacgctctgatgcaatgggtgggccatgatgtgcagaatcgacagggggaactgggtatgcttttgagctacatcagactgccactgttgccaccgcagctgttggctgaccttgaaaccagttccatgttcacaggcgatctagagtgccaaaagcttctcatggaagcaatgaagtatcacctgctgccggaaagaaggtctatgatgcagagcccaaggaccaaacctcgaaaatccacagtcggtgctctgtacgccgtaggcggaatggacgccatgaaagggaccacgaccatcgagaagtacgacctccgcaccaattcctggctgcacattggtaccatgaacggacgccgtctgcaattcggcgtcgccgttattgacaacaagctttacgtcgttggtggcagggatggacttaaaacactcaacaccgtggagtgctttaaccccgtgggaaaaatttggacagtcatgccaccgatgagtacccatagacacggcttaggtgtagccaccctggagggcccaatgtatgccgtcggtggtcatgacggctggagttatctgaacacagtggaacgatgggatcctgagggccgacagtggaactacgtcgcttcaatgtctactcctcgttctacagttggcgtggtggcgctaaacaataaactgtatgcgatcggagggagagatggcagcagctgtctgaaatctatggagtacttcgacccccacactaataagtggagtctgtgtgcaccgatgtccaaacgcagaggtggcgtgggcgtggccacttataacggctttttatatgttgttggcggtcatgatgctcctgcctcaaaccactgttcacggttgtcagattgcgtggaaagatacgacccgaagggagattcttggagcaccgttgccccactctctgtgccacgcgacgccgtcgcagtgtgccctctgggcgataagttatacgtagtaggtggatacgatggccacacttacctgaacaccgtggaatcgtacgatgcccagcgaaatgaatggaaagaaagtatgcaggagctccttcaaaatttctacaccacacagaagttaaaggagaccttaggccattag

SEQ ID NO: 28920 - DNA, 2157 bp, Artificial Sequence
  Description of Artificial Sequence: Synthetic coding sequence
atgtctgtcagtgggaaaaaggaatttgacgtgaaacaaatactgaggctcagatggaggtggttcagccatccatttcagggcagcaccaacacaggaagttgtctgcagcaggagggatacgagcaccgagggacacccgtgcagggcagactcaaatcacattcgagagatcgcaatggactaaagaaaagcaactcgcccgtacaccataacatacttgcaccagtccccggacccgctcctgctcatcaaagggccgttcagaacttgcagcaacataacctgatagtgcattttcaagccaatgaagacactcctaaaagcgtacctgagaagaacctgtttaaggaagcttgtgagaagcgggctcaagatctggagatgatggccgatgataatattgaagactccaccgcacggctagatacacagcactctgaggacatgaatgctactcggtctgaagagcaattccatgtcattaaccacgcagaacagacactgcgaaagatggaaaactaccttaaagagaagcagctctgtgacgttctcttaatcgcaggacatctccgcatacccgctcataggctggtgctttctgcggtcagtgattactttgctgccatgttcacgaacgatgtactggaagccaaacaagaagaggttcgaatggagggagtagacccaaacgctctcaatagcctggtccagtacgcatacacgggggttctgcagctgaaagaagacactattgaatctctcctcgcagccgcttgtctgctccaactcacccaggttattgatgtgtgtagcaacttcctgattaagcagctgcatccgagcaactgcctaggcatcagaagtttcggagacgcgcaagggtgtactgaattgctgaacgtggcccacaagtatactatggaacatttcatcgaagttatcaagaatcaggagtttctgctcctgccagcaaatgagatatctaaactgctgtgttctgacgacatcaatgttccagacgaagagacaatatttcatgccctaatgcaatgggtcggacatgatgtgcagaatcgtcaaggcgaattgggaatgttactctcctacatccggctaccactgctgcccccacagctgctggcggatctcgaaacaagctccatgttcacaggcgatctggagtgtcaaaaactgttgatggaggcaatgaagtatcacttactgccagaacgtcgcagcatgatgcagtccccaaggacaaaaccaaggaaatccacagtgggagcactgtacgctgtgggtggcatggacgccatgaaggggaccaccactattgagaagtatgatttacgtaccaactcctggcttcatatcggtaccatgaacggccgacggctccagtttggtgtggcagtcattgacaacaaactctatgtggtcggtggtagggatggcctgaaaaccctgaacacagtcgagtgttttaaccccgtgggtaagatttggaccgtgatgccaccaatgtcaactcaccgtcatggcttaggggtagccacattggaagggcctatgtatgcggtaggtggccacgatggttggagttacctgaatacagtggaacgttgggacccagagggacgccaatggaactatgtagccagcatgtcaactcccagatcaactgtgggcgtagttgctctcaacaacaaattgtatgccatagggggacgtgacggttcatcatgtctcaagtccatggagtattttgatccacacacaaacaaatggagcctgtgcgctccaatgtctaaacgtaggggtggggttggagttgctacttataacggattcctgtacgtcgtgggagggcacgacgcccctgctagtaaccactgcagtcgattgtccgactgcgtggaaaggtacgaccccaaaggtgacagttggagcacagttgctcccctgagcgtgccacgagacgccgttgcggtctgtcctttgggggataagctctacgtggtgggtggctatgatggacatacataccttaacacagtggagtcatacgacgcccagcgcaatgaatggaaagaggaagtgcccgtgaacataggtagagctggagcctgcgtcgttgtagtgaagctaccctag

SEQ ID NO: 28921 - DNA, 1134 bp, Artificial Sequence
  Description of Artificial Sequence: Synthetic coding sequence
atgaacggaccagtctcacccaagtccaaagccaggccatcttctcccagcaccagctggcataggcctgcctcaccctgtccttcacccggacccggtcacactttgcccccaaagccacctagccccagagggaccaccgcctccccaaaaggtcgggttaggcgcaaggaggaggctaaagaatccccgagtgccgctggtccagaagacaaatctcagagcaagagacgagccagcaacgaaaaggaaagcgccgcacctgcgtctcctgctccttctcctgcaccttcacccacacccgctccccctcagaaagaacagcctcccgcagagactccaacagcccctgcgccacctgtcacaccaagtaaacccatggcgggtactacagaccgagaggaggctactcggctgcttgccgaaaagaggaggcaggcaagagagcaacgcgagagggaagaacaagagcggagactgcaggccgagcgtgataagcgcatgcgcgaagagcagctggcaagagaggctgaggctcgcgcagagagagaagccgaagcacggcgtagagaggagcaggaagctagggaaaaagcacaggctgagcaagaagagcaggagcgcttgcagaagcagaaagaagaagcagaggcccgttcccgagaggaggcagagaggcagcgcctcgagcgcgaaaagcatttccagcagcaagaacaggagaggcaggagagacgaaaaagactcgaggagatcatgaagcggaccaggaaatccgaagtgtccgagaccaagaaacaggattctaaagaagcaaacgcaaacggctcttcccctgaaccagtgaaggctgtggaggccagatctcccggactgcaaaaggaagctgtgcagaaggaggagcccatcccccaagagccccagtggagtctaccgtccaaagagctcccagcttctcttgttaacggccttcagcccctaccagctcaccaggaaaacggcttctcaacaaatggtcccagcggagacaagagcctgagccggacccctgaaacacttctccccttcgccgaagccgaggcatttctgaaaaaagccgtcgtccagagcccccaggtgaccgaagtgctttag

SEQ ID NO: 28922 - DNA, 2427 bp, Artificial Sequence
  Description of Artificial Sequence: Synthetic coding sequence
atggagtccgggcctagggcggagctcggcgcaggagccccacccgctgtggttgctagaacacctcctgagccaagaccctctcctgagggcgatccttcgccgccaccgccacctatgagcgccctcgtacctgatacacctccagacacaccccctgccatgaagaacgccactagcagtaagcagcttccactggaacctgagagccccagtgggcaggttggaccgagacctgcaccaccccaggaagaaagccccagctctgaggcgaaaagccgaggacctacccccccagccatgggtcccagggacgcgaggccccctagacggtcttctcagccatctcctaccgctgtccctgcaagtgattccccacctacaaaacaggaggtgaaaaaggccggtgaacgccacaaactggcgaaagaaaggcgcgaagagagagcaaagtacctggctgctaagaaagctgtgtggcttgaaaaggaggaaaaagccaaggccttaagagagaaacagctgcaggagagacgccgtcgactagaggagcagcgccttaaagcagagcaacggagagcggcactggaggagagacagcgacagaaactggagaaaaataaggaaagatatgaagccgctattcagcgatccgtcaagaaaacatgggctgaaatccgacagcaaaggtggagctgggccggagcactacatcattcctccccaggccataaaacatcaggtagcagatgtagtgtgagtgccgtaaacctcccaaagcatgttgatagtatcattaacaaacgtttgtcaaaaagcagcgccactttatggaattcaccttcccggaatcgctccctacaactgagtgcttgggaaagctccattgtcgacagattgatgacacctacactttctttcctcgcacggtcccggagcgccgttactttacccagaaacgggagagatcaagccgtacccgtgtgtcctcgcagtgcatccgccagtcctctgacaccatgtagcgtgacacgaagtgttcaccgttgcgcacccgctggggaacggggagagaggaggaagcccaatgctggaggcagtcctgcccctgtgagacggcgtcccgaagcaagccccgtccagaagaaagagaagaaagataaagagagagagaacgagaaggaaaaaagtgctttagcacgggagagatcgctaaaaaaacggcagtcgctgcctgcgagccctcgcgctcgtctttcagcttcaacggcctcagagctctctcctaagtctaaggccaggccttcctcccctagcacaagctggcatcgcccagccagtccttgcccgtcaccaggacccggacacaccttgcccccaaagccgccaagtcctcgcggaacgacagcttctccgaagggtcgcgtgcggaggaaagaggaagcgaaggaaagtccaagtgccgctggtcccgaggataaatcccagtctaagcgcagggcctcaaacgaaaaggaatctgctgctccggcaagccctgccccttcccctgcaccgtcaccaacacccgctcctccgcagaaggagcagcctcctgctgaaacccccacagatgccgctgtactgacctctcctcccgctcctgcaccacccgtgaccccctcaaaacctatggcgggaacaaccgatcgggaagaggctacaaggttgcttgccgagaagcgacgacaggctagagagcaacgcgaacgggaagagcaggagcgccgtttacaggctgagagggacaaaagaatgcgggaggaacagctggcccgtgaggcagaggcgagagccgaaagggaagcggaggccaggcgaagggaggagcaggaggcccgagagaaggcccaggcagaacaggaagagcaagagcgccttcaaaaacaaaaggaagaggctgaagcccgatctcgcgaggaggccgagcggcaaaggctcgagcgggaaaaacactttcagcaacaggaacaggagagacaggagagacgcaaaagactagaggaaatcatgaaaagaacccgaaagtctgaagtcagcgagaccaagaagcaagatagcaaggaggcgaacgcgaatgggagctcaccagaacccgttaaagcagtcgaggcccgatcacctggcttgcagaaggaggcagtgcagaaggaggaacctattccccaggagccccagtggtccctcccctccaaagaactgccggctagcctggtcaatggccttcagcctttgccagctcaccaagagaacggattttctacaaatggtccatcaggggataaaagtctcagcagaacaccagagaccctgctcccctttgcagaagcagaagctttcctgaaaaaggccgtggtgcaaagcccacaagtcactgaggtcctgtag

SEQ ID NO: 28923 - DNA, 2526 bp, Artificial Sequence
  Description of Artificial Sequence: Synthetic coding sequence
atggaatcgggccctcgtgctgagcttggagctggcgctcccccagccgttgtggccagaacacctccagaacctcgccctagcccagaaggggatccttctcccccacctccccctatgtcggccctggttcccgatactccacccgatacacctccagcaatgaaaaacgccacgagttcaaagcagttgccgctggagccagagtcacccagcggtcaggtagggccaaggccggcacccccacaggaggagtccccaagttccgaggcaaaatcacgtggccctacaccaccagcaatgggccctcgtgacgccaggccacctcgcagatcctcccagccatcaccaaccgccgtgccagcctctgactcccctccaacaaaacaggaggtcaagaaagccggagagcggcacaagcttgctaaggagagaagagaggagcgtgccaaatatctggctgctaaaaaagctgtgtggcttgaaaaagaagagaaggccaaagccctgagagaaaagcagctccaggagagacgcaggagactggaggaacagcggcttaaagccgaacagcggcgagccgcacttgaggaaagacagagacagaaactggagaaaaacaaggagaggtacgaggccgctattcaaaggtcagtcaagaagacatgggcagagattcgccaacagcgttggagctgggccggagcgcttcaccattccagtcctggtcacaaaactagcggatcaaggtgtagcgtgtcggccgtgaacctccctaagcatgtggacagtatcatcaataaaaggctgtcgaagagcagcgctacactgtggaattcaccatcccgcaataggtccctacagctgtcagcatgggaatctagcattgtcgatagactgatgacacccacgctttcctttcttgcacgcagtaggagcgccgtaacgcttccacgcaacggtagagatcaaggacggggatgcgacccaggcaggggccctacctgggggagagccggagcctctcttgctagggggcctcagcccgaccgcacacatccctcagcggctgtacccgtttgcccaagaagtgcctcagcttctccgttaactccatgctcagtcacccggagcgtgcaccgctgcgccccagccggtgagagaggtgagagacgcaaacccaacgccggaggttcccccgcaccagtgaggagacggccagaggcgtcgcccgttcagaaaaaggaaaaaaaagacaaggagagggaaaacgagaaagaaaagagcgccttggcccgagagcggagtctgaaaaagcgccagagtctcccggcaagccctcgggctcgcttgtccgctagcaccgcctctgaactgtcccccaaaagcaaagccaggccaagctccccttcgactagttggcataggccagcttcaccatgcccatcacctggccctggacatactctaccaccaaagccacccagccccaggggtacaacggcctcacctaagggcagggtgaggcggaaggaagaagctaaggaaagtccttctgcagcgggacctgaggataaatctcagagcaagaggagggcctcgaatgagaaggaaagcgcagcccctgcttctccagccccaagtcctgcaccctctcctacaccagccccaccgcagaaggagcagccccctgccgagactccgacagatgccgctgtgttgacaagccctcctgcgcctgcacctccggtcaccccaagcaagccgatggccggtacgaccgatagggaagaggctacccgcctgctggccgagaagcgcaggcaggctcgggaacagagggaacgagaagagcaggagcggagactgcaggctgagcgcgataagcggatgcgtgaggagcagctggcaagagaggccgaagcgagggccgaacgtgaagcagaagcaagacgcagagaagaacaggaggcaagggaaaaagcccaagccgagcaggaggaacaggagagactgcagaaacaaaaggaggaagccgaggctcgctcccgcgaagaggccgagagacagcgattagaaagagagaaacacttccagcagcaagaacaagaacggcaggaaaggcgcaagaggctggaagagattatgaagcgcacacgaaaatcagaagtgagcgaaacgaagcagaaacaagactctaaagaggctaacgctaatggatcaagtcccgaaccagtaaaggctgtagaggccaggtctcccggactccaaaaggaagctgttcaaaaggaggagcccatccctcaggagccccagtggagtctgcccagcaaggagcttccagcttctctagttaatggtttacagcctctaccagcgcaccaggagaatggattctcgacaaacgggcctagcggtgacaaatccttgtctcggacacctgaaactctgctgccgtttgccgaggcggaggccttcctgaagaaggcagttgtacagtctccacaagtgaccgaggtgttatag

SEQ ID NO: 28924 - DNA, 495 bp, Artificial Sequence
  Description of Artificial Sequence: Synthetic coding sequence
aatcttcctaagcacgtggactccatcatcaataagcgccaacggctcgaacgcgagaaacacttccagcagcaagagcaggagagacaggaacgtagaaagcggttagaagagattatgaaaagaactagaaaatccgaggtcagcgagaccaaaaaacaggactcaaaggaagcgaatgccaacggcagctccccagaaccggtgaaagccgtggaggcgcgttcacccggacttcaaaaagaagctgtgcagaaagaagagcccatcccacaggagcctcaatggtctctcccaagtaaagaactgccggcaagcctagtcaacggactgcagcccttgcctgcccaccaggaaaacggcttctcgacaaatggtccctcaggcgacaaatcactcagtaggacacccgaaactcttctgcctttcgcagaggctgaggccttcctgaagaaggcggtagttcagtcaccccaggtgaccgaggttttgtag

SEQ ID NO: 28925 - DNA, 345 bp, Artificial Sequence
  Description of Artificial Sequence: Synthetic coding sequence
atggtgatcagggtctatattgcaagcagctctgggtccaccgccataaaaaaaaagcagcaagacgttctggggttcttagaggcaaacaagattggattcgaagagaaggatatcgctgcaaatgaagagaacagaaagtggatgagagagaacgtcccagaaaattctaggcctgcgacagggtaccctctcccaccacagatttttaacgagagtcaataccgcggtgactatgatgcattcttcgaagccagagaaaataacgcggtttacgcatttctggggctgacggcgccacctgggtccaaagaagccgaggtccaggccaagcaacaggcctag

SEQ ID NO: 28926 - DNA, 537 bp, Artificial Sequence
  Description of Artificial Sequence: Synthetic coding sequence
atgagcggtttctccaccgaagagcgggcagcgccattcagtttggaataccgggtgttcctgaagaacgaaaagggacagtacatcagcccttttcacgatattccaatctacgccgacaaggacgttttccatatggttgtggaagtgccgagatggagtaacgccaaaatggagattgccacaaaggacccactaaacccaataaagcaggatgtgaaaaaggggaagcttagatatgtcgcaaacctgtttccctataaaggatatatttggaactacggcgcaatcccccagacttgggaggatcccggacataatgacaagcacaccggctgctgcggagacaacgacccgattgacgtatgtgagattggctccaaggtgtgcgctagaggggaaatcatcggagtaaaagtcctcggtatactcgctatgatcgatgagggagaaaccgattggaaggtcatcgccatcaacgtggacgatcccgatgcagctaactacaacgtctgcaacagcgtagtgattttgtag

SEQ ID NO: 28927 - DNA, 870 bp, Artificial Sequence
  Description of Artificial Sequence: Synthetic coding sequence
atgagtgggtttagtacagaagagcgggctgctcccttttcgctggagtaccgggtcttcctcaagaatgaaaaaggtcagtacattagtccttttcacgacattcccatctatgctgataaagatgtctttcatatggtggtggaagttccaagatggtcgaatgctaagatggagatagctaccaaggaccctctgaatcctatcaagcaggatgtcaaaaaggggaagcttagatacgttgctaacttattcccctacaagggttatatttggaattacggggcaataccccagacttgggaggaccctggccataacgacaagcatacggggtgttgcggcgataacgatcccattgacgtgtgtgagattggctccaaggtgtgtgccagaggtgagatcatcggcgtaaaagttctcggtatcctggctatgattgatgagggcgaaacagattggaaagtaatcgccatcaatgtggatgatccagacgcagcaaactacaatgacattaacgacgtaaaacgcctgaagcctggatatctcgaagccacagtggactggtttaggaggtataaggtcccagacggcaaacctgaaaatgaatttgcattcaatgccgagttcaaagataaagactttgcaattgatatcattaaaagcacgcatgaccactggaaagcactggtgacaaagaagaccaacggaaaggggattagttgcatgaacaccactctgtccgaatcgccttttaaatgtgatcctgatgctgctagggctattgtggatgctcttcccccaccctgcgaatctgcctgcaccgtgccgacagatgttgataagtggttccaccatcagaaaaattag

SEQ ID NO: 28928 - DNA, 2103 bp, Artificial Sequence
  Description of Artificial Sequence: Synthetic coding sequence
atgactgagagatgctcactctggtccgcgttgtccgctgccgcttgctgtttctatcgaggctctttcgttcagttctcgaaggaaaaatatattttggactcatctcctgagaaacttcataaagagctcgaggaggaactcaagctctccagtacagacctgcgctcgcacgcatggtatcatgggcgtataccaagggaagtgagtgaaactcttgtgcagaggaacggagattttttgatccgagattctcttacatctctgggcgactacgttctaacttgccgctggcggaatcaagcccttcattttaagatcaataaagtcgtcgtcaaagcgggagagagttatacccacatccaatatttgtttgaacaagagagtttcgaccatgttccagctttggtgcgctaccacgtggggtctagaaaggccgtctctgaacaatcgggagccatcatctactgcccagtgaatcggacatttccgctgagatacctggaagccagctacggattaggtcaaggctcttccaaacctgcgtctccggtgtcccccagcggacccaaaggcagccatatgaagcggaggtcggtgactatgacggatggactcacggccgacaaggttacgaggagcgacggttgtccgacatcgacatcactacccaggcctcgtgattccatacgcagttgtgctctttcaatggatcagattccggatcttcactctccaatgtcccccatctccgagagtccctcgagtccagcgtactcaaccgtcacgagagttcacgccgcacctgccgctccctcggccaccgccctccctgcatcacctgtcgccaggcgctcgtccgagcctcaactgtgtcccggtagcgctcctaagactcatggagagagcgataaaggccctcacacatcaccatctcacacgctcggcaaggcttcaccctcaccatctctgtcaagttatagtgatccagattccgggcattattgtcagttgcagccccctgtgcgcggaagcagggagtgggccgcaaccgagacatcctcccagcaagctaggtcgtacggagagcgccttaaggagctgagcgagaatggcgcaccagagggtgactggggaaaaaccttcactgtgccaatcgtagaggtgacaagttcattcaatcccgcaacattccagtcattacttataccccgagataaccgcccactagaagtaggccttctgaggaaagtaaaggagctgctcgctgaggtcgatgctagaaccctcgccagacacgtgaccaaggtcgactgtctagttgcgagaattctgggagtgacaaaagaaatgcagacactgatgggcgttagatgggggatggagctcctaactctgcctcacggaagacagctgaggctagacttacttgaacgcttccatactatgagcatcatgctggccgtggatatcttgggctgcactgggagcgcggaggaacgcgcagccttactccataagaccatacaactggcggctgaacttcggggaaccatgggcaatatgttttcttttgcagcggtcatgggtgccttggacatggctcaaatcagccgactggaacagacatgggtgaccctgcgccagagacacacagagggagccatactgtatgagaaaaagctaaagcccttcttgaagagcctgaacgaagggaaggaggggcctcccctgtcaaatacaaccttcccacacgtactacccctgattacactgctggaatgtgactccgccccaccagaagggccagagccctggggctctacagaacatggggttgaagtggtgctggctcacctcgaggccgctcgcaccgtggcacaccatgggggactttaccatacgaatgctgaggtgaagctgcagggcttccaagccagacccgagctcttagaagtattttccacagaattccagatgcgcctcctctggggaagtcagggcgctagctcctcacaggcccgtcgatatgagaagttcgacaaggtgctgactgctctttcacacaagttggagcctgccgttagaagctcagagctttag

SEQ ID NO: 28929 - DNA, 2379 bp, Artificial Sequence
  Description of Artificial Sequence: Synthetic coding sequence
atggcaccagcactgccatcccctcataaggctgttgcacgcccagagcttctactcgacaccgccgctcatagcggaaaacttagagctcccgatgggggtgagggagccgaatgtgcgggtcataacggcggaccgtcttggggggtggggcagggacagagccaagaacccagtcgacaggggatacctcaggctccgtggttagtttcatggcagcgtcggggatttccacccagtagcttctgcccaggacccttgcggacggagaaactgagggctgggcgatgcccactcttgctgtgcgggggagccgctggggagcccgaggctggtagcgattatgtgaagttcagtaaagagaagtacattttggacagttctcctgagaagctgcataaggaactggaagaggaactgaagttatcatcgactgacctcagatcccatgcatggtaccacggcaggatccctcgtgaggtgagtgagactctcgtacagcggaatggtgactttctcatccgcgatagcctgacttcgctcggtgactacgtcctgacgtgtagatggcggaaccaagccctacatttcaaaattaacaaagtcgtggtcaaggcaggcgagtcttacactcacatacaatacctgtttgagcaggagagctttgatcacgtgccggcactggttcggtaccacgtgggtagtcgcaaggccgtttccgagcagtcaggggctattatctactgcccagtgaataggaccttcccacttcgttatctggaagcttcttatggcttggggcaggggtcctcaaagccggcaagtccggtctcccccagcgggcctaaggggtctcacatgaagcggaggagcgtgactatgaccgacgggctcactgccgacaaagtcacacgcagtgacggatgtcccaccagtacctccctacccaggcctcgcgactccatcagaagttgtgccctgagtatggatcagataccagacttgcacagtcctatgtctcccatatcagaaagcccctcaagtcccgcttatagcacagtaacaagagttcacgctgccccagccgctccttctgccaccgctcttccggcaagcccagtggcccgacggtcgtcggaaccgcagctctgtcccggatcggcaccaaagacacatggcgaaagtgacaagggaccccatacatcaccaagccacacactcggaaaggccagcccgtcgccctcactctcttcttacagcgacccggacagtggacattactgccagcttcagccccctgtcaggggtagcagggagtgggctgccacggaaactagttcccagcaagccagatcttatggggaaagactcaaggaactgagcgagaatggcgcacccgagggcgactggggcaaaactttcacggttcccatagtggaagtgaccagttctttcaatccagccaccttccagtctttgctgatacccagagacaatcgcccactggaggtggggctgctccgtaaggttaaggagctcctggctgaggtagatgccaggactctggcaagacatgttactaaggttgactgcttagtggccaggattttgggagtcactaaagaaatgcagactttgatgggggtgcgctggggtatggagttgctgaccctgccacacggcagacaactcaggctggacctgctagagcggttccacactatgagcatcatgctggctgtcgacatattgggatgtactgggagcgcggaggaaagggccgctcttctccacaaaactatacagctggcagctgaactgagaggtactatgggaaacatgttcagtttcgccgcagttatgggggctctcgacatggcccagatctctcggctggagcaaacctgggttacattgcgtcagcgccatactgagggggcaattctatatgagaagaaactaaagccatttttgaaatctcttaatgaaggaaaggaaggcccaccattgtccaacacaacgtttcctcacgtcctaccactcattacgctgctggagtgcgactctgcacctccagaaggcccagagccatggggaagcaccgagcacggcgtggaagtagtgcttgcccacctggaagcagcgaggactgtggcccaccacggcggtctctatcacactaacgccgaagtcaaactgcaaggcttccaagcccgacctgagctcttggaggtgttcagtactgaattccagatgcggctgctatgggggtcacaaggcgcttctagtagccaggcgagaaggtatgaaaaattcgataaagtattaactgctttgagccataagctggaaccagccgtgagatcgagcgaattatag

SEQ ID NO: 28930 - DNA, 2112 bp, Artificial Sequence
  Description of Artificial Sequence: Synthetic coding sequence
atgactgcagtcggcaggagatgcccagccctcggatcccgcggagccgctggtgagcctgaggccggatccgactacgtgaagtttagcaaggaaaaatacatcttagatagctcccctgaaaagctgcataaggaactcgaggaagaactcaagctctctagtactgacttgcgatctcacgcgtggtaccacggtcgcattccgcgagaggtgtctgaaaccttggtccagaggaacggtgacttcctgatcagggactcactcacctccttaggtgactacgtgctgacctgccgatggcgcaatcaggcccttcatttcaaaatcaataaagtcgtggtaaaggcaggagagtcctatacgcatatacaatatctattcgaacaggaatctttcgaccacgtgcctgcactcgtccggtaccatgttggcagccggaaagcagtgtctgagcagagcggagctataatttactgcccggtgaatagaaccttcccgctccgctatctggaagccagctatggcctgggacagggttctagtaagccagccagccctgtcagcccttctggacccaagggctctcacatgaaaaggcgctccgtgacaatgacagatgggttaaccgccgacaaagtcactcgttcagatggctgtcccacttctacatccctgccaaggccccgtgattccatcaggagttgcgccctgtctatggatcagatacctgacctgcactctcccatgagtcctattagcgagagcccatcatcaccggcttactctacagttacacgcgtccatgccgcacccgctgcaccatctgcgaccgccttgccggcttctcccgttgcaaggcgcagctccgaaccccagctgtgcccagggagcgcgccaaagacacatggggagtccgataaaggccctcacacttccccatcccacacactgggcaaagcctctccttcgcccagcttgtcatcctacagcgacccagattctgggcactactgtcagctgcagccgccagttagaggctcacgcgaatgggccgctacagagacaagctcacaacaggcacgctcatatggggagagactcaaggaattgtccgaaaacggtgctccagagggagattgggggaaaaccttcactgtgccaattgtcgaggtgactagtagcttcaaccccgcaacttttcagtccttactcatccctcgggacaataggccgttggaagtgggtctgctgcggaaggtaaaagagttgttagccgaggtcgatgccagaaccctggctcggcatgtcacgaaagtggattgcctggttgctaggatcctcggagtgaccaaagagatgcagacgctgatgggcgtacggtggggtatggagctcctaactcttccacatggacgccagctccgcctggacctgttggaacggtttcacactatgagcatcatgttggcagtggatattctgggctgtaccggctccgctgaggaacgggcagctctgctccacaaaactatccagctggcagcggagctcagaggcacaatgggcaacatgttcagttttgccgcagtgatgggcgctttagatatggcacagatcagccgcttagaacagacctgggtgactctgcgacagagacacactgagggcgctattctctatgagaagaagcttaagccctttctgaaaagtctcaatgagggaaaggaaggcccacctttatcgaacaccaccttccctcacgtgctgcctctgatcaccctgctggagtgcgattccgcaccccctgaggggcctgagccctggggtagtacagagcacggagtggaggtcgtcctcgcacatctggaggcggcaaggaccgtggctcatcacggaggcctgtaccatacaaacgcggaggttaagctgcaggggtttcaggccagaccagagctattggaggtgttctctacagagtttcaaatgcggctcttgtggggcagccagggagccagtagctcacaggctcgacgttacgaaaaatttgacaaggtgctgacggccctgtcacacaagcttgaaccagccgtcagaagttctgagctctag

SEQ ID NO: 28931 - DNA, 1869 bp, Artificial Sequence
  Description of Artificial Sequence: Synthetic coding sequence
atggatcaactgcctcaaaaaaacctgctcaggctgcatcctgctggaagcgccggatgttctacaggagtcgagagctcctctatggatggcttctggatggaagtagagcagatccagcaacgcgatgaacttagggaagaggactccggcggaaacgagggacagttacccgaggagggcgaggccgagagtcagtggctgcaggacaccggtctgtccggcctcttaggaggacttggattggatggtgatcatcaggaattactgagcactctgacacagactcaggtcgcagcagtgtgtcggagacttgatatatatgcgcgttccgtgaggagacagcacaagacccctgtgcgagacgtccgcgatgtgtttggagtcttcaactcagggaaaatgagtagcgagaacggtgacagtggcatgaaaggcgctcagttgtcatccggagcatcgaagttccctccagccgcagaacctgggggacttcaagagcaggcaggtcgcgaggaggcttttaacatggattccgcctattcagagcaggccgctgtcttgctccagaggagcaggcctagccggggtggtacatctgcttggggcaagtgttccctacctaagttcaccgtgcccaagggtagactcggcgtcacacgcataggcgacctgtcattacaagatatgcgcaaagtcccttctctggctctgattgagctgactgctttgtgtgatattttaggcctagatttgaaaaggtctaaggccggaaagtggaaggccgcagagacgagactctttggggtcccgcttgacagcctgctggaagctgaccacaaagtgctgcctagtactcaggtgccattggtattacaagcattactttcttgcctggaaaagcgaggactcgatatggaggggatactgagggtgcccggatcacaagctcgtgttaaaggtctggagcagaagctcgaacgggatttctacgcagggctgttcagctgggacgaagtgcatcataatgacgcctccgacctgctgaagaggttcatccggaaactaccaactccgcttttgacggcagaatacctccccgcattcgccgtggtcccaaacatacctaacctcaagcaaaggctgcaggtgttacacttattgatccttatcctgccggaacctaacaggaacgcgctgaaagcccttctggaatttctccgaaaggtcgtcgcaagggaacaacacaacaaaatgacccttagaaacgtgagcacagtgatggcgcctaatctattcttacatcaaggacgaccgcctaaactgccaaaggggaaagagaagcaactggctgaaggagccgcagaggtggtgcagattatggtgcactaccaggatcttctgtggacagttgcctcatttctggtggcacaagttagaaagttgaacgacagtagctcaagaaggccccagctttgcgatgctgggctgaagacctggctacggcgaatgcacgccgaccgcgacaaggcaggcgatggactagaggctactcctaaggtggcgaagattcaggttgtttggcctatcaaggaccctctgaaagtaccactcactccatcaaccaaggtcgctcacgtgctgaggcagttcacagaacacctgtccccaggatccaaaggacaggaggactccgaggacatggacagcttgctgctgcaccatcgctcaatggagtctgccaacatcctcctgtacgaagtggggggaaacataaatgaacacagactagacccggatgcttatctgctggacctctatcgggcaaatcctcatggggagtgggtactcaaacagaatcccacatag

SEQ ID NO: 28932 - DNA, 846 bp, Artificial Sequence
  Description of Artificial Sequence: Synthetic coding sequence
atggctacggaattgcagtgcccggattctatgccgtgtcacaaccagcaggtgaattcggcgtccaccccgtctcccgagcagcttaggcccggagaccttattctcgaccacgcaggtggcaaccgtgcctccagggccaaggttatcctgctgaccggatacgcacattccagtctgccggcagagttggatagtggagcttgtggcggtagcagtttaaactctgagggtaatagtggaagcggggatagtagctcctacgatgcaccagccggaaactcctttttggaagattgtgagttatcgcgacagataggcgcacagctgaaactgctgcctatgaacgaccagattagagagctccagacaatcattcgtgacaaaaccgcctcccgcggagattttatgtttagcgccgacaggctgatcaggctggtagttgaggagggtttgaatcagcttccatataaggagtgtatggtgactacgcccacaggctataaatatgagggagtgaaattcgagaaagggaactgcggggtgtctattatgcgatccggagaagcaatggagcagggactgagggactgctgtagatccatcagaataggaaagatactgattcagagcgacgaggagacacaacgtgctaaagtctactacgcaaagttccctcctgatatctacagacgcaaagtactgctaatgtatcctatcctgtccacagggaacaccgttattgaggctgtcaaagtgctaatagaacatggcgtgcagccatccgtcatcattctcctgtctctattctccactccccacggggagttctcaatgcgacagtag

SEQ ID NO: 28933 - DNA, 930 bp, Artificial Sequence
  Description of Artificial Sequence: Synthetic coding sequence
atggccacagagctccaatgtcctgattcaatgccatgtcacaaccagcaggttaacagcgcttccactcctagccccgaacaattgagaccaggagacttgatactcgaccatgccggaggcaaccgcgcaagtagggccaaagttattctcctgacagggtacgctcacagcagcctgcccgcagagctggatagtggagcatgcggaggttctagcctgaactccgagggtaattccggaagtggggattcctcctcttacgatgcacctgcagggaactcttttcttgaggactgtgagttgtcccggcagatcggcgctcagttaaaactgcttcccatgaatgaccaaatccgtgaattgcagacaatcatccgggacaagaccgctagcaggggtgactttatgttttccgcggaccgattgatccgcttggtggtcgaagaggggctcaatcaactgccgtacaaggaatgtatggtgactactcctaccgggtacaagtatgaaggagtcaagttcgagaagggcaattgtggtgtgtcgatcatgcgatctggagaggccatggagcaaggcctcagagactgttgcaggagtattagaattgggaagatcctcattcagagcgacgaggaaacgcagagagcaaaagtatactacgcaaaatttcccccagacatttaccggaggaaagttctgctgatgtaccctattctcagtactgggaacacagttattgaggctgtgaaggtcctcattgaacacggagtgcagcccagtgtaatcattttactatcactcttttctacaccacatggagccaagagcattattcaggaatttcccgagattacgatcttgacaacagaagtccatccggtcgcacccacacattttggtcagaaatacttcggaaccgactag

SEQ ID NO: 28934 - DNA, 633 bp, Artificial Sequence
  Description of Artificial Sequence: Synthetic coding sequence
atggtttccggttcagaacagaagtttctgatagggctcggaaagtcccagatctatacttgggatggacgacaaagtgatcgctggatcaagttggacttaaaaaccgaactgccacgcgatacattgctctctgtggaaatagtgcacgagttaaagggagaggggaaagcccaacgtaagatctccgcaattcacatcttggacgttctggtgctgaacgggacagacgtgcgggagcaacacttcaatcaacgaattcagctggcagagaagttcgtaaaagcagtttcaaaacccagcaggcctgatatgaaccctatccgtgtcaaggaggtatacaggctcgaggagatggagaagatcttcgtcaggctggaaatgaaaattatcaaggggagtagcggcaccccaaagctgtcatataccggtcgagacgatagacactttgtacctatgggcttatatatcgtaaggaccgttaatgaaccgtggactatgggattttccaagagctttaaaaaaaaattcttctacaacaagaagactaaggacagtacattcgacctgcccgctgactctattgccccatttcacctgccaagtctggcgtgcctgagcaaaatggactag

SEQ ID NO: 28935 - DNA, 1119 bp, Artificial Sequence
  Description of Artificial Sequence: Synthetic coding sequence
atgaagcggaggacggaccccgaatgcaccgcacctatcaagaaacaaaagaagagagtagcggaactcgccctgagtctgtccagcacctcagacgacgagccgccaagctccgtgtcccatggcgctaaggcatccacgacaagcctctcgggctcagatagtgagactgaaggaaaacagcatagttccgattctttcgacgatgccttcaaggccgacagtcttgtggaaggcaccagctctagatacagcatgtacaattcagtgagccagaaacttatggcaaaaatggggtttagagagggggagggactggggaaatattcgcaaggacgtaaagacattgtcgaggcgagttcacaaaaagggagacggggactaggactgacattgcgcggatttgatcaggagctaaacgtggactggcgggatgaaccagaaccctccgcttgcgagcaggtctcatggttccccgagtgcacaactgaaataccagatacacaggagatgtcagattggatggtggtggggaagagaaaaatgatcatagaggacgagaccgaattttgtggggaggaactgctgcactccgtcctacaatgcaagaagcccttggtgaaagatcgcgaagccgaactgctctactttgccgatgtgtgcgcagggcctggcggattcagcgaatatgttctgtggcgtaaaaaatggcatgctaagggctttggcatgacgctcaagggtcccaacgattttaagctggaagacttttactcggccagttccgagctctttgaaccctattatggcgagggcggaatcgacggagatggcgatattacccgaccggagaatatttccgcgttccgaaatttcgtcctcgacaatacagatcgtaaaggcgtccactttctcatggccgatgggggattcagcgttgaaggccaggagaacttacaagagatcctgtctaaacagctcttactttgccagtttttgatggccctatccatcgtgcgcaccgggggtcatttcatatgtaaaacgtttgatctgttcacgccattcagtgtcggcctggtttatctgttatattgttgtttcgaacgggtctgttag

SEQ ID NO: 28936 - DNA, 615 bp, Artificial Sequence
  Description of Artificial Sequence: Synthetic coding sequence
atggccggatacctctctgaatcagacttcgtaatggtggaggagggattctccacgcgggacctgttgaaagagttgactctgggtgcctcgcaggcaacaaccgacgaggttgcggcttttttcgtggccgacttgggggcaatcgtgagaaaacatttttgctttcttaagtgcctgcctcgcgtgcgacctttttacgctgtcaagtgcaattcttcaccaggagtcctgaaagtcctggcacaactgggcttgggctttagctgtgctaacaagattgcaagtgtcataaattccgctctagacctctatttcccggaggggtgtggggttgatatctttgccgagctgggcagatactacgtgacctccgctttcacggttgctgtgtccataatcgctaaaaaggaggttctgttggatcagcctggcagagaggaggagaacggctctacgtcaaaaactatcgtctatcatctggatgagggggtctatgggatcttcaatagcgtcctattcgacaatatctgcccaactcctattcttcaaaaaagcaagaatcactccccctgttacatgtcactagagtctattcacttcatcgcggtttag

SEQ ID NO: 28937 - DNA, 1443 bp, Artificial Sequence
  Description of Artificial Sequence: Synthetic coding sequence
atggcagggtatctgagcgaatcagattttgtgatggtagaagaaggcttttcgacacgggatttgctgaaagagcttaccttaggcgcatcccaggctacaactgatgaagtggcagcctttttcgtggctgacctgggcgcaattgtccggaaacacttctgctttttgaaatgcctcccccgagtgcgccctttttatgcagtgaagtgtaacagctcgccaggggttttaaaagttctggcccaactcggtttgggcttttcctgcgccaacaaggcggagatggagcttgtgcagcacattggcatccctgcttcgaagatcatttgcgccaatccatgtaaacagatcgcacagattaagtatgctgccaagcacgggatccagttgctttcctttgacaatgagatggaactggcgaaagttgttaagtcccaccccagtgcaaagatggtgctgtgcattgcaacagatgattcacattcccttagctgtctgagcctgaaattcggcgtgagtcttaaaagttgtaggcatctccttgagaatgccaaaaagcatcacgtagaggtggtgggggtctcatttcacattggctctggctgtcctgatccacaagcatatgcccaaagcatcgccgacgccaggctggtgtttgaaatgggtactgaactcgggcacaagatgcacgtgcttgatctcggaggaggatttcccggaacggaaggcgctaaggttcgcttcgaagaaattgccagtgtgattaatagcgcgttggacctctatttccctgagggttgcggggtagacattttcgccgagctagggaggtactacgtgacatctgcattcaccgttgccgtgtccattatagctaagaaggaagttctgcttgatcaacctggcagggaggcccctctgcctcccccacacattgctacctgtgcagctagcgaaccatctccaccagccgaggaaaacggatccaccagtaaaactattgtatatcaccttgacgagggcgtctatgggatctttaacagcgtgctgtttgacaacatttgcccgacccccatcctgcagaagaagccttctaccgagcagcctctgtattcctcttcactatggggccctgcggtggacggttgtgattgtgtggcagagggcctctggttaccacagctccatgttggcgattggttagtttttgataacatgggtgcctatacagtggggatggggtcaccattttggggaacacaagcatgccacattacctacgctatgagcagggtggcttgggaggctctccgaagacagctgatggccgctgaacaggaggatgacgttgagggcgtctgcaagccgctttcttgcggttgggaaatcacggacaccctctgcgtggggcctgtcttcacgccagcttctatcatgtag

SEQ ID NO: 28938 - DNA, 1383 bp, Artificial Sequence
  Description of Artificial Sequence: Synthetic coding sequence
atggccggatatttatcagaatcggactttgtgatggtcgaagaaggctttagcaccagagaccttctaaaggaactgacgctcggtgcaagtcaggctactacagatgaggtagccgctttcttcgtcgcagatctcggggcaatcgtccgcaaacacttttgttttctcaagtgcctgccccgagtgcgcccattctatgcagttaagtgcaattcaagcccaggcgtactcaaagttctggctcagttgggtttgggattttcttgcgcaaacaaggctgagatggaactggttcaacacatcggtatccccgcttctaaaattatatgcgctaatccctgtaaacagatcgcccagatcaagtatgctgccaagcacggcatccaactattgtcttttgataatgagatggagttggccaaggtggtaaagagccaccccagcgccaagatggtgttatgcattgccactgatgactcccattccctctcctgtctttccctgaagtttggggtgtcattgaagtcatgcagacatctgctcgaaaacgcaaagaagcaccatgtggaggttgtaggcgtttccttccacatcggcagtgggtgtcccgatccgcaggcctacgctcaatctattgctgacgccaggctggtctttgagatggggacagagctgggccataagatgcatgtgcttgatctcggtggcggatttcctggcaccgagggggctaaagtgcgcttcgaggagattgctagcgtgatcaattctgctctggacctctactttcctgaggggtgcggcgtcgacatcttcgctgaattaggaaggtactacgtgacctcagcatttacagtggctgtcagcatcattgcaaaaaaagaggtcctattggaccagcctggaagagaggaagaaaacgggagtaccagtaaaacaatcgtttatcacctggacgaaggcgtttacggaattttcaacagcgtgcttttcgacaatatctgccccacaccaatccttcaaaagaaaccctctacagagcagccactttacagctctagtttatggggccctgccgtggacgggtgcgactgtgtggccgaagggttgtggcttccccagttgcatgttggggattggcttgtgtttgataatatgggcgcttatactgtggggatgggtagcccattttgggggacgcaagcctgccacattacttatgccatgtccagagttgcatgggaggccctccgccgacagcttatggctgctgaacaagaggatgacgtagagggggtgtgcaagcccttgagctgcggctgggagatcactgacaccttgtgtgtcgggcctgtgttcacaccagcgtctataatgtag

SEQ ID NO: 28939 - DNA, 2508 bp, Artificial Sequence
  Description of Artificial Sequence: Synthetic coding sequence
atgaagcgcagaacagaccctgagtgcaccgcccctatcaaaaaacaaaagaaacgggtcgctgagctcgcacttagcctgtcctccaccagtgatgacgagcctccaagttccgttagccatggtgcaaaggcttccactacctcactgtccggcagtgactccgaaactgagggcaagcagcacagctctgacagctttgacgatgcctttaaggccgacagtctggttgagggtactagtagtagatattcaatgtataattccgtaagccaaaagcttatggctaaaatggggttcagagaaggggagggactgggtaaatactcacaagggcgtaaggacatagttgaagccagcagccagaaagggaggaggggactcggcctcacactgaggggcttcgaccaggaattaaatgtggactggcgggacgagccggagccttctgcctgtgaacaagtgagctggttccccgaatgcaccactgaaatcccagatactcaggaaatgtcagattggatggtcgtgggtaagagaaagatgattattgaagacgagacggaattctgcggggaggaactgctgcactccgtgcttcagtgtaaaagcgtgtttgacgttctggatggcgaggagatgaggcgagccaggactcgggctaacccatacgaaatgattcggggagtcttttttttaaaccgagccgcaatgaaaatggctaatatggacttcgtgtttgataggatgttcacaaacccccgagattcttatggcaaaccgcttgtgaaagaccgcgaggccgagctcctgtattttgccgatgtgtgtgcagggccagggggttttagcgaatatgtcctgtggcggaagaaatggcacgccaaaggatttgggatgacgctgaagggaccgaacgacttcaaacttgaagatttctatagcgcttccagcgagctgtttgagccctactacggggaagggggtatagatggagatggggacatcactaggcctgaaaacattagtgctttcaggaatttcgtccttgataatacagaccgaaagggcgtacattttctgatggccgacggcggtttctccgtggagggtcaagagaacctgcaggaaattctttctaagcagctgctcttatgccaattcctgatggccctgtcgattgtaagaaccggagggcacttcatttgcaagacgtttgatctttttacccccttcagtgttggactcgtttatctgctgtactgttgcttcgagagagtgtgcctgttcaaacctattacatcaagacccgctaacagtgagcgctatgtcgtctgcaaggggttaaaagttggaatcgacgacgtgagggactatctgtttgctgtcaatataaagttgaaccaactccgaaacaccgatagtgatgtcaacctcgttgtgccacttgaagttatcaaaggagatcacgagttcacagactatatgattcgaagtaacgaaagccactgttctttgcagattaaggccctggcgaagatccatgcgtttgttcaagacacgactctcagcgagccacgccaggccgaaattcgaaaagaatgtctacgcctttggggcattccggaccaggcccgagtggccccttcatcttccgaccccaagtccaagtttttcgagttgatccagggcaccgagatcgatatcttcagctataaacccacgcttctgacctctaaaaccctagaaaagattcggcctgtgtttgattaccggtgcatggtgtccgggtctgagcaaaaatttctgatcgggctggggaaaagtcaaatctacacttgggacggacgacagagtgaccgttggattaagctggacctgaagacagagttgccgagagatactttacttagtgtggaaattgtccacgagctaaagggcgaaggcaaggcccaacgtaagatctctgccatacacatcctggatgttctggtgctgaacgggaccgatgtccgggaacagcattttaaccagcgcatacagcttgctgaaaaatttgtaaaagccgtgagcaagccttccagaccagatatgaatccaattcgagtcaaggaggtctaccggctagaagagatggaaaagatctttgtcaggctcgaaatgaagataatcaaagggtcttcaggtactcccaaactctcgtatacaggacgcgacgatagacacttcgttccgatgggattatacatagtcaggacagtcaatgagccttggacaatgggtttcagcaagagcttcaaaaagaagttcttctataacaagaaaacaaaagacagtacctttgaccttccggcagatagtatcgctccattccacatctgctattatggacgcctgttctgggagtggggggatggaattagggtccacgactcacagaagccacaggatcaagacaaactgagtaaggaggatgtgttgtcattcatacaaatgcaccgcgcttag

SEQ ID NO: 28940 - DNA, 252 bp, Artificial Sequence
  Description of Artificial Sequence: Synthetic coding sequence
tgacaggaactcctgaaggagaaaactcttgccgagcagaacttagaggacacaagacaacaactgctggccgcacgctcgtcacaagccaaggccatcaacaccctggagacgcgagtgagggaacttgaacagactcttcaagcctctgaggaacagttgcagcaaagcaaaggtatcgtcgctgcacaggagacgcagattcaagagttggtatctgcctattggtcctgttgcatccctggaccttag

SEQ ID NO: 28941 - DNA, 2304 bp, Artificial Sequence
  Description of Artificial Sequence: Synthetic coding sequence
atgttcgccaaacttaagaaaaaaatagcagaggagacggctgtcgctcagcgtccgggtggcgcaacacggataccaagatccgtgagcaaggaatcagtagcatcaatgggcgcagactcaggagacgacttcgcatcggatggaagctcctccagagaggatcttagttctcagttactcagaaggaacgagcagattcgcaaacttgaggcaagactaagcgactatgccgaacaggtgcgaaatctgcagaagattaaggaaaaactcgagattgcccttgagaagcatcaggacagctcaatgcgtaaattccaagaacagaacgagacatttcaggccaatagagcgaagatggctgaaggactggcacttgccctggcaaggaaagatcaggaatggagtgagaaaatggatcaactggagaaggaaaaaaacattttgaccgcacagctgcaggagatgaagaatcagtccatgaatttgttccaaagacgcgatgagatggacgagcttgagggatttcagcagcaagaactcagtaagatcaaacatatgctactgaagaaagaggagtctctagggaagatggaacaggaactggaagcaagaacaagggaactgagcaggacccaggaagagctaatgaactcgaaccagatgagcagtgatttaagccaaaaattagaggaactccagcgccattacagcaccctggaagagcagcgagaccatgtcattgcgtctaaaaccggtgccgaaagcaagataacagcgctggagcagaaggagcaggagctacaggcacttattcagcaactgagcatcgatttgcagaaggtaaccgctgagacccaagaaaaggaggacgtgatcacccacctccaggagaaagtggctagcttggagaaacgcctggaacagaatttatcaggcgaggagcacctccaggagctactgaaggagaagaccctggcagagcaaaacctggaggatacgaggcagcagcttttggccgcaagatcttcccaggcgaaagccatcaacactctcgagacccgggttcgggaactggagcagactctacaagccagcgaagagcaactgcaacagtctaaaggaattgtggccgctcaggagactcagattcaggaactggccgctgctaaccaggagtccagtcacgtacaacagcaggcccttgccctggaacagcagttcctggaacgaacccaggcattagaggcacaaatcgtggccttggagaggactagggcggcagaccagacgaccgccgagcaaggaatgcggcaactagaacaggagaatgcagctctcaaggaatgtaggaatgaatatgagagatcactccagaaccaccaattcgaactcaagaagttgaaagaagaatggtcacagcgcgagatcgtgtccgtggctatggcccaggccctcgaagaagttcggaaacagcgagaagaattccaacaacaggcggctaacttgactgctatcatcgacgaaaaggagcagaaccttcgcgaaaaaacagaggtgctgctgcaaaaggagcaggagatcttacaactcgaaagggggcacaacagcgctttactgcagatccaccaactccaggcagaactggaggccctccgtacactgaaagccgaagaagcagccgtggtggcagaacaggaagatctcttgagacttcgaggaccactgcaagcagaggctctaagcgtcaacgaatcacatgttaccagccgcgctatgcaggatcccgtgttccagctaccgactgccggacggacccccaatggcgaggtaggggctatggacctcactcagctgcagaaggaaaaacaggatctggagcagcagctgctggagaagaataaaacaatcaagcagatgcagcaacgtatgcttgaattacggaaaactctacaaaaggaactcaagatccgacctgacaatgaactattcgaggtgcgggagaagcccggacctgagatggctaatatggctcccagcgtcaccaataacactgacctgactgatgcaagggaaatcaacttcgagtatttgaagcatgttgtcctgaaatttatgtcttgtagagagtctgaagcatttcatcttatcaaagccgttagtgtactcctgaatttctctcaggaggaggaaaacatgttaaaggagaccctagaatataaaatgtcctggttcgggtcaaaacccgctccgaaaggttccatacgcccaagcatatctaaccctagaattccttggagctag

SEQ ID NO: 28942 - DNA, 291 bp, Artificial Sequence
  Description of Artificial Sequence: Synthetic coding sequence
tgagctaaaatcaaagccagagatcttcggggaaagaaaaaggaggagctgctcaagcaactcgatgacttaaaagtcgagttatctcagctgcgggtcgccaaagtgacagggggagccgcaagcaagctatctaagatcagggtggtgcggaagtcaattgctagggttcttaccgtgattaaccaaacccaaaaagagaatctcaggaagttttataaagctgccgctggcggtccatgcatccaaatggatcgagtgctcccgcagcccccagcatgctcttgctag

SEQ ID NO: 28943 - DNA, 1035 bp, Artificial Sequence
  Description of Artificial Sequence: Synthetic coding sequence
atgcgcaggcgcagagaggaggagggcattcaactgagaaagcagaagagagaacagcagctgtttaagcgcaggaatgtagaactcatcaacgaggaagccgctatgtttgattcattattgatggactcctacgtcagctctactaccggcgagtctgttataacacgcgagatggtcgaaatgctattctcagatgacagtgatctgcagctggccaccactcaaaagttccgcaagctgctgtcaaaggagccgagtccgcctattgacgaagttataaatacacctcgggtggtggatcgtttcgtcgagtttttgaaacgaaatgagaattgtaccctgcaggctgtgtgggctttggggaacattgctggcgactcaagcgtgtgtagagactatgtgctgaattgctccatcttgaatccactcctcactttactgacaaaatctaccagactcacaatgactcgcaatgccgtttgggccctgagcaacttgtgtaggggcaaaaacccgcctccagagtttgccaaagtgagtccatgcctccctgttctaagtagactgctgttcagtagcgactcagatcttcttgctgacgcctgctgggcgctgtcatatctgtccgatggtcctaatgaaaagatccaagccgtcatcgacagcggcgtatgtaggcggcttgtggagcttctcatgcacaatgactataaagtcgcctcacccgcactgcgagcagtgggcaatattgtgacgggggatgatattcagacgcaggtcatactcaactgttctgcactaccatgcctcctgcatctattgtcctcaccgaaggaaagcattaggaaggaggcttgctggactatctcgaacattaccgcaggaaaccgcgctcagattcaagccgttatcgatgcaaatattttccctgtcctaatcgagatcctgcagaaggcggaatttaggacgagaaaggaggccgcatgggccataacaaatgccacttctggcggaacaccagagcagatatag

SEQ ID NO: 28944 - DNA, 582 bp, Artificial Sequence
  Description of Artificial Sequence: Synthetic coding sequence
atgcctacgacatctagacccgctctggatgttaagggcggtacctctccagcaaaggaggacgctaaccaggaaatgtcttcagtggcgtactctaatcttgcggtgaaagaccggaaggctgtcgcaatcctgcattaccccggagttgccagcaatggcactaaggcctccggagccccaacttcttcgagcggctcccctataggaagccccaccactacacctcccaccaagccaccgagttttaacctccatcccgcaccccaccttcttgcatccatgcacctgcagaagcttaactctcagtatcaaggtatggctgccgctacaccaggccaacctggcgaagcgggacccctgcagaactgggattttggagcacaggcgggaggggctgagagcctgtccccgtcagccggagcccaaagccctgccatcatagatagcgatccagtggacgaggaggtgctgatgtctctggtcgtggagctgggtcttgacagggctaatgagctgcccgagctgtggctggggcagaacgaatttgacttcacagctgacttcccctccagctgttag

SEQ ID NO: 28945 - DNA, 1611 bp, Artificial Sequence
  Description of Artificial Sequence: Synthetic coding sequence
atggaaacaatggcatctccaggtaaggataactaccggatgaaaagctataaaaataatgcactgaatcctgaggaaatgagaaggaggagggaggaggagggaatacaactgaggaagcaaaaacgcgagcaacagctttttaaaaggaggaacgtcgaactgattaacgaagaggcggctatgtttgatagtctgctgatggactcttacgtttcgagtaccaccggggagagtgtaatcactcgtgagatggtggagatgttgttttccgacgactctgaccttcagttggcgactactcaaaagttccggaaattgttaagtaaggagccgagccctcccattgatgaagttatcaacacacctagagttgttgaccggtttgtggagtttctgaagcggaacgaaaactgcaccctgcagttcgaagctgcctgggctctcactaatattgcctcaggcacctcgcagcagactaagattgtgattgaagccggtgccgtgccaatttttatcgaactccttaacagtgatttcgaagacgtgcaagaacaagctgtttgggccctggggaacatagccggagatagctcggtgtgtcgggattacgtattaaactgcagtatcctcaatccacttctgaccttattaaccaagtcaacgaggctgacaatgacccgcaacgcagtttgggccttgagcaacctgtgcagaggcaagaacccaccaccagaattcgcgaaggtctccccttgtcttcccgtcctgagcaggctgctttttagctcagacagtgacctcctggccgatgcctgctgggccctcagctatttatctgacggtcctaacgaaaaaatccaggctgtcatcgatagcggagtctgccggcgacttgtggaactcctgatgcacaacgattacaaggtcgcctctccagctctgcgtgctgtgggtaacattgtaacaggcgatgatattcagacccaggtgattcttaactgtagcgctctcccttgcctattgcaccttctgtcatctccaaaggaatctattcggaaagaggcgtgttggacaatctccaacatcacagccggaaatcgggcacaaatacaggctgtgatcgatgccaatatatttccagtcttaattgagatactgcagaaggctgagttcagaaccaggaaagaggctgcttgggcgataacaaatgcgacttctggcggaacccctgagcagataagataccttgtcagtctaggttgtataaaacctctctgcgacctcttgaccgtcatggattctaaaattgtgcaggtggccctcaacggactggagaacatcttaagactaggggaacaggaggggaagaggagtggctcaggagtgaatccttattgcgggttaatcgaagaagcttacggactcgataagatcgaatttctgcagtcgcatgagaatcaggaaatctatcaaaaagcgttcgatcttatcgagcattatttcggcgtggaagatgatgatagttctttggctcctcaggtggacgaaacccagcagcagtttatcttccagcagcctgaagcgcctatggaggggttccagctgtag

SEQ ID NO: 28946 - DNA, 2769 bp, Artificial Sequence
  Description of Artificial Sequence: Synthetic coding sequence
atgattacatcagccgctggcataatctctctccttgacgaggatgaaccgcagttgaaggaatttgccctgcacaaactcaatgccgttgtgaatgatttttgggccgaaatctccgagtcagtcgataagatcgaagtgctctacgaggacgaaggctttcggagtagacagtttgctgccttggttgcctccaaggtcttttaccatttgggtgccttcgaagaaagcctgaactacgccctcggggcaggcgacctcttcaacgtgaatgacaactccgagtacgtggagacaatcattgcgaagtgtatcgaccactacactaagcaatgtgtggaaaacgccgatctccctgaaggggagaaaaaacccattgaccagcggctggagggcattgttaacaagatgttccagcgctgcctcgacgatcataagtacaagcaggcaatcggtattgctctcgaaaccagacgcctggatgtatttgaaaaaactatcctggagtcaaacgacgtgcctggcatgctggcctattcactgaaactgtgcatgtccctgatgcagaataaacaatttaggaataaagtgctgcgcgtcctggttaaaatttacatgaacctcgagaaacccgattttatcaacgtttgccaatgtctgattttcctggatgacccccaggcagttagcgatattctcgagaagttggtgaaagaagacaatctcctgatggcatatcaaatatgctttgacctctatgagtctgcaagccagcagttcctgtcaagtgtgatccagaatttgcgcactgtggggactccgattgcttccgttccagggagtactaatacaggaactgtgcctggaagcgaaaaggacagtgattctatggagacagaggagaagactagttctgcgttcgtgggtaagacacccgaagcctccccagaacccaaggatcaaaccctgaaaatgatcaaaattctgagcggggaaatggccatagaactgcatctgcagtttctcattaggaacaacaacactgatctgatgattctgaagaacaccaaagatgccgttcgaaattccgtgtgccacaccgcaaccgtgattgctaatagcttcatgcactgcggcacaacttcggatcagttcttgcgcgataatttggaatggctagcacgcgctaccaattgggcgaagtttaccgctacggcatccctgggagtcattcacaaagggcacgagaaagaggccctgcaattgatggccacatacctgcccaaagacaccagcccaggcagtgcttatcaagaaggcggagggctgtacgccttagggctaatccacgcaaaccacgggggtgatataatcgactacttactgaaccaactaaaaaatgcctccaacgatatcgtgcgtcacgggggtagtcttgggctggggctcgctgccatgggcactgcaagacaggatgtttacgacctcctgaaaaccaatctttaccaggatgacgcagttaccggagaggctgctgggcttgccctcggcctggtcatgctcggatcaaagaacgcccaggctattgaagacatggttggctacgcccaggagactcaacacgaaaaaatcctgcggggacttgcagttggcatcgcactcgtaatgtacgggaggatggaggaggctgacgccttgatcgagagcctgtgcagagacaaagatcctattctgaggaggagcgggatgtataccgtagctatggcttactgcggttccgggaataataaagcgattcggaggctcctgcatgtagccgttagtgacgtaaacgacgacgtaaggcgggctgccgtagagagtttaggctttatcctgttccgcacacccgaacagtgtcctagtgtcgtctcactgctgtcggaatcatacaatccccacgtccggtacggcgcagctatggccttaggcatatgctgtgcgggaactggcaataaggaagccataaatctcctggaaccaatgactaacgaccctgttaactacgtgcgccagggcgctctgatagcttcggctcttattatgatacagcaaaccgagattacttgtccaaaagttaaccaattccggcagctctactctaaggtgatcaacgataagcacgatgatgtcatggcaaagttcggggcaatcttggcacaaggcatcctggacgccggaggtcacaacgtaacaatttccctacagtcccgcactggtcacacgcacatgccctccgtggtgggagtgttggtgtttacccagttttggttctggttccctttgagtcactttctgagcctagcctatactcccacctgtgtcatcggtctcaataaagatcttaaggtgtcaacggcggtcctttcgattacggcgaaagcaaaaaagaaagagaaggagaaagagaagaaagaagaggagaaaatggaagtcgatgaggctgaaaagaaagaagaaaaagagaaaaaaaaagagccggaacccaactttcagctgctggacaacccggctcgcgtgatgcctgctcagcttaaagtccttaccatgccggagacatgcaggtaccagccatttaagccactttcaattggtggtattattatcttaaaagacacttcagaagacatcgaggagctggtagagcctgtcgccgctcacgggcctaaaatcgaggaggaggagcaggagcctgaaccacctgaaccattcgagtacattgacgattag

SEQ ID NO: 28947 - DNA, 1227 bp, Artificial Sequence
  Description of Artificial Sequence: Synthetic coding sequence
atgcctgaggaacaggctttcagtgtgctggtgaaaattatgttcgactatggactgcgggagctgtttaaacagaattttgaggacctgcactgcaaattctatcaactggaacgcttaatgcaagaatacattcctgacctgtataatcacttcctagatatttctctggaggcgcatatgtacgcgtcacagtggtttttgacactctttaccgctaagtttcctttgtatatggtgtttcacatcattgaccttttgttatgcgagggaattagcgtgattttcaatgtcgcactggggctcctgaagacctcaaaggatgatttgctcctcacggattttgaaggggctctgaaattcttcagggtgcagctgccaaagcgctaccggtctgaggagaacgccaaaaaactcatggagttggcgtgtaatatgaaaatcagtcagaagaagctcaagaagtatgagaaagagtatcatacaatgcgggagcaacaagcccagcaagaggatccaatcgaacggttcgagcgcgaaaacagaaggctgcaggaagccaacatgcgtcttgagcaggagaatgacgatctggcacatgaactggtgacctctaaaatcgctttacgaaaggacctcgataacgccgaggagaaagctgatgcactcaacaaggagctgctaatgactaagcaaaaacttatcgatgccgaagaggaaaaaagacgtctcgaagaggaatccgcccaattaaaggagatgtgtcggagggaattagacaaagctgagtcagagattaagaaaaattcgtccattattggagactacaagcagatttgtagccagctcagcgaacggttagagaagcagcagaccgccaataaagttgagattgaaaagatcaggcagaaagtggatgattgcgagcgctgcagggaatttttcaataaggagggccgtgtcaaaggaatctccagcaccaaggaggtattggacgaggatacagacgaggaaaaagaaacactgaagaaccagcttcgcgagatggagctggaactcgctcagacaaaactgcaattagtggaggccgaatgcaagatacaggatctggagcatcatctaggtctggccctaaatgaagtgcaggccgctaagaagacatggtttaaccgtactctgagctctataaaaacagctaccggcgtgcagggaaaagagacgtgctag

SEQ ID NO: 28948 - DNA, 3210 bp, Artificial Sequence
  Description of Artificial Sequence: Synthetic coding sequence
atggacgataaggccagcgtgggtaagatctctgtgagttctgattcagtcagcacccttaattccgaggactttgtccttgtgtcccgccaaggagacgaaactccatcaacaaacaacgggagtgatgatgaaaaaacaggtctgaaaattgtcggtaacggctccgaacagcagctgcagaaagaattggccgacgttttgatggacccgccaatggatgatcaacccggagaaaaagagctagtcaaacgctctcaactcgatggtgagggggacggacctttgtccaaccagttgtccgcatcttccaccataaacccagtcccattggtggggctccagaaacccgagatgagcctcccagttaagcccggtcagggggattccgaagcttctagcccatttacacccgttgccgatgaagacagcgttgtcttcagcaagctcacatacctgggctgtgcctccgtgaatgctccaagatccgaggttgaagcccttcggatgatgtctatcctacggtcacagtgccagatttccctagacgtgactctcagtgtgccaaatgtgtctgagggaatagtccgattgcttgatcctcagacaaataccgaaatcgctaactacccaatatacaagattcttttttgtgtcaggggccacgatgggacaccagagtccgactgcttcgctttcactgaatctcactacaacgccgaactgttcaggatacatgtgtttagatgcgagattcaggaagcagtttctcgcattttgtactcattcgctacagcttttagaaggagcgctaagcagacccctctgtcagccacagccgctccccagacccccgactccgacatcttcactttcagcgtgagcctggagatcaaggaggacgatggaaaaggctacttttcagccgtgcccaaagataaagacagacagtgcttcaagctgcgccagggaatcgataagaagatagtcatatacgtgcagcagactacgaacaaagagcttgctatcgaaagatgttttggactcctcctcagccccggaaaggacgttcgcaactccgacatgcatctgttggacctggaatccatgggcaagtctagtgacggcaagtcttatgtgattaccgggtcttggaaccccaagagtccccattttcaggtggttaatgaagagacacccaaagacaaggttttgttcatgaccactgctgtggacttggttatcacagaggtccaagaaccagtgaggtttctgctggagactaaggtgagagtgtgcagcccgaacgagcggttgttctggcccttttcaaaaagatccacaaccgaaaacttttttctgaaactaaaacagatcaaacagagagagaggaaaaacaataccgacactctatatgaggtggtgtgcttggagtccgaatctgagcgagagcgtcggaagacaacagctagtccatccgtgcgattaccacagtctggatcacaaagttcagtgatcccttcgccgccagaagatgacgaggaagaggataatgacgaaccactcctgtcgggatctggcgatgtgtctaaggagtgcgccgaaaagatactggaaacgtggggggaacttctcagcaaatggcatttgaacctgaatgtgaggcccaagcagctatcttccctggtaaggaacggggttccagaggctctaagaggggaagtgtggcagctgctggctgggtgtcacaacaatgatcacttggtggaaaagtatagaatcctgatcaccaaagagagtccgcaggactccgctattaccagagatattaatagaacattccctgcacacgattacttcaaagacacaggaggtgatggtcaggactcactttacaagatctgtaaagcttattctgtgtacgacgaagaaatcggctactgtcaagggcagtctttcctggccgcagtgctattgctacacatgcccgaagaacaggccttttctgttttggtaaagattatgttcgattacggcctaagagaactgtttaagcagaattttgaggacttacactgcaagttctatcagctggagcgcttgatgcaggaatacatcccagatctctataatcatttcctcgacatatccctagaggcacacatgtatgccagccagtggtttctgacattatttacggctaagttccctctctatatggtctttcacattatagatctgctactgtgcgagggaatttcggtgatctttaacgtggccctgggcttactgaagacatccaaggatgaccttctattaaccgattttgaaggagccttaaaattttttagggtgcaactgccaaaacgctaccgctctgaggagaacgctaaaaaacttatggagttggcgtgtaacatgaagatatctcagaaaaaactcaagaagtatgaaaaggaatatcacaccatgagagaacagcaagcacagcaagaagatcccattgagcgctttgagcgcgagaaccgaaggctgcaggaggcgaacatgaggcttgaacaggagaacgacgatcttgcccacgaactagtgacaagtaaaattgcactgagaaaggacttggataatgccgaagaaaaggctgatgcgctcaataaggagctgctaatgactaaacagaagctgattgacgccgaagaggagaagcggcgattagaggaggaatcggcgcaactgaaagaaatgtgccgaagggagcttgacaaagccgagagtgaaattaagaaaaatagttctattataggagactacaaacagatctgcagccaattgagcgaaaggctggagaagcagcagaccgcaaataaggtggaaatagaaaaaatcagacagaaggtggatgactgtgagcggtgtagagaatttttcaacaaggaaggccgagtgaaggggatcagctcaaccaaagaggtcctggacgaggacactgatgaggagaaggagacactgaaaaatcaactgcgtgaaatggagttggagctggcccagacgaagcttcagctagtggaggcagagtgcaagatacaagacctcgaacaccatctgggtctggcactaaacgaagtacaggctgcaaagaagacctggttcaataggaccctcagctcaattaagaccgcaacaggcgtgcaaggcaaagaaacttgttag

SEQ ID NO: 28949 - DNA, 2808 bp, Artificial Sequence
  Description of Artificial Sequence: Synthetic coding sequence
atgcaacggaagctagtgactctcgttaattgtcagttggttgaggaggagggacgagtgcgcgcaatgagggccgcaaggagtctcggcgagcggactgtcacagagctcatactccaacaccagaacccacagcaactcagtgccaacctgtgggcagcagtgcgagcgaggggctgccagttcctgggtcctgccatgcaggaagaggccttgaagctcgtgttgctcgcgctcgaagacgggtccgccctcagcagaaaagtgctagtgctgttcgtcgtgcaacgattggagcctcgcttcccccaggctagtaaaacctccattggccatgtggttcaactgctctaccgggcttcatgctttaaggtgaccaaacgtgatgaagacagttcactaatgcagctcaaggaagagtttaggtcatacgaggccctccgaagggaacacgatgcccagattgtgcatatcgcaatggaagcaggccttagaatctcccctgaacagtggtcaagcttgctttacggagatctcgcacataagtctcatatgcaatcgattattgataagttgcaaagccccgagagtttcgccaagtctgtgcaagaactgacaatcgtcctgcaaagaaccggagatccggcaaacctgaatcgactcaggccccacctagagctgctcgcaaatatcgatccgaatccggacgccgtctccccaacatgggagcagctcgaaaatgccatggtagctgtcaagaccgtggtgcatggcctggtggacttcatccagaactacagccggaagggccatgaaacaccccagcctcaacctaattccaagtacaaaacatctatgtgtcgggacctgagacagcagggcggatgtccgcgtgggacaaattgtacattcgctcacagccaggaggagttggagaagtacaggctgcgaaataagaagatcaatgcaacagttaggacatttccgttgctgaataaggtgggcgtgaataatacagttactacgacagccggaaatgtaatttctgtgatcgggtcaaccgagactactgggaagatcgtccccagcactaatggtatctcaaacgccgagaactccgtttcacaactgatcagcaggtctaccgattcaacattacgagcgctggagaccgtaaaaaaagtaggaaaagttggcgcaaatggccagaatgctgccggtccgagtgctgatagcgtgacagagaacaagattgggtcgccgccaaagacccccgtgtccaacgtggccgctacctctgctgggccttcgaatgttggaaccgagttgaactccgtgccacagaaaagtagtccctttctgacaagggtgccggtctatcctcctcacagtgagaacatccagtattttcaagatccacgcacacagatcccgttcgaggtcccacagtatccccagactggatactaccctcctcctcccacagtgccagccggagttgcaccctgcgttccgaggttcgttcgctcgaataatgtgccggaatccagcctgcccccagcatctatgccatacgccgaccactactcgaccttttctcccagagacaggatgaacagctctccttatcagccccctcctccccagccttatggcccagtcccgccagtaccttccggcatgtatgctcctgtgtacgactcacggaggatctggcgacccccaatgtaccagcgagatgatatcatccgttctaattccctcccacctatggacgttatgcatagctccgtataccagacttctctccgtgaacggtataattcattagacggatactacagcgtggcctgtcaacctcctagtgagccaaggactacagtgcctttgccgagagagccttgcgggcacttgaaaacatcgtgcgaagaacagattcgtcgcaagcctgaccaatgggcccagtatcacacccaaaaagcacctctcgtaagctctacactccctgtcgccactcagagtcctacaccgcctagcccactcttctcggtcgactttagagctgacttttctgaatccgtttcagggactaaattcgaggaggaccacctgtcacactattctccatggagctgcggaacaatcggatcctgtattaacgccatagatagcgagccaaaagacgtaattgctaactcgaacgcagttctaatggacttagatagtggcgatgttaaaaggcgcgtgcacctatttgagactcaacggaggaccaaggaagaggaccctattatccccttcagtgatgggcctattatatcgaagtggggagcaattagccggtctagtagaactggttatcacaccactgatccagtccaggccacggcaagtcaggggagcgcaaccaagcccatatctgtgagcgactacgtcccgtatgtaaacgcggtggacagccggtggagttcatatgggaatgaagccacaagctccgcccactatgttgaacgcgatagatttatcgtcactgacctttccggccaccggaagcatagttcaacaggcgacctgctctcactggaactgcaacaagctaaaagcaactccctactgctccaacgggaggccaacgcgctggcaatgcagcagaagtggaatagtctggatgaaggacggcatctcactctgaatctgttgagcaaggaaatcgagttgcgaaatggcgaggtgaagaagctgaatttgtcagcatcatgtctgatgtacctttttagtgcagcagcgtcgtggctgtatcattactag

SEQ ID NO: 28950 - DNA, 1437 bp, Artificial Sequence
  Description of Artificial Sequence: Synthetic coding sequence
atgcctgtccaggctgcgcagtggaccgagttcctctcttgcccaatttgctataatgagttcgacgagaatgtgcacaaacccatttcactgggctgtagtcatactgtatgtaaaacatgtctgaacaaattgcacagaaaggcatgtccgttcgaccagactgcgataaatacagacatcgatgtactgcccgtgaacttcgctctactgcagttagtaggagctcaggtgccagaccaccagagtattaaattatctaacctcggggagaacaaacactatgaggttgcgaaaaagtgcgtggaggacctggccctgtatctaaagccattgagcggcggtaaaggagtcgcgtccctcaatcagtctgccctctcacgtcctatgcaaagaaaactggtcactcttgttaattgccagctggtggaggaggaaggcagggtgcgggctatgagagcggctaggtcactgggggagcgtaccgtaactgaactgatcctccagcaccagaatccgcagcagctgtcagcaaatctatgggctgccgtcagagcaaggggttgtcagtttctaggtccagccatgcaagaagaggccctcaaattggtgttgttggcactggaggatggctccgccctgtcacgtaaagtacttgtgctattcgtcgtccagagactcgaacctaggtttccccaggccagcaaaacatccattggacatgtcgtgcagctgttgtacagagctagttgttttaaggttacaaagagggatgaagatagctccctgatgcagcttaaggaagagttcaggagttacgaggccctaaggcgtgagcatgatgcccagatagtacacattgcgatggaggccggactgcgcatctcccctgagcaatggtctagtctcctctacggagacctcgctcacaaatctcatatgcagagtattatcgacaagctgcagtcacctgaaagcttcgccaaaagcgtgcaggagctcaccatagtgttgcagcgtacgggcgatccagctaacctgaaccgcttgcggcctcacctggagctgctggctaacattgaccccaaccctgatgccgtgagtcccacatgggaacagttagaaaacgccatggtcgccgttaaaaccgtagtgcatgggttggtggatttcatccagaattactcaagaaaagggcacgaaactccccagccacagccaaactcaaagtataaaacctcgatgtgcagggatctaagacagcagggcggatgccctcgcggaacaaattgtacctttgctcactcccaagaagagctcgagaagtaccgcctgagaaacaaaaaaataaacgccacagaagttctcaagcaacagggcaagttgtttcaggttcagacagagtttcagatgcagaaaactgtgtttcccagctag

SEQ ID NO: 28951 - DNA, 3576 bp, Artificial Sequence
  Description of Artificial Sequence: Synthetic coding sequence
atgcctgtccaggcggcacagtggacagaattcctgtcttgtcctatatgttacaatgaattcgacgaaaatgtccacaagcccatcagcctcggttgctcacacacagtctgtaagacctgcctgaacaaacttcatcgcaaggcgtgcccctttgatcaaacagcaatcaatacggatatcgatgtcctacccgtcaatttcgcgctactgcagctcgtcggcgctcaggtgccagaccaccagtctattaagctgtctaatcttggggaaaataaacactatgaagttgcgaagaagtgcgtcgaagatctagccttatatctgaagccattgtccggaggcaagggggtggcctctttgaaccagtccgcgctgagcagacctatgcagaggaagctggtaacactagtgaattgtcagctggtcgaagaagaggggcgtgtgcgcgctatgagggcagccagatctctgggggagcgtaccgtgacggagctgatcctgcaacatcagaaccctcagcagctgtcagctaacctgtgggctgcagtgcgggctagaggctgtcagttcctggggccagctatgcaagaggaagcgctgaaactcgtacttctcgcactcgaggacggatccgctctgagtcgaaaggtattggtgctgtttgtggtgcagagactggagcccagatttcctcaagcttcgaagacaagtataggacacgtcgttcagctgttgtatcgagcttcgtgctttaaggtgacgaagagagatgaagacagtagccttatgcagctgaaagaggaattccgatcttacgaagcactcagacgcgaacacgacgcccagattgtgcacatagccatggaggccggactgcgaatctcaccagagcagtggagttcgctgctgtacggcgacttggctcacaaatcgcatatgcagtctattattgataagctccaatctcctgagtcattcgcaaaaagcgtgcaggaactgaccattgtactccagcgaactggcgaccccgctaaccttaatcggttgcggccacaccttgaacttctggccaacattgatcccaaccctgacgccgtgtccccaacatgggagcagctggagaatgctatggtggctgtgaagactgtagtgcatggcctggtggattttatccagaactactctagaaagggtcatgaaacaccacagcctcaaccaaattccaagtataaaacaagtatgtgtagggatctgagacagcaggggggatgtccacgtggcaccaactgtaccttcgcccatagtcaggaagaactggaaaaatatagactccgtaataaaaagatcaatgccacagtccgtacatttcctctgctgaacaaggtgggcgtgaacaataccgtgactactactgctgggaatgtgatttccgtaataggttccacagagactactgggaagatcgtccctagcaccaatgggataagtaacgctgagaatagtgtgagtcagctgatctctcgatccaccgattcaaccctgagagcactcgagacagttaagaaggtcgggaaggtcggtgcaaatggacagaatgcggctggcccatccgccgactctgtgacagagaacaaaataggttcgccacctaagaccccagtgtcgaatgtggccgctaccagcgccggtcctagcaacgtcggtacagagcttaacagtgtgcctcaaaagtcgtctccctttctgacccgggtccccgtttatcccccacacagcgagaatatccaatatttccaagaccctaggacacagatccccttcgaagttccacagtacccacagaccggatattacccccctccccctacagtgccagctggggtagctccatgcgtacccagatttgtgcgcagcaataacgttcccgaaagttcacttcccccagccagtatgccttacgccgaccattactcaaccttcagtcctcgagatcgtatgaactctagcccgtaccaaccccctcctccacagccgtatgggccagttccgccagtgccatccgggatgtatgctccagtgtacgattccaggcggatttggaggccaccaatgtaccagcgcgacgacatcattagatccaattctctgccgcctatggatgtgatgcactcctccgtgtaccaaacaagccttagggagagatacaattcactggatgggtactattctgtcgcttgccaaccgccatccgaacccaggaccacagttccattgccaagagaaccatgtggccacctgaagactagctgcgaagaacagatccgcaggaagcccgaccaatgggcccagtatcacactcagaaggcgcctctggtctccagtacattgcctgtcgctacgcaatcacccacccctccgagtccactctttagcgtagactttcgcgctgactttagcgaatcagtgagtgggacgaaattcgaagaagaccacctcagccactactctccgtggtcgtgcggaacaatcggctcatgtatcaacgccatcgatagtgaaccaaaggacgtgatcgcaaattcaaacgctgttctgatggatctggacagtggcgatgttaaacggagggttcacttgttcgagacgcagcgcagaactaaggaagaggatccaatcattccattttctgacggtccaatcatctcaaagtggggggctatttcacgctcgtcacgcacgggctatcacactacagatccagtccaggccaccgcatcccaaggtagcgctacaaagcccattagcgtcagcgactatgttccatatgtaaacgctgtggactcccgttggtcctcttatggcaatgaggctaccagtagcgctcattacgtggagagggaccgcttcatagtaactgatctgagcggccacaggaagcactccagcacaggagacctgctctcactggagctccagcaggccaagtctaactcactgctcctacaaagggaagcgaatgctctcgcaatgcaacagaagtggaatagtcttgacgaaggtcgacacctcaccctcaaccttctaagtaaagagattgaactgagaaacggggagctccagagcgactatactgaggatgctacagataccaaacccgaccgtgatattgagctggagttgagcgctctggacaccgacgagcccgatggccaatctgaacctatcgaagagatcctcgacatacagctggggattagttcccagaacgatcagttgcttaatggaatggcagtggaaaatggccaccccgtgcagcagcaccagaaagagcccccaaagcagaaaaagcagagccttggcgaggaccatgtgatcctggaagagcagaagactattctacccgtgacttcttgcttttcccagcccctgcctgtctccataagtaacgccagctgcttaccaatcaccacaagtgtcagtgctggcaacttgattttgaaaactcatgtgatgagcgaggacaaaaacgatttcctgaagcccgttgccaacggcaaaatggttaactcctag

SEQ ID NO: 28952 - DNA, 1569 bp, Artificial Sequence
  Description of Artificial Sequence: Synthetic coding sequence
atggccgctagcgcaaaacggaaacaggaggaaaaacatttgaaaatgctccgggatatgaccggcctcccccacaaccgaaaatgttttgattgtgaccagagggggcctacatacgtcaatatgactgtggggagctttgtgtgcacttcgtgcagcggttcactgcgtggtctgaatccaccccaccgagtaaagtctatctctatgacaactttcacacagcaggagattgagtttctgcagaagcacggaaatgaggtgtgtaagcaaatctggttaggtctattcgatgaccggagttcggctatcccagacttcagagacccccaaaaggttaaagaattcctgcaggagaaatatgagaagaaaagatggtatgtacctccagagcaggccaaggtagtggcgtctgtacacgcgagtatcagcggaagtagcgcttcttcaactagtagtacaccagaggtgaaaccgctaaagagcctgctcggcgactctgcacccacactgcaccttaataagggcaccccctctcagagccccgtcgtaggcaggagccagggccagcaacaggagaaaaagcagttcgaccttctaagcgatcttggcagtgacatttttgcggctccggcaccccagagcaccgcaaccgccaacttcgccaatttcgcgcatttcaactcccacgctggcggaagcgccgcaagcgttaacgcaaatttcgcccacttcgacaacttccctaaaagctccagcgccgactttggcacctttaatactagtcagtcccatcagacggctagtgccgtgtcaaaggttagcaccaacaaagcgggacttcagacagccgataagtacgccgcactggcgaacttggacaacatcttttcagccggacagggaggcgatcaggggtccggattcggcactactggcaaagcccctgtgggctctgtcgtgagtgttccctctcagagtagcgcctcaagcgataagtacgcggctcttgccgagctggatagcgtgtttagcagcgctgcaaccagctccaacgcgtacacatccacatctaacgcttcttctaatgttttcggcaccgttcccgtggttgcgtcggcccagacacagcctgcaagttcttccgtgcctgcgccattcggcgctacgcctagcacgaaccctttcgtcgccgcagcagggccatctgtcgcaagctcaacgaatccatttcagacgaacgccagaggggcaacagctgcgacattcggcactgcaagtatgagcatgcccaccggattcggcactcccgcaccttatagcctgccgacttctttttctggatcttttcagcagccagctttccctgcccaagccgcttttccacagcagactgcattttctcagcagcctaacggtgccggatttgctgcttttggacagacgaagccagtcgtcaccccttttggccaggtggccgcagccggtgtatcttccaatccattcatgaccggcgctccaactggccagttccccacaggcagttcctcgactaacccgttcctgtag

SEQ ID NO: 28953 - DNA, 1524 bp, Artificial Sequence
  Description of Artificial Sequence: Synthetic coding sequence
atgcaggatgactccatcgaggcatctacctccatcagccagctgcttcgggaatcgtatctcgctgaaacgaggcaccgtggcaacaatgaacggagtagggccgagccttccagcaatccctgccactttggttccccttcgggagcagcggaaggcggaggcggtcaggacgacttgccagacctctctgcttttctttcccaggaggagcttgatgaatcagtaaatctggcacgtttagcaatcaactatgatccgctggaaaaggctgatgaaacccaggcacgcaagagattatctcccgatcagatgaaacattcccccaacctgtcgtttgagcctaacttctgtcaggataacccgaggagtccaactagttcaaaagaatctcctcaggaggctaagcggcctcaatactgttccgagactcagtctaagaaggtatttctgaataaggctgctgatttcattgaggagttgtcctccctttttaaaagccattcaagtaagaggatacgcccaagggcatgcaaaaaccacaaatctaagctggagagtcagaataaggtcatgcaggagaacagctcttcattctccgatctatctgaacggagagaacggagttcagtgcctatccctattcccgctgataccagggataatgaggtgaatcatgccctggagcagcaggaggcaaagcgacgggaggcagagcaggcagcttccgaggcggcagggggagacacgacaccgggatcatcaccctcttccctgtactatgaagagccacttggccagccgcctcgttttacacagaagctgcggagcagagaagtgcccgaaggaacacgagtccagcttgactgcatcgtggtcggaatcccccctcctcaggtgcgatggtactgtgaaggaaaagagcttgaaaactccccggatattcacattgtccaggccggtaaccttcactctctgacaattgctgaagcgttcgaagaggacaccggaagatattcatgttttgcctcgaacatctacggaacggattccaccagtgctgaaatctacatcgaaggcgtctcatcttctgactcagaaggcgacccgaacaaggaagaaatgaacaggattcagaagccgaacgaggtctcatcccccccaaccacaagcgctgtgatcccgcctgccgtgcctcaggctcagcacctggtggcacaaccaagagtggcaacaatccagcagtgccagagccccacgaattacttgcaaggcctcgatggcaaacctatcatcgccgctcctgtatttacaaaaatgctgcagaatttgtccgcctcggaaggccagctcgtcgtatttgagtgtagagtaaaaggggcaccaagcccaaaagtcgagtggtatagagaaggaacactgattgaggacagtcctgacttccggatcttgcagaagaagccaaggagcatggcagaacccggtaaggacgacttcaacttcaacctcctcgtctacgaatag

SEQ ID NO: 28954 - DNA, 3150 bp, Artificial Sequence
  Description of Artificial Sequence: Synthetic coding sequence
atgttatgttggggtaacgctagctttgggcagctggggctgggagggatcgacgaggagattgtgctcgagccaaggaagtccgatttcttcataaataagcgggttcgcgatgtcgggtgcggattgagacatactgtgtttgtgctcgatgacggaaccgtgtacacttgcggatgtaatgatctggggcagctgggccacgagaaatcccggaaaaaaccggagcaagtagtagcactggacgcgcagaacatagtcgccgtatcttgcggggaggcacacactctcgccttgaacgataagggacaagtctacgcctggggtctggactcagatgggcagcttggcttggtgggttctgaagaatgcatacgcgtgcctcgaaatattaaatcattgtcggacattcagattgtgcaagtggcttgtggatattaccactcactcgcgctctccaaagcctcggaggtcttctgttgggggcagaataaatatggccaattgggactcggaaccgattgcaaaaagcagacatcacctcagcttttgaagtcattgctgggcattccttttatgcaggtggccgcagggggtgcacactcctttgttctcacattgtctggggcaattttcggctggggcagaaataaattcggccaactgggtcttaacgacgagaacgatcggtatgtccctaatctcctgaagagccttcgcagtcagaagatcgtttatatttgttgcggagaggaccacacagcggctttgactaaggaaggcggagtgttcactttcggggcagggggatatggacaactgggccacaactccacctctcacgagattaatccccgtaaagtgttcgaactaatgggctctattgtgaccgagatcgcatgcgggcgacagcatacgagcgcgttcgtgcccagctcagggcgtatctatagtttcggattggggggaaatggtcaactaggaacaggcagtacttccaacaggaagtctcccttcacggttaagggaaactggtacccgtacaacggacagtgcctgcccgatatcgattccgaggaatacttctgcgtgaaacggattttctcagggggtgaccagagcttctctcattatagctccccacagaactgcggccctcctgatgactttcgctgccccaatcctaccaagcagatttggaccgttaatgaagctttgatccagaagtggctgtcatatccgagcggcaggttcccggttgaaatcgccaatgagattgacgggacattttcctcttccggttgtctgaacggtagctttttggctgtgagcaatgacgatcactataggaccgggacacgcttttccggggttgacatgaacgcagctcgtcttctgtttcacaagttgattcagcccgatcaccctcagatttcccagcaggtggccgcaagcctggagaagaaccttatccctaagctgactagcagcttgcctgacgtggaggccctccggttttacttgaccctgcctgagtgtcctctaatgtccgattccaataattttacaacaatcgccatcccatttggcactgccctggtcaatctggagaaagccccactgaaggtcctggagaattggtggtcagtgttagagccccctttgttcctgaaaatcgtggagttgttcaaggaggttgtcgtgcatctgctgaagctgtacaaaatcgggattcctccttctgagcgcagaattttcaactctttcctccacacagccctcaaagtgttggagatcctacatagggtgaacgagaaaatgggccaaattatacaatacgacaagttttatatacatgaggtacaagaactgatcgacatcaggaatgactatatcaattgggtccagcagcaggcatacggcatgctagccgacatcccagtcaccatttgtacgtacccattcgtgttcgatgcccaggctaaaacgaccctgctacagactgatgctgttctgcagatgcagatggctatcgaccaagcccatagacaaaatgttagcagtctgtttctgcctgtgatagagtcagtgaacccatgcctgatcctggtagtgcgcagagagaacattgttggcgacgctatggaggtcttgcgcaagaccaagaacatagattacaagaagcccctgaaagtgatctttgtaggagaggacgcagttgatgcaggcggagtccggaaagagttctttctgttgatcatgcgggaactcctggaccctaaatacggaatgttccggtactacgaggactcgaggctgatctggttttctgacaagacttttgaggacagcgatctctttcatctgattggcgttatttgtggactggccatctataactgtacaattgttgacctccacttccccctggccctgtataaaaagctacttaaaaagaagccatctctggacgacctcaaggagcttatgcctgatgttggtcgcagtatgcagcagttactggattaccccgaggacgatatcgaagaaacattctgcctgaatttcacaatcactgtggaaaatttcggagccaccgaagttaaagagttggtcctgaatggagccgacaccgctgtgaacaaacaaaaccggcaggagtttgtcgatgcctacgtggactatatatttaacaagtcggttgcatcactgttcgatgcattccatgctggatttcacaaagtgtgcgggggaaaggtcctgctccttttccaaccaaatgaactccaggcaatggttatcggcaataccaattacgactggaaagaactcgaaaaaaatacggagtataagggggagtattgggctgagcaccctacgataaaaatcttctgggaagtgtttcatgagctgcctcttgaaaagaagaaacagttcctgctcttcctgaccggaagtgatagaatccccattctgggaatgaagtcacttaagctggtcatacagtccaccggtggaggcgaagaatatttaccagtgtcgcatacgtgtttcaacctgctggatctgcccaagtatacagagaaagagaccctacgaagcaagttgatccaggccatagaccacaatgagggtttctccctaatctag

SEQ ID NO: 28955 - DNA, 726 bp, Artificial Sequence
  Description of Artificial Sequence: Synthetic coding sequence
atgaacagcggtcggcctgaaacaatggaaaatctccctgccctctatactatcttccagggagaggttgcgatggtgaccgattatggagcctttatcaaaatacccggttgccggaagcagggcttggtgcaccgcacgcacatgtcctcctgtcgcgtggacaagccttccgaaattgtggatgtcggtgataaggtgtgggttaagttaattgggagagagatgaaaaacgatcggatcaaggtttcactgtctatgaaagtggttaaccaaggcaccgggaaagacctcgatcccaataatgtgatcatagagcaggaggagcgcaggcggagaagctttcaagactatactggtcaaaagattacgctggaagccgtgttgaacaccacttgtaagaagtgtggctgtaaagggcacttcgccaaggactgttttatgcagcccggaggcactaaatattccctgatccctgacgaggaagaagagaaggaagaggctaagtcagccgaatttgagaagcccgaccccacaaggaatccaagtcgcaaacgcaagaaggagaagaaaaagaagaaacacagagatcggaagagctctgacagcgattcttctgacagcgagtcagacaccggcaaaagagccaggcacaccagcaaggactccaaggccgctaaaaaaaagaaaaagaagaaaaaacataagaagaagcataaggagtag

SEQ ID NO: 28956 - DNA, 870 bp, Artificial Sequence
  Description of Artificial Sequence: Synthetic coding sequence
atgattattaattggaatcaggtgtctgtactatggaagtgcctcctgaaacaatccgctagctatcaagatcgtaggcaatcctggagacgtgcaagtatgaaggagactaacagaaggaagtccctccaccccatccaccaaggaatcaccgagctctcgaggtccatatccgtcgatctggccgagagtaaaaggctgggctgtctactgctgtccagcttccagttctcaatccagaaacttgaaccatttctgagagatacgaaagggttctcacttgagtccttccgagccaaggcatctagtcttagcgaggagctaaaacacttcgcggacggactggaaactgatgggactctgcagaaatgtttcgaggactccaacggcaaagcttctgatttcagcctagaggcctccgtggccgagatgaaagagtatatcaccaagttttctctggaacggcagacctgggatcagctgcttctgcactaccagcaggaggcaaaggagatcctctctcgcggttcgaccgaggccaaaattaccgaagtaaaagttgagcccatgacctacctcggttcttctcagaacgaggtgctaaacaccaagcccgactaccagaagatacttcagaaccagagcaaagttttcgactgcatggagctcgtgatggacgaactacagggctcagttaaacaactccaggcatttatggacgaaagcactcagtgtttccagaaggtaagtgttcaactgggtaaacgctccatgcagcagctggatccatcccccgctagaaaactgctgaaacttcagctgcagaatcctccagccatccacggaagtggatctggcagctgtcagtag

SEQ ID NO: 28957 - DNA, 750 bp, Artificial Sequence
  Description of Artificial Sequence: Synthetic coding sequence
atgaccagcgtgactcgaagcgaaataatcgatgagctgagcaggagtatcagcgtggacctggccgagtcaaagcgtctggggtgcttgcttctgtcatcttttcaatttagtattcagaaactggaacctttcctgcgggataccaagggcttttctctggaatctttccgggctaaggcctcttctctctccgaagagctgaagcacttcgctgacggcctggagacagatggtactctccaaaagtgctttgaggactctaacggcaaggccagtgattttagtttagaagcctcagtggctgagatgaaggagtatatcactaagttcagtctggaacgacaaacatgggaccagctgttgctccattatcagcaggaagcaaaggagatcttgagtagaggcagcaccgaggcgaaaattacagaagtgaaggtggaacctatgacgtatctgggctcatctcaaaacgaggtactcaatacaaaacctgactaccagaagatcctgcagaaccagagcaaggtgtttgactgcatggagctcgtgatggacgagctccagggttctgtgaaacagctgcaggccttcatggatgagtcaactcagtgcttccagaaggtttctgtacagctgggcaagaggagcatgcagcagttggacccttctcctgctagaaaactgttgaaactgcagctgcagaatccacctgcgatccacggatctggatcaggaagttgtcagtag

SEQ ID NO: 28958 - DNA, 855 bp, Artificial Sequence
  Description of Artificial Sequence: Synthetic coding sequence
atgacctctgtcacaaggtctgagattatcgacgaacagagcgcctcttaccaagataggcgacagtcatggcggagagccagcatgaaagaaaccaaccgtcgcaaatcgcttcacccaatccaccagggaatcacagaactatccagatctatctctgtcgacctcgccgaaagtaagagacttgggtgtctgctgttgtcaagcttccagtttagcatccagaaactggaaccatttctacgcgacactaaggggttcagcctcgaatcttttagggctaaagcttcatctctctcggaggagttaaagcactttgctgacggactggagaccgacggcaccctgcagaagtgcttcgaagacagcaatggaaaagcaagtgactttagtctagaggcatctgtcgccgagatgaaggagtatattacaaaattctcactggaacgccagacttgggatcagctcctcctgcactaccagcaagaggctaaggaaatcctgtcacggggaagcaccgaagcaaagatcacagaggtgaaggtggaacccatgacttatctgggaagttctcagaacgaagttcttaataccaagcccgattatcaaaagatactccagaatcagtctaaagtgtttgattgcatggagctcgtcatggacgagctccagggatccgtcaaacagctacaggcttttatggatgaatctacccagtgctttcagaaggtcagcgtgcagctgggcaaacgatctatgcagcagctggacccttcgcctgctagaaaactcttaaagctgcaactccagaatcctcccgctatccatggttcagggagtgggtcttgtcaatag

SEQ ID NO: 28959 - DNA, 1071 bp, Artificial Sequence
  Description of Artificial Sequence: Synthetic coding sequence
atgacctccgtaacccgatcggaaattattgacgagaaaggtcctgtgatgtctaaaacgcacgatcatcagctggaatcttccctatcgcctgtcgaagtgttcgccaagacctctgcctcgctggaaatgaaccagggagtttctgaagaacggattcacttgggaagcagccccaaaaagggcggaaattgcgacctgagtcatcaagagcgcctgcagagtaagtctcttcacctgagcccccaggagcaatctgccagctatcaggatcgccgacagagttggagacgggcttcaatgaaggagacgaatcggaggaagtccctgcaccccatccatcagggcatcactgagcttagcaggtctatctccgttgacctcgcagagagtaagcgcttgggttgtctgctgctctcctctttccagttctcgatccagaagctcgagccctttttacgggacaccaaagggttttccctggaatcattccgcgcaaaggccagctcgctgtccgaggagctgaaacactttgccgacggattggaaactgacggaacactacagaagtgcttcgaggacagcaacggaaaggcttccgacttctctctcgaggccagtgtggccgagatgaaggaatatatcacaaagttttctctggagaggcagacttgggaccagctgcttctgcactaccagcaggaagcgaaagagatcctgtctagggggagcaccgaggcaaaaatcacagaggtgaaagtggaaccgatgacttaccttggaagcagccagaacgaggtgttgaataccaagcctgactatcaaaaaattctgcagaaccagtcaaaggtgtttgactgcatggaacttgtgatggatgagctccaggggtccgtaaagcagctacaggccttcatggatgagtcaactcaatgttttcagaaggtgtcagtgcagcttggaaaacgtagcatgcaacagttggatccgagccccgcacgaaagttactgaaactgcagttgcagaaccctccagcaattcacgggtccgggagtggttcatgtcagtag

SEQ ID NO: 28960 - DNA, 1071 bp, Artificial Sequence
  Description of Artificial Sequence: Synthetic coding sequence
atgaccagtgttacccgctctgagatcatcgatgaaaagggcccagtgatgtcgaagacccacgaccaccagctggaatctagtctctctcctgtggaggtattcgccaaaacctcagcttctttggagatgaaccagggagtgagtgaagagcgcatccaccttggctctagccccaaaaaaggcggtaactgcgacttatcccatcaggagcggctgcagagcaagagtctgcacctgtctcctcaggagcaatcagccagttaccaggaccggaggcagtcctggagaagggcatcaatgaaagaaaccaacaggcggaagtctctccatccgatccatcagggaattaccgagctgtccaggtcaatatcagtcgatctggccgaatcaaagcggctcggttgcttactactatccagctttcaattctctattcagaaactggagccattcctgagggacacaaaaggttttagcctggagtcctttcgcgctaaagccagtagcctcagtgaagagctgaaacacttcgcagatgggttggagactgatggcactctgcagaaatgctttgaggacagtaatggcaaggcctccgatttttctctagaagcctcagtggctgagatgaaggagtacataaccaagttttctctggaacgacaaacatgggaccaactgctgctgcattatcaacaggaggcgaaggaaattctttctcggggatctaccgaggcgaaaatcaccgaggtaaaggttgaaccaatgacctacctcggttcctctcagaatgaggtcctaaacacaaagccagactatcagaagattttgcagaaccagtccaaagtctttgactgcatggagctggtgatggacgagcttcaggggagtgtgaagcagttgcaggcattcatggacgaatctacacagtgtttccagaaagtgtctgtgcagctaggaaagcggtcaatgcaacagctcgatccatctcctgccaggaagctgctgaagctgcagttgcaaaacccccctgccattcacggatctggctctggttcatgccaatag

SEQ ID NO: 28961 - DNA, 1617 bp, Artificial Sequence
  Description of Artificial Sequence: Synthetic coding sequence
atggccgctgctgcctcagtcacaggacgtgtcacctgggctgcttcaccgatgcgtagtttaggccttggccgtcgcctgagtctgcctggaccccgactggacgcggtgactgcagccgtaaacccatctctgtcggatcacggaaacggcctaggccgaggcaccaggggctctggttgctctgggggatctctggttgctgactgggggggtggcgcagccgcagctgccgctgtggccctggctctggcgccagccctgtcaactatgagacgtgggtcttccgagagcgagctcgcagcaagatgggaggctgaagctgtcgccgctgctaaagcagcggctaaggccgaagcagaggctaccgccgagactgtagcagagcaggtgagagtggatgcaggagctgcgggagagccagagtgcaaagccggagaagaacagccgaaggtactggcccctgctcccgcacaacccagtgcagccgaagaggggaatactcaggtcctgcagaggccgccaccaacactcccgccaagcaagccaaaacctgttcaggggctctgcccccatggcaagcccagagataaggggcgtagctgtaagcgttccagcggccatgggtccggcgagaatggatcccaaaggccggtgaccgtggactcgagcaaggctcggacgtcgctcgatgccttaaagatctcaataaggcaactcaaatggaaggaattccccttcggcaggcggctgccctgtgatatctattggcacggggtctcatttcacgacaacgacatcttctctggacaggtaaataaatttcccggaatgaccgagatggtcaggaagatcaccctctcccgggcagtgcgaaccatgcagaacctgtttccagaggaatacaacttttatcccagatcatggattctccctgatgagttccagttgtttgttgcccaggtgcagatggttaaggatgacgaccccagctggaagcccaccttcatcgtaaagcctgacggcggatgccagggtgacggcatctatctcattaaagacccgagtgatattcgccttgccggtacgctacagtcccggccagcagtggttcaagaatacatctgtaaaccgctgttgattgacaaacttaagttcgatatccgcctatatgtcctgttgaaatcactggatccactcgagatctacattgccaaagacgggctttccaggttttgcacagaaccgtaccaggagcctacacctaaaaacctccaccgcatattcatgcacctgacaaattatagtcttaacattcacagcggtaactttattcactcagacagtgcctctacggggtctaaaagaacattttcatccattctgtgtcgactatcgtccaaaggcgtcgacatcaagaaagtctggtcagacattatctcagttgtaattaagactgtaatcgctctgactccggaactgaaggtgttctatcagtccgacatcccaacaggacgcccaggaccaacttgctttcaggtaactattgcgtcatctcagccagcattccctgctctgacaggactcaaacgtgcattgtggctgcgggtgggatag

SEQ ID NO: 28962 - DNA, 1356 bp, Artificial Sequence
  Description of Artificial Sequence: Synthetic coding sequence
atgacagagatggtgcggaagattacgctgtcgcgggctgtccggaccatgcagaacctttttcccgaggagtatatttgtaagccactgcttattgacaagttgaaatttgatattagactctatgttttgctgaaatccttagacccgttggagatttatattgctaaggacggcctatctcggttttgcaccgaaccgtaccaggaacccacccccaaaaacctgcatcggatatttatgcaccttacgaattacagcctgaacattcattctggtaatttcattcacagcgattccgccagcaccggttccaagcgcacctttagttctatcctctgtcggcttagctctaagggggttgatattaaaaaggtctggagcgacattatctcagtggtgataaagactgtgattgcgctgaccccggagcttaaagtcttctatcagtctgatattccaaccgggaggcctggccctacctgcttccagatcctggggttcgacatactgctgatgaagaacttgaaacctattcttttggaggttaatgccaacccatccatgagaatcgaacatgaacatgaattgagtcctggtgtttttgagaatgtaccctcccttgtggacgaggaggttaaagttgcagttatccgcgatacacttcggctgatggaccctctgaagaaaaaaagagaaaatcagtcccaacagcttgagaaaccttttgctggaaaagaggacgctttagacggtgagcttacatccgccccagattgtaatgcgaatccggaggcccacttgccttccatttgtttaaaacaggtgttccccaagtacgctaaacaatttaattacctcagactggtggatcgcatggcaaacctgtttattaggttcctcggcattaagggaaccatgaagctcggacccactgggttccggactttcattcgcagttgcaagctcagctcatcttctcttagtatggccgctgtcgacatcctgtacatagacatcaccagacgctggaattctatgacgttggaccagagggattctggaatgtgcctgcaagcctttgttgaagcattcttctttttggctcagcgaaagttcaagatgttgccactgcacgagcaggtggcctccttgatcgatctgtgtgaatatcacttgtcgctcctggacgaaaagagattggtgtgtggccgaggggttccatcgggaggcaggccacctcaccgaggacccccacaggaaccatctccgtcagcccagccggcaggcgacaacccccctccccgaacatcttgtgccaacaaactgtctcatccaagacatacactgtcatag

SEQ ID NO: 28963 - DNA, 1644 bp, Artificial Sequence
  Description of Artificial Sequence: Synthetic coding sequence
atgaaagtggtgaagtcggctgagcactataccgaaaccgcattggacgaaatccgactgctgaagagcgtccggaattccgatccaaatgaccctaatagggagatggtggtgcagctgctcgacgacttcaaaatttcaggcgtgaatgggacccacatttgcatggtgttcgaggtgcttgggcaccacctcctgaaatggattatcaagtctaattaccaggggttgccactgccctgtgtgaagaaaattatccagcaagttctgcagggattggactatttgcataccaaatgcagaattatccacaccgatataaaaccagagaacattctgctttctgtgaacgaacagtacattcggcgtttggcagctgaagccaccgagtggcagcgctccggagccccacctccgagtggaagcgctgtgtccaccgcccctcagcctaagccagccgataagatgagtaagaataagaagaaaaagctaaaaaaaaaacagaagcgacaggcagagttgctggagaagagaatgcaggagatcgaagagatggagaaggagtctggccctggacagaagagacctaataagcaagaagagtcggaatcccctgtggaacggcctttgaaagaaaaccccccaaacaagatgacccaagagaaattagaagagagttcgacgataggacaggatcagacattaatggaacgggacactgagggcggagccgctgagattaactgcaatggagtgatcgaggtcataaattatacccagaacagcaataatgaaacactacgccacaaggaggaccttcacaacgccaatgactgcgatgtccaaaatctcaatcaggaatcatcctttctgagctctcagaatggcgattcgagtacttcccaagagactgactcctgcactcctatcaccagcgaagtctctgatacaatggtttgccagtctagcagtactgtaggacagtccttctctgaacagcacatctcccagctgcaggagagcattagggcagagatcccgtgcgaagacgaacaggaacaagaacataacggccctcttgataacaaagggaagagtaccgcaggaaacttcctcgtcaacccacttgaaccgaagaacgccgagaagcttaaggtcaaaatagctgacttaggcaacgcatgctggcataagcactttacggaagacatccagacgcggcaatatagatctctggaggtgcttatcggcagcggctacaacactccagctgacatttggtctaccgcatgcatggcttttgagctggccaccggcgactacctcttcgagccccactccggcgaagagtatacgcgggacgaagatcacatcgtgcatataatcgagctaatcggcaggattccccgtagattctccctctctggcaagtactcacaagacttttttagccataggggtgacctgaaacatatcacaaaactgaaaccctgggggctctttgaagtgctggtggagaaatatgagtggtctcaggaggaggctgccggtttcaccgatttcctgctgcccatgctggaactgatcccagagaagagggcgaccgcggctgaatgtctgaggcatccatggctcaattcctag

SEQ ID NO: 28964 - DNA, 1968 bp, Artificial Sequence
  Description of Artificial Sequence: Synthetic coding sequence
atggaaaggaaagtgctagcattgcaagctcgcaagaagcgtaccaaagccaagaaggataaggctcaaagaaaaagtgaaactcagcacagggggagtgcgcctcatagcgaatcggacctgccggagcaagaggaggagatccttggttccgatgacgatgagcaggaggacccgaatgactattgcaagggtgggtaccatttagtgaaaatcggagaccttttcaacggccgttaccacgtgatccggaaactgggctggggacacttttctaccgtctggctctcttgggatattcaaggaaaaaagttcgtcgccatgaaggtggttaagagcgcagagcattacacagaaactgcccttgatgaaattagactactgaaatctgtgcggaattccgatcctaatgaccccaaccgggaaatggtcgtacagctccttgacgattttaagatttccggagtgaacggcacccacatttgtatggtgttcgaggttttaggacaccaccttctgaagtggatcattaaatccaattatcaggggctgccactgccttgcgtgaagaagataatccagcaggtattgcaggggctagattaccttcatacaaagtgtcgtatcatacataccgatattaagcccgagaacatcctcctgtccgtcaacgaacagtacatccggcgtctcgcagcagaggctactgaatggcagaggagcggcgctccacccccttctggctctgccgtgtctacagccccacagcctaagcctgccgacaagatgtcaaagaataaaaagaaaaagcttaaaaaaaagcagaaacggcaggctgagctgttggaaaaacgcatgcaggaaatcgaagagatggagaaggaatcaggcccagggcaaaaacggccaaacaaacaagaggaatcagaatcccccgtggagagaccactcaaggagaatcctccaaacaaaatgacccaagagaaattggaagagagttctaccatcgggcaggatcagaccttgatggagcgagatactgaaggcggtgctgctgaaatcaattgcaatggtgtcattgaggtgatcaattacacacagaatagcaacaacgagaccttgaggcataaagaggatttacataatgcaaatgattgtgacgtccaaaatctgaaccaggaatcttccttcttatcatctcagaatggcgactcttcaacttcacaagaaaccgattcttgtacccccattacctccgaagtgagcgatacaatggtctgtcagagctcctccacagtcgggcagagtttctccgagcaacatatttcacagctgcaggaaagcatcagagcagagattccgtgtgaggacgagcaggaacaggagcacaatggcccactggacaataagggaaagtctacagccggaaatttcctggtcaatcccctcgagccgaagaatgccgaaaaactgaaggtgaaaattgccgacctggggaatgcatgctgggtgcacaaacactttactgaagacatccaaacacgtcagtatcgcagccttgaggtgttgattggctccggatataacacgcccgcagacatttggagtaccgcctgcatggcgtttgagcttgctacgggagattacctgtttgagcctcactccggcgaagagtacactagagacgaggaccacatcgcactaatcatcgagctgctcggcaaagtgccaagaaagctcattgttgcgggtaagtactccaaagagtttttcacaaaaaaaggcgatctcaaacacattaccaagctcaagccatgggggctgtttgaggttttagtggaaaaatatgaatggagccaggaggaagcagctggctttactgactttttgttacccatgctggagcttattcccgaaaagagagctacagccgctgagtgtttacggcatccttggctgaatagctag

SEQ ID NO: 28965 - DNA, 864 bp, Artificial Sequence
  Description of Artificial Sequence: Synthetic coding sequence
atggcagcatctctctggatgggtgacctggaaccatacatggacgaaaactttatatcccgcgcatttgccacaatgggagagaccgtgatgtctgtgaagattatccgaaacaggctaaccggaattccggcaggctattgcttcgtggagtttgcggacctggcaacagcggaaaaatgcctgcacaagatcaacggtaagcctctgcccggtgccactccagctaagagatttaaattgaattatgctacatacggaaaacaacctgacaattccccagaatattctctgtttgtgggcgatctgacccctgacgtcgatgatggtatgctgtacgaatttttcgttaaagtctacccaagttgccgtgggggtaaggtggtgctggatcagaccggcgtgagcaaaggctatggatttgtgaagttcacagatgagctggagcagaagcgtgctttaactgagtgccagggagccgtggggctcgggagtaagcctgtgcgcctaagcgttgctatcccaaaggcctctcgcgtgaagcctgttgagtatagtcaaatgtactcttatagctataatcaatattatcaacagtatcagaattattatgcgcagtggggatatgatcagaacactgggagttattcatattcctacccccagtatggctatactcagtctaccatgcagacctacgaggaggtcggggatgatgcactggaggacccaatgccccagcttgatgtcaccgaggctaacaaggaattcatggagcagagtgaggaactctacgacgctctgatggactgtcactggcaaccgcttgataccgtttctagcgaaattcctgccatgatgtag

SEQ ID NO: 28966 - DNA, 438 bp, Artificial Sequence
  Description of Artificial Sequence: Synthetic coding sequence
atggccgagagaaacgaagatcaccatctgcaggtactgaaggaaagcgaagtgttgctccaagcgaagcgcgcagagttggagaaattgaagtcacaggtgacaagtcagcagcaagaaatggcagtgctggacagacagcttggtcacaaaaaggaagagttgcacctgctgcaggggtcaatggtgcaggccaaagccgatctgcaggaggctctccggctgggcgaaaccgaggtgacagaaaagtgcaaccatatccgcgaggtgaagagcctcctagaggagctctctttccagaagggagagttgaatgtccagatctcggaaaggaaaacccagcttacactgataaagcaggaaattgagaaagaggaggaaaatctgcaggtggttctgcggcagatgagtaagcataagaccgccttcctgcaatag

SEQ ID NO: 28967 - DNA, 3024 bp, Artificial Sequence
  Description of Artificial Sequence: Synthetic coding sequence
atgcagcatcttaagtcaaagaagcgagaagaaagatggatgagagcaagcaaaagacaaagcgaaaaggaaatggaggagctgcaccataatatcgacgacctgctgcaggagaaaaagtccttggaatgcgaggttgaggagctacacagaactgtgcagaagagacagcagcagaaggactttatagacggcaacgtggagtcactgatgacagagctcgagattgaaaagtccttgaagcaccacgaggacattgttgacgagatcgaatgcatcgagaagaccctattaaagagacggtctgagctcagagaggcagacagactcctggcagaggctgagtcagaactatcttgcaccaaggagaaggtgtgcttattggtggtctggggtgtttcttccgtctggactaagaatgcagtcgagaagtttacagatgccaagcgttcccttctacagacagaaagtgacgccgaagagctggagaggagagcgcaggagaccgcagtcaacttagttaaagccgaccaacaattgagaagcctgcaggctgatgcaaaggatttggagcagcataagataaagcaggaggagatcctgaaagagataaataaaattgtggctgccaaggactcggatttccagtgcctttccaagaaaaaggaaaaactgacagaggaactccagaagttacaaaaagacattgagatggccgaacgaaacgaagatcaccacctgcaagtcctgaaggaaagtgaggtcctactccaggccaagagggccgaacttgaaaaactgaagtcacaggtgacaagtcagcagcaggagatggccgtgcttgacagacagttgggtcacaaaaaggaggagcttcacctattgcaaggctcaatggtgcaggccaaagccgacctgcaggaggctttaagactgggagaaacagaagtcacggaaaaatgcaaccatatccgtgaagtgaaaagcttgctcgaagagttgagtttccagaagggggaactgaacgtccagatatcggaacgcaaaacgcagctgactctgatcaagcaagagatcgagaaagaagaggagaatttgcaggtggtcctccggcaaatgtctaagcacaagacagagcttaaaaacatattagatatgttgcagctcgagaaccacgaactgcagggtcttaagttgcagcacgaccagagggtgagcgaacttgaaaaaacccaggtcgctgtgcttgaggaaaagctcgaactggagaacttgcagcagatcagccagcagcaaaaaggcgaaattgaatggcagaagcagcttcttgagcgggacaaacgtgagatcgaacgcatgactgcagagtctagggctcttcagtcttgcgtcgaatgcctgtcaaaagaaaaggaagatctgcaggagaaatgtgacatctgggaaaaaaagctggcacagactaagagggtgcttgctgcagccgaggaaaattctaaaatggaacaatctaatctggagaaacttgagctgaacgttcggaagcttcagcaggagttggatcagctcaatagagataaactctcactgcacaatgatattagcgctatgcaacagcaactgcaagaaaagcgtgaggcagtgaactccctccaggaagagcttgccaatgttcaggatcatctgaacctggccaagcaggatctcctccatacaacgaagcatcaggacgtgcttctctcagagcagaccagattgcaaaaggatatttcagaatgggccaaccgctttgaggactgtcagaaagaggaagaaacaaaacaacagcagcttcaggttcttcaaaacgagattgaggaaaacaagttaaaactcgtccagcaggaaatgatgttccaacgcttgcagaaggagcgcgagtcggaggagtctaaactggagacatcgaaagtcactttaaaggagcaacagcatcagctggagaaagaattaacggatcagaaatccaagctggatcaggttctcagtaaggtcctggctgccgaggaacgggtccgaacgctgcaagaggaggagcggtggtgcgaatctcttgagaagactctttcacagacaaaacgccagctgagcgagagggagcagcagctggtagagaagtctggggagttgttggccctacaaaaggaagcagattctatgagggccgattttagtcttctaaggaatcagtttctgaccgaaagaaaaaaggcggagaagcaagtggcgagtctcaaggaggctctaaaaatacagaggtctcagctggaaaagaatcttctcgagcagaagcaagagaactcgtgtatccagaaagagatggcgaccattgagttggtggctcaagataaccacgaacgcgctcgccgactcatgaaggaactgaaccaaatgcagtacgaatatactgagttgaagaaacagatggcaaaccaaaaagatctggaacggaggcagatggagatttcagacgccatgaggaccctgaagtctgaagtcaaagacgaaattagaactagcctcaaaaatctgaaccagttcttgcctgaactgcctgccgacctggaggcaattctcgagagaaatgaaaatctggaaggtgagctagaatctcttaaagagaacctgccattcacaatgaacgagggcccatttgaggagaagcttaacttctctcaggtccatatcatggatgaacactggcgaggggaggcactgagagagaagcttaggcatagggaggatcggcttaaggcccaactgcgccactgtatgtctaaacaggcggaggttcttatcaagggtaaacggcagactgagggtaccttgcatagtctgcgcagacaagtggatgctctcggcgagctggtgacgtctacaagcgccgacagtgccagcagcccctctctgagccagttggagtccagtcttacagaagactcacagctgggtcagaaccaggagaagaacgcctctgcaaggtag

SEQ ID NO: 28968 - DNA, 2985 bp, Artificial Sequence
  Description of Artificial Sequence: Synthetic coding sequence
atgaaggcccagaaatccgggaaggagcaacagctcgacatcatgaacaaacagtatcagcagctcgagagtcgcctggatgagattttatctcgtattgctaaggagaccgaagagatcaaggatctcgaggagcagttgaccgagggacaaatcgccgcaaacgaggcactcaaaaaagatctggagggcgtgattagtggtctgcaggaatatctcgggactattaaaggacaggctacccaggcccaaaatgagtgtcgtaagctccgcgacgagaaagagacactcttgcagcgcttaacagaggtagagcaggagagagaccagctggagatcgtcgcaatggacgctgagaacatgagaaaagagttggccgagctcgagtccgctcttcaggaacagcacgaggtgaacgcatcattgcagcagacccagggtgacctgtctgcatacgaggccgagctcgaggcccgtctgaatctgagggacgccgaggctaatcagctgaaggaggagttggagaaagtgactcgattaacccagttggagcagagcgcgttgcaggcagaactggaaaaggaacgccaggcactgaagaacgccctgggtaaggcacagttctcagaggaaaaggagcaagaaaactccgaattgcacgccaagttgaagcacctgcaggacgataacaatctgttaaagcagcagcttaaggattttcagaatcacctaaaccacgtggtagatggtctggtccgcccagaggaggtcgctgctcgagtggatgaactgcggagaaaactgaagttaggaacaggagagatgaacatccacagcccctccgatgtcttggggaaatcgctggccgaccttcaaaagcagtttagtgagatactggcacgtagtaaatgggaacgagacgaggcacaggtgcgagagcgtaagctccaggaggagatggcgctgcaacaggaaaagttagccaccgggcaggaagaatttcgtcaggcctgtgaaagagctctggaagcacggatgaatttcgataaaaggcagcacgaggcgagaatccagcaaatggagaacgagatccactatctccaagagaacttgaagagcatggaagaaatccagggcctcacagaccttcagctccaggaggccgacgaggaaaaggaaaggatcctggcacaattacgcgaactcgaaaaaaaaaagaagctggaggacgctaagtcccaggagcaggtgtttggacttgacaaggagctgaagaaattgaaaaaggctgttgccacatccgataaactggccaccgcagagcttacgatcgctaaagatcagctgaaatcgctccacggaaccgttatgaagataaaccaggaacgggcagaagaattgcaagaggcagaacgctttagcaggaaggctgcgcaggctgcacgggacctaacacgcgctgaggcggagatcgaactgctccagaatctgctgagacagaaaggggagcagttccggcttgagatggagaagaccggagtgggaaccggggcaaacagtcaagttcttgagattgaaaaactaaacgaaaccatggagagacagcggaccgagattgctcgtctgcagaatgtcttagaccttacaggcagcgataacaagggaggctttgagaatgtgcttgaagaaatcgcggagctgcgcagggaagtctcttatcagaacgactacattagctcaatggccgacccttttaaacggaggggttactggtattttatgccaccgccacctagctctaaggtaagttcgcactcctcacaggccacaaaagactctggggtggggctgaaatattcagcatcaacccctgtgcgaaaacccaggccaggtcaacaggacggaaaggagggttcccagcctcccccagccagcggatattgggtatactcacccatccgaagcgggttacacaaactgttcccctcaagagacgccgatagcggaggggattcacaggaggagtctgagctcgacgatcaagaagagccccctttcgtgcctccccctggctacatgatgtacacggtcctccccgatgggtcgccagtgcctcagggcatggcactgtatgcgcctcccccacccctgcccaacaattctcgtcccctcacaccaggtactgttgtatacggacctcccccagccggagccccaatggtgtacggcccaccacccccaaactttagcatcccatttataccaatgggagtcttgcactgtaacgtgccagaacatcacaacctggagaacgaggtttcccgacttgaggacattatgcagcatctcaagtccaagaagagggaggaaaggtggatgcgggcttccaaacggcagagtgagaaggagatggaggagctccaccataatatcgacgatcttctccaggagaagaaaagtttggaatgcgaagttgaggagctccatcgcacagtccagaagcgacagcagcagaaggattttatcgacggcaatgttgagagtcttatgaccgagctggagatcgagaaaagtctaaaacatcacgaggatatcgttgacgaaatcgagtgcattgaaaagacactcctgaaaagacgctctgagctgagggaggccgataggctgctagctgaggctgaatctgaactgagttgcaccaaagaaaaaacaaaaaacgctgtcgagaaattcacagatgcaaagcgatccttgctacagacggagtccgacgccgaagagctggagagaagggctcaagaaaccgccgtaaacctcgtgaaagcggaccagcagctgcggtcgctgcaggccgacgcaaaagacttggaacagcataagatcaagcaggaagaaattctcaaagaaatcaacaagattgtggcagccaaagatagtgactttcagtgtctcagcaagaagaaggaaaagctcactgaggagtag

SEQ ID NO: 28969 - DNA, 5321 bp, Artificial Sequence
  Description of Artificial Sequence: Synthetic coding sequence
atgaaagctcagaaatcggggaaggagcagcagctggatattatgaacaagcagtatcagcagcttgaaagcaggctcgatgaaattctgagccggatcgctaaagaaacagaggaaataaaagacctggaggagcagctgacagaaggacagattgccgcaaacgaggcactaaaaaaggacctggagggcgtgatctccggcctgcaggagtaccttggtactatcaaagggcaagcaacgcaggcacagaatgaatgtcgcaagctcagggatgaaaaagagaccttactgcagagactgacagaggtagagcaagagcgagaccaactggaaattgttgccatggacgccgagaacatgcggaaagagttggctgagctggagtctgcgcttcaagaacagcatgaggttaacgcctctttgcagcagactcagggggacttatctgcatatgaagctgaactggaggcgaggcttaacctacgggacgccgaagccaaccaactgaaggaggaactggaaaaggtcacccggctcacgcaactcgagcagtccgctctgcaggccgagctggaaaaggagagacaggcccttaagaacgcgctagggaaggctcagtttagcgaagagaaggagcaagagaacagtgaactgcacgccaagctgaagcacctgcaggacgacaacaaccttctcaaacaacagctaaaagattttcagaaccacctgaaccacgtggtggatgggctggtcaggcctgaagaggtcgctgcgagggtggatgaactgagaagaaaactgaagcttggcaccggcgagatgaacatccatagtccttccgacgtgttgggcaagtcactggcagatctgcagaaacaattctccgaaatcttggccaggtccaagtgggaaagagatgaggcacaagttcgggagagaaagctacaggaggagatggctctccaacaagaaaagctagcgacaggtcaggaggagttccgccaagcttgcgaacgtgctttggaagcgaggatgaacttcgataagagacagcatgaggccagaattcagcagatggaaaacgagatccactacttacaagagaacctcaaaagcatggaggagattcagggtctgaccgatctgcaactgcaagaagccgatgaggagaaggaaaggattctggcccagcttcgagaactggagaagaagaaaaagctggaagacgccaagagtcaggaacaggtattcggacttgacaaagagctcaagaagctaaaaaaggccgttgctacatcggacaaattggctacagctgagttgacaatcgcaaaagatcagctcaagtcgcttcatgggaccgtgatgaaaattaaccaggagcgggctgaggaactccaagaggccgaaagattttcccggaaggcggcacaggccgctagggatctgaccagagcagaagcggaaatcgagctactgcagaatttgctgagacagaaaggagaacagtttcgcctcgagatggagaagactggtgtgggcacaggtgctaactctcaggtgctcgaaatcgagaagctcaacgagacgatggagcggcagcgaacagagattgcccgtcttcagaatgtcctggacctcaccgggagcgacaataaaggtgggttcgagaacgtactggaagagatcgccgagttacgtcgggaggtctcctatcagaacgattacatttcaagtatggccgaccccttcaagagaagaggctactggtatttcatgccacctcctccgtcaagcaaagtgtcatcccatagctctcaggccaccaaggactctggggtcggactgaagtatagtgcttcaacccccgtgagaaaacccagaccgggtcagcaggatggaaaagagggctctcaacctccccctgcttcaggttattgggtgtattctcccatccgcagcggactgcacaaactgtttccaagcagagacgcagattctgggggagactcccaagaagagagcgaactggacgatcaggaagagccaccgttcgtccccccacccggatacatgatgtacacggtgctccctgatggcagccctgtaccacaggggatggccctgtatgctccgccaccaccccttccaaacaattcccggcctctcacccctggcacagtagtctacggacccccacccgctggcgctccaatggtctacggccctcctcctccaaattttagcatcccattcattccgatgggcgttctgcactgcaatgtgcccgagcaccacaatctggaaaatgaggtgtccagactggaagatatcatgcagcacctgaagagcaagaagagggaagagaggtggatgcgagcctccaaacgccaatccgagaaggaaatggaagagttgcaccataacatagacgatctcttacaggaaaagaagtctctagaatgcgaggtcgaagaattgcacagaacggtacagaagagacagcagcagaaagactttatagatgggaatgtggagtcactcatgaccgagcttgagatcgagaagagcctgaagcaccatgaagacatcgttgatgagatcgaatgtatagagaaaactctgctcaaacgcaggagtgaactgcgagaagctgatcgcctgttggctgaggccgaatccgagctgtcatgcactaaggaaaaaaccaagaacgctgtggaaaagttcaccgatgcaaagagaagtttgctccagactgagtctgatgccgaagaactggaacgacgggcacaagagacagctgtaaacctggtaaaagctgatcaacaactcagatcattacaggctgacgctaaggacctggaacagcataagatcaagcaagaagagatcctaaaagaaataaacaagatcgtggctgccaaggactcggattttcaatgtttgtccaaaaagaaagagaaactgactgaggaactgcagaagcttcaaaaagacattgaaatggctgagcgaaacgaggaccatcacctgcaggtactgaaagagagtgaagtgttactgcaggccaaacgggctgagctcgaaaagcttaagtcccaggttacttcacagcagcaggaaatggctgtgctggatcggcagctgggtcacaagaaggaagaactgcacttgctgcaaggctctatggtgcaagcaaaggccgatctccaggaggccctgcgcctcggcgaaacggaggtgaccgagaagtgtaaccacatccgggaagtgaagtctttgctcgaagagctctctttccagaaaggcgagctgaacgtgcagatttccgagcgcaagacccaactaaccctcattaagcaggagatcgagaaggaggaggagaatctgcaggtggtcctgcgacaaatgtcaaaacacaagaccgaattgaagaacatccttgacatgctgcagctggagaaccacgagttacaaggactcaagctgcagcacgaccagagagtttcagaactggagaaaacccaggttgctgtccttgaggagaagctggagctggaaaacctccagcagatctcccaacagcagaaaggcgaaattgagtggcaaaaacagctgttggagcgagacaaacgtgagattgagagaatgactgccgaaagccgcgcacttcaaagctgcgtagagtgcctctccaaggagaaggaggacctgcaggaaaagtgcgatatttgggaaaaaaaactggcccagaccaagcgtgtcctagccgcagctgaagagaactcaaagatggagcagtctaatctggagaaactcgaactgaatgttcggaagttacagcaggaacttgaccagctgaaccgggataaattgtcactgcacaacgacatttctgcgatgcagcagcagctgcaggagaagcgagaggctgtaaattcgctccaagaggagctggcaaatgtccaggatcacctgaacctggctaagcaggatctgctacatacaacaaaacaccaagatgtgctgctgagcgagcagacgcgcctccagaaggatatttcggagtgggcaaacaggtttgaggactgtcagaaagaggaggagacaaagcagcagcaattgcaggtcctgcagaacgaaatcgaagagaataaattgaaattggtacagcaggagatgatgttccagcgtctacagaaagaaagagaatccgaggaatcgaagctggaaacaagcaaggtgaccctgaaagaacagcaacatcagctggagaaggaactcacagaccaaaaatccaaactggatcaggtactttccaaggtgttagccgcagaggaaagggtgcgtacgcttcaggaggaggaaagatggtgcgagagtttggaaaaaacccttagtcagactaagcgtcaacttagtgaacgggaacagcaattggtcgagaagtcaggtgagctgctggctctgcagaaggaagccgattcaatgagggcagatttttcactcttaagaaaccagttcctcacagaaaggaaaaaagccgagaagcaagtcgcctccctaaaggaagctctgaaaatccagcgctctcagctggaaaagaacttgcttgagcagaagcaggagaattcatgtatccagaaggagatggccacaatcgaattggtagcacaggacaaccatgagagggctaggcggcttatgaaggagctaaatcagatgcaatatgaatataccgaattgaaaaagcagatggctaaccagaaagatctggagcgcaggcagatggagatctctgacgctatgagaacacttaagtctgaggtcaaggatgagatccggactagcttgaagaacctgaaccaattccttcctgagctgcccgcagacctggaggccatcttagaaagaaatgaaaatcttgaaggcgagcttgagagcctcaaagaaaatctcccctttacgatgaacgaggggccattcgaggaaaaactgaacttttcccaggttcatatcatggatgagcattggcggggagaggccctgcgcgaaaaactacggcacagagaggatcgccttaaagcacagttaaggcattgcatgtcgaagcaggcagaagtcctgataaaagggaaacgacagacagaaggcacgctgcacagcctccgtagacaggtggacgcgctaggcgaactcgtgacgtctacctcagcagattctgccagcagcccatccttgtctcagctcgagagctctcttacggaggattcccagctgggacagaaccaggaaaaaaacgcatcagcaaggta

SEQ ID NO: 28970 - DNA, 2487 bp, Artificial Sequence
  Description of Artificial Sequence: Synthetic coding sequence
atggaaaaacagaaacaggagatcgccggaaagcagaaggagataaaagacctgcagatcgccatcgattcattggacagcaaagacccaaaacactctcatatgaaggctcaaaagtcgggaaaggagcagcaactcgacataatgaataagcagtaccagcagttagagtcccgcctggatgaaattttgagtcgaatagctaaagagaccgaagaaatcaaagacttagaagagcagcttaccgaaggacaaatcgcagctaatgaagcacttaaaaaagacctcgaaggtgtcatttctggcctgcaggagtatctgggaaccataaagggacaggccacacaggcccaaaatgagtgcagaaaactccgggatgagaaggagacgttactccagagactgactgaggtggaacaggagagagaccaattagaaatcgtagccatggatgcagagaatatgcggaaggagcttgcagagctcgaaagtgctctccaagagcagcacgaggtgaacgcttcactccagcaaacccaaggagatttgtctgcatacgaagccgaactcgaggcaagactgaacctccgggacgccgaggcaaatcagttaaaagaggaacttgagaaggtgacacggttaacccagctggaacagtccgctctccaggcagagcttgagaaagagcgtcaggccctgaagaatgctcttggcaaagcccagttttcagaagaaaaagaacaggagaacagtgagctgcacgcaaaactgaagcatctgcaagatgacaataaccttctgaagcaacagctcaaggactttcagaaccacctcaaccacgtggtggatgggctagtaagacccgaggaggtcgccgctcgggtagatgagctgaggagaaagctgaagctggggacaggcgagatgaatatccactctccatcagatgtgctggggaagagcttggccgatctgcaaaagcagttctcagagatacttgcgcgttccaaatgggaaagggacgaggcgcaggtccgtgagcggaagctgcaggaagaaatggcgttgcagcaagagaagcttgccactggtcaggaggaatttagacaggcctgcgagcgcgctctggaggcgcgaatgaacttcgataagcggcagcacgaagcccgaattcaacagatggagaatgaaatacactatctgcaggagaatcttaagtcaatggaagagattcagggtctgactgatctgcagctccaagaggcagatgaagaaaaagaacgaatccttgctcagctgcgcgaactggagaagaagaaaaaactcgaagacgccaagtctcaggaacaggtcttcggtctcgacaaagaactgaaaaaattgaaaaaagccgtcgccacttcagataagctagccactgccgaacttacaattgcgaaggatcagttgaagagcttgcacggcactgttatgaagattaaccaagagagagcagaggaactgcaggaggctgagaggttctctcgaaaggctgcccaggccgcacgtgacctgacaagagcagaggccgagatagagctgttgcagaacctcctgcgccaaaagggggagcagtttcgactggaaatggagaagactggggtcggaaccggcgctaactcgcaggtgctggaaattgaaaagctgaatgagacaatggaaaggcaaagaactgagattgcgaggctgcagaacgtgttggacttgactggctctgacaataaagggggattcgagaacgtcctggaggagatcgcagaactgcgacgggaagtctcatatcaaaacgattacatatcttccatggcggatcccttcaagcgccgaggatactggtatttcatgcccccaccacccagctctaaggtgagctcacacagctcacaggcaactaaggattctggagttggtctgaagtatagcgctagcacaccggtcagaaagccaagacccggacaacaggacggcaaggaggggagtcaaccacctcctgccagcgggtactgggtttatagccccatacgaagtggactgcataagctgttcccctcgagggatgctgatagtggcggagattcacaagaggagagcgaactggacgatcaggaggaacctccgtttgtgccgccacctggatatatgatgtatacagttcttcccgacggaagtcctgttccccagggcatggcactttatgctccaccccctccgctccctaataatagcagacccctcactcccggtacagtggtgtacggaccacctcctgccggtgcgccaatggtttatggaccacctccacccaatttctctataccattcatcccgatgggcgtactccactgtaatgtgcccgagcaccacaacttagtgtctgggaaaacctacaactctctgtcgaccctcctgccttgggtgaccgacaaggtcatatatttgatgtcctag

SEQ ID NO: 28971 - DNA, 6977 bp, Artificial Sequence
  Description of Artificial Sequence: Synthetic coding sequence
atgaagaaggggtcccagcagaaaatctttagcaaagcgaagattccttcaagctcccattcccctattccttcatctatgagtaacatgcggtctcgttcgttgtcaccactaatcggctccgagaccctaccattccactccgggggacagtggtgcgagcaggttgagattgcagacgaaaataacatgctccttgattaccaagatcacaaaggagcagattctcacgccggtgtgcgatatatcaccgaggcccttataaagaagcttacaaaacaggacaacttggcactgatcaaatccttgaacctctccttgagcaaagacgggggaaaaaagtttaaatatatagagaacctcgagaaatgcgtgaaactagaagtgctaaacctgtcatacaacctgattgggaagatcgaaaagctggataagctactcaagctacgcgaattaaatctgagttacaataaaatatcaaaaattgagggtattgagaatatgtgcaatttacagaagcttaatttggccggaaatgagatcgaacacatccccgtttggcttgggaaaaaactcaaatccctcagggtcctcaatctgaagggaaataagatttcatccctgcaagatatttctaagttgaagcccctgcaagacctgatctccctgattctggtcgaaaaccctgtagtgaccctaccccactacctccagttcacaatattccatctcagatcactggaaagcctcgaaggtcagccagtgaccacccaggaccgccaggaggctttcgagagattctccctcgaagaagtcgagagactggagcgggacctggaaaagaagatgatcgagaccgaggaattgaagtccaagcagacgcgctttttggaggagatcaaaaaccaagataaattgaataagtcactgaaagaggaggcgatgctccagaagcagtcctgcgaggagctcaagtccgacctgaatacaaagaacgaactgctcaaacagaagaccatagagctcacccgcgcatgccagaaacagtacgagctcgagcaagaactggccttttataagattgacgcaaaatttgagccgctgaactactaccccagcgaatacgccgagattgataaggccccagatgaatctccatacattggcaagagtaggtacaaaagaaatatgttcgccactgagagctacattatcgactccgcacaggctgtgcaaatcaagaaaatggaacccgacgaacaactgaggaatgatcatatgaacctaaggggccacactccactagacactcagttagaggacaaagagaagaagatctcggctgcgcagacaagattgagcgaactgcacgatgaaatcgaaaaagccgaacagcagattcttcgggcaaccgaggagttcaagcaactcgaggaggccatccagcttaagaaaatctcggaggcaggcaaagatctgctttacaagcagctctctggcagactgcagctcgtgaataagctccgccaagaggccctagacctcgaactccaaatggagaagcaaaagcaagaaatcgccggaaagcagaaggaaatcaaagatctccaaattgcaattgacagcctggattccaaggatccgaagcactcacatatgaaggcgcagaaaagcgggaaggagcaacaactcgatattatgaataagcagtatcagcagctggagtccagattagatgagatcttgtcccgcattgccaaagagactgaagaaattaaggaccttgaagaacagctaacagaaggacaaatcgcggcaaacgaggccctaaagaaagatctcgagggggtgatctcgggtctccaagaatacttggggactatcaaaggacaggcaacccaggcccagaacgagtgccggaaactcagagacgagaaggaaacgctcctgcagaggctgaccgaagtggaacaggagcgcgatcaactcgaaatcgtagccatggacgccgagaatatgaggaaggagcttgcagaactggaatccgctctgcaagaacaacacgaggtgaacgccagtctgcagcagacgcagggagatctgagcgcttacgaggccgagctggaggccagactgaacctgagagacgcagaggccaaccagctcaaggaagaattggaaaaagtcaccaggttaactcaactggagcagtcagcactgcaagcggaattagagaaggagcgacaagctctaaagaacgctctaggaaaggcccaatttagcgaggagaaggagcaggagaattctgagctgcacgctaagctgaagcacctccaagatgacaacaatctcctcaaacagcaactgaaggactttcagaaccatttgaatcacgtcgtcgatggcctcgtcagaccggaggaagttgcagcccgtgtggatgagctgaggcggaaactgaagcttggaaccggagagatgaacattcactctccctcagacgtgttgggcaagtcccttgccgatctacagaagcagtttagcgaaattttagctaggtccaagtgggaaagggatgaggcccaagtccgggagcgaaagctacaggaagagatggctctgcagcaggaaaaactcgccaccgggcaagaggaattccgtcaggcatgtgagcgtgcgttggaggctcgtatgaatttcgacaagaggcagcatgaggcaagaattcagcagatggagaacgaaatacactacctgcaagagaacttgaagagcatggaggagattcaggggctgactgacctacagctgcaggaggctgatgaagagaaggaacgaatcttagcgcaactgcgcgaactagaaaagaagaagaagctggaggatgccaaaagtcaggagcaagtgtttgggctggacaaagagctgaaaaaattgaagaaggcagtagccacctccgacaaactggccaccgccgaactcaccatcgccaaagaccagctgaagtcacttcacggcactgtaatgaagatcaatcaggagagagcagaagagctgcaagaggcagagcgttttagtaggaaggcggcacaggccgcaagggacctgaccagggcagaggccgagatcgagctgcttcagaacctgctgcgtcagaagggagagcagtttcggctggagatggagaagaccggggttgggacaggggcaaactcgcaggtgctggagatcgaaaagctgaacgagacgatggagaggcagcgtaccgagatcgccagattgcagaacgtgctggatctcacaggttccgacaataagggaggttttgagaatgtgcttgaagagatagcggaacttaggagagaagtctcataccaaaatgactacatctcatccatggctgatccctttaagagaaggggctactggtatttcatgcctccccctcctagctctaaggtgagctcacacagttcccaggccacaaaggattctggcgtgggtcttaaatacagtgcctccacccctgtaaggaagccgagacctggtcaacaagacggcaaagaaggttcacagccccctccggcttccgggtactgggtgtacagccctataaggagtgggctgcacaagctgttccccagtagagacgccgattccggaggcgactcccaggaggagtctgaattagacgaccaggaggaaccgcctttcgtacctccccctggttatatgatgtatactgtgctgcccgacggcagtcctgtcccccagggtatggccctatatgccccacctcccccactacccaataactcccggcctttgacacctggaactgtggtgtacggaccgccacccgcaggcgcacccatggtgtacgggccaccaccccctaacttcagcatcccctttatcccaatgggtgtgctgcactgcaatgtacccgaacatcataacctagaaaatgaggtctcccgactggaagatatcatgcaacatctcaagtctaaaaaacgagaagagcgatggatgagggcctccaaaagacagagtgaaaaggaaatggaggaactgcaccataatatcgacgatctcctgcaggagaagaaaagtctcgagtgtgaggtggaagagctccatagaaccgtgcagaaacgccagcaacaaaaggattttatcgacggaaatgtagaatctcttatgacagaactggagatcgaaaaatctcttaagcatcacgaggatatcgtggacgaaatcgagtgtatagaaaagacactgctgaagcggagatctgagttgcgagaagcggaccgtctgctcgccgaggctgagagcgagctgtcatgtaccaaggagaagacaaagaacgcggtggagaagttcaccgacgcaaaacgctctctgcttcaaactgagagcgatgccgaagagttagagagaagggctcaggagacagccgtcaacctcgtgaaggccgatcaacagcttaggagcttacaggccgacgctaaagatctcgagcagcacaaaattaagcaggaggaaattttgaaggaaataaacaagattgtggctgcgaaggattctgacttccagtgtctctctaaaaaaaaagaaaagctgactgaagagcttcagaagctccagaaggatatcgaaatggcagagcgcaatgaagaccatcatttgcaagtgctgaaagagtcggaggttctgctgcaggctaaacgcgctgaactggaaaagctgaagagtcaggtgacctcacagcagcaggagatggctgtgttggaccggcagcttggacacaaaaaagaggaactgcaccttttacaaggctcgatggtccaagctaaagccgacctgcaggaggccctgcgcctgggggaaacggaggtaacagaaaagtgcaatcacattagagaggtgaagtcccttttagaggagctctcattccagaaaggggagcttaatgtgcaaattagcgagcggaagactcagttgacattaatcaagcaagaaatcgagaaggaagaagaaaatttgcaggtagttcttaggcagatgagtaaacacaaaacagaattaaaaaacatcctagacatgttgcagcttgaaaaccacgaattacaagggctcaagcttcagcatgatcagcgcgtgagcgaactcgaaaagacccaggtggcggtcttagaggagaagctcgaactcgaaaacctgcaacagatttcccagcagcagaagggggagattgagtggcagaagcagttgttagagagagacaaacgcgaaattgagagaatgacagccgaaagccgcgcactgcagtcttgtgttgagtgtctgagcaaagagaaggaggatctgcaagagaagtgcgatatctgggaaaaaaagctggcacaaactaagagagtcctcgctgcggcagaggaaaattccaagatggagcagagcaatctagaaaaattggagctgaatgtgcgtaagctgcagcaggaactggaccaactgaatcgagataaactgtccttacataacgatatctcagccatgcaacaacagctccaagagaagagggaagcagttaatagcctgcaagaggagctcgccaacgttcaggaccacctcaatttagccaagcaggatctcctccatacaaccaagcaccaagatgttctgcttagcgaacagactagactgcagaaggacatcagtgaatgggctaataggttcgaggactgtcagaaggaagaggagactaagcagcagcagctgcaggtcctgcagaacgaaattgaagagaataagctaaagcttgtgcagcaggaaatgatgttccagcgactgcagaaggagagggaatccgaagaaagtaaactggaaaccagtaaagtgactttgaaagaacagcaacaccagttagagaaggagctgaccgatcaaaagtctaaactggaccaagtgttatctaaggtgctggccgcagaggagagagtgaggaccctccaggaggaagagaggtggtgcgagtctcttgaaaaaaccttaagccagaccaagcggcagctttccgagcgtgagcagcagttggtggaaaagtcaggtgaactgttagccctccagaaagaagccgactctatgagggcagatttttcccttctgagaaaccagttcctaactgaaagaaagaaggccgagaaacaggttgcaagcctcaaagaagctctgaaaatccagcggtcgcaactagagaagaacctcctcgaacagaaacaggaaaactcttgtatacaaaaggagatggctactattgaactggtagcacaggacaatcatgagagagctcgacggctgatgaaggagctgaatcagatgcagtatgaatacaccgagctaaagaaacagatggccaatcagaaggacctcgagagacgccaaatggagatttcggatgcaatgagaacactgaagtctgaagtcaaagacgaaatccgcacaagcctcaaaaacctgaaccagttcctccctgagctccccgcagacttggaggccattttggaaagaaatgaaaatctggagggtgagctggagtcgcttaaagaaaacctgcccttcactatgaacgaaggtcccttcgaggaaaaacttaacttttcccaggttcacatcatggacgagcactggcgcggtgaggctctgcgggagaagctgagacatagggaagaccggttgaaggctcagttaagacactgcatgagcaaacaggccgaagttcttattaaaggcaagaggcaaactgaaggaactttacactccttgcgtaggcaggttgacgcgctaggagaactggtcacttccacatccgcagattctgcttcttctccaagcctgtcacagcttgagtcatcactaacagaggattcacaactgggccagaatcaggagaaaaacgctagtgcgagata

SEQ ID NO: 28972 - DNA, 1359 bp, Artificial Sequence
  Description of Artificial Sequence: Synthetic coding sequence
atgaagaagggttctcagcagaaaatcttttcaaaggcgaagataccttcctccagccactcccccatcccctcttctatgtctaacatgcgcagtcgatctttgtccccactgatcggctctgagactcttcccttccactcagggggacaatggtgcgagcaggttgaaattgccgatgagaacaacatgctgttagattatcaagatcacaagggagctgattcacacgctggcgtccgttatatcaccgaggcactgataaagaaactcacaaagcaagacaacctggcactcattaagagtctcaatctgtcattatccaaggatgggggaaagaaatttaagtatattgagaatctagagaaatgtgtgaagctcgaggtgctgaacctgtcatacaacttaatcggcaagatagaaaaactcgacaagctcctgaaactgagagagctgaacttgtcctataacaagattagcaagattgaagggatcgagaacatgtgtaatctccagaagttgaacttggccggaaacgaaattgagcatatacccgtatggcttggaaagaaattgaagtctctgagggttctgaatttgaagggcaataaaatcagcagtctccaggacatttcgaagttgaagccccttcaggacctgatttctctcatacttgtggagaaccctgtggtgactttacctcattacctgcagttcacaatttttcacctccggagccttgaatcactggagggacaacccgtgaccacacaggacaggcaagaagccttcgagcgcttctccctagaggaagtcgagcgtttggagcgggatttggagaagaaaatgattgagactgaggaactcaaatctaagcaaacaaggtttcttgaagagatcaagaaccaggataagctgaacaaatcactcaaggaggaggcaatgcttcaaaaacagagttgcgaagagttaaagagcgatttgaataccaagaatgaactgcttaagcagaaaactatcgaactgacacgagcctgtcaaaaacaatacgagctcgagcaggagctcgccttttacaaaatcgacgccaaatttgaaccattgaattactacccaagcgagtacgccgaaatcgacaaggccccagacgagtccccttacatcggtaagtcaaggtataagagaaacatgtttgccacagagagctacatcattgacagtgctcaagccgtccaaatcaaaaaaatggaacctgatgagcagctgaggaatgaccatatgaatctgagaggtcatacgccgctggacacgcagttggaggatcacaaactggactaccagaactgcatgatgaaatag

SEQ ID NO: 28973 - DNA, 1053 bp, Artificial Sequence
  Description of Artificial Sequence: Synthetic coding sequence
atgtgctgcgattcagactttgttgccaggaacaagagccaagattcaggaatcgctgagatggaagagctaccagtgccccacaacattaagatctccaatattacctgcgattcctttaagatcagttgggaaatggatagtaagtccaaggataggataacacattacttcatcgatcttaataagaaagagaacaaaaactctaacaaatttaagcacaaggacgtccccaccaagctggtggctaaggccgtgcccctgccgatgacagtacgcggacattggttcctgtctccacgcacggaatatacagtcgctgtacagacagcaagcaagcaggtggacggggattatgttgtgtctgagtggtctgagatcatcgaattttgtacagcagattactccaaagtgcatttgactcagctgctggaaaaggcagaggtcattgctgggagaatgttgaaattttccgttttttatcgaaatcaacacaaggagtacttcgactatgtgcgagagcatcacgggaacgcaatgcagcccagtgtgaaagataacagcggcagccacggatctcccataagtggaaaactggagggcatattcttttcatgttcgacagagttcaataccgggaaaccacctcaggactcaccttacgggaggtatcgcttcgagattgctgccgaaaagctgtttaaccccaacactaatttgtacttcggcgatttctattgcatgtatacagcataccattacgtaatccttgttattgctccagtcggatctccaggcgacgaattttgcaagcagcggctgccccaactgaattccaaggataacaagttcttgacctgtaccgaggaggacggagtgctggtctaccatcacgcgcaggacgtcattctcgaggtgatctacacagatccggtggacctttctgtggggacagtggctgagattacaggccatcagcttatgtcattatccacagccaatgcaaaaaaagacccctcatgtaagacctgcaatatctcggtaggacgatag

SEQ ID NO: 28974 - DNA, 1131 bp, Artificial Sequence
  Description of Artificial Sequence: Synthetic coding sequence
atggaggtgcctcggttggaccacgctttgaacagccctacatccccttgtgaagaggtgatcaaaaatctatcactggaggcaatccagctgtgtgacagagatggcaacaagtctcaggattctggaatcgcagaaatggaagagttacctgttccccacaacatcaagattagtaatataacgtgcgactcctttaagatctcttgggaaatggacagcaagtcaaaggaccgcattacccattatttcatcgatctgaataagaaggaaaacaaaaacagcaataagttcaagcacaaggatgttcctacaaagcttgtggccaaggctgtccccctgccaatgactgtcaggggccactggttcctgagtcctagaaccgaatacacagtcgccgttcagactgcttccaagcaagtggacggagattacgtggtctccgagtggtcagagattattgagttttgcaccgctgattactctaaggtacacctcacccaactgctcgagaaggccgaggtgattgccggaaggatgttgaaatttagcgtcttttaccggaaccagcacaaagagtactttgattatgtgagggagcaccatggcaatgcaatgcagccgtccgtgaaagacaactccgggagccatggaagccccatatctggcaagctcgaaggaatctttttcagctgttccaccgagttcaacacaggaaagcctcctcaggacagcccatacggacggtataggttcgagatcgcggctgagaaactgttcaacccaaacaccaacctgtactttggggatttctactgcatgtacaccgcctaccactacgtgattttagtaattgccccagtgggcagcccaggggacgagttctgtaagcagaggttgccccagcttaatagcaaagacaataagttcctgacctgcacagaagaagacggggtgctggtgtaccatcatgctcaagatgtgattcttgaagttatatatactgatcctgttgaccttagtgtggggaccgtggctgaaattaccgggcaccagctgatgtcactgtctacagcgaacgctaaaaaagatccaagctgtaagacttgcaatatttccgtgggtagatag

SEQ ID NO: 28975 - DNA, 1263 bp, Artificial Sequence
  Description of Artificial Sequence: Synthetic coding sequence
atgctcaaggccgtaatcttgatcgggggaccccagaaaggtacccgctttaggccccttagctttgaagtcccaaaacccttattccctgtggctggggtaccgatgatccaacaccacatcgaggcctgtgcccaggtgcctggcatgcaagaaatcctgttgattgggttctatcaacctgatgagccgttaacgcagttcttggaggccgctcagcaggaatttaacctgcccgtcaggtatctgcaggagtttgcccctcttggcactggcggtggtctatatcacttccgtgatcagattttggcgggttctcctgaggctttctttgtcctcaatgccgacgtctgctctgatttcccgcttagcgctatgctggaggcacatcggcgtcaacggcatcctttcctgctgttgggaaccacagctaacagaacgcagtccttgaattatggatgcatcgtggaaaaccctcagacccatgaagttctgcattacgtggaaaagccaagtacttttatctcggacattattaattgcggcatttatctcttttctcccgaggccttgaaacccttgcgcgacgtattccagcgaaaccagcaggacggtcagcttgaagactccccgggactctggccaggagcagggacgatcaggttggagcaagatgtgttcagtgcactcgctgggcagggccagatctacgtgcatctgaccgatggaatctggagtcaaatcaaatctgctgggtctgccttgtacgcctctagactgtatttaagccgctaccaggatacccatccggagcggttggcaaaacacacccctggaggaccatggattagaggcaacgtgtacatccatcccacagcaaaggtggctccaagcgcggttctggggcctaatgtaagcatcggcaagggggtgaccgtcggtgagggggtcagactgagggagtctatcgtcctgcacggagctaccctccaggaacacacttgcgttctgcacagtattgtcggttggggaagtacagtggggaggtgggcccgtgtggagggcaccccgagcgacccaaatccgaatgacccacgcgctaggatggactccgagtcgttgttcaaggatgggaagctgttgcctgccattacgatcctggggtgtagggtcagaatcccagctgaggtcctgatcttaaacagcatcgtcctgccacataaggagctgagccgctcattcacaaatcagataattctgtag

SEQ ID NO: 28976 - DNA, 411 bp, Artificial Sequence
  Description of Artificial Sequence: Synthetic coding sequence
gatccactcagctggctctctgggccatggggccaagtgccagccggaatctgcccgccaagacatcgtggttggtatcacttcagggatcagatcctggcgggtagcccagaagctttctttgtgctcaacgccgacgtatgcagtgacttccccctctctgccatgctggaagcccacaggcggcagcgacacccttttctgctcctgggaacaactgcaaatagaactcaatcactcaattatggctgtatcgtggaaaatccccaaactcacgaggtgctgcattatgtagaaaagcctagcacctttatcagcgacattataaattgtggaatttacctgttcagcccagaggccctgaaacctctgagggatgtgtttcaacgcaaccagcaggatggtcagtag

SEQ ID NO: 28977 - DNA, 1365 bp, Artificial Sequence
  Description of Artificial Sequence: Synthetic coding sequence
atggagcgtaaagacttcgagacgtggcttgacaacatctccgtgacatttctgtccttgaccgacctgcagaaaaacgagactttggaccacctaatttcactgtccggcgctgtccaactgcgtcacctgtcgaacaatttagaaactctgcttaagcgcgatttcttaaaattgctgcctctggagctgtcattttacctcttaaagtggttggacccccaaacactcctgacctgctgccttgtgtcaaaacagtggaacaaagtgatttctgcctgcaccgaggtctggcagacagcctgcaaaaacctgggttggcagatagacgactccgtccaggacgctctgcactggaaaaaggtgtatctaaaagccatcttgaggatgaagcagctggaggatcacgaggccttcgagacaagcagcctaattggtcattctgcccgagtctatgcattatattataaggacggcctcctctgcacaggctcagacgatctgtccgccaagctgtgggatgtcagtacaggccagtgtgtttatggcattcagacccatacttgcgccgcagtgaaattcgacgaacagaagctcgtgactggtagtttcgacaatacagtcgcatgctgggagtggagctccggcgcaaggacacagcacttccggggtcacactggggcagtgttcagtgttgactacaacgacgagctcgatattctggtgtctggaagcgccgacttcacagtcaaggtgtgggctcttagcgcaggaacctgtctgaataccctgacaggacatacagagtgggttactaaggtagtgctccagaagtgtaaagtcaagtctctgctccactccccgggtgactatatcttgttgagcgccgacaaatacgaaatcaagatctggcccattggccgagagatcaattgtaaatgcctcaagactcttagtgtaagtgaggaccgatccatctgcctccaaccacgccttcactttgacggcaagtatattgtttgcagctccgccctaggtctctaccaatgggattttgcgtcctatgatattctaagggtcatcaaaaccccagagattgccaacttggcactgctagggttcggcgatatcttcgccctcctctttgacaaccgctatttgtatattatggacctccggactgagtctttaatttctcgctggcctctgccagagtaccggaaatctaaaaggggcagttccttccttgcaggcgaggcctcatggctgaacggcctggatggacataacgacacgggcttagtcttcgccacctctatgcctgaccattccatacatctggtgctatggaaggagcacggatag

SEQ ID NO: 28978 - DNA, 372 bp, Artificial Sequence
  Description of Artificial Sequence: Synthetic coding sequence
atggaagccgctgaaactgaagctgaagccgctgcgctggaggtcctcgccgaggttgcgggaatactggagcccgttgggctccaggaagaggccgagctgcccgctaaaattctggtggaatttgttgtcgactcgcagaagaaagacaagcttctgtgctctcaacttcaggttgcagacttccttcaaaatattctggctcaggagagaccctggtgtgtgctgcagggctgttggtctactacttgctggcgctgtaagttcgccatgacgagctggcgtaccgccgcttggagaaaaatactcgagaaagcaagcgatttcccacacctgcctacaatcatcactggaaagaccgtcaatagctag

SEQ ID NO: 28979 - DNA, 834 bp, Artificial Sequence
  Description of Artificial Sequence: Synthetic coding sequence
atggaggcagccgaaactgaagccgaagctgctgcattagaagtcctggccgaggtcgccggaatcctggagcctgtgggcctgcaggaggaagcagagctccccgcaaagatcttggtggagttcgtggtagattcacagaagaaggataagctgctgtgttcccagctgcaggtggcggactttctccagaatatcctggcccaggaggataccgctaaaggattggaccctttggcttccgaagacacttcgcgacagaaggcaatagccgcaaaggagcaatggaaggaactgaaagcaacatatagagagcacgtagaggccatcaaaattggactgaccaaggcactgacccaaatggaggaagcccagcgcaaaagaactcaactgcgtgaagccttcgaacagctccaggccaagaagcagatggctatggagaagaggcgcgctgtccagaaccaatggcagctgcaacaggaaaagcatctgcagcacttggcggaggtctctgctgaggtgcgagagcgcaaaacaggtactcagcaggaactcgatagggtctttcagaagctaggaaacctcaaacaacaggctgaacaggaacgcgataagctgcaaaggtatcagacgtttcttcagctgctgtacaccctacagggcaaacttttattcccggaggcagaggccgaagcggagaacctacctgatgataagcctcagcagcctacacggccacaggagcaaagcactggagacacaatgggcagggaccctggagtcagttttaaggccgtgggactgcagccagccggagacgttaacctcccttag

SEQ ID NO: 28980 - DNA, 1713 bp, Artificial Sequence
  Description of Artificial Sequence: Synthetic coding sequence
atgtcctccatcggcgagggcatcgatttctctcaggaaagacagaaaatatctggcctccgcactttggagcagtcagtgggcgaatggctggagtcaatcgggctgcagcagtatgaatccaaacttctgcttaacgggttcgatgacgtgcatttcctggggagcaatgttatggaggagcaggatctcagagatataggcatctcagacccccaacaccggaggaagctcctacaggccgcaagaagcctccctaaggtcaaggccttaggctatgacggtaattccccaccgtcagtccctagttggctagactcccttggccttcaagactacgtgcattcctttttgtcatccggatattcttccattgatacggtcaagaatctctgggagttggaactggttaatgtgctgaaggtgcaactcctggggcaccgcaaaagaatcatcgcctctctggcagacagaccctatgaggagccacctcagaaaccccctaggttctcacagttacgctgccaggacctgctgagccagacatcatctcccctcagtcagaacgatagctgcactgggagatctgctgaccttttattgccgcctggtgataccggacggaggcgccacgactccctgcacgacccggcagcgccatctcgtgcggagcgctttcgaatccaggaagagcatcgcgaggcaaaactcacgttgcggcctccatctctggccgctccctatgctcctgtacaatcttggcagcaccaacccgaaaagctgatttttgaatcttgtgggtacgaggctaattacctgggaagcatgttgatcaaggatctgcgcggaacagagtcaactcaagacgcatgtgctaaaatgaggaaatcaaccgagcatatgaagaagatcccaactatcatcctcagtatcacctacaaaggcgttaaatttattgacgcctctaacaaaaacgtgatcgctgaacatgaaattcggaatatcagctgcgcggctcaggacccagaagacctgtgcacttttgcatacataaccaaagatctgcagacctcacatcactattgccatgtgtttagcaccgtggacgtgaacctcacttacgaaatcatcctaaccctggggcaggccttcgaggtggcttaccagctcgcgcttcaggcacaaaaatcccgcgctaccggggcttcagctgccgaaatgattgagactaaatcatccaagcccgttccaaaaccgagggtgggcgtacggaagtctgccgtacccctgcctcctgactccaggtgctgttactgccatacctgcaccacccaccgcccatcctatctccccctcccttctgtctcacctggtgtcaagctagaaccaccagatatggatcaggacgctcaaagtcacgcctcggtttcatgggtggtagatcccaagcctgacagcaagagaagcttgtctacgaaccataccagattggagttggtgtgttgctcccaaccagagaatgagttggtgtccaccatcagcggtgacaaacctaaaagttttcttgaacccctcctgtttgtgatgcctaccacagcctataaccacaattgcccagaatggagatctcagaaagatggcggatgcagcacttccgagtgccctcaccatctgtgcttagaaaagcctggcgtgttatccctggagatgtag

SEQ ID NO: 28981 - DNA, 1785 bp, Artificial Sequence
  Description of Artificial Sequence: Synthetic coding sequence
atggaaagcaatcacaaaagcggggacggtctttcaggaactcagaaagaggcagccctgagagctcttgtgcaaagaactgggtattctctggtacaagagaacgggcagagaaagtatgggggaccccctcctgggtgggatgccgcaccccctgagcgcggttgtgagattttcatcggaaagctgcctagagatctctttgaagatgagctaattccactctgcgagaaaatcggaaagatttacgagatgcggatgatgatggacttcaacggcaacaatcgtggttacgcgtttgtaacattctccaataaagtggaggcaaaaaatgccattaagcaactgaataactatgaaatacgcaacggccgactcctcggagtttgtgccagtgtagacaattgcagactgtttgtgggtgggattcctaaaaccaaaaaaagagaggagattttgtccgagatgaagaaggttacagagggagtcgtggacgtgatcgtgtacccgagtgcagcagataagaccaagaatcgtggctttgctttcgtggagtatgaatcacatcgagcagctgcgatggccagacgcaaactgttgccgggtcgtatccagctgtggggacacggcatcgcagtggattgggctgaacctgaagttgaggtcgacgaagacacaatgtcctccgtgaaaatcctgtacgtccggaacctcatgctgagtacttcagaagagatgatagagaaagagtttaacaacatcaaacctggcgctgtggaaagggtgaagaaaatacgggactatgcctttgtgcactttagcaacagggaggatgccgtggaagcaatgaaggctctgaacggaaaagtgctggacggcagtcctattgaggtaactttagctaagcccgtcgacaaagatagctatgtgcgttacacacgtggcaccggaggccgtgggactatgctgcaaggagaatatacgtacagccttggccaggtatatgatcctaccacaacttatcttggcgctcccgtgttctacgcccctcagacatatgccgctataccaagtctccacttccctgcaacaaaagggcatttatccaatagagcaatcatacgtgctccatccgttagggagatctacatgaacgtccctgttggagcggcaggtgtacgcggactgggcggtagaggatatctcgcttatacaggcctgggtcgaggttatcaagtgaaaggggacaaacgcgaggataaactctatgatattctgcccggtatggaactgacccccatgaatccggtcacattgaaaccccaaggaattaaactcgcgcctcagattctcgaggaaatctgtcagaagaacaactggggtcaacctgtgtaccagctccacagcgctatagggcaggatcagaggcagttgtttctgtataagattacaattcccgctctggcctcacagaaccccgctatccacccatttacaccacccaaactctccgccttcgtcgacgaagccaaaacctacgccgctgagtacaccttgcagaccctgggtattccaacggacggcggagacggaactatggccacggcagcggctgccgctactgcatttcccggatatgctgttcccaatgcaacggcgcctgtttccgctgcccaactcaaacaggctgttaccctagggcaggacctggcagcttatacgacatacgaggtgtatccgacctttgcagtgaccgcaaggggcgatggctacggaaccttctag

SEQ ID NO: 28982 - DNA, 1785 bp, Artificial Sequence
  Description of Artificial Sequence: Synthetic coding sequence
atggaagcggtgtgtctgggaacatgtcccgagccagaggcaagtatgtctacagctataccaggcctcaagaaagggaacaatgctctgcaatcaattatcctccaaactcttcttgagaaggagaatggtcagcgcaaatatggcggaccccctccaggatgggatgcggctccaccagaacggggttgcgaaatctttattggtaaactcccgcgagatttgttcgaagatgagcttatccctctgtgtgagaagattggcaagatttacgaaatgcggatgatgatggattttaatggcaataaccggggatacgccttcgtaaccttttccaataaagtggaggctaaaaacgcgataaagcagctgaacaattatgagatccggaacggacgcctcttgggggtgtgcgccagcgttgacaattgccgactgtttgtgggagggatccccaagacaaagaaacgcgaggaaattcttagcgaaatgaaaaaggttaccgagggcgtggttgatgtgattgtctatccaagcgcggcagataagacgaaaaaccggggtttcgcctttgtggaatatgaatcccacagagcggctgcgatggccagacgcaaactgctgccaggtcggattcagctctggggtcatggaatcgccgtagactgggctgagccagaggtagaggtggatgaagataccatgagctccgtgaaaatattatacgttcgtaatttaatgttgagtactagcgaggagatgatcgagaaggaatttaacaatatcaaaccaggagccgtcgaacgcgtaaaaaaaatcagagattatgcctttgtccacttttccaacagagaagatgcggtggaggcaatgaaggccttaaacgggaaggtcctcgatggatcccccatcgaagtcactctggctaaaccggtggacaaagacagttatgtgagatatactaggggcaccgggggtcggggtactatgctccagggcgagtacacttactctctggggcaagtttacgaccctactaccacctatctgggtgcaccagtattttacgcccctcagacgtatgccgctattccttcccttcactttccggctactaaaggccatctgagcaatagagccatcatccgcgcaccctccgtgagaggagcagctggagtacgcggattaggaggcagaggatacttggcatataccggactcggacggggatatcaggttaaaggcgataagagggaagataagttgtacgatatcttgcccggaatggagcttactcccatgaaccctgtgacgctgaagcctcaagggattaagcttgccccacagatcctggaggaaatatgccaaaagaacaattggggccaacctgtgtatcagcttcacagcgctattggccaagaccagagacagctgtttctgtacaagattactataccagccctcgcttcccagaatcccgcaatccatccgtttaccccacctaaactcagtgcattcgtggatgaagcgaaaacctatgcagccgagtacacactgcagaccctcggaattccgaccgacggcggtgacgggacaatggcaactgcagccgcagctgcgaccgcatttccaggatacgcagtccccaacgctactgcgccagtgagtgcggctcagctgaagcaggcagttacgctcggacaagatctggccgcatataccacttacgaagtatatcctactttcgccgtgacagcaagaggtgatgggtacggtacattctag

SEQ ID NO: 28983 - DNA, 1761 bp, Artificial Sequence
  Description of Artificial Sequence: Synthetic coding sequence
atggaaagcaatcataaatctggggatggtctgtccgggacccagaaagaggctgcattacgagctttggtgcagaggactggctacagcttggtgcaagaaaatggacaaagaaagtacggcggacccccacccggatgggatgcagccccaccagaaaggggctgtgaaatctttattggcaagctgccccgtgacttgttcgaggatgaactgattcctctttgcgaaaaaatcggaaaaatctacgaaatgaggatgatgatggactttaacggcaataaccggggttatgccttcgtaacatttagcaataaggtggaagccaagaacgccatcaagcagctgaacaattacgagattcgcaacggtcgcctcctcggtgtctgtgccagcgtcgacaactgccgcctttttgttggcggaatccccaaaaccaagaaacgtgaagaaatcctgtccgaaatgaagaaagtgacagaaggcgtggttgacgtgattgtgtaccctagtgccgcagacaagacaaaaaatagagggttcgcctttgtcgagtacgagtcacaccgggctgcagcaatggcaagaagaaaactacttcccggtagaattcagctgtggggtcacgggatcgctgtagattgggcagaacctgaagtggaggtcgatgaagataccatgtcatcagtgaagattctgtacgtaagaaatctaatgttgagcacctcagaggaaatgatagaaaaagagtttaataatataaagccaggagccgtggagcgggtgaagaaaatcagggattacgcctttgttcacttctcaaaccgagaagatgctgttgaagcaatgaaggctctcaatgggaaagtgcttgacggcagccccatcgaggtgacattagcaaagcctgttgacaaggactcatacgtgagatacacccggggtactggcggtaggggaaccatgcttcagggagaatacacttactccctgggccaggtgtacgaccccaccaccacgtacctcggagcaccagttttttatgcccctcagacatatgccgcaatccccagccttcacttccccgcaaccaaaggccatctgtccaatagagctattataagggccccatccgtgaggggtgctgccggagtcagagggctgggcggtagagggtacctcgcatataccggccttgggcgagggtaccaggttaagggcgacaagcgggaagacaagctttacgacatactccctggtatggaactgacccccatgaacccagtcacgctgaaaccccaaggcattaaactggccccacagatcctcgaggagatttgccagaagaacaactggggtcaaccagtgtatcagctgcacagtgcaatcgggcaggaccaaaggcagcttttcttatacaagatcactatacctgcgcttgctagccagaatccagccattcacccgttcacgccacctaagctgtcggcatttgtcgacgaggccaaaacatacgcagcggaatacactctccagacactgggaatacctacagacgggggagacggaaccatggcaacagcggcagcggcagcaaccgctttccccggatacgccgtcccaaacgctaccgcgcctgtctcggctgcccagctaaaacaagcagtcaccctcggtcaagacctggccgcatatacgacctacgaggtctaccctaccttcgctgtgacagctaggggcgatggctacggcactttttag

SEQ ID NO: 28984 - DNA, 1761 bp, Artificial Sequence
  Description of Artificial Sequence: Synthetic coding sequence
atggaaagtaaccacaaaagtggtgatgggctgagtggcacgcagaaagaagctgcactgagagcccttgtgcagcgcacgggctattccttggtacaggaaaatggacagagaaaatacggagggcctccacctgggtgggatgccgctccacctgagagaggttgcgaaatcttcattggcaaactgcctcgtgacctcttcgaggacgagctgatcccattatgcgagaaaatcgggaagatatacgagatgaggatgatgatggacttcaacggcaataacaggggttatgcgtttgtcacattctccaacaaggttgaagcaaagaatgccattaagcagcttaataactacgagattcgtaacggtcgtctgctaggcgtgtgtgcctctgtcgataattgtcgtctgttcgtgggcggaatccccaaaactaaaaagcgtgaggagatactgtcggaaatgaagaaagtgactgaaggggtggtcgatgtaatagtctatcccagtgccgctgacaaaactaaaaacagaggcttcgcctttgtggagtacgaatcacatagggcagccgctatggctagacgcaagttgctccctgggagaattcagctgtggggccacggcatcgctgtggactgggctgagcccgaagttgaggtcgacgaggacacaatgtcctcagtgaagatcctgtatgtaagaaacctgatgctgagcacgagcgaagaaatgatcgagaaggagttcaataatatcaagcccggtgcggttgagcgggttaaaaagatccgggattatgcctttgtacacttctctaatcgtgaagatgctgtggaagctatgaaggcgctgaatggcaaggttctcgatggttcccctatagaagtaactttagcgaagccagtggacaaggatagctatgtgcgctacactcgaggcacggggggacgtggcacaatgctgcagggagagtacacatactcgctgggccaggtgtacgatccaaccacgacctacctgggggcacctgtgttctatgcaccccagacctacgctgcaatcccaagtctgcattttccagctacgaaaggacacctttccaatagggccatcatccgcgcacccagtgtgaggggcgctgctggtgtccgaggccttggcggtcgcggatatttggcctacaccggactggggcgtggctatcaggtaaagggggataaacgggaagacaaactgtatgatattttgcccggaatggaactgactccaatgaatccggtcactctcaaacctcaggggataaagctggccccacagatcctcgaggagatttgtcagaagaataattggggccagcccgtgtaccagcttcactccgctatcggacaggatcaaagacaactgttcttgtacaagatcactattcccgcactggcttcccagaatccagctatccaccctttcacccccccaaagctttccgctttcgtcgacgaagcaaaaacatatgctgctgaatatacactgcagaccctgggtattccaacagatggaggggatggaactatggccactgcagccgctgcagcaacagctttccccggttatgccgtccccaatgcaacggccccagtgtctgctgcacagttgaaacaggccgtcactcttggtcaggatctggctgcctacacgacttatgaagtctacccaactttcgccgttaccgccaggggggacggctacggcacattttag

SEQ ID NO: 28985 - DNA, 1542 bp, Artificial Sequence
  Description of Artificial Sequence: Synthetic coding sequence
atgcagcggacttttgcgtggttactggatagggttcagcatctaggtgcgccagtgactctaagagctagctacttggagatctacaatgagcaggtgcgcgatctgctgtctctagggtctccacgacccctgccagttaggtggaacaagacgcggggtttctacgtcgagcagctgcgggtggttgagttcgggagcctcgaagccctgatggagctgctgcagaccggcttgagcagacgcagaaatagtgcccatactcttaaccaggcgagttcccggagccacgcgctcctgacattgtacatcagtagacagacagctcagcaaatgccgtctgtagatcccggagagcctccagtcgggggaaagttatgctttgtggacctggcaggatccgagaaagtggccgcaaccgggagccggggagagctaatgctcgaggcgaacagcataaatagaagtctcttggccctcgggcattgtatctcactcctcctggatccacaacgcaagcagagtcacatcccctttagagatagtaaacttacaaaactactggccgactctttgggaggtcgaggcgtcacactcatggtggcttgcgtgagcccctccgctcaatgcctacctgagactctgtccacactgcgatacgcgagtagggcacagcgagtgactacacgccctcaggccccaaagtctcctgttgccaaacagccccagcggcttgagaccgaaatgcttcagcttcaggaagaaaatcggaggctgcagtttcagcttgaccagatggattgcaaagcgtccgggctcagcggggctcgggtggcatgggcacagagaaacctgtacggaatgctacaggagttcatgctagagaacgaaaggctgagaaaggaaaagtcccagttacagaacagccgcgacctggcccagaacgagcagcgcattctggcgcaacaagtacacgccctggagcgacgactgctaagtgcttgttatcaccatcagcagggcccaggtctcacccccccttgcccttgcctgatggctcccgctccaccttgtcatgcactgccccctctgtactcctgcccatgttgccatatttgtcccctttgtcgtgtgcctctggctcactgggcttgcctgcccggtgaacatcatttgccccaggtgcttgatcctgaagccagtggaggccgaccaccctctgcacgaccacccccttgggctccaccttgttcacccggaagtgccaaatgtccccgagaaagatctcactccgattggactcagacccgggtgctggctgagatgctgaccgaggaagaggtagtccctagcgccccacccttgcccgtacgcccacctaagacctcaccaggtctgcggggaggagccggagtgcctaacctcgctcagaggctcgaggctctccgcgaccagataggctccagcctgaggcgcggacgctcccaacctccttgttccgaaggcgcaagaagtcctggacaagtactgcctccgcattag

SEQ ID NO: 28986 - DNA, 786 bp, Artificial Sequence
  Description of Artificial Sequence: Synthetic coding sequence
atggtgaagggggaaaaaggcccaaagggcaaaaagatcacgctgaaggtggcgcgtaattgtataaaaattacattcgacggcaaaaagcgcctggacctatcgaagatgggcataaccacctttcccaaatgcatcctgagactttctgatatggacgagctggatctctcccgtaatcttatcagaaagataccagattctatatccaaatttcaaaacttgaggtggctggacttacatagtaattacatcgacaagctgccagaatccattgggcagatgactagcttgctgtacctcaatgtctcgaacaaccggcttacttccaacggattgcccgtcgaactaaagcagctcaaaaacatcagagctgtgaatctgggcctcaatcacctggatagtgtccctacgacactcggagctcttaaggaactacatgaagtcgggttacatgacaacctgctgaataacattccagtttccattagcaagctgccaaaattgaagaaactaaatattaagagaaatccttttccgaagccaggcgagtctgaaattttcattgacagcatcagacggctcgagaatctgtacgtggtcgaagagaaggacttgtgcgctgcctgtctgaggaaatgtcagaatgcaagagacaacctgaaccggataaagaacatggcaactaccactccgcgaaaaacaatcttccctaaccttatctcacctaattcaatggcaaaggattcttgggaggattggaggataaggctcacgagcagttag

SEQ ID NO: 28987 - DNA, 1770 bp, Artificial Sequence
  Description of Artificial Sequence: Synthetic coding sequence
atggcatcctcgcaaagggacatggaagactgggttcaagccatcagacgggtaatttgggcgcctctgggcggagggactgcacggcgatcccatgctcatcctctagagcccctgccacctggcatttttgggcagagacttgaggagactgtccaccacgaacggaaatatggaccccgtctggctccccttctcgtggagcaatgtgtggattttattagggagaggggtctcactgaggaaggcctcttccgaatgccaggtcaggcaaacttggtgagggatctccaagactccttcgattgtggcgagaaaccacttttcgattccaccacagacgtgcatactgtcgcctctctgctgaaattgtacttgcgggaattgcccgaacctgtcgtgccctttgctaggtacgaggacttcctgtcttgtgcacaactcctgaccaaagatgaaggcgaaggtacgctagagctggctaaacaagtgagcaacctgccccaggccaattataatctgttgcggtatatctgcaagtttctggacgaagtgcaggcctatagcaacgtgaataaaatgtctgtgcaaaacctggccaccgttttcggacccaatatcctgagaccccaagtggaagatcccgtgacaattatggaggggacgtccctcgtccaacatctgatgactgtgctgattcgaaagcactcccagttgtttacggccccagtccccgagggccctacctcaccacgtggcggtctccagtgcgcagtaggatggggaagcgaagaagttaccagggatagccaaggggagcctgggggacccggattgccggctcacagaacctcatcactggatggtgccgctgtagctgtgctgagccggaccgcccctaccggacctggctcgcgttgttcacccggaaagaaggtacaaacattgccaagctggaaaagtagtttccgtcaacctaggtccctgagcgggtcccctaagggtggcggatcaagtctcgaggtccctattatttcttccggcggaaattggctgatgaacgggttatccagcttgagaggccatcgacgtgccagctctggtgataggctgaaggatagtgggagtgtccagcgactaagcacttatgacaatgtccccgcaccgggactggtgcctggcattcccagcgtggcttcaatggcctggagtggcgcaagcagctctgagagttccgtggggggtagcctgtcatcatgcaccgcctgtagagcctcggactccagcgcgaggtcttctctacataccgactgggctctggaaccttccccactgccatccagttcagaagaccctaaatccctcgacctggatcatagcatggacgaggctggcgctggtgcaagcaatagcgagccctcagaacccgatagccccacgcgggaacatgcaaggaggagtgaggcactccagggacttgttaccgaattaagggcagagctgtgcagacaacgaacggagtatgaacgctcggtgaaaagaatcgaagagggttctgccgacctgcggaaaaggatgtccagacttgaggaggaactggaccaagagaagaaaaaatacattatgctggagattaaactgcggaatagcgaacgggcacgggaagacgccgaacggagaaatcagctgctgcaacgagaaatggaggagttcttttccacgctaggttccctgacagttggcgcaaagggagcgagagccccaaaatag

SEQ ID NO: 28988 - DNA, 1209 bp, Artificial Sequence
  Description of Artificial Sequence: Synthetic coding sequence
atgtccgccgaaggagccgagcctggccctggaagtggcagtggcccaggcccaggccctctgtgccccgaacatggccaggctctttcttggttttgcggatcggagcggcgacctgtgtgtgccgcatgcgcaggcctaggcggtaggtgtagagggcatcgcattaggagagccgaggagcgcgcagaagagctgcgaaataagatagtggaccagtgcgaaagactgcaactccagtcggccgctataaccaagtacgtggcggacgtgctgccaggaaaaaatcagcgcgcagtgagtatggcttcggccgcacgcgagttggtgattcaaagactctctctggtccgcagcctgtgtgagtccgaagagcaacgcctgttagagcaggtgcacggggaggaagagagggcccaccaatccattctcactcagcgggtgcattgggcagaagcgctgcagaaactggatactattcggacgggattggtggggatgctaactcatctagatgatctccaactcatccagaaggagcaggaaatcttcgagcggactgaggaggccgaaggtattctcgacccccaggagtcggagatgctgaactttaacgaaaagtgtacgcgatcacccctgttaacccagctgtgggcaacggccgtgttaggatccttgtctggtaccgaggacattcgcatcgatgaaaggactgtgagccctttcctccagctttctgacgacaggaagacattgactttttcgaccaagaagtcaaaggcctgtgctgacggtccagaacgatttgaccattggccgaatgcactggcagcgacatcattccagaacggacttcatgcttggatggtgaatgtccagaacagctgtgcctacaaggtgggtgtggccagcggacacctgccccgtaaaggcagcggaagtgactgtaggctcgggcacaatgctttctcctgggtattcagcagatatgaccaggagttccgctttagccacaatggacagcacgagcctctcggcctactgagaggccctgctcagttaggagtggtactagacctgcaggtgcaggaactgctgttttatgaaccagccagcggcacagtgctttgtgctcaccatgtcagcttccccggacccctctttcctgttttcgcagtggccgaccaaactatcagcatcgtccgatag

SEQ ID NO: 28989 - DNA, 258 bp, Artificial Sequence
  Description of Artificial Sequence: Synthetic coding sequence
atgctaaggagaaaaccgactcgattggaactcaaactcgacgacatagaagagttcgaaaacattcgtaaggatttggagacaaggaagaaacagaaggaggacgttgaggtggtcggaggatctgatggcgaaggcgctatcgggctcagctcggatccgaagtcaagggagcagatgatcaacgatagaataggctacaaaccccaacccaagccgaacaacaggtctagccagttcgggagcctggaattctag

SEQ ID NO: 28990 - DNA, 744 bp, Artificial Sequence
  Description of Artificial Sequence: Synthetic coding sequence
atgctgtcagacggctgtggctcggaggaaaaaataagcgtgcccagctgctatggaggtatcggcgcacccgtgtctcgccaggtgcctgctagtcatgattctgaactgatggcattcatgacgagaaaactctgggatttagagcagcaggtgaaggctcaaacggacgagattctttccaaagatcagaaaattgccgcactggaggatctggtgcaaactctgcgaccacatcccgctgaagccaccctacagagacaggaggagctcgaaactatgtgcgttcagctgcagcggcaggttcgcgaaatggaacgctttctctcagattacgggcttcagtgggtgggcgaacctatggatcaagaagattccgagtctaagacagtttccgagcacggtgaaagagattggatgactgcaaaaaaattctggaagcctggggattccctagcccctcccgaagtcgactttgacaggttgttggcgagtctgcaggatcttagcgagttggtggttgagggggatacccaggtgacacccgtgccgggtggcgcacgcctgcgaacattggagcctattccgttaaagctttatcggaacggcataatgatgttcgacggtccattccagccattctatgatccttcgactcaacgctgtctgagagatattctggacggtttcttcccatcagagttgcagaggttatacccaaacggagtgcccttcaaagtgtag

SEQ ID NO: 28991 - DNA, 1464 bp, Artificial Sequence
  Description of Artificial Sequence: Synthetic coding sequence
atgagctctccgctggcctccctgtctaaaaccaggaaggtacctttaccaagcgagccaatgaatcccggacggagaggaatccgtatttacggggacgttcccgcatctcacgacagcgaactgatggccttcatgaccaggaagctgtgggatctggagcagcaggtgaaagctcagacggatgaaatcctgtctaaggatcagaaaatcgcggctctggaggacttagtccaaacactgaggcctcatcctgcagaagccacattgcagaggcaggaagaactagaaaccatgtgcgtccaactgcagcgccaagtgcgagaaatggaacggttcctgagcgattatggattgcaatgggtcggcgagcccatggatcaggaggactctgagtcaaagacagtatccgagcacggtgaaagggactggatgacggctaagaaattctggaagcctggcgattcattagcccctcctgaggttgacttcgataggcttctcgcttcactgcaggacctgtccgaactggtggttgagggtgatacacaggtgacaccagtgccaggaggtgcccgactccggaccctcgagcctatccccctgaaactctatcgaaacggaattatgatgtttgacggcccattccaaccgttttacgacccaagtacccagcgctgcctgagagacatactcgacggcttcttcccaagtgaattgcagagactgtacccaaacggggtgccctttaaggtttcagatctgagaaatcaggtgtacctggaagacggactggacccatttcccggagagggacgggtagtgggaagacagttgatgcacaaggcccttgatcgcgtggaggagcacccaggctccaggatgaccgcagaaaagttcctgaatcgcctccctaagtttgtgattcgacagggcgaagtcatcgatatcagaggtcccattcgagacactctgcagaattgctgtccactacctgctaggatccaggagatagtggttgaaacccccaccctggccgcagagagggagcgctcccaggagagcccaaatacacctgcccctcctctgagcatgctgaggataaagagcgagaacggcgaacaggcattccttctgatgatgcaacctgacaacacaataggagatgtccgagcgttactggctcaggcccgtgtaatggacgcatctgctttcgagatcttctctactttccctcccacactgtatcaggatgatacattgactttacaggcagctgggctcgtacccaaggcagctctcctgttgcgagcacgtagggcccctaaaagcagtttgaaattttccccagggccttgtccaggtccaggccctggcccttcacccggacctggtcccggaccatctcccggaccagggccaggcccaagcccttgcccgggaccctcaccttcgccacagtag

SEQ ID NO: 28992 - DNA, 1020 bp, Artificial Sequence
  Description of Artificial Sequence: Synthetic coding sequence
atgtggacagcacgaggcccatttcggagggatcgctggtcctccgaggatgaagaggcagccggaccgtcccaggccttatcccctctgctttccgacacccgaaagatcgtctccgagggggaacttgaccagttggcacagatccgcccactgattttcaactttcatgagcagactgccattaaggactgtttgaaaattctggaggagaagactgctgcatacgatattatgcaggaattcatggcacttgagctcaagaacctgccgggagagttcaactccggaaatcaaccaagcaaccgcgaaaagaaccggtatcgggacatcctgccttacgacagtacacgggtgccactggggaaatctaaggactatataaatgccagttacattcgcatcgtgaattgtggggaggagtatttttacatcgcaacccaggggcctctgttatcaacgatcgatgacttttggcaaatggtgctcgaaaacaacagcaatgtgatcgctatgatcacgcgcgagatcgaaggaggcatcattaaatgttatcactattggcctatctctctcaagaagcctctcgaactaaagcatttcagagtttttctggaaaactaccagatcctgcagtattttataattaggatgtttcaggtcgtcgagaaatctactggaacctctcactcagtaaagcaattacagtttacaaagtggcccgaccatggtacacctgcatccgctgactcctttattaaatatattaggtacgcccgtaagtcccacctgaccggccctatggtggtgcactgttccgccggaattggccgaacgggcgtctttctgtgtgttgatgtagtgttttgcgctattgtcaaaaactgtagtttcaacattatggacattgttgcacagatgagagaacagagatccggcatggtccagaccaaggaacagtatcatttttgctatgacattgttctcgaggtgctacgaaaactgctgaccctcgactag

SEQ ID NO: 28993 - DNA, 1563 bp, Artificial Sequence
  Description of Artificial Sequence: Synthetic coding sequence
atgagcagccctctggcaagcctgtcaaagaccaggaaggttccactccctagtgaacccatgaatccagggcgtagaggcatccggatatacggagacgaagacgaagtggacatgctcagcgacgggtgtggctcggaggagaaaatttccgtgccatcttgttatgggggaatcggggcacctgtgtctcggcaagtcccggcatctcatgattcggagctgatggccttcatgaccagaaagctgtgggatcttgaacagcaagtgaaggcccagactgacgagattcttagcaaggaccaaaaaattgccgctctggaggacctggtgcagacgctgaggccccaccccgcagaggctactctgcagcgccaggaggagctcgaaaccatgtgtgttcagcttcagagacaagttcgcgaaatggaaaggttcctatccgactatggcttgcagtgggtaggtgaaccgatggaccaggaggacagtgagtccaagactgtcagcgaacatggggaaagagactggatgacggctaagaaattttggaaacccggagattctttggctcctcccgaagtagattttgacagacttctggcgagtctccaagacttatcggaactcgtcgtcgaaggagatacacaggttacaccagttccaggaggggcacggctgcggactctggaacccattcccctgaagctctatcggaacgggatcatgatgtttgatggacctttccagcctttttatgacccttcaacccaaaggtgtctgcgtgacattctcgacgggttcttcccctccgaactacaacgattatacccaaacggggtgcccttcaaagtgagtgacctgagaaaccaggtgtacctggaagacggcctcgaccccttccctggtgaggggagagtggtggggagacaactaatgcataaagctcttgacagagtggaggagcaccccggtagccgaatgactgcagagaagtttctgaatcggcttcccaagtttgtaatcagacagggggaagtgatcgatattagaggtcccatcagagatactctgcagaattgctgcccgctgcccgctagaatccaagaaattgtagtggagacacctactctagccgctgagagagagaggtcccaggagtccccaaatacaccagcacccccacttagcatgctgagaattaaaagcgaaaacggagaacaggcatttctcctgatgatgcagcctgacaacactataggcgatgtgcgggctctgctggctcaggccagagttatggacgcttctgcctttgagatcttcagcacgttccccccaaccctgtatcaggacgatactctgactctccaggctgccggactcgttcccaaagccgctctcctgttgagagcacggcgagccccaaaatcttcattgaaattttcccccggtccatgccccggtccaggtccagggccttcccccggtcctggccctggcccatcaccaggtccagggcctgggccttccccatgcccaggaccctctcccagcccccagtag

SEQ ID NO: 28994 - DNA, 1563 bp, Artificial Sequence
  Description of Artificial Sequence: Synthetic coding sequence
atgagctcgcctctagcaagtctgagcaagacacggaaagtccccttaccgtcagaaccaatgaatccaggccgtcgagggatcaggatctatggcgatgaggatgaggtcgacatgttatcagatggatgcggttccgaagagaaaatttctgtgccttcgtgttatgggggaatcggggctccggtttcccggcaggtgcccgcaagtcacgatagtgagttaatggccttcatgacacggaagctctgggaccttgaacaacaagtgaaggcacagacagacgagatcttgtctaaagaccagaaaatagccgctctggaggacctggtgcagacattacgtccgcacccagcagaggctacactccagagacaagaggaactggaaacgatgtgtgttcaactccaaagacaagtgcgcgaaatggagagatttctctctgactatgggttgcaatgggtgggcgaacccatggatcaggaagattctgaatcaaagaccgtttctgaacacggcgagcgggactggatgacagccaagaaattttggaagcctggtgacagtttagcacccccagaagttgattttgacaggctcctggccagcctgcaggacttgtccgagctagtcgtggagggcgatacgcaggtcacccccgtgcctggcggagctcgactccgaacgctggaacctatcccactgaagttgtaccggaacggaattatgatgtttgatgggccattccagccattctacgatccatcaactcagcggtgcttgcgagatattctcgatggattctttccaagcgagcttcaaagactgtaccccaacggggtgcctttcaaggtgagcgacctgaggaatcaggtgtatttagaggatgggcttgaccccttccccggtgaagggagagtagtgggcagacagctgatgcataaagccctggatcgcgtggaggagcaccctggaagccggatgacagcagaaaagttcctgaatcggcttccgaagttcgtcatcagacagggggaggttatcgatatccgcggaccaataagagacaccctgcagaattgctgtccacttcccgctcggatccaggagatcgtggtcgaaacccccacattggcggctgaaagggaacgctctcaggaatctcctaacacccctgctccccctcttagcatgctgaggattaaaagtgagaatggagagcaagcttttctcctgatgatgcagcccgacaacacgatcggagacgttcgggcattactcgcccaggctcgtgttatggacgctagcgcctttgaaatcttctcgacattcccgccaaccctctaccaggacgatactttaaccctccaggcagccggactagttccaaaagcagcattgttattgagagctaggcgcgctccgaagtcaagtctgaagttcagtcccggaccctgcccaggccctggcccaggcccttctccaggccctggtcccggaccaagtcctggtcccggacccggacctagtccatgcccgggaccttctccctcccctcagtag

SEQ ID NO: 28995 - DNA, 834 bp, Artificial Sequence
  Description of Artificial Sequence: Synthetic coding sequence
atgtttgatgggccattccaaccattctatgatcccagcactcagcgttgcttacgggatatcctggacggctttttcccttcggagttgcagcgactgtaccccaatggagtgccattcaaggtgtccgatctcagaaaccaagtgtatctggaagatggccttgatccgtttcccggtgaaggcagggtagtgggtcggcagctgatgcacaaggctctcgatagagtggaggagcacccaggctctaggatgactgccgaaaagtttcttaataggctgccgaagtttgtcattcgccaaggagaggtaatcgacatacgcggacctatccgtgatacgctgcagaactgttgtcccctccctgcaaggattcaggaaatagtagtggaaacgccaaccctggctgccgagagagaaagaagccaggagtctccgaataccccggcaccacctttgtcaatgctgaggattaaatcggaaaatggagaacaggccttcttgctgatgatgcaacccgataatactatcggcgacgtgcgagccttgttagcccaagctcgcgtgatggacgcatccgccttcgagatcttctcgacatttccacccaccctgtatcaagacgataccctcacgctgcaggctgcagggttagtcccgaaagccgctcttctcctgagagcacggagggctccaaaatcctcactgaagttttcacccggaccatgcccgggaccgggaccagggccatcccccggtccgggtccgggtccgtcacctgggccaggccctggaccgtctccttgccccggtccctccccatctccccagtag

SEQ ID NO: 28996 - DNA, 1314 bp, Artificial Sequence
  Description of Artificial Sequence: Synthetic coding sequence
atggctggtggaccccctaaagccctgcctagtacaggacctcactccctccgtgacatgccgcatcctctcgccggaagttcttcagaggaagccgttggcggtgacagtactccctcacccgaccttctgatggccaggagttttggcgacaaagacttgatcctcccaaacggtgggacccccgctgggaccagttcaccagcctcaagctcctccctactcaaccgtctgcagctcgacgacgatatcgacggagagactcgtgatttgttcgtgatcgtggacgatcccaagaagcacgtgtgtactatggagacttacatcacctatcggattactaccaagtccactcgcgtagagttcgatctgcctgaatactctgtgcgacgtagatatcaggactttgattggctgcgttcaaaactggaagaaagccaacccacccatctgatacctcccctcccagagaagtttgtggtcaagggcgtagtggaccgcttcagtgaggagttcgtggaaacccgcaggaaagccctggacaaattcttgaagagaattacggatcacccagtactgtcatttaacgaacacttcaacatttttctgactgccaaggacctaaacgcttacaagaaacaggggattgcactcctcaccaggatgggcgaatctgtaaaacacgtgacgggaggctacaaactgcggacacgtcctctggagttcgctgccatcggcgattatctggatacgttcgccctgaaactgggcacaattgaccgaattgcacagcggataatcaaggaagagatcgagtatcttgtggagctgcgagaatatgggccagtgtactccacctggtctgccctcgagggggagcttgccgaacccttggagggcgtctccgcctgcattggaaattgctccactgcactcgaggagctgactgatgacatgacagaggattttttgcctgtgctcagagagtacattctgtactcagattcaatgaagtcagtcttgaagaagcgtgatcaggtgcaggctgagtacgaagcgaagttagaagctgttgctttacggaaggaggaccgcccaaaagtgcctgccgatgtggagaagtgtcaggacaggatggaatgcttcaatgccgacttgaaggctgacatggaaagatggcagaacaataaacgacaggactttagacagttgctgatggggatggccgataaaaatattcaatattacgagaagtgccttatggcctgggaaagcataatcccactcctccaagaaaagcaagaagctaagtag

SEQ ID NO: 28997 - DNA, 1263 bp, Artificial Sequence
  Description of Artificial Sequence: Synthetic coding sequence
atgtcctctccacgagactttagggccgaacccgttaacgactacgagggcaatgattctgaagccgaggatctaaactttcgcgaaactctcccttctagctcacaggaaaacacaccacggagcaaggtttttgaaaacaaggtgaattctgaaaaggtaaaactgtccctccgcaattttccccacaacgattatgaagacgttttcgaggaacccagcgagtccggcagtgacccgagcatgtggacagctagaggcccatttcggagggatcgatggtctagcgaggacgaggaagcagccggtcctagtcaagccctgagtcccctgttgagcgacactagaaaaattgtgtctgagggtgaactcgaccaattggcgcagattaggcccctgattttcaacttccacgagcaaactgccatcaaagactgtcttaaaatcctggaagaaaagacagcggcatacgacattatgcaggaatttatggccctagagctcaagaatctcccgggagaatttaatagtgggaatcagccatccaacagagagaagaaccggtaccgcgacatcctgccgtacgactcaacacgggtacctttgggaaaaagcaaagattatatcaacgcatcctatattcggattgtgaactgtggggaggaatacttctatatcgctacacagggacctctgcttagtaccattgacgatttttggcagatggtcctggaaaacaattctaacgtaattgcaatgatcaccagagagatcgagggcggaattattaaatgctatcactactggcccatatccctaaaaaaaccgctggaattaaaacatttcagagtgttcctcgaaaactatcagatcctacagtactttataatcaggatgttccaggtagtagagaagtctaccggcacttcccactctgtgaagcagctgcagtttacgaaatggcccgaccacggcacccccgcaagtgcggattcttttatcaagtatatcagatatgcccgtaaaagtcacctgactgggcctatggtcgtgcattgcagcgccggtataggcaggacaggtgttttcttgtgtgtcgatgttgtattctgtgcaatagtcaagaactgtagtttcaacatcatggatatcgtggcccaaatgagggagcaacgttccggcatggtgcagactaaagagcaatatcacttctgttacgatatcgtgcttgaagtgctccgtaagctgttgaccctggactag

SEQ ID NO: 28998 - DNA, 837 bp, Artificial Sequence
  Description of Artificial Sequence: Synthetic coding sequence
atgtccagcccaagagacttccgggcagagcctgtgaatgattacgagggaaacgatagcgaggcagaggacctcaacttccgagaaaccctaccgagttctagtcaggaaaataccccaaggtctaaagttttcgaaaataaggtcaactccgaaaaggtaaagctgtccctgcggaactttccccacaacgattacgaagatgtatttgaagagccctctgaaagcggaagtgacccttcaatgtggactgccagaggccctttcagaagggatcggtggagctccgaagatgaagaggctgctggaccaagccaggcgcttagtccactgctatccgataccagaaaaatagtctcagagggcgaactggaccaactggcacagatcagacctctgatcttcaatttccatgaacagacagctatcaaggactgtctcaagatcctcgaggaaaagactgccgcttacgacatcatgcaagaattcatgactgggactagtcatagcgtaaagcagctgcagttcacgaagtggccagaccatggaacccctgcctccgccgattcattcattaagtacattcgatatgccagaaaaagccacctcactggaccgatggtcgtgcattgctcagctggcattggccgaactggcgtcttcttgtgcgttgatgtggtgttttgcgcaatcgtgaagaactgttcatttaatattatggatatcgtcgcacagatgcgcgagcagagaagcggaatggtgcagactaaggagcagtaccacttctgctacgatatcgtccttgaagtcctccgaaagctgcttacactggattag

SEQ ID NO: 28999 - DNA, 681 bp, Artificial Sequence
  Description of Artificial Sequence: Synthetic coding sequence
atgtcatcacccagggactttagggctgagcctgtgaacgattacgaaggaaacgacagcgaggctgaggatctgaattttcgcgaaacgctacccagcagctctcaggagaacacccctaggagtaaagtgttcgagaacaaggttaatagtgaaaaggtgaaattgagcctccgtaactttcctcacaatgattatgaagacgtattcgaagaaccaagtgagagtggctctgacccatctatgtggaccgctcggggaccctttcggagggacagatggagctccgaggatgaggaggccgctgggccttctcaggccttgtctccactactgagcgatacacgaaaaattgtcagcgagggggaattggaccagctggctcagataagaccactgatcttcaatttccacgaacagacagcaattaaggattgtctgaagattttggaagagaagaccgctgcctatgatattatgcaggaattcatggcattagagctgaagaacctgcccggtgagttcaacagcgggaatcagcctagtaatagggaaaagaaccgctatagggacatcctgccctttcaacatcatggatacagcggacctaatgagaggactacgttctggcacggaagcaacgagggcgctgtgagtctactcttgcggtattgtgcctag

SEQ ID NO: 29000 - DNA, 681 bp, Artificial Sequence
  Description of Artificial Sequence: Synthetic coding sequence
atgcaccagacctgcgttcgtcttgaaagagaagcctctgccagaccatcacccggaccagtgttaccacccaggcctctcccctcccacaccgaactacaaattagggaaggacccaagagaacaattagggcagctgcggaaggggctccctgtgtcggacgcgtgcggtgtgccccaggcaacagagggggaagggagggagccagtggcgtgcggggtggcgtggcacaggtgccaccgaggttaccagcgcctcctatcggacctgagcgagacgacctagctggcggagccggaaggaaaccgctaccttcgacagctgctgcatccagtccaggcagtgcagctgctgccactgcagcactatgccctccggcaaggttaagcaccccaagcatgtccggcttgagggtgtatagtactagtgtgactggatccagggaaattaagtctcagcagtccgaagtaacccgcatcctggatggaaaaaggatccagtatcagctcgtggacatatctcaagacaatgccctgcgcgatgaaatgagagcactcgccggtaacccaaaggccacgccaccccagatcgtgaacggcgaccagtattgtggcgattatgagctgttcgtggaggctgtggagcagaatacgctgcaggaatttcttaagctggcctag

SEQ ID NO: 29001 - DNA, 1518 bp, Artificial Sequence
  Description of Artificial Sequence: Synthetic coding sequence
atggatccagggaacgaaaattctgccacggaggcggcagctattatcgacctggacccagacttcgagccccaatcacggcctcgatcgtgcacttggccccttcccaggcccgagatcgccaatcaaccctctgaaccgccagaggtggaacccgatttgggagagaaggtgcacacagaaggaagaagcgagcccattttgctgccgtccagactccctgagcccgctgggggaccccaacctggaatactgggtgccgtgacggggcctcgtaaaggagggtcacgccgaaatgcgtggggtaatcagagttacgcagagcttatctctcaagctattgagtccgctccggagaagaggttgaccctggcccagatttacgagtggatggtccggacagttccttacttcaaggataagggtgatagcaattcttctgctggttggaaaaatagcataaggcacaatctgtcccttcacagtaaattcatcaaggtacacaacgaggccacaggcaagtcaagctggtggatgctgaacccagaagggggtaagtctgggaaggcaccacgtagaagagccgcaagcatggacagctccagtaaacttctcaggggtagaagcaaagccccaaagaaaaagccctcagtgctccctgcacctccggagggtgctacgccaaccagcccagtgggtcacttcgccaagtggtctggctcaccgtgttcccgcaacagagaggaagcagatatgtggactacattccgtcctcgctcctcctccaatgctagctctgtgagcacacgactctcgccactgcggcctgaaagtgaagtgctcgccgaagaaatccccgctagcgttagctcctatgcgggaggcgtcccccctacacttaacgagggactagaattattagacggattaaacctcacatctagccatagcttactgtctaggtccggtctttccggattctctctgcagcacccaggagtgaccggcccactgcacacctacagctcaagcctcttttctcctgctgaggggccactgtctgctggtgagggctgtttttcctcatcgcaggctctggaagctttactgacatctgatactcctccaccaccagccgatgttctgatgacgcaggttgaccccatcctgagccaggctcccaccctcctgttgctgggaggactgccctcctccagtaagctggctaccggagtggggctgtgccccaagccgcttgaagctccaggacccagcagtctggtgccgactttgtccatgatcgcaccacctccagtcatggccagcgcccctatcccaaaggctctgggcacccctgtgttaacccctcccaccgaagccgcatcccaggatcggatgccccaagacttagatctcgatatgtacatggaaaatttagagtgcgacatggacaatatcatttcagacctaatggatgaaggggaaggtttagactttaacttcgaacctgatccttag

SEQ ID NO: 29002 - DNA, 1062 bp, Artificial Sequence
  Description of Artificial Sequence: Synthetic coding sequence
atggactataaatctagcctaatccaggacggaaacccgatggaaaacctggaaaagcaattgatctgtcctatctgtctggagatgttcactaagccagtggtgattctgccatgtcagcacaacttgtgcagaaagtgtgccaacgacatattccaggccgctaatccatattggacaagcagaggatcctcggtctctatgagtgggggaagattccgctgtcccacgtgtaggcacgaggtcataatggaccgccatggagtgtacggactgcagaggaatctgctggtggagaatatcatcgacatctacaagcaggaatgtagctcgaggcctctccagaagggatctcatccaatgtgtaaggagcatgaggatgagaagatcaacatctattgcctcacgtgcgaggttcccacctgttctatgtgtaaggtttttggaatccacaaggcatgtgaagtggcccctcttcaaagtgtattccagggccaaaaaaccgagctgaataattgcatctcgatgcttgttgccggaaacgaccgagtacagaccattatcacccagcttgaggattcacggagagtcaccaaggagaatagccatcaggtcaaggaagagctttctcaaaagtttgacacactttacgccatcttagacgagaaaaagagcgagttgctgcagcgtatcacccaggaacaggaaaagaaactgagttttattgaagccttaattcagcagtatcaggagcaattagacaaaagtacgaaattagtagagacggcgattcagtcactggatgagcccggaggcgcaacatttttgctcacagccaaacagttgataaagagcatagtcgaggccagtaaaggctgtcagctaggaaagaccgaacagggctttgagaacatggacttctttacccttgacctcgaacacatcgccgacgccctccgagctattgatttcggaaccgatgaggaggaggaggagttcatcgaagaagaggaccaggaggaggaggaaagcacagagggaaaggaagagggacaccagtag

SEQ ID NO: 29003 - DNA, 1179 bp, Artificial Sequence
  Description of Artificial Sequence: Synthetic coding sequence
atgggagtgaatcagtctgtgggcttccccccagtgaccggccctcatctggttggctgtggtgatgtcatggaaggtcagaacttacaggggtctttcttcagacttttttacccctgtcagaaggctgaggaaactatggagcagcccctgtggatccctcgctacgaatactgtacgggtctggccgaatatctgcaattcaacaagaggtgcggagggcttctctttaacttagcagtagggtcctgtcgacttcccgtatcatggaacggtccattcaaaacaaaagactcaggttatcccttgataatctttagccacggtctgggggcatttcgcacgctgtacagcgctttttgcatggagcttgcatcaagagggttcgttgtggcggtcccagagcacagggaccggagcgcagccactacatacttttgcaaacaggcgcctgaggagaaccagccaaccaatgagtcgctccaggaggagtggatccccttcaggagagtcgaagagggtgagaaggaattccacgtcagaaacccccaagttcatcagcgcgtctcagagtgtttgcgcgtgcttaagatattgcaggaggttacagcgggtcagacggtgttcaatattctgcccggaggcctggatcttatgaccctgaaggggaatattgatatgagtcgtgtcgctgtcatggggcactcattcggtggggctacagccatacttgctttggccaaggagacccagttccgatgcgctgtggctcttgacgcctggatgtttcctttggagcgcgatttctatcccaaggcacgtggccctgtattctttatcaataccgagaagttccagactatggagagcgttaacctgatgaagaaaatctgtgcccaacacgagcagtcacggattattactgtcctgggatccgtgcataggtcacaaactgatttcgcatttgtgaccggtaacctcatcggaaaatttttttctactgagacccgcggatccttggatccctacgagggacaggaggttatggtcagggccatgttagccttcttacagaaacacctggacctgaaagaggactacaatcagtggaacaacttaattgaggggatcggaccgagccttactcctggcgcaccccaccacctttcaagcctctag

SEQ ID NO: 29004 - DNA, 1179 bp, Artificial Sequence
  Description of Artificial Sequence: Synthetic coding sequence
atgggcgtcaatcagtccgtcgggtttccccctgtgaccgggcctcacctcgtggggtgcggagatgtcatggagggacagaatttacagggcagtttttttaggctgttctacccatgccagaaggctgaggagaccatggagcaacccttgtggattcccagatacgagtattgcaccggtcttgccgaatatctccagttcaacaaaagatgtgggggactgctgttcaatcttgccgtgggttcgtgcagactgcctgtgagttggaacggacccttcaaaacaaaggactccggctacccattaatcatcttcagtcatgggttgggagcatttcgcacactgtattcagccttctgtatggagctggcatccagaggtttcgtcgtggccgtcccagagcatcgcgatcgttcagccgcaaccacgtatttctgcaagcaagctccagaggagaatcagcccacaaacgagtctctgcaagaggaatggatcccatttagacgggtggaggagggtgagaaggagtttcacgtgagaaatcctcaggtgcatcagcgggtgtctgaatgcctaagggtcttgaagatcctccaggaggtaactgccggacagactgtatttaatatcctgccgggtggcttggatctaatgactctgaaagggaatattgacatgtccagagtagccgtgatgggccacagcttcgggggagccaccgcgattctggccctcgcaaaggagacccagtttcgatgcgctgtggcactggatgcctggatgtttccactagagcgagacttttaccccaaagcgagaggcccagtttttttcatcaatacagagaaatttcagacaatggagagcgtcaatctgatgaaaaagatttgcgcacagcacgagcagtccagaatcataactgttctgggctcagtgcatcgcagtcagacagatttcgcttttgttaccgggaacctcatcggaaagttttttagtaccgagactcgcggtagtctggacccatatgaaggccaggaagtgatggtaagagctatgctagccttcctgcaaaagcacttggatctgaaggaagattataatcagtggaacaatctcatcgaaggcatcggtccttccctcacccccggagcgccacatcatctcagctccttgtag

SEQ ID NO: 29005 - DNA, 213 bp, Artificial Sequence
  Description of Artificial Sequence: Synthetic coding sequence
atggtcagaacgaaaacctggacactgaagaagcacttcgtgggctatccaaccaacagtgactttgagctgaagacagcggagctgccaccattgaagaatggagaagtacttctggaagcattgttcttgactgtcgacccatacatgcgggtcgccgctaaaaggctgaaggagggcgacacgatgatgggccagcaggtggctaaatag

SEQ ID NO: 29006 - DNA, 213 bp, Artificial Sequence
  Description of Artificial Sequence: Synthetic coding sequence
atggtccggactaaaacttggaccctgaaaaaacatttcgttggatatcctaccaattcagactttgaactgaagactgcagagctgcctcccctcaaaaacggagaggttcttttagaggccttattccttaccgtggatccgtatatgagagtggcggctaaacgacttaaagaaggggacactatgatggggcagcaggtggctaaatag

SEQ ID NO: 29007 - DNA, 534 bp, Artificial Sequence
  Description of Artificial Sequence: Synthetic coding sequence
atgcctggccttacagcgtacttcgggctcttggaaatctgcggcgtgaaaggcggagaaactgttatggtaaatgccgctgcaggagccgtgggcagcgtagtagggcaaatcgccaaactgaagggatgcaaggttgttggagcggtgggatccgatgagaaggtggcctatctccaaaagctgggtttcgacgttgtttttaactacaaaacggtcgagtcccttgaggaaacactaaaaaaagcgagccccgatggctatgactgctacttcgacaacgtcggtggtgaatttagcaatacagtgatcgggcagatgaaaaagttcggccgaatagcaatatgtggagccatctctacttacaaccgcaccggccctcttccacctgggccacccccagaaattgtcatttatcaggagcttcgaatggaagctttcgtagtgtaccggtggcagggggacgctagacagaaagcattgaaggacctgttaaaatgggtgctggagctgccatatttcgtaattgattag

SEQ ID NO: 29008 - DNA, 1263 bp, Artificial Sequence
  Description of Artificial Sequence: Synthetic coding sequence
atgtcatctcccagggacttccgtgccgagccagtgaatgattacgaaggtaatgactccgaagctgaagatctaaatttccgagagactcttccttcgtcatcccaagaaaataccccccgatccaaagtgttcgaaaacaaagtaaacagtgaaaaggtaaaattgagcctgaggaacttcccacacaatgattacgaggatgtgttcgaggagcctagtgaaagcggcagtgaccctagtatgtggacggcgcgtggacccttcaggcgcgacagatggagctcggaggatgaggaggccgcaggcccaagtcaggctttgagccctttgctgtccgacactcgtaagatcgtgtcggagggagaactggaccaactggcccagatcaggcccctgatattcaactttcacgagcagacggcgatcaaggattgcctgaaaatcctggaggagaaaacagctgcttatgacattatgcaggagtttatggcactggagctgaagaatcttccaggcgaatttaattccggaaaccaacccagtaatagggagaaaaatcggtacagagacatcctcccatatgatagcacgcgggtacccctgggcaagtccaaggactatatcaatgctagctatatcagaatcgtaaattgtggcgaggaatatttctatattgccacccagggcccactgctgagcactattgatgacttttggcaaatggtgttggagaataattccaacgtcattgctatgattacccgagagatcgaggggggtattatcaagtgttaccattattggccaatttctctcaagaaacctctggagctgaagcattttcgtgtgttcctcgagaattaccagatcttgcagtattttatcattcgcatgtttcaggttgtcgagaagtccactggcacgtcccacagcgtaaaacagctgcagttcacgaagtggcccgaccatgggacacccgcatctgcggattccttcataaagtacatacggtatgctagaaaaagccacttgacaggtccaatggttgtacactgttcagccggtataggacgcactggtgtctttctgtgtgtcgatgtcgtgttctgcgccattgtcaagaattgttcgttcaacattatggatattgtggcgcagatgcgagaacagagaagcggtatggttcagactaaagagcaatatcatttttgttatgacatcgtgctggaggtgctccgtaagttgctgaccttggattag

SEQ ID NO: 29009 - DNA, 837 bp, Artificial Sequence
  Description of Artificial Sequence: Synthetic coding sequence
atgtcttcaccaagggatttccgggctgaacccgttaatgattacgaaggaaacgattcggaggccgaagatttaaacttccgagagaccctgccctcgtcttctcaggagaacactcctcgttccaaagtgttcgagaataaggttaacagtgaaaaagtcaagttgtccctgcggaatttccctcacaacgattatgaagatgtattcgaggaaccctcggagtccgggagtgatccatcgatgtggaccgcacggggtccctttcgcagggacagatggtcatccgaagacgaagaggccgctgggccaagccaggctctgtcgccactgctctccgacacccgcaagattgtttccgaaggagaactggatcagctggcccagattcgcccactcatctttaatttccacgaacagacagctatcaaggattgcttgaagatcctcgaagaaaaaaccgccgcatacgacataatgcaggaattcatgactggtacctcgcatagcgtgaagcaactacagtttaccaagtggcccgatcacgggacccctgctagcgcagattccttcattaaatacataagatatgctcgaaaaagccatcttacgggcccaatggtggtgcattgcagcgctgggataggtagaaccggtgtatttctatgcgtggacgtcgttttctgtgccatcgtgaagaactgttcttttaacattatggatattgtagcccagatgcgagagcagcgcagcgggatggtccagactaaggagcaatatcacttctgctatgacatcgtgttggaggtgctgagaaaactcttaacactcgactag

SEQ ID NO: 29010 - DNA, 681 bp, Artificial Sequence
  Description of Artificial Sequence: Synthetic coding sequence
atgagcagtccccgtgacttccgtgcagaacccgtgaatgactatgaaggaaacgacagtgaagccgaggatctcaactttagagaaaccctccccagttcctcccaggaaaacacaccaagatctaaagtgtttgaaaataaggtaaacagtgaaaaggtaaagctgtctctccgcaatttccctcacaatgactatgaggacgtctttgaggagccatcggagtctgggtcagaccctagtatgtggaccgccagaggcccttttcgacgcgatcgctggtcctcagaagacgaggaagctgcagggccttcccaggctttgtcccctctcctgtctgacactagaaaaattgtgtcagaaggagagctggaccagctggcccaaatccggccacttatctttaatttccatgagcaaacagctattaaggactgcttgaaaatactagaagagaaaaccgccgcttatgatattatgcaggaatttatggccctggagctcaaaaatttgcctggcgagtttaattccggaaaccaacccagcaatcgagaaaagaataggtatcgtgacatccttccatttcagcaccacggatactctggaccaaatgaaaggactaccttttggcacggttccaatgaaggcgctgtgtctcttcttctgaggtactgcgcctag

SEQ ID NO: 29011 - DNA, 789 bp, Artificial Sequence
  Description of Artificial Sequence: Synthetic coding sequence
atgtcacgatatctgcgtccacctaataccagtttgttcgtgcgtaatgtcgcagacgatacgaggtcagaggatctgcggagggagttcggtcggtatggaccaatagtggacgtatacgtaccgctggacttctacacaagacgtccacggggattcgcttacgtccaattcgaagacgtgcgggatgctgaggacgcactccataatctggataggaagtggatttgcgggaggcagatagaaatccaattcgcacaaggcgaccggaaaactcctaatcagatgaaggcaaaagagggacgaaacgtgtactcctcgagtcgctacgacgactatgatagatacaggagaagtcggtcacgcagttacgagcggaggcgaagcagatctcgctccttcgattataactatcggagatcttattcacctcgcaactcacggccaaccggccgacctcgcaggagcagatctcacagcgacaatgacagattcaaacaccgcaatcgctcattttcaagaagtaaaagtaactctaggtccagatcaaaatcgcaaccaaagaaagaaatgaaagccaagtctcgaagtcgctcagcctcccacaccaaaactcggggtacaagcaagacagacagcaaaacgcattataagtcagggagcagatatgaaaaggaaagccgaaagaaagaaccaccgcgaagtaagtcgcagtcacgaagtcagagcagatcccgttctaaatcccggagtcgatcttggacctccccgaagtcctctgggcactag

SEQ ID NO: 29012 - DNA, 522 bp, Artificial Sequence
  Description of Artificial Sequence: Synthetic coding sequence
atgagccgctatctgcgtcccccaaatacgagtctgtttgtccggaatgtagcggacgacaccagaagcgaggatcttaggcgcgaattcggcaggtacgggcctatcgtggacgtctatgtgcccctggacttctacaccaggcgacccagaggcttcgcttacgtgcagtttgaggacgttcgggacgccgaagacgcactccacaatctggaccgaaaatggatctgcggccgacagatcgagatacagtttgcccagggagaccgcaagacacccaatcagatgaaagctaaggagggtagaaacgtctacagttcaagcagatatgacgattatgacagatacagacgaagccggtcaaggtcctatgagcggaggagatcacgctctaggtcctttgactataactacagaagaagttactcccccaggaattctcgtcccacaggaaggcccaggcgaagcaggagtcactctgacaatgattcccaagtgtccaaaaagaagaacgaaagatag

SEQ ID NO: 29013 - DNA, 669 bp, Artificial Sequence
  Description of Artificial Sequence: Synthetic coding sequence
atgagcgcttttggccatgacgaggcttggatggaagcaggagggttcggtttagaggcggcagagaggaccgaatatcagtcactctgtaagagtaagctcctcttcctaggtgagcaatccgtggggaagacatcgatcatatcccggttcatgtacaactcctttggatgcgcctgccaagcaactgttggcatcgactttctctccaaaactatgtacctcgaggatcagattgtacagctacagctgtgggacaccgctggccaggaaagattccactctctgattccatcttacatacgagattccaccattgccgtcgtggtgtacgatatcaccaatatcaattccttcaaggaaaccgacaaatgggtggaacatgtgcgggcagagcgaggagatgacgtcgtcatcatgttactgggtaataaaattgatttggataataagcggcaagttactgctgaacagggtgaggaaaaatccaggaacttgaacgtgatgtttattgaaacgagtgctaaaacgggttataatgtgaaaaaactgtttcgtagggtggcctccgccttgctttcaacacgaacgtctcctcctccaaaggaaggaacagttgagattgagttagagtcctttgaagaatccgggaatcgctcctactgttag

SEQ ID NO: 29014 - DNA, 348 bp, Artificial Sequence
  Description of Artificial Sequence: Synthetic coding sequence
atggttcagatcattaaggacacaaatgagttcaaaactttcctgaccgccgcaggtcacaagttggcagttgtgcaattctcctctaagaggtgtggaccttgcaaaagaatgtttcctgtttttcacgcaatgtccgtgaaatatcagaacgtgtttttcgccaacgtcgacgtgaacaatagtccggagctggctgagacgtgccacattaaaaccatccccactttccagatgttcaagaaatcacaaaaagtaactctgttctctagaatcaagcgcatcatctgctgctatcggtctggttttatgtctaatctctgcctcgccgacgacggaaatgaatag

SEQ ID NO: 29015 - DNA, 384 bp, Artificial Sequence
  Description of Artificial Sequence: Synthetic coding sequence
atggtgcaaatcatcaaggacacgaatgagttcaaaaccttcctgaccgcggctggacataaactcgcagtggtgcagttctcgtcaaagagatgcgggccttgcaaacggatgtttcccgtcttccatgcgatgagtgttaagtaccagaatgtattcttcgccaacgttgacgtgaataacagccccgaattggctgaaacatgtcatattaagaccattccgacctttcagatgttcaagaaatcccagaaagtcactcttttcagtcgcatcaaacggatcatctgctgttatcgctctggattcatgtctaatcttatctttgaattttgcggggctgatgctaagaagctggaggccaagacacaggagctgatgtag

SEQ ID NO: 29016 - DNA, 1767 bp, Artificial Sequence
  Description of Artificial Sequence: Synthetic coding sequence
atgcacaggtctgccccttcgcagacaaccaagcgaagtcgcagtcctttctcgaccaccagacgttcttgggatgactcggaatcatctggaacaaacctgaatattgacaacgaagactattctaggtacccaccccgagaatatcgtgctagcggatccaggcgcggaatggcatacgggcatattgatagttatggggcagacgacagcgaggaggagggagcaggtcctgtggaacgacccccagtgcgaggcaagactgggaaattcaaggacgacaaactgtacgaccctgaaaagggcgcacggtccctggctggaccacctcctcacttttcttcattttcgcgagacgttagagaagaacgagacaagctggatccagttccagcagcaaggtgctccgcaagcagggctgacttcttaccccaaagttcagtggcctcgcagtctagcagcgaaggcaagctggccactaagggcgacagctcagaacgggaacgtcgcgaacagaatttacctgctcgccctagccgggctcctgtgagtatctgtggaggaggcgagaataccagtaaatctgccgaggaacccgtagtccggccaaaaattaggaatctggcctctccaaattgtgtaaaacccaaaatcttcttcgacaccgatgatgatgacgatatgccgcactctacgtctcgctggcgggatacagcaaacgacaacgaaggacactctgacgggctggccagacgaggaagaggggaaagtagttctggctatcctgagcccaagtacccagaggacaagagagaggcgaggtccgatcaggtaaaacctgagaaagtgccaaggagacgtcgcacaatggccgaccccgatttttggacccactcagatgattattacaagtactgcgacgaagactctgacagcgacaaggagtggatagccgctctgaggcggaaatacaggtctagggaacagaccctgtcttccagcggagaatcatgggagacacttcccggtaaagaagaacgagaacctcctcaggctaaagtaagcgcctccactggcacttctcccggacctggcgcatcagcctctgctggtgcaggagccggagcaagcgctggttctaatggtagtaactacctcgaggaggtgcgggagcccagccttcaagaagagcaagcaagcctggaggaaggtgaaattccatggctgcaatatcacgagaatgacagctctagcgagggtgacaatgattctggacacgaactgatgcagcccggagtgtttatgttggacggcaacaacaacttagaagatgactcctctgtctcagaggatctggaggtggattggagtctcttcgacggcttcgccgatggacttggcgtggctgaggctatctcgtatgtggatccacagtttctaacatatatggcattggaagagcggctcgcccaggctatggagacggctctagctcacctcgagagcttagcagtggacgtggaagtggcaaacccgccagctagtaaggaaagtatagacgcactgccagagatactggttaccgaagaccatggtgccgtggggcaggaaatgtgctgtccaatctgttgctccgagtacgtgaaaggtgaagttgcaacagagttaccatgccaccactactttcataagccttgtgtgtctatctggctgcagaagagcggcacgtgtcctgtatgtagatgcatgttcccgccacctctttag

SEQ ID NO: 29017 - DNA, 612 bp, Artificial Sequence
  Description of Artificial Sequence: Synthetic coding sequence
atgcctgagcagttcagtgtcgccgagttcctcgccgtaactgctgaggacctgtccagtcctgctggcgctgccgcatttgcagccaaaatgcccagatacagaggcgctgccctggccagagaagagatccttgaaggggaccaagccattctgcaaagaatcaagaaggccgtgcgcgcaatccattcatccggcctgggacacgtggagaacgaagagcagtacagagaggcggtggagtccctggggaacagccatctgtcacagaactcccacgagctgagtacgggatttctgaatcttgccgtgttcactcgcgaggtcgcggcactatttaaaaacctaatacaaaatttgaataacattgtaagtttcccattagatagcttaatgaagggacaactcagagacggacgacaagacagcaaaaagcagttagagaaagcctggaaggattatgaagctaagatggccaagctggagaaggaaagagacagggctcgggtcacggggggaatccccgcatggaatcttgggattcccgctaaaccacatccaaccctgaaacgtgcatccgaaagcccacaggcccctcccgaccctgcctag

SEQ ID NO: 29018 - DNA, 1932 bp, Artificial Sequence
  Description of Artificial Sequence: Synthetic coding sequence
atgggacaagaatccagcaagcccgtctggccaaaccctaccggtggatatcagagtaatactggacgaagatatggccgtaggcatgcctacgtatcctttcgccctccaacatcacagagggaaaggatcgcctctcagcgcaagacaaacagcgaggtgccgatgcaccgatcagctccttctcaaacaacaaagcgcagtaggtcacccttttctactacacgccgatcctgggacgattctgagtcgtcaggtactaatctcaatatagacaacgaagattacagcaggtaccccccacgggaatatcgggcatctggatcgaggaggggaatggcctacgggcatattgactcatatggcgctgatgactccgaggaggagggggctggccctgtcgaacgccctcctgtcagaggtaagaccgggaagttcaaagacgataaactctacgatcccgaaaagggcgctcggagtttggcaggtccgccacctcatttcagctccttcagccgcgatgttcgagaagaacgagacaagcttgaccccgtcccagccgctagatgttctgcgagccgggcagacttcctcccacagagcagcgtggcaagtcaaagcagctctgaaggtaagctggctaccaaaggcgacagctcggaacgggagcggcgagagcagaatcttcccgctcggccttccagggctcccgtgtctatctgtgggggtggagagaatacttccaagagcgcggaagaacctgttgttagacccaaaatacgtaatctcgcatcacccaactgtgtaaaaccaaaaatcttctttgataccgatgacgacgatgatatgccccactcgacgagccgatggagagatactgcgaatgataatgaaggtcactccgacggattagcgaggcgcggaaggggagagagcagtagcggataccctgagccaaagtatcccgaggacaaacgcgaagccaggagtgatcaggtgaagcccgagaaggtgccaaggcgaagacgtaccatggctgacccggacttctggacccacagcgacgattactataagtattgtgatgaggactctgactccgataaggaatggatcgcggctctgcgaaggaagtaccgtagcagggagcagacccttagctcatccggtgaaagttgggaaactctgccaggtaaggaagagcgagaaccccctcaggctaaggtctcggcttctaccggaacatctccaggcccaggcgcatcagcaagcgccggagctggggctggcgcttctgcaggatctaacgggagtaactacttggaagaagtgagggagccatccctacaagaggagcaggcatccctggaagagggcgaaatcccctggctgcagtatcatgagaacgattcttcgtccgaaggagacaacgatagtggccatgagttaatgcagcctggtgtctttatgttagacgggaacaataaccttgaagatgactctagtgtaagtgaagacctggaggtggactggtctctgttcgatggtttcgcggacggactcggtgtggcagaagcaattagttacgttgatccacagttcttgacctacatggcattggaagaacgcctagcgcaagccatggaaacggctctggcccacctggagtcactagctgtggatgtggaggtggcaaacccaccggcttctaaggagtctattgacgctttgccggaaatcctggtgaccgaggatcatggtgccgtcggtcaggaaatgtgctgccccatctgttgctccgaatacgtcaagggtgaggtggccaccgagctcccttgtcaccactacttccacaagccgtgcgtgagcatttggcttcaaaagtcaggaacttgtcccgtatgtcgttgtatgtttccaccccctctctag

SEQ ID NO: 29019 - DNA, 1368 bp, Artificial Sequence
  Description of Artificial Sequence: Synthetic coding sequence
atgggacaggagtcctctaaacccgtgtggcctaatccaaccggtggctatcaatccaacactggacgtaggtacggcagaagacatgcctacgtgtcttttcggcctcctacatcacagcgtgaacgcatcgcaagccagaggaaaacaaacagcgaggtgcccatgcaccgatccgccccttcccaaacaactaaaagatcaagatctcccttttccactacacgtaggagctgggatgattctgagagttctggtacaaatctcaatatcgacaacgaagattacagcagcacaagccgctggcgtgacacagctaacgacaatgaaggtcactccgacggcctagcccgtcgtgggcgaggcgaatccagttctggctatcctgagcccaagtatccagaggacaaacgggaagcaagatccgatcaggtgaaacccgagaaagtgccacgacgtcggcgaaccatggctgaccccgatttttggacacactcagacgactactacaaatattgtgatgaagactctgactcggacaaggaatggattgctgcccttcgcaggaaatatagaagccgggagcagacgctgagcagctctggagaaagctgggagaccctgcctggcaaggaggagagggagcctccacaggccaaagtgtccgcatctacagggacttctcctggacctggggcatcagccagtgcgggagccggtgccggtgcttcagccggatccaacggctccaattacctggaagaggtgcgggaaccaagcttgcaggaggaacaggcatctctggaagagggtgaaattccctggcttcagtaccatgaaaatgacagcagtagtgagggagacaatgacagcgggcatgaactaatgcagccgggtgtcttcatgctggatggtaacaataatttagaagacgactcaagcgtgagtgaagacctggaagttgactggtctctgttcgatggcttcgccgatggcctaggggtagccgaggcaatttcgtacgtcgatccacagttcttgacttacatggctctggaagaacggctggcccaggccatggagacagccctagcccaccttgagtccctggccgtggatgtggaggtggccaatcctcccgcatctaaggaaagtattgacgctctcccagaaatcctggtgactgaagaccatggggcagtgggtcaagagatgtgctgccctatctgctgcagtgaatacgttaagggggaggtcgcgacagagctgccttgtcatcactacttccacaagccttgtgtgagcatctggcttcaaaagtccggcacctgccccgtgtgcaggtgcatgttcccccctccattatag

SEQ ID NO: 29020 - DNA, 390 bp, Artificial Sequence
  Description of Artificial Sequence: Synthetic coding sequence
atggcagagctgattcagaaaaagctgcagggcgaagttgaaaaataccaacagctacagaaagatctgagcaagtctatgtcggggaggcaaaaacttgaagcccagcttacagaaaataacattgtgaaggaagagcttgcgctactagatggatccaatgtcgtgttcaagttgctgggccctgtgctggttaaacaggagctgggcgaggctcgagctactgtgggaaaacggctggattacatcacggcggagatcaagcggtatgaatcccagctcagggacctcgaaaggcagtccgagcagcagagagagaccctggcacagctgcagcaggaatttcagagggctcaggccgctaaggccggtgctccaggcaaggcatag

SEQ ID NO: 29021 - DNA, 390 bp, Artificial Sequence
  Description of Artificial Sequence: Synthetic coding sequence
atggccgagctcatccaaaagaaattgcagggcgaagtggagaagtaccagcagctgcagaaagacttaagcaaatcgatgtccgggcgacagaagctggaggctcagctgaccgagaataacatagttaaggaggagctcgccttgttggatgggtcaaatgttgtgttcaagctactgggccctgttcttgtgaagcaggaactgggcgaggctcgcgctactgttggaaagcgcctggactacatcaccgcggaaataaagaggtacgagtcccagcttagggatctcgagagacagtcagaacaacagcgggagacgcttgcccagctgcagcaagagtttcagcgcgcacaggcagcaaaggctggggcacccggaaaagcctag

SEQ ID NO: 29022 - DNA, 390 bp, Artificial Sequence
  Description of Artificial Sequence: Synthetic coding sequence
atggccgaactcatccaaaagaaactgcagggggaagttgagaagtatcagcagctgcagaaagaccttagtaagagtatgagcggtcggcagaaactggaggctcaacttaccgagaacaacatagtaaaggaggagcttgcattgctggacggatccaacgttgttttcaaactacttggacctgtgctcgtcaagcaagagctaggggaagcccgagccactgtagggaagcgcctggattatattactgcagagataaaacgatatgagagccaactcagagatttggaaagacagagcgaacagcaacgcgagaccttggcacagctacagcaggagtttcagagagctcaggctgccaaggcaggcgcacctggtaaggcctag

SEQ ID NO: 29023 - DNA, 1512 bp, Artificial Sequence
  Description of Artificial Sequence: Synthetic coding sequence
atgaaatgtgagcattgcacccgcaaagagtgttcaaaaaagacaaagactgacgatcaggagaacgtgtcagccgacgcacccagtcctgcgcaagagaatggggagaagggagaattccataagctcgcagatgccaaaatcttcctgtccgactgtcttgcttgtgactcatgcatgaccgcagaggagggggtgcagctgtcacaacagaatgcaaaggacttttttagagtgctaaacctgaataaaaaatgtgatacaagcaagcataaagttctagtggtgagcgtatgcccgcagagccttccttatttcgctgcgaaattcaatctttcagtgactgacgcttccaggcgcctgtgtggattcctcaaaagcttgggtgtccactacgttttcgacactacgatcgccgctgatttcagcattctggagtcacaaaaggaattcgttcggcgatacaggcagcattctgaggaggaaagaacacttcccatgctcacatccgcgtgtcctggctgggtgagatacgccgagagagtgctcggcagacctattacggctcacttgtgtacagcgaaatctccacagcaagtgatggggagccttgtgaaggactactttgctcgacaacaaaatctgagtccagagaaaattttccacgtgatcgtggccccatgctatgacaagaaactggaggccttgcaagaaagcctccctccggctctccatgggagtcggggtgctgactgcgtactcacatcggggaaagtcttaatctcgtggtggtgcaccccagtgattaccgctacccaggaagctgctgcacgggagtccctggaaccaggaaggcagcgcctacaacgggacaagattgcccctcttgatagctctctgggtggcggtggcgagatagcacagatcatggagcagggagacctatctgtacgggacgcagccgtggacaccttgttcggtgatctcaaggaagacaaggtgacgcgccacgacggggcaagcagtgatgggcatctggctcatatattccgtcacgcagccaaagagttgtttaatgaggacgtggaggaagtgacatacagggctctgaggaataaggatttccaagaggtgactctggagaagaacggcgaggtggtgctgaggttcgccgcagcctacggtttccgaaacattcaaaacatgatactgaagctgaagaaaggcaaatttccctttcacttcgtcgaggttcttgcgtgcgccggaggatgtctgaatggaaggggccaggcccagacgccagatgggcacgctgataaagccctcctgagacagatggaaggcatttacgcagacattccggtgagacggccagagtctagcgctcacgttcaagagctgtaccaagaatggctcgaaggcatcaactcacctaaggcgcgtgaagtacttcacaccacttaccaatcccaagaacggggaactcattcactggatatcaaatggtag

SEQ ID NO: 29024 - DNA, 348 bp, Artificial Sequence
  Description of Artificial Sequence: Synthetic coding sequence
atggcaacagaacccgaagcagccgaaccagttgtgcctagcctagttgacaggtattttacccggtggtataaacctgatgtcaaggggaaattctgtgaagaccactgcatcctccaacactctaacagaatatgcgttataaccctggccgaatcacatccagttcttcagtctggaaagacaatcaagagtatcagctatcagatttcgaccaattgtagcaggcttcaaaataaggtgtccggcaaattcaaaaggcgaatcatatacctggagaaggtggaggacgtgatcaagagaaagatgatgccactcagcctggggctgcacctgccccattcctag

SEQ ID NO: 29025 - DNA, 1566 bp, Artificial Sequence
  Description of Artificial Sequence: Synthetic coding sequence
atgaatgtatcactatcacagaagaccgtgaagatccatagactgttccccatgctggccttctccgagccctatgagttcgtgagcctggagtggttgcagaagtggctagacgaatcgaccccaactaagcccattgataatcacgcgtgtctttgttcgcatgacaagctccaccctgacaagatcagcataatgaaacgcatcagcgagtacgctgcagatattttttattccagatatggagggggtcccagactaaccgtaaaggctttatgtaaagagtgcgtggtagaacggtgtcggatcctccggctaaagaatcaactgaacgaggattacaaaaccgttaataacctgcttaaggccgcagtaaagggcgatgggttttgggtaggcaaatcatctctgagatcctggcgccaattggctctggagcagctggatgagcaggacggtgatgctgagcagtcgaacggaaagatgaatggcagcactctcaacaaggatgaaagcaaagaggaacgcaaagaagaggaggaactgaatttcaacgaggatattctttgcccacacggcgagctgtgtatttcagaaaacgagcgcaggctggtatctaaggaggcctggtccaaactgcagcagtattttcccaaggctcccgagttcccttcctacaaggagtgctgttctcaatgcaagattctggaacgcgaaggcgaggaaaacgaggcgttacacaaaatgatcgctaacgaacagaagacctcactccccaatctgttccaagacaagaaccgcccatgcctcagcaactggcccgaagatacagacgtcctgtacatcgtgtctcagttctttgtggaggaatggcggaaattcgtacggaagccaactcgatgcagccccgttagctcagttgggaattccgccctattgtgtccccacggcggactgatgtttactttcgcctctatgactaaagaagatagcaaactgatcgctcttatttggccttcagaatggcagatgattcagaagttgtttgtggtggaccacgtaattaagatcactagaatcgaggtgggcgatgtcaatcccagcgagacccagtacatcagcgagcctaagctttgccctgagtgccgggaggggctcctgtgtcagcagcaacgcgatctcagagaatacacacaagctactatctacgtccataaagtggtggacaataagaaagttatgaaggactctgctccagagctgaacgtctcatcttccgagaccgaggaggataaagaggaggccaagcctgatggagagaaagaccctgattttaatcagataatgcacgcattctcagtggcacctttcgaccagaatctcagcattgacggtaaaatcctgtcagatgactgtgccactcttgggacactgggtgtgattccagagtctgtcatactcctgaaggccgacgaacctatcgctgattacgcagctatggatgatgtgatgcaagtgtgcatgcctgaggagggcttcaagggcacaggcctgttgggacactag

SEQ ID NO: 29026 - DNA, 984 bp, Artificial Sequence
  Description of Artificial Sequence: Synthetic coding sequence
atgacggctgtgggggctgagcgactcacctctgtacgagcgtggctgtcttgttgcggagcatgtgtttgcgtctttctgttcctatgtctgtgcgtgtttcctctgcgcgtacatgtgcatgtgtgggggggagagtgccgggtggatattgccgtgttcgtgagtaagcacatgatcgtcgctctaatgcatgtgaccggcgctgccggtcttctgcggctctgcgtaagggcctgcgtttgtatgagggtgtgcgcgaccgctcacatgtaccgagttgacaagtcgttcacctcacgtaggtcggtgtggaggagcgacgggcagaaccaacacttcccccaggcccttgacctgtccagagtgaacctcgtgccatcttacacaccatcgctctaccccaagaatactgatctgttcgagatgatcgagaaaatgcaaggatcacgaatggacgaacagcgatgcagttttccccctcccctgaaaacagaggaggactatatcccgtatccctctgttcacgaagtgctgggcagggaaggcccattcccattaattctcttaccccaatttgggggttactggattgaaggaactaaccacgagattacatccatccccgagaccgagccactgcaatctcctacaaccaaagtcaaactagagtgcaacccaacagcgaggatctaccgcaagcacttcttgggtaaggagcattttaattattattcattagatgctgctctaggccatttggtgttctccctaaaatatgacgtcattggagaccaggaacatctcagactcttgttgagaactaaatgtaggacctatcatgacgtcattccaatttcatgcctgacagagtttcccaatgtggtacagatggccaaacttgtctgcgaggatgtgaatgtagacagattctatccagttctttacccgaaagtatggctcgacctgggtaccgcacactag

SEQ ID NO: 29027 - DNA, 2079 bp, Artificial Sequence
  Description of Artificial Sequence: Synthetic coding sequence
atgattgagaaaatgcagggatccaggatggatgaacagaggtgttctttcccaccacccctgaaaactgaggaagactacatcccgtatccttccgtgcacgaggtgttgggccgagagggccctttcccacttatcttgctcccgcaattcggaggctactggattgaaggcactaatcacgaaatcactagcattcccgaaactgaacccttgcaatcacctaccaccaaggtgaaactcgagtgcaatccgaccgcacggatctaccggaaacatttcctcgggaaagagcactttaattattattccctcgatgctgccctgggccacctcgtgttcagtctgaagtatgacgtgattggcgaccaggaacatctccggttgctcctacggacaaaatgtaggacatatcatgatgtcattccgatttcctgtctgaccgagttccccaacgtcgtgcagatggctaaactcgtgtgcgaggatgtgaatgttgaccggttctacccggtgctctatcctaaagctagccggttgatcgtgacatttgatgagcacgttataagcaacaactttaagttcggagtgatataccagaagcttggccagacatccgaagaagagcttttttcaactaacgaagaatctcccgcatttgtagaatttctggagtttctgggacagaaggttaaactgcaggattttaaaggttttagggggggacttgatgtgacccacggccagactgggacggagtccgtctactgtaattttcggaataaggagatcatgtttcatgtatcaactaaactgccctatacagagggggatgcccaacagctgcagcgcaaacgtcatatcgggaacgatatcgtggccgtcgtgttccaggatgagaataccccattcgtgccagacatgatcgcatccaatttcctccacgcttatgtggtggtccaggctgagggcggaggaccagacgggcctttatacaaggtgtctgtgactgcccgtgacgacgttccattttttggccctcccctgcccgatccagcagtcttccggaagggtcccgaatttcaggaatttctgctgaccaaacttattaacgctgagtacgcctgttataaagctgaaaaattcgccaagctggaggaaaggacccgcgctgctctactggagacactatatgaggaattacatatccattcacagtccatgatgggcctgggcggagacgaggacaaaatggagaacggttcaggaggaggtggattcttcgagtcctttaagcgcgtcatcagatctcgcagtcagtcaatggacgcaatgggactttcaaacaagaagcccaacacagtgagcacaagccatagtggctctttcgcccctaacaatccagacctggctaaggctgccggaatctcacttcttatacccggaaagtccgcctctcggtttggccgtcgaggctctgccataggtattggaacagtcgaagaagtggttgtgaggggggctgctgggagcgggggatgcctacacgcactgttttccgctaggtcgcaggatgggggtcatatcggcgacgtggctcctcttccacccggtcaggcccctggcagggctggctggtctgggggatcttcagatgggacacagcatctcttatggggtctcagcctgattgtgccaggcaaatcaccgaccaggaagaaatcaggtcctttcggctccaggcggtcatctgctatcggcatcgagaacatccaggaagtccaagaaaagagagagagcccgccagctgggcaaaagacccctgacagcggccacgtgagccaggagcccaagtctgagaatagctccacgcagtcctcccccgagatgccaaccacaaagaacagagccgagaccgcagcgcagcgggctgaagctttgaagcttcccctgttagtccagtgtcagcaactgcgccagcggggtgggggagatggtgggtgcggtcgcagaggccaccggccaggagagcgcgtcatactgagaaacacaccccaggccggactcctgcacttatag

SEQ ID NO: 29028 - DNA, 2085 bp, Artificial Sequence
  Description of Artificial Sequence: Synthetic coding sequence
atggcccagctgaggccggctgtcccccctggccgaccacgccgagggtctctgccagccggagcaagttggcagaatacagacctctttgaaatgattgaaaagatgcaggggagtaggatggatgaacagaggtgctcctttccaccgcctctgaaaaccgaggaggactatatcccctatccatctgttcacgaagtgcttggcagagagggaccttttcctttgattctcctgccgcagttcgggggatattggattgagggtaccaaccacgagataaccagtatccccgagactgagcccctgcagtccccaactaccaaggtgaaactcgagtgcaatccgaccgcccgaatttaccgcaaacatttcctgggcaaggagcactttaactactactctctggatgccgctttaggtcacctcgtcttctcccttaaatacgatgtcatcggtgatcaagagcacttaaggctgctccttagaaccaaatgtcggacatatcatgacgtgattcctattagttgcctcactgagtttccaaacgtcgttcagatggcgaaactagtttgcgaagatgtcaatgtggacagattctacccagtgctgtaccctaaagcatctagactcattgttactttcgatgagcatgttatctccaacaatttcaaatttggagtgatttaccagaaactcggacaaacgagtgaggaagagctgttttcgaccaacgaggagagcccggcttttgtcgaattcctggagtttctgggacagaaagtgaagctgcaggattttaagggatttcgtggaggattagatgtcacccatggccagaccggcaccgaaagcgtgtattgtaacttcagaaacaaggagatcatgtttcacgtgtctactaagcttccttacaccgaaggcgatgctcagcagcttcagcgcaaaagacacatcgggaacgatatcgtagctgtggtgttccaggacgagaacacacctttcgtgccagatatgattgcatccaacttcttgcacgcgtatgtggtagtccaggccgaagggggagggcctgacggcccactgtataaggtttctgtgacagcccgagatgacgtgccattcttcgggcctcctttaccagacccagctgtgttccggaaaggcccagaatttcaggaatttttgctcaccaaactgatcaatgccgagtatgcttgttacaaagccgagaaatttgctaagctggaagaacgcacgcgcgctgccctccttgagaccctgtacgaagaattacacattcacagccaatctatgatgggactaggaggggatgaggacaagatggagaacggcagcggtggagggggtttcttcgaatctttcaagagagtgataaggtcacgcagtcagagcatggacgccatggggctttccaacaagaaacctaacaccgtctctacctctcactctggatcatttgctcccaataatcccgatctcgctaaggcagcagggattagtttaatcgtgccgggaaaatcacccacacgcaagaagagtggtcctttcgggagtagacggtcctccgcaatcggtatagaaaatatccaggaagtacaagaaaaaagggagtctcccccagcagggcagaaaactcctgactccgggcacgtgtcccaggagcccaagtccgaaaatagcagtactcagagctcacccgagatgcccacgacaaagaacagagccgaaacagccgctcagcgggcagaggcactgaaggacttctcacggtcctcctcatcagcttcgtcctttgccagtgtcgtcgaggagacggagggtgtagacggcgaggacacaggcttagaatcagtgtcgagtagcggcactcctcataagcgcgactctttcatatattccacctggttggaggacagcgtttccacaaccagcggcggtagtagccctggtccctcacgaagcccacaccccgatgcgggaaaattgggtgatccagcttgtccagagataaaaattcagcttgaggccagcgaacagcacatgccccaactggggtgctag

SEQ ID NO: 29029 - DNA, 2082 bp, Artificial Sequence
  Description of Artificial Sequence: Synthetic coding sequence
atggcccagctgcgtcccgctgtgccgcctggccgtcccaggcgcggatcattacccgcaggtgcctcttggcaaaacaccgacctcttcgagatgattgaaaagatgcagggatccagaatggatgagcagcgatgctccttccccccaccgctgaagactgaggaagactatattccatacccctccgtacatgaagtgttgggaagggagggccctttcccactgatattgctgcctcaatttggtgggtattggattgaggggactaatcacgagatcacttccatccccgagactgaaccgctgcagagtcctaccaccaaggtgaaactcgagtgtaatcctaccgcaaggatctatcgtaagcattttctgggtaaggaacattttaactattactctctcgatgccgcactgggccacctggttttttcattgaaatatgatgttatcggggaccaggagcacctgcgccttcttctgcgtacaaagtgccggacctaccatgatgtgatccctatctcctgcctgaccgagttcccgaatgtggtacagatggccaaactcgtgtgcgaggatgtgaacgtagaccggttctatccagtgctttatcctaaggcatcccggctcatcgttacttttgatgaacacgtgatttccaacaactttaagttcggtgtcatctatcagaaactgggacagacttccgaggaggaattattcagcaccaacgaagaaagcccagcattcgtcgaatttctcgaatttctgggtcagaaggtcaaactgcaagacttcaaaggttttaggggtggactagacgtgacacatgggcagacaggcactgagtccgtatattgtaacttccgtaataaagagattatgttccatgtttccaccaaattgccatatacggaaggtgatgcccaacttcagcgaaagagacatattggaaatgatattgtggctgttgtctttcaggatgaaaataccccctttgttcccgatatgattgcctccaactttctgcacgcatatgtggtagtgcaggctgagggaggaggacctgatggcccattgtataaagttagtgtaactgcccgagatgacgtgccttttttcgggcctcccctccccgaccctgctgtctttcgcaaaggacccgagttccaggaattcctcctcaccaaactgatcaatgctgaatacgcttgctacaaggccgagaagtttgccaagctggaagaaaggacccgcgctgcgctgttggaaaccctatatgaggagctgcacattcattctcagagcatgatgggactcggcggagacgaagataaaatggagaatggctcgggcggaggcggttttttcgagtcctttaagcgggtcatccgttcacgcagccaaagcatggacgccatgggcctttcgaacaagaaacccaacaccgtatcgacgtcacacagcggctcattcgctcccaataaccccgacctcgcaaaggctgccggtatttcgctcatcgtcccgggtaaatccccgactcggaaaaagagtgggccatttggatctagaagaagcagcgctattggaattgagaatatccaagaggtccaagagaagagggagtcacccccagccggtcagaaaacgcccgattcaggtcacgtgtcccaggaaccaaagagcgagaattcttcgacacagagctctcccgaaatgcctacgacgaagaacagggccgagactgccgctcagagagctgaagctcttaaggattttagccgctcatcatcctctgcctctagctttgcctctgttgtggaagagacagagggtgtggatggagaagacacaggactcgaatcggtgtcatccagcggcactcctcacaaacgggatagcttcatctactcgacatggctggaagactccgtgtcaaccacgagtgggggaagctctcccggacctagtagatctccccatcccgatgctggcaagctgggagaccctgcctgtcccgagattaagatacagctggaagccagcgagcagcacatgcctcagctgggttgttag

SEQ ID NO: 29030 - DNA, 1992 bp, Artificial Sequence
  Description of Artificial Sequence: Synthetic coding sequence
atgatcgagaaaatgcagggctcgcgcatggatgagcaaagatgttcattccctccaccactgaagaccgaagaggactacatcccttaccctagcgtgcacgaggtcttgggaagggaagggcctttcccccttatactcctcccccaatttggagggtattggatcgaagggacaaaccacgaaattacttctatcccggaaaccgaacccctgcagtctcctacaaccaaggtgaagttggagtgcaatccaaccgcccgaatctacagaaagcactttctcgggaaggagcacttcaactattattcgctggacgcggctctgggacatttggtctttagcctgaaatatgacgtgatcggggaccaggagcatttgcgtctactgctgcggaccaaatgtcggacctaccacgatgtgattcccatatcgtgtcttacagagttccccaacgtggtgcagatggctaaacttgtctgtgaagacgtcaacgtggacagattttatcctgtgctatacccgaaggccagtagactcatagtcacttttgacgagcacgtcatcagtaataatttcaaatttggggtgatatatcaaaagcttggccagaccagcgaagaggaattattctccacaaatgaggaaagccccgctttcgttgagttcctagaattcttgggccagaaggtgaaacttcaggattttaaggggtttcgcggaggactcgatgtgacccacggtcagacaggaactgaaagcgtttattgcaattttcggaacaaggagatcatgtttcacgtgagcaccaaacttccttacacagagggcgacgcccaacaattgcagcgcaaacggcatattgggaacgatatcgtagctgttgtctttcaggatgagaacacaccatttgtgcccgatatgatcgcttcaaacttcctgcatgcctatgtggttgtgcaggcagaaggcggaggaccagatggacccctctacaaggtcagcgtcaccgccagagacgacgtgccttttttcgggccacccttgcctgacccagctgtgttccggaaaggacctgagttccaggaatttctgctaacaaagttaattaatgcggaatacgcttgctataaggcagagaaatttgctaaactcgaggaaaggacccgagccgctctgctggaaaccctatatgaggagcttcatatccacagccagtccatgatggggttgggcggagatgaagataaaatggaaaatggaagtggtggcggaggattttttgaatccttcaagcgagtaatcaggagtagatcccagagcatggacgccatggggctgagtaataagaagccaaatacagtctcaacctctcactccgggtcctttgcaccaaataatcccgatttggctaaggctgctggaatttcgctcatcgtgccgggtaaaagccccacaaggaaaaaatccggccctttcggttcccgccgtagttctgcaattgggatcgaaaatatacaggaggttcaggaaaagagggagagcccccctgcaggccagaagacaccagactcaggccacgtaagccaggagcccaagagcgagaactcgagtacacagtcctcccccgagatgccgacgaccaaaaaccgcgctgaaaccgccgcacagagggccgaagccctcaaagatttcagcaggtcatccagctcagcttcctccttcgcctctgttgtggaggagacggaaggagtggatggggaggacacaggactggaatctgtctcttcatctggtactccccacaaacgcgactccttcatctactctacgtggttggaggactccgttagtactacttccggtggatccagtcccggaccttcgcgtagtccgcaccccgatgctgggaaactgggcgaccctgcctgtcccgagattaaaatacagctggaagccagcgagcagcacatgccgcagctcggatgctag

SEQ ID NO: 29031 - DNA, 744 bp, Artificial Sequence
  Description of Artificial Sequence: Synthetic coding sequence
atgctcgtgctgcggtccgccttgacaagggctctagcaagtcggactctcgcgcctcagatgtgttcaagctttgctaccgggccacggcagtacgacggtattttctacgaatttagatcctattatctcaagccatccaagatgaatgagtttttggagaattttgagaaaaatgcccacctccgaaccgcacacagcgaactggtaggttactggtccgtggagttcggcggaagaatgaacacggtctttcacatatggaaatacgacaacttcgcccatagaaccgaagtaaggaaggcattggcaaaagataaagaatggcaggagcagttccttattccgaacctggccttgatagataagcaagagtcagaaattacatacttggtaccttggtgtaagctcgagaaaccccctaaagagggggtttatgagctggccacttttcaaatgaagccgggaggccctgccctttggggggatgccttcaagcgcgcagttcatgctcatgtgaatctcgggtatacgaaactcgtaggagtctttcacaccgaatatggagctcttaatcgggtccatgttctctggtggaatgagagtgccgactcgagggcggcagggagacacaagtcacacgaggatccacgcgtagtcgcagccgtgcgagagagcgtgaattacctggtctcccagcagaatatgcttctgataccaacttcctttagcccccttaagtag

SEQ ID NO: 29032 - DNA, 3594 bp, Artificial Sequence
  Description of Artificial Sequence: Synthetic coding sequence
atgcacataaaaagcattatactggagggttttaaaagctatgctcagcgaacagaggtcaatggcttcgaccctttgtttaacgccatcactgggctgaacggcagtggaaagagtaatatactcgactctatctgttttctcttgggtatcagcaatctgtcccaggtgagggcatccaatctacaggatctggtctataaaaacggccaggccggaatcactaaagcaagcgtatcaatcaccttcgacaactcagataaaaaacagtcgcctcttgggtttgaggtgcatgatgagatcacagtgacccgtcaggtggtgattggcggtcggaacaagtacttaatcaacggcgtaaacgcaaacaatacacgggtacaggacctgttctgtagcgttggactcaacgtgaataaccctcacttcctgattatgcagggacggattactaaggtactcaatatgaaaccccctgaaattctttcaatgatcgaggaggctgccggaactaggatgtacgagtacaaaaaaattgcggcacagaaaactatagaaaagaaagaggccaagttaaaggagattaaaaccattctggaggaagagattacaccgaccatacaaaaattaaaagaggagcggagctcatatctcgaatatcaaaaagttatgcgggagattgaacatctgtcaagactctatatagcatatcagtttctcctggctgaagataccaaggtgcgatcagccgaagagttgaaagagatgcaagataaggttatcaagctgcaagaagagctgtcagagaacgataagaaaattaaagcactaaaccacgagatcgaggagctggagaaacgcaaagacaaggagaccggcggtatactgagatctctcgaagatgccctggctgaggcccaacgcgttaacaccaagagccagagcgctttcgacctgaagaagaaaaacttggcttgtgaagagtccaagaggaaggagttagaaaagaacatggtagaagacagcaagacactggcggctaaagagaaagaggtgaaaaagataacagacgggctccatgcactccaggaagcaagtaataaagatgccgaggcactggccgctgcacagcaacactttaacgctgtctcggccggacttagttcaaacgaggatggggcagaggctacactagcaggacagatgatggcctgcaagaatgacatctctaaagctcagaccgaggctaagcaggcccagatgaagctcaagcatgcccagcaggaactcaaaaacaagcaagcggaggtgaagaaaatggactctgggtatcgcaaggaccaggaagcacttgaggctgtcaagcggcttaaggaaaaactggaggccgagatgaaaaaactgaactatgaggaaaacaaggaagagtccctcttggagaagcgcagacagctcagccgcgacatagggaggttgaaagaaacctacgaggccctactcgccagatttcctaacctgagattcgcctataaggacccagaaaaaaattggaataggaactgtgtgaaaggccttgtcgcgagtctgatctcagtgaaagatacctcagccacaactgctctcgagcttgtggccggagaacggctttataacgtggtcgtcgacacagaggtcactggaaaaaagcttctagagcggggagagctgaagcgcagatatacgatcataccactaaacaaaatttctgccaggtgcattgccccagaaacacttcgcgtcgctcagaacctcgttggacccgataatgtccatgtggcactgagcttggtcgagtacaagcccgagctccagaaggccatggaattcgtttttggcaccacgttcgtgtgcgacaatatggacaatgcaaagaaggtggccttcgacaaaagaatcatgacccgtactgtgacgctgggcggagacgtatttgatccccatggaacgctgagcgggggagccaggtcacaggctgcaagtatcttgacgaaatttcaggagttaaaagacgtgcaagatgaactgcggatcaaagaaaacgaactgagggctcttgaagaggaactcgcaggattgaagaacaccgccgaaaaataccgacagttgaaacagcagtgggaaatgaaaacggaggaggccgacttactgcagaccaagctgcagcagtcatcctatcataaacagcaggaggagctcgatgcattgaagaaaacaattgaggagtctgaggagaccctgaagaacaccaaggagatccagagaaaggccgaagagaagtatgaagtactagaaaataaaatgaagaatgcagaggccgagcgggaacgcgagctgaaagacgcccagaaaaagctggactgtgctaaaaccaaggccgatgcgagctctaagaagatgaaggagaaacagcaggaagtggaagccattacacttgagctcgaagaactgaagagggaacatacgagctacaagcagcagctggaggccgtcaatgaggcaataaagagctatgaatctcagattgaggtcatggcagcagaagtggccaagaataaggagtctgtaaataaagctcaggaagaagtgacaaaacagaaagaagtcataacagcccaggatacagtcatcaaggccaagtatgcagaagtggccaagcataaagaacagaataacgattcacagttgaaaattaaggagctcgaccataacatcagcaagcataagcgtgaggcagaggacggcgctgccaaggtgtcaaaaatgctgaaggactacgactggattaacgctgaacgccacttatttggccagcctaactcagcttatgacttcaagacgaataatcccaaagaggcagggcagaggttacagaaacttcaagagatgaaagagaaacttggtcggaatgtcaatatgcgagccatgaacgtgcttactgaagctgaggagagatacaacgatctgatgaaaaaaaagcgaattgtggagaacgacaagtctaaaattctcaccacaatcgaggacctggatcagaagaagaaccaagctctgaatattgcgtggcagaaagtgaataaggactttggcagcatttttagcactctgcttccaggagcaaacgccatgctggcacccccagaggggcaaacggtgcttgatgggctggaatttaaagtggcccttggaaacacctggaaggagaatttaaccgagctcagcggcggacaacgctccttggtcgcgctgagtctgattctctctatgctcctctttaaacctgcccctatatatatcctggacgaggttgacgctgccttggatctatctcacacccagaatattggccagatgctgagaactcatttcacccatagccagtttatcgtggtaagtttgaaggagggcatgttcaataacgccaacgtgctttttaagacgaagtttgtggatggtgtctccactgtcgcaagattcacgcagtgccagaacgggaaaatctcgaaggaggccaaatccaaggccaaacctcctaaaggagcgcacgtcgaggtgtag

SEQ ID NO: 29033 - DNA, 3594 bp, Artificial Sequence
  Description of Artificial Sequence: Synthetic coding sequence
atgcatataaagtccattatactggagggttttaagagctacgctcagcgtactgaagttaacggctttgaccccttgtttaacgctatcacaggacttaatgggagcggtaaatctaatatactggattctatttgtttcttgttggggatctcaaatctgagccaggttagagcatctaatctgcaggacctggtttataagaatggccaagccggaatcactaaggcttcagtttcgattacattcgataactctgataagaaacagagccccctgggattcgaagtacacgacgagatcaccgttacaagacaagtcgtaataggcggtcggaataagtacctcattaacggggtgaatgcaaacaacaccagggttcaggatctgttctgttctgtgggcctcaacgtgaacaatccacactttctcataatgcaggggcgaatcaccaaggtgcttaatatgaaacctccagagatcctgtcaatgatcgaggaggcagcgggaacccggatgtatgaatataagaaaatcgcagcccagaaaactatcgagaagaaggaagctaagctgaaagagatcaagacaattctcgaggaggagatcactccaactatccagaagctcaaagaggagaggtcatcttacttggaatatcagaaggttatgcgcgagatcgaacaccttagcaggttgtacatcgcttatcaatttttgctggccgaggataccaaggttcgatcagctgaggaactgaaggagatgcaggacaaagtcattaagcttcaggaggagcttagtgagaacgacaaaaaaattaaggccctgaaccatgagattgaggaactggagaaacgtaaggacaaagagacaggcggtatcttgagatcgcttgaagatgctctggcagaagcccagcgggtgaacacaaagtcacaatccgctttcgatttgaaaaagaaaaatctcgcctgcgaagaatccaaaaggaaagagttagagaaaaacatggtcgaggattccaaaacgctcgccgctaaagagaaagaagtgaaaaagatcaccgatggcctccatgctctgcaggaggcgagcaacaaagatgccgaggccctggctgcagcccagcagcattttaacgctgtgtcggctggcttgagctcaaacgaagacggagcagaggccacactggccggacagatgatggcatgtaaaaatgatattagtaaggctcagacagaggctaaacaggcacaaatgaagttaaaacacgcgcagcaggagctgaaaaacaaacaggctgaggtcaaaaaaatggactcaggatacagaaaagatcaagaggcactggaagccgtcaagcgcctgaaagagaagcttgaagcagagatgaaaaaactcaattatgaagagaacaaggaagaatctctgctggaaaaaagaagacagttgtcgagagatatcgggcgtctcaaggaaacctacgaagccctcctggcccgatttcctaacctacgctttgcatataaagatcccgaaaagaattggaatcggaactgtgtcaaagggttagtggcctctctcatttccgtgaaggatacatcggccacaactgccctcgagctggttgccggagagcgtctgtataacgttgttgtcgacaccgaggttaccggcaaaaagttgcttgagcgaggtgaactgaaaagaagatacaccattataccattgaataagatttctgctaggtgtattgcacccgagaccctgcgggtcgcccagaatttggttggcccagataacgtacacgtggcgcttagcctagttgaatacaagcctgagctgcaaaaggcgatggagttcgtgttcggcactaccttcgtgtgtgataacatggacaacgcgaagaaggtcgcttttgataaaaggataatgaccagaacagtgacactgggcggtgacgtgtttgacccacacgggaccctgagtggaggagcaaggtcacaagctgcgagtattttaactaagtttcaggagttgaaggatgtccaggacgaactgagaattaaagaaaacgagctgagggccttggaggaggagctcgctggattaaaaaataccgccgaaaagtaccgccagctgaagcagcaatgggagatgaagacggaggaagcagatctgttgcagacaaagctgcagcagtcttcataccataagcagcaggaggagctcgacgctctgaagaaaacaattgaagaaagtgaggagacactgaagaatacaaaggagattcaaaggaaggctgaagagaagtacgaagtactggagaacaagatgaaaaatgccgaggccgaaagggaaagagagttaaaagatgcccagaagaaactcgactgcgcaaagaccaaagccgacgcatccagcaagaaaatgaaggagaaacagcaggaagttgaggcaattaccctcgagctggaagaattgaaaagagaacacacatcatacaagcagcagcttgaagccgtgaacgaagcaataaagtcgtacgaaagtcagatcgaggtcatggccgcagaagtcgcgaagaacaaggaaagcgtaaacaaagcccaggaggaggtgaccaaacagaaagaggtgatcacagcacaggatacagtcatcaaagctaaatacgcagaggtggccaagcacaaagaacagaacaacgatagtcagcttaaaatcaaggagttagaccataacattagtaagcacaagcgagaggctgaggatggcgcagcgaaggtgtccaagatgctcaaggattatgactggatcaatgcagagcgtcacctttttggccaaccaaatagcgcttatgacttcaagaccaacaaccctaaggaggcgggtcagaggctccagaaacttcaggaaatgaaggaaaaactcggcaggaacgtaaatatgagagctatgaatgtcctaacagaagctgaggagcgttacaatgatctgatgaagaagaagcgtattgtggaaaatgacaagtcaaagatcttaactacaattgaggatctcgaccagaaaaagaatcaggctctgaatatcgcctggcagaaggtgaataaggactttggctccatctttagcacactcctgcccggtgcaaatgccatgctcgccccacctgaggggcagaccgttctggacggcctggaattcaaggtagccttaggaaacacatggaaagagaatctgactgagttatccggcggacagcggagcctggttgccctctctctcattctgtccatgctcctgtttaaaccagcccctatttatatcctggacgaagtagatgcggcattagatttgtctcacacacagaacattgggcagatgctaaggactcacttcacccactcccagttcattgtcgtgagcctgaaggagggaatgtttaacaacgctaacgtcctatttaagactaagtttgttgacggcgtctctacagtagctagatttacacagtgtcagaacggcaaaatctctaaagaggcaaagagtaaggctaagcctcccaaaggagcccacgtcgaggtatag

SEQ ID NO: 29034 - DNA, 1047 bp, Artificial Sequence
  Description of Artificial Sequence: Synthetic coding sequence
atgtcgttaccccgattccaacgcgtgaacttcggaccgtatgacaattacattcccgtgagcgagctgtccaaaaaatcatggaaccagcaacactttgcactcctctttcccaaaccacaaagacctggcacaaaacgccgatccaagcccagccaaatccgcgataacaccgtgtcaatcattgacgaggaacagctgagaggggatcgcaggcagccattgtggatgtatcgtagcctgatgcgcatctcagagcgtccttctgtgtacttggccgcaaggcgccagcctctaaagccaacaaggactgtagaggtggattccaaggcggctgagatagggaaaaaaggagaagataaaaccacacagaaggatacgacagactcagagtctgaactgaagcagggaaaaaaggattcaaagaagggcaaggacatcgagaaagggaaagaagagaaactggatgcgaaaaaggattctaagaagggcaagaaagacgccgagaaaggaaaggactctgccactgagtcagaggacgagaaaggcggagccaaaaaagacaataaaaaggataagaaagatagcaataagggaaaagactctgccaccgaaagcgaaggagagaaaggcggaacagaaaaggactcaaagaaggggaagaaggactccaaaaaaggcaaagatagtgccatcgaattacaagccgtaaaagctgacgagaaaaaagatgaggacggcaagaaggacgctaataagggcgatgaaagcaaggacgcaaaaaaagatgccaaggagataaaaaagggcaagaaagacaaaaaaaagccgtcgagtacggattcagacagtaaagatgatgtcaagaaagaatcaaagaaagacgccacgaaagatgcgaaaaaagttgccaagaaagacactgagaaggaatcggccgacagcaagaaggatgccaaaaaaaatgccaagaaggatgccaagaaagatgcaaagaaaaatgcaaaaaaggacgaaaaaaaggacgccaagaaaaagggcaagtag

SEQ ID NO: 29035 - DNA, 1515 bp, Artificial Sequence
  Description of Artificial Sequence: Synthetic coding sequence
atgaacagccagccccagactaggtctcccttcttccagcgaccacagattcaaccccctcgagcgaccattcccaatagtagcccttccatcagacctggcgctcagactccaacagctgtttaccaggccaatcagcatataatgatggtgaaccacctcccgatgccctacccagtgcctcagggcccacagtattgcatcccgcagtaccggcatagtggacctccctatgtcggtccaccccagcaatacccagtacaaccccctggacccggtcccttttaccccggaccaggcccaggtgactttcctaatgcttatggaaccccattctacccttcccagcccgtttaccagtcagctcccatcattgtaccaactcagcagcagccaccccctgctaaacgtgagaaaaaaacgattagaatccgggacccaaatcagggcggaaaagatatcactgaggaaatcatgagcggagggggatcccggaacccaactccccctatcggtcgccctacctccacacccacccctcctcagcagctgcctagccaggtgccagaacactcccccgtggtgtatggcactgtggaaagtgcccatctcgctgcatcaacccctgtgaccgccgcatccgatcagaaacaggaagaaaaacccaagcctgaccctgtgctgaagtccccttcccctgtgctgcggctggttctaagtggtgaaaagaaggagcaagaagggcaaacgagcgagactaccgcgattgtgtctatcgccgagttaccactgccaccctcacctacaaccgtgtcaagcgtggctcgaagcaccatagcggctccaacctcaagtgccttgagtagccagccaatcttcactactgcaattgatgaccggtgtgaactgtcttctccaagagaagatactatcccaatcccctctttgaccagttgtaccgaaacttctgatccgctgcccactaacgaaaacgatgacgatatttgcaagaagccatgcagtgtggcgccaaacgacattccacttgtttcaagcaccaacctgatcaatgaaatcaacggtgtgagcgaaaagctgtctgctaccgaatcgattgtggagattgtcaagcaagaagtcctgcctctgacacttgagctggagatccttgagaatcctcctgaagagatgaaactcgagtgtatcccagctcctatcactccctctactgtaccgtcctttcctcccacccctccgaccccccctgctagtccaccacatactccggtgattgtgccggcagcagcaaccacggtttcctcacctagtgccgctatcaccgtgcagcgagtcctagaagaagatgagtcaattcggacttgtttgagtgaagacgctaaagagatccagaataaaattgaagtggaggctgatgggcagaccgaggagatactggacagccagaatttgaacagcaggcgcagcccggttcccgagacctctaacgagtgttag

SEQ ID NO: 29036 - DNA, 744 bp, Artificial Sequence
  Description of Artificial Sequence: Synthetic coding sequence
atgctgaagttccttgtctggttcctacaatggtgtgtgtgtgtgttggtgcagccagccaaagaacttcttcactgcttaaagatgcagatgagaatcagcaagtacactaagtgtctgcaggcacagatcgctatcacggtgcccaagacttggaagaagccaaaagacagaacccggacgaccgaggagatgctggaggccgagctggaactgaaggcggaagaagaattatcaattgataaggtcttggaatccgagcaggacaaaatgtctcagggattccacccagagagggatccaagcgatcttaaaaaagtgaaagccgtggaagaaaacggggaagaggccgagcccgtgcggaatggggcagagtccgtgtctgagggcgagggcatcgacgccaattccggtagcaccgactcatctggcgatggagtaacattccccttcaagcccgaaagttggaagccgaccgataccgaaggcaaaaaacaatacgaccgcgaatttctccttgacttccagtttatgcccgcatgcatacagaagccagaggggctgcctcctatttcggacgtagtattggacaaaattaaccagcctaaactgcccatgaggactctcgacccaaggatcttgccacggggtccagacttcactcccgcattcgcagactttggaagacagacacctgggggacggggtgtgccggtttctgcgagctccctgcagcttacctag

SEQ ID NO: 29037 - DNA, 3918 bp, Artificial Sequence
  Description of Artificial Sequence: Synthetic coding sequence
atgaatagtcagcctcaaacgagatcccccttctttcagcgcccacagattcagccgcctcgtgcaactatacccaactcatcccccagtatccgcccaggtgcccagacacccacagccgtgtaccaggcgaaccagcatataatgatggtgaatcacctgccaatgccttaccctgtcccacagggcccacaatactgcatcccccagtacaggcactccggcccaccttacgtgggaccacctcagcagtatcccgtccagccccctggcccagggcctttttatccagggccagggccaggtgacttccccaacgcctatggcacccctttctatccttcacaacccgtataccagagcgcccctatcatcgtgccaacgcagcagcagcctcctcctgcgaaaagagagaaaaaaacaatacgtatcagggaccctaatcagggtggtaaagacataacggaggagattatgagtggcggaggcagccgaaaccccaccccccctattggacggccaacatcaacccctactcctccccagcaattgcccagccaggttcccgagcatagtcctgtggtgtacgggacagttgaatcagcgcacttagctgcctccactcctgttactgctgcttctgaccagaagcaggcacaaatagccatcactgtacctaagacctggaagaaaccaaaggaccgcacacgaacaacagaagagatgttagaggccgaattggagctcaaggccgaagaagaactcagtattgacaaggttctagaaagtgagcaggacaaaatgtcccagggattccaccccgaacgggaccctagcgatttgaaaaaggtaaaggctgtcgaggagaatggtgaggaggcagagcctgttcgaaacggcgctgaatctgtctcagagggggaaggtatcgacgccaattcgggtagcacagactcttctggagatggagtgactttcccattcaagccagaatcttggaaacctactgacacagagggcaaaaagcagtatgatcgggaatttctcttagacttccagttcatgcccgcttgtattcagaagcctgaggggcttccacccatctcagacgtggtcttggacaagatcaatcagcccaaactgccgatgcgcacgctggacccaagaatcctccctcgaggaccggatttcacccccgcatttgctgattttggacgccaaactccgggaggccgtggagtccctctcttaaacgtaggtagccgaagatcacagcctgggcagcgacgggagcctaggaagataattactgtatctgttaaggaagatgtgcatttgaaaaaagctgagaatgcctggaagccaagccaaaagcgggatagccaggcagatgatcccgagaacattaaaacccaggagcttttccggaaggtgcgtagtattctgaacaagctgaccccccagatgttcaatcagttgatgaaacaagtctctggtttgaccgttgataccgaggagcgtttgaaaggggtgatcgatctcgtgttcgagaaggcaatcgacgagccttcatttagcgttgcttacgccaacatgtgcagatgtctggtgaccttaaaagtcccaatggccgacaagcccggaaataccgtcaactttcgcaaactcctattaaaccgatgccaaaaggaattcgaaaaagataaggctgatgatgatgtgttcgaaaagaagcagaaagaattagaagccgctagtgcaccagaagagcggactaggctccacgacgaactggaagaggcaaaagacaaggcaagaaggcgaagtatcggtaacatcaaatttattggggagctgttcaaactgaagatgctgactgaggccattatgcatgactgtgtggtaaagctgttgaagaatcacgacgaggagtcgctcgagtgcctctgtagattgctgaccaccatcggcaaagacttagatttcgaaaaagctaaaccccgaatggatcagtactttaatcagatggaaaaaattgtgaaggaacgcaaaacgtccagtcgcattcgatttatgctccaggatgtgatcgatctgcgactgtgcaactgggtgtcccggagggcagatcagggacctaagacaattgaacagatacacaaagaggccaaaatcgaggaacaggaagaacagcgaaaggtacagcagctgatgactaaggaaaagcgtagaccgggagtacaacgcgttgatgaagggggatggaacacagtacaaggcgcaaagaattcgcgcgttctggacccctcgaagttccttaagatcaccaaacccactatcgacgaaaagatacaactcgtgcccaaagctcagctgggctcctggggtaagggttcaagtggaggcgcaaaggcctcagaaactgacgctctgcggagctccgctagtagtctgaatagattctccgccctgcaaccacccgcaccctccggctcaacaccgtcaacacccgttgaattcgactcgcgtcggacgctaacatcaaggggatccatgggaagagagaaaaacgacaaaccactgccctccgccaccgcccgacctaatacatttatgaggggcggttctagcaaggacctgctggataatcagagccaggaggaacagcggagagaaatgctggaaacggtcaaacagctgacggggggagtggatgtggaacggaattccaccgaggcggagaggaacaagaccagggagtctgcgaaacctgagatcagcgcgatgtcagctcatgacaaagccgctctgagtgaggaagagctggagagaaaatctaaatctatcatcgatgaatttctccatattaacgacttcaaggaggctatgcagtgtgtggaagagctgaacgcacagggactgctccacgtgttcgtgagagtgggcgtggagtctaccctggagagatcacagatcaccagagaccatatggggcagcttctttaccagttagttcagagcgaaaagctgagcaagcaggactttttcaaaggcttcagtgagacgctggaactcgccgatgacatggcgatcgatataccccacatctggctgtacctagccgaactggttaccccgatgctgaaggagggagggatcagtatgcgagaactgaccatcgagttctcaaagcctctcttgcccgtcggtcgcgctggagtgttactgagcgagatcctacatctcctgtgcaagcaaatgagtcacaaaaaagtgggggcactttggagggaagccgacttatcatggaaggatttccttccggagggagaggacgtgcacaacttcctgctagaacaaaaactggacttcattgaatccgatagcccgtgttctagtgaggccctgtctaaaaaggagctctcggccgaggaactgtacaaaaggttggagaaattgattattgaagacaaagccaacgatgagcagattttcgattgggtggaggctaatctcgatgagatccagatgagctctcccactttccttcgcgctctgatgactgcggtgtgtaaagcagcaattatcgctgattctagtacgtttagagtcgataccgctgtgatcaagcagagagtccctatcctcctgaagtatctcgactcagacactgagaaggagttacaagcattgtatgccttgcaggcctctattgtgaaactggaccagcccgctaacctcctgcggatgttctttgactgtctttacgacgaagaggtgatttctgaggatgctttctacaaatgggaaagctctaaggatccggcagaacagaacggcaagggggtcgctctcaagtcggtcacagcattttttacttggttgagagaggcggaggaggagtccgaggacaactag

SEQ ID NO: 29038 - DNA, 4776 bp, Artificial Sequence
  Description of Artificial Sequence: Synthetic coding sequence
atgaattcccagccgcagaccagatcacccggaggattccggcctattcaattcttccaaaggccccagatccaaccccctcgggctactattccaaattcctcaccaagtatccgacctggagcccaaactcctactgccgtatatcaggcgaaccaacatatcatgatggtgaaccacctcccaatgccataccccgttccacagggaccacagtattgcatcccacagtaccgacattcgggaccaccttatgtaggcccacctcagcaataccccgtgcagccccctggccctggccctttttaccccggacctggacccggagatttccccaatgcctacgggactcccttctaccccagtcagccagtataccaatctgcgccaattattgttcctacgcagcagcagccaccgccagctaagagagagaaaaagacgatcagaatccgcgatcctaaccaaggtgggaaggacatcacagaggaaattatgtccggcggaggctctaggaatccaacgccaccaatcggaagacccactagcacccccacacctccgcagctcccctctcaggttccagaacacagcccggtggtgtacggcacggtagagtcagcccacctggccgcatccactccggtgacagcagctagtgaccagaagcaggaagagaaaccaaagcctgatccagtccttaaatcccccagccccgtgctgaggctagtcttgtcaggggaaaaaaaggagcaagaaggacagacttcagaaaccaccgctatcgtctccatcgctgaacttcctttgcccccaagccccaccacagtgtcttcggtagctcgctccactattgcagctcccacaagttcggctctgtcatcccagccgatttttaccacagcaatagatgaccgctgtgaattgtctagtcccagagaggatactatacccatcccatctctaacatcttgcaccgaaacttctgatcctttacccacaaatgaaaacgacgatgatatttgtaagaagccatgttccgtcgcacccaacgatattcccctagtgtcatccaccaatctcatcaacgagattaatggcgtgtccgaaaaactgagcgctacggagtcaatcgtcgaaattgttaaacaagaagttctccctctaactctagaactggaaatcctcgaaaatcctcctgaagagatgaagttggagtgcatccctgcacccatcaccccatctacagtgcctagtttcccgccaacaccaccaacccccccagctagcccccctcataccccagtcattgtgccagccgctgctaccaccgtgtcctcgccaagtgcagctattacagtacagcgtgtgctcgaagaggacgagtccatccgcacttgtctgagcgaggacgccaaagaaattcaaaacaaaatagaagtcgaggccgacggccagaccgaagaaatcctggatagtcagaacctgaatagtcggcgtagtccggtgcctgctcagatagcaataaccgtccccaagacctggaagaaacccaaagaccggacacgtactaccgaagagatgctcgaggccgagcttgaattaaaagctgaggaagaattgtccatcgacaaggttctcgaaagtgagcaggataaaatgagccagggcttccacccggagagagacccatcagacctgaaaaaggtgaaagcagtcgaggaaaacggggaagaggctgagcccgtgaggaacggggcagagtcagtctctgagggagagggaatcgatgccaatagcggatccaccgacagcagcggagatggagtgacttttccatttaagccagagtcctggaaacctaccgacacagagggcaagaagcagtacgacagggaattcctcctggactttcaatttatgccggcttgcatccagaaacctgaaggactcccaccgatttccgacgtggtactcgataaaattaaccagcctaaactgcctatgcgtacactcgaccctcggatcctgccacgtggacccgattttactccggcttttgcagattttggacgccaaaccccagggggaaggggtgtgcccctacttaacgttggctctagaaggtcacagcccggacaaaggagggagccccgtaaaatcatcactgtctcagttaaggaggacgtgcacctgaaaaaggctgaaaacgcttggaaaccaagccaaaagcgcgactcacaggccgatgacccagaaaacatcaagacgcaagagctgttccgtaaggtaaggagcattctcaacaagctgacacctcagatgtttaatcagctcatgaaacaggtgagcggtttgactgtcgatacagaggagagactgaaaggcgtgattgaccttgttttcgaaaaggctattgacgaaccaagctttagcgttgcatatgcaaacatgtgtcgatgcctcgtgactctcaaggtaccgatggcagacaaacctggcaacacagtgaacttccggaagttactgttgaacagatgccagaaagagtttgaaaaagacaaagctgatgatgatgtgttcgagaaaaagcagaaggaactcgaggctgcttcagctcctgaagaacggacacggctccacgatgaactggaagaagctaaggataaggcacgcaggcgatcaatcgggaacataaagtttataggagagttatttaaactaaaaatgctgaccgaggcaattatgcacgattgtgttgtcaagctcttgaagaaccacgacgaggagtcactggaatgcttgtgcagattgctaacaaccattggaaaggacctggattttgaaaaagctaaaccacgaatggatcagtactttaaccagatggagaaaatagtgaaagagaggaagacaagcagccgtatccgctttatgctccaagacgttatcgatctgcggctttgtaactgggtgagtaggcgcgcagaccaggggccaaaaaccattgaacagattcataaggaggccaaaatcgaagaacaggaagaacaacggaaggtgcagcagctgatgactaaagagaaacgaagaccaggcgtccagcgcgttgacgagggtggatggaatactgtgcaaggagcaaagaatagccgtgtgctggatcctagtaagtttctaaagatcactaagccaacaattgatgagaagatccagctggtcccaaaggctcaactggggtcatggggcaagggaagtagtgggggagccaaagccagcgaaacagacgcattgcgatcgagcgctagctctctgaacagatttagtgctttacagccccctgcaccctcagggtccacaccatcaaccccagtcgaatttgactctcgaagaaccctcacctcccgaggcagcatggggcgagaaaaaaacgataagccactgccttctgcgactgcaagaccaaacacatttatgaggggcggatcatcaaaggacctgctggacaaccagagccaggaagaacaacgacgggagatgttggagactgtcaaacaactcaccgggggagttgacgtcgagcgcaacagtacagaggcagagcggaacaaaacaagggagagtgctaaacctgaaatatccgcgatgagcgctcacgacaaggcagctctgagcgaagaggagttggagcggaagagcaaatcgatcatcgatgaatttctccacatcaacgatttcaaggaagccatgcagtgcgttgaggagcttaacgcacagggtctgctgcatgtgttcgttagagttggtgtggaatctacactggagaggtctcaaataacaagggaccacatgggccagctgttataccagctggtgcagtcggaaaagctgagcaagcaggattttttcaaagggttttcggaaaccctcgaactggcagatgacatggccatagatattccccatatttggctgtacctggccgagctagtcactccaatgttaaaggaaggtggtatatccatgcgagagttgaccattgaatttagcaagcccctccttcctgtcggacgagctggagttctgctctccgagatcttgcacctattgtgcaaacagatgtctcataaaaaggtgggggctctctggagggaggccgatttaagttggaaggacttccttccagagggcgaggacgtgcacaacttccttctggagcagaaactggattttattgagtcagatagcccctgtagttccgaagcgctgtccaaaaaagagctgagtgccgaggaactgtacaaacggcttgaaaagctgataatcgaggataaagccaatgacgaacagatatttgactgggtggaagcaaacttggatgaaatccaaatgtcttcccctacttttttgcgtgccctgatgacagctgtttgcaaggcagccatcatcgctgattcctctacgttcagagtggacacggccgtcatcaagcagcgagtgcccattttactcaagtatctggactccgatactgagaaagagttacaggcactgtatgcccttcaagcatcaattgtgaaactcgatcagcctgccaaccttctcagaatgtttttcgattgtctttatgatgaggaagtgatctctgaagatgccttttataaatgggaatcttccaaggatcctgccgagcagaacgggaagggagtagctctcaaatcagtcaccgctttctttacctggctgagggaggccgaggaagagagtgaggataactag

SEQ ID NO: 29039 - DNA, 1002 bp, Artificial Sequence
  Description of Artificial Sequence: Synthetic coding sequence
atgagcggtgacgaaatgatatttgaccctacgatgagtaagaagaaaaagaagaagaagaaacccttcatgctggatgaggagggagatacgcagacagaagaaacccagccttcagaaaccaaggaggtggaacccgaacccaccgaagacaaggacctcgaagctgatgaagaagacacgcgcaagaaggacgccagtgacgacctcgatgacttgaattttttcaaccaaaaaaagaagaaaaaaaagacaaagaaaatctttgacatcgatgaggccgaagaaggcgtgaaggacctgaaaatagaaagcgacgttcaggagcccaccgagcccgaggacgatctggacatcatgttaggtaacaagaagaaaaagaaaaagaatgtcaagttccctgatgaggatgaaatcctggaaaaagacgaggctctggaggatgaggataacaagaaggatgatggaatcagtttttctaaccagactgggcctgcctgggctggcagtgagagagattatacctacgaggagctcctcaacagggtgtttaatattatgagggaaaagaatccagacatggtggccggagagaagaggaagtttgtgatgaaaccaccccaggtggtgagagtcgggaccaagaaaacttccttcgtcaatttcactgacatctgcaagttgcttcatcgtcagccaaagcatttgctggcctttctgctggccgagctggggacttccggctccatcgacgggaataatcagctggtgatcaaagggcgatttcagcagaaacagatcgagaacgttctccggagatatattaaagagtatgtgacgtgccacacctgcagaagtcccgataccatcctccaaaaggacacacgtttgtacttccttcagtgcgagacgtgccattctaggtgctcggtggccagcattaaaaccgggttccaggccgtaacagggaaacgagctcaactccgcgcaaaagctaattag

SEQ ID NO: 29040 - DNA, 2619 bp, Artificial Sequence
  Description of Artificial Sequence: Synthetic coding sequence
atgggtgagggcggtctgccgcctgcctttcaactgcttcttcgagcatgcgaccaaggggacacggaaaccgccaggcggctcctggagcccggagctgctgagccagccgagaggggcgcagaacccgaggcgggagccgaacccgcaggggcagaagtggcgggacccggagctgccgcagctggcgctgtgggcgctcctgtcccagtggactgctctgatgaagccggaaacacagccctccagtttgcagccgctggcggtcatgagccattagtcagattcctgcttcgacggggagcctctgtcaacagcagaaaccactatgggtggtccgctttgatgcaggccgctcgatttggccacgtgtctgtggcccacctcttgctcgaccatggcgctgacgtaaatgcccaaaaccgactaggggctagcgttctaacggtggcgagccgaggaggacacttgggggttgtcaagctactgctggaggcaggcgcattcgtggaccaccaccaccctagtggcgaacagctcggtttaggagggagccgggacgaacccctggatatcaccgccctgatggccgcaattcagcatggccacgaggccgtggtgaggttgcttatggagtggggagctgacccaaatcacgctgctcggacagttgggtggagtccgctgatgctcgccgctctgactggaaggctcggcgtggcacagcaactggtagagaagggcgctaacccggatcatctgtcagtactggagaaaactgcctttgaagttgccctcgactgtaaacatagagacctggtggactacctggaccctctcactaccgttagacccaagaccgacgaagagaaaagaaggccggacatctttcatgcactcaaaatggggaatttccagctggttaaagagatcgccgacgaggaccccagccatgtcaaccttgtcaatggcgatggcgcaacacccctgatgctcgccgcagtgactggtcagctggctctcgtccagcttttggttgaaagacacgctgatgtggacaaacaagatagtgtgcacggctggacggcgctgatgcaggctacgtaccacggcaacaaagaaatagtgaagtacctcctcaaccaaggagccgacgtgaccctgagagctaaaaatggatacacggccttcgatttagtgatgctgcttaatgaccctgatacggagttggtgagattgctagcttcagtgtgcatgcaggttaataaggacaagggtaggccctctcaccagcctccccttccccatagcaaagtgcggcaaccatggagcatccctgtgctccccgacgacaaggggggactgaagtcttggtggaataggatgagcaaccgttttcgaaaactcaaactcatgcagactcttccgcgaggcctgtctagcaaccagcctcttcccttctccgacgagcccgaacctgctcttgatagcaccatgcgtgccgcaccgcaggataagacctctaggtcagcgctgccagacgctgcacccgtaaccaaagataacgggcctggcagcactagaggggaaaaagaggataccttgttaacaaccatgcttcgcaatggcgctcccttaacacgcttgccctccgataagcttaaggccgttatcccaccctttttgccaccaagtagctttgaattatggtctagtgacaggagtcggacacgccacaatggtaaggctgaccccatgaaaactgctctcccccagcgcgcaagccgcggacacccagtgggcggagggggaaccgacacaacgccagtgcggccagtcaagttcccctccctgcccaggagtccagccagtagcgcaaattccggtaactttaatcactctccccactcctctggcggatcttctggagtgggagtgtctaggcatggaggagagttactgaataggagcggtggttcgattgacaacgtgttatcccaaatcgcagctcagcgtaagaaagcagcaggattgctcgaacaaaagccctctcataggtcgagcccggtgggcccagctcccggatccagccccagtgagctcccagcatctccggctggcggttcagccccagtgggaaaacaaaagctcgaaacatcaaagagacccccttctggcacctccacaacgtctaaaagcacttctcctaccctcactccttctccctcgccaaaaggccacactgcagagtcatccgtttctagttcttctagtcatcgccagagcaaatccagtgggggtagctctagtggaaccatcacggatgaagatgagctgacgggaatcctgaagaaactttccctggagaagtatcagcctatcttcgaagagcaggaagtggacatggaggccttcttgaccctgacagatggggacctgaaagaactgggtatcaagaccgatgggtcccgccagcaaatcctggccgctattagcgagctgaacgccggaaagggccgagaacggcagatcttacaggaaaccatacacaactttcacagtagttttgagtctagcgctagcaacaccagagctccaggaaacagtccttgcgcttag

SEQ ID NO: 29041 - DNA, 483 bp, Artificial Sequence
  Description of Artificial Sequence: Synthetic coding sequence
atggaagctgagagaccacaggaagaagaggacggcgaacaggggccacctcaggatgaagaaggatggcctcctcctaacagtacaacacgtccctggcgttcggctcctccaagtcctcccccacccggtacacgacacactgccctgggacctaggagcgcttcactcctgtctttgcagacagagctgctcctggacctcgtggcagaagcgcagtcacggcgactggaagaacagagggccaccttttacactcctcaaaatccgtccagtctggcacccgctcctcttagacctctagaagatagggagcagctgtacagcacaatcctttcccaccagtgtcaaagaatggaggcccagcgatcagaacctcccctgccgccagggggacaggagctgttagagctcctgctgagagtgcagggcggaggtaggatggaggagcagcgctctcgacctccgacccacacttgctag

SEQ ID NO: 29042 - DNA, 483 bp, Artificial Sequence
  Description of Artificial Sequence: Synthetic coding sequence
atggaggccgagcggcctcaagaggaggaagatggcgagcaggggccaccccaggacgaggaaggctggcctcccccaaacagcacaacacgcccatggcggagtgcaccaccatccccccctccccctggaacccgacatacagccctgggaccccgatccgcgagcttgctgagtctacagactgaactcctgcttgatctcgtggcagaggctcagtcacggagattggaagagcagagagcaacattttacacacctcagaacccatcttctttggccccagcccctttgaggcctctcgaggacagggaacaactgtatagcaccattctgtcacaccagtgccagcgcatggaggcccagagatccgaacctccactcccccctggaggccaggaattgttagaattgcttttgagagtccagggcggaggaaggatggaagagcaacgatcaaggcctcccacacatacatgctag

SEQ ID NO: 29043 - DNA, 2790 bp, Artificial Sequence
  Description of Artificial Sequence: Synthetic coding sequence
atgcaggggttgcccgaccccccttcacagcggggaatcatccctcgggcattcgagcacgtcttcgagtccgtgcaatgcgccgagaacacaaaattcctcgtgagggcctcctacctggaaatttacaacgaagatgtgagggatcttctgggcgctgacacgaaacagaaacttgagctgaaagaacaccccgagaaaggcgtgtatgtcaagggcctttcaatgcacaccgttcatagtgtggcccaatgcgagcacattatggaaactgggtggaaaaatcgatcagtgggctatacactgatgaataaagactccagccggtcccactcaatctttacaatctcgattgaaatgagcgctgtggatgagagggggaaagaccacctgcgggcaggcaaactgaacctggtagatctcgcaggaagcgagaggcagagcaagactggggctaccggtgagagactcaaagaggcaaccaagataaacttgtcgctgtcagccctaggcaacgtcatctctgcattagtggacgggagatgtaagcacgtgccgtatagagatagcaaactcactcggttactacaggattcacttggcggtaacactaagacacttatggtagcttgccttagccccgctgacaacaattacgatgagaccctttcaactctccgctacgcaaatagagctaaaaacatcagaaataaacctcgaataaacgaggatcctaaggacgccctcttacgggaatatcaggaggaaattaaaaaactaaaggccattctaacacagcaaatgagccccagctctcttagtgcgcttttgagcaggcaagttccacctgaccccgtccaggtggaggaaaagctcttgccccaacccgtgatacagcacgacgttgaagccgagaaacagctgatccgagaggaatacgaggaaaggttggctaggctgaaggccgactacaaagctgagcaggagagccgagctagactcgaggaggatataacggccatgaggaattcttacgatgtgcggctttcaactttggaagagaatcttaggaaagaaacagaagctgtgcttcaggtgggggtgctatacaaggcagaagtcatgtctcgcgctgagttcgcctccagtgccgaatatccacccgcttttcagtatgagacagtggttaaaccaaaagttttctcaaccacggacactctgccttctgatgacgtctctaaaactcaggtttcctctagattcgccgagttgcctaaggttgaaccatctaagtcagagatctcacttgggagctccgaaagttcatctttagaggagacatcagtgtccgaagcttttccaggaccagaagagccatctaacgtcgaagtgtcaatgcccaccgaggaatctcggtcgaggtactttctggacgagtgcctcggccaggaagccgctggacaccttctaggtgagcagaactatttaccccaggaggagccacaggaggtgccgcttcagggtttgttgggacttcaggatccattcgccgaagttgaggcaaaactggcacgcctaagctctactgtcgcacggacagacgctccgcaggccgacgtaccgaaagttcctgtccaggtgcccgctccaactgacctgctggaacccagtgacgctcgccctgaagccgaggcggctgatgatttcccaccacgtcccgaagtggacctcgcctcagaagtggccctggaggtggtgcgcaccgctgagcccggagtctggctagaagcccaggcgccagttgccttggtcgcccagccagagccattgcctgcaactgcaggggtcaaaagagagtcggtcggaatggaggtggccgtcctgacagatgacccactgccggtggttgatcaacagcaggtgttggcccgattgcagcttctggagcagcaggtggttggtggcgagcaggccaaaaataaggatctgaaagagaaacacaaacgaagaaagagatacgctgatgaaagacgcaaacaactagtggccgctcttcaaaattcggatgaggattcgggtgactgggtgcttctgaacgtgtacgactcgattcaggaggaggtccgcgctaagtctaagttactcgagaagatgcagagaaaacttcgcgctgcagaggtcgaaatcaaggatcttcaatccgagttccagctggagaagattgattacctcgcaactatcaggcgccaggagcgagattccatgttgctgcagcagctccttgaacaggtgcagccactgatccgccgtgactgcaattattctaatcttgagaaaatcctgagagaaagctgttgggatgaggacaatggattttggaagataccacacccagttattacaaaaacctccctccctgtcgctgtctctaccggcccacagaacaagcctgccagaaagacgtctgcggctgataacggtgagcctaatatggaagatgatcgctacaggctgatgttgtcgcggtccaactctgaaaacatcgcatcaaactatttccgctctaagcgggcatcgcaaattttgtctacagatgctagaaagtccctcactcatcacaatagccctcctggactgagttgtccactatctaataatagcgccataccacccacgcaggccccagagatgcctcaacctaggccgttccggcttgaatccctggacatcccgttcaccaaggccaaacgtaaaaaaagcaaatctaatttcggatcagaacctctctag

SEQ ID NO: 29044 - DNA, 426 bp, Artificial Sequence
  Description of Artificial Sequence: Synthetic coding sequence
atgaacaagcacgtgctcaagatccagaaggaattagaggaagcaaaggagaagctggcacgtcaacacaagcgaaggtccgacgatgatgaccgatcctccgataggaaagacggagtcctggaagagcaaatagaaaggctgcaagaaaaagttgaaagcgcccagtctgagcaaaagaatttgtttctggtgattttccaacggtttatcatgatcttgactgagcacctcgtgcggtgtgagacagacggcactagcgtgttaactccctggtataagaattgcatcgaacgcctgcagcagatttttcttcaggtctgcggcgagcttcgtctgggtaacaacacaattctaagccataaagacttctctttaaaaaaaatcctggttaaatttgtgcgacgactctattctacatgctag

SEQ ID NO: 29045 - DNA, 2373 bp, Artificial Sequence
  Description of Artificial Sequence: Synthetic coding sequence
atgagtcggagacgacattccgacgagaacgatggcggtcagccacataagcgtcggaagaccagcgacgctaatgagacagaagaccatctggagtcattaatttgcaaagtgggggaaaaaagtgcatgtagcctggagtctaatcttgagggcctggctggcgtgctcgaggctgatctgcccaactacaaatccaaaatattgcggctgttgtgtactgtggcacgattgttgccagaaaagttaacaatttacacaaccctcgttggattgttaaacgccaggaactacaattttgggggtgagtttgtggaagccatgatcaggcaattaaaagagtcactcaaggccaataactataatgaagctgtgtatctggtaaggttcttgagcgatctcgtgaactgccatgtcatcgctgcaccatctatggtcgccatgttcgagaatttcgtctcagtgacccaagaagaagacgtgccacaggtgcggcgagattggtacgtttatgcttttctctcaagcttgccttgggtgggcaaggaactgtacgaaaagaaagacgcagaaatggataggattttcgcgaatactgagtcttacctaaaaagaaggcagaagactcacgtgccaatgctccaagtgtggaccgctgacaaaccccatcctcaggaagaatatctggattgcctgtgggcacagatccagaagctgaagaaggacagatggcaagagcggcatatcctacggccatacttagccttcgactctatcctctgtgaggcgctgcaacataaccttccccctttcactccaccaccgcacactgaggatagcgtgtaccccatgcctcgcgtgatcttcagaatgttcgactacacagacgaccccgagggcccagttatgcctggctctcactctgtagagaggtttgtgatagaagagaatctgcactgcatcatcaagagccactggaaggagcgtaagacctgtgctgcacaactcgtcagttaccccggaaagaacaagatccccctcaactatcacatcgtggaggtcatcttcgccgaactgttccaattacccgcaccaccccacatcgacgtgatgtacacgacacttctgatagagctctgtaagctgcagccgggttccctccctcaggtactggctcaggctactgagatgctttatatgcgactggatacaatgaatacaacctgtgttgatcgttttatcaactggttttctcaccatctgtctaatttccagtttagatggtcttgggaggattggtcagattgcttgtcccaggacccagaatctccaaagccgaaattcgtgcgcgaagtgctagagaagtgtatgcgcctgtcatatcaccagcgaatcctcgacatcgtgcctccaaccttctcagccctatgtcctgcaaacccaacctgtatttacaagtatggagacgagagcagtaattctctgcccggacatagcgttgcactctgtctggccgtggcatttaaatcaaaagctaccaatgatgaaatcttttccatcctaaaggatgtaccgaatcctaatcaggacgacgatgacgatgaagggttttcttttaatccccttaaaatagaggttttcgtgcaaactcttctgcacctggccgcaaaatctttttcacattccttttccgcactggcaaaattccatgaggtgtttaagacacttgccgagtctgacgaagggaaactgcacgtgctgagagtgatgtttgaggtctggcggaatcacccgcagatgatagcggtgcttgtggacaaaatgattaggacccagatcgtggattgcgctgccgtcgccaactggatattctcgtcagaactttctcgggactttacacgactgtttgtatgggagattttgcacagcactataaggaagatgaataagcacgtcctcaagatccagaaagaactggaggaagctaaagagaagctggcccgacagcataaacgccgatctgacgacgatgaccggtcctcagatcgcaaagatggtgtgctggaggaacagatagagaggctgcaggagaaagtggaaagcgcccagagcgaacagaaaaacctttttctggtgatttttcagcgctttatcatgatcctgacggagcatctggtgcgatgcgaaacagatggaaccagcgttctcactccctggtacaagaactgcatcgaacgcttgcagcagatatttcttcagcaccatcagattatccagcagtatatggtcacacttgaaaatctgttgtttaccgccgaactggatccgcacatcctcgcagtttttcaacagttttgcgctctgcaggcttag

SEQ ID NO: 29046 - DNA, 699 bp, Artificial Sequence
  Description of Artificial Sequence: Synthetic coding sequence
atgtctcaagttctgagtattctaggcatgcatactttgatgtctaaccagcagtattaccaggctctgtcatccagcagcatcatgaataaagagggactaaattcggtgatcaagccaacccagtataagcccgtccccgacgaggagccgaatagcaccgacgttgaggaaacactggagcggatcaaaaacaacgacccaaaactggaggaggtaaacctaaacaacatccgcaacattcccatccctacattaaaggcttatgctgaggccttgaaggagaatagttacgttaagaaattttctatagtggggactagatctaatgatcccgtcgcctacgcgttggccgagatgctgaaggaaaacaaagtgcttaagactttgaacgtggaatctaatttcattagcggagccggaatcctgagactcgtggaagcgctgccgtacaacacaagtctcgtggagatgaagatcgacaaccaaagtcagccactgggtaacaaagtagagatggagatcgtgtccatgcttgagaagaacgctaccctgctaaagtttggctaccactttacacaacaaggaccaaggctgcgtgctagcaatgctatgatgaataataacgacttggtacggaaaagacggctcgctgacctgactggtcccatcattcctaaatgccggtcaggggtgtag

SEQ ID NO: 29047 - DNA, 2403 bp, Artificial Sequence
  Description of Artificial Sequence: Synthetic coding sequence
atgtccagcctaggagctagtttcgtccagatcaaatttgacgatcttcagttttttgaaaactgtgggggtggctcattcggtagcgtatacagggcaaaatggattagtcaggacaaagaagtggcagtgaagaaactgctcaagatagagaaagaggccgaaatcctgtccgttctgtcccaccggaatatcatccaattctacggtgtgatcttagaacctccaaattacggtatcgttaccgagtatgcctcactcggcagtctttacgactacattaacagcaatcgctcagaggaaatggacatggaccatataatgacatgggctaccgatgttgcaaaagggatgcactatctccatatggaggcaccagttaaggtaatacaccgcgatctcaagtcgagaaatgtcgtcatagccgcagacggagtcctgaagatttgcgatttcggtgcgagccgcttccacaatcataccacacatatgtcactcgtgggtacgtttccctggatggcacctgaggtaatccaatctctgccagtgagtgaaacttgcgacacgtattcctatggagtcgtactctgggagatgctaacgcgcgaggtacccttcaagggactagagggtctccaggtggcatggctagttgttgagaagaatgaaagactcacaattccaagctcctgtcccagaagttttgccgaactcctccaccagtgttgggaggctgacgctaagaagcgccctagcttcaagcaaataatcagtattctggagtctatgtcgaacgatacttctctgcccgataaatgtaattccttcctgcacaataaggctgagtggcgatgcgagatagaggctaccctggaacggctgaaaaaactcgagcgagatttgagctttaaggaacaggaactgaaggagagagaacgcagactgaaaatgtgggagcagaagctgactgaacaaagtaacactccattgctgccttcgttcgaaatcggtgcctggaccgaggatgatgtctactgttgggtccagcaacttgttcgaaaaggtgactcaagcgccgagatgtctgtgtacgcctccctattcaaagaaaacaatataacaggaaagaggctactgttgctggaagaagaggaccttaaagacatgggaatagtgtctaaaggacatatcatccattttaaatcagccatcgaaaagctgacacacgactacatcaatctttttcacttcccccctctcataaaagactccggcggagaacctgaagagaacgaggaaaaaatcgtaaatttggagctcgtttttgggtttcacctgaaacccggaacaggacctcaggattgtaagtggaaaatgtacatggaaatggacggggacgagatcgctatcacatatattaaggatgtgacttttaacaccaatcttcccgatgccgagattcttaagatgaccaagccaccgtttgtgatggagaagtggatcgtgggcatagcaaaaagccaaactgtagagtgcaccgtcacctacgagtccgacgtgcgaacccctaagtcaacaaagcatgtgcatagcatacagtggagcagaactaagccccaggatgaggtgaaggcagtgcaactggccatccagacactgttcactaatagcgatgggaatcccggaagccgttcagacagctccgccgactgccaatggctcgacaccctgcgcatgaggcagattgccagcaatacttctttacagcgctcacagagtaaccccatcctcggttctccttttttttctcactttgatggccaagactcatacgctgctgcagtccgccgaccccaggtacccatcaaataccagcagatcaccccagtgaatcaaagtcggagttcctcaccaacccagtatgggttaacaaagaacttcagttctctccacttaaatagccgcgacagtggtttttcgtccgggaatactgacacgtccagcgaacggggtcgctattccgaccggagcagaaacaaatatggcagaggcagcattagtctcaatagcagtccgaggggcagatacagtggaaaaagtcagcatagcacaccctcgcgcggacggtatccgggtaagttttatcgggtttcacagtctgctttaaatccccatcagagccccgacttcaagcgatcacctagggatctgcatcagcccaacacaatacccggaatgccgctccatccggaaactgattctcgcgctagcgaagaagatagcaaagtttcggaaggtggctggaccaaggtggaataccgcaagaagccccatcgtcccagccctgccaaaacaaacaaggagcgcgcacggggagatcacagaggctggaggaatttctag

SEQ ID NO: 29048 - DNA, 1071 bp, Artificial Sequence
  Description of Artificial Sequence: Synthetic coding sequence
atgcgcaggttcttgagacctggccacgacccggttagggaaaggttgaagcgcgacctattccagtttaacaaaacagttgagcatggctttcctcaccaaccatcagccctcggatattctccctctctgcggattttggcgatagggaccaggtcgggagccattaaattatacggcgctcctggcgtggagtttatgggtctgcatcaggagaacaacgccgtgactcagatccatctcctccctggacaatgccagttagtaactcttttggacgataactctctccacctgtggtcgttgaaggttaaaggtggcgcttccgagctgcaagaggatgaatcctttacgctacgcggacctcccggtgctgccccttcagcaactcagattactgtagtcctcccacatagcagctgcgagttattatacctggggacagaaagtggaaacgtcttcgtggtgcaactgccagcgttcagggccttggaagatagaaccatcagcagtgacgctgtcctgcagcgcctccccgaggaggccagacatcgtagggtatttgaaatggtagaagccctccaggaacatcccagagacccgaatcagatattaatcgggtattctagaggcctcgtcgtaatctgggacctgcaggggtctagagttttataccactttctatcatcccaacaattagaaaatatctggtggcagagagacggacggctgttagtgtcctgtcattccgacggctcttactgccaatggcccgttagctcagaggcccagcaaccggagccgcttcgtagcttggtcccatacgggccttttccttgcaaagcaataactaggatcctgtggctgacgactcgccagggccttccattcactatatttcagggtggcatgcccagagccagttatggggacagacactgtatttcagtgattcacgatggacagcaaaccgcctttgatttcaccagcagagtgattggtttcaccgtcctgacagaggccgacccagcagctagcagaagggcctctggggttggggctcagggctag

SEQ ID NO: 29049 - DNA, 2526 bp, Artificial Sequence
  Description of Artificial Sequence: Synthetic coding sequence
atgggtgcccgtgccgcagggacgagttctggcggtggtcctcgaccatgtctcgcccgaggcctctctgcgtccccttttcctgcaaaacagcaacacccccaggcgggagcttcgcccgctgaacttcagcagagggcttactacagggcccgacaggatgctgcttcccaacctgggctgggcttcctgatctcccccagcagttgcagttcatggggcccaggttcgttcacgcggtcttgtggctaccctacactgtgtagctcctggataagtaaacgcgaacctggagagctgagcggagtctggactagcgcttggaggacacacgccgcttttaccggttcgcaggatttatgtttgtataaggggttgggatccatttatgaggacaaaactgcactgtcccttttgggactgggtgaagaaaccaacgaagaggacgaggaagaatcggacaatcaaagtgtgcactcctcatctgagcctctgagaaatctgcatctcgacatcggagccctcggaggcgacttcgaatatgaggagtctttgaggaccagtcagcccgaggagaaaaaggacgtgtccctggactccgacgcagccggaccacctactccttgcaaacccagttccccaggggcagactcttcactcagctccgcagtggggaaggggaggcagggttccggcgcaagaccgggactacccgaaaaagaggaaaatgaaaagagtgagccaaagatttgccggaatctggtgacgcctaaggcagaccccaccggtagtgagcccgcaaaagcgtcggagaaggaggcccctgaggatacagtcgatgccggagaggaaggctcacgtcgggaagaagccgctaaagagcccaagaagaaggcgtcagcccttgaagagggctcctccgatgcctcccaggagcttgagatctctgaacacatgaaggaaccccagttgtctgacagtatagcatcagaccccaagagcttccatggactggatttcgggtttaggtccaggatctctgaacatctgctggatgttgacgtgttgagccccgtgttaggcggtgcctgccgccaggcacaacagcccctcggaatcgaagacaaggatgattcacagtcttcacaagatgagcttcagtcgaagcagtcaaaagggctcgaagagcggtaccaccgcctgtcacctccactgcctcacgaagagcgggcacagagtccccctcgttctctcgccacagaggaagaaccccctcaaggcccagaggggcaaccagagtggaaagaggctgaagagctgggggaggacagcgcggcaagcctgtcactgcaactctctctgcagcggcgttcaacagagcctgtggctcctcctgaacagctatctgaggcggcacttaaagccatggaggaggccgtcgcccaggtgttggagcaggatcagcgccatttacttgaaagcaagcaggagaagatgcagcagctccgcgaaaaattatgtcaagaggaggaagaagagatcctgagattgcaccagcagaaagaacagagcctgtctagtctgagagagcgattacagaaagcaattgaggaggaagaagccagaatgcgcgaagaggaatctcaacggctctcatggctacgggcacaagtccagagtagcacccaggcagatgaggaccaaatacgtgcagaacaggaagcgtccttgcagaagttgcgcgaggagctggaatcccaacagaaagcagaacgggcttccctcgaacaaaaaaaccgtcagatgctcgaacagttgaaggaggagatagaagctagtgaaaagtccgagcaggctgccctgaatgctgcgaaggagaaagcacttcagcagctacgagaacagcttgaaggagaaagaaaggaggccgtggcgacccttgagaaggagcattctgctgagttggagcgcctgtgctcctctcttgaggcaaagcatcgggaggtggtgtcatccctgcagaaaaagatacaggaggcccagcagaaagaggaggcccagctgcagaaatgcctggggcaggtggaacaccgtgtgcatcagaaaagctaccacgtggcgggatacgagcatgagttgagcagtctgttacgggagaagcggcaggaagttgaaggggaacacgaaaggcggctcgacaaaatgaaagaagaacaccagcaggttatggcgaaagctagagagcagtacgaagctgaggagcggaagcaaagggcggagctcctcggtcacctgacaggagagctggaacgcctgcagcgagctcatgagagagagttagagaccgtgaggcaggaacagcataaaaggctggaagatttgagaagaaggcacagagaacaggaacggaagctgcaagacctggaattagacttggagactagggcgaaggatgttaaagccaggctggcattgctcgaggtgcaagtcagggacttacaggaatcactgacgtcagagtcctag

SEQ ID NO: 29050 - DNA, 1053 bp, Artificial Sequence
  Description of Artificial Sequence: Synthetic coding sequence
atgatccgaggttttgaggccccaatggctgagaatcctccccctcccccaccaccagttatcttttgtcatgacagtcccaagcgcgtgctcgtgtctgtaatccgcactaccccaattaaaccaacctgtggcggtgggggtgagcctgagcctccaccacccctgataccaacgtctcctggcttcagcgattttatggtttacccttggcgctggggtgagaacgcccataacgtgacgctgtccccgggagcagcgggagctgccgctagtgctgcactgcctgcggcagccgctgccgagcattccggactccgcggtagaggcgctcccccaccggcagcgtcggcctctgctgccgcatcgggtggcgaggacgaggaggaagccagcagccccgactcaggacacttgaaagacgggatcagaaggggaagacctagagctgacacggtccgagacttgatcaacgagggggagcacagctcttctcgcatccgctgtaacatttgtaacagagtttttcctagagagaagtcattacaggcccacaagagaacgcatacaggagaaaggccatacctatgtgactatcccgactgcgggaaagccttcgtgcagtcaggccaactgaagactcatcaacgattgcataccggggagaagccttttgtgtgctctgagaacggatgcctttctagattcacccatgctaataggcattgccccaagcacccctatgcccgtctcaaacgcgaggagcctactgacacactgtccaagcaccaggcagctgataacaaggccgctgcggaatggttagccaggtattgggaaatgcgcgaacagcgtacgcctaccctcaaagggaaattagttcagaaggcggaccaagaacaacaggatcctttagaatacttacagtccgatgaagaggatgacgagaagcgcggtgcccagaggcggctgcaggagcaacgcgagcgactacatggcgcactggccctgatagaactggctaatttaacgggagccccactgcgacagtag

SEQ ID NO: 29051 - DNA, 1137 bp, Artificial Sequence
  Description of Artificial Sequence: Synthetic coding sequence
atgaacatgatatggaggaactcaatcagctgtctgagactgggcaaagttccccacaggtaccagtccggatatcaccctgtcgcaccactgggctcaaggatcctgacagatcccgcaaaggtgttcgaacacaatatgtgggatcacatgcaatggtctaaagaggaagaggctgcggcaagaaagaaggtaaaagaaaattccgccgtgcgtgtactcctggaagagcaggtgaaatatgaacgggaagcaagtaaatattgggacaccttctataagatccataagaacaagttctttaaggataggaattggttgttgagggagtttcccgaaatactgccagtagaccagaagcccgaagagaaggccagggaatcctcctgggaccacgtgaaaaccagtgccacaaaccggtttagtcggatgcactgtcccaccgtgcctgatgaaaagaaccactacgaaaagtcttctgggtctagtgaaggtcagagtaagaccgagtcagattttagcaacctggacagcgagaagcataagaaggggcctatggagactggtctctttcccggatccaacgctactttccgtattctggaggttgggtgcggggctggaaactctgtgttccctatccttaacacgctggaaaattcaccagaaagcttcctctactgctgcgatttcgcctctggcgcagtggaactggtaaaatctcactcatcatatcgggctacacagtgtttcgcttttgtgcacgacgtttgtgacgacggattgccctacccattccctgacggcatcctggacgtcatcctgcttgtgtttgtcttatcttccatccatcccgatcggatgcagggagtggtgaacagattgagcaaattgctgaagcccggtgggatgttactgttcagagactatgggcgttatgataaaacacaactgcgattcaagaaggggcactgcctaagtgagaacttttacgtgcggggagatgggaccagggcgtattttttcaccaaaggagaggtccatagcatgttttgtaaagctagcctggacgaaaaacaaaacctggtcgacagacgcctccaagttaacaggaagaaacaggttaagatgcactag

SEQ ID NO: 29052 - DNA, 1797 bp, Artificial Sequence
  Description of Artificial Sequence: Synthetic coding sequence
atggggctacgtgcctcaagaccgagtaagctcacctggaagaagtgggccacaactgcagcttctaattcctgttcacgttctgtcagcagctgtaggcgctgcacaggaggacggcttatgaaagagccctggagaagaccaagttccagtatctgttatacatccaggagtagtacaataaaattcagtagtaataagtttaaaactttgtctgtcttgttgagtcatctacaccttttccgcctgcacgtgaaaatctctcagcctagcttgccaattagcagtcgcggagctgccagcagttcccagtttcaggggctgccctccaggagcgccatctttcagcaacagccagagaactgcagtagccccccaaacgttgctctcacctgtctaggaatgcaacagcccgctcagagccagcaggtcacaatccaggtgcaggagccagtggatatgctctccaatatgccaggaacagctgcaggatccagcggccgtggcattagcatctccccatctgccggtcagatgcagatgcagcacagaactaatctcatggccaccctcagttatggccaccgtcccctgagcaagcagctatctgccgactccgcagaggcgcacagtgcccaccagcaacctcctcattacacgacaagtgcgctccagcaggcgctgctgagccctacgcctcccgattacacaaggcaccaacaggtgccacatattctgcagggcctgctgtctccgagacactccctgaccggtcattctgatattcggctccccccaacagaatttgcgcaactgattaagcggcaacaacagcagcggcagcagcagcagcaacaacagcagcagcaggaataccaagaattattccgccacatgaaccagggagacgctggatctttggctccaagcctagggggtcagagtatgactgagcgccaagcactcagctatcagaacgcggactcctaccaccaccacacgtctccgcaacacctgctgcagatccgggctcaggaatgcgtgagtcaggccagctcccctacaccacctcatgggtatgcccaccaaccggctcttatgcattcagagagcatggaggaggattgctcctgtgagggcgctaaagacggattccaggatagcaaaagttccagcaccctgaccaaaggatgtcacgactcaccgctgctgctaagtacgggaggacccggagaccctgaatctctgctgggtactgtgtctcacgcgcaggaactcggtatccatccctacggtcatcagccaacagccgctttctctaaaaacaaagttccttctcgagagccagttatcgggaattgtatggacagatcctccccgggtcaggcagtggaactgccagatcacaatggcctcgggtaccctgccaggcctagtgtgcatgagcaccatagacctcgcgcacttcagaggcaccatacgatccagaattccgatgatgcatacgtccagttggataatctacctgggatgtctctcgttgccggtaaagctctctcgtccgccagaatgtctgatgctgtcctgtcccagtccagcctcatgggtagccagcagttccaggacggtgagaatgaggagtgtggagcaagcctgggtggtcacgagcaccccgacttgtccgacggttcacaacacctcaacagctcctgttacccatcaacttgtatcaccgatattctgcttagttacaagcacccagaagtgtccttctctatggaacaggccggagtttag

SEQ ID NO: 29053 - DNA, 3966 bp, Artificial Sequence
  Description of Artificial Sequence: Synthetic coding sequence
atggccgctgccgcagcatcaggggctggcggtgccgcaggcgcaggaaccggtggggctgggccagccggtagattgctgccaccaccggcaccgggttcacccgcagcgcctgccgcagtgtctcccgcagctggacagcctagaccacccgcaccagcctctaggggtcctatgcccgctcgaattggttattacgagatcgaccggactattggaaagggtaactttgcagttgtgaaaagagctactcacctcgtgacaaaagcaaaagtcgccataaagatcatcgacaaaacgcagctggatgaagagaaccttaagaagatctttcgggaagtgcagattatgaaaatgctgtgtcatccgcatattattagactgtatcaggttatggagactgagaggatgatttatttggtgaccgaatatgccagtgggggagaaatattcgaccatcttgtggcccacggtcgcatggcagaaaaggaagccagaaggaaattcaaacagattgtgacagccgtctatttctgtcattgtcgcaacatcgttcaccgagatctgaaagcagaaaaccttctgctggatgccaacttgaacataaagattgccgactttgggttttctaacttgttcacaccgggacaactcttgaaaacttggtgcgggtcccctccatatgctgctccagagctgttcgagggtaaagaatatgacggtccaaaggtggacatttggagtctcggggttgtgctatacgtgttagtatgcggcgctctgcccttcgacggctccacacttcagaacctccgcgctcgggtcctttccgggaagttcaggatccccttttttatgagcactgagtgcgaacatttaatacgacacatgctggtgctggatcccaataaaagactatcaatggaacagatatgcaaacataaatggatgaaactcggcgacgctgacccgaattttgatcgactcatagccgagtgccaacagctgaaagaagagaggcaggtagaccccttgaacgaagacgtgttgctcgcaatggaagacatggggttggacaaggagcaaacgctgcagagtctgcggagcgatgcctatgatcactattccgccatctattctcttttgtgtgacaggcataagaggcacaagaccctgaggctcggggctcttcctagcatgcccagagcgctcgccttccaggctcccgtaaacatccaggccgaacaggcaggcaccgccatgaacatcagtgtgccccaagtccagctgataaaccccgagaaccagattgtcgaaccagatggaaccctgaacttggattccgacgagggagaagaaccctcaccagaagcgctcgtccgctatctgtcaatgcggagacatacggttggcgtggctgaccctaggacagaagtgatggaagatttacaaaaattactgcctggatttccgggagtcaatccgcaggcgccattcctgcaggtggccccaaacgtgaacttcatgcacaacctgttgcctatgcaaaatctacagccaaccggccagttggaatacaaggagcagagcctgctgcagccccctacgcttcagctccttaacgggatggggcctctggggagacgcgcatccgacggcggagccaatatccagctgcacgcacagcagctgttgaagagacctcgcggtcccagccccttagtgacgatgaccccagccgtcccagcggtcacccctgtggacgaggagagctccgatggagagcccgatcaggaggccgtgcagtctagtacctacaaggactctaatacactgcatctcccaacggagcgcttctcgccagttcggagattttcagacggggctgccagtatccaggcatttaaagctcaccttgaaaaaatgggaaataactccagcattaaacagctccagcaagagtgcgagcagctccaaaagatgtatggaggacagattgatgaacggacattagaaaaaacccaacagcagcacatgctctaccagcaggagcagcaccatcagatactgcagcagcaaatccaagacagtatctgtcctccacagccgagtcctccactccaggccgcttgcgaaaatcaacccgctctgctgacacatcaactacagcggctaagaatccagccatctagtccacccccaaaccatccaaataatcatttattcagacaaccctctaactcaccacctccgatgagctcggctatgattcagcctcatggggctgccagtagttcccaattccaggggttgcctagtcgatcagccatttttcagcagcagcctgagaactgttccagtcctcctaacgtggccctcacgtgtctcggcatgcaacagccagcacagtcccaacaagtcactatccaggtgcaagaaccagtggacatgctcagcaacatgccaggtactgcagctgggtcttccgggcgtgggatatctatctcaccctcagccggtcagatgcagatgcaacacagaaccaatcttatggcaaccctctcctatggccatagacccctaagcaaacaactctcagcggactctgcagaggcccatagtctgaatgttaataggttcagtcccgctaattatgaccaagctcatctgcatcctcatctgttttccgaccagagccgcggttctccctcttcatattccccttccaccggagttgggttctctcctacgcaagccctgaaggtgccacctctggatcagtttcctacttttcctccttctgctcaccaacagcctccccactacactactagcgccctgcaacaggctttactgtctcctactccccctgactatacccgacaccagcaggtgccccacattctgcagggactgctttcgccgagacactcattgacgggacactcagacatcagactgccacctactgagttcgcgcagctaattaagagacagcaacaacagaggcaacagcaacagcagcaacagcaacagcaggaataccaagagttgttccggcacatgaaccagggagatgcgggatctttggctccttccctcgggggacaaagcatgaccgagaggcaggctctgtcttaccagaatgccgactcttaccatcaccacacatcaccccagcacttgttgcagatcagggcccaagaatgcgtaagccaggctagcagccctacccctcctcacgggtacgcccaccagcctgcattgatgcacagtgagtcaatggaggaagactgctcatgtgaaggcgcaaaggacggattccaagactctaagtcttcttccacccttacaaagggatgccacgattcacccttgctgttgtctaccggtgggcctggcgaccctgaatcactcctgggaaccgtcagtcatgcacaagaattgggtatccacccttatggccatcagcccacagcagccttttctaaaaataaagtgcctagcagagaacccgtgattggcaattgtatggaccggtcaagccctggccaggccgtcgaactgcccgaccacaacggcctgggatatcccgcacgccctagtgtccacgagcatcaccgcccaagggctttgcaaagacaccataccatccagaacagcgatgatgcgtatgtgcaattggataatctgcccggaatgagcctggttgccggaaaggccctgagttcagcacgtatgagtgatgctgtgctgagccagagcagtctgatgggatcccagcagttccaggatggtgaaaacgaagaatgcggggctagtttaggaggacacgagcaccccgacttgagtgatggcagccagcatctgaactcttcatgctatccctcaacctgcatcacagatatcctgctgtcttataagcaccctgaagtcagcttctctatggagcaggccggtgtctag

SEQ ID NO: 29054 - DNA, 1569 bp, Artificial Sequence
  Description of Artificial Sequence: Synthetic coding sequence
atgccaagaaagaaggctgctgccgcagcctgggaagagcctagcagcgggaatggaaccgcacgcgctggaccacgaaagagagggggtcctgctggaaggaaacgggagcgcccagagcggtgtagcagtagcagcggcggaggctcctctggcgacgaggacggcctcgagctggatggggcacccggtggtggcaagagggccgctcgtcctgcgactgccggaaaagccggaggtgcggcagtcgtcatcaccgaaccagagcatacaaaagagcgcgtaaaactggaggggtcaaaatgcaaaggacagctgcttatttttggggcaacaaactgggatttaattggtaggaaagaagtcccaaagcagcaggctgcttacaggaatctgggccagaatctgtgggggcctcatcggtacggctgtctggctggcgttagggtgaggactgtcgtgagtggtagttgcgccgctcactccctcctgatcacgacagaggggaagctgtggtcttgggggagaaacgagaagggccagctcggacacggagataccaagcgcgtcgaagctcctaggcttattgagggcctgtcccatgaagttattgtatccgccgcatgcggtcgtaatcatacgcttgcattgaccgagactgggtccgtgtttgcttttggggagaacaaaatggggcagctgggcctggggaaccagacagacgctgtgccatcccccgctcagattatgtataatggacagccaatcactaaaatggcgtgcggagctgagttttctatgatcatggattgtaagggaaatctctacagcttcggatgtccggagtatgggcagctggggcataatagcgacggaaagttcatagcgagagcccagcgcatagaatacgactgcgagttggtaccgcgtcgggtcgctattttcatcgagaaaaccaaggatggtcaaattttgcctgttcccaatgtggtcgtcagggacgtagcctgcggggcaaatcataccttagtgctcgatagccagaagagagttttttcctgggggttcggcggttatgggaggctgggccatgcggagcagaaggacgagatggtgccgcgtctcgtgaagttgttcgatttccccggaagaggggcaagtcaaatatatgccggatacacctgtagcttcgctgtgagcgaggttgggggactattcttttggggggctacgaatacatctcgggagtcaaccatgtatcccaaagcagtccaggatttgtgcggttggcggatccgctcgctggcgtgcggcaagtccagtatcatcgtggctgccgacgaatccacaatttcatggggcccatccccaacattcggagagttaggatacggagaccacaaacctaagagtagtaccgcggctcaggaagtgaagacccttgacggcattttctccgagcaggtcgcaatgggctactcacactctctcgttatagcgcgtgatgaaagtgaaacagaaaaagaaaagattaaaaagctgcccgaatataaccctagaaccctgtag

SEQ ID NO: 29055 - DNA, 1569 bp, Artificial Sequence
  Description of Artificial Sequence: Synthetic coding sequence
atgcccaggaagaaagccgcagcagccgcttgggaggaacccagcagcggcaacggcaccgctcgggcaggcccacggaaacgcggtggcccagcgggacgtaagagagagcgccctgagcggtgctcatccagttccggtgggggaagttccggtgacgaggatgggctggaactcgacggcgctcccggtggcggaaaacgagccgcacgccctgcgaccgccggaaaggccggtggcgcagccgtggtgatcactgaacccgagcacacgaaagagagggtgaagctggaaggatccaagtgtaaaggacagcttctgatctttggcgctactaactgggacctgatcggacggaaggaagtgccaaagcaacaggctgcatatcgtaacctcggacaaaacttatgggggcctcaccgctatgggtgtcttgctggggtgagagtaaggacagtagtgtcaggtagctgtgcagcacattccctcctcattactactgagggtaagctgtggagttggggtcggaacgagaagggacagctgggccacggtgacactaaacgagtcgaagccccacgtctgatagaaggactatctcacgaagtcatcgtcagcgccgcatgtggtagaaaccacaccttggcattgaccgagactggcagtgtctttgcttttggtgaaaacaagatgggtcagctgggtctaggtaaccagactgatgcagtacctagcccagctcagattatgtacaatggtcagccgattaccaagatggcctgcggggcagagtttagtatgattatggactgtaaaggcaatctgtatagctttggctgcccagagtatggccagctaggccataactccgatggcaagttcattgcccgtgcccagagaattgaatacgactgtgagctggtgcccaggcgggtggcgatctttatagaaaaaaccaaggacgggcaaatcctgcccgttcccaatgtggtcgttagagacgtggcctgtggcgcaaaccataccctggtgctcgacagtcagaagcgagtgttttcgtgggggttcggaggttacggtcggttagggcatgccgaacaaaaggatgagatggtgcctaggctcgttaagctcttcgatttcccgggaagaggggctagccagatctatgccggatatacctgcagtttcgcagtatcagaggtggggggtttgttcttttggggcgctacaaacacaagtcgggaatctacaatgtatccaaaagccgtgcaggacttgtgtggatggcgcatccgatccctggcatgcggcaagtccagcatcatcgttgcagccgacgaaagcactattagttggggaccctcaccaaccttcggtgaactgggctacggagatcacaagcccaagtccagcacagccgctcaggaagttaaaactctcgacggcatcttctccgagcaagttgccatgggctacagccactctctggtgatcgccagggatgagagtgagaccgagaaagaaaaaatcaaaaaactgccagaatataatccacggacactatag

SEQ ID NO: 29056 - DNA, 552 bp, Artificial Sequence
  Description of Artificial Sequence: Synthetic coding sequence
atgactgaccagacatattgtgaccgcctagtacaggacactccctttcttaccggccatggaagactgtctgagcagcaggtggaccggattatcctacagttgaatcgctactaccctcagatcctgacaaacaaggaggctgaaaaatttcggaacccaaaggcgtcgttgcgcgttagactttgcgatctgctgtcgcatcttcaacgtagtggggaacgggattgtcaggagttctaccgcgctctttatatccacgctcagccgctgcactctcgcctgccttctcgtcacgcattgcagaacagtgattgcaccgaactcgattccggcagtcagtccggcgagctgtcgaatcggggaccaatgtcattcctcgcgggtctcgggctggctgttggactggctctgctgctttattgctatcctccggacccgaaaggcctgcccggtacacggagagtgctcggttttagccccgttattattgaccgacatgtgagcagatatctcctggccttcctggccgacgatctagggggtctctag

SEQ ID NO: 29057 - DNA, 492 bp, Artificial Sequence
  Description of Artificial Sequence: Synthetic coding sequence
atgctggacctcctggatatcgagggcttatacccactatacaacagggtcgagagatatctcgaggagtttcctgaagagaggaaaacactgcagattgatgggccatacgatgaggccttctatcaaaagctactggatcttagcaccgaagatgatggaactgtagctttcgccttgactaaggtccagcagtatcgcgtggccatgaccgctaaagactgcagcattatgatcgcgctgtccccttgtcttcaggatgccagttcagaccagcggcctgtggtaccctcttctcgtagccggtttgcttttagcgtgtcagtgttggaccttgatttaaaaccatacgagtccataccacatcagtacaagctggacggaaagatcgtgaactactactcgaagacagtaagggctaaagacaatgccgtcatgtcaacccgtttcaaggagtctgaagattgcaccctcgtcctgcacaaggtttag

SEQ ID NO: 29058 - DNA, 777 bp, Artificial Sequence
  Description of Artificial Sequence: Synthetic coding sequence
atggcaaggccacccgtgccgggatccgtggtggttcctaactggcatgagtctgcggaaggaaaagaatacctggcctgtatcctgcgcaaaaaccggagacgtgtctttggactgttagagaggcctgtattgctgccccctgtgtccattgacacggcatcctacaaaatattcgtgagcgggaagtctggggtcggtaaaacagcccttgtggctaagctggccggactggaagtgcccgttgtccatcatgagactaccggaattcaaacaacggtggttttctggcctgccaaactgcaagctagttctcgggtggtaatgtttaggttcgagttctgggattgcggtgaatcggccctcaagaaattcgatcacatgttgctagcttgcatggaaaacaccgacgctttcctctttttattttccttcactgacagagcttccttcgaggatctccctggtcaactagcgaggatagccggagaggccccaggcgtggtccgtatggtgattggctccaagttcgaccagtatatgcatactgacgtgccagagagagacctgaccgctttcaggcaggcttgggaactacccctgctgcgagtgaagtccgtgccgggacgcagattagccgatgggcgaacacttgacggacgagccggactggccgacgtggcccatatactgaacgggctggccgagcagctgtggcatcaagatcaggtagccgcaggccttctaccaaacccacctgagtccgctccggagtag

SEQ ID NO: 29059 - DNA, 333 bp, Artificial Sequence
  Description of Artificial Sequence: Synthetic coding sequence
atggccgacaaggtcctgaaggagaaacggaagcagtttatcagatctgtgggagaaggcactatcaacggactgctcggcgagctgctggaaaccagagtactctcacaggaagaaatcgagattgtcaagtgcgagaacgccactgtgatggacaaagcgcgtgccctgttggacagcgtcatccgcaaaggagcgccagcgtgtcagatctgcattacctacatctgcgaggaagacagccatcttgccggtaccttaggtctgtcagccggtcccacgagcggtaaccatctcaccacccaagattctcaaatcgtcctgccgtcctag

SEQ ID NO: 29060 - DNA, 924 bp, Artificial Sequence
  Description of Artificial Sequence: Synthetic coding sequence
atggagccctcaagtctggagctgccagcggacacggtacagagaattgccgcagagcttaaatgtcaccccacagacgagcgtgtggcactacacctggatgaagaggacaaattgagacattttcgtgagtgcttttatatacctaaaatccaggatttgccacctgttgacctgtctctggtgaacaaagatgaaaacgccatctatttcctgggcaactctctcgggctgcagccgaagatggtgaagacctacctggaagaagaactggacaaatgggctaaaatcgctgcatacggtcacgaagtgggtaaaaggccttggataaccggagacgagtccatagttggcttgatgaaggatatagtcggcgcaaatgagaaagagatagctctcatgaatgctctcacggtcaatctccatctcctgatgttgagcttctttaagccaactcccaagcgatataagattttgctggaggctaaggcctttccatctgatcactatgccattgaaagtcaactgcaactgcacggcctcaacattgaggaatccatgaggatgatcaagcctcgtgaaggcgaggaaactttgcgcattgaagatattctcgaggtcatcgagaaggagggtgatagcatagccgtgatcctgttcagtggggtccacttctatacagggcagcattttaatatccctgccattacaaaagcaggacaggccaaaggctgttacgtcggctttgatctcgcgcatgcggtgggtaatgttgaactttatctccacgattggggcgtggacttcgcctgttggtgctcgtacaaatatctcaatgcgggagcgggtgggatagcaggcgcatttatccacgagaaacacgcccacacaattaaacctgcgagatccgaatttttcaattag

SEQ ID NO: 29061 - DNA, 3060 bp, Artificial Sequence
  Description of Artificial Sequence: Synthetic coding sequence
atggagcctggggaggtgaaggacaggatcctcgagaacatctctttgagtgtgaagaagctgcagtcttacttcgctgcctgcgaggacgaaatccccgctattcggaaccatgataaggtgcttcagcggctgtgcgaacacttagatcatgctctgttatacggactgcaggacttatcaagcggctactgggtcctcgtggtccattttaccaggagggaagcgatcaaacagatcgaagtgctccagcatgtggctactaacctcggaagaagtcgggcttggctgtacttggcattgaacgagaattccttagagagctatctgaggttatttcaagaaaatctgggattactgcacaaatactatgtgaagaatgcactcgtatgctcccacgatcacctcactctttttctgaccctggtgagtgggctcgagtttattaggtttgagttggatctggacgcaccctacctcgatttggctccatacatgcccgattattacaaaccgcagtatctgcttgattttgaggatagactgccaagctctgtgcacggtagtgactccttgagcttaaatagtttcaacagtgtaacaagtacaaatttggaatgggatgacagcgcgattgcaccttcgtcagaagactatgatttcggcgacgtatttccagcagtaccatcagtgcctagcacggactgggaagatggggatttgacagacacagtgagtggtcctaggagtacagcgtctgacctcacctcctctaaggcatcaacaaggagccctactcagaggcagaatccctttaacgaggagcctgctgaaacagtctcctcatctgacacaacccccgttcataccacctcgcaggagaaagaggaggctcaggcgctggaccccccagacgcgtgtacagagctggaagtgatcagagtgaccaaaaagaagaagatcggaaagaaaaaaaaaagccggtctgacgaggaagcctcgcccctgcacccagcatgcagccagaagaagtgtgccaagcaaggtgacggggacagccgtaatggtagtccctctctggggagagattctcccgacactatgcttgcatccccacaggaagagggcgagggtccaagctctaccactgaatcctccgagagatctgaaccagggctcctcatccccgagatgaaggacacctccatggagaggcttggacagcccctgagcaaagttattgatcagctgaacggacaattagacccgagtacttggtgcagcagagccgagccgccagaccagtccttcagaactggatcaccaggggacgccccagagcggccacctctgtgcgacttctctgagggcctcagcgcacctatggatttttataggtttactgtcgagtctccaagcaccgtaacaagcggaggcggtcaccacgatcccgctggcctcggacagccacttcacgtgcccagctcccccgaagcagccggacaggaagaggagggagggggaggcgaaggacaaacacccagacctttggaagacacaacccgggaggctcaagagctggaggcccagctgtctctggtgagggaggggcctgtctccgaaccagaacccggaacgcaggaagtcctgtgccaacttaaacgtgaccagccatcaccatgcctttccagcgccgaagacagcggcgtggacgaaggacaagggtctccctctgagatggtgcattcttcagaattccgtgttgataataaccatctcctgctgctgatgatacacgtgttccgtgagaatgaagagcaacttttcaagatgatccgcatgagtactggacatatggagggaaacttgcaactcttgtacgtcttgttaactgactgctatgtgtacctgctgcggaagggggctactgagaaaccctatctggtcgaagaagctgtcagttacaatgagttagactatgtgagcgtgggcttggatcaacagacggtgaagttggtgtgtaccaaccgtcgtaagcaattcctcttggatactgccgatgtggcccttgccgagttcttcctcgcatccctgaagagcgctatgattaaaggctgtagggaacccccatacccctctatcttgactgacgctacaatggaaaagctggcactggcaaaatttgttgctcaggagtctaaatgtgaagctagcgcagttactgtgcgtttttatggccttgtacattgggaggatcctactgacgagagtctcggacctaccccatgtcattgtagccctcctgagggaactattactaaggaaggaatgctgcattataaggctggtacttcttacctggggaaggaacattggaagacttgctttgtggtcctttctaacggcatcttgtatcaatatcccgacaggacagacgtcatccccctgctgtcagtaaacatggggggagaacagtgtggcggttgcaggcgcgctaacaccacagatagacctcacgccttccaagtgattctatctgaccgaccctgcttagagctttccgctgagtctgaagccgagatggccgagtggatgcagcacttatgccaggctgtctccaagggggtgatccctcaaggtgtggcaccatccccctgcatcccatgctgtctcgtgctcacagacgacaggctttttacttgccacgaggactgtcagacatcattttttcgcagcctcggcaccgccaagctgggcgacattagcgctgtgtccactgaaccaggcaaagaatattgcgttctggagttctcacaggactcacaacagctgctcccaccctgggttatctatctgtcatgcacgtcggaactggaccggctcctgagcgctctgaactccggctggaagaccatttaccaggtggatctcccgcacacagcaattcaagaggcaagcaacaaaaagaagtttgaggatgctctgagtttgattcatagcgcttggcagaggtctgattctctgtgtaggggcagagcttccagggacccttggtgctag

SEQ ID NO: 29062 - DNA, 318 bp, Artificial Sequence
  Description of Artificial Sequence: Synthetic coding sequence
atgaagcccttcgaagacgccctgaaaaatcagcccctcggccctgtgctgagcaaggcggcttcagtggaatgcatttccccggtgtcccccagagcacccgacgcgaagatgctagaagagctgcaggcagaaacctggtaccagggcgaaatgagcaggaaggaagcagagggactgctggagaaagatggagacttccttgtaagaaagtcgactacaaaccctggatcattcgtcctcaccggtatgcacaacggccaggccaaacatttgctgctcgtggatcctgaaggcactagatcaaactcctactag

SEQ ID NO: 29063 - DNA, 318 bp, Artificial Sequence
  Description of Artificial Sequence: Synthetic coding sequence
atgaagccctttgaagacgctctaaagaatcaacctctgggccctgtgctgagcaaagcggcttccgtggagtgcatttctccagtgtctccacgagctcctgacgccaaaatgctcgaagagctgcaggccgaaacctggtaccagggtgaaatgtctcggaaggaagcggagggtctacttgagaaggatggcgacttcctggtacgcaaaagcaccactaacccaggatccttcgtgctgaccggaatgcataacgggcaagccaaacacctgctgctggtagaccctgagggaacccggtcaaacagctattag

SEQ ID NO: 29064 - DNA, 1785 bp, Artificial Sequence
  Description of Artificial Sequence: Synthetic coding sequence
atgttgccgcgaaccaagtacaaccggtttaggaacgactccgtgacttccgtagacgacctacttcacagcctttctgtgtcaggaggcggtggcaaagtttccgccgctagggctacgccggcagccgcaccttacctcgtctctggagaagccctgaggaaagcccctgatgatggccctggctctctggggcacctgcttcataaggtcagccatctgaagttatcctcgtctggcctccggggactgtcctccgccgcaagggaaagggcaggggcacggctatctggaagttgctccgctccatcactagctgcccctgatggtagcgccccaagtgcgcctagagctcccgcaatgtcagccgctcggaaggggaggccaggcgacgagcctcttccgaggccgcctcgcggtgcaccccacgccagcgaccaagttttgggcccaggcgttacctacgtcgtaaagtacctgggctgtatcgaagtgcttcgttctatgaggtcactggatttctctacacgcacccagatcacgcgggaggctattagccgcgtttgcgaagccgtacccggtgctaagggcgcttttaagaaaaggaagcctccgagtaaaatgttgagctccattctgggcaaatcaaatctgcagtttgccggtatgtccatctcacttacgatttccaccgccagtctgaatctgcgcacccccgactcgaagcagataattgccaatcaccacatgaggtccataagcttcgcgagcggaggcgacccagatacaactgactatgtggcttatgtggcaaaagacccagtcaatcgccgtgcctgccacatactcgagtgctgtgacggcctggcgcaggacgttatcggctcaattggacaggcctttgagctaagattcaaacagtacctgcagtgcccaacaaagattcccgctctgcacgacagaatgcagtcccttgacgaaccatggacagaggaggaaggagacggctccgaccacccgtattataactcaataccctctaagatgcctccccctggcggttttctagacacccgcctgaagcccagaccacatgcaccagatacagcccaattcgcagggaaggagcaaacttactatcagggtcgccatttgggagatacgttcggggaggactggcagcagacaccccttagacaagggtctagtgatatttattccactccggagggaaaactgcacgtggccccaacgggagaggctcccacctatgtgaatactcagcagatcccaccccaagcctggccagcagccgtgagttcagccgagagcagcccccgaaaagatcttttcgatatgaagcccttcgaagacgctctgaagaaccaaccgcttggacctgtgctgagcaaagccgcttcagttgagtgtatttctcctgtgagtccccgtgcccctgacgcaaagatgctagaggagttgcaggccgaaacctggtaccagggagaaatgtctcggaaagaggcagaggggctattagagaaggacggcgacttcttagttagaaaaagtactaccaatcctggatccttcgttctgacaggcatgcacaacggccaggctaaacacttactgttggttgacccggaaggcacaatacgcacaaaagatagagtgttcgactcgatttcccaccttattaatcaccatctggagtccagcttgccaatcgtgagcgctggtagcgaactgtgtcttcagcagcccgttgaacgcaaacagtag

SEQ ID NO: 29065 - DNA, 693 bp, Artificial Sequence
  Description of Artificial Sequence: Synthetic coding sequence
atgaatacactaatggatgtgctcaggcataggccaggttgggtggaagtcaaggacgaaggcgaatgggatttttactggtgtgacgtctcctggctcagagagaattttgatcacacctacatggatgagcacgtgcggatttcgcattttcggaaccactacgagcttacaaggaagaattacatggtgaaaaacctgaaaaggttccgaaaacagctggaacgcgaggctggcaagctcgaagctgccaaatgtgacttttttcccaaaacctttgagatgccttgcgaatatcacctgtttgtggaagaattcaggaaaaatccagggatcacctggatcatgaagcctgatacaaggtcaagcgacgatcaaaaggacgacatcccggtggagaactatgttgcacaaagatacattgagaatccttatctaattgggggacgcaaatttgatttgagagtgtacgtactcgtaatgtcctatatcccccttcgggcatggctataccgcgatggtttcgctaggttctccaatacaaggttcacgctgaactctatagatgaccaatatgtgcaccttacaaacgtggctgtgcaaaagacaagccccgattatcatcctaaaaaagtcgcaccgggaggccagtgtgtgccaattacggatagccaacagcctggcagactgtag

SEQ ID NO: 29066 - DNA, 1068 bp, Artificial Sequence
  Description of Artificial Sequence: Synthetic coding sequence
atgaatacattgatggacgtcttaagacatcgtccgggttgggtggaagtgaaggacgaaggtgaatgggacttctattggtgcgatgtcagctggttgcgggaaaattttgaccacacatacatggatgagcatgttagaatcagccacttccggaatcactacgaactgactcgcaaaaattatatggttaagaacctgaagagattccggaagcagctggaacgcgaggcaggcaagctcgaggcagctaagtgcgactttttccccaagacttttgagatgccatgtgaatatcacttatttgtggaagagttcagaaagaaccccggaataacctggatcatgaagccagatacccgctcttccgatgaccagaaagacgatattcctgtggagaactatgtggctcagcgttatatagagaatccgtatttaattggcggtcgcaagttcgacctgagagtctacgtccttgttatgtcttacattccccttagggcatggctgtatagggatggctttgctaggtttagcaatacacgctttacactgaactctattgacgaccaatacgtgcacctgacaaacgtcgccgtgcaaaaaacgtcccctgactaccatcctaaaaaggggtgtaagtggaccctgcagcgattccgccaatatcttgcctctaagcacggcccagaagccgtggagacgcttttcagggatatagacaatattttcgttaaatctttgcagtctgttcaaaaagtgattatttcagataaacattgtttcgagctgtacggatatgatattttgatcgaccaggacctgaagccgtggttattggaggtgaacgcctctccaagtctcacggccagttcacaggaggattacgagctgaaaacttgtctgcttgaggatacactgcatgtagtcgatatggaggcgagattacggcaacgctccgaagagaccacagaagctgcactactgctcccctctagtagtgaggagtcgttccagctgattccttcatgtcaggaggagatttccctgagcaggccatgtgtgtag

SEQ ID NO: 29067 - DNA, 840 bp, Artificial Sequence
  Description of Artificial Sequence: Synthetic coding sequence
atgtctagaccaaagaaccagaattataagggtcatggtctgagtaaaggaaaggaacgcgagcagcgagcaagcattaggttcaagaccacactcatgaacacgttaatggacgttttgcgccacagaccaggatgggtggaagttaaggacgagggtgaatgggatttttattggtgtgatgtcagctggctgagagaaaactttgaccatacctatatggatgagcacgtcaggatctcccacttccgcaaccactacgagctgacccgaaaaaactacatggttaagaacctcaaacgcttccgcaaacagctggagcgcgaagcgggaaagctagaagcagccaagtgcgacttctttcccaagactttcgaaatgccgtgcgagtatcacctgtttgtcgaagagtttaggaagaaccccggaatcacttggatcatgaaacccgtggctcgtagccagggaaagggtatcttcctgtttcggaggctcaaggatatcgtggactggcggaaggacacacggtcttccgacgaccagaaagacgacatccccgtggaaaactatgtggcgcagcgctatattgaaaacccctacctcattggcggacgtaaattcgatctgcgcgtgtatgttctagtgatgtctatgttcacatcacctacttggttgtgtaagaagcatcttccaacaacaacacagcgccgagccgctagcgggcgatgttctgcttccggctccacctggcgacccaatactggtcctagacagtggagacatagcagcgggacaagcacaactagcttgagtaaggcctgtagagtgtgtcgtaggtag

SEQ ID NO: 29068 - DNA, 1116 bp, Artificial Sequence
  Description of Artificial Sequence: Synthetic coding sequence
atgagcaggcctaagaatcagaactacaaggggcacgggctgtccaaaggcaaggagagagagcagcgggctagtataaggtttaaaaccactctaatgaataccctgatggacgtcctcaggcatcggcctggctgggtagaagttaaagacgagggggagtgggatttctattggtgcgacgtatcctggttgcgggagaatcttgagagagaggccggaaagttggaagccgcaaaatgtgactttttcccgaagaccttcgagatgccctgcgagtaccacctcttcgtggaagaatttcggaaaaatcctggaatcacatggatcatgaaacccgtcgctagatcacaggggaaaggcatctttttgttccggagactaaaagacattgttgactggcggaaggatacgagatcttccgacgaccaaaaggacgatatcccagtggagaattacgtagctcagcgatacattgaaaatccctacctgatcggaggcaggaagtttgacctacgggtatatgtgctggtgatgtcatatattcctcttcgcgcatggctgtaccgggacggttttgccaggttctcaaatacccgatttaccctcaattctatagacgatcagtatgtgcatctcaccaatgtggccgtgcagaagaccagtccagactaccaccctaagaagctccatcctaccgttggtcccctctgcatacattcccctgaaaatggatctttgtctgtgactccttggccgtgggacgcgcatatgggctgcaaatggactttacaacgtttccggcaatacctcgcttcaaagcatggaccagaagctgtcgagactttgtttagagatatcgacaacatcttcgtcaaaagtttacagtctgtccagaaagtgatcattagtgacaaacactgttttgaactctatgggtacgacattttaatcgatcaggacctcaaaccctggctgctggaggtgaacgcaagtcccagtctgaccgccagttctcaggaggactacgaactgaagacatgcctccttgaggatactctgcacgtggtggatatggaggcctccttttcgcccatcataccagctgaggtttag

SEQ ID NO: 29069 - DNA, 1320 bp, Artificial Sequence
  Description of Artificial Sequence: Synthetic coding sequence
atggtgccatctagggaagcccttctcgggcctggaactacggctatcagatgtccaaaaaagctccagaaccaaaactacaaaggccatggactttcaaagggcaaagagagggagcaaagggcaagtattcggttcaagactaccttgatgaacacactgatggacgtgctgaggcacaggccaggctgggtggaagtcaaggatgaaggtgaatgggacttctattggtgcgatgtttcttggctgagggaaaattttgatcatacttatatggacgaacatgtgaggatctcccacttccggaaccattacgagctcaccagaaaaaactatatggtgaagaaccttaaaaggttccgcaaacagcttgagcgtgaagcgggaaaactagaggctgcaaagtgcgatttcttccctaaaacgttcgagatgccctgcgaataccatctctttgtggaggagtttcgcaagaacccagggatcacctggataatgaagccagtggcacgctcacagggcaaaggaatctttttatttaggcgacttaaagacatagtggattggcggaaggacacaagatcctcagatgaccagaaggacgatatccccgttgagaactacgtcgctcagcggtatatcgagaacccttaccttattgggggaagaaagttcgatctgcgggtatatgttctagttatgtccgtcttcgctgagtgcttactgtggagcggccaccggaggcaggacgttcatctgaccaatgtggcagtccagaagacctcaccggactatcaccccaagaagggctgcaaatggactctccagagattcagacagtacctcgcatctaagcacgggccagaagctgtggaaaccttgtttcgcgatattgataacatcttcgttaagtcactgcagtccgttcagaaggttatcatatccgataaacattgctttgagctgtacggctatgatattctgatcgatcaggacctaaagccctggctgcttgaggtcaacgcaagcccgagcctaactgcgagctcacaggaggactatgaattgaagacatgtctgctggaagacacactgcatgtggttgatatggaagccagattgaccgggcgagagaagagagtgggtggatttgacctgatgtggaatgatggacccgtctcacgcgaggaaggcgctcccgacttgagtggcatggggaactttgttactaacacccacctggggtgcgtgaacgaccggaagaagcagctgaggcagctgttttgttcacttcaggtgcaaaagaaagcttcgtcctag

SEQ ID NO: 29070 - DNA, 501 bp, Artificial Sequence
  Description of Artificial Sequence: Synthetic coding sequence
atgaaggagatgcttgcaaaagatttggaagagtcacagggcggaaagtcctccgaagtcctatccgccacagagctccgcgtccagctcgcccagaaggaacaggagctggctagggcgaaggaagctctgcaggccatgaaggccgaccggaagaggctcaaaggagagaagacggatttggtctctcagatgcagcagctctatgccaccttagagtctagagaggaacagctgcgtgacttcattcgaaattacgagcagcatcgcaaggagtcagaagacgccgtgaaggcactcgccaaagagaaggatctgttagaacgggagaagtgggaactaaggcggcaggccaaagaggccaccgatcacgcaactgcactgcgaagccagcttgatcttaaggacaataggatgaaggagctggaggccgaacttgcaatggcaaaacagagtcttgctactctcaccaaagatgttcctaaacgccacagcctgtag

SEQ ID NO: 29071 - DNA, 2328 bp, Artificial Sequence
  Description of Artificial Sequence: Synthetic coding sequence
atgatggaggataacaagcagctagcactcagaatcgatggggcagtccagtcagctagtcaggaggtgacaaacctgagagcggaattgacagctactaatcgaagactggccgagctgagcgggggaggaggcccagggccaggccctggagccgcagctagtgcatctgccgctggagacagtgccgcaacaaacatggagaacccccagttgggcgctcaggtcttgttacgagaagaggtctctaggctccaggaggaggtgcacttgcttcggcagatgaaggagatgttagccaaagatctcgaagaatcgcaaggcggtaaatccagcgaagtattgtccgccacagagttacgcgtgcagctggctcagaaggagcaggaactggctagagccaaagaggcactgcaagccatgaaggccgaccggaaacgtctgaagggggagaagaccgacctggtttctcagatgcagcagctctacgcaactttagaatcaagggaggagcagcttcgcgacttcatcagaaactacgagcaacaccggaaggagtctgaggatgcagtgaaggccctggccaaagagaaagatctgctggagcgagaaaagtgggaactgcggaggcaggctaaggaggcgactgatcacgcaactgccctacggagtcagctggatcttaaggataatcgtatgaaagagttagaggccgaactcgccatggctaagcagtccctcgctacactgacaaaggacgtgccaaagcgccatagcttggccatgcctggcgaaacagtgctgaatggcaaccaggaatgggtcgtacaggcagatctgccactcacggcagccattcgccagtctcagcagactctgtatcacagtcacccacctcatcctgctgacaggcaggccgtgcgggtgagtccatgccactcccgacagccttctgtgatctctgatgcttctgccgcagaaggggaccgctcgagcactccatctgatataaacagcccaagacatagaactcattccctatgtaacggggatagccctggcccagtgcagaaaaatctgcacaacccaatcgtgcagagtttagaagacttagaggaccagaaacgcaagaaaaaaaaagaaaaaatggggtttggaagtattagtagggtcttcgctcgcggaaaacagaggaagtccctggaccccggtctgtttgacgattccgactcacagtgcagccccacacggcaatctctttctctgtcggagggcgaggagcagatggatcggctacagcaagtcgagctggtgagaaccactccgatgtcgcactggaaggctggcacggtgcaggcctggctggaggtcgtgatggcaatgccaatgtatgtaaaggcatgcaccgagaatgtcaaatctgggaaggtccttctatccttgtccgacgaagatctgcagctgggactaggtgtgtgttcatcgctacatagaaggaagctacgtctcgccattgaagactacagggacgccgaggcagggagatcactgagcaaagccgctgagctggaccatcattgggtggctaaggcgtggctgaatgacatcggactgtctcaatacagtcaggcttttcaaaatcacctcgtggacggacgtatgctgaactcactcatgaagcgcgacctagaaaaacatctaaacgtcagcaaaaagtttcatcaggtgagcatcctcttggggatagaacttctctaccaagtgaatttttcccgagaggcattacaagagagacgggcaagatgtgagacccagaacattgaccctgtggtatggaccaatcagcgggtgcttaaatgggttcgggatattgacctgaaagagtacgcagataacctgaccaattctggagtgcacggagccgtgcttgtgctggaacccacgtttaatgcagaggcaatggcaaccgcccttggaattccgagcgggaagcatattctcagacgccatctggccgaagaaatgagcgcagttttccaccctgcgaactccaccggcatacgggaggctgagcgatttggaaccccacctgggcgagcaagttctgtaacacgggctgggaaggaggaaaatagcagcgggttaaagtacaaggctggaagacttccactcgggaaaattggcaggggcttttctagtaaagatcctgactttcatgatgattacgggagtttgcagaatgaagattgcggcgatgatgatccccagtcaaggctggaacaatgcaggttagagggatataactcactcgaggttacaaatgtctag

SEQ ID NO: 29072 - DNA, 861 bp, Artificial Sequence
  Description of Artificial Sequence: Synthetic coding sequence
atgtattcactagacaggatctttgctggtttccgtacacggtctcagatgcttctggggcatatagaggagcaggataaggttctgcactgtcagttctccgacaattctgatgacgaggagagtgaaggacaagagaaaagtggcactcggtgccgctcacggtcctggatacagaagccagacagtgtgtgtagcctcgtagaacttagcgacacccaagacgaaacccagaaatccgaccttgaaaacgaagatttgaaaatcgattgtttgcaggaatcccaggaactgaatctacaaaagctgaagaattcagaacgaattctcaccgaagcaaagcagaaaatgcgggagctgacaataaacatcaagatgaaggaggatttgattaaagagttgattaagacggggaacgacgctaagtctgtgtctaaacaatactctctgaaagtgacaaagctcgagcatgacgcagaacaggccaaggtcgaattgatcgagacacagaagcagctacaagaattagagaacaaggacctctcagatgttgctatgaaagtgaagctgcagaaggaattccggaagaagatggacgctgccaaactgcgtgtccaggtcctccaaaaaaagcagcaagactcaaagaagctggcctccctctccatacagaacgagaagcgggctaacgagttggaacagtcagttgaccatatgaaataccagaagatccagctgcagcgaaaattgagagaagagaacgagaagcgcaaacagctagacgccgtcataaagcgagaccagcagaagatcaaggtcatcctttcctacatcccagccaagtacaacatgaagtgctag

SEQ ID NO: 29073 - DNA, 1662 bp, Artificial Sequence
  Description of Artificial Sequence: Synthetic coding sequence
atgaacaagaacactagcacagtagtgtcaccgagcttactcgagaaggaccctgcctttcaaatgataacgatcgctaaggagaccggactcggactcaaagttctgggcggtatcaatcggaatgagggacctttggtgtatatacaggaaatcataccaggaggggattgctacaaggacgggcgattaaaaccaggtgatcagctggtgtcagtcaacaaggagagtatgatcggagtttcttttgaggaagccaagtctattattacaggggcaaagctccgcctggagtctgcctgggagatagcattcattcgccagaagagcgataatatccagcctgaaaacctaagctgtactagcctgatcgaggccagcggggagtacggcccacaggcctctacactgtccttgttctcctcacctccagagatactgatccccaaaacctctagcacccccaagacaaacaacgatatcctgagctcctgtgagatcaagactggatataacaagacagttcagattccaatcacaagcgagaactctacagtcggtttaagtaataccgatgtggcatccgcctggaccgagaactacggcctgcaggagaaaatttccttgaaccccagcgtgcgcttcaaggctgaaaaactcgagatggcattgaactacctgggaatccaaccaactaaagaacaacaccaagcgcttcgtcaacaggtgcaagccgattccaagggtactgtctccttcggtgacttcgtacaggtggcccgtaacctgttctgcctgcagttagacgaagtgaatgtaggcgctcacgagatcagcaacatattagactcccagttgctgccatgcgactccagtgaggccgatgagatggaacggctgaagtgcgaacgggatgatgctctcaaggaggtaaacaccctaaaggagaaactgttggagtccgacaaacaacggaaacagttaacggaggagctgcagaacgttaagcaggaggctaaagctgtggtggaggaaacgagagccctgaggtcgcgaatacatctggctgaggctgcccagcgccaagcccacggcatggaaatggattacgaggaggtaatccgtctcttagaggctaagattactgaactgaaagcacagcttgccgattactccgatcagaacaaagagagtgtccaagatctgaaaaagagaatcatggtgctggattgtcagctcagaaaatccgaaatggccaggaagacattcgaagcttccaccgagaagctattgcattttgtggaggctattcaggaggtctttagcgacaactccaccccactatccaacctgagcgagcgcagggccgtgctcgctagccaaacctctctgacccctctgggaaggaacgggaggagcatacctgccacattagctctagagtcgaaggaacttgtaaaatcggtacgcgcacttctggatatggactgcctgccatatgggtgggaggaagcatacacagcagacgggatcaagtactttattaatcacgtgacccagactacatcatggattcaccccgtcatgagcgttttgaacctttcacgaagcgaggagaacgaggaagattgcagccgcgaattacccaatcagaagtcctag

SEQ ID NO: 29074 - DNA, 564 bp, Artificial Sequence
  Description of Artificial Sequence: Synthetic coding sequence
atggccgctcccggagcccttctggtcatgggagtgtccgggtctggcaagagtactgtgggggctctgctggctagcgagctcgggtggaagttttacgatgctgatgattaccatcccgaggagaatcgccgaaaaatgggtaagggcatccctctcaacgatcaggaccgcatcccatggctctgcaatttacatgacatactgttacgcgacgttgcatctggacagcgggttgtgctggcctgctctgcacttaaaaaaacataccgggacattctcacccaggggaaggacggggtagcgctcaaatgtgaggaaagtggaaaagaggccaagcaagcggagatgcagctcctggtcgtccaccttagtggtagcttcgaggttatttccggcaggctcctgaaacgtgaaggccacttcatgccccctgaactgctgcaatcccaattcgaaacactcgagcccccagccgcaccagagaattttatccagatatcagtggataaaaatgtgtcagagatcatagccactatcatggagaccttaaagatgaaatag

SEQ ID NO: 29075 - DNA, 1134 bp, Artificial Sequence
  Description of Artificial Sequence: Synthetic coding sequence
atggctaccatacccgactggaaactccagcttttggcgagacggagacaggaagaggccagtgtgagaggacgcgagaaagccgagcgcgagaggctttctcagatgccagcctggaagcgcggactgcttgagcgacgcagggcaaaactgggcctgagtcctggggaaccatccccagtgcttgggaccgtagaagctggacctcccgatcctgacgagagtgccgtgttactcgaggcgattggaccagtgcaccaaaacaggttcatccgacaagagcgacagcagcaacagcagcagcagcagagatcagaggaactcctcgccgaacgaaaaccaggaccattggaagccagagaaaggagaccatcccccggtgaaatgagagaccagagtccgaagggcagggaatcgagagaagagaggctttcccctcgcgagacccgtgagcgcaggctgggtattggtggcgctcaggagctttccctgcgacctctcgaagctagagactggaggcagtcccccggtgaagttggtgatagaagttctagacttagcgaggcatggaaatggagactgtccccaggtgaaacaccagaacggagcttgaggctggccgagtcccgggagcagtctcctaggagaaaagaagtggagagtcggctgtcacctggtgaatctgcttatcaaaaactggggctaacggaggcacacaaatggaggcctgattcaagagaatctcaggagcagtccttagtccaacttgaggctacagaatggcgactcaggtccggcgaagagcgtcaggattatagcgaggaatgtggccgaaaggaagaatggcctgtgccaggagtggcccctaaggagactgccgagctgtctgaaactttgacacgtgaagcacagggaaactcctccgctggagtggaagccgcagagcagaggccagtggaggacggagaacgcggaatgaaaccaacagagggctggaagtggacacttataatgtcgctcgcaggaaaaggaaaccagcacctggttacctgcttcccgcatcctgtgagtggcggacgcgcaaattgccccatttctacattgatccagtccccatggtgcggatggggatag

SEQ ID NO: 29076 - DNA, 2223 bp, Artificial Sequence
  Description of Artificial Sequence: Synthetic coding sequence
atggaggcagacggcgacggagaggaactggcacgtctccgctcggttttcgctgcgtgtgacgcgaatagatcagggaggttggagagagaggagtttcgcgcactatgcacggagctgcgagttcggcctgctgacgccgaagctgttttccagcgtctcgatgctgacagggatggtgccatcaccttccaggagttcgcgaggggtttccttggtagcctgcgaggaggacggaggagggactggggaccgctcgatcctgcccctgccgtgtctgaggccggtcccgagacccatgactcggaggaagatgaaggcgatgaagacgcggctgcagctctggcaacatcttgcggacctgcttcacccggtagagcgtggcaggattttcaggctcgactgggcgacgaggctaaatttatcccccgtgaggagcaggtgtcaacactgtatcaaaatataaatttagttgagccgagactgatccaaccctacgaacacgtcattaagaatttcatccgagagattcggctgcagagcacagagatggagaacttggctatagctgtgaagagggcacaggacaaggccgctatgcaactgtccgaactcgaggaagaaatggatcagagaattcaggctgctgaacataagacgcgcaaggatgagaaacgaaaagctgaggaggctctgagcgatctccggagacaatacgagactgaggtgggggatctgcaagttaccattaagaaactgcggaagttggaggaacagagtaagagggtgagtcagaaagaagatgttgcagcactgaagaaacagatctatgacctgtcgatggaaaatcaaaaggtgaagaaagacctgctggaagcccagacaaacatcgccttcctgcagtctgagctggatgcccttaaatctgactatgccgaccagtccctgaatactgagagagacttagagatcatccgcgcatataccgaagaccgcaattcgctcgaacggcaaattgagatcctgcagacggcaaatcgaaaactgcacgattctaatgacgggcttcgcagtgctttggagaattcatattctaagttcaaccgatccttgcatataaataacatcagcccaggtaatacaattagcagatcctcacctaaattcataggacactcccctcagcctctgggttatgataggtcctcacgttcaagctatgttgatgaggattgcgattccctggcactgtgcgatccacttcagagaacaaactgtgaggtggattccctgcccgaatcatgctttgactcgggactaagtacgctgcgagaccctaatgagtacgattctgaagtggagtataagcaccagagaggatttcaaaggagccacggggtacaagaaagctttggcggagacgccagcgacacagatgtgccagacatacgagatgaggagacctttggcttggaagatgttgcctctgtgctggactggaagcctcaaggctccgtgtctgaagggagtatagtgagtagttctcgcaagccaatttccgccctttcccctcagaccgaccttgtggacgacaatgcgaagagcttcagctcccagaaagcgtataagatcgtcctcgccggtgacgccgctgtgggaaagagtagcttcctgatgcggctttgcaagaacgagttccgcgaaaacatttctgcgaccctaggagtggatttccaaatgaaaactttaatcgtcgacggagagcgcactgttctccaactttgggataccgcagggcaggagaggtttagaagtatcgccaagagttactttagaaaagccgatggtgtcctgttgctttacgacgtcacatgtgagaagagctttcttaacatccgggaatgggttgacatgatcgaagacgctgcccatgagactgtgccaattatgttagtgggcaacaaagctgatattagagacacagcggcaactgagggtcagaagtgcgtgcccggtcactttggagaaaagctggcaatgacctacggagccctcttctgcgaaacatctgcaaaagatggaagcaacatcgtggaagcagtgctacacctggctagggaggtgaaaaaacgaacagacaaggatgacagcaggagcatcacaaacctcacaggcactaacagcaagaagtcgccacagatgaaaaattgctgcaatggatag

SEQ ID NO: 29077 - DNA, 4125 bp, Artificial Sequence
  Description of Artificial Sequence: Synthetic coding sequence
atggaagaaaatgaatctcagaaatgcgaaccttgtttaccttattcagccgaccgtcgtcaaatgcaggagcagggaaagggtaatctccacgtcacttctccagaggatgcagaatgccggagaacaaaagaacggctgagcaatgggaactctcgagggagtgtgtcgaaatcatccagaaatatccccaggaggcacactctgggcggacccagaagcagtaaggaaatactggggatgcagacgagcgagatggataggaagcgagaggcgttcttagagcacctcaaacagaaatacccacatcacgcctctgcgatcatgggtcaccaggagagattgcgcgatcagacccgatcccctaaattgagccattcaccgcaacctccgagcctgggagatcctgtggaacatctctcagaaacttctgccgacagtttggaagctatgtccgaaggcgacgcgccaacccccttcagtaggggctcacgaactcgggcttctttgccggttgttcgctccactaaccagacgaaagaaaggagcctcggagtgctttacctgcagtacggcgacgagacgaagcagctaaggatgcctaacgaaatcacaagtgccgacaccataagggccctgttcgtctctgcatttccacagcagctgaccatgaaaatgttggaatctccctcagtggcaatatacattaaggatgagagtagaaatgtgtactatgagctgaatgacgtgcgcaatattcaggaccggtccttactaaaggtatacaacaaagaccctgcccacgcctttaaccacaccccaaaaacaatgaacggcgacatgcgaatgcagcgggaactggtctacgcaaggggcgacgggcctggtgcccctcgaccgggaagtacagcccaccctccccacgcgattccaaattctcctcccagtacccccgtgcctcactcaatgccaccctccccgtccaggatcccttacggcggaactagatcaatggtcgtgcctggcaacgctacaattcctcgcgacaggatttccagccttcccgtgtctaggccgattagccctagcccgtctgcaatactggagcgcagggacgttaaaccagatgaagatatgtctggaaagaatatcgcgatgtacaggaatgaaggcttctacgccgacccctatctgtaccacgaaggccgaatgagcattgcatctagccatggcggtcatccacttgatgtccctgatcatatcatcgcttatcacaggaccgctatccgcagcgcttctgcttactgcaaccctagcatgcaggcagagatgcacatggaacagagtctgtatcgccagaaatccaggaagtacccagacagccacctgccaactcttggcagcaaaaccccgccagcgtcaccccatagagtgtccgacctccgcatgatagatatgcacgcccactacaatgcccatgggcctcctcacacaatgcagcccgaccgcgcttcaccctctcggcaagctttcaaaaaggagccaggcacactcgtctatattgaaaaacccagatctgctgccggactgtcctctttggtggatttgggccctcccctgatggaaaagcaggtcttcgcttatagcacagctacaatccccaaggacagggaaacgtcagagaagatgatgaagacgaccgcgaataggaatcacactgatagcgctggcacacctcacgtgagtggtggaaagatgttatccgcgctggagtccacggttcccccttcccagcccccacctgttggcacaagtgctatccatatgagcctactggaaatgaggcggagtgtggctgaattgcggctgcagttgcaacagatgcggcaattacagttgcagaatcaggagctactccgtgccatgatgaaaaaggccgagctggagatctccggaaaagtaatggagaccatgaagaggctggaagatcccgtgcagaggcagcgcgttttagtagagcaggaaagacagaagtatcttcatgaagaggagaaaatagtgaaaaaactctgtgagctggaggacttcgtggaggaccttaagaaggacagcaccgctgcttccagactggtcacactgaaggacgtagaggatggagcattcctgctacggcaagtgggagaggcggtggccaccctcaaaggcgagttcccaaccctgcagaataagatgcgggctatactgaggatagaggtcgaggcagtcaggttccttaaagaagagccgcacaaacttgacagcctcctgaaacgtgtccgctcgatgacggatgttctaactatgctaaggcgacatgtgaccgacggcctgctgaaaggcaccgatgctgcacaagccgctcagtacatggccatggaaaaggcaacagcagccgaagttttgaaatcacaagaagaggcggcacacacttctggacaaccgttccacagcaccggagctcctggggacgcaaagagcgaagtcgtccccttgtctgggatgatggtgagacatgcccagagcagtcccgtcgtcattcagccgtcacagcattctgtggccctccttaatccagcgcaaaacctgccacacgtggcgagttcacctgccgtccctcaagaggcaacctctaccttacaaatgtcacaggctccacaatcgccgcagattcccatgaacgggagtgccatgcagtcgttgttcatcgaagagattcatagtgtgtctgcaaagaatagagccgtcagtatagaaaaagccgaaaagaagtgggaggagaagagacagaacctcgaccattacaacggaaaggagttcgaaaagctccttgaagaagcccaggcaaatatcatgaagtctatccccaatttagagatgccccctgccaccggacctctgcctagaggtgatgctcctgtggacaaagttgaacttagtgacagtcctaactcagaacaagatctggagaagctgggtggtaagtcgccacctccaccccctccaccgcctcgcaggagctacctccccggatccggcctgactactaccagatctggtgacgtggtgtacaccggaaggaaggagaatatcaccgccaaggcctcctcagaagacgctgggcctagtcctcaaacacgagcaaccaagtaccctgctgaagaacctgcatccgcttggacaccctccccacctcctgtgactacttccagctctaaggatgaggaagaggaggaggaggaaggagacaagataatggccgagttacaggcatttcagaaatgctccttcatggacgttaattcaaactcccatgcggagccttcgcgagccgattcccacgttaaagacactcgcagcggagctacagttccaccgaaagagaagaaaaatctggaatttttccacgaggacgtcaggaaatccgacgtggaatacgagaatgggcctcagatggagttccagaagggttcatcaggcgctccacagacctctcgcatgccagtgcccatgtccgcaaagaataggccgggaaccctcgataagccaggaaaacagtcaaaattgcaagacccccgtcagtatcgccaggcaaacggctcggctaagaagtcgggcggtgacttcaagccaacatctccaagccttcccgcaagtaagataccagcgctttctcctagcagcggtaagagctcttccttgcctagctctagcggggacagctctaacctgcctaatcccccagctacaaaacctagtatcgcctctaaccctctgtcacctcagaccggtccccctgctcattccgcttccctgatcccgtcagtaagcaacggctcactcaagtttcagtcactgacgcacaccggaaagggtcatcacttgtccttctcgccacagtctcagaacggtagggcaccccctccattgtctttcagctcttcacctccttcacctgctagttcagttagtcttaaccagggggctaagggtactcgcacaatccacactcccagtctcactagttacaaggcacagaatggcagcagcagtaaggccactccttcaaccgccaaagaaacctcctag

SEQ ID NO: 29078 - DNA, 5831 bp, Artificial Sequence
  Description of Artificial Sequence: Synthetic coding sequence
atggaggaaaacgagtcacaaaagtgtgagccatgtctcccctactccgcagaccgcaggcagatgcaggagcagggaaaagggaacttacacgtcacgagccccgaggatgcggagtgtcgccgtaccaaggagcgattgtcgaacggcaattcacgaggctctgtgagcaagtccagtcggaacattccgaggcggcatacccttggcggtcccaggagttccaaagagattcttggcatgcagacttcagagatggatcggaagagggaggctttcctcgaacatctaaaacagaagtaccctcatcatgcgtctgctataatgggccatcaggagcgcctgagagaccagactaggtctcctaaactgtctcactcgccgcagccaccctccctgggcgatcccgtggagcatctatcggaaaccagcgctgactctttagaggcgatgtcagaaggcgatgctcctacaccctttagccggggaagtagaacccgggcttccctgccagtggtgcggtcaacaaatcagacgaaagaacggtctttgggtgtattgtatttgcagtatggagacgaaacaaagcagcttcgaatgcccaacgaaattacatctgccgacaccattagagccctgtttgtgtccgcctttccccagcagttgacaatgaaaatgctggagagccccagcgttgctatttatatcaaagatgagagtcgcaatgtctactacgaattaaacgacgtgaggaacattcaagatcggtcactgcttaaggtgtataacaaagaccccgcacatgcctttaaccacactcccaagacgatgaacggggacatgcggatgcagcgtgaacttgtgtacgcccgaggtgacggacccggtgccccaaggcctggttcgaccgcgcacccaccacacgcaatccctaattccccgccatccacacccgtgccacactccatgccacctagtcccagtcgcattccttatggtggaacccgcagcatggtggttccgggaaacgctacaatccctcgagatcgcatctcatctctacctgtaagcagaccaattagtccgagtccgagcgccatcctcgagcggagggacgtgaagccagacgaagatatgagcggcaagaatattgccatgtatagaaatgaagggttctatgccgatccttacctttatcacgaagggagaatgtcgatcgcctcctcccatggcggacatcctctggacgtccccgatcacattatcgcttatcataggacggccattaggtccgcctcggcatattgcaatccatctatgcaggctgagatgcatatggaacagtccctctacagacaaaaatcccgcaagtatccagattcccacctgcccactctgggatcaaagactccgcctgccagcccccaccgagtctctgacttaagaatgatagacatgcatgctcattacaacgcacatggcccaccgcataccatgcaacctgatagagcatcgcccagccgacaagcatttaagaaagaaccaggtacccttgtctatattgagaagccacgctccgcagcaggactgtccagtctcgtggatctcggtcctcctttgatggagaaacaggtgtttgcatactcaacggcaaccatccccaaagatcgcgaaaccagagagagaatgcaggccatggagaaacagattgcttctctgactgggcttgtccagagtgccctatttaagggccctatcacaagctactcaaaagatgcctctagtgaaaaaatgatgaagaccacagccaatcggaaccacacagatagcgccggaacaccccacgtttctggaggcaagatgctgtcagccctggagtctacagtccctccatcccagccacccccagtgggaacttcagcaatccatatgtcccttctcgagatgcgacgatctgtagctgagctgcgcctgcagttgcagcagatgcgccagctgcagttgcagaatcaggaacttctgagagctatgatgaagaaggcagaattagagatttcagggaaagttatggagaccatgaaacgccttgaggacccagtacaacgacagagagtgcttgtggagcaggaacgacagaagtatttgcacgaagaagagaagatagtgaagaaactctgtgagctagaggattttgttgaggatcttaaaaaggactcaactgcagcatcacgactcgttacattgaaagatgtagaagacggggctttcctgctgaggcaggttggcgaagccgtggctacgctcaaaggagagtttccaactctccagaataagatgcgggctatcttacgcatagaggtcgaagctgttcgcttcttaaaagaagaaccacataagctcgattccctactgaagcgtgtccgcagcatgaccgatgtgctcactatgttaaggagacatgtgactgatggtttactgaagggaaccgacgccgctcaggcagcccagtacatggctatggagaaagccacagcagcagaagttctgaagagccaggaggaggcagcacacacctctggccagccgtttcactccaccggagcgcctggcgatgcaaaatcagaggtagtgcctctttccgggatgatggtgagacatgctcagagcagcccggtggtaatacagccttcccagcactccgtagccctgcttaaccctgctcaaaatctcccacatgtcgcttcatcccccgctgttccacaggaggctacttcgacgctccagatgagtcaagcgcctcaaagccctcagatccccatgaacggctccgctatgcagtccctctttattgaggaaatccattcagtttccgcaaagaaccgagccgtctctatcgaaaaagccgagaaaaaatgggaagagaagagacagaacctggaccattacaatgggaaggaattcgagaaactgctggaagaggctcaggccaacattatgaagtcaattcccaacctggagatgccccctgcgaccggccctttgcctcgaggtgacgcaccagttgataaggtagagctgtctgaggattcccccaattctgagcaagacctagaaaagctgggcggaaaaagtccaccaccacctccacctccaccacggagatcctatctgcccggttcgggacttactaccacgcgctctggtgacgtggtgtacacaggcagaaaagagaatattaccgccaaagctagcagtgaggatgcgggaccgagccctcaaacacgagctacaaagtaccctgccgaggaacctgcctctgcctggactccttcacctcccccagtgactacatctagcagcaaggatgaagaggaggaagaagaagagggtgacaaaattatggccgagctccaggcctttcagaagtgttcttttatggacgtgaacagtaattcccatgctgagccttcacgtgctgatagccacgtgaaagatacacgctcaggggcaactgtgccaccgaaagagaagaaaaacttagagttttttcatgaagacgtgcgcaagagcgacgtggagtatgagaatggtccgcagatggaattccaaaaggtcacgacaggcgctgtccgtcctagtgatccgcctaagtgggaaagaggtatggagaattcaatttcagacgcctcccgcactagcgagtataagaccgaaataatcatgaaggaaaatagcatcagtaatatgtctctgttaagggactccagaaattactcacaggaaaccgtacccaaggcaagctttggattctcgggcattagccctctcgaggacgagattaataagggttcaaaaatctccggactacagtatagtatacccgatacagaaaaccagaccctcaattatggcaaaaccaaagagatggaaaaacagaatacagataaatgtcacgttagtagccatacacgcctcaccgaatcttcagtgcatgacttcaagacggaggaccaggaagtcattactacggattttggtcaagtggtcctcaggcctaaggaggcccgtcacgcgaatgtgaatcctaacgaagacggagagagctcaagctccagccccacagaagagaatgccgcaaccgataatatcgcctttatgatcaccgagacaactgtgcaggtcttatcctctggagaggtgcatgacatcgtttcccagaagggcgaggacattcagactgtgaatattgatgctcgaaaagagatgactcccaggcaagagggaaccgataacgaagaccctgtcgtgtgtctagataagaaaccggtgatcattatattcgacgagccgatggatattcgcagcgcatacaagagactgtctactatttttgaggagtgcgacgaggaactcgagcgcatgatgatggaggaaaagatcgaagaggaggaagaagaggaaaatggggacagtgtggttcagaacaacaacacatctcagatgtctcacaaaaaagtcgctcccggtaatttaaggaccggccagcaggttgagactaagagccagccacactccctggcgaccgaaaccagaaatcctggtgggcaggagatgaatcggacggagctgaataaattctcccatgttgattctccaaactcagagtgcaagggggaggacgctaccgacgatcaatttgaatcaccaaagaaaaagtttaagttcaagttccctaagaaacaactcgccgcattgacccaggccatacgcacagggaccaaaacagggaagaagaccctccaggtcgtagtctacgaagaagaggaagaggacggaacattaaagcagcacaaggaagcaaagagatttgagatcgcacgttcccagcccgaggacacccccgaaaacaccgtgcggaggcaggaacaaccttccatcgaatctactagtcctatctctaggacagatgagattaggaaaaatacctatcgcactctggatagcctggaacaaacgatcaaacagttggagaataccatctccgagatgagtcctaaggcgctagtggatacaagctgctcatcaaacagagattctgtggcttcatcttcccacattgcccaagaggccagtcctaggccattgcttgtgccggatgagggccctacggctctggaacctccaacttctatccccagcgccagccgcaagggctcctcaggcgctccacagacatcccgaatgcccgtccccatgagtgcgaagaaccggccaggtaccctcgacaagcctggtaagcaatcaaaactgcaggacccacggcagtacaggcaagccaatggctcggcgaaaaagagcgggggagacttcaagcccacctccccctccttgccagctagcaagatcccagccctgagcccaagctctggaaagtcctctagtcttcctagtagctccggcgatagtagcaacttgccaaatcccccagcaaccaagccgagtattgcttccaatcctctcagcccccagaccggaccacctgctcacagtgcctcccttatacctagcgtcagtaatggctcgctgaaatttcaaagcctcacgcatactggtaaaggccatcaccttagtttctctcctcagtcccagaatggacgcgcacctccaccactgtctttcagttcaagcccaccctcccccgctagcagcgtatcactcaaccagggggctaaggggactaggacgatccatactcctagcctgactagctacaaagctcagaacgggagctcttccaaagctaccccttccactgctaaggaaacatccta

SEQ ID NO: 29079 - DNA, 3795 bp, Artificial Sequence
  Description of Artificial Sequence: Synthetic coding sequence
atgcagacgtcagagatggacaggaagcgcgaggcattcctggagcatctgaagcagaagtacccgcaccatgcatctgccattatgggccatcaggagcggctccgcgaccagacccggtctcccaagctgagtcacagtcctcagcccccaagtcttggtgaccctgtagagcacctgagcgagactagcgccgattctttggaggccatgagtgaaggcgacgctcctaccccattttctaggggtagtagaacccgggcttccctgccagttgttaggagtactaatcagacgaaagaacggtcactgggagtcctataccttcagtacggtgacgagactaaacaactcaggatgcctaacgagatcaccagtgccgatacaatccgtgcacttttcgtgtcagctttcccccagcagctcaccatgaagatgctggagagccctagcgttgcaatatacatcaaggacgagtccaggaacgtgtattatgaattaaacgatgtgcggaatattcaggacagaagtcttctgaaggtgtataataaggatccagcccatgcattcaatcatacccccaagacaatgaatggagacatgagaatgcaacgggaactggtttatgctcggggtgatgggccaggggcaccacgccctggctctactgctcacccacctcacgcgatacccaacagtccaccatccacacccgtcccccattctatgccgccttcaccctcacgaatcccatacgggggaacaaggtcaatggtggtgcccggaaacgcaactataccgagagaccgcatttccagcttgccagtcagcagacccatatcgccatccccatccgctattctggaaaggcgtgacgttaagccagatgaagatatgtcagggaagaacattgcaatgtatcggaatgaaggtttttacgccgatccctacttgtaccacgaaggtcgcatgtccattgccagttctcacggtggacacccgctggacgtgccagaccacattattgcctaccaccggactgccatccgttcagcctcagcctactgtaaccccagcatgcaggccgaaatgcatatggaacaaagcctctaccggcagaaaagtagaaaataccccgacagtcatcttccaactctggggtcaaagactccaccagcttctccacacagagtttctgacctgcgcatgatagacatgcacgcccactacaatgcacatggtccaccacatacaatgcagccagatcgggcttctcctagtagacaggcatttaagaaggagcccggtaccctggtgtacatagagaagccaaggtcagctgctggcttgagcagccttgtggatctgggaccaccactaatggaaaagcaagtcttcgcatactcaacggccaccataccgaaggatcgggagacccgggaaaggatgcaggctatggagaaacagatagcgtcgctcacgggactggtccagtcagctctctttaaagggccaatcacatcatatagtaaggacgcatcttctgaaaaaatgatgaagaccaccgctaatcgaaaccacaccgattccgccggaacgccgcatgtgtctggaggtaagatgttgagcgccctggagagtaccgttccaccttcacagccacctcccgtgggtacatccgccattcatatgagcctattggagatgaggcggtcagttgctgaactacgtttacagcttcagcagatgagacagttgcagctgcagaaccaggagctgctgagagcaatgatgaagaaggcagagttagaaatcagtggcaaggtaatggagactatgaagcggctcgaggaccccgtgcagcgccagcgggtgctggtggagcaggagcggcagaagtaccttcatgaagaagagaaaattgttaagaaactctgcgaactagaggactttgtcgaggacctgaagaaggatagtacagcggcaagtagactcgtgaccctgaaggacgttgaggatggagccttcctcctccggcaggtaggagaggccgtggcgacactgaaaggggaatttcctaccctgcagaacaagatgcgcgcaattctgcggattgaagtagaggctgtgagattcctaaaggaggagccacataaacttgacagccttctgaagagagttcgaagcatgaccgatgtcctcactatgttgcgcagacacgttaccgacggcctgctgaaaggaaccgacgccgctcaggctgcccagtacatggcgatggaaaaagccacagccgctgaagtgctgaagtctcaggaggaagcagcacacaccagcggtcaaccttttcattctaccggtgcccctggggacgcaaaaagtgaagtggtccccttgagtgggatgatggttcggcacgctcaatcaagcccagtggtcattcaacctagccagcatagtgtggctttgttgaaccctgctcagaatcttccccacgtggcctctagccctgccgtacctcaagaggccacttcaacgctgcaaatgtcccaggcgccacaatcaccccaaattccgatgaacgggagcgcaatgcaatccctgttcatcgaggaaattcacagtgtctcagccaaaaatcgagctgtgtccatcgaaaaggccgaaaagaagtgggaggaaaaacggcagaatctggatcactacaacgggaaggaatttgagaagttgttggaggaggcccaggctaacataatgaagtctataccaaacttagagatgccacccgctaccggtccactacccagaggcgatgcacctgtggacaaggtggaacttagcgaggacagccccaactctgaacaggatctggaaaaactgggcggaaagagcccacccccaccgccacctccacctagaagatcttatctcccaggctcaggactgactaccacccgtagtggtgatgtggtgtacacgggcagaaaggagaatattactgcgaaggccagctctgaggacgctggcccatcgccccagacccgtgccacaaagtatcccgcagaggagcctgccagtgcctggaccccgtccccacccccagtgacaacaagcagctctaaggatgaggaggaagaagaggaagagggggacaagatcatggccgagttgcagggcagcagcggcgcaccacagaccagtcgtatgcctgttccaatgtccgctaagaatcggcctgggaccctggataaacccggaaagcagtccaagcttcaggaccccaggcagtataggcaagccaacgggagcgccaagaaatcagggggagactttaaaccaaccagcccaagcctgccagcctcaaagattcccgctctatcaccatcatccggcaagtcctcttccctcccatcaagctcaggagattcttcgaacttgccaaacccgcctgccacaaaacctagtatcgcgtcaaatccgcttagtccccagaccggtcctccagctcattcagctagcctaatcccctctgtcagcaacggcagcctgaagtttcagtcactgactcacactggaaaggggcatcatctttctttcagtccgcagagccaaaacggtcgggctccccctcccctgtcctttagctcttcaccgcctagtcctgccagcagtgtgagtttgaaccagggggctaagggcactaggacgatccacactccgtccctgacaagctacaaagcccagaatggtagctcttcgaaggcgacccctagtacagctaaggagaccagctag

SEQ ID NO: 29080 - DNA, 531 bp, Artificial Sequence
  Description of Artificial Sequence: Synthetic coding sequence
atgggctgttgcgggtgtagcgggggatgcggctccggttgcggcggatgcggtagcggctctggcggatgcggttctggctgcgggggttgcgggagctcctgctgtgtgccaatatgttgctgcaagcctgtatgttgttgcgtccccgcatgttcctgctcctcgtgtggatcatgcggaggctcaaaggggggttgcggctcttgcgggtcttcaaaagggggatgcggttcatgcggatgctcacaaagtaactgttgcaagccatgctgctccagcagcggttgcggtagcttttgctgtcagagctcttgctcaaagccttgctgttgtcagtccagctgctgccaaagctcctgctgtaagccctgctgctgccagtcttcctgctgccagagctcctgcttcaagccatgctgctgccagtcaagctgctgtgtgcctgtgtgttgccaaagctcttgctgcaaaccatgttgtagtcaatcatcctgttgcgtgcctatttgttgccaatacaagatttag

SEQ ID NO: 29081 - DNA, 513 bp, Artificial Sequence
  Description of Artificial Sequence: Synthetic coding sequence
atgggatgctgcggttgctctggcggatgcgggagtggttgcggaggatgcgggagcggctgtggcggatgtgggtccggatgcggcggttatggatctggctgtgggggttgcgggtccagctgttgtgttccggtttgttgctgcaagccagtgtgttgctgcgtgccagcctgttcttgtagctcttgcgggagctgcggcggaagtaaaggcgactgtggctgtggatcttgtggaggcagtaaggggggatgtggctcatgcggatgtagtcagtgtaactgttgcaagccatgttgctgtagttccggatgcggctcctgttgccagagcagttgttgtaacccttgctgttgccagtctagctgctgcgtgccggtgtgctgtcaatccagttgctgcaagccctgctgttgccagtcttcttgttgcgtgccgagttcctgctgtcggagctgctgtagcaaaagtagttgttgcgtccctatatgttgccagtataaaatctag

SEQ ID NO: 29082 - DNA, 2169 bp, Artificial Sequence
  Description of Artificial Sequence: Synthetic coding sequence
atgatcgattctgttaagctgcggagggactccgccgctgattttttctcacactatgaatacttgtgcgcattgcagaattccgtgccgcttcccgcagtcagggcatgtctccgagaaggcgtcctcgacttcaacgccgatcgcctcaggggcgtcgattgggcacccctcctgagtactcttaagatcaataaggacctaccactggttagtatcaaatcttttttccagccctggctgggcgacaccggcagcgatatgaacaagttctgcaggtccagagtgcccgctatcagatataaggatgtcactttccagttgtgcaaggccctgaagggatgtttatccattagcagcgtcctgaaaaatctggaactgaacgggctcattctaagagagagagatctcaccatcttggcgaagggactaaataaatccgccagcctcgttcatctgtccctggcgaactgtcccataggggacggaggactcgaaatcatttgtcagggcattaaaagcagtatcacattgaagacagtgaacttcacaggttgtaatctgacatggcagggtgcagaccatatggctaagatcttgaagtatcaaacgatgcggaggcatgaagagacctgggcggagtcacttagataccgcaggccagatcttgattgtatggccggtttgagaaggatcaccttaaattgtaatactctgatcggagatttgggggcatgcgcattcgcagacagcctgtccgaagatctttggctgcgggcattggatttgcagcagtgtgggctcacaaatgagggagcaaaggcgctcctggaggccctcgagacaaatacaacgcttgtcgtgttggacattcggaagaacccgctaattgatcactctatgatgaaagcagtcatcaaaaaagtgctgcagaatgggcgatccgcaaagtccgagtatcaatggattaccagtccgagcgtgaaagagccctcgaagactgcaaagcaaaagcgcagaaccattatcctcggaagtgggcataaaggaaaggccactatcaggatcgtcggtctggccacaaaaaagcccgtgtcctccggccgtaagcactctctcgggaaggagtactacgccccagcccctctgccgcctggggtatcaggatttctcccatggaggaccgctgaacgggctaagagacaccggggatttccactcataaaaacacgcgatatttgtaatcagctacagcagcctgggtttcccgtgaccgtgaccgtggaatcaccaagttcaagcgaggtcgaggaagtggacgattcctcagagagcgtacacgaagttcccgaaaagacaagcatcgaacaggaagccttacaggaaaaactggaagaatgtctgaagcagcttaaagaagagcgggtgatcaggctgaaggtggataagagagtatccgagctcgaacacgagaatgctcagttacggaatattaacttcagcctgtccgaagcactccatgcgcagagccttactaacatgattctcgatgacgagggcgtgttgggaagcatcgagaattcatttcagaagttccacgctttccttgacctgttgaaggacgcagggctggggcaactggccacgatggcgggaattgaccaaagcgacttccaactcctagggcatccccaaatgacctcaacagttagtaacccgcctaaagaggaaaaaaaggctctcgaggacgagaagccagagcccaagcagaatgccctagggcagatgcaaaatatccaggtgagtatatgtatgcagtccgcttataacgagggtactctgatgaaattccagaagatcacgggagatgctcgcatcccactgccactcgactcattcccagtccctgtgtctactcccgagggattaggcacctcaagtaacaatctgggcgttccagccaccgagcagaggcaagaatcttttgaagggttcattgcacggatgtgcagcccctctccggacgctacaagcggcactggcagccaaaggaaagaagaagagctctcacgcaatagccgtagttctagcgaaaagaagaccaaaactggcgagtacactaagaaacacagcgataagcagcacccgggaaaggatctccactcctag

SEQ ID NO: 29083 - DNA, 1122 bp, Artificial Sequence
  Description of Artificial Sequence: Synthetic coding sequence
atggcattgaatgtcgctccagtgcgcgacacgaaatggctcacactcgaggtatgtaggcagttccaacgcggtacctgttctcgttccgacgaggagtgcaagtttgcacaccctccgaaatcgtgccaggtagagaatggcagagtgatagcatgcttcgactctctcaagggcagatgtagtcgcgaaaactgtaagtacctgcatccaccaacacaccttaaaactcagttggagatcaatgggagaaataatttaattcagcaaaagaccgctgccgcaatgctggcacagcaaatgcagtttatgttcccaggcacaccccttcaccctgtccctacttttcccgttgggcctgccattggcaccaatacagccatcagttttgccccatatctggctccagtgacgccaggtgtgggcctagttccaacagagatcctgcctactaccccagtgattgtgccaggttctcccccagtgaccgtgcctggttcgaccgcaactcagaagctgcttcggaccgataaactcgaagtgtgcagggagttccagaggggcaactgcgcccgaggggagaccgattgtcgattcgctcatccagcggatagcaccatgatcgatactagtgacaataccgtgaccgtctgcatggactatatcaagggaaggtgcatgagggaaaaatgtaaatactttcatcccccagcccatcttcaggctaagatcaaagcggctcaacaccaggctaatcaggcagcagtggccgctcaggctgcggcagctgcagcaactgtgatggctttcccaccaggggctcttcatcccttgcctaaaaggcaggctcttgaaaagtctaatggtactagcgcggttttcaatccctcggttctgcattaccagcaggccctgacttccgctcagctgcaacagcatgccgctttcatccctactggctcagtgctatgtatgacgccagctacttccatcgacaattcggagatcatcagccgtaatggcatggagtgccaggagagcgcacttagaattaccaagcactgttactgcacctattaccccgtgagcagctccatagagctccctcagactgcctgttag

SEQ ID NO: 29084 - DNA, 321 bp, Artificial Sequence
  Description of Artificial Sequence: Synthetic coding sequence
atgacacaatccaccgcaaaagctatgaagagacccctcgaagctactgtggacctcgcctttccccctggggctctccaccctctgcctaaacgccaggctcttgagaaatccaacggaacttcagccgttttcaatccttcggtgctccattatcagcaggcacttacctcagcgcagctccagcagcacgctgcctttatccctaccgtaccgatgatgcattctgccacaagcgccaccgtgagcgcagccacaacacctgcgacctccgtcccctttgccgctaccgcaacggcgaatcagctggtctactcttag

SEQ ID NO: 29085 - DNA, 915 bp, Artificial Sequence
  Description of Artificial Sequence: Synthetic coding sequence
atggccaagatcgagaaaaatgctcccacaatggagaagaaaccagaactgtttaatataatggaggtagacggcgtccctactctgatcctgtctaaggaatggtgggagaaggtgtgtaacttccaggcgaaaccggacgacctgattcttgcaacttacccgaagagcggaactacttggatgcacgagatcctcgatatgattttgaatgatggagacgtggagaagtgcaaaagggctcaaacacttgatcgacacgcttttttggagctcaagttccctcataaagagaagcctgatctggagtttgtgctggagatgagcagcccacagctgattaaaacccaccttcctagtcatttgatcccgccaagtatctggaaggagaattgtaaaatcgtatacgtcgcccgaaaccccaaggattgcctggttagttactatcactttcaccgaatggcgagcttcatgccagatcctcagaatctggaagagttctacgaaaagttcatgtccggaaaagtggtggggggtagctggttcgaccatgtgaagggttggtgggccgctaaggacatgcaccgtatcctctaccttttttacgaagacatcaaaaaaaacccgaagcacgagatccacaaggtccttgagtttctggaaaagacctggtcaggcgacgtcatcaataagattgtgcatcacacatctttcgacgtgatgaaggataacccgatggccaaccatactgcggtgcccgctcacattttcaatcacagcatctccaagtttatgcgaaagggaatgcccggagattggaagaaccactttaccgtggccctgaatgaaaattttgataaacattatgagaagaaaatggcaggttctacactgaacttctgcttggaaatatag

SEQ ID NO: 29086 - DNA, 1188 bp, Artificial Sequence
  Description of Artificial Sequence: Synthetic coding sequence
atggcctccgcggctagcgttacgagcctggccgacgaggtcaattgcccaatctgccaggggaccttacgggagccagttacaatagactgcgggcacaatttttgccgcgcatgtcttaccaggtactgcgagattcccggaccagacctggaggagtctcctacctgccccttgtgtaaggaaccattccgacccggttccttcaggccgaactggcagctggccaatgtggtggagaacatcgaacgactgcagttggtctccactctcggtctgggcgaagaggatgtgtgtcaagagcatggggaaaaaatatacttcttttgcgaggatgatgagatgcaactttgtgtagtgtgccgggaggccggagaacacgccactcacaccatgagattcctagaagacgctgccgctccataccgggagcaaatccacaaatgtctgaagtgtttgagaaaggaacgtgaagagatacaggaaattcagtcaagggagaacaaaagaatgcaagtgctgctgacgcaggtctccactaagagacagcaggtgatctccgaattcgcgcatcttcgcaagttccttgaggaacagcagagtatcctgctcgctcagctggagagtcaggacggagatattttgagacaacgtgatgagttcgacctccttgttgctggcgagatctgtcggttctctgctcttatagaggagctggaagaaaagaatgaaagaccggcacgggaactgctaaccgacattagatccacattaataaggtgcgaaacccgcaagtgcaggaagccggtggccgtgtcaccggagctgggtcagagaattagagactttccacagcaggctctcccattacagcgggagatgaagatgtttctagaaaaactgtgttttgagcttgattacgaaccagctcacatcagtctggatccacagaccagccaccccaaactgttgctgagtgaggatcatcagagagctcagttttcttataaatggcagaacagccccgacaatccccagaggtttgaccgggctacctgcgtcctggcgcacacagggataaccggtggaagacacacatgggtgtggatggctagggtgcccggagacagcggctgctgccagttctgtagcccccctagcgtgctcggaacggaggtagcggcttag

SEQ ID NO: 29087 - DNA, 1446 bp, Artificial Sequence
  Description of Artificial Sequence: Synthetic coding sequence
atggcctcagccgcttctgttacctcattggccgatgaggtaaactgccccatctgtcagggcacattgcgcgagccggtgactatagattgtggtcataacttttgccgggcatgtcttacaaggtactgcgagattcccggaccagatttggaagagtctcctacctgtcccctctgtaaggagccatttaggccaggatcttttcggcctaactggcagctggccaatgtggttgaaaatattgagaggttgcagttagtgtctactctcggcctaggtgaagaagatgtgtgtcaggagcacggagagaaaatctattttttctgtgaagacgacgaaatgcagctctgtgttgtgtgcagagaagcgggagaacatgctacccatacaatgcggttcctggaagatgccgcagctccatatagagaacaaatccacaagtgtttgaagtgcctccgtaaggaaagagaagagatccaagagattcagagccgggaaaacaagaggatgcaagtgctgctgacccaggtgagcacaaaaagacagcaggtcatcagcgagttcgcacacttaaggaagttcctagaagaacagcagtcaatcctgctcgctcagctggagagccaagatggcgacatcctcagacaacgcgatgaattcgacctgttagtcgctggagaaatctgcagattcagtgctctcatcgaagagctcgaagagaaaaatgagagaccagctcgcgaactgctcaccgacatacggtccactctaatcaggtgtgagaccaggaaatgtcgcaaaccagtggcggtgtcccccgagcttgggcagaggatccgtgattttcctcagcaagccctgcctctacaaagggaaatgaagatgttcttggagaaccttcccaaccatctcgttattcccactgcccatatctcactcgacccccaaacaagccaccctaagttactgctgtccgaggatcaccagagggcccagttttcatataagtggcagaacagtcctgataatccacagcgttttgatcgagcgacctgtgtgctggcccacactgggatcacagggggaaggcatacttgggtagtctcgattgatctcgcgcacggcggaagttgtacagtcggggttgtgtcggaagacgttcaacgtaagggtgagttacgtctcagacccgaggaaggcgtttgggctgtgcgtcttgcctgggggtttgtttcagctttaggctcctttcccactcgcctgaccctaaaggagcaaccacgtcaggttcgggtgtccctggactacgaagtcgggtgggtcacctttacgaatgcagtcactcgcgagcccatctacactttcactgcctcctttactcgtaaggtgatccccttttttggtctttggggaaggggttcatccttcagcttgtcgtcctag

SEQ ID NO: 29088 - DNA, 2604 bp, Artificial Sequence
  Description of Artificial Sequence: Synthetic coding sequence
atgcaggccgaagccgcagactggttctcatctatgcctttccagaaacatgtgtactacccgctcgcaagcggaccagaaggccctgacgtggctgttgcagctgccgctgccggagcagcttcaatggcttgcgcacccccaagtgccgcatccggaccactgcctttttttcagttccggcctcggttggagagcgtcgattggcgcaggctgtctgctatagacgtcgataaggtcgctggggcagtagatgtccttactcttcaggagaacattatgaatatcacgttttgtaaactggaagacgagaagtgcccacattgccagagcggcgtcgaccccgtgctgctcaagctgatccgtcttgcacaatttacaatcgaatatcttctgcatagccaggagttcctgacaagtcagttgcacacactggaggaacggctgagactgagccattgtgatggcgaacagtccaagaaactgctcaccaagcaggccggtgaaattaagaccctgaaagaagaatgtaaaaggagaaaaaaaatgatcagcacccagcagctaatgattgaagctaaggcaaattattaccagtgccatttctgtgacaaagcttttatgaaccaggcatttcttcagtcacatatccagcgcaggcataccgaggaaaactcccatttcgagtaccaaaaaaacgcccaaatcgaaaaattgagatcagaaatcgtcgtattgaaggaagaactgcagctgacccgttctgagctggaagcggctcaccacgcctctgcagtacgattttcaaaagaatatgaaatgcagaagaccaaagaggaagacttcctcaaactattcgaccgctggaaggaggaggaaaaggagaaacttgttgatgagatggagaaggtaaaagagatgttcatgaaggagttcaaagagctgactagcaagaacagcgctcttgaatatcaactcagtgagattcagaaatcaaatatgcagatcaaaagtaatattggcacacttaaagatgctcacgagttcaaagaggatagaagtccatatccacaagattttcacaatgtcatgcagctgctggacagccaagagtccaagtggaccgctagagtccaggctatccatcaagaacataagaaggaaaagggtcggcttctcagtcatatagagaagcttcggacatcaatgattgacgacctgaatgcctcaaatgtcttttacaagaagcgcatagaggaactaggacagcgcttgcaagagcagaatgagctgataatcactcagaggcagcaaataaaagactttacctgtaatccattaaacagcatcagcgagcccaaggggaatccactcgcctggcaggccttcgaatcgcagcccgcagcgcctgcagtgcctatgaatgccccagctctccacactttggaaacaaagagttccctccctatggttcacgaacaggcgttctcttctcatattctggaaccgattgaggagcttagcgaggaggagaaagggagggagaatgagcaaaagctgaataacaataagatgcatctgcgaaaggcactcaagagcaattcatctctaacaaaagggctgcggaccatggtggagcaaaatctgatggaaaaacttgagacccttggtattaacgctgacatccgtggaatcagcagcgatcaacttcacagagtgctaaagtcagtggagtctgaacgtcacaagcaggaacgggaaatcccaaactttcaccaaattcgggagtttctggaacatcaggtatcatgcaaaatagaggaaaaagcactcttgtcctctgatcaatgctctgtgagccaaatggacacactgagcaccggagaggtccctaaaatgattcagctaccctctaagaaccgtcaactcatcaggcaaaaggctgtctctaccgaccgtacctctgtccccaagattaaaaagaacgtgatggaagatccgtttccgaggaaaagtagtactatcaccactccccctttctcatccgaggaagagcaggaggacgacgatctaatccgcgcatatgcctcacctggccctcttcctgtcccaccaccacaaaataaaggcagcttcgggaaaaacactgtcaagtccgatgcagacggtaccgaggggtctgagatcgaggacacagatgactctcccaagcccgcaggcgtggccgtcaagacaccaaccgagaaggtcgaaaagatgttcccacatcggaagaatgtgaataagccagtcggcggtaccaatgtgcccgagatgtttatcaagaaagaggaacttcaagaattgaaatgcgccgacgtagaggacgaagactgggatatttcaagcctggaggaggagatctctctcggtaaaaagtccggtaaagaacagaaagagccaccccctgctaaaaatgagccccatttcgctcatgtccttaatgcatggggagcgttcaatccgaagggaccaaagggggaaggactccaggagaacgagagcagcacccttaagagttcactcgtgacggtgactgactggtctgatacgtccgacgtgtag

SEQ ID NO: 29089 - DNA, 279 bp, Artificial Sequence
  Description of Artificial Sequence: Synthetic coding sequence
atggcaacccccccaaaacgcagagcagtcgaggccactggagagaaagtgcttcgttacgagacttttatctctgatgtgcttcagcgggatttgagaaaggtcctcgaccatagggacaaggtgtacgagcagcttgctaagtatctccagctgcggaacgtcatcgagcggctgcaagttaaaacaatggggctcgggaccatcttcctagtgtgcgtgggcaaagggggaaaatgggaggaacgattgcagactcaaccatgtcacctgacatag

SEQ ID NO: 29090 - DNA, 2532 bp, Artificial Sequence
  Description of Artificial Sequence: Synthetic coding sequence
atggcggtggaggattctactctgcaggtggtcgtgcgcgtcagaccaccgacgccccgagagctggactcacagagacgccctgtggtccaagtggttgatgagcgcgtgctggtctttaaccctgaggaacccgacgggggtttccccggattgaagtggggtggcacccatgacgggccaaaaaagaagggcaaggatctcacgtttgttttcgaccgggtgttcggagaggctgcaactcaacaggatgtgtttcagcacacaacgcactcagtgctggattcattcctgcagggctataattgctccgtgtttgcttacggagccactggggctgggaagacacacacgatgctggggagagagggggaccccggtatcatgtatctaacaaccgtggagctctaccgacgcctagaggcaagacagcaggaaaagcacttcgaagtgctgatttcgtatcaggaggtctacaatgaacagattcacgatctgctggaacccaagggccctcttgctatcagagaagatcccgataaaggagtggttgtgcaggggctgtcattccaccaacccgcttctgctgagcagttgctagagattttgacacggggtaacaggaacaggacccaacatcccaccgatgctaacgcaacctctagcaggtcacatgctatttttcagatatttgtgaaacagcaggacagagtgcccggacttacgcaggcggtccaggtggctaagatgtccttgatagatctcgccggtagcgaacgtgcttcatccacccatgcaaagggcgagcgtctgagagagggcgcaaatattaaccgtagtctgttagcgctgataaatgtgttgaatgctcttgctgacgcaaagggcaggaagacccatgtgccctacagggactcgaaactcaccagactgctgaaggattcactgggaggcaattgcagaaccgtcatgatcgccgcaattagcccatcatctcttacttatgaggacacctacaatacattaaagtatgcagacagggctaaggagataaggctctctctaaaatctaacgtcacttctctagactgccatatatcccagtacgcaacaatctgtcagcagctgcaggcagaggtagccgcactacgaaagaagttgcaggtgtacgagggcggagggcagccccctcctcaggaccttcctggatctcctaagtcaggcccacctcctgagcatctgcccagctcacctttacctcctcatccaccgagccagccatgtacccctgagctgccagcaggcccacgcgctttgcaggaggagtcacttggcatggaagctcaggttgagagggccatggaaggcaatagctcggatcaggagcagagtccagaggatgaggatgaaggacctgctgaagaagtgcccacccagatgccagaacagaacccaacccacgcccttcctgagtccccacgacttaccctacagccaaagcctgtggtgggccatttctctgccagggagttagacggagaccgttcaaagcagctcgccctaaaagtgctgtgtgtggcccaacgccagtactctttactgcaggccgcaaatcttttgacacctgatatgataacagaatttgaaactctgcagcagctggttcaggaggaaaaaatagagcccggagcggaagcccttaggacttcagggttagcaaggggcgctcctctggctcaggagctgtgcagtgagtccatccctgtgccttctccgttatgcccagagcccccagggtatacgggcccagtgactcggacaatggccaggcgactgagtgggccactgcataccctagggatacctcccggaccaaactgtactcccgcacagggtagccgctggcccatggagaaaaaacgacgtaggccatcggctctggaagccgatagtcccatggctccgaagagaggcaccaagaggcaacgacaaagcttcctgccttgtcttcgccgaggctctttacctgatacacagccaagccaaggaccctccactccaaaaggcgagcgcgcatcttccccctgccatagtccccgtgtatgcccagcaaccgtgatcaagtctcgggtgcctctgggcccatccgccatgcaaaactgctctacaccactggctctgcctaccagggacttgaatgcgactttcgacttgtcagaggaacctccgagcaagccctcattccacgaatgcattggctgggacaaaatcccacaggagctgtcccgcctggaccagccctttatccccagagccccagtccccctgtttactatgaaaggcccaaaaccaacatcaagtctgccgggtacaagtgcctgcaagaagaagagagtcgcgtctagctccgtcagtcacgggcgttccagaattgcgaggctgccaagcagtacactgaagaggccaggtcctctctattctcaggtaaccgggacccgggatcgagatagcctcggccacgggggaagatag

SEQ ID NO: 29091 - DNA, 561 bp, Artificial Sequence
  Description of Artificial Sequence: Synthetic coding sequence
atggaacctcctaggggacctccggctaacggcgcagagccaagcagggccgtcggcacagtgaaagtgtacctcccgaataagcaacgaaccgttgttactgtcagagatggcatgtccgtgtatgactccctggacaaggccctcaaagtgaggggactgaaccaggactgctgcgtggtttatcgcttaattaaagggaggaagactgtcactgcatgggataccgccatcgctccgttggacggagaagagctgattgtggaggtgctagaagatgtccccttgactatgcataatttcgtgaggaagaccttcttctctctggcattctgtgatttctgcctgaagtttctgttccacggattcaggtgccagacttgcggttataagttccaccagcactgttcttcaaaagtgccaactgtttgtgttgacatgtccacaaacaggcagcagttctatcacagcgttcaggacctgtccggtggttcccgccagcatgaggccccttccaataggcccctgaatgagctgctgactcctcaagggccaaggtag

SEQ ID NO: 29092 - DNA, 1821 bp, Artificial Sequence
  Description of Artificial Sequence: Synthetic coding sequence
atggagcccccacgaggacctcctgcgaacggggctgagcctagccgcgcagtaggcaccgtgaaggtctacctccctaataaacaacgtactgtcgtgacagttagggatggaatgtcagtctacgactcccttgataaggcactcaaggtgagaggactcaatcaggattgttgcgtcgtgtatcggttgatcaagggcaggaaaactgtcactgcttgggatactgctatagccccattggatggagaggaattgatagtggaggtgttggaagatgtgcccctaacaatgcataattttgtcaggaagactttctttagtcttgcattctgcgatttctgcctgaagttcctgtttcacggctttagatgtcagacttgtggatacaaattccatcagcattgttcttcgaaggtgccaacagtttgcgttgatatgagcacgaacagacagcaattttatcactctgttcaggatctcagcggtggcagccgtcaacacgaggccccaagcaacagaccgttgaatgaactgttgactccccaagggcctagcccccgaacccagcattgcgacccagaacactttccctttccggctcctgccaacgctccgcttcagcggattcggtctacatctacgcctaacgtgcacatggtttccacaactgcccctatggattctaacctgattcagctgacagggcagtctttcagtaccgatgcagcaggctcacgaggcggttctgatgggacccctcgtggctctccaagcccagcttctgtgtcctcagggaggaaatctcctcatagcaaatctcccgctgaacagcgggagaggaagtctttggctgacgacaagaagaaggtaaaaaaccttggctaccgcgactcaggttattactgggaagtcccccctagcgaggtgcagttgctgaaacgtattggaaccggtagctttggaaccgttttcaggggacgctggcatggcgatgttgccgtgaaggtgttgaaagttagtcagcccaccgccgagcaagcacaggctttcaagaacgaaatgcaggtgcttagaaagacccggcacgtgaacatactcctcttcatggggtttatgactcggcctggcttcgcaattatcacccagtggtgcgaaggcagctccctctaccaccatctgcatgtggccgacaccaggtttgacatggtccagctcatcgacgttgcaaggcagacggctcagggcatggattatctccacgcaaagaacatcatccatagggatctcaaaagtaacaatattttcttgcacgaagggctaacagtgaaaatcggagactttggtctggccacagttaagactcggtggagtggggcacagccccttgagcagccaagcggaagtgtgctttggatggcagccgaagttatacggatgcaagacccaaacccttatagctttcaatccgacgtgtacgcttacggagtcgtcctctacgaattgatgaccggatcattgccatactcacatatcgggtgccgagaccagattatcttcatggtggggagagggtacctctcaccagatttatcgaagatttcctctaattgtcccaaggccatgcgcagactgctgagcgactgtctgaaatttcagcgggaggagagaccccttttcccacagattctggcgactatagagctcctgcaacgcagtttacctaagatcgagcggtccgctagcgagccttcactgcataggacgcaggctgacgagctgccagcctgcctgttgtctgctgccaggctggtgccttag

SEQ ID NO: 29093 - DNA, 3036 bp, Artificial Sequence
  Description of Artificial Sequence: Synthetic coding sequence
atggtgagttcggacagacccgtgtccctggaagacgaagtatctcactctatgaaggagatgatcggagggtgttgcgtgtgcagtgatgagcgaggatgggctgaaaaccccctcgtctactgcgacggccatggctgcagtgtggcggttcaccaagcatgttatgggatcgtacaggtgcctacaggcccatggttctgcaggaaatgcgaatcccaggagagggccgcaagagttagatgtgagctgtgccctcacaaggacggagccctgaagagaacagacaacggaggctgggcccacgtcgtatgcgccctctacatacccgaagtccagttcgcaaacgtgagtacaatggagccaatcgttttgcagagtgtgccccatgaccgctacaataaaacctgctacatatgtgatgagcagggcagagaatctaaggccgctactggagcttgcatgacttgtaacaagcatgggtgcaggcaagccttccacgtgacatgtgcccaatttgccggacttttgtgcgaagaagaaggaaacggagctgataatgtgcagtactgcggatactgtaaatatcatttttctaagttgaagaagtcaaagcgtggttctaatcgcagctatgatcagagcctatctgattcctcctcccatagccaagataaacatcatgagaaagagaagaagaagtataaggagaaggacaaacacaagcagaagcataagaaacaaccagaaccaagccccgctcttgtacccagcctcaccgtcactaccgaaaagacgtacacatctacctccaataattctatatcaggcagtttgaagcggcttgaggacacaacagccagatttacgaacgcaaattttcaggaagttagcgcacatacatcctccggtaaggatgtgtccgaaacacggggatccgagggaaaagggaagaaatcctcagcccacagctctggccaacgcggacggaagcccggtggtggtaggaatcctggcaccaccgtcagcgccgcaagtccttttccccaggggtccttttctgggactccgggatctgtaaagtcttctagtggttccagcgtgcagagccctcaggactttttatcgtttaccgacagcgaccttaggaacgactcgtactcacacagccagcagtcttctgctaccaaagatgtgcataaaggagaatctggcagccaggagggcggtgttaacagcttcagcacgttaatcggcctgccctctacaagcgctgtaaccagccagccgaaaagctttgagaacagtcccggtgatctgggaaatagcagcctgcctacagctggctataagagggctcaaacttcaggcatcgaagaagagaccgtaaaagagaaaaagagaaagggcaataaacagagtaaacacggaccgggtaggccaaaggggaacaaaaatcaggaaaacgtatcgcatctctctgtgagtagtgcgagcccaaccagcagcgtggcttcagcagcgggatcaattaccagctcatctctgcagaagtcccctacactcttacgaaatgggtcgctccagagtttatcagtgggtagctcccccgtgggatctgagatatctatgcagtatagacatgacggcgcttgccccactacaaccttttcagagctgctcaatgctattcataatggaatctacaactctaacgacgtcgctgtctcgttccctaacgtggtgtctgggagtggttcctcgaccccagtgagctctagccacctgcctcagcaaagctcagggcatctgcagcaggttggcgctctgtcacctagcgctgtgtccagtgcggcaccagcggtcgctaccacccaggccaataccctcagcggctcatcactctctcaggctcccagccacatgtatggcaaccgttcaaattcttctatggccgcactgatcgcacagtctgaaaataaccaaaccgatcaggacctgggtgataattctagaaatctggttggtcggggatccagcccgagaggatccctgagccccaggagccccgtgagtagtctgcagattcgctacgaccagcccggtaatagctccttagaaaatctacctcctgtggccgcttctatcgagcagctccttgaaaggcagtggtctgaagggcagcagtttcttctggagcagggtacccccagcgatattcttggaatgttgaagtccctccatcagctgcaagttgaaaaccgccgactagaagagcaaattaagaacctgactgccaaaaaggaaagactccagctgctcaatgcccagctgtcagtgcctttccccactatcactgccaatccaagcccctctcaccagatacacacatttagtgctcaaacagctcctacaactgattctctcaactcaagcaagtccccacatattgggaactcctttctgccagacaatagccttcctgtcttaaatcaagatttaacatcttcaggccaatccacgtcaagttccagcgctctcagtacgccacctccagctggccagtcaccggctcaacaagggtccggcgtgagcggtgtccaacaagtgaacggagtaacggtaggggctttggcctccgggatgcagcctgtgacctccactatcccagcagtaagtgctgtaggcggtatcattggggcactacctgggaatcagttggctatcaacggcattgtaggagccctaaacggtgttatgcagacaccagttaccatgtcgcagaaccctactccactgactcacacaacagtaccacctaatgccactcatcccatgcccgctacactcacaaatagcgcatctggcctcgggctcctgtccgaccagcagcgtcaaatcctcatacaccagcagcagttccagcagctgctgaatagtcagcagttgacgcccgttcatcgccatcctcacttcactcagcttccccctactcacttttctccaagcatggagattatgcaggtaagaaaatag

SEQ ID NO: 29094 - DNA, 3084 bp, Artificial Sequence
  Description of Artificial Sequence: Synthetic coding sequence
atggtgtcaagtgatcgccctgtgtcattggaggacgaggtctctcattccatgaaagaaatgatcggcggatgttgcgtatgtagtgatgagaggggatgggccgagaatccgctagtgtactgtgatggtcatgggtgtagcgttgctgtgcaccaggcttgctatgggatagtgcaggtgcccaccggcccttggttttgcagaaagtgcgaaagccaggagagggctgctcgcgttaggtgtgaattatgcccacacaaggacggggctcttaagagaacagacaacggtggctgggcacatgttgtttgtgccctttatattcccgaagtacagtttgccaacgtgagtacgatggagcccatagtgctgcagtccgttcctcacgataggtacaataagacctgttacatttgcgatgagcaagggagggaaagcaaagcagctaccggggcatgtatgacctgcaataagcatggatgcagacaagcctttcacgtcacatgtgcccagttcgctgggttgttatgcgaggaggaggggaacggtgccgacaatgtgcagtactgcggatactgcaagtatcacttctctaagctgaagaaatcgaaaaggggttcaaaccgctcctacgaccagagcctgagtgatagcagttcccattcgcaagacaaacatcacgaaaaggagaagaaaaaatacaaagagaaggataagcataaacagaaacacaaaaagcagccagaacctagcccagccttggtgccatctttgacggtgacaacagaaaagacgtataccagcaccagtaacaactccatctctggctctttgaaaagactggaggataccactgctcggttcacaaatgctaatttccaggaggtcagcgcgcacactagtagtggaaaagacgtgtcggaaacaagagggtctgaaggcaagggcaagaaaagttccgcccacagcagtggacagagaggcaggaagccagggggagggagaaacccgggaacgactgtcagcgcagcgagtccttttccccagggctccttcagcggtaccccaggaagtgtgaagtccagctccggttccagcgttcagagcccgcaggattttctgagttttacagactccgatctccgtaatgacagctatagtcacagccagcagagctctgccaccaaagacgtgcataaaggggagtccgggtcacaggagggtggcgtcaatagtttcagtacattaataggattgccatctacatccgcggttacttctcagccaaaatcttttgaaaattccccaggagatctgggtaactcttccctgcccacagccggatataagcgcgcacagacaagcggaatcgaggaggagaccgtgaaagaaaaaaaaagaaaaggcaacaagcagagcaagcatggaccaggtagacctaagggaaacaagaaccaggagaacgtgtcccacctgtctgtgtcctctgctagccctacaagctccgtggcgtctgcagctggcagtataacatcttcctccctccaaaagagccctacactgctgaggaatggaagtctgcagtctttgagtgtcggatcttcacctgtcggttctgagattagtatgcagtacaggcacgatggggcttgtcctactaccacattctccgaactcttgaacgctattcataacgatcgcggagattcctccacactcactaagcaagaactcaagttcataggcatctataatagcaacgacgtggccgttagcttccctaacgtggttagcggcagcgggtcttccacgccagtgagctcctcccacttgcctcaacagagctcgggacatctacagcaggtgggggcactcagcccctctgcggtgagttctgctgcgccagcagtagcaacgactcaggcaaatacactctccggttcttccctgtcgcaggcgccttcccacatgtacggcaaccgatccaactccagcatggccgcattaattgcccagagtgagaacaatcagactgaccaagacctcggcgataatagcaggaacttagttggtagaggcagtagtcccagagggtcccttagccctcgctcccctgttagttctcttcagattcggtacgatcagcctggcaactcttccctcgaaaacctacccccagttgcagcttcaatcgagcagttacttgagcgacagtggtcagaaggtcagcaatttcttctcgaacagggaaccccgtcggacattctggggatgctcaagtcattgcaccagctgcaggtagagaatcggagactcgaggaacagattaaaaaccttaccgccaaaaaagaacgccttcagcttctgaacgcgcagctgtcagtcccgttccctacgattacggcgaatccctcgccctcccaccagatccatacttttagcgcccagacagctcccacaactgacagcctgaacagcagcaaatctcctcacattggtaattcttttttgcctgacaattccctcccggttctcaaccaagacttaacatcctccggacagtcaacctcatcctccagcgccctgtcaaccccgcctccagctggccagtccccagcccaacagggctcaggggtgtccggagtccagcaggtgaacggtgtcacggtgggcgcactcgcttccggtatgcagccagttacttccaccattcccgctgtttctgctgtgggtggcatcattggagcactcccaggcaatcagttagctatcaatgggatagtgggtgcgctaaacggggtaatgcagacgcctgtgaccatgtcacagaatccgacgccactgactcataccacagtgcccccaaatgccacgcatccaatgcccgctaccctgactaactctgcatccggcctgggcctgctttcagaccagcagcgacagatcctcatccaccagcagcaatttcagcaactgctcaactctcagcaactcactcccgtacaccgacatcctcacttcacgcagttgcctcccacccacttcagccccagtatggaaatcatgcaggttagaaagtag

SEQ ID NO: 29095 - DNA, 567 bp, Artificial Sequence
  Description of Artificial Sequence: Synthetic coding sequence
atgaccgctccctcctgcgcctttcctgttcaatttcgccagccaagcgtgagtgggctcagccagatcacaaagtctttatacatctcaaatggcgtggctgcgaataacaagctgatgcttagtagcaaccagatcacaatggtgatcaatgtctctgtcgaggtcgtgaatacactatacgaggacatccaatacatgcaggtgccggtcgctgattcacctaatagcaggctctgtgacttttttgacccgatcgctgatcacatccactctgttgaaatgaaacagggccgtactttgctgcattgcgcagcaggagtttctcggagtgcggctctttgcctggcctatcttatgaagtaccacgcaatgtcactactggacgctcatacctggaccaaaagctgccgaccgatcatccgcccaaattctggtttttgggaacagctgatccactacgagttccagcttttcggaaagaacactgttcatatggtatccagccccgtaggaatgatacccgatatctacgagaaggaagtccgtctaatgatcccactgtag

SEQ ID NO: 29096 - DNA, 381 bp, Artificial Sequence
  Description of Artificial Sequence: Synthetic coding sequence
atggtgtcctctgacagaccggtcagcctggaggatgaagtgtcgcactcaatgaaagagatgatcggcggatgctgcgtttgtagcgatgagcgcggatgggccgaaaaccccttggtgtactgcgacggacacggatgctctgtcgcagtacaccaggcgtgctatggaattgtgcaggtgccaaccggtccatggttttgccggaagtgtgaatcccaagagcgggctgcaagggtagccgagtctcgctccgttgcacaagcaaaagttcagtggtgcgatctgtcgcctctgcagccactgctgccgggatttaaacgcttctcctgcctgtccctgccaaacggtatgcagttcctgctggtgtctctcatttag

SEQ ID NO: 29097 - DNA, 540 bp, Artificial Sequence
  Description of Artificial Sequence: Synthetic coding sequence
atggtaagctccgatcgccctgtgtcactggaggatgaggtgagccacagtatgaaggagatgattggtggttgctgtgtctgttccgacgagcgcggatgggccgagaatcccctcgtttattgtgatgggcacggatgctccgtggccgtgcatcaggcttgctatggaattgtgcaagttcctacaggaccttggttttgtcggaaatgcgaatcacaagagcgcgctgcccgagtgatggtttgtaactcatgctggctggctagcagcgagaacgtaacaccaggttacattgaacatcactgcgcttgtgccagtcctcatcctcgttgtcttgtatcaaacgtcccacccgtgtccggggctctcatgcactgtttctgggcctgcctgacgaccgcggctttctttgggcctcagagcttcacaacctgtcacatgtctttcctggtgagtcgagatatcctattttacatttacggttttatgccatttataagcgtcgtcatttggagatttaagaaggaacgatggtag

SEQ ID NO: 29098 - DNA, 540 bp, Artificial Sequence
  Description of Artificial Sequence: Synthetic coding sequence
atgggactgattttcgctaaattatggtccctcttctgcaatcaagagcacaaggtgatcatagtcggacttgataatgcgggtaaaacgactattctttaccagtttctgatgaatgaggtggtacatacctcacccaccattggcagcaacgtggaggagatcgtggtcaaaaacactcatttcctgatgtgggacataggagggcaggaaagcctcagatcaagttggaacacctactattccaatactgaattcataatcctggtggtcgatagcattgatcgtgagaggcttgccattaccaaggaagaactgtatcgcatgctagctcatgaagacctgcgcaaggccgcagtcttaatttttgctaacaagcaggatatgaagggttgcatgacagccgcagaaataagcaagtatctgacactatccagcatcaaggaccacccttggcacatccagagctgctgcgccctgacaggagaaggattgtgccagggcctggagtggatgacaagtcggataggcgttcgatag

SEQ ID NO: 29099 - DNA, 3345 bp, Artificial Sequence
  Description of Artificial Sequence: Synthetic coding sequence
atgagtcaaactcaggattacgagtgtcgatctcataatgtggacttgccggagtcacggattccaggatccaacacgcggttggaatgggtggaaatcatagaacctcgcacccgcgaaagaatgtacgcgaacctcgtcacgggtgagtgtgtttgggacccccctgccggtgttcgaattaagaggacctcggagaaccagtggtgggagctattcgatccaaatactagcaggttctattattataatgccagtacccagagaacggtgtggcatcggcctcagggatgcgatatcatacccttggctaagctgcagaccctgaagcagaataccgagtcaccacgtgcctctgctgaaagcagtcccggaagaggctcttcagtgtcacgggagggctccacatcttcttccctggagcccgagcctgataccgaaaaagcccaagagcttccggctagggcagggaggcccgctgccttcggaactgttaaggaggactcaggcagctctagcccacccggagtcttcctcgagaaagattacgagatctatagagactatagcgcggacggccaactgctccactaccgaacctcctcactacggtggaattcaggggcaaaagaacgaatgttaatcaaggtggctgaccgtgagcctagctttcttgcagcacaggggaacggatacgctcctgacggtcctccgggagtccggagtcggagaccttctgggtcacagcattctcctagcctacagacctttgcacccgaagccgacggtaccatcttttttccagagcgacgcccatctccctttcttaagcgcgcagaactgcctgggtctagcagccctctactcgcccagccacggaagccatcaggtgactcccagccgtcatctcccagatatgggtacgagcccccactctatgaggagcccccagttgagtatcaggcccctatttacgacgaacctccaatggacgtgcagttcgaggccggaggaggttaccaggccggttctccacagaggtccccaggcaggaagccccgaccgtttctacaacccaacaagcaagggccaccgagtccctgtcagcaattagtattgacaaagcagaaatgtcctgagagattcctgagtctggaatactctccagcaggcaaagagtatgttaggcaactggtatatgtagagcaggctggatcttcgccaaagctccgggcaggcccaaggcataaatacgctccgaaccccggaggaggtagctactccttacagcccagcccatgcctgctgcgggatcagcgattgggggtgaagtctggtgattacagcactatggagggacctgagctgcgtcattcgcaaccaccgactcctttaccccaagcacaggaagatgccatgagctggagttcacagcaggacactctctcctccaccggatatagtcccggaaccaggaagagaaaaagccgcaaaccctccctgtgtcaagcgacttcggcaacacctactgaggggccaggagatttattggtggaacaaccattggctgaagagcagccaccttgtggaacatcacttgctcctgtgaagcgcgctgagggcgaggctgagggggctaggggcgctgcggaacctttcctggcgcaggcaagactggcctgggaggcccagcaagctcactttcatatgaagcagaggagttcttgggatagccagcaagatggatctggctacgaatccgacggagcactgccccttccgatgcccggaccagtggtcagagcgtttagcgaggacgaggcgctcgctcagcaggagaataggcactggcggcgaggaacctttgagaagctggggtttcctcagatcctgctggaaaaatctgtttctgtccagaccaacctggccagccctgagccgtatctgcatccttcccagagcgaggatctcgccgcttgcgctcagttcgagtcgagcaggcaaagtcgctccggagttccctctagtagctgcgtcttcccaacatttactctgaggaaaccatcttctgagacggatatcgagaattgggctagcaaacacttcaataaacatactcaggggttgttccggcgtaaggtttcaatagccaatatgctagcgtggtcttctgaatctattaaaaagcccatgattgtgacttctgatcggcacgtgaagaaggaggcttgcgagctgttcaagttaatccagatgtatatgggcgatcgcagagcaaaagcagaccctctgcacgtggctctggaggtggctaccaagggctggagcgtgcagggcctgagagacgaattgtatatccagttatgtaggcagaccactgagaacttccgcctggaatccctcgctagggggtgggaattaatggccatctgcctggccttcttccccccaacccccaaatttcacagctatctcgaaggctatatttatcgccacatggaccccgtgaatgatacaaaggttacacagcacatcaaagagctcttggagagaaacacaaaaaagaaatctaaacttagaaaaaagcccaagccgtacgtggaagagccagacggcgtggccatcagcacttacgctaagtattgctaccataagttgcagaaggccgctttaactggcgctaagaagggcttaaaaaaacccaatgttgaggaaattaggcacgctaagaacgccgtctttagcccgagtatgttcgggtcagcgctccaggaggttatgggtatgcaacgagagagatacccagagcgtcagctgccctgggtgcaaacaagactcagtgaagaggtcttagcgttaaacggggatcagactgagggtatttttagagtgcctggcgatatagacgaggtgaacgccttaaagctgcaggtggaccagtggaaggttcccacaggattggaagatcctcatgttccggcttccctgctcaaactgtggtaccgtgaacttgaagagccactcatcccccacgaattttatgagcagtgcatcgcccattacgatagccccgaagctgccgtggccgtcgtccatgcgcttcccagaatcaaccgcatggtgctgtgctatctgattaggttcctccaggtttttgtgcagcctgctaacgtcgccgtcacaaaaatggacgtaagcaatctggccatggtcatggcgccaaactgcctcagatgtcagagcgacgaccccagagtaatctttgagaacacaaggaaagagatgagttttttacgtgtgctgatccagcacctcgacaccagcttcatggagggcgtgttgtag

SEQ ID NO: 29100 - DNA, 822 bp, Artificial Sequence
  Description of Artificial Sequence: Synthetic coding sequence
atgggccagaaagtgacaggcggaatcaaaaccgtcgatatgcgtgatcccacataccgtccgttaaagcaagaattgcagggcttggactactgtaagcctactagactagacctgctcttggacatgccaccagtgtcttacgatgtgcaattgttgcattcctggaataacaacgatagaagtctgaatgtttttgttaaagaagatgacaaactgatttttcatcgacacccagttgctcagtcaactgatgcaatccggggtaaggtcggctatacaaggggtctacacgtgtggcaaatcacatgggctatgaggcagcggggaacccatgctgtggtcggagtggccactgccgatgctcccctacactccgttggctataccacattggtggggaataatcatgaatcctggggctgggaccttggcagaaaccggctgtaccatgacggtaaaaatcaaccttcaaaaacctaccccgcttttctagaacctgacgaaacatttattgtgcctgattcattcctcgtggccctggacatggatgacgggaccctctctttcattgtggacggacagtatatgggtgtggctttcaggggtctcaagggcaaaaagctctatcctgtagtgtccgctgtttgggggcactgcgagattcgcatgagatatctcaacggcctcgatcctgagccgctccccctcatggacctgtgcaggcggtccgtcagattagcccttggccgagagaggctgggcgagatccatacccttcctctgccagcctccctgaaggcttacttactgtatcagtag

SEQ ID NO: 29101 - DNA, 3633 bp, Artificial Sequence
  Description of Artificial Sequence: Synthetic coding sequence
atgcctagaggagaggcccctggtccaggacgtcgcggagcaaaggacgaggctctaggtgaggagagcggcgaaaggtggtctccggaatttcatctgcaacgaaagcttgctgattcatctcatagtgagcaacaggatcgaaaccgggtgtccgaagagctaatcatggtcgtacaggagatgaagaaatattttccatccgagcggaggaacaaaccttccacccttgacgctctgaactacgcgctgcgctgtgtccacagtgtacaagcaaacagcgagttctttcagattttaagccagaatggcgcacctcaagcagatgtgtcgatgtactcgcttgaagagctagcaactatagcatcggaacacacctccaagaacacggatacatttgtggccgttttctctttcctttcaggaagactagtgcatattagcgaacaagccgcactaatcctgaaccgcaaaaaggatgtgctcgcgagcagtcatttcgtagacttacttgccccacaggatatgagagtcttttacgcacacaccgcgagagctcaactgccattttggaacaattggacccagagggccgcagccaggtatgaatgtgcccctgttaagccctttttttgcaggatccgcggaggcgaggaccgtaagcaggagaaatgccactctccattcaggattattccctacttgatccatgtgcatcatcctgctcaacctgagctcgagtctgagccctgttgcctaaccgtggtggagaaaattcactccggctacgaggcccctagaattcccgtaaataaaaggatcttcacaacaacccacacaccgggatgcgtttttctagaggtggacgagaaggcagtgccactcctaggatacctcccacaagaccttattggaacctccattctcagttatctacaccccgaagacaggtcactgatggttgcaatccatcagaaggtactgaagtacgcagggcatcctccatttgagcactctccaattagattctgtactcaaaatggtgattatattatcctcgattcaagctggtcttcctttgtaaacccttggtcccggaagatctcctttattattggtcgccacaaggtacgcacaagccctttgaacgaagatgtgtttgccactaagattaagaagatgaacgataatgacaaagatataacagagctccaggagcagatttacaagcttctgctgcagccagtgcacgtgagtgttagcagtggatatggctccttgggttcttccggttcccaggaacaactcgtctctatagcctcaagtagcgaagcctccggtcaccgcgtggaggagactaaagccgagcagatgactctccagcaggtttatgcctcagtgaacaagatcaagaacctgggccagcaactgtacattgagagcatgacaaagtctagttttaaacccgtgactggaactcgcaccgagccaaacggaggtggtgagtccgccaatggaggaggcgagtgcaagacctttacttccttccaccagactctgaagaataactctgtttacaccgagccatgcgaggaccttcgcaatgatgagcactccccttcttaccagcaaatcaactgtatcgattcagtgatccgttacctcaagagctataatattccagctctgaaaagaaaatgtatttcctgtacaaataccacttcaagtagctccgaggaagacaagcagaaccataaagccgatgacgtgcaggcgcttcaggctggcctgcagatcccagccattcccaaatccgagatgccgacaaatgggaggtccattgatacagggggaggggcaccacagatactaagcactgctatgctgtcgctcggttcaggcatatctcagtgcggctacagctctactattgtgcatgtgcccccaccagaaacagccagggatgctacactgttctgtgaaccctggaccctgaatatgcagcctgcacctctaacgagcgaagaattcaaacatgtgggcctgaccgccgcagttctctctgcacatacgcagaaggaagaacagaactacgtcgacaagttccgggaaaagatcctgagctctccatattcttcctatttacagcaggaatcacgctccaaggccaagtactcttattttcagggtgattctacatcgaaacagacaagatccgctggctgtagaaagggtaaacacaaacgaaagaagctacctgagccacccgattctagctcctccaacaccgggagtgggccacgcagaggggctcatcagaatgcccagccttgctgcccttctgctgccagcagtccccacacctcaagtccaacatttcctcccgctgccatggtaccttcccaggccccttatctcgtgcccgctttccccttgccagcagccacaagtcctgggagggaatacgcagcccctggaaccgcccctgagggcctgcacgggctgccactgtccgagggtctccaaccctacccagctttccctttcccttacctggacacatttatgaccgtcttcctgcctgatccccctgtctgtcccctcctatcaccatcattccttccctgcccgtttcttggggctaccgcaagctctgccattagtccatcaatgagcagtgctatgtcgccaacgctggatcccccaccttccgtgacaagtcagaggcgagaagaggaaaagtgggaggctcagagtgaagggcacccctttatcactagcaggagttctagtcccctccagttgaacctgttgcaagaagaaatgcccaggcccagtgagtcccctgatcagatgcgaaggaatacttgtcctcagactgaataccaatgcgtgacggggaacaacggctctgagtcgtccccggctaccactggcgctctctccacagggtcaccaccaagagagaatccttcacaccctacagccagcgctctctccactggtagtccaccaatgaagaatccaagccatcctaccgccagcgctctgagcactgggtcaccacccatgaagaatcccagtcatccgaccgcctctactttgagcatgggcttgccaccgtccaggacacccagccatccaacagcgactgttttgagtacaggctcacctcccagtgagtcaccctctcggaccggatccgccgctagtgggagtagtgattctagtatctatctcaccagtagcgtgtattccagtaagatttcccagaatggccagcaatctcaagatgttcagaagaaagagaccttccccaacgtcgctgaggagccaatttggagaatgatccggcagactcctgaacggatactgatgacataccaggtacctgagagggtgaaagaggtggtgctgaaagaggatctcgaaaagctggaatctatgcggcagcagcaaccccagttttcccacggccagaaagaggagctcgccaaagtgtacaactggattcaatcccagacagtgacgcaggagatcgatatacaggcctgtgtgacctgtgagaatgaagactcagcagacggtgctgcaacctcgtgcggccaggtcctggtggaagactcatgctag

SEQ ID NO: 29102 - DNA, 1137 bp, Artificial Sequence
  Description of Artificial Sequence: Synthetic coding sequence
atgccacgtggagaagcccctggccctggcaggcgcggagctaaagacgaagctctcggggaggagagcggggaaaggtggtcccctgagttccaccttcagaggaagcttgcagacagttctcattcagagcagcaagatcggaatagggtttcagaagagcttatcatggtggttcaagagatgaaaaagtactttcccagtgaaaggagaaacaaacctagcacactagatgccttgaattacgcccttcgttgcgtgcacagtgtacaggccaatagcgaattttttcaaattctgagccaaaacggggctcctcaggccgacgtctctatgtacagtctggaagaactggctacaattgcaagtgagcatacctccaaaaatacggacaccttcgtggccgtattctcctttctttcaggccgactggtgcatatctcagaacaggcagccctgatcctcaatcggaagaaggacgtcctggcgtcctcacattttgtcgacctgctcgcgcctcaagatatgcgggtcttttacgcccataccgctcgcgctcagctcccattttggaataactggacacaaagggcagcaaggtatgaatgcgctcccgtgaagccattcttctgccgaattcgcggaggagaagatcggaagcaggagaagtgtcatagcccgttcaggatcattccatacctgattcacgtgcatcaccccgctcagcccgaactggaatccgagccgtgctgccttactgtggttgagaagattcacagcggttatgaggccccaaggattcctgtgaacaagaggatcttcaccaccactcacactccagggtgtgtattccttgaggtggatgagaaggccgtcccactgctgggctacctgcctcaggacctgattgggacgagcatcttgagctatctccaccccgaggaccggagtctgatggttgccattcaccagaaggtcctcaaatatgcaggacaccctccattcgagcactctccgatcagattttgtactcaaaatggggattacatcatcctggacagcagctggtcgagctttgtgaacccgtggagcaggaagatttccttcattatcggacgccacaaggtgcggacttag

SEQ ID NO: 29103 - DNA, 1794 bp, Artificial Sequence
  Description of Artificial Sequence: Synthetic coding sequence
atggaaaggcccgcacccctggctgtgctcccattctctgaccccgcacatgctctcagcctccttagggggctgagtcagttacgtgctgaaagaaagttcctggatgtgacactggaggccgcagggggaagggatttccccgctcatcgagccgtccttgctgcggcatcaccatacttccgtgcaatgttcgccggacagctacgggagagcagggccgagcgcgtacgactgcacggcgttcctccggacatgttacagctcctcctggacttttcctacaccggacgggtggcagtcagcggggacaacgctgagcctctgctcagggctgcggatcttttgcaattccccgctgttaaggaggcatgcggagcctttctccagcagcagctagatcttgctaattgcctggatatgcaggattttgctgaggctttcagctgctcaggcctggcaagcgccgctcaacgctttatactacgccacgtgggagagttaggagctgaacagctcgaacgactgccacttgcgcgtttgctccgttatctgcgtgacgacgggctgtgtgttcccaaagaggaagccgcttaccaactggcccttcgctgggtgcgcgcagatccccctcgcagggccgcacactggccccagttactggaagccgtgaggttaccattcgtgcgacgcttctacctcttggcacatgtggaggcggagcctttagtcgcccgatgccccccttgtctgcggctgcttcgcgaagctagggacttccaggctgcacggtacgaccgacacgaccggggtccatgccctaggatgcgacccaggccatcgactgggcttgccgagatcctggtgcttgttggcggatgcgatcaagattgcgacgaattggtgaccgtagattgttataatcctcagaccggacagtggcgatatctcgccgaatttcctgaccacttagggggtgggtacagcatcgttgctctcggcaacgacatttatgtgaccggtggctctgatggctctcgactgtacgactgcgtgtggagatataattctagtgtgaatgaatgggccgaggtcgctccgatgctcaaggcacgagaataccactcctccagcgtcctggacgggttgctgtatgtcgtggccgcagatagtactgagaggtatgaccacacgactgattcctgggaagccttgcagcctatgacctacccaatggacaattgctctaccactgcttgtcgagggaggctctatgcaattggctcgctcgccggaaaggagacaatggtgatgcagtgctatgatccagataccgacctgtggagcctcgtcgattgcggacagctcccaccctggagcttcgcccctaagacagctaccctgaacggtctcatgtacttcgtgcgcgacgactcagctgaggtagacgtatacaatcctacacgcaacgagtgggacaagattccctccatgaaccaggtccacgttggcggaagcctcgcagtcctgggaggaaagttgtacgtctctgggggttatgacaacactttcgagttgagtgatgttgtggaggcttacgacccggagactagggcgtggagtgtggtggggagacttcccgagcctactttttggcatggatcagtttcaatatttcgacagtttatgcctcagacgttttccggaggcagggggtttgagctggactcagggagcgatgatatggatcctggccgtcctcggccaccgagagatcctgatgaactgcattag

SEQ ID NO: 29104 - DNA, 1620 bp, Artificial Sequence
  Description of Artificial Sequence: Synthetic coding sequence
atggagcgacccgcacctttagcggtcctgcctttttctgaccccgctcacgcacttagcctcctgaggggactgtcccagctgcgcgctgagcgcaaattccttgacgtcactctcgaggccgctgggggtcgcgatttccccgcacaccgagcagtcctggctgctgcatccccgtactttagggcgatgtttgctgggcagctcagagagtcccgagctgagagggtgaggctgcatggagtaccaccagacatgcttcagctgttgttagactttagctacacagggagggttgccgtgagcggagacaatgcagagcccttacttagagccgctgacctgcttcaatttccggctgtaaaggaagcatgcggggcattcctgcagcagcaactggatttagccaattgtctagatatgcaggacttcgccgaggcgttctcctgcagcgggcttgccagcgccgcacagcgctttatcctcaggcacgtgggagagctgggcgcagaacagctggagaggctcccacttgctaggctactaaggtacttacgggatgatggactgtgcgttccaaaagaagaggccgcatatcaactggcactcaggtgggtgagggctgacccacctagaagagccgcacattggccccagctgcttgaggctgtgaggctgccattcgttcgacgcttttacctcctcgcacacgtggaagccgaacccctggtagccaggtgtcctccatgtctgcggttgcttcgtgaggctagagacttccaggctgctcggtatgacaggcatgacagagggccatgcccgaggatgaggccaagacctagtaccggactggccgagatccttgtcttggtgggcggttgcgaccaggactgcgatgagctcgttacagttgactgctacaacccacaaacaggacagtggcgatacctcgctgagtttcccgatcatttgggcggaggatactcaatcgtcgctctcggcaatgatatatatgtgaccggcggtagtgatggaagcagactctacgactgtgtgtggcgttataatagcagtgtaaacgagtgggctgaagtggcgccaatgctcaaagcccgagaatatcatagtagctctgtgttagatggattgctgtatgtggtggctgccgactcaactgagaggtacgaccatactaccgactcctgggaggccttacagcccatgacatacccgatggataattgttcaaccacagcttgcagagggcgactgtacgctataggctctttggcaggtaaggagaccatggtcatgcagtgttacgatcctgacaccgatttgtggagtctggtcgactgcggtcaactcccaccatggtccttcgcacccaagacagcgaccctaaacggtctcatgtattttgtccgggacgattctgctgaagtagatgtctataatcctacgcgcaatgagtgggataagatcccatcaatgaaccaagtcaactttcaggctggacagcactggaagcatcggctggtcctcattttgcaacctaaatgccacagagacgaatgtctgggcagcacagccatgatgggtgggagccacttgaattag

SEQ ID NO: 29105 - DNA, 2067 bp, Artificial Sequence
  Description of Artificial Sequence: Synthetic coding sequence
atggatggaagcttcgtgcagcatagcgtgagagtcctgcaagagttgaacaaacagcgggagaaaggacaatactgcgacgccacattagacgtgggaggattggtgttcaaggcacactggagcgtgctggcttgctgtagccacttcttccagtctttgtatggcgatgggtcagggggtagcgtggttctgcccgctgggtttgctgagatcttcgggctgctgctggacttcttttataccggccacttagcgctgacttctggaaaccgggatcaagtgttacttgccgcaagggagcttagggtgccagaggccgtggaactgtgtcagtcttttaagcccaagacttccgtggggcaggcagccggaggacagtccggactggggccacccgcaagccagaacgtgaattcacacgtgaaggagccggcaggcctagaggaggaagaggtcagcaggactctaggtctggtccccagagaccaagaaccccgaggtagccacagccctcagaggccacaattacactcccccgctcagtccgaaggtccaagtagtctctgtggaaagctgaagcaggccctgaaaccgtgtcctctggaggataagaagccggaggactgtaaagtgccccctcggccacttgaagccgaaggagcccaactgcagggaggtagtaacgagtgggaggtagtggtgcaggttgaggatgatggagatggtgactacatgtcagaacccgaggccgtactgacacgtcggaaatccaatgtcattaggaagccatgcgcggcagaacctgcattgagtgcaggcagtcttgccgctgagccagctgagaatagaaaaggtaccgctgtgcctgtcgagtgtcctacctgccacaaaaagtttctgtccaaatattacctgaaggtgcacaaccgaaagcacaccggggaaaagccttttgagtgccctaaatgcgggaagtgttattttagaaaagagaatctcttagagcacgaggcaagaaattgcatgaacagatctgagcaggttttcacttgtagcgtctgccaggagacattccgaagaagaatggagttacgcgtccatatggtaagtcatacaggcgagatgccatacaagtgctcctcatgcagtcagcagtttatgcagaagaaagatttgcagagccacatgattaagctacacggcgcaccaaaaccacacgcatgcccaacatgtgccaaatgctttctctcaagaacagaattgcagctccacgaagcctttaagcacaggggggaaaagctctttgtctgtgaagagtgcggccacagggctagctcccgaaatggactgcagatgcatatcaaggcaaagcataggaatgagagaccacatgtgtgcgaattctgttctcatgctttcacccagaaggctaatctgaatatgcacctacgtacccacacaggggagaagcccttccagtgccacttatgtggcaagactttcagaacgcaggcctctcttgataagcataatagaacccacaccggagaaaggcctttctcatgcgaattctgtgagcagcggtttacggagaagggcccactcctccgacacgttgccagtcggcatcaggaaggaaggccccacttctgtcagatttgtgggaagacattcaaagcggtcgaacaacttcgggtgcatgtgcgacggcacaagggggtgcgcaagttcgagtgcacagagtgtggatacaagtttacccgtcaagcacatctccggcgtcacatggagattcacgatagggtcgagaactataatccacgccagcggaaactgaggaatctcattatcgaggatgaaaaaatggttgttgtggctctccagccacccgctgaactggaagttggttccgctgaggtgattgttgagtccctggcccagggaggtcttgctagccaactgccaggacagcgcctgtgtgcagaggaatcttttacaggacccggagtgctggagcctagcctgattatcaccgcagctgtgccagaggactgcgacacttag

SEQ ID NO: 29106 - DNA, 525 bp, Artificial Sequence
  Description of Artificial Sequence: Synthetic coding sequence
atgacccactgttgctccccgtgttgtcagcctacttgttgcagaaccacttgttgccgtaccacttgctggaagccgactacagtgacaacctgctcatccactccctgctgtcagcctgcatgctgtgttagcagttgttgtcagccctgctgtcgacccacttgttgtcagaatacctgttgccgtacaacctgctgccaacccacttgtgtcacctcatgctgtcagccaagctgctgctctaccccatgttgccagcctacctgctgcggctcaagctgttgcggacaaacctcctgcggctcctcttgcggtcagagctcttcatgtgctcccgtctactgcagaagaacatgttactatcctactacagtatgcttacccggatgtctcaatcagagttgcggcagcaactgctgccagccctgctgtagacccgcttgctgtgagactacatgttgcaggaccacatgctttcaaccaacatgcgtgtctagctgctgtcaaccctcttgctgttag

SEQ ID NO: 29107 - DNA, 597 bp, Artificial Sequence
  Description of Artificial Sequence: Synthetic coding sequence
atggtaagtagctgttgcggatctgtgtgtagcgaccaggggtgttcgcaagatctgtgccaagagacatgctgtagaccgtcttgctgtcagacaacatgttgtaggactacttgttataggcctagctgctgtgtttcctcatgctgccgacctcagtgctgtcaatcggtatgttgtcagcctacatgctgtcgcccacctagatgttgcatctccagttgctgccgcccatcatgctgtatgtcaagctgctgtaaacctcagtgctgccagtcagtttgctgccagcctaccactacttgttgccacccccgttgctgcatcagcagctgttgccggcctagctgttgcgtcagtagctgctgtaaaccccagtgctgccaatcagtgtgttgccagccaaactgttgccggcctagttgcagcatcagctcctgttgccggccaagctgctgtgaatccagctgttgtcggccatgctgttgcgttcggcctgtgtgtggtcgagtgtcctgccatacaacctgttaccgacctacatgtgtaatcagctcctgcccgcgacccctctgctgtgcttccagctgctgttag

SEQ ID NO: 29108 - DNA, 1296 bp, Artificial Sequence
  Description of Artificial Sequence: Synthetic coding sequence
atgacttccgattgttcatctacccactgttctcccgagtcttgcggaacggctagcgggtgcgcgcctgcttcaagctgttctgtggagacagcctgcctaccaggcacgtgcgctacatccaggtgccagaccccaagctttttatctaggagcagagggcttacaggctgcttactgccatgttacttcacaggctcctgcaattccccatgcctcgtcggcaactgcgcctggtgtgaggatggtgtgtttacctcaaacgaaaaggaaacgatgcagtttctgaacgaccggctggcttcttatctagaaaaagttcggtccctcgaggagactaacgccgagttggagagtagaatccaagaacagtgtgagcaggacataccgatggtgtgcccggactaccagagatacttcaataccattgaggatcttcagcagaagatactgtgcacaaaggcggagaacagcagactcgccgtccaacttgataactgtaaattagctactgacgacttcaaatctaagtacgagagcgaactttccctgaggcagctgctcgaagctgacatcagctccctgcacggaatcctagaggaactgactttatgtaaaagcgacctggaggcacacgtagagtccctgaaggaggacttgctatgtctaaaaaaaaaccacgaagaggaagttaatctgctgcgtgagcaactgggagatagactgtccgttgaactagacaccgctccgacactggacttgaacagagttctcgacgaaatgcgctgtcagtgtgagactgtgttggcgaacaaccggcgtgaggcggaagagtggctggccgtgcagacagaagaactgaatcagcagcagttgtcgtccgccgagcagttgcagggctgtcagatggagatcctggagcttaaacgcacagctagcgctcttgagatcgagctgcaggcacagcaatccttgacggaatccctggagtgcactgtggccgagacagaggcacaatattctagccaactggcgcaaattcaatgcctgatagataatttagagaaccagctcgcagagatccgctgtgatcttgaacgccaaaatcaggaatatcaggtgctactggacgtcaaggctaggttagaaggggagataaacacctactggggcctgctggacagcgaggattcacggctgtcatgttcgccgtgtagtacaacttgcacctcatccaacacttgtgaaccctgtagtgcctatgtgatctgtaccgtggagaattgttgtctttag

SEQ ID NO: 29109 - DNA, 1047 bp, Artificial Sequence
  Description of Artificial Sequence: Synthetic coding sequence
atggcaggctctctgccaccgtgcgtggtagattgcggcacaggctacaccaaactaggttacgctggtaataccgaacctcaattcattatccctagttgcatcgccatacgggagtcagcgaaagtggtcgaccaggcccagcgcagggtactgagaggggtagatgatctagacttcttcattggagacgaggcgatcgacaaacctacgtatgctacaaaatggcccatcaggcacgggattatagaggactgggacctcatggaacggtttatggagcaggttgtctttaagtacctgcgcgctgaaccagaagaccactattttcttatgaccgaacctccccttaacacgcccgagaacagagaatatctggcggaaatcatgtttgaaagtttcaacgtacctggcctgtatatcgcggttcaagcagtgttggcactggcggctagctggacaagtaggcaagtgggggagcgcaccctcaccggtattgtcattgattccggggacggtgtgacccatgtgatcccagtagcggaggggtacgtcattgggtcctgtatcaagcatattcctattgcaggccgagatatcacttacttcatccagcagctgctgagagaaagagaggtgggcattccgccagagcaaagtctggaaacagctaaggccatcaaagaaaaatattgctacatctgtccggatatagttaaggaattcgccaaatatgacgtggaccctagaaagtggatcaaacagtacactgggattaatgccatcaatcagaagaagtttgtcatcgatgtgggttacgaacgcttcctgggacccgagatcttttttcaccctgaatttgccaaccctgactttatggagagcatctccgatgttgtggacgaggtgatacagaattgcccaatcgacgtgagacgccctttgtataagcccgagttctttcaagtttgccatactaagaaggattacgaggagtacggcccatctatctgccggcataatcctgtgtttggcgttatgtcatag

SEQ ID NO: 29110 - DNA, 273 bp, Artificial Sequence
  Description of Artificial Sequence: Synthetic coding sequence
atggataacatgagcccccgtttgcgtgcattcctgtctgaacccatcggagaaaaagacgtttgttgggtggacggcatcagtcacgagttggcgattaacctagttacaaaaggtatcaataaagcctacatcctcctgggacaattcctgttgatgcataagaatgaagccgagtttcagagatggttgatttgttgtttcggcgcaacagagtgcgaagctcagcagacaagccattgtctcaaagaatggtgtgcgtgctttctatag

SEQ ID NO: 29111 - DNA, 249 bp, Artificial Sequence
  Description of Artificial Sequence: Synthetic coding sequence
atggcaagctcgtcaggtgcaggcgcagccgcagcagcggctgccgctaaccttaatgctgtgcgcgagacaatggatgtgctgctggagatatctcgaatacttaacacagggttggatatggaaacactgtccatttgcgttagactctgcgaacaaggcattaacccagaggccctgagcagtgtgattaaagagctccggaaagccacagaggcccttaaggcggctgagaatatgaccagctag

SEQ ID NO: 29112 - DNA, 3732 bp, Artificial Sequence
  Description of Artificial Sequence: Synthetic coding sequence
atggaaactagagcggctgagaatactgccattttcatgtgcaagtgctgcaacctcttctccccaaaccagagcgagctgctgagtcatgtgtcagagaagcatatggaagaaggagttaatgtggacgagataataattccattacgtcctctgtcaaccccagaacccccaaatagctccaaaacaggcgacgaattccttgtcatgaaaagaaaacgaggacgtcccaaggggtcaactaagaagtcctctaccgaggaagaattggcggagaatattgtcagccctaccgaagactctcctcttgctccagaggagggtaactctctgccaccatcctctcttgagtgtagcaagtgttgcagaaaattctccaataccaggcagctgaggaagcatatctgcattattgttctgaacctcggggaggaggagggggaggcgggaaacgaatctgatcttgaattggaaaaaaagtgtaaagaggatgatcgagagaaggcaagtaaacggcctagaagtcagaaaacggagaaagttcaaaaaatcagcgggaaggaggcccgtcagttgtccggagccaagaaaccaattatctctgttgttctgaccgcccatgaagcaattcccggagctaccaagatcgttccggttgaggcaggtcctccagagaccggggctacaaattccgagaccacaagtgctgatcttgtgccacgcagaggctatcaggagtacgccattcaacaaacgccctacgaacagccaatgaaatccagccggctaggacctacacagttgaagattttcacttgtgagtattgtaacaaagtcttcaagttcaagcattctctgcaggctcacctgcgcattcacaccaatgagaaaccctataagtgtccgcaatgctcatacgcctccgctatcaaagccaacctcaacgtccatctgcggaagcacacgggggagaagttcgcctgcgattattgctccttcacctgtctgtcgaaaggacacctcaaagtccacattgaacgggtccacaagaaaattaagcagcattgccggttctgcaagaaaaaatattctgacgtgaaaaacctaatcaaacacatccgtgatgcccatgatcctcaggacaagaaagtcaaggaagccctggatgaactttgcctaatgactcgggaaggaaagaggcagctgctctatgattgtcacatttgcgagagaaaattcaagaacgaactggaccgggacagacatatgcttgtgcatggagataagtggccatttgcctgtgaattgtgtggacatggtgctacaaagtaccaggctctggaattacatgtgcggaagcacccttttgtgtacgtttgcgcagtctgtcgcaagaaattcgtttctagcatcaggttgagaacccatatcaaggaagtccacggagctgcccaggaagcactggtgttcacaagcagcatcaaccagtccttctgtttactcgagccgggaggagatatccaacaggaagctttgggcgaccaactgcagctcgtggaggaagagttcgcactccagggcgtaaacgccctgaaggaagaggcctgccccggtgatacccaacttgaggagggtaggaaggaacctgaagcccctggcgagatgccagctcctgccgttcatttagcaagtcctcaggcagaatccaccgccctccctccctgcgagctggagactaccgtggttagctcaagtgacctgcactctcaagaggtcgtctctgacgactttttgctcaagaacgataccagctctgcagaagcccacgcagccccagaaaaacctcccgatatgcagcaccgaagctccgtgcagactcagggagaggttataactctgctcttaagcaaggcgcagagcgcgggatcagaccaggaatcgcatggtgcccaatcaccattgggcgagggacagaatatggcggtgttatcagccggagacccagacccctcccgctgtcttaggagtaatcccgcagaggcatctgacctcctgccaccagtggctggtggcggtgacactataacccatcaaccagatagctgtaaggctgcacctgaacatcggtctgggattaccgcattcatgaaggttctcaacagcctgcagaagaaacagatgaatacctcactgtgcgagcgcataagaaaggtctatggagatctggagtgtgaatactgcggtaaactcttttggtaccaagtgcacttcgacatgcacgtgcgcactcacacacgcgaacacttatactattgttcacagtgccattactctagtattaccaagaactgtctgaagcgacatgtgattcaaaagcattccaatattttattgaaatgccccacagatggctgcgactattccacacctgataagtacaaactgcaggcccacctcaaggtgcatacggctctagacaaacggagttactcctgtcctgtctgcgagaagagttttagcgaggatcggctgatcaaatcccacattaagactaaccacccagaggttagtatgtccacaatcagcgaagtccttggacggcgtgtgcagcttaagggactgatcggaaaacgggctatgaagtgtccttactgcgatttctacttcatgaaaaacggatctgatctgcagcgccacatttgggcccacgagggggtcaagccctttaaatgctccctctgcgagtatgctaccaggtctaagtcaaatctgaaggcccacatgaatcggcacagcacagaaaaaactcatctatgtgatatgtgtggcaaaaagttcaaatcaaaaggcacactgaaaagccacaagctcttgcacaccgcagatggcaaacagtttaaatgtactgtgtgtgattacactgctgcccaaaagccacagctgctgcgacacatggagcagcatgtgagctttaagcctttcagatgcgcacactgtcattacagctgcaatatctccggaagcctgaagagacattataatcgtaagcatcccaacgaggagtatgccaacgtcggcactggagaactagccgctgaagttctgattcagcagggaggcctaaagtgtccagtttgcagctttgtctacggaacaaaatgggaattcaaccgccaccttaagaataaacacggcctgaaagtggttgagatcgatggcgatccaaaatgggaaactgcaaccgaggcccctgaggagcctagcacccagtaccttcacatcactgaagccgaggaagacgttcagggcacacaagctgctgttgcagctctacaggatttgcgttacacaagcgagtctggcgacagattggacccaacagcagtaaacatcctgcagcagattattgagttgggagctgagacccatgacgctaccgccctcgcctccgtcgtggcaatggctcccggaactgttaccgtggtcaagcaggtgaccgaagaggaaccttcctcaaaccatactgtgatgatccaggagacagtgcagcaggccagtgttgagcttgctgagcaacaccacctggtggtcagctcagacgacgtggaaggaattgagactgtcaccgtgtacacccaaggtggggaagcatctgaattcattgtctacgttcaagaagccatgcaaccagtggaggaacaagcagtcgagcaacctgctcaagagctttag

SEQ ID NO: 29113 - DNA, 2274 bp, Artificial Sequence
  Description of Artificial Sequence: Synthetic coding sequence
atggcgctcggcgaagagaaggctgaagcggaagcttccgaggacactaaagcacagtcttacgggagaggttcctgtagggagagagagcttgacatcccaggcccaatgtccggcgagcagcctccacgcctcgaggctgagggaggactgatctcgcccgtttggggcgctgagggtatccccgctccaacttgttggatcgggacagaccccggaggtcctagtcgagcccatcagccccaagccagcgacgccaacagagagccagtggccgaaaggtcggaacctgctctgtcagggctacctcctgccaccatgggcagcggggacttactgttgtcaggggagtctcaagtagaaaaaacgaaattatcctcatcagaggagttcccccaaacccttagtctccccagaacgacaacgatctgcagcggtcatgatgctgatactgaggacgaccccagcctcgctgacctcccacaggctttagacctgtcacagcagcctcatagttccgggctgtcatgcctaagtcagtggaaaagtgttctgagtcctggcagcgccgctcagccgtcatcttgcagcatatcagccagctcaactgggtcttccctgcagggccaccaggagagggcggagccacgcggaggttccctagctaaggtgagttcttcgctggagcccgtggtgccacaggagccctcatcagttgttggcttaggcccaagaccccagtggtctcctcaaccagtattcagcggtggggacgccagcggactgggacgcaggcggttgtcttttcaagccgagtactgggcgtgtgtccttcccgacagtttacctccatcccccgataggcacagccccctttggaaccccaacaaagaatacgaggacctactggattacacttacccacttcggcctggccctcagctgcctaaacacttggatagcagggtgccggcagaccccgtcctgcaagactccggcgtggatctggatagtttttcagtctccccggctagtaccttgaaatcacctacgaacgtatcccccaactgtccacccgctgaggcgaccgcgctgccgtttagcggcccaagagagccctctctaaagcaatggccatcacgggttccccaaaagcaggggggaatgggacttgcgtcctggagccaactggcgtcaacaccgcgagccccagggagtcgcgacgcacggtgggagaggagggagcccgcacttcgcggagccaaggatcggctgacgattggcaagcatctcgatatgggctcaccgcagctccggacaagagatagaggttggccatcccctcggcctgaaagggagaaacgcacaagtcagtctgccagacgtcccacctgcacagaatccaggtggaaatcagaggaagaagttgagtcggatgacgagtacctcgctcttccagctcggctaactcaagtttcctctctggttagctatctaggaagtattagtacactcgttacactcccgaccggagatatcaaaggacagtcgccccttgaggtgtccgattccgatggaccagcttcatttcccagttcaagctctcagtcacagcttcccccaggcgctgcactgcagggaagtggggacccagagggccagaacccttgcttcctaagatccttcgttcgggcacatgacagtgccggtgaggggtctctcggatcgtcgcaggcactgggggtgtcctcaggactgttaaaaaccaggcctagcttgccagcccgtctcgatcgctggccattttcagacccagacgtggagggacagctaccaagaaaagggggtgagcagggaaaggagagccttgtccagtgtgtgaagacgttttgttgtcaacttgaggaactgatctgttggctctacaatgtagcggacgtcaccgatcacggaaccgcagctagatcgaatctgactagtttaaagtcctccttgcagctgtatcggcagttcaagaaggacattgacgagcaccaaagcctcaccgaatccgttctgcaaaagggcgagattctgttacagtgccttctggagaatactccagtgctggaagatgtcctaggtcgcatcgccaagcagagcggggaactggaaagccacgctgatagactatacgacagtattcttgcctcactggacatgcttgctgggtgcacacttatcccagataagaaaccaatggccgcaatggaacacccctgcgagggcgtctag

SEQ ID NO: 29114 - DNA, 540 bp, Artificial Sequence
  Description of Artificial Sequence: Synthetic coding sequence
atgaatcccagcatgaagcagaagcaggaagagattaaggaaaacatcaagaatagttccgtacccagacgtacccttaaaatgatccagccatctgcttccggatctctggttgggagggagaacgagttaagtgccggtctgagcaaaagaaagcatagaaacgatcacttgaccagcacaacttcttcccccggagtgatagtgccagagtccagcgaaaacaaaaatctggggggagtgacacaggaatcattcgacctgatgataaaagaaaacccttctagtcagtactggaaggaggtggccgagaagcgcaggaaggcattatatgaagctttgaaggagaatgagaagctccacaaagaaatagaacaaaaagataatgaaattgcaagactcaagaaagaaaacaaggaactggccgaggtggcagaacatgtgcaatacatggccgaactgattgaacgattaaacggtgagccactcgataactttgagtcactggacaaccaggagttcgattccgaagaggagtag

SEQ ID NO: 29115 - DNA, 309 bp, Artificial Sequence
  Description of Artificial Sequence: Synthetic coding sequence
atgaacccctccatgaaacagaagcaggaagaaattaaggaaaacatcaagaactcttcagttcctagacggacactcaaaatgattcaacccagtgcatccggatcactcgtgggtcgggagaacgagttgtcagccggactctctaagcgtaagcacagaaatgaccacctgacttctaccactagctcaccaggcgtcatcgtccctgaatccagcgagaataagaacttgggcggagttactcaggagagtttcgaccttatgatcaaagagaatccttcatcccagtactggaaagaagtatag

SEQ ID NO: 29116 - DNA, 2259 bp, Artificial Sequence
  Description of Artificial Sequence: Synthetic coding sequence
atggctgagcccgcttccgtaacggttactttcgatgatgttgccttatattttagtgagcaggaatgggaaatcctggagaaatggcagaaacagatgtataagcaggagatgaaaacaaactatgagaccctggactccctgggctacgctttctccaaaccggacctgattacttggatggaacaggggcgaatgttgcttatctccgagcagggctgtctggataaaacaaggcggaccacatctccccctacagacgaacagctcaacatgaagaacacaggaaagttgctgtgcttcgatgatgagggtacccctagaaccaaagaggaagactgtcggctaaatggtccacagaagcaagacctgtgtgctgcccttcgaggtaaggaacggaaaatcttgctcgcacaaactgcgacgttccagagcccctctctgcgcgaaactgagattctgaataagaaggtgagcatcacagcctacgaccctgataagaaggatctgcgccataagcctagagaaaccccgggaagactggaaattccaacaggccctagatgctacagttgttatgtctgccgcaaggtgttccaggtgcgcagggatcttctaaagcacaagcgttctcactcgaaatcccagctttgtcggtaccccaaatataagaacagttccaggggaaagagcgaactgcgacgcacacagcgtctgttgtgccaaaagaagcgcttccagtgcagtgagtgcgagaagtcctacttcctcaaaggtagtctcgtgacgcaccaagtcgtacatacaggacagcggccttatccatgtcctgagtgcgacaagactttccgctaccgagctaatttaaaaaaacacctgtgtcttcaccgcggagagcgtcccttttgctgtggagaatgtggacgggcatttgttcagcaatgtgagctcacggaacaccttcgattgcactcaggggaaaagccattccagtgccctcaatgtgatagatgtttcaggctgaagaggggtatgaaagtccacctgactcaacattccggcaaacggccttttcactgtcccgagtgtgggcgttcttttagcagaaaggcagcactgaagacccatcagcgaacccacagcgaagagaagcccttcagctgcggagagtgtggtcggaagtttatatacaaaatcaagctggacgaacacattcgggtgcatacaggtgaaaagcccttctcctgccccgagtgcaacaagagcttccgtctgaaacgctcattaaaagctcatggactccagcacatcggcaagcggccatttcagtgtcctgagtgttctaggggctttttttggcgtaacgctatgcgcgcacaccagagattgcattcggaacagaagcccttcccgtgcgccgagtgcggtaaaagattcacaagacccagcaagttggcttgtcacacccgcgtacacgatcgccagaaggaatttccttgtggggaatgtaagaaaacattctcacaacaaagtcgcctgacacagcatctcaaggtgcacacaaccgagaagccatttagctgtgctgagtgcggcagaagtttccgcagacgcgcacatctgacagagcacacaagactccacagtggcgaagagccctttcagtgtcccgaatgtgacaaaagctttagctggaaagcgtctatgaagttccaccagaggatgcatcgagatgaaaagcccttcgcctgcggcgaatgcgataaaacgtacacacatcaatcacagctgactgagcatctgcggttacacagcggcgagaagccgtatcaatgtcccgagtgtgagaaaaccttccgattaaagggtaacctaaaatcccatctcctgcaacactctggccagaagcctttcagttgcgtgatgtgtgggaagtcattcacccaacaatatcgcctgacagagcatatccgcgtgcattccggtgagaaacctttccagtgtcctgaatgtgataaaagctactgtatccgagggagtctcaaggtccatctgtacaagcacagcggcgagcgcccatttcagtgccccgaatgtgggaagggatttttacaaaaacggagcttgaaagcccacctctgtctgcacagcggggaaagacccttcagttgcgatgaatgtggcagatcttttacatatgtaggcgctctcaaaacccacattgccgtgcacgcaaaggaaaagcccagtagtctatag

SEQ ID NO: 29117 - DNA, 1935 bp, Artificial Sequence
  Description of Artificial Sequence: Synthetic coding sequence
atgttcctaacttacatggagacagtgactaaagagttggtcagctggatgcgaggccacgagtcctctgtattcagcatttccgtccacgcctcaggaaagtatgccataactacttcctcagataccgcccagctctgggacctcgataccttccagcggaaacgaaagcttaacatccggcaaagtgtgggaattcaaaaggtcttcttcttgcccctaagtaatacgatcctgagttgcttcaaagacaactcaattttcgcctgggaatgcgacacactgttttgcaagtatcaattacctgccccacccgaatcaagctccatcctctacaaggtgtttgcagtgactcgtgacggacggattctcgctgcaggtggaaagagcaaccacctacacctgtggtgtctggaggctcgtcagctgttcaggatcattcagatgccaacaaaggtgcgggctatcaggcacctcgaattcctgcctgactcatttgacgctgggtccaatcaggttctgggcgtgctttcacaggacgggataatgcgcttcattaacatgcagacctgcaagttactgtttgagattgggagcctcgatgagggtatatctagctccgcaatttccccgcacgggagatacatagctagtattatggagaacggtagtctgaacatttatagcgttcaggcgctgactcaagaaataaataaaccacctcccccactggtgaaggtaattgaggaccttccgaagaacaagctgtcttcatcagaccttaaaatgaaagtaactagcggcagagtgcagcagccagccaagtcccgagagagtaaaatgcagacaagaattttgaagcaggacttgaccggggacttcgagtcaaagaaaaatgaactccccgacggtctgaataaaaagagactccagatcttgctgaaaggatacggcgagtatccaaccaaataccggatgtttatctggcggtccctcctccagttacctgagaaccacaccgctttctcaacacttatcgacaagggcacccacgtggcattcctgaatctacagaagaagtatcctattaaaagcagaaagctgctgcgcgtgctgcagagaacactcagtgctctagcccactggtcagttattttcagcgataccccctatctgcctctactggcgttcccttttgttaagcttttccagaacaatcagctaatctgcttcgaggtgatcgctacactgatcatcaactggtgccagcattggttcgaatattttcctaacccacctatcaatatcctgagtatgatcgagaatgtgttggccttccatgacaaggagctgctccagcacttcattgaccacgacataacatcccagctctacgcctggcctctcctggagactgtgttcagcgaagtgcttacaagagaggaatggctgaagctgttcgataacatcttctccaatcacccctcctttcttctgatgaccgtggttgcttataacatctgttctcggacccccctcctgagttgcaacctaaaggacgactttgaatttttctttcaccatcgtaacaacctggatatcaacgtagtgattcgacaggtctatcacctgatggaaacaacaccaactgatatccatccagacagtatgctcaatgtatttgtcgccctaaccaaaggccagtacccagtcttcaatcagtatccaaaatttatagttgattaccaaacacaggaaagagagcgtatccgtaacgatgagctcgattatctgagggaaaggcaactaaagatttgtaaactcaaatctaccagcaaggagctgaaaatgaaattaggcacacgaaaccgctcttgcttcgtcaaattgaagaagcaggaggagaaatgtagttacaagaggcgccgaaagtag

SEQ ID NO: 29118 - DNA, 735 bp, Artificial Sequence
  Description of Artificial Sequence: Synthetic coding sequence
atgccgcacaaaataggttttgtcgtggtgtcgtcctctggtcatgaagacgggttctcagccagggagcttatgatccatgcccctaccgtgagtggatggaggagcccaagattctgtcaattccctcaggaaattgtgttgcagatggtagaacgttgtcgcattcgcaaactccaacttctcgctcatcaatatatgattagctccaagattgagttctacatttcagaatcgttgccagaatacttcgcaccttaccaagccgaacggttcaggaggctgggttatgttagcctctgtgacaatgagaaaaccggatgtaaggcgcgagaactgaagagcgtgtacgtcgacgcagtcggccagtttctgaagctgatttttcaccagaatcacgtgaacaagtataatatttataaccaggtggcacttgttgcaataaacattatcggagaccccgcagattttagcgacgagtcaaacaccgcatctagggaaaagctcatcgatcattaccttggccacaatagcgaagaccccgctttggaaggcacctatgcgagcagcgtccggactggtggcgagtctaccttcggggaactgaaggggcctgccgttccatcatccgtgacactgagcgtgctgggaacatcgctcggccagtggttcccgtgtcacctccctgctgtggacgataatgagggtacaccattccagagatgtctcgtgtag

SEQ ID NO: 29119 - DNA, 2778 bp, Artificial Sequence
  Description of Artificial Sequence: Synthetic coding sequence
atgccccataaaatcggttttgttgtggttagcagctccgggcatgaggacgggttcagtgcgagggagcttatgattcatgctccgactgtgtcgggctggcgctcgcctaggttctgccaatttccccaagagatcgtactgcaaatggttgagcgatgtcggataagaaagttgcagctcctggcacaccagtacatgatctcttctaagattgagttttacattagtgaaagcctgcccgaatacttcgcaccttaccaagctgaaaggtttcgacgactcggatatgtgtcactgtgtgacaatgaaaagactggctgtaaggccagggaactgaagagcgtatatgttgacgctgtggggcagttcctgaagctgatctttcatcagaaccacgtgaacaagtataatatttataatcaagtcgcccttgtggccataaacataatcggcgatccagccgacttcagcgacgagtccaacactgcgtcgcgggagaaattgattgatcactatttaggccacaattctgaggaccctgccttagaggggacctacgcaagaaaaagtgactacatcagtccccttgacgatcttgctttcgacatgtaccaagaccctgaggtagctcagatcattcggaagcttgatgagcgaaaaagggaggccgttcaaaaagagcggtatgattatgccaaaaagctgaagcaggcaatcgctgatctccaaaaagtcggagaaaggctgggcagatatgaagtcgagaagaggtgcgctgtggagaaggaggactacgacctggccaaggagaaaaagcaacagatggaacagtatcgagccgaggtgtacgagcagttggagttacactccttgctggatgctgaacttatgcgacggccattcgatcttcctctacagcccctggccagatctggctcaccttgccatcagaagccaatgccctctctaccccagctagaagaacgcggtacagaaaaccagtttgcggaaccctttctacaagaaaagcctagtagctattctctaaccatttccccccagcatagcgcggtggatccacttctgcccgcaaccgatccgcacccaaagatcaatgccgagagtcttccctacgatgagcgccctttgccggctataagaaagcactacggggaggccgttgtggagccagaaatgagcaatgccgacatttcggacgccaggcgcggagggatgcttggtgaacctgagcctttaacagagaaggcactcagggaagcttcatcggccatcgatgtcctgggcgagacacttgtagccgaggcttattgcaaaacttggagctatcgggaggatgcactcctggcactaagtaagaaacttatggagatgcccgtgggcactcccaaagaagatctgaaaaacacactgcgagcttccgtctttctcgtgcgcagggcaataaaggatattgtgacctcagtgttccaggcttcactcaaactcctgaaaatgattattactcaatacatcccaaaacataaactcagtaagctggaaaccgcacactgtgttgaaagaacaatccctgtgttgctgacaaggacaggagactcaagcgctcgacttagggtaaccgcagctaattttattcaggagatggctctgttcaaggaagtcaagtctttgcagatcattccttcatacctcgtgcaaccactaaaagccaattccagcgtgcacttggcgatgtcacagatgggactgttagctcgcctactgaaagaccttggaacgggtagcagcggcttcaccattgataacgttatgaaattttcagtttccgctctagagcatcgcgtgtatgaggtgagagagacagccgtgcgcattatactcgacatgtatcgccagcaccaagcctctattctcgagtatttgccccctgacgacagcaacactcgaaggaacatcctttataaaacgatctttgaaggctttgccaagatcgacggccgtgccacggacgccgaaatgcgcgctagaaggaaagccgcaacagaggaggctgaaaaacaaaaaaaggaggagatcaaggccctccaggggcaactggccgctctcaaggaaatccaggccgaagtacaagagaaggaatccgacgccgtaaagcctaagaatcaggacattcaaggcggtaaggccgctcccgctgaggctctgggcatcccagatgagcactacctggataatctgtgcatattctgtggtgagcgatctgaatcctttactgaagaaggactggacctgcattattggaagcactgtcttatgctcactaggtgcgatcactgcaaacaggtggtcgagatctcctccttaaccgagcacctgctgacggagtgcgacaagaaagacggatttgggaagtgttataggtgcagtgaagccgtctttaaggaagagctgccacggcatattaagcataaagactgcaatccagcaaaacccgagaaattggcgaaccggtgtcctctttgtcatgagaatttctctcccggtgaagaggcatggaaggcccacctgatggggcctgcaggttgtacgatgaatctcagaaagacccacattctgcagaaggctcccgctttgcagccaggaaaatctagcgctgtggcagcaagcggccctctaggcagtaaggcaggaagcaagatacccactcctaaggggggactgtccaaatcctcatccaggacttacgccaagcggtag

SEQ ID NO: 29120 - DNA, 2145 bp, Artificial Sequence
  Description of Artificial Sequence: Synthetic coding sequence
atggcaagagcgggttcatgtgggggagctgccgctggcgctggcagacctgagccttgggagctcagcctcgaggaggttttaaaggcctatgaacagccactgaacgaggaacaagcttgggccgtttgcttccagggatgtcggggactgcgcggttcccccggacgtaggctgcgcgataccggggacctgctactgagaggggatggatctgtgggcgcaagagagccagaagcagccgaacctgccaccatggttgtgccactcgcctcatccgaagctcagacagtacagagcctgggatttgcaatctaccgagctcttgattggggcctggacgagagtgaggagcgcgagctttctccgcagctagaacggctcatagatctgatggccaataatgactccgaggattcaggctgtggagccgcagatgaggggtacggtggcccagaagaggaagaagaagcagagggtgttcccagaagcgtgaggacatttgcccaggctatgagactgtgtgccgctagactcaccgacccacgtggtgcgcaggctcattaccaggcagtgtgtcgggctctgttcgttgaaacactagagcttcgcgcatttctggctagagttagagaagccaaggagatgctgcagaaactgagagaggacgaacctcacctggaaaccccaagggcagagcttgacagcctggggcataccgattgggcccgactctgggtccagctgatgagagaactgagaagaggtgtcaaactgaagaaggtgcaggagcaagaatttaaccctctgccgacagagtttcaattgacgcccttcgaaatgctaatgcaggacatccgcgctaggaattacaagttgagaaaggtaatggtggatggcgacattcctcctcgggtgaagaaagatgcgcacgaacttatcctggatttcatccggagtcgcccaccattgaagcaggtttccgagaggcgcttgcgtccactcccgcctaagcaaaggagcctgcacgagaagatccttgaggagatcaagcaagagaggagattgcgcccagtccgcggagagggctgggccgctcgtgggtttggcagcttaccatgcattctcaatgcttgttcaggggacgctaaaagcacttcttgtatcaatcttagtgtcacagatgctgggggatccgcacagcgacccaggccaagagtccttttgaaggcccctaccctggctgagatggaggaaatgaatacatccgaggaggaagaatcaccatgtggagaggtcactttgaaaagggacagaagcttctcagaacatgacctggctcagctcagaagcgaagtggctagcggactacagtctgccacgcatcctccaggcggaacagaaccacccagacccagagccggttccgcacatgtctggcggcctgggagtagagaccagggcacctgccccgcttctgtctcagacccttcacaccccctgctgtccaatagggggtcatctggggaccgacctgaggcatcgatgaccccagacgcaaaacatttgtggcttgaattcagccatcccgttgagagcctggcccttacggtcgaggaggttatggatgttcgtagggtgctcgttaaggccgaaatggagaagtttctgcagaacaaagaactgttcagcagcctgaagaagggtaaaatctgctgttgttgccgggcaaagtttccgttattttcatggcctcccagctgccttttttgtaagcgtgctgtctgcacatcctgttcaataaagatgaagatgccatccaagaagtttggacacatccccgtttacacgctgggctttgaatcaccccagcgagtttccgccgcaaagacagccccaatccagaggagagacatttttcagtcattacaaggccctcagtggcaatctgtagaggaggcttttccacatatttattcacatggatgtgttctcaaagatgtttgcagtgaatgcacgtcatttgtggccgacgtggtacgctctagccgtaagagcgtggacgtgctcaatacaacaccccgacggtcccgccaaacccaaagcttgtacatccccaataccaggactctggattttaagtag

SEQ ID NO: 29121 - DNA, 1308 bp, Artificial Sequence
  Description of Artificial Sequence: Synthetic coding sequence
atgaatttttcagaagtattcaagttgagttccctcctttgcaaattctcccccgatggtaaatatttagcctcttgcgtgcagtataggctagtcgtccgcgacgtcaataccctccagattctccagttgtacacctgcctggaccagatccaacacatagagtggtccgccgactccctgttcatcctctgtgcgatgtacaaaagagggctggtccaggtgtggtcccttgagcagcccgagtggcattgcaaaatcgacgagggctccgccggacttgtggcctcctgctggagtcctgatgggcgacacatccttaacaccaccgagtttcatcttcgcattaccgtatggagcctgtgtacgaaaagcgtgtcctatattaagtacccgaaggcctgccttcagggtatcacctttacaagggacgggagatatatggcactggccgagcggagagactgtaaagattacgtgtctattttcgtgtgcagtgactggcagctcctgagacatttcgacacagacacacaggatctcactggtatcgagtgggcccctaatggttgtgtgcttgctgtatgggacacttgcctggagtacaaaatactcctttactccctagatggcagactgctgagcacatatagtgcctatgagtggtcccttggaattaaaagcgtggcatggagccccagctcacagtttttagcggttggcagctatgatggtaaagttcgaatactgaatcatgtaacgtggaagatgatcacagaattcggccaccctgccgctataaatgatcctaaaattgtggtttacaaggaggctgagaagtctcctcaactgggactgggatgcctgtccttccccccacctcgtgccggagccggacccttgccaagttctgagagcaaatacgagattgcttctgtgcccgtgagtctgcaaacacttaaaccggttacagatcgcgcaaatcccaaaattggcattggaatgctggccttctcacccgactcctattttcttgctactcggaacgacaacataccgaatgccgtgtgggtttgggatatccagaaattacggcttttcgctgtgctggagcagctaagccccgtgcgggcattccagtgggatcctcagcaaccgagacttgcaatctgcactgggggatcaaggctgtacctgtggtctccagctggatgtatgtctgttcaggttccaggggaaggcaaacacattccagaagctacggatgtcgccgctctcctgtgcgcagtgtggcatcacactgggtag

SEQ ID NO: 29122 - DNA, 819 bp, Artificial Sequence
  Description of Artificial Sequence: Synthetic coding sequence
atgctccagttgcgcgactcggttgacagcgcaggaacaagccctacagccgtactggctgcaggcgaggaggttggcgcaggaggtgggcctgggggtgggcgtcccggagcaggaactcctctccgacaaaccctgtggcccttaagtatccatgatcccacgcggagggcaagggtgaaggagtatttcgtgtttaggccaggcagcattgagcaggccgtggaagagatccgtgttgtggtacggccagtagaggatggtgagatacagggtgtgtggctactgacagaggtcgaccattggaataacgaaaaggagagactggttctcgtgacagaacagtctctgctgatttgcaaatacgactttattagcctccaatgccagcaggtcgttcgaatcgcccttaacgcagtcgataccatttcatatggtgaatttcaattcccgcctaagtcattaaacaagagggagggcttcggaatccggattcagtgggacaagcagtccagaccgagcttcatcaaccgttggaacccttggagcacaaatgttccttacgcaacgtttacagagcacccaatggctggggcagatgagaaaaccgcctctctgtgccagctggaatccttcaaagcccttctcatacaagcggttaagaaagctcagaaagaatcccctctaccgggtcaggctaacggggtgctcattctcgagcgcccactcctaattgaaacctatgttggattgatgtcgttcattaataacgaggcaaagctgggctactccatgacacgtggcaagatcggattctag

SEQ ID NO: 29123 - DNA, 870 bp, Artificial Sequence
  Description of Artificial Sequence: Synthetic coding sequence
atgtggccgtttccctctaggagtctttttccccctcctactcaggcttggttgcagactgtctcttcagacccagaggcccagggctggggcgcatggaatgagaccaaggagattttagggcctgaaggaggtgaaggcaaagaggaaaaagaggaggaggaagatgccgaggaagatcaggacggtgacgccggattcctactatctctgctggaacaggaaaatctggccgagtgtcccctgcctgatcaagagctggaggctatcaagatgaaagtgtgtgccatggagcaggcagaggggacacccaggccccctggtgtgcagcagcaagccgaagaggaggaagggacagccgcagggcagctgctaagcccagaaaccgtcgggtgtccactgtctggcactcccgaagagaaggtggaggcagatcatcgctcagtgtacgtgggcaatgtggactacggcggttcggcagaagagctggaagctcacttttcacggtgtggcgaagtgcatagagttacaatcctgtgtgacaagttcagtggccaccccaaagggtatgcctatatagaatttgctactaagggatcagtacaggctgctgtcgagctggatcagtccctgttcagaggaagagtcatcaaggtgcttcctaagcgaaccaatttcccaggaatcagctctacagaccgcggtggcctgagaggccaccctggaagtagaggcgcacctttcccccactccggactgcagggcaggcccaggctacgcccacaggggcagaataggactccggctgccttgacgccactctgggcaaggccgctgccctgggtggtggtgagccacgtcatcaagtag

SEQ ID NO: 29124 - DNA, 1266 bp, Artificial Sequence
  Description of Artificial Sequence: Synthetic coding sequence
atgtttgagattcttactagcgagttcagctaccagcacagtttaagtattctggttgaggaattcctgcagagtaaggaactgcgagccaccgtaacccagatggagcaccaccacctattcagcaatattcttgatgttctgggcgcatcccaaagatttttcgaagacctggagcagagacacaaggcccaggtgttggtggaggacatttctgacatactggaagagcacgccgagaaacatttccatccttatatcgcttattgtagcaatgaagtataccaacagcgcaccctgcagaagctgattagttctaatgcagctttcagggaggctttgcgggagatcgagcgtcggcctgcttgcggcggactgccgatgctatccttccttattttacccatgcaacgcgtaacgagactgccactcctgatggacaccttgtgtctgaaaacgcagggccattctgaaaggtataaggccgcatccagagcactgaaggccatatccaagctcgttcgccagtgtaatgaaggggcacaccgaatggaacgtatggaacaaatgtacactctgcatactcagctcgacttctccaaagtcaagagcttgccactaatatcggcctccagatggctgctgaagcggggagaattatttttggtggaggaaaccgggctgtttcgcaagattgctagccgacctacttgttacctgtttttgttcaatgacgtgctggttgttaccaaaaagaagagtgaggaatcatacatggttcaggactacgctcagatgaaccacatccaggtggagaagattgaacctagtgagctgccacttcccggagggggaaaccggtccagtagcgttccccatcccttccaagtaacactgctcaggaatagcgaaggcagacaagaacaactcctgttgtcttcggactctgcctctgacagggccagatggatagtagctctgacccatagcgaaagacagtggcagggtctttcgagtaagggggacttaccacaagtggaaatcaccaaggcctttttcgctaaacaggccgacgaggtgacgctccaacaagcggatgtcgtgctggttctccagcaagaagacggatggctttacggcgaaagactaagggatggggagaccggatggtttcctgaggattttgcgaggtttattacctcaagggtggcagtggaaggcaatgttagaaggatggagcgattacgcgttgaaaccgacgtgtag

SEQ ID NO: 29125 - DNA, 1266 bp, Artificial Sequence
  Description of Artificial Sequence: Synthetic coding sequence
atgtttgagatcctgactagtgagttctcttaccagcactccctgagcatccttgtggaagaatttctgcaatctaaagagctcagagccacagtcacccaaatggagcatcatcatctgtttagcaacatcttggatgtgctgggggcatcacagcgatttttcgaggacctcgagcagcggcataaggctcaggtccttgtagaggacatttccgatattcttgaggaacacgccgaaaagcatttccacccttatatcgcttattgcagtaacgaagtttaccagcagcgcaccctccagaaactgatatcatctaacgcagcttttcgagaagctctccgagagatcgaaagaagacctgcgtgcggcggacttccaatgctctccttcctgatcctcccaatgcagcgggtcactaggctcccacttttgatggacacactctgtttgaaaacgcaggggcactccgaaaggtataaggccgcatcaagggctctcaaagcgatctcaaagctggtgagacagtgcaacgagggtgcacaccgcatggagcgcatggagcaaatgtacaccctccatacacaactggacttcagtaaggtgaagagtttgccactgatctctgctagccgctggttgctcaaaagaggggagcttttcctggtcgaagagaccgggctgtttcgtaaaattgcctccaggcctacctgctatcttttccttttcaacgacgttcttgtggtcaccaagaagaagagcgaagagtcatatatggttcaagactatgcgcaaatgaaccacatccaggtggagaagattgaaccaagcgagttgcccctgcctggcggtgggaacaggagcagctcagtgccgcacccatttcaagtaaccctcctgcgcaactcagaaggaagacaggagcagctgctgctttctagtgattccgcttctgatcgcgcacgctggatcgtggcgctgacccactctgaaagacaatggcagggattgtcatcgaagggggacctgcctcaggtggagattaccaaggcgtttttcgccaagcaggccgacgaggtaaccttgcaacaggccgatgtcgtgctggtactgcagcaagaagatgggtggctttacggcgaaagactgagggacggagaaacgggatggttcccagaagacttcgcgagatttatcacttcacgggtcgccgtagagggtaacgtccgccgaatggaaaggctccgcgttgaaacagacgtgtag

SEQ ID NO: 29126 - DNA, 2130 bp, Artificial Sequence
  Description of Artificial Sequence: Synthetic coding sequence
atggctcagagacattccgatagtagcctggaagagaaacttctgggccacaggttccacagtgaactgagacttgatgccggaggaaaccccgctagtggactcccaatggttaggggctctcccagagtacgggatgatgcggctttccagccacaggtgcctgctcctcctcagcctcgacctcctgggcacgaggaaccgtggccaatagtcttgtccaccgaatccccagcagccctcaagctgggcacccaacagctcattcccaagtctctagctgtggcttctaaggccaagactcccgcacgccatcagtcatttggcgcagcggtcctttcgagggaagcagctcgacgcgaccccaaactactcccagccccttcgttttcactggacgacatggatgtggacaaagatcctggtggcatgctcagaaggaacttgaggaaccagagttacagagctgcgatgaaaggattaggtaagccagggggtcagggcgacgcgatacaactatcacccaaactgcaggcattagcagaggagccgtcccaaccccacactcggagccccgctaaaaataaaaagacactaggaaggaaacggggtcacaaggggtcgttcaaagacgacccccagctctaccaagagattcaagaacgaggcttgaataccagccaggagtctgatgatgacatcctcgacgaatcttcaagcccagaagggacacagaaagtggatgccacgattgtggtgaagtcctaccgcccagcccaggtgacctggtcgcagctacctgaagtggtcgagctaggtatcctggaccagctgagtactgaggaaaggaagcgacaggaggctatgttcgaaattctcacatctgagttctcatatcagcactccctgagcattttggtggaagaattcctacaaagcaaagagctccgcgctactgtaacacaaatggaacatcatcacctcttttcaaacatcttggacgttctgggggcatcccagagattctttgaggatttagaacaacgtcacaaggcccaggtgctggtggaggatattagcgatatactagaggagcacgctgagaagcacttccacccatacattgcgtactgctccaacgaagtgtaccagcagagaacgctccagaaacttataagcagcaatgccgcattcagggaagctctgcgggaaatcgagcggcgaccagcctgcggtgggttgccgatgttgtcttttctcattctgcccatgcagcgtgtgacaagattgcccttgctaatggatacactgtgcctgaaaacacagggccattctgagcgctacaaggctgcctctagggcactaaaagcaattagtaagctggttcgccagtgcaatgaaggggcacatcgcatggagcgcatggagcaaatgtacacccttcatacgcaactggacttctccaaggtgaaatccctcccactgataagcgccagcaggtggctccttaaacgaggagagctctttctggtggaagagacaggattgttcagaaagattgcgtcgcgccctacctgttatctgttcctcttcaatgatgttctcgtggtaactaagaagaaaagtgaagagagctatatggtgcaggactacgcacagatgaatcacatacaagtcgagaaaatagaaccttcagagctgccgctgcccggaggtggcaatcgctcctcaagtgttcctcatccatttcaggtgacactgttgcggaacagcgaggggcgacaagagcagttgctgttgagcagcgattctgcctctgaccgcgctcgatggatagtggctttgacccacagcgagagacagtggcaggggctctccagtaagggggatctgccacaggtcgagatcacaaaggcctttttcgctaagcaggctgacgaggtgactctgcagcaggcagacgtagtgctcgttctgcagcaggaggacgggtggttatacggggagcggttgcgcgacggagagaccggatggtttcctgaggattttgcccgattcatcacatccagggtcgccgttgagggaaatgtgagaagaatggaacgcttgagggtggaaaccgatgtttag

SEQ ID NO: 29127 - DNA, 1287 bp, Artificial Sequence
  Description of Artificial Sequence: Synthetic coding sequence
atggtgtggcaggtattggagggattgagccaggacagtgctaaacgactccgatttgttgcgggtgtgatttttgtggacgagggagcggcttgcggacagtctttagaggaacgcagtaagacactcgccgaagtaaagcccattctgcaggccactggttttccctggcacgtcgtggcactggaagaagttttctctttgccgccatcagtgctctggtgctccgcccaagagctcgttggcagcgaaggcgcttacaaggctgccgtcgactcattcctgcagcagcaacatgtgctaggagctggcggaggccctggtccaactcagggagaagagcaacccccacaacctcctttggacccacagaatcttgctcggcctcctgccccagcgcagacagaggctttgtctcagctgttctgttcagttcggactctgactgcaaaggaagagctgctgcagactctgcgtacccacctgattctccacatggccagagcccatggctattccaaggtgatgaccggcgactcctgcactcgactagcaattaaactaatgactaacctggccttaggccgtggtgcgtttctcgcgtgggacaccgggttctctgatgagaggcatggggacgttgtggtggtcagacctatgagagaccataccctcaaggaagtggctttttataataggttatttagtgtaccatccgtgttcacacctgctgtcgacacaaaagcccctgagaaggcctccattcaccgcctcatggaggcatttattctgaggctgcaaacgcagttcccgtccacagttagcactgtctaccgcacgtctgagaagctggtcaaagggccacgggatggaccggcagccggagactcgggcccaagatgcttgttatgcatgtgtgcactggacgttgacgctgcagatagcgctacagctttcggtgctcagacctccagtaggctgtcccaaatgcagtcaccaattccacttaccgaaaccaggaccccgcctggcccatgctgcagccctggagtggggtgggctcaaaggtgcggtcagggcgcttgtagacgggaagacccacaggcatgcatcgaagagcagctctgctatagctgtcgggtaaatatgaaagatctgccatcattagatcctttaccaccctacatcctcgcagaggcacagttacgtacccagcgggcatggggactgcaggagattagggattgtctgatcgaagactccgacgacgaagcagggcagtcttag

SEQ ID NO: 29128 - DNA, 417 bp, Artificial Sequence
  Description of Artificial Sequence: Synthetic coding sequence
atgggagagcaagcagatggcaaggactctattgctagacaagtcgccccagagtcgcactggcccgaactccgcgtccttatcctagtggtgagcgcagaaaagaagctgactggatcaactgtcggaatgagagccagtgtggagacctctcccctcctgcgcttccgcgctgagagcgtggtccccgcacacggcggtgacggacccctacaccccggtgccaggttgccccagctccgacccgcagatcatgagggacagcagcccgtcccccgacacttaccaagacacttgcctccttcactgacttccatgccttcgcctggagcctcctcaacgtggtgtacagcgagtactcctactactggcacgccccgttggcgcacacctctaactagggctccaatgccctag

SEQ ID NO: 29129 - DNA, 597 bp, Artificial Sequence
  Description of Artificial Sequence: Synthetic coding sequence
atgagtaccgttgatttagcccgtgttggtgcatgtatcctcaagcacgccgtgacaggcgaggccgtggagttacgctcgctttggcgggaacatgcgtgtgtggtggctggactgaggaggttcggatgtgtggtttgtagatggatcgcacaggacctctccagcctcgcaggtctgctggaccagcacggagtgcgcctcgtgggggttggccctgaggccctagggttgcaggaattcctggatggagactattttgccggtgaactctacctggacgagagcaaacagttatataaagaattagggtttaaacggtataatagcctgtcaatcctgccggctgcactcggtaaacctgttcgggatgtcgctgctaaagccaaggcggtgggaatccagggtaacctgtctggcgacctgcttcaatctgggggtctgctcgtggtgagcaaaggaggtgacaaggttctactccactttgtccagaagagccccggagattacgtccccaaagaacatatactgcaggtgctgggtattagcgccgaggtctgtgcaagcgaccccccacaatgtgatcgggaagtttag

SEQ ID NO: 29130 - DNA, 642 bp, Artificial Sequence
  Description of Artificial Sequence: Synthetic coding sequence
tagtctcgtgaaagaggctctcgcagtgaagaaccaggcgcaggaaaccgcgaatccggcagccgtgaacctgggctggctgcggctgcaatgtctacagtcgacttggcgagagtaggggcatgcatcctgaaacatgctgttactggggaagcagtcgaacttagatccttgtggcgggagcatgcttgcgtggtggcagggctgaggcgtttcggctgcgtcgtctgtcggtggatcgcccaggatctgagttctctggctggattactggaccagcatggagttcggctggttggcgtaggaccggaggccttgggtcttcaggagttcctggatggcgattactttgcaggggagctctatctggacgagagtaagcagctgtacaaagagttaggatttaagcgttataacagcttatccatcctccccgcagccctgggcaagcctgtaagggacgtcgccgcaaaagcaaaggccgtggggattcagggaaatttatccggcgatctactgcaatctggaggtctgcttgtcgtttccaaggaggtgccaagacgcctgagaccccaaggcgcacacccagccggtccaggacatctgtgcgggggactgtgtcagagacctgcctcagtgtag

SEQ ID NO: 29131 - DNA, 2553 bp, Artificial Sequence
  Description of Artificial Sequence: Synthetic coding sequence
atggcagaagtcgaagccgttcagcttaaagaggagggaaacaggcactttcagctgcaggactacaaggctgctaccaattcgtattctcaggcactcaaactcactaaggataaggccttgttggctaccctgtatcgtaatagggccgcttgcggcctcaaaacagaatcttatgtacaggccgcttcagacgccagtcgcgcaatcgatataaattcttcagatattaaggccctctacaggcgttgtcaggcactggaacacctgggcaagcttgaccaggcatttaaggatgtgcaaaggtgcgccactctcgagccaagaaatcaaaatttccaagagatgctgcgcaggttgaacacctccatccaggagaaactccgcgtccagttcagtacagactctagggtgcaaaaaatgtttgagattttactggatgagaatagcgaagcggacaaaagagaaaaggccgcaaacaatctgatcgtactgggtcgtgaggaagcaggcgcagagaagatctttcagaacaacggagtggccttacttctccagctgctggacacaaaaaaacccgaattggtcttggcagccgtgcggacgttatctggaatgtgcagtggacatcaggcaagggcgactgtgattctgcatgccgttcgaattgaccggatctgctcactgatggccgtggaaaacgaagaaatgagtttggcagtgtgcaatcttcttcaggccataattgactcgctttcaggcgaggacaagagggaacaccgcggaaaggaggaagctctcgttctcgacaccaagaaggatttaaagcagattactagtcacctgttagatatgctcgttagcaaaaaagtgtctggacagggcagagaccaggccctgaatctgcttaataagaatgtccctcgaaaggaccttgccattcatgataatagcaggaccatttacgtggttgataatggcttaaggaagatcctaaaggtggtaggacaggtcccggacctgccaagctgtctgccactgacggataatacccggatgctcgctagtatcctgattaacaaactgtacgatgacctgcggtgcgatccagagcgcgaccattttaggaagatctgcgaagagtatatcacaggaaagttcgacccccaggacatggataaaaatcttaacgccatacaaacggtgtcaggaattttgcaggggccttttgacctgggaaaccagctactggggctgaagggggtgatggaaatgatggtggccttgtgcgggagcgagcgggagacggaccagctcgtggcagtggaagcgctcattcatgcgagcacaaaactctcccgcgcaactttcatcattacgaatggcgtctctttactaaaacaaatttacaaaacgaccaaaaacgagaaaattaaaatcagaacactggtgaccagtgacaagacaatcctctatagcgtggctacaacattggttaattgtacaaattcttacgatgtgaaggaagtcataccagaactcgtgcagctggccaagttttcaaaacaacacgtgcctgaagaacatcctaaagataagaaggattttattgacatgcgcgtcaaacgcttgctcaaagccggtgtcataagtgctttggcgtgcatggtgaaagcggactcagctatactaaccgaccagaccaaggagctcttggccagagttttccttgctctgtgcgacaatcccaaagacagaggaaccatcgttgcgcaggggggaggcaaggctctcatacctctggctctggaaggcacggacgtagggaaggtgaaggccgcacacgccctagccaagattgctgcagtgagcaatccagacattgcattcccaggggagcgggtgtatgaagttgttagaccacttgtgagactactagatacccagcgtgatggactgcagaattacgaggctcttctgggccttactaatctgagtggccgttctgacaaactgaggcagaaaatctttaaagagcgggctctgcccgacattgaaaattacatgtttgaaaatcatgatcaacttcgacaggccgcaaccgaatgcatgtgtaatatggtcctgcacaaagaggtgcaggagcgctttctagcagacgggaacgataggctgaagctggtggtgttgctctgcggggaagatgacgataaggtacagaacgccgctgccggtgctcttgcaatgctgaccgcagctcataagaagctgtgtctgaagatgacacaggtaaccacccaatggctggagattctgcagcggctttgccttcatgatcagctgtctgtgcagcaccggggtcttgtgatcgcctacaacctactcgccgcagacgcggagcttgccaagaaactcgttgaatctgagctcctcgagatcctgaccgtggtgggcaaacaggaacctgatgaaaaaaaggcagaagtagtacagacggctcgcgagtgtctgatcaagtgcatggattacggtttcatcaaaccagtgagttag

SEQ ID NO: 29132 - DNA, 552 bp, Artificial Sequence
  Description of Artificial Sequence: Synthetic coding sequence
atgatgcagatttgtgacacctataaccaaaaacattctctgttcaatgcgatgaaccggttcatcggagctgtcaacaacatggatcagactgtcatggtgcctagcctactcagggacgtgcccctggctgacccgggtctcgataacgatgtaggcgttgaggtggggggtagcggcggttgcctggaggagcgaacgcctcccgtgcctgactccgggagcgccaatggaagctttttcgctccctctagagacatgtactcccattacgtgctcctcaaatcaatcaggaatgacatcgaatggggcgtgttacatcagcctcctccccctgctggtagtgaggaagggtctgcatggaagagcaaggacattctagtggacctgggacacctggagggtgctgatgccggagaggaagatctcgagcagcagttccactaccatctcaggggcctgcacaccgtcttatctaagctgacaaggaaggccaacattctgacgaatcgctataagcaagagatcgggttcgggaactggggccactag

SEQ ID NO: 29133 - DNA, 366 bp, Artificial Sequence
  Description of Artificial Sequence: Synthetic coding sequence
atgtttaacaaatgctcttttcactccagcatttacagaccggctgctgataactcagcctcatccttatgtgcaattatctgttttttaaacctggtcatcgaatgcgatctggagaccaacagtgagataaataagcttatcatttaccttttctcccagaacaacaggataaggttctctaaactgctcctgaagatcctgttttatatcagcatttttagctatcctgagttgatgtgtgaacaatatgtcacgtttattaagcccggtattcattacggacaggtgtctaaaaagcatatcatctacagcacgtttctcagcaaaaatttcaagtttcagcttctccgcgtgtgctggtag

SEQ ID NO: 29134 - DNA, 972 bp, Artificial Sequence
  Description of Artificial Sequence: Synthetic coding sequence
atggagagtagggtggccgacgccggaacgggcgagactgctcgtgcagccggagggtctccagccgtgggctgcactacacgcggtcctgtggtgtccgcgccattaggcgctgccaggtggaagctgcttcgccaagtgctaaagcagaaacatctagatgattgcctgcggcacgttagtgtgagaaggtttgaaagcttcaacttattcagcgtcactgagggcaaggagcgggagaccgaagaggaagtgggagcgtgggtgcaatacacgagcatattctgtcctgaatactcgatcagcctgagacacaattctggatcattgaatgttgaagatgtgctcacatcattcgataataccgggaatgtatgcatatggccctcagaggaggtgttggcatactattgcctgaaacataataatatcttccgcgcattagccgtgtgtgaacttggagggggtatgacttgcctcgcaggattgatggtcgcaatatctgcggacgtcaaggaagtgctcttgacagatgggaacgaaaaggcaataaggaacgtgcaggacatcatcacccgcaatcaaaaggccggtgtgtttaagacccagaaaatatctagttgcgtcttgcgctgggataatgaaacagatgtgagccagctggaaggccactttgatattgtcatgtgcgcagactgcctttttctggatcagtaccgagctagcctggtagacgcaattaagcgattgctccagcctcgaggtaaagctatggtgtttgcaccaaggcgcggtaataccctgaaccagttttgcaatctagctgagaaggccggattctgtatacagcggcacgagaattacgacgaacacattagtaatttccactctaagctcaaaaaggagaaccctgatatatacgaagaaaaccttcactatccgttgctgctgatcttaactaagcacggttag

SEQ ID NO: 29135 - DNA, 3120 bp, Artificial Sequence
  Description of Artificial Sequence: Synthetic coding sequence
atggccgtacagctcgtgccagactctgctctgggtttgctcatgatgactgaagggaggagatgccaggtacatctactggacgatcgaaagctcgaacttctagttcagcctaagctgttggccaaagagttgttggatctcgttgcctcccattttaacttgaaggaaaaggagtacttcggcattgccttcaccgatgagactgggcatctgaattggctgcaactcgataggagagttctcgagcatgatttccccaagaagagtggacccgtggtgttatacttctgcgtgagattctacatagagagcatctcgtatctgaaggacaatgccaccatcgagttattttttctaaatgcaaagtcttgcatctacaaggaactgatcgatgtcgactctgaggtcgttttcgagctggcatcatacatcctgcaagaggccaaaggcgattttagcagcaatgaagtggttcgatctgatctgaaaaagctgcccgctctacccacacaggccctaaaggaacatccaagcctggcctattgcgaggaccgcgtcatagagcactacaaaaaactgaacggtcagacacggggacaggcaattgtcaactacatgtccatcgtggaatccctgcccacctatggcgtccactattatgcagttaaagataagcaggggattccgtggtggctgggcctcagttacaaggggatttttcagtacgactatcacgataaggtcaaaccaaggaagatttttcaatggcggcagcttgagaacctgtacttcagagagaagaagttcagtgtggaagtccatgaccccagacgtgcttcggtaaccagaaggaccttcggccattcaggcatcgctgtgcacacttggtacgcatgcccggcactgatcaaaagcatctgggccatggcaattagtcagcatcagttttatttggacagaaagcaatcaaagtccaagattcacgccgctaggtctttgtctgaaatagcgatcgatctcaccgaaactggtacactgaaaacatccaaactagcaaatatggggagtaagggcaagattattagcgggtcctcaggctctcttctgtcaagcgggagccaggaatccgatagttcccagtcagctaagaaggacatgctcgcagccctgaagagccgccaggaagctttagaggagacgctgcggcaacgattagaagagctgaaaaagctctgcctaagggaggccgagctcaccggtaagcttcctgttgagtatccgctggatcccggtgaggagccccctattgtgcgacgcagaattggcacagcgtttaaactagacgagcagaaaattctcccgaagggagaagaggctgaactggagcggcttgagcgcgaattcgccatccagtctcaaattaccgaagcagctcgtcgtttggcctcagaccccaacgtttccaaaaagctgaaaaaacagcggaagacatcatacctgaatgctctgaagaaacttcaggagatagagaatgctattaacgaaaacagaatcaagtcaggcaagaagcccacgcagcgtgcttccctgatcatcgacgacgggaatatcgcatctgaagattctagtctgagtgatgctttggtgttagaggacgaggactcacaggttaccagcaccattagtcctcttcactcacctcacaaagggctgccacctagacccccttcccacaaccgaccacctcccccacagagtctggaaggtcttcgccaaatgcactatcacaggaacgattacgacaagtctcctatcaaacctaagatgtggtcggagagttctttagatgagccatatgagaaagtcaagaaaagaagtagccactctcactccagctcccataagcgctttccttccacagggtcatgtgctgaggctggaggcggatcaaactcactgcagaacagccctattagagggctccctcattggaacagtcagtccagtatgccaagcactcccgacttgcgcgtgcgaagcccccattacgttcattcaacacgtagcgtggatatcagcccgactaggttacacagtctcgctcttcatttccggcacagatccagctcactggagagccaaggcaaactgttgggatccgaaaacgacacaggcagtcctgacttttacacccctagaaccaggagctcgaatggcagtgatcctatggacgactgcagttcgtgtacatctcattccagctccgaacactactatcccgcacagatgaatgctaattactctactctggctgaggactccccgagtaaggcaagacaaagacagagacaacgccaaagagcagctggcgcactcggttcagcctcatccgggtctatgccaaaccttgccgctcgaggaggcgcagggggtgcaggaggggctggtggcggagtctacctgcattctcagagtcagccatcttcacagtatcgtatcaaggaatacccgttatacatcgaaggaggtgccacgccagttgtggtacggtcactggagagcgatcaagaaggacactactcagtaaaggcccagtttaaaacctccaattcgtacactgccggtggcctcttcaaggagtcctggaggggtggcggaggtgacgagggggacactgggaggctaacacccagcaggagccagatcctcagaactccgtcccttggtcgagagggtgcgcatgataagggcgcaggacgggctgctgtttcagatgagttgaggcagtggtatcagcggtccacagcttctcacaaagaacactcccgcctgagccacacttccagcacctcatctgatagcggctcccagtacagcacatcctcccagtccaccttcgtggcacatagccgcgttacccggatgccacagatgtgtaaggccacctccgccgctttgccccagagccagcggtcctcaacgccttctagcgagatcggcgctacaccacccagttcaccacaccacattttaacttggcagacaggggaggccaccgagaattcccctatcctggatgggtccgaatcacccccacaccagagcactgacgagtag

SEQ ID NO: 29136 - DNA, 390 bp, Artificial Sequence
  Description of Artificial Sequence: Synthetic coding sequence
atgtacagacaacggttcctctattccctgtaccggcacacgcattgggtgagatgtgccaaattcagccccgatgggaggttgatcgtatcttgtagcgaagataaaacaatcaaaatatgggacacaactaataagcagtgcgtgaataacttctcagacagtgtcggggacctttccttactctttcatttccagaaggtggagagttacttacaccaggaggtgcaaacacacaggtcatactatggtgggttaacccttatgaactgtatagtgaaggtgctcccaaaggagatctccaaagattacatcctgatccatcaccacattttcctaatctcaacccaggaacaccacatccctatgagaaagaagctacgactgtag

SEQ ID NO: 29137 - DNA, 2178 bp, Artificial Sequence
  Description of Artificial Sequence: Synthetic coding sequence
atgcaccccgaacccagcgaacccgctaccggcggagctgctgagctggattgtgctcaggagcctggcgtcgaggaatcagccggagaccatggtagcgccggaaggggcggttgtaaggaggagatcaatgatcccaaggagatctgcgtggggtcaagcgatacatcttaccactcccaacagaaacagtccggtgacaatggctctggcggacatttcgcacatccccgtgaggatagagaggaccggggtccccgaatgaccaagtcctcactccagaaactatgtaaacaacacaaactatatatcacgccagcgctgaacgacacgctctacttgcacttcaagggcttcgaccggatcgagaacctggaggagtacacaggactcagatgcctgtggctgcaatctaatggaatccagaaaatcgagaatctagaagctcaaaccgagttacgttgtctgttcttgcaaatgaatctgctccgcaagattgaaaacctggaaccgctgcagaagctggacgcccttaacctctcaaacaactacatcaagactatagagaacctctcttgtctgccagttcttaacactctgcagatggcccataaccacctggaaactgtagaggacatccagcatctacaagagtgtttgagactatgtgtgctcgacctttcgcacaacaagctgagcgatccagagatcctatcaatactggaatctatgcctgacctgagggtgctgaacttgatgggcaatcccgtaatccgccagataccgaactataggcgtaccgtcaccgttcggcttaagcacctgacctatctcgatgatcgccctgtgtttccgaaggatcgggcttgtgccgaggcctgggcccgtgggggttacgcagcagagaaggaggagcgccagcagtgggaatcgagagaacgtaagaagatcactgacagtattgaggcacttgctatgatcaagcagcgcgctgaagaaaggaagaggcagagggagtcccaggagcgtggggagatgaccagctcagacgatggagagaatgtgccagctagcgctgaggggaaggaagaaccgcctggagaccgcgaaacgcggcaaaagatggagctgtttgtaaaagaatccttcgaggccaaggacgaactgtgcccagaaaagccgagtggggaagaaccaccggtcgaggcgaagcgtgaagatggcggaccagagccagagggaaccctgcctgctgagacactgttgttgtctagccctgttgaggtaaaaggagaggacggcgatggggaacctgaggggacattacctgcagaagcaccgcctcctcctcccccagtcgaggtgaaaggtgaagacggtgatcaggagcctgaaggaacattaccggcagagaccctgctgctcagcccgcctgtgaaggtgaaaggggaggacggggaccgcgagcccgagggcactctccccgcagaggccccaccccctcctcctctgggtgctgcccgagaggagcccaccccacaagctgtagccaccgagggagtgtttgtcaccgagctggacgggacaagaaccgaagaccttgaaacaattcgccttgaaaccaaggagacattttgcatcgatgaccttccagacctcgaggacgatgacgaaaccggaaagagtctggaggaccagaacatgtgctttcctaaaattgaggttatttcatccctcagcgatgattcggacccggagttggactacacctctctccccgtcctggaaaacctgcctacagacactctgtccaatatcttcgccgtgagcaaggacaccagcaaagcagcgagggtaccgttcaccgacatcttcaagaaggaggcgaagcgggatctggagattagaaaacaggatacaaaaagtcccaggcctctgatccaggagttgtccgacgaagacccatccggccaacttttaatgcctccaacttgtcagcgcgatgccgctccactgacctcttccggcgaccgcgactccgactttctcgcggcaagttcacctgtcccaaccgaatctgctgctaccccccctgagacctgcgtgggcgtggcccagccttcccaggccttgccaacatgggacctgaccgctttcccagccccaaaggcctcttag

SEQ ID NO: 29138 - DNA, 957 bp, Artificial Sequence
  Description of Artificial Sequence: Synthetic coding sequence
taaggaatcaatggctcagaaggtgatggtgccgaaattgctgagaagtttgtcttttttatcgggtcgaagaatgggggaaagacaacaattatcttgcgctgcttggatcgggatgaacctcccaaacctacacttgcacttgaatatacttatggaaggcgggcaaaggggcacaatacaccgaaggatattgctcacttctgggaacttgggggtggaaccagtcttctggacctaatttccattccaattactggggacacgttgcgcaccttcagcctggtgctcgtattagatttatccaagcctaacgacctctggcctacaatggagaatttgcttcaggcaactaagagtcacgtggacaaggtgattatgaaacttggtaagacaaacgccaaggccgtgtcagagatgcggcagaagatttggaataatatgccaaaagatcaccctgatcatgagctcattgacccttttccggtgcctctagtcatcattgggtctaaatatgacgtttttcaggactttgagtcggagaaacgtaaggtaatatgtaaaaccctgcgctttgtggcccactactatggtgctagcctgatgttcacttctaaaagcgaagcccttctcttgaagatccgaggcgttatcaatcagctagccttcgggatcgataaatctaaatctatctgcgtcgaccagaataaacccctgtttatcactgctggcctcgacagtttcggacagattggtagtcctcccgtcccagagaatgacattggcaaactgcacgctcactcccctatggagctgtggaagaaggtgtatgaaaaactctttccgcctaagagcatcaacaccctaaaggacattaaagatcctgccagggatccgcagtacgcagagaacgaggtcgacgagatgcgaattcaaaaggacctagtcctcagctag

SEQ ID NO: 29139 - DNA, 2559 bp, Artificial Sequence
  Description of Artificial Sequence: Synthetic coding sequence
atggaggccctgggaccgggaggcgatcgggcttcgcctgcttctagcacatcctcattggacctgtggcacctgtccatgcgtgccgactcagcatattcctcatttagcgccgcatctggagggcctgagcctagaacacagtctccaggcacagatctgctcccctatttggattgggattatgttagagtagtgtggggtggcccagggcctgccccacctgatgcagcactctgtacatctccccgaccccgaccagctgtagcagctaggtccgggcctcagcctacggaggtaccgggtacccctgggcctctcaaccggcaggctacgcccctactctatgccctcgctgccgaggcggaagcggcagcacaggcagcagaaccccctagcccaccagcctctcgcgctgcttatcgacagagactgcagggggctcagcgaagagtcttgcgggagaccagtttccagcggaaagaactgcgcatgagcctacctgcacggctacggccaaccgtccctgccaggcctcctgccactcatccccgtagtgcctctctctcacatcccggtggcgaaggtgagcctgctcggtcaagagctcccgctccaggtactgctggaagaggcccactggctaaccagcaacgaaagtggtgtttttccgagcccggtaagctagatcgtgtcgggaggggcggaggacccgcacgagaatgcttgggcgaggcctgtagcagttcaggcttaccaggcccagaacccctcgaattccagcatcctgccctcgctaaatttgaggaccacgaggtgggttggcttccagaaactcagcctcagggatccatgaacctggactccgggtcattgaaacttggcgacgcctttaggcccgcatccaggtcacgcagcgcaagcggtgaagtgctggggtcttggggaggaagtggcggtacaattcccattgtgcaagccgttcctcagggagctgaaacgccacgcccactcttccagaccaaacttagtagatttcttccacagaaggaagcagctgtgatgtaccccgcagagctcccacaatcatctccagcggatagcgagcagagagtttctgaaacttgcattgttccagcctggctcccaagccttccagacgaagtgttcctggaggaagccccactcgtgcggatgcgcagcccaccggacccacatgcctcacagggacctccggcatctgtgcacgcatctgaccagccatatggaacaggacttggacagagaacgggacaggttaccgtccctacagaatatcccctacatgagtgccctggcacagcgggagccgatgattgctggcagggggttaacggatccgtaggaatctcaaggccaacttcccatacacctactggaaccgctaatgacaacatcccaacgatcgatcctacaggcctgactaccaatccacccactgccgctgaatccgaccttctgaagcccgttccggcagacgctctggggctaagcggcaatgacaccccgggtcccagccataacacggccctggccaggggtacaggccagcctgggtcaaggcctacttggccatcacagtgcttagaggaactggtacaagaactcgcgcgactcgatccttcactctgcgaccccctggcttctcaaccaagccctgaacctcctttgggattgctagatggcttgatccctttggctgaggtgagagctgctatgcggccagcctgtggagaggcgggagaagaggccgcttcaacattcgagcctggttcttatcaatttagtttcacccagctgctgcctgcgcctagggaggaaacaagattggagaatccggctacacaccccgtgctggatcagccttgcggccagggtctccccgctcccaataactcaattcagggtaagaaggtggagctggctgcccgtctgcagaagatgctgcaagatctgcataccgagcaggagcgactgcagggagaggcacaggcatgggcaagacggcaggcggcactggaggctgccgtgcgacaggcctgtgcacctcaggaacttgagcgattcagcagatttatggccgatctggagcgcgtactgggcctgctgctgctgctgggaagtcggctggctagagttcgcagggccctcgctcgtgcagcgagcgactcagatcctgatgaacaagcaagcctgctccagaggctgaggttgctgcagcggcaagaggaggacgccaaggaactgaaggagcacgtagctaggagagagagggctgtccgtgaagtgcttgtacgtgctctgcccgtggaggaacttagggtttattgcgctcttctggctgggaaagcggcagttctggcacaacagcgtaatctcgatgagcggattagacttttgcaggaccagttggatgcaatacgcgatgacttaggacaccacgcccctagccctagccctgcacgtcctccagggacctgcccgccagttcaaccccctttcccccttcttttaacatag

SEQ ID NO: 29140 - DNA, 1776 bp, Artificial Sequence
  Description of Artificial Sequence: Synthetic coding sequence
atggcacagggttccgtctctttcaacgacgtaacggtggacttcactcaggaagaatggcagcaccttgatcacgctcagaaaactctctatatggacgtgatgctcgagaactactgtcatctcatcagcgtcggttgccacatgacaaagcccgacgttatccttaaactcgagagaggggaggagccttggacttcttttgccggtcatacgtgccttgaagagaactggaaggccgaggacttcttggtgaagtttaaagaacaccaggagaagtactcccgctcagtcgttagcattaatcacaaaaagcttgtgaaggagaagtccaaaatttatgagaaaacattcacactggggaaaaacccagtgaatagcaagaaccttccgcctgaatacgatactcacggccgtatacttaagaatgtctctgagctcatcataagtaacctcaacccggctcgcaagagattgtcagaatataacgggtacggcaagtcactgctcagtaccaaacaagaaactactcatcctgaggtgaaatcacataatcaaagcgccagagcattctcacacaatgaagtgttgatgcagtaccagaaaactgaaacccccgcacagtcctttggatataatgattgtgaaaagagctttcttcagcgagggggactcatcacccatagcagaccttataagggcgagaatccctctgtatataacaagaagagacgagcaacaaatatcgagaagaaacatacatgcaatgagtgtggtaagagcttttgccgcaaatccgtcttaatacttcatcaaggcatccactctgaggagaaaccatatcaatgccaccagtgcggcaacgcattccggagaaaatcatatctaattgaccaccagcgaacgcatactggcgagaaaccttacgagtgtaacgattgcggcaagtccttccgacagaagaccacactgtcgctgcatcaacgcatccacactggtgagaagccctacatatgcaaagaatgcggcaaaagctttcaccaaaaagccaatctaactgtccaccagaggacacacactggggaaaaaccttacatttgcaacgaatgcggtaagtcattctcacagaagaccacactagccttacatgagaagacccacaacgaagagaagccatatatttgttccgagtgtggaaaatcctttagacagaagacgaccttggtggcacaccaacgaacccatacaggagaaaaatcttacgagtgccctcattgcggcaaggccttcagaatgaaatcgtacctcatcgatcaccaccggacccacacaggcgaaaagccttacgagtgcaacgaatgcgggaaatcattctcacagaagaccaatctcaacctccaccagcgaatacacaccggcgagaagccttacgtgtgcaacgaatgcggtaagagcttccgccaaaaagccaccctgactgtccaccaaaaaatccatactggacagaagagctatgagtgcccacaatgtggaaaggcattctcccgtaagtcatacctgatacaccatcagagaacacacacaggggagaaaccctacaagtgttcagagtgcggcaagtgctttcggcagaaaacgaacttgattgtacatcagcgcactcacactggggaaaagccatacgtgtgcaacgagtgtggaaaatcattcagctacaaaagaaatctcattgtgcaccagaggactcacaagggagaaaatatagagatgcaatag

SEQ ID NO: 29141 - DNA, 2934 bp, Artificial Sequence
  Description of Artificial Sequence: Synthetic coding sequence
atgggttggaagccaagcgaagctagaggccaatcccagtcgtttcaggccagtggactccaaccacgctctctgaaagcagcccgtagagccaccggccgtcccgatcgctcaagggctgccagacctaccatggaccccagcgcacatcggagtcgggctgcacctcccaatatggatcccgatccgcaggctggtgtgcaggtgggcatgagagtcgttagaggtgtggactggaaatggggtcagcaggatggcggagagggaggtgttggcaccgtagttgagctaggtaggcacggtagcccctctactccagatcggaccgtagtcgtgcagtgggatcaggggacccggacaaactatagagctgggtaccagggcgcacatgatctgttattatatgacaatgcacagataggagtgaggcaccctaacataatttgtgattgctgcaagaagcatggcctccgaggtatgcggtggaagtgccgcgtctgcctcgactacgacttgtgcacccagtgttatatgcacaacaagcacgaactggcacacgccttcgatcggtacgagacagcacacagccggcctgttacgctgtcaccgaggcaggggctgccgagaatccctctgagaggaatttttcagggcgcaaaggtcgtgagaggtcccgattgggaatggggaagtcaggatggtggagaaggcaagcctgggagggtggtggacattcggggttgggacgtggagacgggccgatctgtagcatccgtgacatgggctgacggtaccaccaacgtatatcgggtggggcacaagggcaaggtagacctgaagtgtgttggagaggctgccggaggcttctactacaaagaccacctgccgcgactcggcaagccggcagaactccagagacgggtgagtgccgacagccagccattccagcatggagataaggtcaagtgcctgctcgatacagatgtcttacgagagatgcaggaaggccatggcggatggaatccacgcatggctgagcatcactcattttgggtgggagacgtggtgagggttataggcgatctggatactgtgaagcgcctgcaagcaggacatggagagtggacggacgatatggccccagctttgggtcgggttggtaaggtagtgaaggtgttcggggacggtaatctacgagtcgctgtggccggacagagatggactttctcaccctcctgtctggtcgcgtacagaccggaggaagacgcgaatttagacgtcgctgagagagcaagggagaataagtcctcactatccgtcgccctggataagctgcgggctcaaaagtctgacccagagcaccccggtcgccttgtggtcgaggtggctctgggcaacgccgctcgtgcacttgatctgcttaggagacgtcccgagcaggtggacaccaaaaaccagggtagaactgccctccaagtggctgcgtacttaggacaggtggagttaatcagattactactgcaagcgcgtgcgggtgttgacctcccagacgatgaaggaaatacagcgctgcactacgccgctctcggcaatcaaccagaagcaaccagagtgctcctgtctgcaggctgtagagcagatgcaatcaactcgacacaatctactgccctccacgtggctgtgcagagaggattcctcgaggtagttcgcgctctgtgtgagcgcggatgtgacgtgaatctgcccgatgcacatagcgacacgccactgcacagcgccatttcggccggaacaggcgcatccggaatcgtggaagttttaaccgaagttccaaatattgacgttaccgcaaccaattcccagggcttcaccttactccaccacgcttccctgaagggacatgcccttgcagtcagaaaaatactagctcgcgctcggcagctagtcgatgccaagaaagaagacggttttactgccctccacctcgccgcattaaataatcatcgtgaggttgcgcagatccttatccgtgaaggccgatgcgatgtgaacgtgaggaacaggaagcttcagagccccctacatttggctgtccagcaggctcacgtgggactggtgccactgctcgtggacgccggatgttcagtaaacgctgaagacgaggagggagacaccgctctccacgtagccctacagagacaccaactgttgccattggtcgccgatggcgcaggtggggaccccggacccttgcagctgctgtcccgtctgcaagcctcagggctcccagggtccgctgaattgaccgtcggtgccgcagttgcatgctttcttgccttagagggggctgatgtgtcgtatacaaaccatcgtggccgttcacctctggaccttgcagcagagggccgtgttctgaaggccttacagggctgtgcacagcgctttcgcgagcggcaggccggagggggtgccgctcccggacccaggcaaacactgggcactcccaacaccgtcaccaatctgcatgtgggagctgcccctggtcctgaggccgcagaatgtttggtttgttctgaattggctttactggtgttgttttcgccctgccagcatcgcacagtctgcgaagaatgcgccagaagaatgaaaaaatgcatcagatgtcaggtcgtggtgtctaagaaacttcgcccagatggaagtgaggttgcatcagccgcaccagccccaggaccacccagacagttggtcgaggaactgcagagtagatacagacaaatggaggagagaatcacttgtccgatctgcatcgatagccatatccggctcgtattccaatgcggacacggcgcatgtgccccttgcggatcagccctgagcgcctgtccaatttgccggcagccgatcagagataggatccaaattttcgtgtag

SEQ ID NO: 29142 - DNA, 2262 bp, Artificial Sequence
  Description of Artificial Sequence: Synthetic coding sequence
atggatccggatccgcaggcaggagttcaggtcggcatgcgtgtggtaaggggggttgattggaaatgggggcagcaggatgggggtgagggaggtgttggcacggtggtggagttgggaagacacggttccccttccacacccgacagaaccgtggtggtgcagtgggatcagggcacaagaacaaattaccgggcaggctatcagggcgctcatgatctcctgctctacgacaatgcccagatcggcgtacgccatcccaacattatctgtgactgctgtaagaagcatggcctccgaggaatgaggtggaagtgcagggtttgccttgattacgacctatgtacgcagtgctacatgcacaataagcacgaactagcgcatgccttcgacaggtacgagaccgcacactcacgcccagttacgctcagtccaaggcagggtctccccagaatccccctgaggggcatcttccaaggcgcaaaggtggtcagaggacctgactgggaatgggggtctcaggacggcaagccagctgagctgcaacgacgggtgagtgctgacagtcagccgtttcagcacggggacaaagtgaaatgcttgctggatacagatgtgttaagggagatgcaggaaggccatggagggtggaacccgaggatggcagaattcataggacagacaggaacagtccatcgcataaccgatagaggagatgtgagagtgcagttcaaccatgaaactagatggacttttcaccccggtgcactgacgaaacatcactccttttgggttggcgatgttgtccgcgtgataggggacctggatacggtgaagcgccttcaagctggacacggggaatggaccgatgacatggccccagccctgggcagggtaggtaaagtggtgaaggtgttcggcgacggaaacttgcgcgtggccgtcgccggtcagaggtggacattctcaccaagttgcctcgtcgcctataggcccgaagaagatgcgaacctggacgtcgccgaaagagcacgggagaataaatcctctctgtctgtggcccttgacaaacttagagcgcagaagtccgatcccgagcatccgggacgacttgtggttgaagtcgctttgggtaacgctgctcgggctctggatctgctcagaagacggccagaacaagttgacacaaagaaccagggcagaacggccctgcaggttgcagcttacctagggcaggtggagctgatccggttgcttctacaggcccgagcaggagttgacctgcctgatgacgagggaaacaccgcattgcactacgcagccctaggcaaccagccagaggcaacaagggtcctcctctcagctggctgcagggctgatgccatcaattccacccagagtacggctttgcatgtcgctgtgcagcgcggtttcctggaagttgtacgcgcactttgcgaaaggggatgcgatgttaacctgcccgatgcccatagtgacacaccgctccactctgctatctctgccggtaccggcgcatctggaatcgttgaggtcctcacggaagtgccaaatatcgatgttacagctacaaactctcagggatttactcttctgcatcatgctagtctgaaaggacacgccttagccgtgcgcaaaatactggctcgagctaggcagttagtggatgccaagaaggaagatggttttaccgctcttcatctcgccgctctcaacaaccaccgtgaggtggcacagatacttattcgcgaagggagatgcgacgtgaatgtccggaaccgtaaactgcaaagtcctctccacctcgcagtgcagcaggcccacgtcggcctggtgcccttactggtcgatgcaggttgttccgtgaatgccgaggacgaagaaggcgacacggcccttcatgtcgcactgcagcggcaccagctgctcccgctggtcgctgatggcgcaggtggggacccgggtcctctgcagcttctgagccggctccaggccagtggcctccctggctcagcggaattaaccgtgggcgctgcggtagcttgctttttggccctggaaggtgccgatgtgtcttacactaaccatcgaggacggtcccccctggatctcgcggcagaaggccgagtactgaaggcgctccagggctgcgcccagagatttagagtgagggcacaagatgaggaagtacaccaggtgccagggggaaggcagcaagagactgctccaagacgtctctag

SEQ ID NO: 29143 - DNA, 1161 bp, Artificial Sequence
  Description of Artificial Sequence: Synthetic coding sequence
atgggaaaggactattataaaatcctcggcatccccagcggcgcaaatgaagacgagataaagaaggcatatagaaagatggccctgaagtatcaccctgataagaataaggaacccaacgcagaggagaaatttaaagaaatcgctgaagcctacgacgtgttgtcagatccgaagaaacgcggactctacgatcagtatggcgaagaggggctcaagaccggaggtggtacctccggaggctcctcaggctcgttccactatacattccacggcgatccccacgcgacattcgccagcttttttggcggatctaacccttttgatatcttttttgcctcctcccgaagcacccggccattctctgggttcgaccctgatgatatggatgtggacgaggatgaagacccattcggagcgttcggcagatttggattcaatggacttagtcgcggacctcggagagctcccgagcctctctatccacgtcgaaaggtccaagacccaccagtggtgcatgagttgagggtgtctctggaggaaatctaccatgggtctacaaaacgaatgaagataacgagaagacggttgaatcccgacgggagaaccgttaggaccgaagataagatcctgcacattgtcataaagagaggttggaaggagggtaccaagattacttttccgaaggaaggagatgccaccccggataacattccagccgatatcgttttcgttcttaaagacaagcctcacgctcatttccggagagatggaaccaatgtattgtattctgcactgatctccctgaaagaggccctctgcggctgcaccgtgaacatccctactatcgatgggagggtgatcccacttccttgcaacgacgtgataaagcccggaacggttaagcgccttcggggtgagggactgcctttccctaaagttccgacccagcgcggagacctcatcgtggagtttaaggtacggtttccggaccgattgaccccacagactcgacaaatcttaaaacagcagtacccacaacacagtcttcactcgatgtgtacacagctggacgtgcactggactctagccactttctccaaaatgcagaagaaggccactggctttcaagaaaacgtgcccgtccccgaccctttctag

SEQ ID NO: 29144 - DNA, 1008 bp, Artificial Sequence
  Description of Artificial Sequence: Synthetic coding sequence
atgcttggcagtgggttcaaagccgagcgactgcgagtcaacctccgattggtcatcaatagattgaagctcttagaaaaaaaaaagaccgaactggcccagaaagcacgaaaggagatcgcggactaccttgcggctgggaaggatgagcgggctaggatccgggtcgagcatatcatacgtgaggactaccttgtggaggccatggaaatcctggagctgtactgtgacctgttactggccagattcggtctaattcagagcatgaaggagctcgattctgggctcgcagaaagcgtttccaccctgatctgggccgctcctaggctgcagtcagaggtggccgagctgaaaattgtcgcagaccagctgtgtgccaagtattccaaagagtacggaaagttatgtcggaccaatcagatcgggacagtcaatgaccgcctgatgcataagctgtctgtggaagccccaccaaagattcttgtggagagataccttattgagattgctaaaaattataatgtgccctacgagcccgactcggtggttatggccgaggctccgcctggagtggagaccgacctgatcgatgttggctttactgacgatgtcaaaaaaggtggtcccggacgtggcggatccggcggattcacagctcctgtcggcggtcctgatggaacagtacccatgccaatgcccatgcccatgcctatgccttcagctaatacccccttctcataccctcttccgaagggcccagtcgatgacatcaatgctgataaaaacatctcttctgcccagattgtcgggcctgggccaaaacctgaggcctccgcaaaactgcctagccgacccgcagataactatgacaattttgtgctgccagagctgcctagcgtgccagacactctgccaaccgcttcggcaggcgctagcacatctgccagcgaagatattgattttgacgatctgagtaggagatttgaggaactcaaaaagaaaacctag

SEQ ID NO: 29145 - DNA, 1101 bp, Artificial Sequence
  Description of Artificial Sequence: Synthetic coding sequence
atgctcggctctggttttaaagcagagagacttcgagtgaacctgcggctggtgataaacagacttaagctgttggagaagaagaagacagagttagcccaaaaagcacggaaagaaatcgccgattacctggctgccggtaaagacgagagggcaaggatacgcgtggagcacataatacgcgaggattacctggtcgaagccatggagatccttgagctctactgtgatttgcttctcgcccgattcggcttgatccagtccatgaaagaactggattcaggtctcgcagagtctgtgtctactctaatatgggccgctcctagactgcaaagcgaggttgccgagctgaaaattgtggccgatcaactctgtgccaagtacagcaaagaatacggtaaactctgcaggacaaatcagatcggaacggtaaacgacaggctgatgcacaagttgtcagtcgaagctcccccaaaaatactggtcgagaggtacttaatcgaaattgcaaagaactacaacgttccctacgagccggacagcgtcgtgatggccgaggccccaccaggggttgaaactgacctcattgatgtgggcttcaccgatgacgttaagaaggggggacccggacggggaggctcgggaggtttcaccgcccctgtgggcggacctgacggaacagtgcctatgcccatgcccatgcctatgccgatgccatcagccaacaccccattttcataccccctgcccaaaggcccaagtgactttaatggcctcccaatgggtacctaccaagcatttccaaacatccacccaccacaaatacccgctacgccaccgagttatgagagcgtggacgacataaatgccgataaaaacatcagtagtgcccagatcgtcggccctggccctaagcccgaggcttcggccaagctccctagccggccagcagataactacgataatttcgtcctcccggagttgccgtcagttcctgacacccttcctacagccagcgccggtgcctctacaagcgcttccgaggacattgattttgacgacttgtcaaggaggttcgaagagctcaaaaagaaaacctag

SEQ ID NO: 29146 - DNA, 948 bp, Artificial Sequence
  Description of Artificial Sequence: Synthetic coding sequence
atggagaagtatgaaaagcttgccaagaccggcgaaggatcgtacggggtggtctttaagtgtagaaataaaacatcaggtcaggtggtggctgtcaaaaaattcgtggaaagcgaagacgaccccgtggttaagaagatcgctctgcgtgagatccgcatgctcaagcagctcaagcatcccaatctcgtgaaccttattgaggtcttcaggaggaaacggaaaatgcacttagtctttgagtactgtgatcatacccttcttaatgagcttgagcgtaatcctaacggcgtcgccgatggtgtgattaagagcgtgctctggcagacactgcaggctctgaatttttgtcatatacacaactgtatacaccgggacatcaaaccggaaaatattcttattaccaagcaggggatcatcaagatctgtgacttcgggtttgcgcaaattcttatacctggagacgcctacacagattatgtggcaacgcgatggtacagagctcccgagctgctcgtgggtgacactcagtatggatcgagcgtggacatttgggcaattgggtgcgtctttgcggagctgcttacaggccagcccttatggcccggtaagagtgacgtggaccagctctacctgatcattcggactctgggcaaactaattccaagacaccaaagcatttttaagtcaaatgggtttttccacgggattagcattcccgaacctgaggatatggagacattagaagagaaattctcagatgtgcaccccgttgcattgaactttatgaaaggctgcttgaagatgaatcctgatgaccgcctgacatgtagccaacttttggagtcgagttatttcgattctttccaggaggcacagatcaagcggaaggccaggaacgaagggcgaaaccggcgtcgccagcaggtcctacctcttaaatcatag

SEQ ID NO: 29147 - DNA, 948 bp, Artificial Sequence
  Description of Artificial Sequence: Synthetic coding sequence
atggctaatgatccactggaagggtttcatgaggttaatctcgcctccccaaccagtcccgatctcttaggggtgtacgagagtggcacacaggaacagacgacttcccctagtgtgatctatcggccacatcctagcgcactatccagcgtgccgattcaagctaatgcccttgatgtgagcgagttgcccacacaaccagtctacagcagtccacggcgattgaactgtgcagaaatttccagtataagcttccacgtgactgaccccgctccatgctccacatccggtgtgaccgcaggccttacaaaattaacaacaagaaaggataactacaacgctgagcgggaatttttacagggagcaaccattacagaggcttgcgacggaagcgatgacattttcggtttgtccacagactccctcagccggttgcggtcccctagcgtgttagaagtgcgtgaaaagggatacgaacgactcaaggaagaactagccaaagcccagcgcgagttgaaacttaaagacgaagagtgcgaacggctgtcaaaggttcgcgatcagctggggcaagagttagaggagctcaccgcatccctgttcgaagaagcccacaaaatggtccgggaagccaacataaaacaagcaactgccgagaagcaattgaaagaagctcaagggaagatcgatgtgctgcaagcggaagttgctgcccttaagactctggttctgagttcatccccaacaagtccaacccaggaaccattgccgggaggaaaaactccctttaagaaggggcatacccgcaataagagcacatcctctgctatgtctggcagtcatcaggacctgagcgtcattcagccaatagtgaaggattgcaaggaagtgactcaccagggactgtccccactcactctacttatcctggttagcagccaccattag

SEQ ID NO: 29148 - DNA, 1074 bp, Artificial Sequence
  Description of Artificial Sequence: Synthetic coding sequence
atggctagggagaatggcgagtctagtagctcctggaagaagcaggctgaagatattaaaaagatcttcgagttcaaagagaccctcggaacaggcgcattctccgaagtggtattagctgaggagaaggccacaggaaagctgttcgccgtgaaatgcatccccaagaaagcgctcaagggcaaagagtcctccatcgagaatgagatcgccgtccttcggaaaattaaacatgagaacattgtggccctagaagacatctacgagagcccaaaccatttgtaccttgtaatgcaactggtgtcaggcggtgaactttttgatcgaatcgttgagaagggtttctacacagagaaggatgccagcactctgatccggcaggttctagacgctgtttactaccttcaccgaatggggatcgttcatcgggatctgaagccagagaacctactgtattattctcaggacgaggagtctaagatcatgattagcgactttggtcttagcaagatggagggtaagggagacgtaatgagtaccgcgtgcggcacaccaggctacgtggctcctgaagtcctcgcccagaaaccttatagcaaagcggtggattgctggagcattggcgtgatcgcatatattttgctgtgcggctaccctccattttacgacgagaatgatagtaaactgtttgagcagatactgaaggccgaatacgaattcgactcgccttattgggatgacatcagcgacagcgcaaaagatttcatcagaaacctgatggagaaggaccctaacaaaagatacacttgtgagcaggcagccagacacccctggatcgctggcgacacagccctgaacaaaaacatccacgagtcagtgtcagcgcaaatacggaaaaatttcgccaagagtaaatggcggcaggcttttaacgcaactgccgtggtgagacacatgaggaaacttcatttaggatcgagtcttgacagctccaacgcaagcgtgagctcttccctttcactggcttctcagaaagactgcgcctatgtggctaagcccgagagcctatcttag

SEQ ID NO: 29149 - DNA, 1158 bp, Artificial Sequence
  Description of Artificial Sequence: Synthetic coding sequence
atggcaagagaaaatggcgaatcatcaagtagctggaagaagcaggccgaagacatcaagaagatttttgagttcaaggaaacgcttgggaccggcgctttctcagaggtggtgctggccgaagaaaaagccaccggtaagctctttgctgtgaagtgtatccctaaaaaggctctgaaaggcaaggagagtagcattgaaaacgagattgcagtgcttagaaaaatcaagcacgagaacatcgtggcactggaggatatctacgaatccccaaatcacctttatctcgtaatgcaattagtgtcaggtggcgagctcttcgataggatcgtggaaaagggcttctacacggaaaaggacgccagtaccctgatacgccaggtgttggatgctgtctactacctgcataggatggggattgttcacagggatttgaagcccgaaaatcttctatactattcgcaggatgaggaaagcaaaattatgatcagcgactttggcctgtccaagatggaggggaagggagacgtgatgtccactgcgtgtgggaccccaggatacgtggcccctgaggtcttggcccagaaaccttactctaaagcggtcgattgctggagcataggcgtgattgcatacatcctcctgtgcgggtacccaccgttttatgacgaaaatgacagcaagctcttcgaacaaattctgaaggctgaatacgaatttgacagcccttattgggacgacatctctgacagtgcaaaagacttcataagaaacctgatggaaaaggatcctaacaaaagatacacttgtgaacaagctgccaggcatccttggatagcaggtgacacggcactgaacaagaacatccacgagtcggtgtctgcacagattcgtaagaacttcgcgaagtccaagtggcggcaggcattcaatgccacagccgtggtaaggcacatgcgcaaactgcacctgggcagctccctggactcctcaaatgcatctgtgagcagtagcctctccctggctagccaaaaggattgcttggcaccctccaccctatgcagctttatctccagcagcagcggtgtgtctggcgtcggcgctgaaaggcgccctagacccacgaccgtcacagccgttcacagcggatcaaaatag

SEQ ID NO: 29150 - DNA, 888 bp, Artificial Sequence
  Description of Artificial Sequence: Synthetic coding sequence
atgaaaaaagagcacgttctgcactgccaattcagtgcctggtaccctttcttccggggagtgaccatcaaatccgtaatcctcccactgcctcagaacgtgaaggactacttgcttgatgatggcacactggtagtgtcagggagggatgatcctcccacccactcccagcctgattccgatgacgaggctgaggaaatccagtggtctgacgatgagaacactgctaccctaacagctcccgagttcccagagtttgccactaaggtccaggaggctataaacagtctgggcggatcggtttttcccaagttaaattggagtgcccctagggatgcctactggattgctatgaacagttccttaaagtgcaagaccctgagcgacatttttctgctatttaaatccagtgacttcatcacaagggacttcacccaacctttcattcactgtactgacgattcaccggatccctgtatcgaatacgaactggtcctccggaagtggtgtgaactgatccctggggcagagttccgttgctttgtcaaggagaataaactgatcgtcgtgtttgacatttacagggactccaggggtaaggtctggctgatcgatttcaatcctttcggcgaggtgacagacagcctgttatttacttgggaagaattgatcagcgagaacaatttaaatggggacttctctgaagtggacgcccaggaacaggattcgccagcgtttcggtgcacaaatagcgaagtcactgttcagccttcaccctatctgtcttatcgcctgcctaaagactttgtagatctaagcaccggagaagacgctcacaaactgatcgacttcttgaagcttaagcggaatcagcaggaggatgactag

SEQ ID NO: 29151 - DNA, 3273 bp, Artificial Sequence
  Description of Artificial Sequence: Synthetic coding sequence
atggaacaaccaaaaggcgtggactggacagtgatcatacttacgtgccagtataaagattctgtgcaggtgttccaacgggaactagaagtgcggcagaagagggagcagatcccagcaggaacgctcctgctggcggtggaagatcctgaaaagcgggtcggcagtggtggagccactctaaatgccttgctggtggctgccgagcacctgagcgctcgcgcaggctttacttggatttgtgtaggagtcagcttgtggatacgcggttgccacccaccgggtcgattaccagaagcttcggtgcatcgcgcttttcccctgctgcaagtcgttacctctgatgtgcttcatagtgcttggatacttatcctgcacatgggccgtgacttccccttcgacgactgcggacgagcgtttacctgtctaccagtggaaaaccctgaggccccagtagaggcactggtgtgtaaccttgactgcctcctcgacattatgacttatcgcttaggtccgggaagccccccaggggtctgggtgtgttccaccgacatgctgctgtccgtgccagccaatccgggtatttcttgggactcatttcggggtgcgagagtgatagccttgccaggaagccccgcttacgctcaaaaccacggcgtctacctgaccgacccccagggcctggtgttggacatatattatcagggaaccgaggccgagattcagcggtgtgtcagaccggatggtcgcgtgccactcgtgtccggagtggtttttttttctgtcgaaactgccgagaggcttctagctacccacgtgtcaccgcctctggacgcctgcacttacctgggccttgacagtggtgccagacctgtacagcttagccttttctttgacatactgcattgcatggctgaaaacgtcacccgggaggacttcctggtgggccgtccccctgagctgggtcaaggggacgccgatgtcgccggttacctgcaaagcgcacgggcacaactctggagggaactccgtgaccagcctcttacgatggcctacgtgagctctggctcgtactcgtacatgacctcctctgctagtgagtttctgttgagcctcactttacccggtgctcctggcgctcaaattgtccactcgcaggttgaggaacaacagctgctggccgctgggagctcagttgtgtcctgcttgctggaaggccctgtccaactcgggcctggttccgtccttcagcactgccacttacagggaccaatacatattggggcaggctgtctggtgacaggtctggataccgcacattcaaaggcgttgcacggcagggagttgagagatctcgtgctccaggggcatcacacgagactccatgggtcccccggtcatgcttttaccctggtagggagactagactcctgggagcggcagggcgcaggcacctatctgaacgtcccttggtcggagttcttcaagcgcaccggcgtccgggcttgggatttgtgggaccccgagacgcttccagccgaatattgcttacccagcgcaaggctctttcccgttttacacccatcaagagaactcggtccccaggatttgctgtggatgctggaccaccaggaagacggcggagaggcactgcgcgcttggcgggcttcctggcgcctgagctgggagcagctgcagccatgtctggacagagcagcaaccctggcttctaggagagatctgttttttcgtcaggccctgcataaagccagacacgtgctggaagcacgccaagatctgtcccttcgaccactgatctgggccgctgtgagggaaggctgtccgggacctctcttagcgaccttggaccaggtagccgcaggagcaggagaccctggagttgctgcccgagcgcttgcttgcgtcgcggatgtccttggctgcatggccgaggggcgtgggggactccgcagcggtcccgctgctaacccggagtggatgcggccattttcttatctggagtgcggcgatttggcagcaggagtagaggcacttgctcaagagcgggacaagtggctttcaagacctgccctcctagtgagggccgcacgccattatgagggggcagggcagatcctcattaggcaagcagtgatgtccgcacagcactttgtttctacggaacaagttgagctgccaggacctggccaatgggtggtggcagaatgtcccgcacgcgtggacttcagtggcggatggagtgacacacctcctctggcatacgagcttgggggtgcagttctcgggctggccgtgagagtcgatggaagacgcccaattggtgccagggcaaggcgtatccctgaacccgaactgtggcttgctgtgggccctaggcaggatgaaatgactgttaagatcgtctgcagatgcctcgcagatctgagggattactgtcagccccatgcccctggtgcattgctgaaggctgcattcatttgcgccggaattgtacatgtgcactccgaactgcagttgtccactagcagtattctagccggaacggctctagctgcactgcagagggcggctggacgggtcgttggtacggaagcactgatacatgccgtgttgcatctcgagcaggtgctgacaacagggggaggatggcaggatcaggtgggaggccttatgccgggaattaaagttggtcggtcccgggctcagctacccctcaaggttgaggtggaggaagtcacagtgccagagggctttgtgcagaaactaaatgaccatctgcttctggtgtacaccggcaaaactcgcctggcaaggaacctgttgcaggacgtgcttcgatcatggtacgctcgtctgccagccgttgtgcaaaatgcccattcgttggtcagacagaccgaggaatgcgcagagggatttcgtcaggggtcccttccgctgttagggcagtgtctcacctcctattgggagcaaaagaaactcatggctccaggatgtgagcctcttacggtgagacgaatgatggatgttctggctcctcacgttcacgggcagtctctggcaggagcgggagggggagggtttttgtacttgctcactaaagagccccagcaaaaagaggctcttgaagctgttctagccaagactgaaggcttagggaattactccattcatctagttgaggtagatactcaggggctctcactcaagttactgggcacagaggcttcgacttgctgcccatttccttag

SEQ ID NO: 29152 - DNA, 318 bp, Artificial Sequence
  Description of Artificial Sequence: Synthetic coding sequence
atgcttgagctcgcgcaggataggctgcagttcgagacggtagaagttagcgagccttctatgctgcaaaaaatcttaaccacgagaaggcgcgagacagggggaaatgaaccactgcctgtgccaactctgcaacaccatctcgctcctcctgccgaagcaaggaaggtccccagtgccagtcaggtgcaggcgatcaagtgttttctatctaagtgttggagtctgaacataagtacaaaggagtacgcatatcttaaaggaactgtgctatttaaccctgggaagggcaaggagaatgactgtaatcatcattag

SEQ ID NO: 29153 - DNA, 1413 bp, Artificial Sequence
  Description of Artificial Sequence: Synthetic coding sequence
atggctggcgagaatcaccagtggcaggggtccatcctgtacaatatgttaatgagcgctaagcagacgcgcgctgccccagaagcccctgaaacccgactcgttgatcagtgttggggctgtagctgcggtgacgagcccggtgtaggccgtgagggcctgctggggggtcggaatgtggccctcctgtaccgttgctgtttctgcggtaaggaccacccacgccaggggtccatactgtacagcatgctgaccagtgccaagcagacttacgccgcaccaaaggcccctgaagccaccctgggcccttgttggggctgctcatgtgggtctgaccccggagtggggagagccggtcttccaggcggacgccctgtggccctactttatagatgttgcttttgcggggaagaccaccctcgacagggttcaatcctctactctcttctcacatccagtaagcagacgcacgtggcacccgcagctcctgaggcaagacctggcggtgcctggtgggatcgatcctacttcgctcagcggccaggtggaaaggaagctctgccgggaggacgcgcaaccgcattgctgtatcgctgctgcttctgcggagaagatcatccacagcaggggagcactctctactgcgttcccaccagcactaaccaagctcaggcagccccagaggaaagaccacgcgctccatggtgggacacctcctccggcgctttgaggccagtggctctgaagtctccccaggttgtatgtgaggccgcttctgctggattactcaagaccctgcgttttgtgaagtaccttccctgctttcaggtactgccgctagatcaacaacttgtgcttgtgcgcaactgctgggcaagccttctgatgttggagttggcccaggatagactgcagtttgaaacagtggaagtctctgagccgagcatgctgcagaaaatccttaccacaaggcgcagagagacagggggtaacgagcccttgccagtcccaacacttcagcatcatctggctcctccagccgaggcacgtaaggtgccgagcgcatcccaggtccaggccattaaatgcttcctgtccaagtgctggtcgctgaacataagcacaaaggaatacgcatacctgaagggaacagtccttttcaatccagatgttccaggtttgcaatgtgtgaaatacatccagggcctgcagtgggggacacagcagatcttgtctgaacatacaaggatgacacaccaggggccacacgatagattcattgagctgaacagtaccctattcttgctccgtttcataaacgctaatgtgattgccgaactgttcttcaggcctattataggcacagtgagtatggacgacatgatgttggagatgttgtgcaccaagatatag

SEQ ID NO: 29154 - DNA, 2028 bp, Artificial Sequence
  Description of Artificial Sequence: Synthetic coding sequence
atgctccgggcaactgccccatgctggttcccccctggctatcccgaagcgaagaaagtggcggaagaggcggcactagaggctagccgacacttggggggagagcagagtcaggccggagcccctgaaggatccaagatgctccgcgcaaccgccccttgctggttcagaccaggctaccccgaggcaaaaaaggtggccaaggaggcagcccctgaggcttcacgccacctcggggctgagcagtcccccgctggtgcgcctgaggggagcaaaatgttaagagcaactgccccatgctggtttcctcccggttatccagaagccaagaaggtggctgaggaagccgcactggaagcaccagagtttcccctgccctctcatcagccggctcagtcttttggcctttgggtcccccagatgcataagcaagccagcgccttcgtcgacatccaggcagaaccgcaaaaccgaggaccggctgtcccccctgcatggccgaagatggtgacagagtcatgctatttccctgcacagcgtggttcagcgtgccggctaccagcagctcccagattgactgagagaccatcaggcgtccgcattagtgcccctaggaagcggaaaacaattgctcactccagttctccatgccttgttaccggctacaccgacgccaagcgcacaagggtcgcttcctccagtcagcggtcccgtgggagcaaggtaggcagacaacctggtaagacacgaaatcggagtggaatggcgtgtaaaaccaccgcgacgacgtcgagtaaaagaatagtccgccgtgcctccctacccagcttgtcattaaagaagcccatcattctgaggtcaagcggctgtcaagtcccgactgtactgagacgcggttatctgcagctctttaccgaagagtgtctcaagttttgcgcatccaagcaggaggccgaggaaaaagctctgaatgaggagaaggtggcctacgactgctcaccaaacaagaatcgttacttaaacgtggtactgaatacccttaagcgtctcaagggcctaactccctcctccatgcctggcctgtccagggcagccctttactcaagacttcaagagtttctgctgacacaggatcagttgaaggaaaacggttacccattccctcacccagaaagacccggtggtgcggtcctctttaccggacagggcaaaggccctggcgattcctcatgcagagtgtgctgtagatgcggcacggaatatctcgttagctcgagtggacgatgcgtccgcgatcagctgtgctactaccattgggggcgtgttagatcctctcaagtggccggaggcagggtttcccagtatacatgctgcgcggcagcccctggaagtgtgggatgtcaggtggcaaaacagcacgtgagagatggtaggaaggagtctcttgacgggttcgttgagacctttaaaaaagaactcagtagagacgcatatccaggcatctacgctcttgactgtgaaatgtgctatacgacccacggcttggagcttactcgcgttactgttgtggatgcagatatgcgcgttgtgtacgatacctttgtgaaaccagacaatgagattgttgattacaacactcggttctccggagtgacagaagctgatgtcgcaaagaccagcatcacactgccacaagtgcaggccattctcctgtctttcttctccgctcagactatccttatcggccatagtttagaatctgacctgctagccctaaagctgattcactcaactgttgtggatacagcggttctctttccacactacctgggttttccgtacaaacgtagcttacggaatcttgcagcggattatctggcccagatcattcaagactcgcaggatgggcacaattcctccgaagatgcctcagcgtgcctccaattagtgatgtggaaagtacgacaacgggctcagattcagccgaggcataggtctgcatccccagcagccctggcatgcccttag

SEQ ID NO: 29155 - DNA, 711 bp, Artificial Sequence
  Description of Artificial Sequence: Synthetic coding sequence
atgcacactacgcagaaggatactacctacaccaaaatattcgtaggtggtctgccttaccacacgaccgatgcttcccttcggaaatatttcgaagtcttcggagaaattgaggaggccgtcgtgataactgaccgccaaacagggaaaagtcgtggctatggtttcgtaaccatggcagaccgtgccgctgccgagagggcgtgtaaagacccaaatccgattatcgatggacgtaaggccaatgttaacctggcatacctgggagcaaagccacgcatcatgcaacccggttttgctttcggagtccaacagctccatcccgcactgatccagaggccctttggaatcccagctcactacgtctacccccaggcattcgtgcagccgggagtcgtcatcccccatgtgcaaccaacggccgctgcagcctcaacaacaccctatatagattacaccggagcagcatacgctcagtacagcgccgctgctgctgccgctgcggctgctgccgcttacgatcaatacccttatgcggcttctcctgctgccgcaggttatgtgacggcaggcggttacgggtatgccgtgcaacagccaatcacagcagccgctccagggactgctgccgctgccgctgccgctgctgccgctgccgcagcatttggccagtaccaaccgcagcagctgcagaccgataggatgcagtag

SEQ ID NO: 29156 - DNA, 4389 bp, Artificial Sequence
  Description of Artificial Sequence: Synthetic coding sequence
atggccccagtccacggcgacgactctctgagtgattcgggcagctttgtctcctccagagcgcgacgcgaaaaaaaatcaaagaagggtcggcaggaggcactggagcgattgaaaaaagcaaaggccggagagaaatataagtatgaggtggaagactttacaggagtatatgaggaggtcgatgaagagcagtactcaaaactggtgcaggcgaggcaagatgatgattggatagttgacgatgacggaatcggctatgttgaggacggaagggagattttcgatgatgaccttgaggatgacgccctagatgctgacgagaagggaaaggacggaaaggcaagaaacaaggacaaaagaaatgttaaaaaactggcggtcaccaaaccaaataacattaaatcaatgtttatagcttgtgcaggaaagaaaacggcagataaggctgttgacttgtcgaaagatggcctgctgggggacatattgcaggacctcaatactgagacccctcaaattacccctccgcctgtcatgattcttaagaagaaacggagcattggtgcatcgcccaatcccttttcagtacacaccgcgaccgccgttccgtccggaaaaattgcctcccctgtatctcggaaagaacctccacttacccccgtgccattaaaacgggctgagttcgccggagacgatgtccaagtagaaagcacagaggaggagcaggagagtggagctatggagtttgaagacggagactttgatgagcctatggaggtggaagaagtggatctggaacccatggccgcaaaggcctgggataaagagagtgagccagcggaagaagtcaagcaggaagctgacagcgggaaaggtaccgtgtcttacctgggttcctttctaccagacgtgtcgtgttgggatatagatcaggagggggatagctcattctctgtccaggaagtgcaggtggactcatcgcaccttcctctcgtcaaaggggcagacgaggagcaggtgttccacttctattggcttgacgcatatgaggatcaatataatcaacctggagtggtttttctcttcggaaaggtctggattgagtccgctgaaacccacgtttcatgctgcgttatggtcaaaaatatcgagcggactctctatttcctgcctcgagagatgaaaattgacctaaatactgggaaggagacggggactcctatctctatgaaggatgtgtatgaggagttcgacgaaaaaatcgcgacgaagtacaagattatgaaattcaagtcaaagccagttgagaaaaactatgcatttgagatccccgatgtacctgagaaatccgagtatctggaggtgaaatactcagctgagatgcctcagttgccccaagatctcaagggagaaaccttcagtcacgttttcgggaccaacacctcatctctggagctttttttaatgaataggaaaattaagggaccgtgttggctggaggttaagagcccccaactgcttaaccagccggtatcttggtgtaaagtggaagccatggcactgaaaccagacctggttaacgtcatcaaagatgttagtccacctccgctcgttgttatggcattttccatgaagaccatgcagaatgccaaaaaccatcagaacgagatcattgctatggcggctctggtgcaccactcttttgcacttgataaggcggcaccaaaacctccttttcagagccatttttgcgtagtaagtaagccgaaggactgcatcttcccatacgccttcaaagaggtgattgagaagaagaacgtcaaagttgaagtagctgctaccgagcggactcttttgggctttttcctggccaaagtccacaagatagaccctgacatcatcgttgggcataatatctacggattcgagttggaagtcctcttgcagagaattaatgtctgcaaagcccctcattggagcaagatcggcagactgaaaagatctaacatgccaaaactcggaggtcgctcaggctttggagaacggaatgctacatgtggaaggatgatttgcgatgtagaaatttcagccaaagaactcatacggtgcaaaagctatcatttgtccgaactggtccagcagatactcaagactgagcgcgtcgtgatcccaatggagaacatccagaatatgtactctgaaagtagccaattgctgtacctgctggaacacacttggaaagacgctaagttcattctccagattatgtgcgaattaaacgttctccccctcgcactccagattaccaacatcgccggtaatataatgtcacggacgttgatgggtggccgttcagaacgtaacgaatttctgctgttgcacgccttctatgagaataattatatcgtgcctgacaaacagatttttcgaaaacctcagcagaaactgggagacgaggatgaagaaatcgacggcgatacgaacaaatacaaaaagggtcggaaaaaggctgcttacgccggagggttagtcctcgaccctaaagtgggtttctacgacaaatttattttgctgctggattttaatagcctctaccctagcatcatccaggaattcaacatctgtttcacaactgttcaacgcgttgcaagtgaagcccagaaagtgacagaggacggggagcaggagcagatccctgagctgccagaccccagcctggaaatgggcatcctgcctagggagataagaaaattggtcgagcgcaggaagcaggtgaaacagctcatgaagcaacaagacttaaaccccgacctcatactgcaatatgacatcagacaaaaagccctgaagctgaccgccaattctatgtacggatgtctgggtttcagctatagccggttttatgcaaagcccctcgctgcgctggtgacatacaaaggtagagagatactgatgcacactaaggaaatggtgcagaaaatgaaccttgaagtaatctacggtgataccgattctattatgattaacacaaacagtacaaacctagaggaggttttcaagctgggaaataaagtgaagtccgaggttaataagttgtacaaactgttagagattgacatcgatggggtgttcaaaagcttattactgctaaagaagaaaaagtatgctgctctggtggttgagccaacttccgacggcaattacgttactaaacaggagcttaaaggcctggatattgtgaggcgtgattggtgcgacttggcgaaagacacaggcaacttcgtgatcgggcagatcctgtcagaccagagccgggataccattgttgaaaatatccaaaaacggctgatagagataggggagaacgttctgaacgggtctgtccccgtgtcccagtttgaaatcaataaggccctcacaaaggatccccaagactatccagacaaaaaatctctgccacatgtgcatgttgccctgtggataaattctcagggtggtcgcaaggtcaaggcgggtgatacagtcagttacgtcatttgtcaagatgggtcaaacctgacagcctctcagcgggcatatgccccagaacagctgcagaagcaggataatttgactatcgacactcagtattacttagcacagcagatccatccggtggtcgctagaatctgcgagcccatcgatggcatagatgcagtgttgatagcgacctggctcggactggatcctacacaattccgggtgcaccattatcacaaagatgaagagaacgacgcgctcttagggggtccagctcagctgaccgatgaggagaaatatagagattgtgagagattcaaatgtccatgtcccacatgcggaacggagaatatctacgataacgttttcgacgggtctgggacagatatggagccttctctgtacaggtgtagcaatatagactgtaaggcgagccccctgacttttacagtgcagctttcaaataagttgattatggacattaggagatttattaaaaaatactacgatggctggctgatctgcgaggagcctacctgcagaaaccggacgagacatctccctctgcagtttagtcgaaccggaccattgtgccccgcatgcatgaaggctacgttacagcctgaatacagcgataagtctctttatacccagttatgcttttatcggtatattttcgatgccgagtgtgccttggagaaactcacgactgatcacgagaaggacaaactgaaaaaacagttcttcactccaaaagtgcttcaagattacagaaaacttaaaaatacagcggaacagtttcttagtagatccgggtacagtgaggtgaatctgagtaaactttttgctgggtgcgccgtcaagtcatag

SEQ ID NO: 29157 - DNA, 2673 bp, Artificial Sequence
  Description of Artificial Sequence: Synthetic coding sequence
atgagtgccaacaactccccccctagcgcccagaagagcgtcttgccaaccgccattcccgctgtgcttcccgcagcgtctccatgcagctccccaaagaccggcctgtctgccaggctgtcaaacggatcattttccgcccctagcctgactaattcaaggggatccgtgcacactgtttcttttctcctccaaatcggtctgaccagagagagtgttacaatcgaagctcaagaactctcactgtcggccgtcaaagacctggtgtgcagcattgtgtaccagaagttccctgaatgtgggttttttggaatgtacgataaaatcctgctctttagacatgatatgaatagcgagaatattctccagcttattacctcggctgatgagattcacgaaggggacctggttgaagtagtgctgtccgctctcgcgacggtcgaagacttccagattcggcctcacacgctttatgtccacagctacaaagcgcctacattttgcgattactgtggagaaatgttatggggacttgtgcggcagggcctgaagtgtgaaggctgtggcctgaattaccataagaggtgcgcctttaagattcctaacaactgttctggagtcaggaaacggcgtctgagcaacgtgtcactgccgggacccggtctttccgtaccaaggccattacagcctgaatacgtcgcattgccctctgaggaaagccacgtgcatcaggaaccatctaagaggatcccgagctggagcggtaggccaatctggatggagaaaatggtgatgtgtagagttaaggtgccccatacattcgccgtgcactcctacacgcgtcccaccatttgtcagtattgcaagcgactcctaaaaggactcttccggcagggaatgcagtgcaaagactgtaaatttaattgccataagcggtgcgcctctaaggtgcctcgggactgcctgggagaagtaacttttaacggggagcccagctcccttgggaccgataccgacattcctatggatatagacaataacgatataaacagtgattcttcaaggggcctggacgacactgaggagccgagcccccctgaggataagatgtttttccttgatccctcagacctggatgtcgagagggacgaggaggcagtgaaaactatcagtccttctacctctaacaatatacctcttatgagagtggtccagagtattaaacacacaaaaagaaagagctctaccatggtgaaggaaggctggatggttcattacaccagtagggataacctccgtaagaggcactactggcggctagattcgaaatgcctgaccctattccagaacgaaagtggatctaagtactacaaggagatccctctgtctgagatactaaggatcagctcgcctcgcgactttacaaacattagccagggatctaatccccactgtttcgaaattataaccgacacaatggtgtatttcgtaggagagaacaacggcgattcttcacataaccctgtcctcgcagccaccggagtcggcctggatgtagcccagtcttgggagaaggcaatccgccaggcgctgatgcccgtgaccccccaggcttctgtgtgtacatcccctggccaaggcaaagaccataaggatctctctactagcattagcgtatcaaattgtcagatccaggagaatgtggacatatccacagtgtatcagatattcgcagacgaggttctggggtccggccagtttgggatcgtatacggaggtaagcaccgcaaaactggcagggatgtggctatcaaggtcatcgataagatgcgcttccccaccaaacaagagtcccagctgcgcaatgaggttgcaatcctccaaaatcttcaccaccctgggatcgtgaacttggagtgcatgtttgagaccccagaaagggttttcgtagtgatggagaagctgcacggtgacatgctcgaaatgattttgagcagcgaaaagtccagattgcccgaaagaatcacaaagtttatggtcacccagatcctcgtagcgctgagaaacctccattttaaaaatatcgtgcattgcgatctgaagccggaaaacgtgctgctcgcgagtgcagagccatttccacaagtgaagctgtgcgattttggctttgcgagaattattggcgaaaagagcttcaggaggtctgtggtaggcactcctgcttacctggcccctgaagtcctcaggagcaaagggtacaatcggagccttgacatgtggagcgtgggggtaataatctatgtcagtctgtctggcacgtttcccttcaatgaggacgaggacataaacgaccagatccagaatgctgccttcatgtaccccccaaatccatggcgggagatttccggcgaggccatcgatctgatcaataacctgctacaggttaaaatgcgaaaacgctactctgtggacaaaagcctgtcacatccttggttgcaggactaccagacctggctagacctgcgtgaatttgaaactaggataggtgagcgatacatcacgcacgaatccgacgacgctagatgggagattcacgcgtacacacacaatttggtgtatccaaaacacttcataatggcaccaaaccccgatgacatggaggaggacccatag

SEQ ID NO: 29158 - DNA, 4407 bp, Artificial Sequence
  Description of Artificial Sequence: Synthetic coding sequence
atggctcctgtgcatggggacgattgtgagatcggcgctagcgcattgtctgattccgggtctttcgtgtcatcccgcgctcgcagagagaagaagagtaaaaagggcagacaggaggcgttggaacgacttaaaaaggccaaggccggtgaaaaatacaaatatgaggtggaagattttacaggtgtctatgaggaagtggatgaagaacagtactctaaactggtgcaagctcggcaggacgatgactggattgtcgacgatgatggaatcggctacgtggaggatgggcgtgagatcttcgacgacgacctcgaagatgacgcactggatgccgacgagaaaggaaaggacgggaaggcccgtaataaggacaaaaggaatgtgaagaagttggccgtgaccaaacccaataacatcaagtctatgttcatcgcttgtgcagggaagaaaacggccgataaggccgtggacctctctaaagacgggctccttggtgatatcctgcaagatctaaacactgaaacccctcagattacccctcccccagtgatgatcctgaaaaagaaacggtcaattggagcctcccctaacccctttagcgtgcacaccgctacagcggtcccctcaggcaagatcgcgtcacccgtcagcagaaaggagccccctctgactcctgtgcccctgaagagagccgagtttgccggagacgacgtacaagtggagtcaaccgaagaggagcaagagtccggcgctatggagttcgaggatggagattttgatgagcccatggaggtagaagaggttgacctcgagccaatggccgcaaaggcttgggataaggaatccgagcccgctgaggaggtcaaacaggaggcagattccggaaagggaacagtgtcatatcttggtagcttcctgcccgacgtgtcttgctgggatatagatcaggaaggggactcctctttttcagtccaggaggtgcaggtagacagctcccatctcccgctcgtgaagggggctgatgaggaacaagtgtttcatttctattggttagacgcatacgaggaccaatataaccagcctggcgtcgtttttctgttcggcaaggtgtggatcgaaagtgctgaaacccacgttagctgctgtgttatggtgaaaaatattgagcgtacactgtattttctgcccagagaaatgaaaattgatctcaataccgggaaagagactggcactccaattagcatgaaagatgtctacgaagagtttgacgagaagatcgccaccaagtataagatcatgaaattcaaatcaaaacccgttgaaaagaactacgcattcgagatccctgatgtaccggagaagtctgaatatctggaagtgaaatattccgccgagatgccacagctgcctcaggatcttaagggggaaaccttcagccacgtgttcgggacaaacacctcatctttggagttattcctgatgaacagaaaaatcaaaggtccctgctggctagaggtaaaatctccacagctgctaaaccagcccgtcagttggtgcaaggtcgaggccatggccttgaagcctgatcttgtcaacgttatcaaagatgtgtcaccacctcccctggtcgtgatggcgttttccatgaaaactatgcagaatgcaaagaaccatcagaacgagattattgctatggctgctcttgtgcaccatagttttgcattagacaaggccgcacctaagccaccgtttcagtctcacttttgcgtcgtatcaaaaccaaaagattgtatctttccttacgcattcaaggaagtgatcgaaaagaagaatgtcaaagtagaagtcgctgcaacagaacggaccttgcttggcttttttctggccaaagtacacaagattgatcctgatattattgtgggtcataatatatacggcttcgaacttgaagttctgctgcagagaatcaacgtgtgcaaagcccctcattggtctaaaatagggcgactcaaacgatcgaatatgccaaaattaggaggcaggagcggatttggcgagcggaacgcaacttgcggccgaatgatatgtgatgtggagattagcgccaaagagctgatcagatgtaagagttaccatctgtccgagctcgtgcagcagattctgaagaccgaaagagtggttatccccatggagaacatccaaaatatgtacagcgaaagcagccagctattatatctactggagcatacttggaaggatgcaaaatttatcctgcagattatgtgcgagctcaacgtgctgccattggccttgcagatcactaacatcgccggaaatattatgtcccgaaccctgatgggcggaaggagtgaacggaacgagtttctgctcctgcacgctttttacgaaaataattatatcgttcccgacaagcagatcttcaggaagccacagcagaagcttggagacgaggatgaggagatagatggtgacacaaacaagtataagaaaggacggaagaaggcggcatatgccggtggccttgtgctagaccccaaagtcggtttctacgacaagttcattctgctcctggattttaactccctgtacccaagcattatacaggagttcaacatttgttttaccactgtgcagcgtgttgcaagcgaggcccagaaggtaaccgaggacggcgaacaggagcaaataccagagttacctgaccccagcctggaaatgggcatcctccccagagaaattcgtaagctcgtcgaacgcagaaagcaagtgaaacaattaatgaagcagcaggacctgaaccctgaccttattttacaatacgatatcagacagaaggcacttaagctaacagcgaacagtatgtacgggtgcctcggattctcatatagccggttctacgccaagccactggctgcactagtcacttataaaggcagagagatcctgatgcacacgaaagagatggttcagaaaatgaacctcgaggttatctatggcgacacagactccatcatgattaacaccaattccacaaatctcgaggaagtgttcaaattaggaaataaggtgaagagcgaggttaacaaactctacaaactgcttgagatcgacatcgacggagttttcaaatccttactgctccttaaaaagaagaagtacgcagcactggttgtggaacccaccagtgacggcaactacgtgactaagcaggaattaaagggactggatatagtaagacgggactggtgcgacctggcaaaagatacaggaaatttcgtgatcggccagatcctttccgaccagtcacgcgacaccattgtggagaacatccaaaaacggctgatcgaaatcggtgagaacgtgctgaacggttccgtgcctgtgagccagtttgagattaacaaggccctcaccaaggatccgcaggattaccctgataagaaatctttgccacacgtacatgtcgccctgtggatcaactctcagggtgggagaaaagtcaaggccggtgataccgtaagctatgtcatttgtcaggacgggagcaatctgacagcatcccagagagcctacgcgcctgaacagctgcagaagcaagacaatctaaccattgatacacaatattacctggcgcaacagatacatccagtggtggccagaatctgtgagcctatagacggcattgacgcagttctaatcgccacgtggttggggctcgacccaacacaatttcgggtgcatcactatcataaagatgaagaaaatgatgctcttctcggtggaccagctcagttgacagacgaggaaaagtatcgcgattgcgaacgattcaaatgtccctgtcccacctgcggcactgaaaacatttatgacaatgtgttcgatggtagcggtactgacatggaaccaagcctttataggtgctctaacatcgattgtaaagcctcccctctgacattcaccgtgcagctcagtaataaattaataatggacatcaggcgcttcatcaagaagtactatgatggctggctgatttgtgaggaacccacctgtcggaaccgcactaggcacctaccactccagttttcacgcacaggacctctctgccccgcttgtatgaaggccacattgcagccagagtacagcgataagtcattgtatactcagctgtgtttttacaggtatatttttgatgctgagtgtgctcttgagaagctcaccacagaccacgaaaaggataaattgaaaaaacagttttttacccccaaggtgctccaggactaccgtaagctgaagaatacagccgaacagttcctgtcacgctcagggtattctgaggtgaatctgagtaaattattcgctggctgcgctgtgaagagctag

SEQ ID NO: 29159 - DNA, 399 bp, Artificial Sequence
  Description of Artificial Sequence: Synthetic coding sequence
atggtggaacctttcctggggacctggaaattagtgtcctcagagaattttgaagactatatgaaggagttaggagtcaactttgctgccagaaatatggctgggctagtcaagccaactgtgactatttccgtcgatggaaagatgatgaccatcaggacagaatcatcattccaggacactaagatatcgttcaaactcggcgaggagttcgacgaaactacagcggacaaccgcaaggtcaagtctacgattacattggaaaacggatccatgatccatgtccaaaagtggctcggaaaagagacgaccattaagcgaaagatcgttgacgagaaaatggtcgtcgagtgcaagatgaacaatatcgtgagcacgagaatatatgaaaaggtttag

SEQ ID NO: 29160 - DNA, 555 bp, Artificial Sequence
  Description of Artificial Sequence: Synthetic coding sequence
atggataggggagagcaggggttactgcgaacagaccctgtgccagaggaaggggaagatgtcgctgccaccatctccgccaccgagacgctgagcgaggaagagcaggaggagcttaggagagagttagccaaggtggaggaggagatccaaacactgtcccaggtactcgccgcaaaggaaaaacatctcgccgagatcaagcgcaaactggggataaattcactacaggagctgaaacaaaacatcgctaaaggctggcaagatgtgaccgccacctcggcctacaagaagactagcgaaaccttaagtcaggcagggcagaaggcgtccgccgcatttagcagtgtgggcagcgtgattactaagaagctggaggatgtgaagaattcccccacgtttaaaagctttgaggagaaagtagaaaatctcaaatcaaaggtgggcggtaccaaaccagcagggggagatttcggagaggtactgaattccgctgcaaatgcctccgccaccaccaccgaaccccttccagagaaaacccaggaatctctgtag

SEQ ID NO: 29161 - DNA, 675 bp, Artificial Sequence
  Description of Artificial Sequence: Synthetic coding sequence
atggattgtcgcgagatggacctttatgaggattatcaatcaccatttgattttgatgccggtgtcaacaaaagctacctttatctgagcccttcgggcaactcctcgccacccggatcccctacgctgcagaagttcgggctgctgagaacagatcccgtgcccgaggagggagaagacgtcgcagctactatatcagcaacagagacactgagtgaggaggaacaggaggagcttcgacgtgaactagctaaggtggaggaggagatccagactttatctcaggttctcgcggcaaaagaaaagcacctcgcagagatcaagcgcaagctcggaattaattccttgcaagaactgaaacagaacatcgccaagggctggcaggacgtgactgcgacctcagcttacaagaaaacatccgaaaccctaagtcaagcgggtcagaaggcatcagcagcattttcctcagtaggttcagtgattactaagaaactggaggacgtgaaaaacagtccaaccttcaaatcttttgaggaaaaggtggagaaccttaagagcaaggtaggcggaacgaagccagcagggggagatttcggtgaagtactcaacagcgctgcaaatgcctccgccactactaccgagccactgccagagaagacgcaggagagcctgtag

SEQ ID NO: 29162 - DNA, 285 bp, Artificial Sequence
  Description of Artificial Sequence: Synthetic coding sequence
cccagagccgcacggtctagaggtccagctgtgtctcgtccaagagctcctcggccagaacttaccaccgaagccggtgagcctgctcggcgatgcgtcccaccttacgaacatcggccaggcatgcagtgcgcggtgaccaccccacccccatcctattacccgtaccccaacttacggtgggatacaagccactttaagaagtccgggggacctcagaggaataattacgtgattcacccggagttcgtctccgagacctatccggattatagatgctggtag

SEQ ID NO: 29163 - DNA, 1110 bp, Artificial Sequence
  Description of Artificial Sequence: Synthetic coding sequence
atgcccgtggttacgaccgatgccgagagtgagaccggaatacccaagagcctgagtaacgagcctccctctgagacaatggaggagatagaacacacatgcccacaaccgcgtctgacactgaccgctcccgctccgttcgctgacgagacaaactgccagtgtcaggcaccgcacgaaaagttaactattgcacaggctcgcctgggcacccctgcggatagaccagtgagagtttacgcagatgggattttcgatttgtttcactcggggcacgctagagccctgatgcaggctaagactctgttccctaattcttacctcctggtgggtgtctgctcagacgacctgacccacaaatttaaggggtttacagtgatgaatgaggccgagcggtacgaagctctgagacactgtaggtacgttgacgaagttatccgcgacgccccttggacactgacgccagagttcctggagaagcataaaatcgacttcgtcgcgcacgatgatattccttactctagtgccggatcagatgatgtctataagcatatcaaggaagccggaatgtttgtccctactcagcgaaccgagggaatctccactagtgacatcatcactaggatcgtgcgagattatgatgtttacgcacgaaggaacctacagaggggatatactgccaaggagctgaacgtgagcttcatcaacgagaaaaggtaccgatttcaaaatcaagtggacaagatgaaggaaaaggtcaagaacgtggaggagcgcagcaaagaatttgtcaacagggtggaggaaaagtctcacgacctaatccagaagtgggaagaaaaatccagagaatttatcggtaactttttagagctgttcggaccagacggcgcttggaagcagatgttccaagagaggtccagtcggatgctacaggccctgtcccctaagcagtcacctgtcagttccccgacacgtagcagatctccttcccgctctccctcgcctaccttttcttggctgccactgaagacgtcaccaccctcctccccaaaagcggcttccgcctccatctcctctatgtctgaaggagacgaagatgagaaatag

SEQ ID NO: 29164 - DNA, 1056 bp, Artificial Sequence
  Description of Artificial Sequence: Synthetic coding sequence
atggttggacatcaggagtgtatcatggaagaagacaatcgcgctcctcagctatggcgaaagacactcaccgctcccgctcccttcgctgacgagactaactgtcagtgccaggcacctcacgagaaactcactattgctcaagcacgcctggggaccccagcggacaggccagtccgggtgtacgctgacggcatctttgatttatttcacagtgggcatgccagggccctcatgcaggctaaaactcttttcccaaatagttaccttcttgtgggggtctgctccgatgacctgacacacaagtttaaagggttcacagtaatgaacgaagccgaaaggtacgaggctctccgacactgcaggtacgtggatgaagtcatacgggacgccccttggactctgaccccagagtttctcgaaaaacataaaatcgactttgtggcccacgatgacatcccgtactcaagcgctggctcagatgacgtgtataagcatatcaaagaggcgggaatgtttgttcccacacaacggaccgaaggcatttcaacctccgacattatcactcggatagtgcgcgattatgacgtatacgctaggcgtaacctgcagcggggttatactgcaaaggaattgaatgtttcatttattaacgaaaaacggtatcgtttccagaaccaggtggacaaaatgaaggaaaaggtgaaaaacgtggaagaacgctctaaagagttcgtcaatcgtgtcgaggagaagagtcacgatctgattcagaaatgggaggagaagtccagagaatttatcgggaatttcctggagctgttcgggccagatggcgcttggaagcagatgttccaggagaggagcagcagaatgcttcaagccttgtctcctaagcagtccccggtcagttcacctacaagaagtagatctccaagtcggtcaccctctccaaccttctcctggctgcccttgaagacttcccccccatcttctcccaaagccgcaagtgcatccatctcttccatgtctgagggtgatgaggatgaaaaatag

SEQ ID NO: 29165 - DNA, 600 bp, Artificial Sequence
  Description of Artificial Sequence: Synthetic coding sequence
atggcagacaagtcaaaattcattgagtacattgacgaagcgctggagaagtcaaaggagacagctctttcacacctcttcttcacgtatcaaggaattccatatccgatcactatgtgcacctctgagacgtttcaagcgctggatactttcgaggcccgacacgatgacattgtgttggcctcataccccaagtgtgggagcaactggatactgcacatcgtaagtgaactgatttatgccgtgagcaagaagaaatataaatatccggaattccctgtactggagtgtggtgacagcgagaagtatcagaatttggctgcagggattaagcagattgctgagttcctaggcttcttcttaacgggagagcagatccaaacgatcagtgtacaaagcaccttccaggcaatgagagcaaaatcacaggatacgcacggtgctgtcggaccgttcctgttccggaagggagaggtaggagactggaagaacctcttttccgagatccagaatcaggagatggatgagaaatttaaagaatgtctggcagggacatctctgggagcaaaactcaagtacgaatcctactgccaggggtag

SEQ ID NO: 29166 - DNA, 1527 bp, Artificial Sequence
  Description of Artificial Sequence: Synthetic coding sequence
atgaggtgcccaaagtcagcagtcactatgaggaacgaagagctcctgctctctaacggaacagctaataaaatgaatggcgctctggaccactccgatcagcccgatcctgatgccatcaagatgttcgtgggacagattccaagatcatggtccgaaaaagaactcaaagaactcttcgagccttacggggcagtgtaccagatcaacgtactccgggataggtcacaaaatccaccgcagtcgaagggctgctgttttgtaacgttctacaccagaaaggcagccctggaggcccagaatgccctgcataacattaaaaccctgcctggaatgcaccatcccatccagatgaaacccgctgattccgagaaatcgaacgccgtcgaggaccgcaagttattcatcggcatggtgagtaaaaagtgcaatgaaaacgatatcagagtgatgttctctccctttggacaaattgaagagtgtcgtatccttcgaggccctgacgggttaagccgtggctgtgccttcgtgaccttctctacacgtgcaatggctcaaaatgccattaaggcaatgcaccagagccagaccatggagggctgctccagtcctatcgtggtgaaattcgccgatacgcagaaagacaaagagcagcgcagactgcagcagcaactcgcacagcagatgcaacagctgaatactgcaacatggggaaatttaaccggtctggggggtctgaccccccagtacctcgccttactgcagcaagccacgagttcctcgaatttgggtgccttcagcgggatccagcagatggcaggcatgaatgccttgcaactccagaacctggcaacactggctgcagctgccgctgcagcccaaacctctgcaacttctactaacgctaacccattgtccaccacaagtagtgctttgggcgcactgacttcgccagtcgccgcttccacacctaattccacagctggcgctgctatgaactcgcttacttcattaggaactctgcagggcctagctggcgcaacagtcggccttaataacatcaatgcacttgccggaatggcagccttgaatggcggtttgggagccaccgggctgacaaacgggaccgccggaacaatggatgcgctcacacaggcgtactcgggaattcagcagtatgcagctgcagctttgcctaccctgtactcccagagtcttctgcagcaacaatcagctgccggatctcagaaggagggccctgaaggcgctaatctctttatttatcacctccctcaggaatttggcgaccaggacatcctgcagatgttcatgcctttcggcaatgtgatcagtgcgaaggtcttcatcgacaaacagacgaatttgtccaagtgctttggctttgtgtcctatgataatccggtatcggcacaggccgctattcaggctatgaatggcttccagatcggcatgaagcgattaaaagtgcagctgaaacggtcaaaaaacgactctaaaccctactag

SEQ ID NO: 29167 - DNA, 1215 bp, Artificial Sequence
  Description of Artificial Sequence: Synthetic coding sequence
atgggaagcagccaggaggaaggcttacgatgtcagcccagtcaacccgatcacgatgccgacggccactgcgggcctgatctcgaaggcgcagaacgggcaagcgcaacaccagggcctccgggactgctaaattcccacaggccagctgatagcgacgatactaacgcggcaggcccatccgctgctcttttagaaggcctgctgctggggggaggcaagccaagcccccactccactcgccctgggccattcttttacattggaggaagcaatggcgcaacaatcatttccagctactgcaagtctaaaggatggcagcgtattcacgactcccggcgtgacgactacacgcttaaatggtgcgaagtgaaaagcagagatagctatggctccttccgcgaaggcgaacaactgctgtaccaactgccaaataataagctgttgacaaccaaaatcggcctgctatcaacactgcggggacgcgctagggcgatgtcgaaagcctcaaaggtccccggaggggtgcaagctcgcctggagaaggacgccgcagctcctgcgctggaagacttgccttggacctctcctggatatctgagaccgcagcgggttctcaggatggaagaattttttccagaaacatataggcttgatctcaagcacgaacgagaagcattcttcaccttgtttgacgaaacacagatttggatctgcaagccaacagcctcgaaccaggggaaaggtatttttctgctaagaaatcaggaggaagtggctgcattacaagcaaaaaccaggtccatggaagacgatccgattcaccacaaaacacccttccgaggccctcaggctcgggtcgtgcagcgatacattcagaatccactgttagtggatggcaggaaatttgacgtcagatcttatcttttgatcgcttgcacgacgccttacatgatattctttggacacgggtacgcacggctcacactcagcctgtatgacccccactcctcagacctgggcggacacttgaccaaccagttcatgcagaaaaaatccccactgtacatgcttctgaaagagcataccgtttggtctatggaacatctgaatagatacatcagcgacacattctggaaagccaggggcttggctaaagactgggtctttaccaccctgaaggtgcggccactgtgtcccccagtatgggaatag

SEQ ID NO: 29168 - DNA, 2022 bp, Artificial Sequence
  Description of Artificial Sequence: Synthetic coding sequence
atggaccattcctgcacccggttcatacatagaagaggacccccaactcggacgagagctggctttaaaagagggaaacgccctagaattcagcaacgccctcgggcaagggtgagcggaaccatcccggctagtagactgcatcccgctccagccagccagccgggtccttgcccagctccaggccattgcccagttggtcccgcacacgaaagacctatgggaagtagccaggaagagggattacgttgccagccctcccaacctgatcatgacgcggacggacactgtgggcctgacctggagggtgccgagcgcgcatcagcaactcccggaccgcctggactgttgaatagccaccgcccagcagactctgacgacaccaacgctgcaggaccatctgcagcgctgttagaagggctgctgctgggcggaggaaagccctcccctcattcgactagacccggtccctttttttacatcggcggtagtaacggggctaccataattagttcatactgcaagtcaaaaggctggcaaaggatccacgatagcagacgtgatgactacaccttgaagtggtgcgaggtgaagagcagagacagttatgggtcctttagagagggggaacaattactataccagttgcctaacaataagttgctcacgacaaagattggcctcctgagcactctgcgcggtcgcgctcgcgcaatgtcaaaagctagcaaggtgcccggaggagtccaggcaagactggaaaaagacgctgccgctccagctctggaggaccttccctggactagcccaggctatctgcggcctcagagagtgttgcgaatggaggagttctttccagagacatacagactggacttaaaacatgagagagaggcctttttcactctgtttgatgagacacagatatggatctgtaagcctaccgccagtaatcaaggcaagggaatctttctgctgcgaaatcaggaagaagtggcggcacttcaggcaaaaacaagatccatggaggatgatcctatacaccataagactccattcaggggacctcaggcacgggttgtgcagcgttatattcaaaaccccttgctggtggacggacgtaaattcgacgttcgatcctatctgttaattgcctgcacaactccctatatgattttcttcggtcacggatacgctcggctgacgctctcactgtatgatccccatagctcagatctgggtgggcacttgacgaaccagtttatgcaaaagaagagcccactttatatgcttttgaaggaacacactgtctggtccatggagcatttgaatcgttatatctctgacacgttctggaaggcccgaggtttggccaaggattgggtattcacgactctgaagaaacgtatgcagcagataatggcacactgcttcctcgccgctaagcccaagttagattgcaaactcggctatttcgaccttattggatgtgatttcctgatagacgataactttaaagtgtggctcctggagatgaattccaacccagccctgcacaccaattgtgaggtcctcaaggaagtcatccccggtgtggtaattgagactctggacctagtgctcgagacattccggaagtctctccgcggtcagaagatgctgcccttactgtcccaaagaagatttgtgcttctgcacaatggagaagccgaccccagaccccatctaggaggctcctgttctctccggagatggcctcctctcccgacacgacaggcaaagtcctccggtcctcccatgccgcatgccccagatcaaccaggcgctaggagacccgcaccaccaccactagtccctcagcgaccccgtccccctggcccagatcttgattctgcacatgacggggaaccccaggcccctgggactgagcaatctggaaccggtaatcgccatcctgcccaggaaccctccccagggacggctaaagaggaaagggaagagcctgagaatgccaggccatag

SEQ ID NO: 29169 - DNA, 2022 bp, Artificial Sequence
  Description of Artificial Sequence: Synthetic coding sequence
atggaccacagctgtaccagattcattcataggcgcggaccaccgacacgaacgagagctggtttcaagcgcggaaagcggcctaggatccagcaacgcccacgcgcaagggtatcaggcactattccagcttctcgacttcaccctgcccctgcatcgcaacccggtccctgtcctgcacctgggcattgtcctgttgggcctgcccacgaaagacctatgggatcttcccaagaagagggactccgctgtcagcccagccagccagatcatgatgcggatggacactgcggccctgatctggagggggctgagagggctagtgcgacgcccggacccccagggcttctgaacagccaccgccctgcagactcagacgacactaatgccgctggaccctctgcagccctgctcgaggggctgctgctaggaggtggtaagccttcaccccacagtacacgcccagggcctttcttttatatcgggggaagcaacggggcaacaataatatcctcatactgcaaaagcaaaggctggcagcgcattcatgattcacggagggacgactacactttaaaatggtgcgaagttaagagccgcgattcctatgggtccttccgagaaggggagcagttgctctatcaacttccaaacaataaactgctgaccacaaagatcggtctcctcagcacattgaggggcagagctagagccatgtcaaaggctagcaaggtgccaggcggagtgcaggcaaggcttgaaaaagacgccgcagctcccgctctcgaggacctgccctggacttctcccggatatttgcggccacagagggtgcttagaatggaagaattttttccagagacctatagactggacctgaagcatgagcgagaggcattttttacgttattcgatgagacccagatctggatctgcaaaccaaccgctagcaatcaaggaaaagggatttttctgctgagaaaccaggaggaagtggcagcactccaggcgaaaacaaggagcatggaggacgaccctatacaccataagaccccgtttcggggacctcaggccagggtggttcagcgatacattcaaaacccactcctggtcgatggcagaaaatttgacgtgagaagttacctgctgatcgcctgcacaactccctacatgatcttttttggtcatgggtatgcgagacttacacttagcctatatgatccccactcatccgatttggggggtcacctaacgaaccaatttatgcagaagaaatcgcccctgtatatgttacttaaggagcacacagtttggagcatggagcacctgaaccgctatatttcagacacattttggaaagctagaggtctggctaaggactgggtattcacgacgctgaaaaagcgcatgcagcaaatcatggcccattgctttctggctgcaaaacccaagttggactgtaagctcgggtatttcgacttaatcggttgcgatttcctgattgatgataattttaaggtgtggctactagagatgaatagcaaccctgccctgcatacaaactgcgaagtgttaaaggaggtcataccaggggttgtgattgaaaccctggacctggtgctggaaacattcagaaaatccttgcgcggtcagaaaatgttaccgctgctgagccagcgccgatttgtgctcctgcacaacggcgaagccgaccccagaccccatctcggtggcagctgctcattgcggagatggcccccactacccacacgccaggctaaatcttcaggtcccccaatgcctcatgcaccagaccagccgggagcgaggaggcctgcccctccacctttggtcccccagagacctcgcccacccggtcccgatttggacagcgcacatgatggcgaaccacaggcgccaggcacagagcaaagcggtacaggcaatcgccaccctgcccaggaaccctcccccggtaccgccaaggaagagagagaggaacccgagaatgcacgcccatag

SEQ ID NO: 29170 - DNA, 393 bp, Artificial Sequence
  Description of Artificial Sequence: Synthetic coding sequence
atgaccgaggattcgcagcgcaactttaggagcgtgtattacgaaaaagtgggttttcgtggtgtcgaggagaaaaagtcgttggagattctgctcaaggatgatcgattagataccgagaaactgtgtacctttagtcagaggtttccactcccaagtatgtatagagctctggtgtggaaagtacttctgggtatcttgccaccccatcacgaatcccacgctaaggtgatgatgtatcggaaagaacaatatttggatgtgctgcacgcccttaaggtggtcaggttcgtgagcgacgccactccccaggcagaagtttatctgaggatgtatcaactcgaatcagggaaattgcccagatcaccttccttcccattagagcccgattag

SEQ ID NO: 29171 - DNA, 882 bp, Artificial Sequence
  Description of Artificial Sequence: Synthetic coding sequence
atgactgaggactcacaacgaaatttccgaagcgtgtactacgagaaggttgggttcagaggggtggaggaaaaaaagtcactagagatccttttaaaagacgataggctggacaccgaaaagttatgcaccttctcgcagaggttccccctgccttcaatgtacagagccctcgtatggaaagtcctcctagggatcctgccgcctcatcacgaatcacatgccaaggtgatgatgtaccggaaggagcagtacctcgacgtgttgcatgcacttaaagttgtacgatttgttagtgatgccaccccccaggcagaagtataccttaggatgtatcaactggaatccggaaaactcccgaggagccctagctttccactcgaacctgacgatgaagtgtttctggccatcgccaaggccatggaggaaatggttgaggattcagtggattgttactggataacccgcagattcgtcaaccagctgaacactaagtatcgagattcactgccgcagctgcctaaggcctttgaacaatatctgaatctggaagatggccgactgctcacgcacttacgcatgtgtagcgctgcgccaaagctcccatacgatctctggttcaagcggtgcttcgccggatgcctaccagaatcatcactacaacgggtttgggacaaagtagtttctggcagctgcaaaattctagtgttcgtcgcagtcgagatcctcctgactttcaagattaaggttatggcacttaacagcgctgagaagatcacgaaatttctggagaacatcccgcaggactccagcgacgctatcgtatcaaaagcaattgatctatggcacaagcactgtgggacacccgtgcactcgtcgtag

SEQ ID NO: 29172 - DNA, 801 bp, Artificial Sequence
  Description of Artificial Sequence: Synthetic coding sequence
atgactgaggattcacagcggaacttcagaagcgtctactatgagaaggtgggtttcagaggagtggaggagaaaaaatccttagagatcctgcttaaagacgatcggctgggaattctgcctccacaccacgaatctcatgccaaagtgatgatgtatcgcaaggaacagtatctggatgttctgcatgccctgaaagtggttagatttgtgtcagatgcaaccccccaagctgaggtctatctgagaatgtaccaattggagagcggcaagctccccagatcaccttcgttcccactcgagcctgacgacgaggtgttcctcgctatcgccaaagcgatggaggagatggtggaagactccgttgattgctactggataacccgtcggttcgtgaatcagctgaatacgaagtatagggattccctgccacaactgcccaaagcctttgagcaatatttaaacctcgaagacggtagactgttgacacatctgcgcatgtgcagcgctgctccaaaactgccttatgacctatggtttaagcgctgcttcgctggctgtctccctgaaagcagcctgcaacgtgtgtgggacaaggtcgtgagcgggtcctgcaaaatcttggtgtttgtggcagttgagatccttctcaccttcaagatcaaggtgatggcgctaaattctgctgagaaaatcactaagttcttggaaaatatcccccaggactcttccgatgctatagtaagtaaggctatcgacctgtggcataagcactgcgggactcccgtgcacagctcctag

SEQ ID NO: 29173 - DNA, 3672 bp, Artificial Sequence
  Description of Artificial Sequence: Synthetic coding sequence
atgatgagcttatctgtccgcccacagagaaggctgctcagtgctagggtgaataggtctcagtcttttgcaggagtacttgggagccacgagagaggaccgagtctgagcttccgcagctttccagtgttttcaccaccaggacctcctcgaaagcctcccgctctctcgcgggtgagccgaatgttttctgtagcccacccggctgccaaagtgccccagcctgagcggttggacctagtatacactgccttgaagagagggctaaccgcctatttggaggttcaccagcaggagcaagagaaactacaaggacaaatcagagagtccaaacggaacagtagattaggttttttgtacgatctagataagcaggtcaagagcattgaacgttttctccgccgtttggagtttcatgccagtaaaattgacgaactgtatgaggcgtattgtgtgcagcgccgactgcgcgacggagcatataacatggtacgcgcttatactaccggcagccccggttctagagaagctcgggattccttagcggaggctacaaggggccacagagagtatactgagagtatgtgcctgctcgaatctgaactggaggcccagctgggagaattccacctgcggatgaagggcctggcgggatttgcccgactttgcgtgggcgaccagtatgaaatctgcatgaagtacggacgacaaaggtggaagctaaggggacgaattgagggatctgggaagcaagtctgggattcagaggaaactattttcctgcctctattgacggaattcctctctatcaaagtcactgagctgaaggggctggcaaatcacgtcgtagttgggtccgtgagctgtgagactaaagatttgtttgcagccctgcctcaggtggttgccgtggacattaacgatcttggcacaattaagttatcactggaagtgacatggtctccattcgacaaggatgatcagccatcagcagcttcctcggtgaataaagcaagcacagtgacgaaacgcttctccacgtacagtcagtccccgccagatactccctccctgcgcgaacaggcattctataacatgctgagaagacaagaagagctggaaaacgggacagcctggagtctcagttctgagtctagtgatgacagctcttctccacaactgtccgggaccgctagacacagtcctgctccgagaccacttgtgcaacagcccgaacccctgcccattcaagttgctttcagaaggccagagacacccagctctggtccacttgacgaggagggagccgtagccccagtgttggcgaacggccacgctccatactcaaggaccctgtcacacatcagcgaagccagtgtcgatgccgctcttgcagaggcctcagtggaagccgttggaccagagagtcttgcttgggggccttccccgccaacccaccctgcgcctacacatggcgaacatccttcccccgtgcccccagcactggacccaggccactcagcaacgtcgtcgacactcggcaccacaggaagcgtgcctacttcaaccgatcctgcaccctccgctcacctggactctgtgcacaaatccacagattccggccctagtgaactgcccggacccacacatacgaccaccggctctacctactccgcaatcaccactactcactctgccccttcacccttgacccacacgacgacaggctcaacacataaacccattatcagtacgctgacgactaccggccctaccctgaatatcatcggaccagtgcagaccactacctctcccacacacactatgccatctccgacccatactaccgcgtccccaacccatacttccacatctccaacccatacaccgactagcccgacgcacaaaacatccatgtccccgccaacgaccacgtctcccactccgtccggaatgggtctcgttcaaacagctacttctcccactcaccccaccacttcaccaacccatccaacaactagccctattctaatcaacgtttccccctcaacctccctggaacttgctacgctgagcagcccttctaaacatagcgatcccaccctgccgggtacagactccctcccatgctccccccctgtttcaaatagctacacgcaggccgaccctatggcacctcggacaccgcatccttctcccgctcactcctcacggaaaccgttgaccagtccggcacccgacccctctgaaagtaccgtgcagtctctgtccccgacccctagcccaccaacccctgccccacagcactccgatctgtgtctcgcgatggctgtgcagacaccggtgcccacggcggcaggcggttcgggggataggagtctggaggaggcgctgggggcattaatggctgcactcgatgactacagagggcaatttccagagctgcagggactggaacaggaggtaacgagattggagagcctgctgatgcagagacagggcctcaccagatcacgcgctagcagtctaagcatcactgttgaacatgcgctggagtctttttcctttcttaacgaagacgaggatgaggataatgatgtccccggagataggcctcctagtagtccggaagccggagcagaagattctatcgacagtccgtccgcccgtccgctgtcgactggctgtccagccctcgatgccgctctcgttcggcacctgtaccactgttctcgtctgctgctaaaactgggtacattcgggccactacgctgccaggaggcctgggccttggagagactgctcagggaggcgagagtgttggaagccgtatgtgaattctctaggagatgggaaattcccgcaagctcagctcaggaggtggttcagttctcagcctccagacccggattcctgacattctgggaccaatgtacagagaggctgagttgcttcctatgccccgtggaaagagtcctgctcactttttgcaaccagtacggtgcgaggttgagcctgagacagcccggtcttgcggaagcagtttgtgtgaaatttctggaagacgctcttggacagaagctgcctaggcgacctcagcccggtccaggcgagcagctgacggtgttccaattttggtcttttgtggagacattggattcacccacgatggaggcctacgtcacggaaacggccgaagaagtcctgctggtgagaaatctgaatagcgatgatcaggcagtagttttaaaggccctgcgcctggctcctgagggcaggctgagacgcgatggcttacgggcactctcatccttacttgtgcacggcaacaacaaagtgatggccgcagtctctacacagctgcggtcattatcgctggggccaacgtttcgtgaacgcgcactgctctgctttctcgatcaactggaagacgaggatgtgcagactcgggttgcaggctgcctggcccttggatgcatcaaagcaccagaagggatcgagcctcttgtatacctttgtcagacagatacagaagctgttcgtgaagcagcaagacagagtctgcagcagtgcggggaggagggccagagcgctcatcgcaggctggaggagtccctcgatgccctcccacgcatttttgggccaggatccatggcttccacggcattctag

SEQ ID NO: 29174 - DNA, 123 bp, Artificial Sequence
  Description of Artificial Sequence: Synthetic coding sequence
atggctgatgaggaactcgaggcactgcgtagacagcgcctcgccgaattacaagccaagcatggcgatcccggagacgctgcccagcaggaagccaagcacagtagtaccgaagagaaatag

SEQ ID NO: 29175 - DNA, 414 bp, Artificial Sequence
  Description of Artificial Sequence: Synthetic coding sequence
atgaaaccgccagctgcccaagggtctcctgccgctgcagctgccgcagcgcctgccctggactctgcagctgccgaggacttatccgacgcactctgtgaattcgatgccgtgctggcagactttgctagcccctttcacgaaaggcacttccattatgaagagcatctggagcggatgaagaggcggtcctctgcctctgtgtccgatagttctggattcagcgacagcgagtccgccgactctctgtatcgaaattcattcagctttagcgacgagaagctgaattcccctacggattcaactcctgccctactttcggcgacggtgacgccacagaaagccaagctgggtgacacaaaggagctggaggcattcatcgctgacctggataaaaccctggcgtctatgtag

SEQ ID NO: 29176 - DNA, 1593 bp, Artificial Sequence
  Description of Artificial Sequence: Synthetic coding sequence
atgcctaatgtgctgctccctccaaaagagtcgaacctgtttaaaagaatcttgaagtgctacgaacagaaacaatataagaatggccttaaattctgcaaaatgattttaagtaaccccaaatttgcagagcacggtgaaacgttagccatgaagggacttactctgaattgcttgggaaaaaaggaggaggcctacgaattcgtgagaaagggcctgcgtaatgacgtcaagagtcatgtctgctggcatgtgtatggattactgcagcgttcagataagaagtatgacgaggccattaagtgttatcgcaacgctttaaaactcgacaaggacaatctgcagatccttcgagatttaagtctcctacagatccaaatgcgggacctggagggctaccgcgagacccgctaccagcttttgcagctgcggccaacccagagggccagctggattggatatgccatcgcttatcacttgttgaaagactacgatatggcactgaaactgctggaggaattccggcaaactcagcaggttccccctaacaaaatagactatgaatacagtgagttgatcctgtatcaaaatcaggtcatgcgagaagctgatttgctacaagagtctttggagcacattgaaatgtacgagaagcagatttgcgacaagctgctcgtggaggaaatcaagggagagattctgctgaaactaggcaggttgaaggaagcctcagaggtgttcaaaaatttgattgataggaacgcggaaaactggtgttattatgagggacttgagaaggcattgcaaatttcaactctagaagagcgtctgcagatctacgaggagatttccaagcagcatcccaaggccattaccccacgtcgtttgcctctgacactagtgcccggtgaaagatttcgtgaactcatggacaagttcctgagagtgaacttctccaaggggtgtccacccctctttacaacgctgaagtcactgtactataacaccgagaaggtatcaatcattcaagagctggtgaccaactatgaggcctctttgaagacttgcgacttcttctctccttacgaaaacggggagaaagagccacccactaccctgctgtgggtgcagtactttctggcacagcatttcgacaagcttggccagtattcactggctctcgactacattaacgcagcaatcgccagtacgccaactctgattgaactcttttacatgaaagccaaaatctacaagcacatcggcaatctgaaggaggcagccaagtggatggacgaggcccagtctcttgataccgctgaccgcttcattaactcaaaatgtgctaaatacatgctccgtgctaatatgattaaagaagccgaggagatgtgcagcaagtttacaagagagggcacaagtgctatggagaacctgaacgaaatgcagtgcatgtggtttcagaccgaatgtatcagcgcctaccagaggctggggagatatggagatgctctaaagaagtgccatgaagttgaaaggcacagtccgtccacatggactactgggggtaaggagcctcaaatgcacccttag

SEQ ID NO: 29177 - DNA, 2595 bp, Artificial Sequence
  Description of Artificial Sequence: Synthetic coding sequence
atgcccaacgtgctgcttcctccgaaagagtcaaacctgttcaagaggattctaaaatgctatgaacagaaacagtataagaatggcctgaagttctgtaagatgatcctgagtaaccctaaattcgcagagcacggggaaacattggccatgaagggactaacactcaattgtctgggaaaaaaagaagaagcctatgaatttgtgcgcaagggacttcggaatgatgtgaaatcgcacgtctgttggcacgtgtacgggctactgcagcgttccgacaagaaatacgacgaggccataaaatgctataggaatgctctcaaactcgataaagataacctgcagattcttcgcgacttatcgttgctacagattcagatgcgggacttggaggggtacagagagaccaggtaccagctactgcagttgcggccaacgcaaagagcaagttggattggatacgccattgcataccacctgttgaaggattacgacatggcccttaagctgcttgaagagttccgtcagacccagcaagtccctcctaataagattgactacgaatatagcgagttgatcctgtaccagaaccaggttatgcgggaggccgatctgctgcaggaaagcctcgagcacattgagatgtatgagaaacaaatctgtgacaagctgctagtggaggagatcaaaggggaaatcctcctgaagctgggacggctgaaggaggccagtgaggttttcaagaatctgattgatcgcaatgcggagaactggtgttattacgaaggccttgagaaggcattgcagatatcgacacttgaggaacgcctgcagatatatgaggaaatttccaaacagcaccctaaggccataacacccagaagactgccgctgacactggtcccaggcgaacgcttcagagagttgatggataagttcctccgagtcaacttctccaagggatgtcctcccctctttacaaccctgaagtccttgtactataatacagagaaagtatctatcattcaggaactggtcaccaattatgaagcttccctcaagacctgcgatttcttttccccatacgagaacggagagaaggaaccaccgactactttattgtgggttcaatactttctggcacagcatttcgacaaactggggcagtactctctggcactggactacatcaacgccgctatagcatccacaccgacactcatcgagcttttttatatgaaagcgaaaatctacaaacacatcggcaacttgaaagaggccgcaaaatggatggacgaggcacagtcccttgatacagccgacaggtttattaatagcaaatgcgccaagtacatgctccgggctaatatgataaaagaggccgaggaaatgtgctcaaagttcactcgggaaggcacgtcagccatggagaacttaaacgaaatgcagtgcatgtggtttcagaccgaatgtatcagtgcctatcaacgactgggaaggtatggtgatgctttaaaaaaatgccatgaggtggagagacactttttcgaaatcactgacgaccagtttgattttcacacctattgtatgagaaaaatgacccttcgggcttatgtagatctgctgagactcgaggacattctccgtcgccatgcattctatttcaaagccgctaggagcgcaatcgaaatctacctgaaactttacgacaacccacttacaaacgagagtaagcaacaggaaattaacagcgaaaacttgagcgcaaaggagctaaaaaaaatgctgtccaagcaaagacgtgcacagaagaaggctaagctggaggaggagagaaagcatgccgagcgcgagaggcagcagaagaaccagaagaagaagagggacgaggaagaggaagaagcatctggactgaaagaagaactcatccccgagaagctggaaagagtagagaatccgctggaggaggcagttaaatttctgattccacttaagaaccttgttgcggacaacatcgacacacacctcctcgcctttgaaatctatttccgcaagggcaaattcttgctgatgttgcaatccgtcaagagggcatttgccataaattccaacaacccctggttgcacgagtgcctaatcaggttcagcaaaagtgtctccaaccattcgaacctgcccgacatcgtaagtaaggtcttatcccaggaaatgcagaaaatatttgtgaagaaagacctggagagctttaacgaggattttttaaagcgcaacgccacttctttacaacatctgctgtccggcgctaaaatgatgtactttctggacaagtcgagacaagaaaaggctatcgccattgcgaccaggctcgatgaaactatcaaagataaggatgtgaagactcttatcaaggttagcgaggcacttctggacggaagctttggtaattgttctagccagtatgaggagtatagaatggcctgtcacaatctgctgccttttactagtgcatttctacctgcggtcaatgaggtggataaccccaacgtggctctgaaccataccgctaattacgacgtgctggctaacgaaatttag

SEQ ID NO: 29178 - DNA, 1668 bp, Artificial Sequence
  Description of Artificial Sequence: Synthetic coding sequence
atgcaatcgtgcgaatctagcggggatagcgccgatgatcctctgagtagaggcctcaggaggcggggtcaaccccgagtcgtcgtcatcggagccggactggctggattagcagccgcaaaggcgttgctggagcaaggcttcaccgacgtcacggtcttagaagcgtcatcccacattggcggaagagtgcagtctgtgaaactggggcatgctacattcgaactgggggcaacctggatccatggatcccacggaaatcccatctaccacctggcagaagcaaatgggctgctggaggaaactacagatggggagaggtcagtcggccgtatcagcctgtattctaaaaacggcgtggcatgttacctcaccaatcatggcagacggatccctaaggacgtagtcgaagagtttagcgatctgtataatgaagtgtacaatctaacccaggaattcttccggcacgataagcctgtcaacgctgaaagccagaactcagttggcgtgtttaccagggaagaagtcagaaatcgtataaggaatgatcccgacgaccccgaggccacaaagaggctgaaacttgcaatgattcagcagtacctgaaagtagaaagctgcgaatccagctcccacagcatggacgaagtatccttaagtgccttcggggaatggaccgagatcccaggggcacatcacatcataccatctggctttatgcgggtggttgagctactggccgaaggaatacctgctcacgtgattcagctgggtaagcctgtcagatgcatacactgggaccaggcctcagccaggcccagaggacccgaaattgagccaagaggagaaggtgatcacaatcacgacactggagagggcggacaagggggagaggaacccaggggtgggagatgggacgaggacgaacagtggtccgttgttgtagagtgtgaagactgcgaactgatccccgctgaccatgtgattgtgaccgtctctctcggggtgctgaaaaggcagtacacctccttttttaggcccggtctgcccactgagaaggtggccgcaatacatagactgggtatagggaccaccgacaagatcttccttgagtttgaagaaccgttttgggggccagagtgcaacagtttgcaattcgtgtgggaagacgaggcagaaagccatacattgacttaccctccagaactgtggtaccgcaagatttgtggctttgacgtgctgtaccccccagaaaggtatggccacgtgctttccgggtggatctgtggagaggaggccctcgtcatggagaaatgcgatgacgaggccgtggctgaaatatgcactgagatgctaaggcaatttactgggaatcccaacattcctaagccaaggcggatactccggagtgcctggggttccaacccgtacttccggggatcttacagctacactcaggtggggtcaagtggcgctgatgtcgaaaagctggcaaagccccttccatacacggaatcttcaaagacagctcctatgcaagtgttgttctccggagaagctacccatcgtaaatactacagcactacacacggagcattgctctctggccagcgggaggccgcacggttgatcgaaatgtatcgggatctttttcagcaggggacgtag

SEQ ID NO: 29179 - DNA, 630 bp, Artificial Sequence
  Description of Artificial Sequence: Synthetic coding sequence
atggctcccgtgggcgttgagaaaaagctgctgctgggccctaatggtcctgcggtagcggctgcaggtgatttgacgtctgaggaggaggagggccagtccctgtggtcatcgatcctgtctgaggtcagtacccgggctcgcagcaaactccctagcggaaaaaacattcttgtgttcggcgaagacggatctggcaagactaccctcatgacaaagctgcaaggagctgaacacggcaagaagggtcggggtctggaatacctctaccttagcgtacacgacgaagaccgtgatgaccatactaggtgcaacgtgtggatcctggacggtgacctgtaccacaaagggctgctgaagttcgcggtcagcgcagaatctctgcccgaaacactggttatttttgtggctgacatgagccggccttggaccgtaatggaatcactgcaaaagtgggctagcgttctgcgcgaacacatcgacaagatgaagattccacctgagaaaatgagagagttggaacgtaagttcgtgaaagacttccaggactatatggaacccgaagaggggtgccaggaaggtcctctctctaacagggttgagcagatgaggcccaggaatcactggtag

SEQ ID NO: 29180 - DNA, 858 bp, Artificial Sequence
  Description of Artificial Sequence: Synthetic coding sequence
aactggaacctggcctcttggaacccaagcaatccagagtgcctgctgttagtcgtgaaggagttagtgcagcagtaccatcagtttcagtgtagccgtttgcgcgagagttctcgcttgatgttcgaataccagacactgctagaagagccgcaatatggcgagaatatggagatctatgccggaaagaaaaataattggaccggggaatttagcgcaaggtttctgctgaaattgccggtggactttagcaacatcccaacctacctccttaaggacgtcaatgaggatccaggagaagatgtggctttgctttcagtgtcctttgaagacaccgaagccactcaggtataccctaagctgtatctgtcacccagaattgaacacgcattgggcggttcctcagccttgcatatacccgcattccccggtgggggttgtctcatcgattatgtccctcaggtctgtcatctgttgacaaacaaagtgcagtacgttatccaaggctatcacaaaagacgagagtacattgctgcattcctttcccatttcgggacaggcgtggttgagtatgatgccgagggctttactaagctgaccttgctgctgatgtggaaagacttctgctttctggtgcacatcgacctgcctcttttcttccctagggatcaacctactttaactttccagtctgtgtatcactttacgaactcagggcagctttacagccaggcccaaaaaaattatccatactcacccagatgggacgggaatgagatggccaagcgcgctaaggcctattttaagacgtttgtgccacagttccaggaggctgcatttgcgaatggcaagctgtag

SEQ ID NO: 29181 - DNA, 1152 bp, Artificial Sequence
  Description of Artificial Sequence: Synthetic coding sequence
atgagcccggaagtggcattgaaccggattagccccatgctaagcccgttcattagtagcgttgtccgtaatggcaaggtcggcctggatgcaacaaattgccttcgtattaccgacctcaagtcgggatgcaccagtctaacgcctggccctaattgcgacaggttcaagttgcacattccctatgccggtgagaccctgaaatgggatataatatttaatgcccaataccctgaactgccccctgacttcatattcggggaggatgccgagttcctgcccgaccccagcgccctgcagaacctggcctcatggaacccttctaatccagagtgtttactgctggtcgtgaaagagctggtgcagcagtatcaccaattccagtgctctcgtctgcgggagtccagtaggctgatgttcgaataccaaaccttgttggaggaaccacagtacggagagaacatggagatatacgcaggaaagaagaataactggaccggagagttttcagcccgatttctgctgaagttgcccgttgacttctccaacatacctacgtacctgctcaaggatgtgaacgaggatcctggagaagatgttgcgcttctctccgttagttttgaggacacagaggcaacccaggtgtatcccaaactgtatctcagccccaggatcgagcatgcactaggtgggagctcagcactgcacatccccgcattcccgggtggcggatgtctcattgattacgttccccaggtttgccacctcctgacaaacaaggtacagtacgtgatacagggctaccacaaaaggagagagtacatcgccgcttttctatcccacttcggtaccggagtggtggagtatgatgccgaggggttcacaaagctgaccctcttgttgatgtggaaggatttttgcttccttgtgcatatcgatctgccacttttcttcccacgcgaccagcctacacttacttttcagtctgtttatcattttactaactcgggtcagttgtactctcaggctcagaagaactacccctacagcccaaggtgggacggcaatgaaatggccaagagagctaaagcctactttaaaactttcgtaccccagtttcaggaggccgctttcgctaacggcaaattatag

SEQ ID NO: 29182 - DNA, 1131 bp, Artificial Sequence
  Description of Artificial Sequence: Synthetic coding sequence
atgagccctgaagtcgctctcaacaggatatccccaatgctgagcccttttatttcttcagtggtccggaatggcaaggtgggcttagacgcaacaaactgcctcagaattacggatctgaagtctggatgtaccagccttacccccggaccaaattgcgacaggttcaagttgcacatcccttacgcaggagaaacgctgaaatgggatataatcttcaacgcccagtatcctgagcttccacctgatttcatcttcggagaagatgccgagtttctccctgacccttcggcattgcagaatctggcctcttggaatcctagcaaccccgagtgcctgctcctcgtcgtgaaagagctggtacaacagtatcatcagttccagtgcagcaggctgcgcgagtcaagcaggctcatgtttgagtatcagacgcttctggaagagccacagtacggtgaaaatatggaaatttacgcgggaaagaagaataattggacaggcgaatttagcgctcgctttcttctgaagctgcctgtagacttctccaacatcccgacttacttgttgaaagatgttaatgaagatcctggagaagacgtcgcactactctccgtcagcttcgaagatacagaggccacacaagtctatcccaagctgtacctgtcacccagaattgaacacgcactgggagggtcgtccgccctgcacattcctgccttccctggcggaggatgtctgatcgattatgtcccccaggtgtgtcatctattaaccaataaagtgcagtacgttattcagggttatcacaagcgccgtgagtacattgccgcttttctttctcactttggcactggagtagtggagtatgatgccgagggcttcacaaaactgaccctgctcctgatgtggaaggacttctgctttctggtccacattgatttaccattatttttcccccgagaccaaccaacactcacattccagtcggtttatcatttcacaaacagcggtcaactatattctcaggcgcagaaaaattacccctattcccccagatgggacggtaacgagatggctaagcgcgcaaagagagaatccaaccgagatggcgaggaaagctcaagcgcctag

SEQ ID NO: 29183 - DNA, 312 bp, Artificial Sequence
  Description of Artificial Sequence: Synthetic coding sequence
atgattagagccttccccactactaccccccgatccctccatctatttacctcatctaccttcctcgcgcgagcgctgcccggtgcttttccaactggggcatgcgaggagaggctgtcagtgcccgagagcaccccctttacagcggttctgaaattcgccgctgaagagttcaaggtcccggcagctacatccgccatcatcacaaacgacggaatcggcattaaccccgctcagaccgctggaaacgtgttccttaaacacggaagcgagttgagaatcatcccaagggaccgcgttgggagctgctag

SEQ ID NO: 29184 - DNA, 1968 bp, Artificial Sequence
  Description of Artificial Sequence: Synthetic coding sequence
atggctacaccagtagtgacaaagactgcctggaaattgcaagagattgttgcccatgcctctaatgtgtcatctttagtgcttggcaaagccagcggcagactgctagcaaccggaggcgacgattgtagggtgaacctgtggtcaataaacaagcctaactgtattatgtctctgacaggacataccagcccagttgagtccgtgcgactgaacacccctgaagaactcatagtggcgggtagccaaagcggaagcattcgtgtgtgggatctcgaggctgctaaaatacttagaaccctgatgggccacaaggccaacatctgctccctggatttccacccctatggagaattcgtggccagtggaagccaggacaccaatattaaactgtgggacatcagaagaaagggatgcgtgtttagatatcggggacatagtcaggctgtccgctgcctgagatttagcccggacgggaaatggctggcttccgctgcagatgaccacacagtcaaattgtgggacctcacagccggaaagatgatgtccgaatttcccggtcacactgggccagtgaacgtggtggagtttcacccaaacgaatacttactcgcgtccggctcctctgacagaaccatccgattttgggacctggagaagttccaagtcgtcagttgcattgagggtgagcctggcccagtgagaagtgtattattcaaccccgatggttgttgtctgtatagcggatgccaggacagcctgcgggtctacggatgggagcccgagcgatgttttgacgtcgtgctggtgaattggggtaaggtagccgacctggccatctgcaatgatcaactgataggagtcgccttctctcagagtaatgtctcaagctatgtcgtggacttgacgagggtcactcgaacaggcaccgtggctcgcgaccctgtccaagaccacaggccactggcccagccattgcccaatccctctgcaccacttagacggatctatgaacggccaagtactacttgttcaaagccccagagagtgaagcagaactcagaatctgagcggaggtcaccgagtagtgaggatgaccgcgacgagcgtgagtcccgagcagagatccagaatgcagaagactacaatgagatatttcagccaaagaactccattagcaggactccaccccgacgctctgagcctttcccagcccctccagaggacgacgctgccacggctaaagaggccgcaaaacccagccccgcaatggatgtgcagttccctgttcccaacctagaggtactgccaagacctcctgtggtcgcctctacccccgcacctaaggcagaacctgctatcattcctgcaacacgcaatgagccgattggtcttaaggcttctgacttcttgcccgctgtgaagatccctcagcaagcggagctggtggatgaggacgctatgtctcaaatcagaaagggccatgataccatgtgtgtggtactaacctcccggcacaagaacctggacactgtgagagccgtttggaccatgggcgacatcaagactagcgtagacagtgcggtcgcaattaacgatctgtcagtggttgtggacctgctgaatatcgtgaatcaaaaagcttctctgtggaagcttgatttgtgcacgactgtcctgccccagattgaaaagctcctccagagtaaatatgaatcgtacgtgcaaacaggttgtacatcccttaaattgatcttgcagcggtttctgcccctgatcacagatatgctcgccgctccacccagtgtgggggtggatatctccagggaagagcgccttcacaagtgtcgactgtgctataagcagttgaaatcaataagcggattggtgaaatctaagtcaggcctgagtgggagacacggcagcacgttccgcgagctgcatctcttgatggcttccctggactag

SEQ ID NO: 29185 - DNA, 165 bp, Artificial Sequence
  Description of Artificial Sequence: Synthetic coding sequence
atgttcctgtctgccgtgttctttgctaaatcgaaaagcaacgagacaaaatcacccttgcggggtaaggaaaagaacactttaccattgaatggtggactaaagatgacattaatatataaagagaaaacagaaggcggtgatacagattccgagatactgtag

SEQ ID NO: 29186 - DNA, 2457 bp, Artificial Sequence
  Description of Artificial Sequence: Synthetic coding sequence
atgaagaagcagtttaaccgtatgcgccagttggcaaatcaaacagttggcagagcagaaaaaacagaagtacttagcgaggatttactacaggttgaaaagcgacttgaactggtcaaacaggtgtcccattccacacataagaagctcacagcctgtttacaaggccagcaaggcgctgaggccgacaaacggagtaagaagctgccacttaccacattggcccagtgtttgatggagggatccgctatactgggtgacgatactctcctggggaagatgctgaaactgtgtggggaaacggaagataagctcgcccaggagctgattcactttgaacttcaggtcgagagggatgtaatcgagcccctctttctgctggcggaggtggagatccccaatatccagaagcagcgaaagcacttagccaagcttgtgctggatatggacagcagtaggactcgctggcagcagacatctaaaagcagcggtctctcatcttctcttcaacccgctggagctaaggccgatgccctgcgggaagagatggaggaagcagcaaaccgcgtcgaaatctgtagagaccagttgagtgcagacatgtacagcttcgttgccaaggagatcgattacgcaaattacttccaaacactgattgaggtacaggctgagtatcacaggaaatcacttacattactccaggctgtgctgcctcagatcaaggcacagcaggaagcatgggtagaaaaaccctccttcgggaagccgttagaagaacatctgaccatttctggcagggaaattgccttccccattgaagcatgcgtaactatgctgctggagtgcggaatgcaggaagagggattgtttcgggtggccccatccgcttcaaaactgaagaagcttaaggccgcactggactgctgcgtggtggacgtgcaagagtattcagccgacccccatgccatcgcaggtgctttaaagtcctatttaagagaactccctgaaccactaatgacctttgagttgtatgacgaatggatacaggctagcaacgtgcaggaacaggacaagaaattacaggccctgtggaacgcctgtgagaaactgcccaaagctaaccacaacaatatccgatatcttattaagttcctgagcaagctcagcgaataccaggacgtcaacaagatgactccttcaaacatggccatcgtgttgggaccaaacctgttgtggccacaagctgagggtaacatcactgagatgatgactactgtttcactgcagattgtcgggatcatcgaacccattatccagcacgcagactggttcttccccggagagatcgaatttaacattacgggtaattacggatctccagtgcacgttaatcataatgctaactactcaagcatgccgagcccggacatggatcccgctgacaggcgacagcctgagcaggcacgaagaccactttctgtcgccacggacaatatgatgctcgaattctacaaaaaggacggcctgcgcaagattcagtccatgggtgttagggtcatggacacaaattgggtcgccagacgaggatcatcagcaggtaggaaggtgagctgcgccccaccaagcatgcagcctccagctccaccggctgaactcgctgcacctttgccttccccactgccggagcagccactggatagccccgctgcccctgccctgagcccttccggcctgggtttacagcccggaccagagcgaacctccaccactaagagtaaagagttatcaccgggaagcgctcagaaggggagtcccggatccagtcaaggcacagcctgtgctggtactcagcccggagctcagccaggagctcagccaggagcctcgccgtctccgtcccagcccccagccgaccaaagccctcataccctgcgcaaagtctccaagaagttggctccaatcccgccaaaggttccattcgggcagccaggcgctatggccgaccagtctgccggtcagcctagccccgtgtcactttcacccaccccaccatcgacccccagcccttacgggctcagttacccacagggttacagcctcgctagcgggcagctatctcccgctgcggcacctcccctggcttcacctagcgtgttcacaagcaccctcagtaagtctaggcccaccccaaaacctagacagaggcccacactccccccaccacaacctccaactgttaatctttcggcaagttcccctcagagcactgaggccccaatgcttgacggaatgtctcccggtgaatcaatgagcaccgacttagtccactttgacattccttcaattcacattgaactgggttccacccttcgcctgagccctctggaacacatgcggaggcacagtgttactgacaagagagatagcgaggaagaatctgaaagcacagcactctag

SEQ ID NO: 29187 - DNA, 1014 bp, Artificial Sequence
  Description of Artificial Sequence: Synthetic coding sequence
atgaccaataacagcggctccaaggctgagttagtcgtggggggaaagtacaagctggtgagaaaaatcggttcaggcagcttcggggacgtgtatctaggaatcaccaccacaaacggcgaggatgtcgcagtgaagctggagtcgcagaaggtcaagcacccccagttgctatatgagtccaagctatacacgattttgcagggcggagtcggaataccacacatgcattggtacgggcaggagaaggataacaacgtgctggtaatggatctcctcggacccagcctggaggacctattcaatttttgcagccggagattcaccatgaagacagtgttaatgctcgctgatcagatgatttcccgcattgaatacgttcacactaagaatttcctgcacagggacattaaaccagataacttcttgatgggaactggcagacattgcaataaactgtttttgattgattttggactggccaagaagtacagggacaataggacccgccagcacataccctatagggaggacaaacacctcatcggcaccgtccgttatgccagcataaatgcccatttagggatagagcagtctcggagggatgatatggagtcactcggatacgtttttatgtactttaatcgcacctcccttccctggcagggcctgagagccatgaccaaaaaacaaaagtacgagaaaatatccgaaaaaaagatgagcacccctgtcgaggtgctgtgcaagggatttcctgctgaattcgccatgtatctgaactactgtcggggtctgagatttgaggaggtacctgattatatgtatttacgccagttattccggattttgtttcgcacacttaatcaccagtacgattatacttttgattggactatgctaaaacagaaggcggctcagcaggccgcatcatctagtggtcaggggcagcaagctcagactcagaccggcaagcaaaccgaaaaaaataagaataacgtcaaggataattag

SEQ ID NO: 29188 - DNA, 1608 bp, Artificial Sequence
  Description of Artificial Sequence: Synthetic coding sequence
atgagtgaaggggagtcccaaacagtgctgagtagcggtagcgatccaaaggtggagtccagcagctctgcccctggtttgacctccgtgtctcctccggtgacatctacaacctcagccgcatcacctgaagaagaagaagaaagcgaagacgagagtgaaatactggaagaatcaccctgcgggagatggcaaaagcgacgcgaggaggtgaatcagagaaatgtccccggaatcgactcggcatacttagcgatggacaccgaggaaggcgttgaggtggtatggaacgaggttcagttctctgaaaggaaaaattacaagctgcaggaagaaaaggtcagagccgtcttcgacaacctcattcagctcgaacaccttaatatagtgaagtttcacaagtactgggccgatattaaggaaaacaaggcaagggttatcttcataacagaatacatgagtagcgggagcctaaaacagttcctcaagaaaaccaagaagaatcacaagaccatgaacgagaaggcatggaaacggtggtgtacccagatactgtcagccctctcttacctgcacagttgcgaccctcccatcattcacggcaatctgacatgcgatactattttcatccagcacaacggcctgataaaaataggatctgtggctccggataccatcaacaatcacgtgaagacttgcagagaagagcagaaaaacctgcatttttttgcacccgagtatggcgaagtgactaacgtcaccaccgccgtcgatatttacagttttgggatgtgcgccctggagatggctgtgctggagatccagggcaacggggaatcttcctatgttccccaggaggcaatcagtagcgcaattcaactcttggaagatccgctccaacgagaatttatacagaaatgcctccagtccgaaccagctcgccgtcccaccgctagggaacttctgtttcatcctgctctgtttgaggttccaagtctgaagctattggccgcacactgcatagtggggcatcagcatatgatcccagaaaacgccctggaggagatcaccaagaatatggacaccagtgccgtactcgctgagattccagcaggcccagggagagaaccggtgcaaacgctatatagtcagtcccccgcactcgagctcgacaaattcctggaggacgtgcgaaacggcatctaccctctcactgccttcggacttccaagacctcagcagccgcagcaggaagaagtaacctcacctgtagttcctccctccgtgaagactcccaccccagagcctgccgaggtcgaaacgagaaaagtcgtactgatgcagtgcaatatcgagagtgtcgaagagggtgttaaacaccatttgactttactgctcaaactggaggacaaacttaacaggcacttatcctgcgacctgatgcctaatgaaaatatcccggaacttgccgcagagttggtacagctgggattcattagtgaggcagaccaatcgcgcctgacctcactgctggaggagacactcaataaatttaactttgcacgcaattctacacttaacagtgcagcagttacagtctcctcgtag

SEQ ID NO: 29189 - DNA, 2169 bp, Artificial Sequence
  Description of Artificial Sequence: Synthetic coding sequence
atggaaacatccgatatccagatattctatcaggaagatcccgagtgtcagaatctctcagagaacagttgccccccatcagaggtctccgataccaacctgtatagtccttttaaaccccgaaactatcagctcgagctggccctgcccgcaatgaaaggcaagaatactattatatgcgcccctacaggctgcgggaaaactttcgtttcactgctgatctgcgagcatcacctgaagaagttcccccaaggtcagaaaggtaaggtagtctttttcgcaaaccaaattcctgtatatgaacagcagaagtctgtgttcagtaagtactttgagcggcacggttacagagtcacaggaattagcggtgcaactgccgaaaacgtgcctgttgagcagattgttgagaataatgatattatcatcctgacaccccagatcctggtgaacaatctgaagaaagggaccatccccagtctcagcatctttactctgatgatctttgatgagtgtcataacacctccaagcaacatccttataatatgattatgttcaactacttagatcagaagttgggtggctcttcaggacccttgccccaggtgattggactaacagcaagcgtaggcgtcggggatgcaaagaacaccgacgaggccctggactacatctgcaagctctgcgcttccctggatgcaagcgtaatagcaacagttaaacacaaccttgaggagttggaacaggtcgtgtacaagcctcagaagttttttcgcaaggtcgagtctaggattagcgacaagttcaagtatattattgcacagctcatgagagacacggagtctctggcaaaaagaatttgcaaggatcttgagaatttatcccagatccagaatcgcgagtttggcacacagaagtacgagcagtggatcgttactgtccagaaggcatgcatggtttttcagatgccagataaagacgaagagtcccgcatttgcaaggccctgtttctttatacttcacacttgcgtaagtacaacgacgctctcatcattagtgaacacgcaaggatgaaggacgcattagattaccttaaagactttttctctaacgttcgcgctgcaggttttgacgaaatcgaacaggacctgactcagcgcttcgaggaaaaactgcaggagcttgaatctgtgagccgcgaccctagtaacgagaacccgaaactggaagacctgtgttttatactgcaagaagagtaccacctgaacccagagacaatcactattctctttgttaaaacgcgagccctcgtggatgctttgaaaaattggatcgagggcaatcccaaactaagtttcctgaagccaggaatcctcaccggcaggggaaagactaatcaaaatacggggatgaccttgcccgctcaaaagtgcattctcgatgcattcaaggcgtcaggggaccataatatcctcatcgcaacgagtgtggccgatgagggaattgatattgcacagtgtaacctcgtgattctgtatgaatacgtcggtaacgtcatcaagatgatacagacccgcggaaggggtagagccaggggcagcaaatgtttcttactcacaagcaacgcaggagttatcgaaaaggagcagattaacatgtataaggaaaaaatgatgaacgatagcatcctgcggctgcagacttgggatgaagcggttttcagggagaagatactgcatatccagacacacgaaaaattcattcgcgactctcaggagaagcccaagcccgtacccgacaaagagaacaagaagttgctgtgtcggaagtgtaaggctctcgcatgttacaccgccgacgtccgcgtcatcgaggaatgccattacacagtgcttggggacgcctttaaagagtgcttcgtaagccgtccacatcctaaacctaaacagttctcgagttttgaaaagcgggcaaaaatcttttgtgcccgacagaactgtagccatgattgggggatccacgtgaagtataagacttttgagatccctgttatcaagatcgaatcttttgtggtggaggatatagccaccggcgtgcaaacgctgtatagtaagtggaaggacttccacttcgagaagattccgtttgaccctgccgagatgagtaagtag

SEQ ID NO: 29190 - DNA, 2643 bp, Artificial Sequence
  Description of Artificial Sequence: Synthetic coding sequence
atgacaacagagcagagacgctccctgcaagcttttcaagattacatacggaaaactctcgatccaacatacatactgagctacatggcgccatggttcagagagggctacagtggactgtatgaggcgatcgagagctgggatttcaaaaagattgagaagctggaggagtaccgtctactcttgaaacggttgcagccagagtttaagacacggataatacccacggacatcatctcggacctctccgagtgcctgatcaatcaggagtgcgaggaaatcctccaaatctgttccaccaagggtatgatggctggcgctgagaagttggtggaatgcctgctaaggtcagacaaggagaattggcccaaaacactaaaactggcacttgaaaaggaacgcaataaattctcggagttatggatcgtggaaaagggcatcaaagatgtcgaaaccgaggatctggaggacaaaatggaaacatccgacatccagattttttatcaagaggatcctgagtgtcagaacctgtccgaaaattcctgccctccctcagaagtgtccgacaccaacctttatagcccatttaagcctaggaactatcagctagagcttgcgctgcctgccatgaaagggaaaaatacaatcatctgtgctccaaccgggtgcggcaagaccttcgtgagcctgttaatctgcgagcaccacctgaaaaagtttcctcagggtcaaaaaggtaaagtggtgttctttgccaaccaaattccagtatacgaacagcagaagtctgtgttcagtaagtactttgaacgccatggatatcgcgtcaccggtataagcggggcaaccgccgaaaacgtacccgtcgagcagatagtggagaataacgatatcatcatactcacaccgcagatattagtcaacaatttaaaaaagggcaccattcccagcctgtcgatatttacactaatgatctttgacgagtgtcacaatacttctaagcaacatccctacaatatgataatgttcaattacctggaccagaagttagggggaagtagtggccctcttccgcaggtgataggcctgacagctagcgtcggagtaggcgacgccaagaacacagatgaagccctggattacatatgtaaactttgcgccagtctcgacgcttccgtgattgccacagtaaagcataatctggaagaactggagcaagtagtatacaaaccacagaaattcttccggaaagtggaatctcgcatcagcgacaaatttaagtatatcatagcccagctgatgagggatacagagtctctcgcaaagcgaatctgcaaagatctggaaaatctgtcacaaatacagaatcgcgaatttggcacccaaaagtatgaacagtggatagtgaccgttcagaaggcctgcatggtattccaaatgccagacaaggacgaagagtcccggatttgcaaagctctcttcctgtatacctctcatttgcgcaaatacaacgatgcgctgatcatctccgaacacgctcggatgaaagacgcccttgactatttgaaagactttttttccaacgttcgggcagcgggattcgatgaaatcgaacaggatctcacacagaggtttgaggagaagctgcaagaactggaatctgtgtctcgtgatccaagcaacgaaaacccaaaactggaggatttgtgttttatactgcaagaagagtatcatcttaatcccgaaaccatcaccatcttgtttgtgaagacccgagcactcgtcgatgcactgaaaaattggattgagggaaatccaaagctgtccttcttgaaacccggaatcctaactggaagaggcaagaccaatcagaacactggcatgacccttcctgcccagaagtgcattcttgacgcgtttaaagctagcggcgatcataacatcctgatcgcaacgagcgtggcagacgaggggatagatattgcacagtgtaatctcgtcattctgtatgagtacgtaggcaacgtcattaagatgattcagacacggggacgcggtcgggcacgagggtctaaatgctttctgctcacgtcaaacgctggcgtaatagaaaaggaacagattaatatgtataaggaaaaaatgatgaacgatagcattctaagattacagacctgggatgaggctgtcttccgtgaaaagatacttcatattcaaacccacgagaagttcatacgcgactctcaagagaaacccaagccggtgcctgacaaagagaataaaaagttactgtgtcgcaaatgcaaggccctggcatgctatacagcagatgttcgagtgattgaagaatgccattatactgtcctgggagatgcatttaaagagtgcttcgtttctcgccctcatcctaaaccaaaacagttctctagtttcgaaaagagagcaaaaatcttttgcgcacggcagaattgctcacacgactgggggatccatgtgaagtataagacctttgagatccctgtaataaaaattgaatcatttgtggtggaggacatagccaccggggtccagaccctgtattccaaatggaaggactttcattttgaaaagattcctttcgaccctgccgaaatgtcaaagtag

SEQ ID NO: 29191 - DNA, 2778 bp, Artificial Sequence
  Description of Artificial Sequence: Synthetic coding sequence
atgaccaccgagcagcgcagaagcctgcaagcgttccaagactatatccgcaagaccttggaccctacttacattctgtcatatatggccccttggttccgcgaggaggaggtccagtacattcaggctgagaaaaacaataagggcccaatggaagcggcaactctttttctgaagttccttttagaactgcaggaagagggctggttcagagggttccttgacgccctggaccatgccggttattctggattatacgaggctattgaatcatgggacttcaagaaaatcgaaaaactcgaagagtacagactcctgcttaaacgattgcagcccgaattcaagacaagaatcatacccactgatattatctcagacctgtcagagtgtttgattaaccaggagtgcgaagaaattctgcagatctgctcaacgaagggtatgatggctggggcagagaagctggtcgagtgccttctccgaagcgataaagagaattggccaaagaccctgaagctggccctagaaaaagaacggaacaaattttccgaactctggattgtcgaaaaaggtatcaaggatgtggagaccgaggatttggaggacaagatggagacatccgatatacaaattttttaccaggaggacccagaatgccagaacctttctgaaaacagttgccctccaagcgaggtgtccgacacaaatctgtacagtccattcaaaccaagaaactatcagctggagctggcccttcccgcaatgaaggggaagaatacaatcatctgcgcccctaccggatgtggaaagacattcgtgtctttactgatctgtgagcatcacctaaaaaaattccctcaggggcaaaaggggaaggtggtctttttcgccaatcagatcccagtctacgagcagcaaaaaagcgtgttctccaaatatttcgagcgccacggttatcgtgtgaccggcattagtggtgcaactgctgagaacgtgccagtggagcagatcgtcgaaaataacgatatcatcattcttaccccccagattctggttaacaatttgaagaagggcaccattcccagtcttagtatcttcactctgatgatcttcgacgagtgccacaatacttcaaaacagcatccttacaatatgattatgtttaattaccttgaccaaaagctcggtgggtcatccgggccactcccgcaggtgatcggattgactgctagcgtcggtgtcggagacgccaagaatacagacgaagccctcgactatatttgtaagctgtgcgcttctctggatgcctctgtcattgccacagtgaaacataacctggaagagttagaacaagtggtctacaagccgcagaaattttttcgtaaagtcgagtccaggatcagtgacaagttcaagtacatcatcgcacaactgatgcgtgataccgagagtctagcaaagcgcatctgcaaggatctggagaacctaagccagatccagaatagagaatttggcacacagaagtacgaacagtggattgtgactgtgcagaaagcgtgtatggtctttcagatgcccgacaaagacgaggagagccgcatttgtaaggcactctttctatacacctctcacctccgtaaatataacgatgcactgattatcagtgagcacgccaggatgaaggacgctctcgattatttaaaggactttttttctaatgtgcgggctgctgggttcgacgagatcgaacaggatctgacccagcgcttcgaggagaaactgcaggagcttgagtccgtcagtcgagatccatcaaacgaaaatcctaagttagaggatctatgcttcattctccaggaggaataccacttgaatccagagacgataaccattctcttcgtcaaaacgagagcactggtcgatgctctcaagaactggatcgagggcaatcccaaattgtcattcctgaagccgggaattctcaccggcagaggaaagacaaaccagaataccggcatgacactaccagcccagaaatgtatactcgatgcctttaaggcctctggcgatcacaacatacttatagctacaagcgtggctgatgaggggatcgatatcgcccaatgcaatcttgtgatcctgtatgagtatgtgggcaacgtgataaaaatgatccagacacgcggacggggaagagccaggggatccaaatgcttcctgctgactagtaatgccggagttatcgagaaggaacagatcaacatgtacaaggagaaaatgatgaatgacagcattttgagactccaaacatgggacgaggcagtgtttcgtgaaaagatactgcacatacaaactcacgaaaagttcatccgggactctcaggaaaagcctaagcctgtcccagataaggaaaataaaaagctgctctgcaggaaatgtaaagcactcgcgtgctacacagcggacgtcagagtgatcgaagagtgccattacactgttctgggagacgcctttaaggaatgcttcgtcagcagaccacatcccaaaccgaaacaattctctagcttcgaaaaaagggcgaaaatattctgcgcacgccagaactgcagccacgactggggcattcacgtgaaatacaagacattcgagatccccgtcatcaagatcgaatcctttgtggtcgaggacattgccactggggtacagaccttatactcgaagtggaaagactttcattttgagaaaatccctttcgaccctgctgagatgtctaaatag

SEQ ID NO: 29192 - DNA, 987 bp, Artificial Sequence
  Description of Artificial Sequence: Synthetic coding sequence
atggatggagaggatatccctgatttttcttcactaaaggaggagaccgcctactggaaggagctcagccttaagtacaaacaatcattccaggaggcacgggatgagctggtggaatttcaagagggatctagagagctggaagccgagttagaggcccaactcgtacaggccgaacagaggaacagagacttacaggccgacaatcagcggctgaaatatgaggtggaggctttgaaagaaaaacttgaacaccagtatgcccagtcctacaaacaggttagcgtgcttgaggatgatctgtcccagacacgagccatcaaggagcagctgcataaatacgtacgcgagctggaacaggccaatgatgatctggaacgggctaagagggcgaccatagtgagcctggaagactttgagcaacgtctgaaccaggcaatcgaacggaacgctttcctagaatccgaattagacgagaaagagtccttactggtttccgtccagcggctcaaagatgaggcacgcgatcttagacaggagttggccgttcgcgaaaggcagcaggaggtaaccaggaagtcagctccatcctcgcctaccttggattgtgagaagatggactccgcagttcaggcttccttgtccttacctgccacacctgtcggaaagggcacagagaacacattcccatcaccgaaggctattccaaatggttttggaacctctccattgacccccagcgctcgcatcagcgccctcaacatagtgggggacttactgaggaaagtgggcgcactcgagtcaaagttggcggcttgcagaaacttcgccaaggatcaggcctcccgtaagtcctatatctccggtaacgttaattgtggagttctgaatggaaacgggactaagtttagtaggtcagggcacacaagttttttcgacaaaggtcaggaaaaagtgattttccccacccttttcatgggccaatag

SEQ ID NO: 29193 - DNA, 2898 bp, Artificial Sequence
  Description of Artificial Sequence: Synthetic coding sequence
atggcactgctgtgcggcctggggcaggtcactttgcgcatctgggttagtctgcccagccagagtgagaacggtatcgggttcctcgcagccagagcgtttttgcggtctggaggtatggaagccctgacgacccagctgggccctggcagagaaggctctagtagcccaaattcgaagcaagagctacagccttactctgggtcttcggccctcaagcccaatcaagtcggcgaaacttccctgtacggagtccctattgtgagtctggtgatcgacggacaggagaggttgtgcttggcgcagattagcaatacattgctgaagaactattcctataacgagatccacaaccgccgtgtggccttaggtattacatgcgtgcagtgcactcctgtacagctggaaatattgcggcgagccggagctatgcccatttcaagcaggagatgcggcatgatcacaaaaagggaggctgagaggctttgcaagagtttcctgggggagcataagccgccaaagttacccgaaaactttgcttttgacgtggtgcacgagtgtgcttggggcagccggggatcattcatacccgcacggtacaacagttcccgcgctaaatgcattaagtgcggttactgtagcatgtacttctctccaaacaagtttatctttcatagccataggactcctgacgcaaagtatacccagcctgatgcagcgaattttaatagctggcggaggcatcttaagctcagcgacaaatccgccactgacgaattatcacatgcgtgggaggacgtgaaggcaatgttcaacggagggacacggaagagaacgttctctttacaagggggaggcggtggaggcgcaaatggcggttctggaggacagggtaagggcggagcgggtggcggaggtgggggtggccctgggtgtggagcagaaatggcccctggcccacccccacacaaatccctgcggtgcggcgaggacgaagccgctggcccacctggacctccaccccctcatccacagcgagggctagggttggccacaggtgcgtcaggacccgctggacctggcggacctggaggcggtgcaggagtccggtcttatcccgtaattcccgtcccctctaaaggattcggcctcctgcaaaagctgccacctcccttgttcccccacccatacggcttccccacagccttcgggctgtgccctaagaaggatgacccagtgttgggtgctggcgagcccaagggtgggcctgggactggatcaggtgggggtggcgctggcacagggggaggggctggaggccctggcgcaagccacctcccacctggcgctggggcaggtccaggcggtggcgctatgttttggggccatcagccctccggcgcagccaaagatgccgctgcagtggccgcagctgcagctgcagccaccgtttatcccacgtttccaatgttctggccagccgctggatccctgcctgtgccaagctacccagcagcccagtcccaggccaaggcagtagctgctgccgtggcagccgcagcggcagcggcagctgctgcagcaggatctggcgctccagaaccactggatggagccgaacccgcaaaggagtctggactgggagccgaagaaagatgccccagcgcacttagccggggaccattggacgaggacggtactgacgaagctctaccaccaccgctggcccctctgccaccccctccaccaccacccgctaggaaggggagttatgtgagcgcttttagacccgttgtaaaagataccgagagtattgccaagttatatggatctgcgagggaagcttatggggcaggacctgcacgcggtcccggacccggagctggctcgggtgggtatgtctcccctgactttctctctgagggctccagttcctataacagcgcctcaccagatgtggatacagccgacgagccagaagttgacgttgagtctaacagatttccagacgatgaagacgcccaagaggagacagagcctagtgcgccttcggccggtggcggtccggatggtgaacagccgactggaccaccatctgctacttcctccggcgctgatgggcctgctaacagtccagacggcggatcacctaggccccgacggaggctgggaccccctccggcagggcgaccagctttcggcgacctggccgctgaggatctggtgaggaggccggaacgcagccccccaagcggagggggaggatacgaactgcgcgagccatgtggaccccttggcggtccagccccagccaaggtttttgctcccgagagagacgaacacgtgaagtcagcagccgtggccctaggacctgctgcgagttacgtttgcacgccggaggcccacgaacccgacaaagaagataatcattctcctgctgacgacctggaaactaggaagagctatccagaccagaggtccatatcacagccttcccctgcaaatactgaccgcggagaggatggactgacactagacgtgaccggtacacacctggtggaaaaggatatcgaaaatcttgcgcgtgaagagctgcaaaaacttctgttggagcagatggaactgaggaaaaagctcgaacgggagtttcagtctctgaaggacaactttcaggaccagatgaaacgcgagctcgcctacagagaagaaatggttcagcaattgcagattgttagggataccctgtgcaatgagctggatcaggagagaaaggctagatacgccattcagcagaagctgaaggaggctcacgacgcactgcatcacttctcatgtaagatgctaacccccaggcactgtacaggcaattgtagcttcaaaccacccctgcttccgtag

SEQ ID NO: 29194 - DNA, 1803 bp, Artificial Sequence
  Description of Artificial Sequence: Synthetic coding sequence
atggcctccaatcacaagtccagtgcggctagacccgtgtcacgtggtggagtgggactgacaggtagacctccaagtggcattagacccctctctggcaatatccgggttgctaccgcaatgcctcccggaactgcgcgtcctggtagcagaggctgtcccatcggtactggaggcgtgctctccagtcaaatcaaagttgcccatcggccagtgactcaacagggccttaccggcatgaagaccgggactaagggcccacagagacaaattcttgataaatcctactatctaggcctgctgaggtcgaagatcagtgagctgaccacagaggtcaacaagcttcaaaagggaatcgagatgtataaccaggaaaatagcgtgtaccttagctacgagaaacgcgctgaaaccctagcggtcgagattaaagaactgcagggccaattggctgattacaatatgttggtagataaacttaatacgaacaccgagatggaagaagtaatgaatgattataacatgctgaaggctcagaatgacagggaaacccagtccctggatgtgatcttcacagaacgacaagccaaagagaaacaaataagatcagtggaggaggaaatagagcaagagaagcaggccacagacgacataattaagaatatgtcctttgagaatcaagtcaagtacctcgaaatgaaaaccacgaatgagaaacttctccaggaactcgatactcttcagcagcaattggattcacaaaatatgaagaaggagtccctggaggctgagatagcccattctcaagtcaaacaggaggccgtgttactgcatgagaagctgtatgagctagagtcccatagggaccagatgatagctgaggacaaatcaataggcagtcctatggaggagcgcgaaaagttgctaaagcagataaaagacgacaaccaggaaatcgcaagcatggagcgtcagcttactgatacgaaggagaagataaaccagtttatcgaggaaataagacagctggacatggaccttgaggagcaccaaggggagatgaatcagaagtacaaggagttaaagaaacgcgaagaacacatggacacttttattgagaccttcgaagaaacaaaaaaccaggagctcaagagaaaagcccagatcgaggccaacatagttgcccttttagaacattgctcacgtaacattaatcggattgagcaaatatcatcaatcaccaaccaggaattgaagatgatgcaggatgatcttaacttcaagtctacagaggtgcagaagagtcagtcaaccgcacagaacctgaccagtgatatccaacgactgcaattggacctgcagaagatggagctcctggagagcaaaatgactgaagaacagcatagcttgaaatctaagatcaaacagatgacaactgacttggagatctacaatgacctgcccgctcttaagtcttccggcgaagaaaagattaaaaagcttcatcaggagaggatgatcctgtcaactcacaggaacgcgttcaagaagattatggaaaagcagaatattgagtatgaagctttaaagactcagttgcaagagaacgagacccactcccagctcactaatctcgagcgcaagtggcagcacctggagcagaataatttcgcgatgaaggagttcatcgcaaccaagagtcaggaaagcgattaccagcctattaaaaagaacgttacaaaacagattgccgagtataacaagacaatcgtggatgctctgcattctacctcgggtaattag

SEQ ID NO: 29195 - DNA, 582 bp, Artificial Sequence
  Description of Artificial Sequence: Synthetic coding sequence
atgctggtggctggaaatgatagggtgcaagctgttatcacgcagatggaggaggtatgccaaacaatcgaggacaacagcaggagacagaaacagctcctgaaccaaagatttgagtctttgtgtgccgtcttggaagaaagaaagggggaacttctacaagcgcttgccagagagcaggaggaaaagctgcaacgcgtgaggggattgattaggcagtacggcgatcaccttgaagcgagttcaaaactggttgagtccgctattcagtccatggaagaaccacaaatggctctatatctgcaacaggctaaggagctgatcaataaggtgggggcaatgtcgaaggtcgaacttgccggacgacccgaacccggatatgaaagtatggagcagttcactgtgagagtggagcatgtagctgagatgctcaggaccatcgacttccagccaggagcctccggggaagaagaagaggtggcgcctgacggcgaagaagggagtgctggccctgaagaggagcgacctgatgggcctctcggaccctactctgcttacgtgtcgttgtgcggggctccatag

SEQ ID NO: 29196 - DNA, 1077 bp, Artificial Sequence
  Description of Artificial Sequence: Synthetic coding sequence
atgaatttcaccgtgggctttaaaccgctcctgggcgatgcccactccatggataaccttgagaagcagctgatctgtcccatttgtctggaaatgttctccaaacctgttgtgattcttccgtgccagcacaatctgtgccgcaagtgtgctaatgatgttttccaggcttccaaccccctttggcagtcaaggggctcaacaaccgtatccagcggcggaagatttcggtgcccctcatgcagacatgaagttgttttggatcgtcacggcgtttacggtctacagcggaacctcctggtggagaatattatcgatatttacaagcaggaatcctcgcgccctctgcactctaaggcagaacagcatctcatgtgcgaagagcacgaggaagaaaaaattaatatttattgcttatcctgtgaggtgcctacttgttcgttgtgcaaggtgttcggcgcacataaagactgtgaagtagcaccgctacccaccatttacaagaggcaaaaatctgaattgagcgacggaatagctatgttggtggccggaaatgatcgggtgcaggccgtcattacacagatggaagaggtgtgccagactatcgaggataatagtcgtagacaaaagcagctgttaaatcagaggtttgaatccctgtgtgccgtgcttgaagaacgcaaaggggaattgttgcaggcattggctcgggaacaggaggaaaagctgcagagagttcggggtctaatcaggcagtacggagaccacctcgaggcctccagcaagctggtggagagtgctatccagagcatggaggaacctcagatggctttgtatctccagcaggctaaggaactcattaataaggtcggggctatgagcaaggtcgaattggcgggacgccctgagccaggatacgagagcatggagcagtttactgtgagggtggagcatgtggcggagatgctgcggacgatcgacttccagccaggagccagcggcgaggaggaggaagtggcacccgatggagaggagggatcagctggccctgaggaggagcgaccggacggcccttag

SEQ ID NO: 29197 - DNA, 756 bp, Artificial Sequence
  Description of Artificial Sequence: Synthetic coding sequence
atggctgcttcaaccatgtccatctgtagttctgcatgtaccgactcttggagagtggtggattgtcccgaaagctgctgtgaaccatgctgttgtgcccctgctccctccttgacactggtctgtacccccgtctcatgtgtgtctagcccttgttgtcagaccgcttgcgaaccttcagcttgtcagtccggttatacctcatcatgtacgaccccttgctatcagcaatcgtcttgccaacctgattgttgcacaagctccccgtgtcagcaggcttgttgcgttcccgtctgttgcgtgccagtttgttgtgtgccagtgtgtaacaaacctgtgtgtttcgtacctacatgctctgagtcctctccctcatgttgccaacagagctcctgtcagccaacatgctgtacttcctcaccctgccagcaggcctgttgcgtccccgtgtgtagtaaatccgtctgctacgtccctgtctgtagtggagctagcaccagctgttgccagcagtcgagttgccagccagcatgttgcactgcttcctgctgccgaccatcctcaagtgtgtctcttctgtgtcaccccgtgtgtaagtccacttgttgcgtccccgttccaagttgcggcgcaagtgcttccagttgccaacctagctgctgccggactgcgtcttgcgtttcgctgctctgcagaccagtatgttctagacccgcttgctactccctgtgttcggggcagaaatcctcctgctag

SEQ ID NO: 29198 - DNA, 1128 bp, Artificial Sequence
  Description of Artificial Sequence: Synthetic coding sequence
atggccgctagtactatgagcgtctgctcctccgacctctcctacggatctcgtgtgtgtcttccaggttcatgtgattcatgttctgacagctggcaggttgatgactgcccggaaagctgttgcgagcccccatgttgcgccccaagctgttgcgcgccagcgccatgcctgtcactggtgtgcacacctgtctcccgcgtctcctccccgtgttgccctgttacatgcgaaccgtctccatgccaatctggatgcacaagcagttgtacacccagttgctgtcagcaatcaagctgtcagcttgcgtgctgtgcctcctcgccatgtcagcaggcatgttgcatgcccgtgtgttgcaagacggtgtgttgcaagcctgtttactgtgtgccagtgtgctcaggggatagctcctgctgccagcagtccagctgccaatccgcatgttgtacttcgtccccatgccaacaggcgtgttgtgtccctatttgttgtaagcccgtatgctcaggcattagcagttcatgctgccagcaatcatcctgcgtatcctgtgtctcttctccatgctgtcaagctgtgtgcgaaccgagtccgtgccagtccggctgtatttcatcatgcaccccttcttgctgtcagcagagttcgtgccagcccgcatgctgcacttcctctccttgtcagcaagcttgctgcgtgcccgtgtgttgtaaaccggtgtgctgtgtgcccacatgtagcgatgactccgggtcttgttgtcagcccgcttgttgcacttccagccagtcccaacagggctgttgtgtgcctgtatgctgtaagcccgtgtgttgcgtcccagtgtgttcaggcgcatcttcatcatgttgtcaacagtccagctgccaacccgcatgttgcaccactagctgttgccgaccaagctcatctgtgagtttactttgtcgccctgtgtgccgacccacctgctgtgtacccgtgccttcctgttgcgcccctacttccagctgtcaggcaagctgctgccgtccagccagttgcgtgagcctgttatgcagacccgcttgttccagacccgcttgctgcggcccaaccagcacgcagaaatcatcctgctag

SEQ ID NO: 29199 - DNA, 1587 bp, Artificial Sequence
  Description of Artificial Sequence: Synthetic coding sequence
atggccacccgcgtggaggaggctgccaggggcagaggaggcggagctgaggaagccactgaggcaggcagagggggtcgtcggcgatcaccccgacagaagtttgagatagggacaatggaagaggctggcatctgtggtctgggcgtgaaggccgatatgctctgtaactctcaatccaacgacatcctgcagcatcaaggtagcaattgtggcggaacatctaacaaacattcactagaggaagatgaaggctcagactttattactgagaatcggaacttggtttctccggcttactgcactcaagagtctcgggaggagattcctgggggagaagccagaacggatcccccagatggccagcaggactccgagtgcaatcgcaacaaggagaagactctcgggaaggaggttctgctgcttatgcaagcacttaataccttaagtacccccgaggagaagctggctgccctttgcaaaaaatatgctgaccttttggaggagtctagaagtgtgcagaagcagatgaaaattctgcaaaagaaacaagctcaaattgtgaaggagaaggttcacctgcagagcgagcacagcaaggccatattggcacgcagcaagttggaatcactgtgccgcgaattgcaacgacataataaaacgctgaaggaagagaacatgcagcaggctagagaagaggaggagcgaaggaaggaagccactgcacattttcagatcaccctcaatgagattcaggcccagttggagcaacatgacatccataatgctaaactacggcaagagaatattgagctcggtgagaagttaaaaaagctgatcgaacagtacgctctgcgggaggaacacatcgacaaagtgttcaaacataaagagcttcagcagcagttagtcgatgccaagctgcagcagactactcagttgatcaaagaagccgatgaaaagcatcagagggagagggaattcctcctcaaagaggcgacggaatcccgccataagtacgagcaaatgaagcagcaagaggtgcagttaaaacaacagctgtcactatacatggacaaattcgaggagtttcagaccacaatggctaagtctaatgaactgtttaccacatttcgacaggagatggagaagatgaccaagaaaatcaagaagttggagaaagagaccattatctggcgaaccaaatgggagaataataacaaagctttgctccagatggcggaagaaaagaccgtgcgagataaagaatacaaggctctccagattaagctggagcggctggaaaaactgtgccgggcattacagactgaaaggaatgagcttaatgagaaggtggaagttctaaaagaacaggtttcaatcaaagctgccattaaggcagccaatagagacctcgccactccagtaatgcaaccctgcaccgctctggattcacacaaggagttaaacacctccagtaagagagctctgggagctcacctcgaggctgagcctaagtcgcagcgctctgcggtgcaaaaacctccgagcacagggtccgccccagccatcgagagcgtcgactag

SEQ ID NO: 29200 - DNA, 399 bp, Artificial Sequence
  Description of Artificial Sequence: Synthetic coding sequence
atgagggcctctccgtgcataagccagccagcagcctcctggcatccgcgaccatccgcactccggccaactgctggatcaggccctgacacccgcacacctggaactgtcgaggacggctcagcaccctgccccgcttttagaagccccgctgtaagcccctgcggcgaggagccatgctgtttccagatttcccctgctgaggagacacttgaactggggagacttgtgtccccgggtaattgtgatacactatccccgcgagctgctggcttctatgcctgccatgtccggtctctgatcccctgccgctctactaaaggcagatggccactgactgcctcagctgctggactgagcaggcacgcacagtgcggccctagcttaggtctcggatag

SEQ ID NO: 29201 - DNA, 1944 bp, Artificial Sequence
  Description of Artificial Sequence: Synthetic coding sequence
atggccgaatttcgagtccgggtgagcaccggcgaagcatttggcgcaggaacctgggacaaagtctctgttagtattgtcggaaccaggggcgagtccccgccactgccattagataaccttggcaaagagttcacagccggagcagaagaggactttcaggtcacgttaccagaggacgtgggcagggttctgttgctgagggtccacaaggccccaccagttctccctctcttaggaccccttgctcctgacgcgtggttttgcagatggttccagctcactccacctaggggtggccatctgctgtttccctgttatcaatggttggaaggagctgggaccctagtactccaagagggaacagctaaggtctcttgggccgaccaccaccccgtgctgcagcagcagcggcaggaggagctgcaagccaggcaggagatgtatcaatggaaagcctacaatcccggttggcctcactgcctagatgagaagaccgtggaggatctcgagttgaatatcaaatattccacggcgaaaaacgcaaacttctatcttcaggcaggaagcgcttttgctgaaatgaagattaagggcctcctggaccgtaagggactgtggaggtctttgaacgaaatgaagcggatattcaattttcggcgaacaccagctgccgaacatgcctttgagcactggcaggaagatgcgtttttcgcttcccagttcctcaatgggctgaatccagtgttgatacgtagatgccattatctgccaaagaacttcccagtgacagacgccatggtggcgtcagtgcttggcccaggaacgagccttcaggctgagctggagaagggctcgctcttcctggtggaccacggaatcctttcaggcatccaaaccaacgtgatcaacgggaagcctcaattcagcgccgcacctatgactttgctctatcaatcccccggatgcgggcctctgttacccctggctatccaattatcgcagacccccggacccaatagccccattttcctgcccactgacgacaaatgggactggctgctcgccaagacatgggtcaggaatgccgagttcagtttccatgaagctctgacgcacctgcttcactcacatctgctacctgaggtgtttacactggccactcttagacagctcccgcattgccacccactatttaagtccacaggaatcggaattgaagggttctccgaacttattcagagaaatatgaagcagctcaattactccctcctctgcctgccagaggatatccgcacccgcggtgtcgaggacatcccagggtattattacagagacgatggaatgcaaatttggggagccgtagaacgttttgtgtcggagattatagggatctactatccaagtgacgagtctgttcaagacgacagggagctgcaggcatgggttcgcgagatcttctcgaaaggcttcctcaatcaagaatcctcaggaatcccctcaagtctcgagactagggaagccttggtgcagtatgtaacaatggtaatctttacatgttcggcaaagcacgccgcagtgtccgcagggcagtttgatagctgcgcatggatgcccaatttgcccccttcaatgcagctcccaccccctacttcaaaaggcttagctacatgtgagggcttcatcgcaactctgccccctgtgaatgctacatgcgacgtcatactggcactgtggctgctctccaaagagccaggcgatcagcgcccactggggacatacccggatgaacacttcacagaggaggctccacggcgatccatagctacttttcagagcaggcttgcgcagatctcccggggtatccaagaaaggaatcagggactggtcttgccgtatacctacttggaccctcccctgatcgaaaactcagtatctatatag

SEQ ID NO: 29202 - DNA, 2031 bp, Artificial Sequence
  Description of Artificial Sequence: Synthetic coding sequence
atggctgagtttcgagtgcgcgtgtcaacaggcgaggcttttggcgctggtacatgggacaaggtgtccgtgtccatcgtgggcacgcggggagaaagccctccactgccactcgataacctaggaaaggaattcacagctggcgctgaggaggattttcaggtcaccctgcccgaagacgtgggaagggtcctgttactgcgagtgcacaaggcccctccggtcctgcccctgttaggcccattagcgcctgacgcttggttctgccgctggtttcagctaactcccccaaggggtggacacctcctgttcccgtgctaccagtggttagagggggcaggcaccttagtattacaggaaggtacagccaaagtgagttgggctgatcaccacccggtactacagcaacagcgtcaggaagagcttcaagcccgacaggagatgtaccagtggaaggcatacaatcccggatggccgcactgtctggacgaaaagaccgtggaagatctcgaactcaacatcaagtactctacagctaaaaacgccaacttttacctgcaggctgggagcgcgttcgcagagatgaagatcaagggcttgttggatagaaaaggcctttggcgaagtctcaatgagatgaagcggatatttaattttcggaggacccctgcggctgagcatgctttcgagcattggcaggaggacgccttcttcgcctcgcagttccttaacgggctgaaccccgtgcttattcgtcgctgccactacttgcccaagaacttcccagttaccgacgctatggtcgcctctgtattgggcccaggcacctcactgcaggctgaattggaaaaaggctctctgttcctggtagaccacggcatactcagcggcatccagaccaatgtgatcaatggaaagccacagtttagcgctgctcccatgacgctgctgtatcagtctcccggatgcggcccactgctcccactcgctatccagttatcacagaccccaggacccaattcccctatttttctcccaaccgatgataaatgggattggctactggcaaaaacgtgggttagaaatgctgagttctcgtttcacgaggcactcacccatctgttacactctcacttgcttcctgaagtatttacattagcgacgttacgccaacttccacactgtcaccctttgtttaaactcctcattccccacactcgctacactctgcacataaatacactcgctcgagaacttctgatcgtcccgggacaggtagtcgacagaagcactggcattggtatagaaggcttctcggaacttattcagcgtaacatgaagcagctgaactatagtctcctatgtttgcctgaggatatccggaccaggggcgtggaagacatcccagggtactactatcgagatgacggtatgcagatttggggagctgttgaaaggtttgtctcggagattattggtatttattaccccagcgacgagagtgttcaggacgacagagagcttcaggcctgggtgcgcgaaatattcagtaagggttttctaaaccaagaaagctcagggatcccctcttcccttgagacacgagaggcactggtccagtacgtgaccatggtaatcttcacttgctcagctaaacacgctgctgtttcagccggacaattcgattcgtgcgcttggatgccaaatctgccaccttccatgcaattaccccctccaacatcaaagggcctcgctacttgtgaagggtttattgccacgctccccccagtaaacgccacctgtgacgtcatacttgccctgtggctgctgagcaaggaaccaggagatcagcgacctttgggaacttaccctgacgaacacttcaccgaagaggccccaagacggtcaattgccactttccaaagtaggctggctcaaatttcaagaggcatccaggagcggaaccaagggctggtgttgccatatacctacctggatccccctctaatcgaaaattccgtgagcatatag

SEQ ID NO: 29203 - DNA, 1665 bp, Artificial Sequence
  Description of Artificial Sequence: Synthetic coding sequence
atggctacaagcgccgacagtcccagcagcccactaggagccgaggacttgctatcagattctagtgagcctccaggacttaaccaggtctcgagcgaagtgacatcccaactctacgcttctcttcgattgagcagacaggctgaggccaccgcaagagcccaactgtaccttccctctacctcccccccacacgaaggcctggacggatttgcccaagagttaagccggtcgttgagcgtcggcctagaaaagaatctgaagaagaaagatgggagtaaacatatatttgagatggagtccgttcggggacaactgcaaacaatgctccaaactagccgggacacagcttatcgggacccgctgattcccggtgcaggctccgaacgtagggaagaggattcattcgacagcgacagcaccgcaactctcctgaatacacggccactccaagacctgagtcccagctcttcagcccaggcattagaagaattatttcctcgttatacttcactgcggcctgggccaccgctcaaccctccggatttccaaggcttaagagatgcattggactctgagcataccaggcgcaaacactgcgagcgacatatccagtctcttcagacccgtgtcctggaactgcagcagcaactggctgtagcagtggccgctgaccggaagaaagacaccatgatagagcagcttgataaaactctggctcgggtggtggaagggtggaaccgccacgaagccgagcgcaccgaagtgttgcgaggcctgcaggaagagcaccaggctgccgagctgacgcggagtaaacaacaggaaaccgtgaccagattggagcagtccctgtccgaggctatggaagccctcaacagagagcaggagtcagcacgactccagcagcgcgagcgggaaactctcgaagaggagcggcaggccttaaccctgaggttggaagcggagcagcagcgctgttgcgttctacaggaggagcgtgacgccgctcgtgctgggcagttgtcagagcaccgtgagcttgaaaccctgagagcagccctggaggaagagcgccagacctgggcccaacaggagcaccagttgaaggaacactaccaggctctgcaagaggaatcgcaagcccagctcgagcgcgaaaaagagaagtcacaacgcgaggcccaggctgcctgggaaacccagcaccagctagccctcgtgcagtcggaagtccgtcggcttgaaggcgaactggatacagcgagacgggagcgagatgccttgcagcttgagatgtccctcgttcaggcccgatacgaatctcagcgtatccagctcgagtctgaacttgctgttcagctggaacagcgcgtaaccgagcggctagctcaggctcaggagtcctcactgcgacaagccgcatcactgagggagcatcataggaaacaactgcaggatctcagtggccagcaccagcaagagctcgcatcacagctggctcagtttaaggtggagatggcagagcgcgaggagcggcagcaacaggtggcagaggactacgagctacgactgttgctgcttgaccccccagctcccggactgcgcagcccaaggaggcggcgtgggggaagcgggctctgtctgccttggccctggccctag

SEQ ID NO: 29204 - DNA, 2778 bp, Artificial Sequence
  Description of Artificial Sequence: Synthetic coding sequence
atggcaacgagcgctgatagccctagttcacccctcggagcggaagatctgctgagtgacagctctgagccacctgggctgaaccaggtgtcctccgaggtcacatcacaactgtacgccagtctgcgcttatcccgccaagccgaagccacagctcgtgcacaactctatctccctagcacatcccccccacacgagggactagacggtttcgcacaggagctgtctcggagccttagtgtgggactcgaaaaaaacctaaagaaaaaggatggatccaaacatatttttgagatggagtcagttagagggcaactgcagacaatgcttcagacctctcgagacaccgcatacagagatcccttgatccctggtgcgggatcagagcggagagaggaggacagcttcgattctgacagcacagctaccctcctgaatacaaggccgctgcaagacctgagtcctagctcatccgcccaggcactggaggagctgttccccagatacacaagcctgcgccctgggccacccctcaaccctcccgactttcaggggctgagagacgcgctcgattccgaacatacacgtcgcaagcattgtgaacggcacatccaaagtttgcagacccgggtcctggagctccagcagcaattggccgtggccgttgctgctgacaggaagaaggacaccatgatagagcaactggataaaacactggctcgtgtagtcgaggggtggaacaggcatgaagcggagagaaccgaggtattacgcggtctccaggaggaacaccaagcagctgagcttacacggtctaagcagcaagagaccgtcacccgcttggaacagagcttaagtgaggcaatggaagcactcaaccgagagcaagagtcagcacgcctgcaacagcgcgagcgcgaaacccttgaggaggaacggcaagctctgacattgcgcctcgaggcggagcaacagagatgctgcgtgctgcaggaagagagagacgccgcaagggccggacagctgtccgagcatcgggagctcgagacacttagagcagctctggaggaggaacgccagacctgggcccagcaggaacatcaactcaaggagcattaccaggcccttcaggaagaatcccaggcccagcttgagagggagaaagagaagtctcagagggaagctcaggcggcttgggaaacacagcaccaacttgccttggtgcagagcgaggtgagacggcttgaaggtgagctggataccgcgcgacgcgagagagatgcactccaattagagatgagcctcgtgcaggcgaggtacgaatctcaacgcatccagctcgaatcggagttagcagtgcagttggagcagcgggtgactgagcgcctcgctcaggcacaggagagttctctccggcaagccgcatccctgagagagcaccatagaaagcagcttcaggacttgtcgggccagcatcaacaagaactcgcctctcagctcgcacagtttaaggttgagatggccgagcgggaggagcgccagcaacaagtggccgaagactatgagctaaggctagcccgtgagcaggcaagggtgtgtgagcttcagtctggcaaccagcagcttgaggaacagagggtggaactcgtagagcgcctgcaggccatgctgcaggcgcattgggatgaagccaatcagcttttaagtacgacgctcccaccccctaaccctccagccccaccagcaggaccatcttccccgggacctcaagaaccggaaaaggaggagcgacgggtgtggacaatgccccctatggctgtcgctttgaaacctgttctgcaacagtcacgggaggctagggacgaactacctggcgcacctcccgttctttgcagcagcagcagcgacctatccctgctcttggggccatcctttcagagtcagcattccttccagccgttagagcccaaacccgacctgacaagcagcaccgccggagctttctctgcactgggcgcatttcaccctgaccacagggcagagcggcctttcccagaagaggatcccggacctgacggagagggcctgttaaaacagggcctcccaccagctcagctggaaggcctgaagaactttcttcaccagctgcttgaaactgtgccacagaataatgagaaccccagcgttgacttgttacccccaaaatcaggtccactgacagtcccaagttgggaggaggctccgcaggttccacggataccaccccctgttcacaaaactaaggttcccctagcgatggcatccagcctttttagagttcctgaacctcccagtagtcatagtcagggcagtggacctagctccggaagtcctgagagaggaggggatggtctaacatttccgaggcagctgatggaagtttctcaactccttaggctataccaagctagagggtggggagccctcccggctgaggacctccttttatatctcaagcgactagaacactctggctataagcctggaagaaaagaagaagggttttctgggtggaaactcgattacggagagtggagtgggaccgatggaagaggcgacaacgtacccagaaggaataccgatagccggcttggcgagatccccaggaaggaaataccctcacaggccgtgcctcgaagactggccactgcacccaaaactgaaaaaccccctgcgcgaaaaaaatccggacacccggctccatcgagcatgcgttccagaggcggagtatggaggtag

SEQ ID NO: 29205 - DNA, 2961 bp, Artificial Sequence
  Description of Artificial Sequence: Synthetic coding sequence
atgtatttttgctggggcgctgactctcgggagctccagcgtcgaagaaccgcaggctcacctggtgccgagctccttcaggccgcaagtggcgagagacactccctgttgctgctgacgaaccacagggtcctgtcctgcggagacaactcacgcggtcagctagggaggcgcggagctcaaaggggcgagctgcctgagcccattcaagctttggagacgcttattgtggacttggtgtcatgcgggaaggagcacagtctggctgtgtgtcataaggggagagtcttcgcttggggcgctggatctgagggccaactcgggatcggtgagttcaaagagatcagcttcacacctaaaaagatcatgactctgaatgacataaagattatccaggtttcctgtggccactaccactcacttgcattgtcgaaggatagccaggtatttagctgggggaagaattctcatggacaacttggtctggggaaggagtttccatctcaagcctcgccccagagggttagatctttggaggggatcccactagcacaggtcgccgctgggggagcccacagcttcgccctgtccctctgcggcacttctttcgggtgggggtccaactctgccggtcagcttgcactgtccggccgaaacgtgcccgtccagtctaacaagccattaagcgtaggcgcactaaaaaacctgggcgtggtgtatatctcctgcggggatgctcatacagccgtgctgacccaggatgggaaggttttcacctttggagataatcggagtggccagttaggctacagtcccacacctgagaagagaggccctcaactggtcgagcggattgatggtcttgtcagtcaaattgactgcgggtcataccacacgctggcctatgtacacacgaccgggcaggttgtaagttttgggcacggcccatctgatacctcaaagcccacgcaccctgaggctctgaccgaaaactttgacatttcttgcctaatcagcgccgaagattttgtcgacgtccaagtgaagcatatttttgctggaacgtacgccaatttcgtgactacacatcaggacacatcgagcacccgggctccgggtaaaaccctgcccgaaatcagccgcatctcacaatctatggcagaaaaatggatcgcggttaagaggagatccaccgagcatgagatggcaaaatctgagattaggatgatattctcttccccggcttgcctgacagccagctttttgaagaagcggggtaccggggagactacatccatcgacgtggaccttgaaatggcaagggatacctttaagaagctcacgaagaaggagtggatatcgagtatgataaccacatgcctagaggacgacttgcttagggcgctcccctgtcacagtcctcatcaagaagctctttccgtttttttactactacctgagtgtccagttatgcatgactctaagaactggaaaaaccttgtggtgccgttcgctaaggctgtgtgcgaaatgtctaagcagtccttgcaggttctcaagaagtgttgggcctttctgcaagaatcctcactcaaccctctaatccagatgctcaaagcagccattatcagccagctgctgcatcagacaaaaacagaacaagaccactgcaacgtgaaggctctgcttggcatgatgaaagaacttcacaaagtgaacaaagcgaactgccgtctaccagagaatacttttaacattaacgaactgtccaatttgttgaacttctacattgaccggggtagacaactgttccgtgataatcatttgatgtccgagaagaaggcttacatgcttatgcacgagaccatcttacagaaaaaagacgagtttcccccaagtccaagattcattctgcgcgttagacggtctcgacttgtgaaggatgctctacgacagcttagtcaggccgaagccacggatttctgtaaggtgcttgttgtcgaatttatcaacgaaatctgccctgagagcggcggtgtgtctagcgaattttttcattgtatgttcgaagaaatgacgaagcctgaatacggtatgttcatgtaccccgaaatgggatcctgtatgtggtttccagcgaaacctaaacctgagaagaaaaggtacttcttgttcggcatgctctgtggactgtctctatttaacctgaatgttgctaatctgcccttcccccttgctctgtataagaagctcctggaccagaagcccagtctggaggatttaaaagagctaagcccccgactggggaagtctctgcaggaggtcttggatgacgccgcagatgatatcggggacgcactctgtatccgcttttcgattcactgggaccaaaatgatgtggatcttatcccaaacggtatctccattcccgtggatcagacaaacaaacgcgactatgttagtaaatatattgactatatcttcaatgtgagcgtaaaggccgtatacgaggagtttcaacgaggcttctaccgcgtgtgcgagaaagagattcttcgacatttctaccctgaagagctgatgacagccattattggtaataccgattacgactggaaacaatttgagcagaattcaaaatacgagcagggataccagaaatctcatccgaccattcaattattttggaaggccttccataagctgactttggacgagaaaaagaaatttttatttttcctgacaggaagggatcgactccacgctagaggtatccaaaagatggagattgtgttccgatgtccggagaccttcagcgagcgcgatcaccccaccagcataacatgtcataacattctgtcccttccgaagtatagtaccatggagaggatggaggaagcgctccaggtagccattaacaataacagaggttttgttagtccaatgttgacccagagctag

SEQ ID NO: 29206 - DNA, 435 bp, Artificial Sequence
  Description of Artificial Sequence: Synthetic coding sequence
atgaccacaaggcaggctacaaaagatcctctgttgcgaggagtcagccccacaccatcaaaaatccctgttagaagtcagaaacgtactccgtttcccacagtgacttcgtgcgcagtcgaccaggaaaaccaggacccgcgtcgctgggtccagaaacctccactgaacatccagagacccctcgtggactcagccggaccacggccaaaagccagacaccaggcagagacctctcagaggctggtgggcattagccaaccaaggaacccgctggaagaactcaggccgagccccaggggacagaacgttggcccaggaccccctgcccaaaccgtactagttcctgcccctgggaagctattcgccctccgcaggagcccttttcctcctgcaaagtgccacctcgccaggtgccacgggctatacctgtag

SEQ ID NO: 29207 - DNA, 327 bp, Artificial Sequence
  Description of Artificial Sequence: Synthetic coding sequence
atggccgatcctagggtgagacagatcaagatcaaaaccggggtagtgaagcgcctagtaaaggaaaaggtgatgtacgagaaagaggctaaacaacaggaggaaaaaattgaaaagatgagggccgaagatggggaaaattacgacattaagaaacaggctgaaattctccaggagtcgcgaatgatgatccctgattgccagcgcagattggaggctgcctacctcgatcttcagcgtatcctggagaacgagaaggacctcgaggaagcggaggagtacaaagaggctcgtctcgtactcgattccgtgaagctcgaagcgtag

SEQ ID NO: 29208 - DNA, 1341 bp, Artificial Sequence
  Description of Artificial Sequence: Synthetic coding sequence
atgcgggagtgtctttccatccacataggccaggcaggaatccagattggggacgcatgttgggaattgtactgtttggaacacggcattcagccaaatggtgtggttcttgacacacaacaggatcagctggaaaatgctaagatggaacacactaatgcatcattcgatacgttcttttgcgagacaagagcgggtaaacacgtgcccagagcattgtttgtggaccttgaacccacggttattgatggcattaggaccggccaacaccgttctttattccacccagaacagctgttgagcggcaaagaagacgccgcaaacaactacgcgagggggaggtatagtgtcggttcagaggtgattgacttggtccttgaaaggacacgcaagctagccgaacagtgcggcggtctgcagggctttctaatcttccggagctttggcggaggtactggatcaggcttcacctcactattaatggaacggctgacaggcgaatatagtcgcaagacaaaacttgagttctctgtgtatcctgccccacggatatcaacagcggtggtggagccatacaatagcgtgctgactacccatagcacaactgaacacactgactgtacattcatggttgataatgaggccgtctacgatatttgccatcggaagctgggtgtggagtgtccttcgcacgcctctatcaacaggttagtagtgcaagtggtgtcttctattacagcatcactccggttcgaggggccactaaacgtagatctcattgagtttcagacaaacctggttccgtaccccaggatccactttcccatgaccgctttcgcgccaattgtctctgccgataaagcttatcacgaacaatttagcgtctctgacattacaaccgcctgttttgaaagctcgaaccagctcgtgaagtgtgacccacggcttggaaagtacatggcttgttgcctgttgtacagaggcgacgtggtgccaaaggaggtgaatgccgctattgccgcaaccaagtcccgccatagtgtgcaatttgttgactggtgcccaacaggattcaaagtcggaattaataataggccaccaaccgtgatgcccggaggcgatctagctaaggttcaccgatctatttgcatgctatcaaacactacagctatcgtcgaagcctgggcgaggcttgaccacaagtttgacttaatgtacgccaaacgtgccttcctgcattggtatttaagagagggcatggaagaggccgagtttctggaagccagggaggatctagcagctttggagagagattatgaggaggtcgctcagtcattctag

SEQ ID NO: 29209 - DNA, 873 bp, Artificial Sequence
  Description of Artificial Sequence: Synthetic coding sequence
atgggatccagcaaaaaggtgacattatccgtactctctagagagcaatcagaaggcgttggagctcgggtgcgcaggagcatcggcaggcccgaactgaagaacctggacccattccttctatttgacgaattcaaaggtggtagacccggaggtttccctgaccaccctcatagggggttcgagacagtgtcctatctgctggaagggggttccatggctcatgaggacttctgtgggcatactgggaaaatgaaccctggagaccttcagtggatgacagccggtcggggaatattgcacgctgagatgccttgcagcgaggagcctgcacatggtttgcagctgtgggtgaaccttcgttcttccgagaaaatggtggaaccacaataccaggaacttaagtccgaggagatccctaagccatccaaggacggtgtaaccgtcgccgtgatttccggggaggccctcgggatcaagagtaaagtttacacccggacccccaccctctatctggactttaaactggatccaggcgctaagcactcccaaccgattcccaagggctggacttcttttatctacactatctccggggacgtatatattggaccagatgatgctcagcaaaaaatagaacctcatcacacggctgtgttgggcgaaggtgactctgtgcaggtggaaaacaaggatcctaagagaagccacttcgttcttatcgctggcgaaccccttcgcgagcctgtgattcagcacggtccttttgtaatgaatactaacgaggagatctctcaggcaatcctggactttcgtaacgctaaaaacggctttgagagggcgaaaacctggaaatctaagatcgggaattag

SEQ ID NO: 29210 - DNA, 873 bp, Artificial Sequence
  Description of Artificial Sequence: Synthetic coding sequence
atgggtagcagtaagaaagtgaccctgtctgtcctgagcagagaacagtcagaaggcgtgggtgccagggtgcggagatcgatcggcagaccagagctgaaaaaccttgatccattcttgcttttcgacgagttcaaaggaggccgtcccggtggcttcccagaccacccacatcgcggttttgaaacggttagttacctgctggaagggggaagcatggcacatgaggatttctgtggtcacactggtaaaatgaaccctggcgatctgcagtggatgacggctgggagaggcatactacacgcagaaatgccctgctcagaagagcccgctcatggacttcagctgtgggtgaacctgcgaagttctgagaagatggtcgagcctcagtaccaagagctgaagtctgaggaaatcccaaagccttccaaggatggcgttaccgtggctgtgatttccggtgaggcgctgggcatcaagagcaaagtgtatacccggacaccaacactgtacttagactttaagctggatcccggtgcaaaacatagccaacctatccctaaaggctggacgagcttcatctatactatttccggtgatgtttacatcgggccagatgacgctcaacagaagatcgagcctcaccataccgccgtactgggtgagggggattcggttcaggtagagaataaggaccccaaacggtcgcactttgttctcatcgctggcgaacccttgagggaacctgtgatccagcatggaccattcgtgatgaacaccaatgaagaaatctcccaggccatcttagatttccgaaacgccaagaacggctttgaaagggccaagacttggaagtcaaaaatcggcaattag

SEQ ID NO: 29211 - DNA, 1200 bp, Artificial Sequence
  Description of Artificial Sequence: Synthetic coding sequence
atggacttctttagctctcaccttcttgccgattcttcctcgcctgccactaactcttcacacactgatgcccacgagattctcgtttccgactttttggtgtccgatgagaacctgcagaaaatggagaacgtgctggatttatggtctagcggactgaaaaccaatatcatcagcgagctaagcaagtggaggctgaactttatcgactggcatcggatggagatgagaaaggagaaggagaaacatgctgcccacctgaagcagctttgcaatcagattaatgagctcaaagagctacagaagacctttgaaatctccatcggcaggaaggacgaggtcatatcctctctctcccatgccataggtaaacagaaagaaaaaatcgagttaatgaggaccttttttcactggaggatcggtcatgtccgagcccgtcaggatgtctacgaaggcaagcttgccgatcagtactaccagaggacgctgctgaaaaaagtctggaaggtgtggagatcagttgttcagaagcagtggaaagacgtagttgagagggcttgtcaggccagggccgaagaggtatgcattcaaatctcaaatgattatgaggccaaagttgcgatgctgtccggggcactagagaacgctaaggctgagatccagcgcatgcaacacgagaaggagcacttcgaggatagtatgaaaaaggcctttatgagaggtgtttgtgccctcaacctcgaagccatgactatcttccagaacaggaacgacgccggtatcgactctactaacaacaagaaggaggagtacggtcctggggtacagggtaaggagcactctgctcatctcgacccaagcgctccgccaatgcccctaccggttactagccctctgttaccatcccctcccgctgccgtcggaggagcttccgctactgccgtgccatcagccgcttccatgacctcaactagagccgcttctgctagctctgttcatgtgcccgtgtccgccctgggtgcgggttctgctgccaccgcggcatcagaggagatgcagacaatcccacaggccaccgcggctaaataccccaggactatccacccggagtcttccaccagcgcctcacgctctctaggaaccagaagcgctcatacacagtcattgacaagtgtacacagtataaaagttgtggattag

SEQ ID NO: 29212 - DNA, 729 bp, Artificial Sequence
  Description of Artificial Sequence: Synthetic coding sequence
atggccgctgtaaaagcctcaacatcgaaagcgacacgcccatggtacagtcaccctgtgtacgctcgctattggcagcattatcaccaggccatggcatggatgcagtcccatcataacgcttataggaaggctgtggagtcatgtttcaatttgccatggtatttgccctcagccctcttaccgcagagtagctatgacaatgaggcagcctacccgcagagcttctacgatcaccatgtcgcttggcaggactatccttgctcctcatctcactttcgacgcagtggtcagcatcccagatactcctctcggatccaggcatcaaccaaggaagatcaggcactgtcaaaagaagaggaaatggaaaccgagtctgacgctgaggtggaatgtgatctgtctaacatggaaattaccgaagagctccggcagtacttcgctgagacagagaggcaccgtgaggagagaaggcggcaacagcaactggacgccgaacgactggactcctatgtgaatgccgaccatgatctgtactgcaacactagacgctcggtcgaggcccctactgagagaccaggggaaaggcggcaggccgagatgaaaaggctgtatggagacagtgctgccaaaattcaggccatggaggcagccgtgcagctctcctttgataagcattgcgaccggaaacagcctaaatattggccggtcattccgcttaagttttag

SEQ ID NO: 29213 - DNA, 1482 bp, Artificial Sequence
  Description of Artificial Sequence: Synthetic coding sequence
atggaaaggagcccggacgtgtctcccggtccttcacggagttttaaggaagagctcctatgtgcagtgtgttatgatccctttcgggacgccgtcaccctaaggtgcggtcacaatttttgcagagggtgcgtgagcaggtgttgggaggtccaggtgagccctacttgcccagtctgtaaggaccgcgcatctccagccgacttaaggaccaaccacacactcaacaaccttgtggagaagctattgagggaagaagcagagggagcgcgttggacgagctacaggttctctagggtgtgtaggctccatagaggacaactaagcctgttttgcctggaggataaagaactcctgtgttgtagttgccaggcagacccccgtcaccaaggtcacagggtgcagccagttaaggatactgctcacgattttcgtgttagatcactgatcgccgaagaaaggaggaattttctgcctacacaccagtggattgtgaccaagacccgcttgcaaacaagttccccgaaccttcagtctcgtcggcagggacaggttcaggagcatggtgcttgtaccgctggtgaaggccaggggctgctgggacacgcagctttgctcgatgcaatggctgaagagacacgacaaaagcagctattggctgatgagaaaatgaagcagctgacagaagagacagaagtgctggcacacgagattgagaggctacagatggagatgaaggaagacgatgtgagcttcctgatgaagcataaatcacgcaagcgacgactgttctgtactatggagcccgagccagtccaacctggtatgctcatcgacgtgtgcaaatacctgggctctctacagtatcgggtctggaaaaagatgcttgcctcagtggagtctgtcccgttttctttcgatcccaataccgcagccggttggttgtccgtctccgatgacctgacctccgttactaatcatggttacagggtgcaggtggagaaccctgagagattttcatcggcaccctgcttgctaggctctcgcgtcttctcacagggatcacacgcttgggaagtggccttaggaggtttacagtcctggcgtgttggcgtcgtgagggtcagacaagattcaggggcagaagggcatagtcactcatgttaccatgacactagatcaggattctggtatgtatgcaggacacagggagttgagggtgatcattgcgtgacatcagaccccgctacatccccactagtgctggccattcccagacgtctgcgtgttgagcttgagtgcgaggagggcgaactgtccttctacgacgcggagagacactgtcacttgtatacctttcacgctagattcggcgaagtgcgaccttacttttacttaggaggcgctcggggtgcaggccctccggaacctcttagaatttgccccctccacatcagcgtcaaagaggaactggacggatag

SEQ ID NO: 29214 - DNA, 1473 bp, Artificial Sequence
  Description of Artificial Sequence: Synthetic coding sequence
atgaatcttgcagaaatctgcgataacgccaaaaagggcagggaatacgccttactgggcaattacgactcgtctatggtgtattaccagggggtgatgcagcaaatccaaaggcattgccagagcgtgagagaccccgctattaaggggaagtggcagcaggtgcgtcaggagctactggaagagtacgaacaagtcaagagtatcgtgagcaccctcgagtcattcaaaatagacaagccacctgattttcctgtctcttgccaggacgagccatttagggatcccgctgtttggcctcctccagttccagcagaacatcgggcaccaccacagatcaggcggccaaatagagaggtgcgacccctacgcaaagagatggcaggtgtaggagcgagaggcccagtaggtcgcgctcatccaattagcaaatctgagaaaccttctacttccagggacaaagactatagggcaagaggccgagatgataagggcaggaaaaatatgcaggacggagcttcagacggagagatgcctaagttcgacggcgctggctacgacaaagacctagtggaggccctggagcgggacatcgtgagtcgcaacccttctatccactgggacgatattgccgatctcgaagaagccaagaaactgttgagagaggccgtcgtactccctatgtggatgcctgatttcttcaaggggatccggcgaccctggaaaggggtgctgatggtgggccctccaggcacgggcaagacaatgcttgctaaagcggtggctaccgagtgcgggacgaccttctttaatgtgagctcttctaccttaaccagcaagtacaggggcgagtccgagaaactcgtgaggctgctgttcgagatggcacgcttttacgcccctacaacgatcttcatcgatgagatcgattctatctgctctcggcgaggcaccagcgacgaacacgaagcatccaggcgcgtgaagtccgaacttctcattcagatggatggggttgggggagccctggaaaacgacgatccctctaagatggtgatggttcttgcagccaccaacttcccatgggacatagacgaggccctcaggcgacgattagagaaaaggatctatattcctctgccaactgcgaaaggcagggcggagctactgaagatcaatctcagggaggtagaactggatcctgatatccaattagaggacatcgccgaaaaaatagaaggctattccggggctgatattacgaacgtgtgtcgtgacgcgtctctaatggcaatgagacgcaggatcaacgggttgtcacctgaggaaattcgggcattgagtaaggaggagctgcagatgccggtgacaaagggtgatttcgaactggccttgaaaaagattgccaaatctgtctctgctgctgaccttgagaaatatgagaaatggatggtggaatttggcagcgcctag

SEQ ID NO: 29215 - DNA, 1473 bp, Artificial Sequence
  Description of Artificial Sequence: Synthetic coding sequence
atgaaccttgctgagatctgtgataacgcaaaaaaagggcgagaatatgccctgctgggaaactacgattccagcatggtgtactaccagggcgtaatgcagcagattcagcgccactgccagtctgtaagagacccggctatcaaaggtaagtggcagcaggtccggcaggagttactggaggaatacgagcaggtaaaatccatcgttagcaccctcgaatcttttaagatcgacaaaccacccgacttcccagtcagctgccaggatgaaccttttcgtgaccctgccgtttggcccccacccgtgccggcagaacacagggctcctccccaaattcgtaggccaaatcgggaggtgagaccactcagaaaggagatggctggagttggcgcaagaggccctgttggtcgcgcacacccaataagtaagtctgagaaaccgtcgacctcccgcgataaagactacagagctcggggtagagatgataagggcaggaaaaacatgcaggacggcgcatcggatggcgagatgcctaagttcgacggtgcaggctacgataaggatctagtggaggctctggagcgcgacatagtctctcggaacccaagcatccactgggacgacattgctgatctggaggaggccaaaaagctgttgcgcgaggccgtagttctacccatgtggatgcccgacttttttaaggggattagacgtccttggaaaggggtcttgatggtaggtccccctggcaccggaaagactatgctggctaaggctgttgctacagaatgtggcacaaccttcttcaatgtgagctcaagcactttgaccagcaaatatagaggagagagcgagaaactggtgcggctgctgtttgagatggccaggttctacgcccctacaaccatcttcattgatgagattgattcaatttgcagccgacgaggaacgtctgacgaacatgaagcgagtcgtagggtgaaatccgaactgctgatacagatggatggcgtcggaggggcactggagaacgatgacccatcgaagatggtgatggtgttggctgccaccaacttcccgtgggatattgacgaagccctgagacgccgactggaaaaacggatttatattcctctgcctactgccaaaggcagagccgagctgctgaagatcaatctacgtgaagttgaactggaccctgatatccaactggaagatattgcggaaaaaatcgaggggtactcaggagcagacataacgaacgtgtgtcgggatgccagtctcatggccatgagaaggcggattaacggcctctctcccgaagaaatccgtgcgctgagcaaggaagagctccagatgccagtaacgaaaggagactttgagctggccttgaagaaaatcgccaaaagtgtctcagccgcagatctggagaagtatgagaagtggatggtggaattcggctctgcatag

SEQ ID NO: 29216 - DNA, 1068 bp, Artificial Sequence
  Description of Artificial Sequence: Synthetic coding sequence
atggactttatctttcatgagaagcaggaggggttcctctgcgctcagcattgtcttaacaatctgttgcagggtgaatacttttcccccgtggagctggcttccatcgcacaccagctagatgaggaagaaaggatgcgcatggcagaagggggagtgacttctgaggagtatctggccttccttcagcagccgtctgagaatatggacgataccggcttcttttccattcaagtaatcagcaacgcactaaagttctggggattggaaatcatacactttaataatcccgaataccaaaagttagggatcgaccctatcaatgaaagatcgttcatatgtaattataagcagcactggttcactatcagaaagttcggcaaacattggttcaacttaaactctctccttgctggaccagagttgatttcagacacatgtttggctaacttccttgcacggctccaacaacaggcctatagcgtctttgttgtgaaaggcgaccttcctgactgcgaagcggatcagctgttgcagattatcagcgtagaagaaatggatactccaaagctcaatggcaaaaagctggtcaagcaaaaggaacatcgggtttacaagaccgtcctcgaaaaggtgagcgaagagagtgacgagagtgggacttccgaccaggacgaggaagacttccagagagccctcgagctaagcaggcaagagactaacagggaagatgagcacctcagaagcacaatcgaattatccatgcaggggtccagcggtaacacatcccaagacctgcccaaaacaagctgcgtaacaccagcttctgaacagccgaagaagatcaaggaggattactttgagaagcaccagcaagaacagaagcagcagcaacagcagagcgatctaccgggacactcatcttatctccacgaacgccctaccacgtcaagtcgggctatcgaatctgacctctctgacgacatctctgaaggcacagtccaggcagctgttgacaccatactggaaattatgaggaagaatcttaagatcaagggagagaagtag

SEQ ID NO: 29217 - DNA, 5909 bp, Artificial Sequence
  Description of Artificial Sequence: Synthetic coding sequence
atggctgccagatccgccccttcctgtcatttacggcttgaatgggtttacggatatagggggcatcagtgtcgtaataacctctactatacagccgctaaagaaatagtctatttcgtagccggtgtcggcgtggtgtattctccgagggaacaccggcaaaagttttacaggggacacagtgacgacattatcagtctggcattacaccctgaaagagttctagtggccacagggcaggtcggaaaggaaccttatatctgcatttgggacagctatacagttcagaccataagtgtgctgaaagatgttcacacgcacggaattgcctgtcttgcctttgatctggacgggcaaagacttgtgtcagtgggattggacagtaagaacgccgtatgcgtttgggattggaagcgtggaaaaatgctgtcgatggcccctggacataccgaccgcatattcgatatctcctgggacctataccagccaaataagctggtcagctgcggagtgaaacacataaaattctggtccctgtgtgggaatgcactgactccgaagagaggcgtgttcggaaagacaggtgatttacagacaattctttgtctggcctgtgcgcgtgatgagcttacttatagcggcgcattaaatggcgatatttacgtgtggaaggggataaatctgataagaaccatccagggagcccacgctgccggtatatttagcatgaatgcgtgcgaggaagggtttgcaacaggtggtagggacgggtgtatccgcctttgggacctgaccttcaaacctatcactgtgattgatttacgagaaacagatcaaggctataagggcttgtccgtgcgcagtgtgtgctggcgcggtgaccacatactggtgggtactcaggatagtgaaatatttgagatcgtcgtacaggagaggaataaaccgttcttgattatgcagggccactgcgaaggagaactatgggccctcgccgtgcaccctactaaaccactggcagtgaccgggagcgacgatagatcagttcgaatttggtcccttgtagaccatgcactcatagcccgatgcaacatggaggaacccatccgatgtgcagctgtaaacgccgacggaattcacttagccttgggcatgaaagatggatcgttcactgtgctcagggttagggacatgacagaggtggttcacatcaaggaccgtaaggaggctatccacgaactgaaatactcaccggacggaacctacttagccgttgggtgtaatgattcaagcgtggatatttatggggttgctcagcggtacaagaaggtgggggagtgtttaggaagcctgtcctttatcacccacctggactggagcagtgacagccgctatttgcagacaaacgacggtaatggaaaaaggctgttttaccgaatgcctgggggaaaggaggtgacttccacggaagagatcaagggtgtccactgggcttcatggacatgcgtgagtggactagaagtcaatggaatttggcccaaatatagtgatatcaacgatatcaacagtgtcgatgggaattacatcgggcaggtgcttgtaactgcagacgactacggaattatcaagctgttccggtacccttgtctgcggaagggtgccaagttcagaaagtatatcggtcactctgcccacgtgactaatgtacgatggtcccatgactatcaatgggtaattagtattggcggagccgaccacagcgtgttccagtggaaatttattccagaaagaaaattgaaggacgccgtgcacatcgcaccacaggagagtctggctgactcccactccgatgaatctgacagcgacctgagcgacgtgccggagctagacagcgaaattgagcaggagacccagctgacctacagaagacaggtgtacaaggaggacctgccgcaactcaaggagcagtgcaaggaaaaacagaagtccgcgacgtctaaacgcagagagcgtgcccctggcaactccattagactacattttgtgcatggttatcggggttatgactgtcggtctaacctcttctacacacagataggggagatcgtgtatcatgtggccgcagttggggtgatctacaaccgccagcagaacacgcaaaggttctacctggggcacgacgatgatattctctgtttaacaattcatccactgaaggattacgtcgcaacagggcaggtgggaagggatcctagcatccatatttgggacacagaaaccatcaaacccctgtccattctcaagggccatcatcaatacggtgtaagcgccgtggacttttcagcagatggaaagcgtctcgcttcagtaggaattgacgattctcacaccgtagtgctgtgggattggaaaaaaggtgagaagctctcgatagcgcgtggaagcaaagataaaatcttcgttgtgaagatgaatccatacgttcctgataagctgatcacagctgggatcaaacatatgaagttttggagaaaggccggaggcggattaattggcaggaaaggctacattggcacactgggaaagaacgacacaatgatgtgcgcggtctacgggtggaccgaggaaatggcattttccggaactagcactggggatgtctgcatctggagggatatctttctggtgaaaacagtcaaggctcacgacgggcctgtgttttctatgcatgctctggaaaaaggatttgttacagggggtaaagacggtatcgtggccctatgggacgattccttcgaacggtgtctaaagacgtatgccattaaaagagcagctctagcaccgggttctaagggccttctgttagaagataatccctccatccgggcaatcagcttaggtcatggtcatattctggtggggactaaaaatggcgaaattttagaggtggacaagtctgggcctattacactcttggtccagggacacatggaaggagaagtttggggtttggcaacgcacccctacttgcctatttgcgctactgtttcagacgataagacgctccgcatttgggatctgtctccaagtcactgcatgcttgccgtgcgaaagctgaaaaaggggggtcggtgttgctgtttctccccagacggcaaggctctcgccgttggccttaacgacggttcgttcctaatggcgaacgccgataccctggaagatctagtatccttccaccataggaaagacatgattagtgacatacgttttagccccggttctgggaagtacctcgccgtggccagccacgatagcttcatagatatctacaatgttatgtctagcaagagagtcgggatctgtaaaggggctacttcatatattacacatatcgactgggacatcaggggaaaactgctgcaagttaatacaggcgctaaggagcagctctttttcgaagccccaaggggaaaaaaacagaccattcccagtgtggaagttgagaagattgcttgggcatcctggacctcggtgctgggcctctgctgtgaagggatctggcctgtgataggtgaggtaaccgacgtgaccgcctcttgcctcacttccgataaaatggtactcgcaacgggcgatgacttagggtttgtgaaactctttcgataccccacaaaagggaaattcgggaaatttaaacgttacgttgctcactctactcacgtgacaaatgtgaggtggacctatgatgattctatgttggtaacactaggaggaaccgatatgtccctgatggtctggactaacgaaatggaaggctatagagaaaaaagaccttgcgactccgaggagtcggacattgacagtgaagaagatggcggatatgatagtgacgtcacaagagagaacgaaattagttatacgataagagcactgtccacgaatatccggccaatgctcgggattaaacctcatctgcagcagaaagaaccatccattgatgaaagaccaccggtctctagagcaccgccacagcccgagaagcttcagacgaataacgtaggcaagaagaaacggcctatcgaggacctagtgctcgaactgatcttcgggtaccgcggaagggactgtcgcaacaatgtccattacctgaatgatggggatgatataatctatcacacagccagcgttggcatcctgcataacgttgcaaccggctcgcagtccttctaccaggagcacaatgacgacatcctgtgcctgactgtgaatcaacatcccaagtttataaatatcgtggcaaccggccaggtgggtgactcggcagacatgagtgctacagcaccaagcattcacatctgggacgccatgaataagcagaccctgtcaatcctccgatgttaccattcgaagggggtctgttccgtgtcctttagcgccaccggcaagctgttgctgtccgttggacttgatcccgaacacacaatcactatctggcggtggcaggagggggctaagattgcctcaagagctggtcacaaccagcggatttttgtggccgaattcaggcccgacagcgacacccagttcgtgagcgttggggtgaaacacgtcaaattttggacattggcagggagagccctgctgagcaaaaaaggattattaagcacactggaagatgcaagaatgcagaccatgttagcaatcgcattcggggcaaacaatctgacattcacaggcaccatttctggtgatgtttgcgtatggaaagaccatatcctgtgccggatcgtggccagggcccataatgggccagtgttcgcaatgtacaccacgcttagagatggactcatcgtgacagggggtaaagaacgcccatctaaagaagggggagcagtgaagttgtgggaccaagaactccgaagatgccgcgcatttaggttagaaacgggacaggccaccgactgcgtgagatctgtgtgcaggggtaagggaaagatccttgtgggcactagaaacgctgagataattgaagttggtgaaaagaatgcggcttgcaacattctggtgaacgggcatgttgatggacccatatggggactcgctactcacccgtcccgggatttcttcctgtctgccgctgaggatggcaccgtccgcctctgggatattgcagacaagaagatgttaaataaggtgaaccttggccacgctgctcggaccgtgtgttactccccggagggcgacatggtggccataggaatgaagaacggtgagttcattattctcctcgtgtctagcttgaagatttgggggaagaaaagggaccggagatgtgcaattcacgacatacggttcagcccagacagtcggtatttggctgtcggatcatccgaaaattctgtggacttttacgacctcaccttaggcccaactcttaaccggatctcctactgcaaagacatccccagtttcgtaattcagatggattttagcgccgattcatcttacctgcaggtgagctctggatgttacaagcggcacgtttacgaagtaccatctggcaagcacttaatggatcacgccgcaatcgaccgaataacctgggccacctggacctctatcctgggtgacgaagtgctcggtatctggagtcgtcacgccgaaaaggctgacgttaactgcgcatgtgtgtcccacagcggaatttccctcgtgacgggcgacgactttggcatggtaaaattattcgacttcccgtgtcctgagaaattcgcaaagcacaagcggtttttgggacactcgccccatgtgaccaacatcaggttcaccagtggcgataggcatgtcgtgtcagctgggggagacgactgctcactgtttgtgtggaagtgcgtccatacaccacacta

SEQ ID NO: 29218 - DNA, 1146 bp, Artificial Sequence
  Description of Artificial Sequence: Synthetic coding sequence
atgcccttgcaggtctctgattacagttggcagcagacaaagacagccgtatttctctcattgcctcttaagggagtttgtgtccgcgacaccgacgtgttctgcacggagaattatctgaaggtcaacttccctccttttcttttcgaagcatttctttatgctcccatcgacgatgagtcctcaaaggctaaaatagggaacgatactatagtgtttaccttatacaagaaggaagctgctatgtgggaaacactgtcagtgaccggcgtggataaagagatgatgcagaggatccgggagaagtctatcctccaggcacaggagagggccaaggaagccaccgaggccaaagcggctgctaagagagaagatcaaaagtacgcccttagcgtgatgatgaagatcgaagaagaagagaggaaaaaaattgaggatatgaaagaaaatgagaggatcaaggccactaaagctctggaagcatggaaggagtatcagcggaaggctgaagaacagaagaagattcagcgggaggagaagctgtgccaaaaggaaaaacaaatcaaggaagagcgtaagaaaataaaatacaagagcctaacacggaatctggccagcagaaacctggcaccaaagggtagaaactcagagaatatttttacagagaagctgaaagaggattcgatcccggctcccagaagtgtgggttcaataaaaattaatttcacccccagggtctttcccaccgctctgcgggagtcccaggtggcagaagaagaggagtggctgcataagcaggctgaagcgaggcgtgctatgaacaccgatatcgccgaattatgcgatctcaaagaggaggagaagaaccccgagtggttaaaagacaaaggcaacaagctgtttgctacggaaaattacctggcggctattaatgcctacaaccttgcaattagactcaacaacaaaatgcctctcctctacctcaatagagctgcctgccaccttaagctcaaaaatctgcataaggctatcgaggactctagtaaagaattttgctcgcttgaaggcatagaatgtcaggctagcgagccgaaactcagccaccacatcccttctgatttgcatgtatacattcagatggcctag

SEQ ID NO: 29219 - DNA, 1344 bp, Artificial Sequence
  Description of Artificial Sequence: Synthetic coding sequence
atggcgggtgccggagggggaaatgacatacagtggtgcttctcccaggtgaagggggctgttgacgacgatgttgccgaagcagacataatttcgactgtagagttcaatcacagcggcgaactcctggctacgggcgacaaaggcggacgtgttgtgatcttccaacaagagcaggagaataaaatccagtcacattcgcggggagaatataacgtgtactctacttttcagtcgcacgaaccagaattcgactacctaaagagccttgagattgaggaaaagattaataagattcgttggctgcctcagaaaaatgcggcacagtttcttttaagtacaaacgataaaacgatcaaactgtggaagatatctgaaagggacaagagacccgaggggtacaacctaaaggaagaagacggacggtatagggatccaaccaccgtgaccaccctccgcgttcctgtgtttcgcccaatggatctcatggtggaggcatctcccaggcggatcttcgcgaatgcccacacataccacataaactcaatctcgatcaactctgattacgagacatatctgagtgctgatgacctgcggataaacttatggcatttagaaatcaccgataggtctttcaacatagttgacatcaaacccgctaacatggaagagctgaccgaagtgataactgccgcagagtttcaccccaattcatgcaatacgttcgtttacagcagctccaaggggaccatccgtctttgtgacatgcgcgctagcgcgctatgcgatcgccatagtaaactgttcgaggaaccagaggatcctagcaataggtcttttttttctgaaatcatcagcagtatctctgacgtcaaattttcacacagcggacgctatatgatgaccagagattatttaagcgtaaaaatatgggatctgaatatggagaatagaccagttgagacgtatcaagttcacgagtacctgaggtctaagctgtgctccctctacgagaacgactgtatcttcgacaagtttgagtgctgttggaacggctctgactccgtcgtaatgactggctcctacaacaattttttcagaatgtttgaccgcaataccaagcgagatattacattggaagccagtagagagaataacaagccacggaccgtgctgaaaccgagaaaagtgtgtgcctctggcaagaggaaaaaggatgagatctccgttgactccctcgattttaacaagaagattttgcataccgcctggcaccctaaggagaatattatcgctgtcgccactaccaataatctgtacatcttccaggataaggtgaattag

SEQ ID NO: 29220 - DNA, 1413 bp, Artificial Sequence
  Description of Artificial Sequence: Synthetic coding sequence
atggacctgagggaccaggagttagtcaagattgtcggcattcgatacgaggttggacccccaacgctgtgctgtctgaaactcgcattcatcgacccggctactggcaagctaatggataagagtttctccattcggtaccacgatatgccagatgtgatcgatttcctcgtcttgcggcaattctatgacgaggcaaggcagcggaactggcagagttgcgatcgatttcgctccattatagacgacgcttggtggttcggcaccgtgttgagccaggagccgtatcagccacagtaccctgactcccatttccaatgctacatcgtgcgctgggataatactgagatcgaaaaactgtcgccctgggacatggagcctatcccagacaatgttgatccacctgaggaactgggcgcatccatttcagtcacaacagatgagttagagaagctcctctacaagccccaggctggggagtggggccagaagtcccgagatgaggagtgtgaccgtatcatcagtggaatcgaccagttgcttaacctcgatattgctgccgcatttgctggccctgttgacctctgcacttatcctaagtattgtaccgtcgtcgcgtatccaactgacttatataccatcagaatgagactggtgaatcgattctacagaagactaagcgccttagtgtgggaggtgcgttatatcgagcacaacgctcgtacttttaatgaacccgagagtgtcattgctcgctcagccaaaaaaatcaccgaccagctgctgaaatttatcaagaaccaacactgcacgaacatcagcgagctcagtaacaccagcgaaaacgatgaacagaatgccgaggaccttgatgactcagacttgccgaagacttcgagcggcagacgcagagactacagggatattattgacacacccatggactttggtacagtgcgggagacgctggacgcaggcaactatgattctccactcgagttttgtaaagacatccgacttatattttcaaacgccaaggcatatacccctaacaaaagatctaagatttacagcatgacattgcgcctgagtgcgttgtttgaggagaaaatgaagaaaatcagttcggatttcaagattggacagaaattcaatgagaaactgagacgatctcagaggtttaagcagaggcagaattgcaagggggattcccagccaaacaaaagcatcagaaacctaaaaccaaagcgacttaaatcacaaactaagataattccagagttggtcggcagcccaacccagagtaccagcagcaggaccgcatacctggggacacacaagacctctgctgggatctcgagcggggtgacctctggcctgttccggtttagcagaatcattcgaaaggaatag

SEQ ID NO: 29221 - DNA, 516 bp, Artificial Sequence
  Description of Artificial Sequence: Synthetic coding sequence
atgtgcggtcgagccccaccccctgaaataaccggccgtgagccaggttaccacttagtagagcagagttgctggctgaagcctctaccaagaaatttgggccacagtctattctggacagtgtggaaaccaagaccggtgtcacagttggttgcacaacaggttacacagcagtttgtccctcccacccagtcgaagaaagaaaaaaaggacaaagtggaaaaggagaagagcgaaaaggagacgaccagcaagaaaaatagccacaagaagaccaggcccagactgaagaacgtggaccgctctagcgcacagcacctggaagtaacagtaggtgacttaactgtgattattaccgacttcaaagaaaaaactaaaagcccaccggcttcctccgctgccagcgccgaccaacactctcagtcaggtagcagctctgataataccgagagaggcatgtcccgctctagttctcccaggggagaggctagttccctgaatggcgagtctcactag

SEQ ID NO: 29222 - DNA, 417 bp, Artificial Sequence
  Description of Artificial Sequence: Synthetic coding sequence
atgggcgacaagaaatcacctacaaggaagcctcgcccagtgtcgcagctagtggcacagcaggtaacccagcagtttgtcccaccaacccagtccaagaaagagaaaaaggacaaggtcgaaaaagaaaagagcgaaaaagaaactacatccaaaaaaaactcacacaagaaaacgcggcctaggctgaaaaatgtggaccggagcagtgctcagcacttggaagtgactgtgggagacctcacagttatcattacagacttcaaagagaaaactaaatcacctccagcatccagcgctgcttcagccgatcaacacagccaatctgggagcagcagcgataacaccgagcgcggtatgtctcgcagcagctccccacgcggagaagccagcagcctgaacggggagagccactag

SEQ ID NO: 29223 - DNA, 1047 bp, Artificial Sequence
  Description of Artificial Sequence: Synthetic coding sequence
atggggcattgctgctgtaaaccctacaattgcctccaatgtctggataagactaacgagtcagctcttgtcaaggaaaaggagctcagcattgagctggccaatattcgggacgaggttgcattccataccgcgaagtgtgaaaaacttcagaaagagaaagaagaactggagcgtaggttcgaggacgaagttaaaagactgggctggcagcagcaggcagagctccaggagctggaggagaggttgcagctccaattcgaggctgagatggctagactgcaggaagaacatggggaccagctgctctctattcgatgtcagcaccaggagcaggtagaagatctgactgcctctcacgacgcagcactcctagaaatggagaataaccacaccgtggctataaccatactgcaggacgaccacgatcacaaagtgcaagaacttatgtcgacacatgaacttgaaaaaaaggaactggaagagaattttgagaaattgagactgtctttgcaagaccaagtggacacactgacctttcaatcacaatccttgcgtgaccgagccaggagatttgaggaggcgctgcggaagaatactgaagagcaactggagatcgccctggccccttatcagcatctggaggaggatatgaagtctctcaaacaagtgcttgagatgaagaaccaacagatacacgaacaggaaaagaagatcctggagctggagaaattagctgagaaaaacatcatcctggaagaaaagatccaggttcttcagcagcagaatgaggatcttaaggcccgaatcgaccagaatactgtagtcaccagacagctttccgaggaaaacgccaatcttcaggaatacgtcgaaaaagaaacacaagaaaagaaaaggctgagcaggaccaatgaggagctgctgtggaagctgcagacaggcgatcctacgtctcccatcaagctaagcccaacaagccccgtttaccgagggtcaagctcagggcctagctctccagctcgtgtgagtacaactcctcgatag

SEQ ID NO: 29224 - DNA, 2664 bp, Artificial Sequence
  Description of Artificial Sequence: Synthetic coding sequence
atgaacagcggaggcggtctgccaccaccgagcgctgccgcaagcccatcttcatctagcctggccgctgccgtagcagtggtagctcctcctggggtcggcggtgttcccggaggcgcagctgtgggtgtgaagctaaaatactgccggtactacgcaaaggataagacttgtttttatggagaagagtgccagttcctgcatgaggaccccgctgccggtgcagctcccggtctgggtctgcactcgaactcagtgcccctggccttggccggtgcacctgttgccggatttcctccgggtgctgtcgccggtggaggcgctggtccccctccaggcccaaagaaaccagacttaggtgacccaggtactggcgcagcagctggcggtggtggcagttctggtggcctggacggcccacgattggcgattcccggaatggacggcggagccctgaccgacacatcactgaccgactcctacttctctaccagtttcatcggcgtaaatggttttggcagtcccgtagagacaaagtaccctcttatgcagcgaatgaccaattcgtcttctagcccatcgctcctgaacgactcggctaagccatatagtgctcacgaccccctgacttcccctgccagttctctgtttaatgacttcggagctttaaacatttcacagcgacggaaaccacgtaaatacagactcggaatgctggaagaacgcctcgtcccgatgggctccaaagcacgcaaggcaaagaatcctatcggttgcctcgctgatcgctgcaagtctggggtccccatcaacatggtgtggtggaaccgcgtgaccgaaaacaatctccagacccccaaccccaccgcatctgaattcatccccaagggcggaagcacatctcggctgtctaacgtaagccagagtaacatgagcgctttttcgcaggttttctcccacccaagcatgggtagccctgctaccgccggtttagctcccggtatgagtctgtctgccggttcaagccctctgcattcacccaaaataaccccccatacctcccctgcccctagaagaaggagtcacacacccaatcccgcttcctacatggtaccaagcagtgcctccactagcgtgaacaatccagttagccaaacaccaagtagcggccaggtgatccaaaaggaaacggtgggcggtacgacatatttctacacggatactacacctgcgcctttgactggaatggtcttccccaactaccatatctatccgccaaccgcaccacatgtcgcttatatgcagcctaaagccaatgcccctagcttctttatggctgatgagctgcggcaggaacttataaaccggcacctcattacgatggcccagatagaccaggcggacatgccagccgtgccgaccgaggttgactcgtaccattcactgttccccctcgaacccctgccgcctcccaacaggattcagaaaagctcaaatttcggatacattacaagctgctataaagccgttaatagcaaagacgacctgccgtattgcctacggcgtatccatgggttccggttggtgaacacgaaatgtatggtacttgtggatatgtggaagaaaattcagcattccaatatcgtgacattaagagaggtgttcaccacgaaggcttttgcagaaccctccctggtttttgcttacgattttcacgccggaggagagactatgatgagccggcattttaacgatccaaatgcagacgcgtactttaccaaaagaaaatgggggcagcatgaaggcccactgcctaggcagcacgccggattactccccgagagtctgatatgggcatacattgttcagctgtctagcgccttgcggactatccacactgccggacttgcctgtcgagtaatggacccaaccaagatcctgatcactggcaaaacccggctgagggttaattgtgtaggcgtatttgacgtgttgactttcgataacagtcagaacaataatcccctggctcttatggctcagtatcagcaagccgaccttatctctctgggcaaagtcgtgctcgcacttgcctgcaacagcctagccggtattcagagggagaatctgcagaaagccatggaattagtgacaattaactactcatccgatctgaagaacctgattctctacctgctgaccgatcaaaaccgcatgagaagtgtgaatgacatcatgcccatgatcggcgctcgattctatacccagttggacgccgctcaaatgcggaacgatgtgattgaagaagaccttgcaaaggaagtgcagaacggacggttgtttagactccttgccaaactgggtacgatcaatgagaggcctgagttccagaaagaccctacttggagcgagaccggagatcgctaccttttaaaacttttccgcgatcatcttttccatcaggtaacagaagctggcgctccatggatcgatctgagccatataatatcctgtctgaataaactcgacgctggggttcccgagaaaattagtttgatttctcgtgatgagaagtccgtcttggtggtgacttatagcgatctgaaaagatgctttgagaacacattccaggagctgatagcagccgctaatggtcaactgtag

SEQ ID NO: 29225 - DNA, 1710 bp, Artificial Sequence
  Description of Artificial Sequence: Synthetic coding sequence
atggccaccctagtcgttaacaagctcggcgcaggcgtggatagcggaaggcaaggctctcgagggaccgctgtggtgaaagttctggaatgcggggtatgcgaagacgttttcagcctccaaggcgacaaagttcctcgcctgttactctgtggtcacaccgtgtgccacgactgcctgacccgcctccctctgcacgggagagctatccggtgccctttcgatcgccaggtgactgatcttggcgatagcggggtgtggggcctgaaaaaaaacttcgctctgctggaactgctggaacggctccagaatggtcctatcgggcaatacggcgcagcagaggagagcatcggaatctctggcgagtccatcattcgatgcgacgaggacgaggcccacctcgctagcgtgtactgtaccgtgtgcgccacccacctctgctccgagtgtagccaagttactcactcaaccaagactctggcaaagcaccggagggtaccacttgccgacaagcctcacgagaaaaccatgtgcagccagcaccaggtgcacgcaatagaatttgtgtgcctggaggagggttgccagaccagtccactaatgtgttgcgtttgcaaagagtacggcaagcaccagggccacaagcacagcgtactggagcctgaggcaaaccaaatccgtgcctctatcctggacatggcccattgtattcgcacttttaccgaggagatttcagattattcccggaaactggtaggcatcgtgcagcatatagaaggaggggaacaaattgtcgaggacgggattgggatggctcacactgagcacgtgcccggaacggccgaaaatgctagatcatgcattcgcgcatatttttacgacctgcacgagaccctttgtagacaggaagaaatggcactctcggtagtggacgcccacgtgagggaaaaactcatctggctgcggcaacagcaggaggatatgactattttgctgtccgaagtgtctgctgcatgccttcattgcgagaagactctccagcaagatgattgcagggtggttctagccaaacaggagattacgcgcttgctggaaacccttcagaagcagcagcaacaattcacagaggttgccgaccacatccagctggacgcctctattcctgtgacgtttaccaaagacaatcgcgtccacatcgggcctaaaatggagatccgggtggtcacactgggccttgatggggctggcaaaacaactattctatttaagcttaagcaggacgagttcatgcagcccatcccaacaataggttttaatgtcgagactgtcgaatacaaaaatcttaagttcactatctgggatgttggaggaaaacataagctgcggcctttatggaaacactactatcttaatacgcaggcggttgtcttcgtggtcgactccagtcatcgcgacaggatttcggaggcccactctgaattggcaaaactcctcactgaaaaggagctcagagatgcactgttgctgattttcgctaataagcaggacgtggctggcgcactttccgtcgaggagatcacggaacttctcagtttgcacaagctctgttgcggtagaagctggtatattcaggggtgcgacgcacgaagcgtttttcagatcatttgtgatcagtatacaggtaaagaagtggtgaccgagaagggctag

SEQ ID NO: 29226 - DNA, 2061 bp, Artificial Sequence
  Description of Artificial Sequence: Synthetic coding sequence
atgggaagaattcaccaggccatggtgaccagccttaacgaagataatgagagcgtgaccgtagaatggattgagaacggggataccaaaggaaaagaaattgaccttgagagtatttttagcttgaacccggacttggtgccagacgaagaaatcgagccctctcctgagacgcccccacccccagccagttctgccaaggtcaataaaatcgtaaagaaccggaggaccgttgcctctattaaaaacgacccaccatcgagagacaacagagtcgtcgggtctgctcgtgcacgacccagccagtttccagagcagagctccagcgcccaacaaaatggaagcgtctccgacatcagccctgttcaggccgcaaagaaagagtttgggcctccatcccgcagaaagtccaactgtgtgaaggaggtggagaaactgcaggagaagcgcgaaaagagaaggctgcagcagcaggagttgcgggagaaacgcgctcaggatgtagacgctaccaaccccaactatgaaatcatgtgcatgatccgtgattttcgaggctcgttagattaccgacctctgactactgccgatcctattgatgaacataggatctgtgtgtgtgtacgaaagcgcccactgaataaaaaggagacacaaatgaaagacctggatgtcattaccatcccctcgaaggatgttgttatggtgcacgaacctaaacagaaggttgacctgacccgatacctggaaaatcagactttccgctttgactatgccttcgatgattctgctcctaacgaaatggtgtataggtttaccgctcggcctctggtcgaaaccattttcgaaaggggtatggcaacctgcttcgcgtacggccagaccggaagtggcaagacccacacgatgggcggagatttctctggcaaaaatcaggactgctcaaaagggatctatgcactagccgcaagagacgtttttctcatgttaaaaaagcctaactataaaaagctggagctgcaagtgtatgctacgttttttgagatatacagcgggaaggtgtttgatcttctgaaccgtaaaaccaagttgcgagtgttagaggacggcaagcaacaagttcaggtggtcgggcttcaggaacgggaggttaaatgcgtggaggatgtgctcaagctaattgacattgggaactcctgcagaaccagcggacaaacatccgctaatgcacattcctcccgctctcatgccgtgtttcagatcatccttagacgcaaaggtaaacttcacggtaaattttctctgatcgatctggctggcaacgaaagaggtgctgacacttcttctgctgacagacagacccgcctcgagggagctgagattaacaaaagcttgcttgctctcaaagagtgtataagggccctaggcagaaataagcctcatactccctttcgcgctagcaaactaacccaagtgcttcgggactcctttattggcgaaaactctaggacgtgtatgatcgcgacaatttctcccggtatggcctcttgcgaaaacactctcaatacattaagatatgcaaacagagtgaaagagctcaccgtggatccaacggcggcaggagatgttagacctattatgcaccatcccccaaaccagattgacgatttggagacgcaatggggcgtcggtagttctcctcagcgggacgatctcaaactcctttgcgagcagaacgaagaggaggtgagcccccagctctttacattccacgaagcagtgtcccagatggtagagatggaagagcaggtggtggaggaccaccgggcagtgttccaagagtcaatccgctggctggaagatgaaaaagcactgctcgagatgaccgaagaagttgactatgatgttgacagttatgctacccagctggaggccatcctcgaacagaaaatcgatatcttgacagaactaagggacaaggtgaagtcattccgcgcagcgttgcaggaggaggagcaggctagcaaacagataaatccaaagagacccagagccctgtag

SEQ ID NO: 29227 - DNA, 618 bp, Artificial Sequence
  Description of Artificial Sequence: Synthetic coding sequence
atgtctgtggacccaatgacgtatgaggcacagttcttcggtttcactccgcagacctgcatgctccgcatatatatcgcattccaggactacctgtttgaggtaatgcaggccgtagaacaggtgatccttaaaaagctggacgggatccccgactgcgacatttccccagttcagattaggaagtgcacagagaagtttctgtgctttatgaaagggcactttgacaacctgttttccaagatggagcagttgtttctgcaattgattctgaggatcccttcaaacattctgctccctgaggacaagtgcaaagaaaccccctattctgaagaagactttcagcatcttcaaaaggaaattgagcagctgcaggagaaatacaagaccgaactgtgtaccaaacaggctctcctcgcagaacttgaggaacagaagattgtccaggcgaagcttaagcagaccttgacctttttcgacgaactgcacaacgtcggacgcgatcatggcacttcagacttcagggagtccctcgtgagcttagtgcagaattccaggaagctgcaaaacatacgtgacaatgtggaaaaggagtccaaacgcttaaagataagctag

SEQ ID NO: 29228 - DNA, 1866 bp, Artificial Sequence
  Description of Artificial Sequence: Synthetic coding sequence
atggtcttatgtcccgtcattggcaagctgctacacaaacgggtggtgttggccagcgcttctccgcgtagacaggagattctgagcaatgcgggactcaggttcgaagttgtgccatcaaagtttaaggaaaaactagataaagccagcttcgccaccccctatggctatgcgatggagacagctaagcaaaaagcacttgaagttgccaataggctgtatcagaaggatctcagagctccagacgtcgtgatcggcgctgacacaatcgtgaccgttgggggacttatccttgaaaaaccagttgacaagcaggatgcctatagaatgctgtcccgtctgagtgggagagagcacagcgtgtttactggggtggccatcgtgcactgttctagcaaagatcatcagcttgatacgcgcgtttccgaattttacgaggaaacgaaggtcaagtttagcgagctctcggaggaattgctgtgggaatatgtccattctggtgagcccatggataaggccggtggctatgggatacaagcgctgggaggcatgttggtggaatccgtccatggagactttctgaacgttgtgggtttccccctcaaccacttttgcaagcagctggttaagctctattaccccccacgccctgaggatctccgaagatctgtaaagcacgacagtattccagccgctgacacttttgaggacctgtctgacgtggagggcggaggttcagagcctactcagcgcgatgcgggtagtagagatgaaaaagccgaggccggtgaggcaggtcaggctactgctgaggctgaatgtcaccgtactagagagaccctcccccctttccccactcgactcctcgagctgatcgagggcttcatgttgagtaagggactcctgactgcttgcaaactaaaagtcttcgatcttcttaaagatgaagccccacaaaaggccgctgacatcgcttcgaaggtggacgctagcgcgtgcggcatggagcgccttctcgatatctgtgctgcaatgggactcctggaaaaaaccgaacagggctacagcaatactgaaactgcgaacgtgtatctggcctcagatggcgagtattcactgcatggcttcataatgcataataatgatcttacatggaacttgttcacttacctggaattcgcaatccgggaagggacaaatcagcaccaccgagcacttggcaaaaaggctgaggacctgttccaagatgcttattaccagtctcccgaaacacggttgcgttttatgcgcgcaatgcacgggatgaccaagcttacagcctgccaggttgccaccgcctttaatctgtcccgtttctctagcgcatgcgatgtgggcggttgtacgggcgctctggcccgagaactcgcaagggaatatcccaggatgcaagtgactgttttcgaccttccagacatcatcgagttggccgctcattttcaacctccaggccctcaggcagtccagatccacttcgccgcaggtgattttttccgggatcctctgccctccgctgagctgtatgtcctgtgcaggatcctccacgactggccagacgataaggtccacaagctgctgtctcgtgtggccgaaagctgcaagccaggagctgggctgctcctggtggagaccctcctcgacgaggaaaaaagagtggctcaaagagccctcatgcaatccctgaacatgctggtccagacagaaggtaaagaacgttctctgggtgagtatcagtgtttacttgaacttcatggtttccatcaggtgcaggtcgtccatctgggcggagtactggacgccatactggcaaccaaagtggcgccatag

SEQ ID NO: 29229 - DNA, 2541 bp, Artificial Sequence
  Description of Artificial Sequence: Synthetic coding sequence
atgcttttcactgtctcctgctccaaaatgagctcaattgtagacagggatgattcttctatattcgatggactggtggaagaagacgacaaagacaaagctaagcgcgtatccagaaacaaaagcgaaaagaaaaggcgtgaccaattcaacgtgctgattaaggagctgggcagtatgctgccagggaatgcacgcaagatggacaaatccacagtactgcaaaaatctatagactttctgcggaagcacaaagaaatcaccgcccagagcgatgcctctgagatcaggcaggattggaaaccaacctttctcagcaatgaagagttcacgcaattaatgctggaagccttagatgggttctttttggcaatcatgacagatggatccatcatttacgtgtcggaaagcgtaacgtcgctgcttgaacatctcccatccgatttagttgaccaaagcatcttcaattttattcccgagggcgaacattcagaggtgtacaaaatcctaagcacgcacctattggaatccgacagcctgactccggaatatctgaaaagtaagaatcagttggaattctgctgccatatgctgagaggcactattgatcctaaggaaccaagtacttacgaatatgttaagtttataggcaattttaagagtttaaacagtgtctcttcaagcgctcataacgggttcgaagggacgattcagcggactcatagaccatcttatgaggaccgggtttgtttcgttgcgaccgtgaggctggctaccccacagtttatcaaggaaatgtgcacggtggaggagccaaatgaagagtttacatccaggcacagtttagagtggaaattcctgtttctggaccaccgtgcccctcccatcattggctacctgccattcgaggtgttgggcacatccgggtatgattactaccacgtcgacgatttggagaatttggccaagtgtcatgaacacctgatgcagtatggcaaaggtaagagctgttattataggtttcttacgaaaggccagcagtggatttggcttcaaacacattattacataacgtatcaccagtggaacagcagacctgagtttatcgtgtgcacccataccgtggtgagttatgccgaggtgagagccgagcggagacgcgagctggggattgaagaatctttgccggaaactgcagccgataaatcccaagacagcggctccgacaaccggattaatactgttagtctaaaagaggccctggagcgttttgatcattcgccgaccccctctgcaagcagcaggtcgtcgcgaaagtcgagtcacactgcagtgtccgatccctcaagtacacctactaagattcctaccgatacgagcaccccccctagacagcatctgcctgctcacgagaaaatggtgcagcggcgatcaagtttcagttcccaatccattaacagccagagtgtgggtagtagcctgacccagcctgttatgagccaggcgacaaacctgccaattccacaggggatgtcccagttccagttttccgcccaactgggggctatgcagcaccttaaggatcagctggagcaaaggacgcggatgattgaggctaacattcacaggcagcaagaagaactgcggaaaatccaagaacagctccagatggttcacggtcagggactacaaatgttcctccagcaaagcaacccaggcctaaactttggcagcgtgcagctgtcaagcgggaactcatccaacatccagcaattggcacctatcaatatgcaggggcaggtggtgccgaccaaccaaatccagagcggcatgaacacaggtcacatcggcactacccagcacatgatccagcaacagacactgcagtctaccagcacgcagagtcaacagaatgtgctctccggacactctcagcaaacttccttgccctcacagacccagtcaactcttactgcgccactttacaacaccatggttatttcccagcccgcagcaggcagtatggtgcagatacccagctccatgccccagaatagcacacaaagcgcggcagtaacaaccttcacacaggaccggcagatccgcttttcccaggggcagcaactcgtgacgaagctcgttactgcacctgtagcttgtggagcggttatggtacccagcacaatgctcatggggcaggttgttacagcctaccccaccttcgcgacccagcagcagcaatcccagactctgtccgtcacccaacagcagcaacagcagtcctcacaggaacagcagctgacatccgtgcaacaacccagccaggcccaactcactcagccgccacagcagtttctccaaaccagcagacttttgcatgggaaccccagcacacagttgattctgagtgcggcttttccactgcaacaatcaacgttcccccagagtcaccaccagcagcaccaaagccagcagcagcaacaactgtctcgtcacaggactgattctctgcccgatccaagcaaagttcagccgcagtag

SEQ ID NO: 29230 - DNA, 1818 bp, Artificial Sequence
  Description of Artificial Sequence: Synthetic coding sequence
atggtgttgtgtcccgtgattggtaaattgctgcacaagagagtggtgctggcaagcgcctctccccgaagacaggagatcctgagcaacgcaggcctgagattcgaggtggtccccagcaaatttaaggagaagctcgataaggcctcattcgccacaccatacggctacgccatggagaccgcgaaacaaaaggctctggaggtcgctaatcgcctgtaccagaccgtgggcggtttaatactggagaaacctgtggacaagcaggatgcctacaggatgctttcccggctctccgggagggagcacagcgtctttaccggagtcgccattgtgcattgttcctccaaagaccatcagctggatactagggtctcagagttctatgaggagaccaaggtcaagttttccgaactctccgaggagctcctctgggagtacgtgcactctggtgagccgatggacaaggccggaggatatggcatccaggccctggggggaatgctggtcgaaagtgtgcacggcgatttcctgaatgtggtcggctttcccctgaatcacttctgtaagcaactggttaagttatattatccccctaggcctgaggacctccgcaggagtgttaagcacgacagtattcccgcagccgatacattcgaagatctctctgacgtggaagggggaggcagcgagccaactcagcgcgatgctggatcccgggatgaaaaggcggaggcaggcgaggctggccaggcaactgcagaagcagagtgtcatcggactcgggaaacgctgccgccatttcctactcgcctcctcgaattaatcgaaggcttcatgctcagcaagggactccttaccgcttgcaagctaaaggtgttcgaccttctaaaggatgaagccccacagaaagccgcagacatcgcatccaaagtcgacgccagcgcctgcggcatggaacgattgctggacatttgtgcagctatgggcctccttgagaagacagaacagggatactcgaatacagaaactgctaacgtgtacttagcaagcgacggagagtatagtcttcatggatttatcatgcataacaacgatctcacctggaacctttttacttacctggaatttgccatcagagagggaacaaaccagcaccatcgcgctttaggaaaaaaggcggaggatctttttcaagacgcgtactaccagtctcccgagacacgtctacgatttatgcgggcaatgcacggaatgacaaaactgactgcctgccaagtcgccacagcgttcaatttatctcgcttttcttctgcatgcgacgtagggggatgcaccggcgcactcgccagagagctcgcccgagaataccctaggatgcaggttacggtatttgacttgcccgacattattgagttagccgctcacttccagccccctggccctcaagctgttcagattcattttgccgcaggcgatttctttcgcgatccactgccatctgctgaactttatgtgctctgtaggatattgcatgattggcccgacgataaagtacataagctcctttccagagtcgcggaatcttgtaaacccggtgctggcctgttactcgtcgagacacttctggatgaagagaaaagggtagctcagcgtgctctgatgcagtctctgaacatgctggtccagacagaaggaaaggaacggtcccttggcgaatatcaatgtctattagagttacacggttttcaccaggtgcaagtggtgcatcttggcggagtgctcgacgctatattggcaacgaaggtggcaccttag

SEQ ID NO: 29231 - DNA, 696 bp, Artificial Sequence
  Description of Artificial Sequence: Synthetic coding sequence
atgaccgtggggaagagcagcaagatgctgcagcatattgattatcgcatgcgatgtattctccaggacggcagaatcttcataggaacgttcaaggcgttcgataagcatatgaacctgattctgtgtgactgcgacgaattcagaaagattaagcccaaaaattctaagcaggctgaaagagaagaaaaacgagtgctcggcctggtcctcctgcggggagagaatcttgtttcgatgacagtggagggccctcctcctaaagataccgggatagccagagtacctctggccggagctgctggcggtcctgggatcgggagagctgccggtcgcggtataccggcaggagtgccaatgccgcaggcccctgccggacttgccggtcctgtgcgcggagtggggggtccctcccaacaggtcatgacgccccagggacggggaactgtcgccgctgccgcagcagccgctacggcatctatcgcaggtgcgccaacccaatatccaccaggacgtggcggaccaccacctcccatggggcgaggagctccacctcccggtatgatgggcccacccccagggatgcggccaccaatgggacccccaatgggaatccctcctggcagaggcacacctatgggaatgcctcctccgggaatgaggccccctccgcctggcatgaggggacttctgtag

SEQ ID NO: 29232 - DNA, 855 bp, Artificial Sequence
  Description of Artificial Sequence: Synthetic coding sequence
atgtggcggggactggctttagcccgtgccattggctgtgctgccaggggaagaggacagtgggctgtgcgggctgctgattgcgcacaatcagggagacaccctggacctgcggtggtatgcggtcgccgactaatctccgttttggaacaaatcagacatttcgttatgatgcctgagattaacacgaaccaccttgacaaacaacaggtccagcttctcgctgagatgtgcatcttgattgacgaaaatgacaacaagatcggagctgaaacaaaaaaaaattgccatttaaatgagaatatagagaaagggctgttacatcgggcattttccgtgttcttgtttaataccgagaacaagcttctgttacagcagaggagtgatgccaaaatcaccttccctgggtgcttcacgaacacctgttgcagtcatccactgtcaaaccccgctgaactggaagaaagcgatgctctcggcgtccggcgtgccgcacagagacgtctgaaagccgagctgggcatccccctggaggaggtaccccctgaagaaatcaactatctgacacggatacattacaaagctcaatctgacgggatttggggcgagcacgaaatcgattatatactcctagtccgtaagaacgtgaccctcaaccctgatccaaatgagattaagtcatactgctacgtcagcaaagaggagcttaaggaattgctcaagaaggccgctagcggggagataaagatcacaccttggtttaaaattatcgcagccacattcctgttcaaatggtgggataacttaaatcacctgaaccagttcgtcgatcacgagaagatctaccgtatgtag

SEQ ID NO: 29233 - DNA, 180 bp, Artificial Sequence
  Description of Artificial Sequence: Synthetic coding sequence
atgacacgcggaaaccagagggagctggccaggcaaaaaaatatgaaaaagcagagcgattccgttaagggcaagcggcgtgatgatggtctctccgctgcagcaagaaagcagcgggattccgaaatcatgcagcagaaacagaaaaaggcaaatgagaaaaaagaggaacctaaatag

SEQ ID NO: 29234 - DNA, 3039 bp, Artificial Sequence
  Description of Artificial Sequence: Synthetic coding sequence
atggaagaatatgaaaagttctgcgagaagtccctggcgaggatccaggaggcctccctgagtaccgagagctttctccccgcacagtccgagtccatctctctcatccgcttccacggagttgcaatcctctcccctctgttaaacatcgaaaaaagaaaggagatgcagcaggagaagcagaaagcactggatgtggaggctcggaagcaggtaaatcggaagaaagctctcctaacgagggtccaggagattctagataacgtccaggttaggaaggctcctaatgcatctgattttgatcaatgggagatggagacagtgtactcaaacagcgaagtgcgcaatttaaacgtgcccgctacttttccaaactccttcccgtcgcacactgagcacagtactgccgcaaaacttgacaaaattgccggaatcctgcctctagacaacgaagaccaatgtaagaccgatgggattgatttagcgcgagattccgaaggatttaactcgccgaaacagtgcgattccagcaatatatctcacgtggaaaatgaggcttttcctaaaacctcgagcgcgactccacaggaaaccctaatcagcgatgggccattctccgttaatgagcagcaggatctaccattgctagcagaggtgatacctgacccgtatgtgatgagcctgcagaacttgatgaaaaagtctaaggaatacattgagcgggaacagtccagacgatctctgaggggaagtattaacagaatcgttaatgaatcccacctggacaaagagcacgacgcagtggaagtggctgactgcgtgaaagagaagggccagctaaccggcaagcattgcgtatcggtgattcccgataaaccttcactcaacaagtcaaatgtgcttcttcagggcgctagcacccaggctagctccatgagcatgcctgtgctcgcgtctttcagcaaggttgatatacctattagaacaggacatcccaccgtgctggaaagcaactccgactttaaggtcatcccaacattcgtgaccgaaaacaatgtgattaagagtctgactggaagttatgcaaagctgccgagccctgagcccagtatgtcacccaaaatgcacaggcgtaggtccaggacctctagtgcctgtcacatattaattaacaatcccataaatgcttgcgagttatcccctaagggtaaggaacaggcgatggacttaattatccaggacactgatgaaaataccaacgttccggaaattatgccgaagttaccaacagatctggctggggtgtgtagctcaaaagtttatgtgggaaagaacacgagtgaggtgaaggaagacgtggtactggggaagtcaaatcaagtctgccaaagctcaggcaatcatttggagaataaggtgacacacggcctagtcactgtggagggtcaactcacatcggacgaaaggggtgctcatattatgaattcaacttgcgctgctatgcctaaacttcatgaaccatacgctagttcccagtgtattgcctccccaaacttcggcacagtgtccggattaaagccagcatccatgctagagaagaattgtagtctgcaaactgagctgaataagtcttatgacgtgaagaaccctagccctcttcttatgcagaatcaaaacacaagacaacagatggatacgcctatggttagctgcgggaacgaacagttcttggataatagcttcgagaaggtgaaaaggcgattggatttggacattgatgggcttcagaaggagaattgtccttacgtcattaccagcggcatcaccgagcaggaaagacaacacctgccagagaaaagataccctaagggatctggttttgtgaacaaaaataagatgctcggcacttcatcaaaagaatccgaggagctcctgaagtcaaagatgcttgcttttgaggagatgagaaagagacttgaggagcaacacgcgcagcagttatccttgttgatagcagaacaagaacgcgaacaggagaggctgcagaaagagatcgaagagcaggaaaagatgctgaaagagaagaaagccatgaccgcagaggcttctgagctggacataaacaacgcagtggagctcgagtggcgtaagatcagcgattcaagtctgctcgagactatgctgagccaggccgacagtctccacacttctaactccaacagtagcggctttactaactctgctatgcagtatagttttgtaagtgctaacgaagcccctttttacctgtggggatcttcgaccagtggacttacaaaactgagcgtcacgcgtccgttcgggagggcgaaaactagatggagccaggtcttcagcctggaaatccaggccaaattcaacaagatcactgctgtagcaaaagggtttcttacgagacggctgatgcagaccgataaactcaaacaacttcgccagaccgttaaagacactatggagttcatacggtcatttcaatcagaggccccacttaaaagaggtattgtgtccgcacaggacgcttccctgcaggagcgagtcttggcccagctgcgtgccgcactgtacggaattcacgacatcttctttgtgatggacgctgcagagcggatgtctatcctgcaccacgatagggaggtaagaaaagagaagatgttaaggcaaatggataagatgaagtctccgcgagtggcattgagcgcggctacccagaagagcctggatcggaaaaaatacatgaaggccgctgaaatgggcatgcccaataaaaaattcttagttaagcagaacccaagtgaaactcgggtgttacagcctaaccagggtcagaacgccccagtccacagactgttatcccgacaggggactcccaaaacctccgtgaaaggagtggtgcagaatcggcagaaacctagccagtcaagagtgcccaatagggtccctgtatctggcgtctacgcagggaagattcagaggaaacggccaaacgtcgcaactatctag

SEQ ID NO: 29235 - DNA, 267 bp, Artificial Sequence
  Description of Artificial Sequence: Synthetic coding sequence
atggcaagcgcctccgcacgaggcaatcaggacaaggatgcgcattttccccctccgagcaagcagtctctccttttttgtcccaagtccaagctgcacatccaccgcgcagagatttctaagattatgagagaatgccaagaggaatctttttggaaacgtgccctacccttctccttggtgtcgatgttggtgactcaggggttggtttatcagggctatttggcggctaacagccggtttggcagtttgccaaaggtcgcctag

SEQ ID NO: 29236 - DNA, 738 bp, Artificial Sequence
  Description of Artificial Sequence: Synthetic coding sequence
atgaacggtagggccgactttagggagcctaatgcagaggtgcccagacccattccgcacattgggcctgactacattcctacagaagaagagaggagagttttcgccgagtgtaacgatgagagcttctggttccggtcagtccccctggcagcaacaagtatgctgattacacagggcctcataagtaaaggaattctcagttcccatccgaagtacggctctataccaaagctgatcctcgcgtgtataatggggtacttcgccggaaagttgtcatatgtgaaaacgtgccaggagaagttcaaaaagctagagaacagtcccctcggtgaggccctacgcagcggacaggctcgaaggtcgtctccaccaggacactattaccagaaaagcaagtacgatagtagcgtatctggccagtcctcttttgtaacgagcccagccgctgacaatattgaaatgcttccgcattacgagcctattccatttagttcgtctatgaatgagtccgctccaaccggaattactgatcatattgtgcagggcccagatcccaacctggaggagagcccaaagcggaagaatattacctacgaagagctgagaaacaaaaatcgggaatcctatgaagttagcctcacacaaaagactgatccatccgtcagaccgatgcacgaacgagttcctaaaaaggaggtgaaagtgaacaagtacggggatacatgggatgagtag

SEQ ID NO: 29237 - DNA, 1551 bp, Artificial Sequence
  Description of Artificial Sequence: Synthetic coding sequence
atgagctaccccgctgacgattatgagtcggaagctgcctacgacccatacgcctacccatcagactacgatatgcacactggggacccaaagcaggaccttgcctatgagaggcagtatgagcagcaaacctaccaggtaatccccgaggtgatcaagaacttcattcagtattttcacaagacagtgagtgatctgatcgaccagaaagtgtatgagttacaagcgtctagagtctcctcagacgtcatagatcagaaggtgtacgagatccaagacatctacgagaacagttggaccaagctcacagagaggttctttaagaacacaccctggcctgaagccgaggccattgctcctcaggtcggaaatgatgcagtattccttatcctgtacaaggagctgtactaccgccatatttacgccaaggtgtctttccaatcttttagccagtacagatgcaaaaccgccaaaaaaagtgaggaggaaatcgatttccttagatccaatcccaagatctggaacgtccattccgtactcaatgtgctgcactcactagttgataagtctaatattaaccgccagctcgaggtatacacttccggtggggacccagagagcgtagccggagagtacggcaggcactcactttataagatgctcggatactttagcctggttggcctgttgcgccttcactcccttctgggggactattaccaggccatcaaagtgctggagaatatagagctgaacaaaaaaagtatgtacagcagagtccccgagtgccaagtaacgacgtattattacgtgggattcgcgtacttaatgatgcggagataccaggatgccataagagtattcgcaaatatactgctgtacatccagcgaacgaagtcaatgttccaacgaacaacatacaagtatgaaatgattaacaaacagaacgagcaaatgcacgcattacttgcaatcgctttgacaatgtatccaatgcgtatcgacgagagtattcatcttcagctcagagaaaagtacggtgacaagatgttaaggatgcaaaagggcgatccccaagtgtatgaagaactgttttcatattcctgccctaagttcttgagtcccgttgtccccaattatgataacgtgcatccaaattatcacaaggaacccttcctccagcagctgaaggtcttctctgacgaggtgcagcaacaagcccagttgagtaccatccgatcttttcttaaactgtacacaactatgcctgtggctaaattagccggattcctcgacttgaccgagcaggaattccgcatccagcttttggtgtttaagcacaagatgaaaaacctagtctggacatccggaatctccgcccttgatggggagttccagtccgccagtgaagttgatttctacatcgacaaggatatgatacacatagccgataccaaagtcgcccgacggtacggagatttcttcatcagacagatacataaatttgaggaattaaaccggaccctcaaaaagatgggccagcgaccgtag

SEQ ID NO: 29238 - DNA, 2502 bp, Artificial Sequence
  Description of Artificial Sequence: Synthetic coding sequence
ctttctagaagagtaccatgtgtgcgcagagggtgtaggccgcctctgcctcccttgcccggatcacagagtcgggcttggtcgcgcgatagagaagcacctctcgatccaggaagacccgcacagtctgggcgaagaccaaccagtagaagtgtgtcacacgcctgttcatggaatgggggtagtctagaccctctggaaggcactccagcccttctgcgcagcgcggagcgcctcatgaggaaagtgaagaagctacgtctggataaagaaaataccggatcctggagatccttttctctgaactctgaaggggctgaacgaattacatcttacgatttccactcagagtccgggttgtttttgtttcaagcaagtaatagtctcttccactgcagagacggaggaaagaacggatttatggttagtcctatgaagccacttgaaatcaagacacaatgcagtggcccacgcatggaccctaaaatctgccctgcagatcctgcctttttctcattcatcaacaattcagatctgtgggtggctaatattgagacaggggaagaaaggcgactgacattttgtcaccagggcctgtctaatgttctcgacgacccgaaatccgccggagtggcaacattcgtaattcaagaggaatttgataggtttacaggctactggtggtgccccacggcctcctgggaagggagtgagggattgaaaacactcaggatactgtacgaggaagtggatgagagcgaagtggaggtcatccacgtgccaagcccggcactggaggagaggaaaacggactcctacaggtacccacggacaggatcaaaaaacccaaaaatcgcccttaaactcgccgagttccagaccgatagccagggaaaaattgtctctactcaggagaaggaactagtgcagccattcagttcccttttccccaaggtggaatacattgcacgcgctggctggacccgagacgggaagtatgcgtgggcgatgttcttagaccgcccacaacagtggcttcagttagtactgcttccacccgcactctttattcctagtaccgagaacgaggagcagaggctggcaagcgcaagggcagtgcccaggaacgtgcagccttacgttgtttacgaggaggtcacgaacgtgtggataaatgtgcacgacatcttttatcccttcccccaaagtgagggtgaagacgaactttgcttcttacgcgcaaacgagtgcaaaaccggtttttgtcacctgtataaggtcaccgccgtgttgaagtctcaaggatacgattggtccgagcccttcagcccgggagaggatgagtttaaatgcccaatcaaggaagagattgctctgacatccggcgaatgggaagttcttgccaggcatggatctaaaatatgggtgaatgaggagactaaattggtgtacttccagggaactaaagacacacccctggaacatcatctatacgtggtctcttatgaggctgccggtgagatcgtgagattaaccacacccggattcagtcattcttgttcaatgtcccagaacttcgatatgttcgtcagtcactactctagcgtgagcacacccccatgcgttcacgtttacaagctcagcggccctgacgacgaccccctccataagcagccccgattttgggcttcaatgatggaggcagctagctgtcctcccgactatgttccccctgaaatctttcatttccacaccagaagcgacgtgaggctttacggtatgatctacaaacctcacgctttgcaaccgggaaaaaaacaccccactgtcctgtttgtatatggtggccctcaggttcagttggtcaacaattcatttaagggaatcaagtacctgaggctaaacacactggcaagtctggggtacgccgtcgtggtgattgacggacggggatcctgccaacgtggcctaagatttgagggagcccttaaaaaccagatgggacaggtggaaatcgaggaccaagtggaagggttgcaattcgtagccgagaagtacggcttcatcgacctctccagagtagccattcatggatggtcgtacggaggatttttgtctttaatgggcctgattcacaagccccaggtcttcaaggtggccatagcaggggctcccgtaactgtgtggatggcttacgacaccggttacaccgaacggtatatggatgtaccagagaacaatcagcacggctacgaagccggttcggtggcactgcacgttgagaagctgccgaatgaaccaaatcgcctgctgattttgcacggcttccttgacgagaacgtgcacttctttcatactaattttctggtatcccagctaattcgtgccggaaagccctaccagttgcagatttaccccaacgagcgccactcaatcagatgtccagaatcaggggagcattatgaggtcaccctgctgcactttctgcaggagtatttgtag

SEQ ID NO: 29239 - DNA, 5072 bp, Artificial Sequence
  Description of Artificial Sequence: Synthetic coding sequence
atggactgtttattggaactaagcgcaaccgacacaaagatcgaggagagctccagccaaagttttgtggctagtgagaaccaggtcggcgcagccgaaagtaagatcatggaaaagagacccgaggaggaatcagaggatagcaaaatggattctttcctagacatgcagctgactgaggatcttgatagcctgatccagaatgcgtttgagaaactgaacagttctcccgacgaccaggtgtactcttttctgcctagtcaggatgtgaatagcttcaacgactcgtcagaattcatcaatccagatagctcaaacatgacccccatattcagcactcaaaacatgaatctgaacggcgaaaatcttgagaacagcggttcgacactgtcacttaatccactcccatcccattccgtactcaatgagagtaagtgctttatcaaagataatacactggccctcgaaagtaattatccagaggattcgctcctctccagctcacttaatgtggcgtcagattctatcgcaggttgttcctcattaaatcagaagcagaaggagctcctcgagagcgagtgcgttgaagctcagttcagtgaggcgccagtcgacttggatgcctccgaacctcaggcgtgcttgaacttgcccggactagacctgccgggtacggggggtgaccagaaatccacaagagtgagtgacgtgtttcttccatctgaagggttcaatttcaagccccacaagcaccccgagctgcctaccaaggggaaggacgtgtcttattgcccagtgctggccccattaccacttctactacccccacctcctcctccgcctatgtggaaccccatgattcccgcattcgacctgttccagggaaaccatggttttgtggcccctgtggtgacaaccgctgctcactggcgttctgtgaactatacattcccccctagcgtgatctcacacaccagtcctacgaaagtctggcgaaacaaagatggcaccagcgcctaccaggttcaggagacacccgtcagccaagtggtgagaaagaagaccagctacgtcggcctggtcttggtgctgctgcgcggattacctggaagtggtaagtccttcttagctagaaccctccaggaggataatcctagcggtgtcatcctgtccacagatgactatttctatataaacggccagtaccagtttgacgttaagtacttgggggaggcccatgaatggaaccaaaaccgcgctaaggaggcctttgagaagaagatttcacctattataatagataacaccaacctgcaggcttgggaaatgaagccgtacgtggccctatcccaaaagcataaatataaggttttgttccgagagccagatacatggtggaaatttaagccaaaagagctcgccaggagaaacatacacggtgtgtctaaagagaagattacccgcatgctggagcattatcagagatttgtttcggtacccatcatcatgtcctcctcagtcccagagaaaattgagcgcatagagctgtgcgcctattcctgcgaagacagatccacaagcccaagagacgacgaggacatcataagcgaaaaggaggagaacatcctgtctctttcactgaaacacttggaatttaccgaagaaaagaacctggatgtgacaaaagagacaatgctcccagagaacgtggcttacctgagtaatgctgacctcaataaaagacggaaagagatctcagacatgaatcccagcattcagagcgctttaattctagaaacaccacatatgtacttttcggatagcgaatctaaacttcaagcgacagataagtcagagaatgagcagattgagatggtcgctgtcaagggttactctaagactgataccgattcctccatggagcgtgtgtccccatcgacctgctgctccgagaataatcaggaggactgtgacctggctaattccggacctctacagaacgagaagagctctccaggtgaaattgtggaggagcgggctacagtaaccaagaaagcgttcgggaaacagaagtcaaaatcaaccctggagaagttccctagacatgaactgtccaattttgtgggagattggcccgtcgataagactattggacagcggacgaagcgcaatcggaaaacagagaagacatcctctgtccaatccgataagaagtataattacccccagtcacacaagctggtaaatagcgtgtcggtgaacacagattgcgttcagcagcggggaagcccccatgagagcgtggaggacggcagaaaaagtcagtgcgacgacgcttccgagcccctgaattcctacaaatacgacgcctataaaaacatcgataagaatagctttaatataatgggggattggcctagttccgacagcctggcacagagggagcataggtcccgcatgcccaagacaggcctctcagaacccaacctggaaattggcaccaatgacaaaatgaatgagataagcctgtccacagcgcatgaggcctgctggggtacaagctcccaaaagctcaagacgttaggctcctcgaatctcggcagctccgagatgttgcttagcgagatgacctgtgaatcccagacttgcctgagcaaaaaatcgcatgggcagcacactagtttgcccctaacctttaccaattccgcccctacggtatccggcgtagtggagccacagacactcgcagagtgccaggagcaaatgcctaaacgtgatcctggaaaggaggtgggaatgtgcacccagacagaacctcaggacttcgccctcctttggaaaattgagaagaataagataagcatctccgatagcattaaggtgcttacagggaggctggatggctttaaaccaaaggtgttcaacattaataccaaaagcgatgtgcaagaagcaataccctacagagtgatgtatgataaaagcacgtttgtcgaggagtctgaacttaccagtgctgacgagagtgaaaatttgaatatcttgtgcaaactgtttggatctttcagtttagaggccctgaaggacctctacgagcggtgtaataaggacatcatttgggctacgtcgttgctgctggatagcgaaacaaaactgtgtgaggacacagagttcgaaaactttcagaagtcatgcgacggcagtcagatcggccctttctctctcgggttgaacctgaaagaaattattagtcagaggggtacgctggagaactccaactctccagtaccagaattctctcatggaatcggaatatccaacgcggactctcagtccacgtgtgacgcagagcgtggtaactcagagcaggccgagatgcgggcagttacacccgaaaaccatgaatccatgactagtatctttccaagcgccgctgtagggctgaaaaacaacaatgacatcctgcccaacagccaggaggagctgctgtactcctccaagcagtcatttccaggaatcttaaaagctacaacccctaaggacatgtctgagacagagaaaaatttagttgttaccgagaccggggataatatccactctccatctcactttagcgatatcttcaactttgtaagctcaacaagtaaccttgagctgaacgaagagatctactttaccgattctcttgagattaagaggaacgaaaattttccgaaggactacgttaagttcagtgatgaagaagagttcatgaacgaggatgaaaaagagatgaaagagatcctaatggccggaagcagcctgtctgctggtgtgagtggagaagacaaaacggagatcctgaatccaacccccgctatggccaaatcccttacgattgattgtctcgagttggccttaccacccgagctagcgtttcagctgaatgagctatttggcccagtgggcatcgattcaggtagccttaccgtcgaagattgcgtcgttcatattgacctcaatctggcaaaggttattcacgaaaagtggaaagaatctgtgatggaacggcagagacaggaggaggtatcatgtggaaagttcatgcaggaccctagtctagtgggacataccggactcgacaacccggaacagaagtcatcacagcgcaccggaaaaaagcttttgaaaactctaacagcctcggaaatgctgccgctgctcgatcactggaatacccagacgaaaaaggtgagtctgagggaaataatgtcagaggaaatcgcactgcaggaaaagcataatctcaagagggagacactaatgtttgaaaaagactgtgccaccaagctgaaggaaaagcagcttttcaaaatcttcccagcgatcaaccaaaactttctcgttgatattttcaaggaccacaattatagcctggagcacactgttcaattcctgaactgcgtgttggagggagatccagtgaagaccgtggttgctcaagagtttgtgcaccaaaatgaaaatgtcacatcgcacacggggcaaaagagtaaggaaaagaaaccaaaaaagttgaaagagactgaagaaaccccctcagagctgagttttcaggatttcgaatatcctgattacgacgattatcgagcagaggcctttcttcaccaacagaagaggatggaatgctactccaaggccaaagaggcttatcgcatcggtaagaaaaacgtggccacgttctatgctcagcaggggacactgcatgagcagaaaatgaaggaagccaaccacctggcagcaattgaaatcttcgagaaggtcaacgctagccttctgcctcaaaatgtcctggaccttcacggtctgcacgtcgacgaggcgttggagcacctgatgcgcgtgctggaaaaaaaaacagaggagtttaagcagaatgggggaaaaccctacctgtcagtgatcaccggtaggggcaatcatagtcaggggggagtagctaggatcaagccagccgtaatcaagtatcttatttctcatagctttcggttctctgaaatcaaaccagggtgcctgaaggtcatgctgaagta

SEQ ID NO: 29240 - DNA, 477 bp, Artificial Sequence
  Description of Artificial Sequence: Synthetic coding sequence
atgggaagtgggtcctcccgcagcagccggaccctacgtcgacgcagatcccctgaatctctgcccgctgggcctggagcggcagccctggagggcggaacacggcgtcgggtccccgtcgccgctgcagaggtaccgggagccgctgctgaggaggctcccggaagagatcctagccccgtggcaccgcctgatggcagagacgagactctgcgactcctcgatgaactgctcgcggaatcggccgcttggggaccccctgagcccgcacccagacggccagccagattgagacccacagcagtagcgggatccgccgtctgcgctgagcaatctaccgagggtcaccctggctccggcaatgtaagcgaagctccaggatccgggcgaaagaagcccgagcggccagctgcaatcagttatgaccacagcgaggagggcctgatggcctctatcgagcgcgagtattgcagatag

SEQ ID NO: 29241 - DNA, 738 bp, Artificial Sequence
  Description of Artificial Sequence: Synthetic coding sequence
atggagaagacggagcttatccagaaggccaaactcgccgagcaggcagaaaggtacgatgatatggcaacatgtatgaaagcagttactgaacagggcgctgagctgagcaatgaagagaggaaccttctgagtgtcgcgtacaaaaatgtggtggggggacgtcggtccgcttggagggtcatttcatcaatcgaacaaaagaccgacacgtcagacaaaaaactccagctcatcaaagactatagggagaaagtcgagtctgaattgcgttccatttgcacaacagtgctggagctcctggacaagtacttgatcgctaacgccacgaatcctgaatccaaggtcttttacctcaagatgaaaggggattacttccggtacttggccgaagttgcatgtggcgacgatagaaagcaaacaatagacaatagtcagggggcttatcaggaagctttcgacataagcaaaaaagagatgcagcctacccaccccattcggctcggattggccctgaatttttctgtgttctactatgagatactcaataacccagaattagcttgcacgctggccaaaacggcctttgatgaagccatcgccgagctggacaccctaaatgaagatagctacaaagactctactcttattatgcaacttcttagggacaatttaacactctggacctctgatagcgcgggagaggagtgcgatgccgctgaaggggcagagaattag

SEQ ID NO: 29242 - DNA, 1014 bp, Artificial Sequence
  Description of Artificial Sequence: Synthetic coding sequence
atggaacaaccttggcctcctccaggtccatggagccttccacgcgctgagggagaagctgaggaggagagtgatttcgacgtgtttccctcaagcccacgctgtcctcagctgcctgggggaggggcacagatgtattcgcatggcatcgaactcgcgtgccagaagcagaaggagtttgtgaagtccagcgtcgcctgtaaatggaacctggccgaggctcagcagaagcttgggtccctcgctctgcataatagtgagtccctggaccaggagcacgctaaagctcaaactgccgtctcggagctgaggcagcgcgaggaggaatggaggcagaaggaagaggccctcgtgcaacgcgagaagatgtgtttatggtcaacagatgctatctccaaggacgtctttaataagtccttcatcaatcaggacaagagaaaggacaccgaggatgaagacaagtctgaatcatttatgcaaaaatacgagcaaaaaatacggcacttcggcatgttgtcacgctgggacgacagtcagcggttcctgtccgaccatccttatctcgtgtgtgaagagacagccaagtaccttattctgtggtgttttcatctggaggcggaaaaaaaaggcgcattgatggagcagatagcccatcaggctgtcgttatgcaattcatcatggagatggcaaagaattgtaacgtggatcctcgcggttgtttcaggctcttcttccagaaagcaaaggccgaagaggagggctattttgaggcttttaaaaacgaactggaagctttcaagagtagggtaaggctgtactcccaatctcaatcttttcagcccatgaccgtccagaaccacgtgccacactctggtgtgggctctattggcttgctagagagcctgccgcagaatcccgactatctacagtactctattagcactgcgctttgttcacttaattccgtggtgcacaaggaagacgacgaacccaaaatgatggataccgtctag

SEQ ID NO: 29243 - DNA, 927 bp, Artificial Sequence
  Description of Artificial Sequence: Synthetic coding sequence
atggaacagccatggcctcccccagggccttggtcgctcccaagggctgaaggcgaagcagaggaggagtccgatttcgacgtattcccttcatcccccaggtgtccccaactgccaggcggtggagctcaaatgtactcacatggaatagaacttgcttgccagaagcagaaggagttcgttaagagctccgtggcctgcaagtggaatctggctgaggcccagcaaaaactcggttctctggccctgcataattcggaaagcttggatcaggaacatgcaaaagcacagaccgctgtatctgagctgcgtcagcgggaagaagagtggcgccagaaggaggaagcccttgtgcagagggaaaagatgtgcctgtggagtacggatgccatttccaaggatgtgttcaacaaatcatttataaatcaggataaacgcaaggacaccgaggacgaggacaagtctgaaagcttcatgcagaagtacgagcagaaaatccgtcattttggaatgctgtcccggtgggacgacagccaacgctttctgtccgatcacccatatctggtatgcgaagaaactgccaaatacctcattctgtggtgcttccacctagaggccgaaaaaaagggtgccttgatggagcaaatagctcatcaggccgttgtgatgcagttcatcatggagatggctaaaaattgcaatgtcgatcctaggggctgcttcagactgttctttcagaaggccaaggcagaggaggaaggttactttgaagcattcaagaacgagctcgaagcttttaaatctcgtgtgcggctgtattcgcagagccaaagcttccagcccatgaccgtgcagaaccatgtcccacactctggagtcggcagcatcgggcttcttgagagtctgccgcaagctccccgattttag

SEQ ID NO: 29244 - DNA, 4227 bp, Artificial Sequence
  Description of Artificial Sequence: Synthetic coding sequence
atgtggtctctgacggctagcgagggtgagagcactacagctcatttttttcttggcgcaggcgacgagggcctggggacacgcggtatcggaatgagacccgaagagtccgacagcgagttgctggaggacgaggaggacgaagtgccaccggagccccagattatcgtcgggatatgtgcaatgactaaaaaatcaaagagcaagcccatgacccagatacttgagagactctgcaggttcgactatctgacagttgtgatactgggggaggatgtaatcctcaacgagcctgtggagaattggccgtcgtgccattgcctgatttcattccactcaaagggctttccccttgataaggccgtggcatactccaagttgcggaacccttttctgattaatgatctggcgatgcagtattatatacaagaccggcgagaagtgtatcgcatcctccaggaagaggggatagacttgccaagatatgccgttctcaatcgggatccggctcggccagaggaatgcaacttgattgagggagaggaccaggtagaggtgaacggtgctgtcttccctaaaccatttgtcgaaaagcccgtgtcggcagaggaccataatgtctacatttattatccatcctccgccggtggagggtcacaaaggcttttccggaagatcgggagccggagttcggtttattccccagagagttctgttcgcaagaccgggtcctatatttacgaggaatttatgcccactgatggaaccgatgtcaaggtgtatactgtggggcctgactatgcccatgctgaggccagaaagagtccagccctcgatggcaaggtcgaacgcgatagcgagggaaaagagatcagatacccagtgatgctaaccgctatggagaaactcgtggcgcgtaaggtttgtgtcgccttcaaacaaacggtgtgtggatttgacctcctgcgggctaacggacatagtttcgtctgcgacgtcaatggtttttcatttgtgaaaaactcaatgaagtactatgatgactgcgcaaaaatcctgggaaatacgataatgcgcgagttggcccctcaattccagattccatggagtattcccactgaggccgaagacatcccaatagtccctactaccagtggaacaatgatggagcttagatgcgtgatagcaattattcgtcatggagataggacccccaaacagaagatgaaaatggaggtgaaacaccctagattcttcgcactcttcgaaaaacacggcggatacaagaccggcaagcttaagctaaaacgcccagagcagctccaggaggtcctggatattactcggcttttgttggccgagctggagaaagaacccggaggagaaattgaagagaaaacaggaaaactggagcagttaaagagtgtgttggagatgtatggacacttttcaggaatcaaccgcaaggtccaactcacgtactatccccatggggtgaaggcctcgaacgagggccaggatcctcaacgggagaccctcgccccttccctgctgctggtcctgaaatggggcggagagttaacacccgctggtagggtacaagccgaggagctgggcagggcatttcggtgcatgtatcctggcggtcaaggcgactacgcaggctttcccggatgtgggctacttcgacttcattctacctttagacacgatttgaaaatttatgcaagcgacgaaggccgagtacagatgacggcagcagcatttgccaagggtctcctggcattagaaggcgaactgaccccaattctggtccagatggtcaagtcagccaacatgaacggccttttagattcagacggagatagcctgtcttcttgccagcatagggtgaaggctcggctacaccacatactgcaacaggatgccccattcggacccgaggattacgaccagcttgcccctactcgcagcacctccctcttaaactcgatgacaatcatccagaacccggttaaagtatgcgatcaggtcttcgcattgatagaaaatttaacacaccagattagggagaggatgcaagatcctcgatcagtggatctccaactgtaccactcagagacacttgaactcatgttgcaaaggtggagcaagctggagcgcgactttagacagaagtccggcaggtatgacatatctaagatccccgatatctatgactgcgtaaaatacgacgtgcagcataatgggtcgcttggcctccaaggaactgccgagttgttgagactgtctaaggctttggcagacgttgttataccccaggagtatggaatctctcgggaagaaaaattggaaatcgctgtcggcttttgtctcccgttgcttcgcaaaattcttttggacttacagaggacacacgaggacgaatcagtaaataaactccacccgctctacagtcgcggtgtcctgtcccccggacgccatgttaggacaaggttgtatttcacttctgaatcgcatgtacacagcctgctctccgtatttaggtatggcggtctgctcgacgagacgcaggatgcccagtggcagagagccctagactacttatccgccatatccgagctcaactacatgacacaaattgtgataatgctgtacgaagacaatacgcaggaccccctgtctgaggaacggtttcacgtagaactccatttttccccaggagttaagggtgtggaagaagagggatctgctccagcaggctgcggcttccgtcctgcatcttcagaaaatgaggaaatgaaaacgaaccagggaagtatggaaaatctttgccccggaaaggcttccgacgaacccgatcgtgcgcttcagacctcccctcagcccccagagggaccgggactccctaggcgttctcccttgatccggaataggaaagctggtagtatggaggtcctttctgagacgagctcctcccgtcccggagggtacaggctttttagttcatcgaggccacccaccgaaatgaagcagtcaggtcttggcagtcagtgcacggggttgttctccacgacagttttgggcggatcctcttccgcaccaaacctgcaagattacgcaaggagtcacgggaagaagttgccaccagcatcactcaagcaccgggatggttttgagggctgttccatggtacccacaatttaccctctggaaacgttacataatgctttatcccttcggcaggttagtgagtttctgagccgtgtctgccagcggcacaccgacgcgcaagcccaggcctcggcggcactgtttgatagcatgcactcctctcaggcctcggacaatcccttcagcccaccacgaacactgcattccccaccactccagcttcagcaaagatctgaaaagccaccgtggtactcctctggtcccagctcaacagtcagcagcgccggaccttcctcacccactacagtagatgggaacagtcagttcgggttctcagatcagccgtccctaaactcccacgtggccgaggaacatcagggattgggccttctgcaggagacccccggtagcggtgcccaggaactgtcaatagagggagaacaggagctgtttgagcctaaccagtctccccaggtgccccctatggaaacctcccagccatatgaagaagtgagccaaccttgccaggaggtgcccgacatctcccagccatgccaagatattagtgaagccttgagtcaaccttgccagaaggtcccagatatctctcagcagtgtcaggagaaccacgacaatgggaaccacacttgccaggaagttccccacatttctcagccatgtcagaaaagcagccagctgtgtcagaaagtgagtgaggaggtctgtcagctgtgcctcgaaaatagcgaggaagtgtcacagccctgtcaaggagtgagtgtagaggtcgggaagctcgtgcacaaattccacgtgggggttggcagtctagtacaggaaaccctggtggaagtgggatccccagccgaggagatccctgaggaggtaatccaaccatatcaggaattctcagtggaggttgggagattggcccaggagacgagtgcaatcaacctactgagtcaagggataccagagatcgataaaccttctcaggaattccctgaggagattgatctccaggcacaggaagtgcccgaggagattaattag

SEQ ID NO: 29245 - DNA, 528 bp, Artificial Sequence
  Description of Artificial Sequence: Synthetic coding sequence
atgattctgaatgtcctagagtacggaagtcagcaagtggcagacttgacgctgaatctggatgactacatagacgccgagcacttgggcgacttccatcggacctataaaaacagcgaagagctcaggtccaggatcgtctcagggattattacgcctattcacgaacagtgggaaaaagctaatgtgtcatccccccaccgagagtttccgccagccacggctcgggaagttgatcctctgcggataccccctcatcatccacacacaagtagacaaccaccctggtgcgatccactaggtcctttcgtggttggaggcgaggatctcgatccttttggacccagacgcggagggatgattgtcgatccactcagatccggctttcccagagcgctcattgacccatctagcgggttaccaaatcgactacctccaggggctgtgcctccaggagctaggttcgatccatttggcccaatcggcacatcaccgccaggtccccgacccgaccggagggggcagtag

SEQ ID NO: 29246 - DNA, 552 bp, Artificial Sequence
  Description of Artificial Sequence: Synthetic coding sequence
atggctggactcgaagtccttttcgcaagtgccgcacccgcaataacatgtcgccaagatgcactcgtttgcttcctacactgggaagttgttacgcacggctacttcggactgggcgttggcgaccagccaggccctaacgataagaagtcagagctgttaccagccggatggaataataataaggatttgtacgtcttgaggtacgagtataaggatggttccagaaaactgctggttaaggctataactgtagagagttctatgatcctcaatgtgctggagtatggatctcaacaggtggctgatctgacgctgaatttagatgattatatcgacgcggaacacctgggggattttcatcgcacatataaaaactctgaggagctgcgcagcagaattgtaagcgggataataacacctattcacgaacagtgggagaaggccaatgttagcagcccacatagggagtttccaccggctacggcccgtgaggtggatcctctccgcattcctcctcatcacccccacacctcccgccagcccccatag

SEQ ID NO: 29247 - DNA, 888 bp, Artificial Sequence
  Description of Artificial Sequence: Synthetic coding sequence
atgccggtgcacacgctctcacccggtgctccctctgccccagcactaccctgcagattaaggacccgggtcccgggttacttgcttcggggaccagccgatggcggtgcgagaaagcctagcgcagtagagcgtttggaggctgataaggcgaagtacgttaaaagtttacatgtggctaacacacggcaggagcccgtgcagccgcttcttagtaagcagccgttgttctccccggagacccggaggaccgtattgacacctagtcgccgagcgctccccggaccctgccgcagaccccagcttgacctggatatcctgtccagcctcatcgatctctgtgatagcccagtgtccccagccgaagcatcgagaaccccaggcagggccgagggcgctggcaggccgccaccagccaccccaccaagacctccacctagcacatctgctgtacgcagggtggatgttagaccccttcctgcgagccccgctaggccctgcccgtcaccaggcccagccgctgccagctcccctgccaggccccctggcctgcagcggtccaaatccgatctgtccgaacgattttcccgcgctgctgccgatctggagcggttttttaacttctgcggtctggacccagaggaagctagggggcttggagtagcccacctcgcgcgtgccagctcagatattgtgtctctggccggaccctccgcgggacccggaagctccgaaggtgggtgttccagacgatcgtccgtgaccgtggaagagcgcgctcgggagcgggtcccatacggcgtgagtgtggtagagagaaatgccagggtgataaaatggctgtacggactaagacaggctcgcgagtcgcctgctgccgagggctag

SEQ ID NO: 29248 - DNA, 888 bp, Artificial Sequence
  Description of Artificial Sequence: Synthetic coding sequence
atgcccgtgcacaccttgagcccaggtgctccatccgctcccgctcttccttgcaggctcaggaccagagtgccaggatatctgctaagagggcctgcggacggaggggcaagaaagccaagtgcggtggagagattagaggcagacaaagccaaatatgtaaagagtctacacgtggccaatacaaggcaggaacctgttcagcccttactgtctaaacagcccttattctctcccgagacacggagaacagtgctgacacccagcaggagagcactgccgggaccctgccgacgtccgcagcttgatttggacatcctcagttctcttatcgacctgtgtgactctcccgtctctccagcagaagccagcagaacgccaggcagagccgaaggcgctggtcggccaccacctgcaacgccccctcggccaccacccagtacatcggctgtgcggagggtcgatgtgaggcccctgccagcttcaccagcccgtccatgtccctcccctggccctgccgcagcttccagccccgcacggcctccagggcttcaacgatcaaaaagtgacctctcagagaggttttccagagcggctgccgacctcgaaaggtttttcaacttctgtggcctggatccagaagaggcacgcggactcggcgtagcacacctcgcgcgagcctcctcggacattgtgtctcttgcagggccatctgctggtccaggttccagcgagggtggatgtagtcggagaagctctgtaaccgtggaagaaagggccagagaacgggttccatatggagtgtcagtcgtggagcgtaacgcgcgtgtcattaagtggttgtatggactgcgacaggcaagggagtcccccgctgctgaggggtag

SEQ ID NO: 29249 - DNA, 414 bp, Artificial Sequence
  Description of Artificial Sequence: Synthetic coding sequence
atgggtctgcgcgctgggggtacactcggcagagccggagccggacgaggtgcacctgagggcccaggacctagcggaggtgctcagggtggcagcatccattcaggcagaatagcagcagtccataatgttccgctctcagtcttgattcggcctctaccgagtgtgctggacccggctaaagtgcagagtctggtggacacaattagagaagaccccgactctgtgccaccgattgacgtgctgtggatcaagggggcacagggaggagactatttctacagttttggagggtgccacagatacgcagcctaccagcagttacaaagagagaccatcccagccaagctggtgcagtctactctctctgacttgcgagtgtacctaggagcctctacccctgacctccagtag

SEQ ID NO: 29250 - DNA, 1731 bp, Artificial Sequence
  Description of Artificial Sequence: Synthetic coding sequence
atgaaatgccactatgaagcattaggggttcggagagatgctagtgaagaggagttgaaaaaagcctataggaaattggcgttaaagtggcaccccgacaagaatctggacaatgctgccgaagcagcagagcagtttaaattaatacaggctgcctacgacgtgttgagtgacccccaggagagagcttggtacgacaaccacagggaagctctgcttaagggtgggttcgacggcgaataccaggatgatagcctcgacctactgcggtactttacagtgacatgttactctggatatggagacgatgaaaagggattctatacagtgtacaggaatgtttttgaaatgatcgcaaaggaagagcttgagtccgtactggaggaagaagtagatgactttccaacattcggcgactctcagtccgattatgataccgtcgttcaccctttttacgcatactggcagtctttttgtacacaaaaaaactttgcgtggaaagaagaatacgacactagacaagccagcaacagatgggaaaagcgtgccatggagaaggaaaataaaaaaatccgcgacaaggcgcgaaaagagaagaacgagctagtgaggcagcttgtagcctttatccgcaagcgtgataaaagagttcaagctcacagaaaactcgtggaagaacagaatgcagaaaaagccagaaaggcagaggagatgagacggcaacaaaaattaaagcaggcgaagctcgtggagcagtaccgcgagcagtcttggatgacaatggctaacttggagaaggaattgcaggagatggaagcacgatatgagaaggagttcggtgatggatccgatgaaaacgaaatggaagagcatgagctcaaggatgaggaggatgggaaggacagtgacgaagccgaagacgccgaattatacgacgatctttactgcccggcatgcgacaagtctttcaaaactgagaaggctatgaagaatcacgagaaatcaaaaaagcacagagaaatggtggccctgctcaaacagcagttggaggaggaagaagagaactttagccgccctcaaatcgacgagaatccactggacgacaactccgaggaggagatggaagatgctccaaaacagaagctgtcgaagaagcaaaagaagaagaaacagaaaccagcacaggacgtgcccggaaaagattcatatttgcctgcagcccacttccagatggcatggggcaaaaaatgcgtgttgggggaacgtagagacggtgaaagcgagcacaagtgcgctaagatgctactagaaaataggcagaactatgacgataattttaacgtgaacggtcctggggaaggcgtgaaggtggacccagaggacaccaatctaaaccaggacagcgccaaggaattggaagacagtccccaggaaaacgtctctgtcactgaaatcattaaaccatgtgacgatccaaaatccgaagcgaagtccgtgccaaaaccaaaagggaaaaagactaaggacatgaagaaaccggtccgggtgccagctgagccccaaaccatgagcgtcctaatctcttgcacgacgtgtcatagtgaatttccttcccgtaataagctgttcgaccatctgaaggctacaggccacgctagagctccaagtagcagctccctgaactcagcaacatcgagccaaagtaaaaaggagaaaaggaagaaccgatag

SEQ ID NO: 29251 - DNA, 798 bp, Artificial Sequence
  Description of Artificial Sequence: Synthetic coding sequence
atgctcgctctgaccgtgttggagacatgcgtgaagaattgcggacataggttccatgtactcgtggcctctcaagacttcgtagaatcagtgcttgtgaggactattctccctaagaataaccccccaaccatagtgcatgacaaagtcttgaacctgatacagagctgggctgatgcattccgcagttccccagacctcaccggcgtggtgaccatctacgaggatttgaggagaaagggcctggagttccctatgacggatttagatatgctgtctcctattcatacccctcagcggactgtgttcaactcagaaacacaaagtgggcaggattcagtggggactgattcaagtcagcaggaagactcaggtcagcatgccgcaccgctgccagcccctccaattttgtccggcgatacccccattgcccctaccccagagcagatcggaaagttaagaagtgaacttgagatggttagtggaaacgtgagagtgatgtcggagatgctcacggagcttgttccaacccaagctgagcctgcagacttggagcttctgcaagaactcaatcggacctgccgggctatgcagcagagggtgctggagctgatacctcagatagcgaacgagcagcttactgaggagcttttgatcgtcaacgataatctgaataatgtattcctccgccatgagcgcgacagaggactgacagttctgccgcgacttgtgtccaatagttggccccaggcggtactacccccttggccccctaaagccctggtcctccaggcctag

SEQ ID NO: 29252 - DNA, 6272 bp, Artificial Sequence
  Description of Artificial Sequence: Synthetic coding sequence
atggatgaagtagagcaggatcagcatgaagcacgcttgaaagaattgttcgatagcttcgatacaacagggacagggagtctcggtcaggaggagttgaccgacctgtgccatatgctatccctggaggaagtggctcctgtactgcagcagaccttactgcaggacaatcttcttgggagagttcattttgatcagttcaaagaagcactgattttaattctgtccaggactttgtctaacgaggaacactttcaggaacctgactgcagtttagaggcgcagcctaagtacgtgcgtggtggcaagagatatggacgacggagcttgcctgaatttcaggaatccgtggaggaattccccgaggtaacagtgatagagccgcttgacgaagaggctaggccaagccatatacccgcaggcgactgttctgagcattggaagacccagcgtagcgaagagtacgaagccgaagggcaattacgtttttggaatcccgatgacctcaatgcttcacagtcaggcagtagcccacctcaagactggatcgaggagaagctacaggaggtgtgtgaagacctaggtattactagggacggccacctgaatagaaaaaagttggtgtctatctgtgaacagtatgggttgcagaatgttgatggcgagatgctagaagaagtgttccacaatctggatccggatggcacaatgtctgtggaagactttttctatggactcttcaaaaatggaaagagcttaactcctagcgccagcacgccctatcggcagctgaagagacacctctccatgcagagctttgatgagagtggaaggagaactacgacatcaagcgccatgaccagtacgataggcttccgcgttttctcgtgccttgatgacggaatgggccatgctagcgtcgagagaatcctggacacttggcaggaagaaggtattgagaactcccaggagattctaaaggctctagactttagtctcgatgggaatattaatcttacagaactgacactggccctcgagaatgaactgctcgtgacaaaaaattctatccatcaagccgcactggctagcttcaaagctgagatccgacacctcctggagagagtggatcaggtggtgcgagagaaggaaaaacttcgttctgacttggataaagctgaaaaattgaaatcgctgatggcctcagaggtcgacgaccaccacgccgcaatagagcgtcgcaacgaatacaacttgcgcaaactggacgaagagtataaggaaagaatcgcagcactgaaaaatgaattgaggaaggaacgggaacagatcctgcagcaagcaggcaaacagcggctggaactggagcaggagatcgaaaaggccaaaacagaggaaaattatattagggaccggctggctttgtcattgaaagaaaattccagacttgaaaacgaacttttggagaacgccgagaaactcgccgagtatgagaatcttacaaataaattgcaacgaaacctcgaaaacgttttggcagagaaatttggcgaccttgacccctcatccgcagaatttttcttgcaggaggagcggttgacccagatgcgtaacgaatacgaaaggcagtgcagagtcctgcaggatcaagttgatgagttgcagtcggagctcgaggagtaccgagcccagggccgagtgcttcgcctcccattgaaaaacagcccttcggaagaagttgaagcaaattcaggagggatcgaacctgaacatggactcggcagcgaagaatgcaatccattaaatatgagcattgaggcagaacttgtaatcgagcagatgaaagagcagcaccatcgcgacatttgctgtctccggctggagctggaagacaaggttcgtcactacgagaagcagctcgacgaaactgtggtcagctgcaaaaaggcacaggagaatatgaagcaaaggcacgaaaacgagacacacactctggagaaacagatctctgacctaaaaaacgaaattgccgagctgcaaggccaggctgctgtgttgaaggaggcacaccatgaggcaacttgtcgacatgaagaggaaaaaaagcaactccaggttaaactcgaagaggagaagacacaccttcaggaaaaactgaggctccagcatgagatggagctaaaagccaggctgacacaggcgcaagcttcgtttgagcgggagcgagagggtctccagagttcagcgtggacagaggaaaaagtccgaggactgacacaggaactggaacagtttcatcaggagcagctcacatctttggtagaaaaacacaccctggagaaggaggagttacgcaaggaacttctggaaaaacaccaacgagagttacaggaaggacgcgagaaaatggagacagagtgcaataggcgcacgtcccagatcgaggcccaattccagagtgactgtcagaaagttacagagaggtgtgagagtgcgctgcagagcttagaaggccgttaccggcaggagttgaaggatctgcaagaacagcagagagaggaaaagagtcaatgggagttcgagaaagatgaactgactcaggagtgtgccgaggcacaggagctcctgaaggaaactctgaagcgggagaagacaacctcgctcgtgctcacgcaagaacgcgagatgcttgagaaaacctacaaagagcatctgaattccatggtggtcgagcgacaacaacttctgcaagatctggaggaccttcgcaacgtgagcgagacccaacaaagcctgctgagtgatcaaatcctggagctgaagtcctctcacaagcgcgagcttagggagcgggaggaagtcctctgccaggccggagcctcagaacaactggcctcccaaagattggagcgcctggagatggagcacgatcaggaacggcaagaaatgatgagcaagttactcgcaatggaaaatatacacaaggctacttgcgagacagccgatcgagaaagagccgagatgtctacagagatctcacgccttcagagcaaaattaaggaaatgcagcaggcgactagcccattgtccatgctgcagagcggctgtcaggttattggggaagaagaggtcgagggtgatggcgcactatcattgctgcagcagggagagcagcttctggaggaaaatggcgacgtcctgttgtccctgcagcgtgcccacgagcaggcagtaaaggagaatgtcaaaatggctactgagatcagcaggctgcaacaacggctccagaaactcgaacccggattggtgatgagcagctgtttggatgagcccgcaactgaattctttgggaacacggcagaacagaccgaacagtttctccagcaaaatcgcaccaagcaggtggaaggggttactcgcagacacgttctgtctgacctcgaggacgacgaggtcagagaccttggctcaaccggcacatcctctgtgcaacggcaggaagtgaagatagaagaaagcgaggcctcagtcgaaggcttcagcgaacttgaaaacagtgaagagactagaactgagtcctgggagcttaaaaatcagatctcacagttgcaggaacaacttatgatgctgtgcgctgactgcgaccgcgcatcagaaaaaaaacaggacctgttgttcgatgtgtcagtgttgaagaagaaacttaagatgctcgagcgtatccccgaagcatcaccgaaatacaaattgctatacgaggatgtgtccagggagaacgattgtctgcaggaagaactgcggatgatggaaacgagatatgatgaagccttagagaacaacaaggaactcactgcagaggttttcagactgcaggacgagcttaaaaaaatggaagaagtgacagaaaccttcctaagtctcgagaagagctacgatgaggtcaaaatcgaaaatgagggcctgaatgtcctggtacttcgtctgcaaggaaagatcgaaaagctacaggagagtgtcgtgcaaaggtgcgactgctgtctgtgggaggcttctctcgagaatctcgaaatagaaccggatggtaatatcttacagctcaatcagacattggaggaatgcgtgccgagagtgcgctccgtgcaccacgtcatcgaagagtgtaaacaggagaaccagtatttagaagggaatactcagctattggaaaaagttaaggctcatgaaatagcttggcttcacggcaccattcaaactcaccaggaaagaccgagggtccagaatcaagtcatattagaagagaacaccactttgctgggtttccaagacaagcactttcagcaccaggctaccattgcggagctggagctggaaaagactaagctccaggagcttactaggaaactgaaggagagagtcaccattttagtcaaacagaaagatgtgctgagccatggcgaaaaagaggaagaattaaaggccatgatgcatgatctgcagataacatgctcagagatgcaacagaaggtagagttgctccgttacgagagtgaaaagctccagcaggagaattccatactgcgaaatgagattactactctcaacgaggaagattcaatcagtaatctgaaactggggactctgaatggaagccaggaggagatgtggcaaaaaaccgaaactgtgaagcaggaaaatgccgctgtgcagaaaatggtcgaaaatttgaaaaagcaaatcagcgagctgaaaatcaaaaatcagcagctcgacctagagaataccgaacttagccaaaaaaattcccagaaccaggagaagctccaagaattgaaccagaggttgacagagatgctctgtcaaaaggagaaggagcccggaaactccgctttggaagagcgagagcaagaaaaatttaaccttaaggaggagctggagcgttgcaaagtacagtcaagtacgttggtttcatctctcgaagctgaactgagtgaggtgaagattcaaactcacatcgtgcagcaagagaaccacttgttgaaggatgaactggaaaaaatgaagcagctgcatcgctgcccagaccttagtgactttcagcagaaaatctcctcggtcctgagctataatgaaaaactcctgaaagagaaagaggcactcagcgaggagcttaacagctgcgtcgacaagctggcaaaatcttcgttactggagcatcgcatcgccacaatgaaacaggagcagaagtcatgggagcatcagtcagcttccctaaaatcccagctggtcgctagccaagagaaggtccaaaatctcgaggacactgttcagaacgtgaacttgcagatgagccggatgaaaagcgacctgagagtgacacagcaggaaaaggaagctctgaagcaagaggtgatgtctctgcataagcagctccagaatgccggtggaaaaagctgggcacctgaaattgcaactcatccctcagggctccacaaccagcaaaagcgcctctcctgggacaaacttgaccaccttatgaacgaggaacagcaacttctgtggcaagaaaatgagagactccaaacaatggtgcaaaacaccaaagcagagctgacacatagtcgggaaaaggttcgccagctggaatctaacctgctcccgaagcaccaaaaacatctaaacccctccggtaccatgaatcctaccgaacaggaaaaactgagcctgaaacgcgagtgtgaccagttccagaaggagcaatctccggctaatagaaaggtgtcccagatgaattccctggaacaggaattggagacaatccatctcgagaacgaggggctaaagaaaaagcaggtgaagctcgacgagcagctgatggagatgcagcacctgaggtccaccgccacgcccagtccgtcaccacatgcttgggacctacaattactgcagcagcaggcgtgccctatggtacctcgggaacagtttttgcagcttcagcggcagcttcttcaggctgagcggatcaaccagcacctccaagaggaactggagaacaggacctcagagacaaatacccctcagggaaatcaagagcagctggtcacggttatggaagagcgtatgattgaagttgaacagaagctcaaactggtcaaacgactgcttcaagagaaggtcaatcaattaaaggagcaggtttctctcccgggtcacctttgttctcccacttctcacagctccttcaactctagtttcaccagcttgtattgccacta

SEQ ID NO: 29253 - DNA, 4134 bp, Artificial Sequence
  Description of Artificial Sequence: Synthetic coding sequence
atggatgaggtggagcaagaccagcacgaagccaggctgaaagagctgttcgactcatttgatacaacaggcaccgggagcctcggccaggaagagttaacagatctgtgtcatatgttatctcttgaggaggtggccccagtgctacaacagaccctcctccaggacaatctgctggggagggtgcacttcgaccagttcaaggaggctttgatcctcattcttagccgtacactttccaacgaggaacatttccaggagccagattgttctctagaagcccagcccaagtacgtgagaggcggaaagaggtatggacgtcgcagcctgccggagttccaggagtcagtggaagagttcccagaagtgaccgtcatagagccacttgacgaggaagctaggccatcccacattcccgctggagattgctctgaacattggaaaacacagaggtctgaggagtatgaagctgagggacagttgcgtttctggaacccagacgacctgaacgcctcacagtctgggagctcaccacctcaggactggatagaggaaaaactccaagaagtctgtgaagaccttggaataactcgagatggccaccttaaccggaagaaactggtgtccatatgcgaacagtacggacttcagaatgtcgacggtgagatgttggaggaagttttccacaacctggatccagacggtaccatgtcagtcgaagactttttctacgggctcttcaaaaacgggaaatccctgaccccaagtgcgagcaccccctaccggcaacttaaacggcatctgagcatgcagagctttgatgaatccggccgaagaactactactagttcagcaatgacctcgacaattggtttcagagtgttttcatgcctcgacgacggtatgggccatgcttcggttgagcggatccttgacacatggcaggaagagggaattgagaatagccaggagatactgaaagctctggacttttccttggatggcaatattaatctgacagagctcactctcgctctggagaatgagctgctggtgacaaagaattccattcaccaggccgcacttgcaagttttaaagctgagataagacatctcctggagagagtggatcaagtggtgcgcgagaaggaaaagctcagaagcgatttggataaggcggaaaagcttaagtcactgatggcatccgaagttgacgatcaccacgcggctattgagcgcagaaacgaatacaatctaaggaaactggatgaggagtataaagaacgaatagcagcattgaaaaacgaactgcgaaaggaacgagagcaaattctgcagcaggctggcaagcagcgcttggaactcgaacaggagatcgagaaagccaaaactgaggagaattatatccgggaccgcctagcgctttctctcaaggaaaacagccgcctggaaaacgaattactggaaaatgctgaaaagcttgccgagtacgagaatttgacaaataaactccagcgtaatctggaaaatgtcctggctgaaaagtttggggacctggacccgtcttccgctgaatttttcctgcaggaggaacggttaacccagatgagaaatgagtatgagaggcagtgccgggttttgcaggatcaggtggatgagcttcagtccgagctcgaggaatatagagctcaggggcgagtgttaaggctcccgctgaaaaactctccaagtgaagaggttgaagcgaatagcggcggaatcgaaccagaacacggtcttggctctgaggaatgtaatcccctgaacatgagtatcgaagctgaattagtcatagagcaaatgaaggaacagcatcacagagacatctgttgtcttcgactcgagcttgaagacaaagtcagacactacgagaagcagcttgacgagacggtcgtgagctgtaagaaagctcaggaaaatatgaagcaacgccatgaaaacgagacacataccctcgagaagcagatctctgatctcaagaatgagatcgccgagctgcagggccaggctgctgtcctgaaagaagcccatcatgaggcgacatgtaggcatgaggaggaaaaaaaacaactgcaggtcaagctagaagaggaaaagacccacctacaagaaaagctgcgccttcaacatgagatggaactaaaagcacgcctcactcaggcccaggcaagctttgaacgggaacgcgagggcctccagagcagtgcctggacagaggagaaggtacgcggactgacccaagagctggaacagtttcaccaggagcaattgacgtccctggttgagaagcacacgttggagaaagaggagttgcgcaaagagctcctggagaaacaccagcgcgagctgcaggaaggcagatatgaaagcgagaagcttcagcaggagaacagtatcttgcggaacgagatcacgacccttaacgaggaggactctattagcaacctgaagttgggcaccctcaacggaagccaggaagaaatgtggcagaaaactgaaacagttaagcaggaaaacgccgctgtgcagaagatggtcgagaacctcaaaaagcaaatctcggaattaaaaatcaagaatcagcaactcgacctcgaaaatacagagctgagtcagaagaacagtcaaaaccaggaaaagttgcaagagctgaatcaacgactcactgagatgctgtgccaaaaagagaaagagcctggcaatagtgccctcgaggagagagaacaagaaaagtttaacctaaaggaagaactggagcgctgcaaggtccagtccagcacattggtgagctccctagaggcggaactcagcgaggtcaagattcagactcacattgtccagcaggaaaatcatctgttgaaggacgagctggaaaaaatgaaacaactccaccgatgtcctgatctctcagatttccagcagaaaatcagctctgtgctgtcatacaacgagaagctgctcaaagagaaggaggcattgagtgaagaactgaactcatgcgttgacaaattggccaaaagctctctgctcgaacaccggatcgccacaatgaagcaagaacagaagtcttgggaacatcagtcagcttcgttgaagtctcagctggtggccagtcaagagaaagtgcagaaccttgaggacactgtgcaaaatgtgaatctacagatgtctaggatgaaatctgatctaagagtgacccaacaggaaaaggaggcacttaaacaggaagtgatgagtctgcacaaacagctgcagaacgccggtggtaaaagctgggctcccgagattgcgacacatcctagcggacttcataatcagcagaagagactgagctgggacaaactcgaccatctaatgaacgaggagcagcaactcctgtggcaggaaaatgagagactccaaacaatggtgcagaacaccaaagcagaactcacccattcccgggagaaagttcgccagctggaaagcaacttactgcctaaacatcagaaacacctcaacccttctggtacaatgaacccgaccgaacaagagaagttgagcctcaaaagggaatgtgaccagttccagaaagagcagagccctgcaaaccggaaagtatcccagatgaattctctagaacaggaattagaaactattcatctggagaacgagggcctgaaaaagaaacaggtgaagctggacgaacaactgatggagatgcaacacctgagatctaccgccaccccatcaccatctcctcacgcgtgggacctccaactgcttcagcagcaggcttgtcccatggtccctagggaacagttcctgcagctgcaaaggcagctcctgcaggccgagcggatcaatcaacatcttcaagaagagcttgagaacaggacctcagaaaccaacacccctcagggcaatcaggaacaactcgtgacggttatggaggagaggatgatagaggtggaacaaaaacttaaactcgtcaaaagactgttgcaggagaaagtgaatcaactgaaggaacaggtttctctgcccggacacctgtgttcaccgacaagccactcctcgttcaattcctcttttacaagtttatattgtcattag

SEQ ID NO: 29254 - DNA, 3171 bp, Artificial Sequence
  Description of Artificial Sequence: Synthetic coding sequence
atggcaactgggaactacttcggcttcactcattcaggagctgcggcagccgctgccgctgctcaatattctcagcagccagcttccggggtggcctattcccacccaactaccgtggccagctacacagtgcatcaggccccagtggccgctcatacagtcaccgcagcctatgcacctgcagccgcaacagtcgcagtggctcgccctgcccctgtcgcggttgccgcagcagccactgccgcagcctacggcggataccctactgctcacacagccacagactacgggtacacgcaacgacaacaagaggcaccacccccacctccacctgccactacccaaaattatcaagacagctattcttatgtccgaagcacagcaccggctgtggcctatgacagcaagcagtactatcagcaaccgacagcaaccgccgctgccgtcgcagcggctgcccagccccagcctagcgtggcagagacctactatcagacagctcctaaagcgggatactcccagggcgctacacaatacactcaggcccagcagaccagacaggtcaccgctatcaagcccgctaccccaagcccagccacaacgacatttagtatttatcccgtaagctctactgtccagccagtggccgctgcagccacagtagtgccatcatacacccagtcagccacctattccactacggcagtgacttatagtgggacgtcctattcaggctacgaggcagccgtatactctgctgcttcctcatactatcaacagcagcaacagcaacagaaacaggctgcggctgccgctgccgctgccgctgccacagccgcttggactggaaccacctttaccaaaaaagctccatttcagaacaaacagctaaagcccaagcagcccccaaagcccccacagatccattattgcgacgtgtgtaagatttcatgcgcagggccacagacctacaaagagcacctcgaaggccagaagcataaaaaaaaggaggccgctctaaaagcctcccagaatactagttcttcaaattcaagcacacgaggaactcaaaatcagttacgatgcgagttatgcgacgtttcctgcacaggtgccgatgcgtatgctgcacacattcggggagcaaagcaccagaaggtggtgaagctgcacaccaaacttgggaaaccaattccaagtacagagcctaatgtcgtgagccaagccacctcttcaacagctgtgagtgcgtccaagcctactgcgagtccatcatctatcgctgccaacaattgtaccgtgaatacttcttccgtggctactagcagcatgaaaggtctgaccactacaggtaatagtagtctgaactctacatccaataccaaggtttcggccgtgcccactaatatggctgcaaagaaaacaagcacaccaaagatcaacttcgtgggcggaaacaagcttcagtccacagggaataaggccgaagatattaaagggactgagtgcgtgaagtccactcccgtgacatctgccgtgcagatccctgaagtcaagcaagacaccgtctcagaacccgtgactcctgcttccttggcagctctgcagagcgatgttcagccagtcgggcatgattacgtggaagaggttagaaatgatgaggggaaggttatacgatttcattgcaagttgtgcgagtgctccttcaacgatccgaatgctaaggagatgcacctcaagggccgtagacatcggctacagtataagaagaaggtgaaccccgatctccaggtggaagtgaagccctctatcagggcccgaaaaattcaggaagaaaaaatgagaaaacaaatgcagaaggaagaatattggagaagacgggaggaggaagagcgctggcgtatggagatgaggagatacgaggaggacatgtactggaggagaatggaggaggagcagcatcactgggacgatagaaggcgcatgcctgacggaggatacccccacggcccacctggacctcttggactcctaggagtgaggcccggaatgccaccccagccacaaggccctgcaccactacggcgtcctgactctagcgatgacagatacgtaatgactaagcacgctacgatttaccctacagaggaagagctgcaggcggtccagaaaatcgtctcaattacggaacgggctctcaagcttgtctcagacagcctctccgagcacgaaaagaacaaaaataaagagggggacgataagaaggagggagggaaggatcgcgcactcaagggtgttctccgcgtgggcgtgttggcaaagggcttgctgttgcggggagacaggaatgtgaacctcgtgctgctctgttccgagaaaccctctaaaaccctgctgtcaagaatcgctgagaatctgcctaaacagttagctgttatctcccccgagaagtatgatatcaaatgcgccgtgtccgaggcggctattatcctgaacagctgcgtggagccaaagatgcaggtcaccataacgctgaccagccccataatcagggaggaaaatatgagagagggggacgtcaccagcggcatggtaaaggacccccctgacgtacttgaccggcagaagtgcctggacgccctggccgctctgcgccatgccaagtggtttcagcaggcccgagctaacggactccaatcatgtgtgataatcattagaatcctgcgggatctttgccagagagtgccgacctggagtgacttcccgtcgtgggcaatggagctcctggtggagaaggcgatttcttcggccagctccccacagagccctggggacgccctgaggagagtttttgagtgtatctcttctggaattatactcaaggggtcccctggcctgcttgatccatgcgaaaaagatccattcgatacgctggcgactatgactgaccagcagagggaggacatcactagctccgcacaatttgcactcaggcttttagctttccggcagatacacaaggtcctgggcatggatccactgccgcagatgtcccagcgcttcaacattcacaataataggaaaaggagacgcgactccgatgggatggacttaaaactgagaggcaagaagaccaagaagattatgatcacgttcaaaaagtgtctctag

SEQ ID NO: 29255 - DNA, 390 bp, Artificial Sequence
  Description of Artificial Sequence: Synthetic coding sequence
atggggtgttgtggctgcagcggtggctgtggctccggctgtgggggttgcggcagcggatgtgggggttgcggctccagctgctgcgtgcccatttgctgctgcaagcccgtatgctgctgcgtgccagcctgtagctgcacatcatgtgggtcttgtggaggctccaaaggatgttgtgggagctgcggaggaagcaagggcggttgtggctcatgcggtggctcgaaaggagggtgtggctcttgtggttgcagccaatgctcatgttgcaagccatgttactgctcaagcggctgcggcagctcttgttgtcagtcttcttgttgtaagccttgctgttctcaggccagctgctgcgtgccaatttgctgtcaatgcaaaatatag

SEQ ID NO: 29256 - DNA, 1344 bp, Artificial Sequence
  Description of Artificial Sequence: Synthetic coding sequence
atgcccatgcctaccgaaggaaccccaccacctttatctgggactcctatccccgtgccggcatattttagacacgcagagcccggtttctctctaaaacgacctcgcggtttgtctaggtcactccctcctccaccacctgccaagggctctatcccaattagcaggctgttccctcccaggacaccagggtggcaccaactgcagccccgtagagttagtttccgtggtgaggccagtgaaacgcttcagtcacctggttatgacccgagccggccagagagcttttttcagcagtcatttcaaaggctcagtcgcctgggccacggtagctacggagaggttttcaaagtccggagtaaagaggacggcaggctgtatgctgtgaaaagatccatgagtcctttccgcggtcctaaagatagggcccgtaagctggctgaggtcggtagtcatgaaaaagtcggccaacatccttgctgtgtgcgcctggagcaggcctgggaagagggaggaatcctgtatctgcagacggaactgtgtggcccaagcctgcagcagcactgtgaagcttggggagccagcctccccgaggctcaggtatggggatatctgcgggatacgctcctcgccctggcccaccttcactcacagggcctcgtgcacctcgatgtgaagccagccaatatctttcttggaccacgcggacggtgcaagttaggggacttcggtctcctcgtggagctcggaacggctggcgctggggaggttcaagagggggatcccagatatatggcgcctgagctgctccaggggtcgtatggcactgccgctgatgtcttctcacttggccttacaatcctggaggtggcctgtaatatggagctccctcatggaggcgaggggtggcagcagttacggcagggctacctgccacccgagtttacggcgggattgtcgagcgaactgaggagcgtgctggtgatgatgctggagcctgatcctaaactgcgggctacagccgaagcactgctagcgttacccgtgctgcgccagcccagagcttggggggtcttatggtgtatggcagccgaggccctctcacgcggttgggccctgtggcaagccctcctggccttgctgtgttggttatggcatgggctggcgcaccctgcaagctggctgcagcctctggggccacctgctactccacctggaagcccgccttgttcgctgctgttggatagttctctgagttccaattgggatgatgattcactcggtccttgtgtattaaagcgtacagagggggctcttgaatgctcccagatggaaggcttgtag

SEQ ID NO: 29257 - DNA, 1005 bp, Artificial Sequence
  Description of Artificial Sequence: Synthetic coding sequence
atgagcgcagcgaatccagagacaccaaacagcacaatctccagggaagcttccacacagagctcatccgccgctgcttcacaaggctgggtgctgcctgaaggtaaaatcgtgcccaacacggtttttgtgggcggaatcgatgccagaatggacgagacagaaatcggttcctgtttcgggcgatacggatctgttaaagaagttaagatcatcacgaatcggacaggggtaagcaagggctatggctttgtctcctttgtgaacgacgtggacgtccagaagattgttggcagccagattcactttcacgggaaaaagttaaaattgggacctgccatccgcaagcagaagttgtgtgctaggcatgtgcagcccagacctctggttgtcaacccaccccctccaccccagttccagaacgtttggcgcaatcccaacacagaaacctacctgcagccccagataacccccaacccagttacccaacacgtacaggcctattcggcctatccacattctcccggacaggtgattacagggtgccagctgctggtgtataattaccaggagtacccaacataccccgattcagctttccaagtcaccacgggctaccagctacctgtgtacaactaccaacccttcccagcttatccgcgaagcccatttcaggtgacagcaggttaccagttgccagtttataactatcaagcattccccgcttatcccaactcgccctttcaggtggcgactggctatcagttccctgtgtataactatcagcctttccctgcatacccgtctagcccttttcaggtgaccgctgggtatcaacttcccgtatacaattatcaagcattccccgcataccctaattccccattccaggtcgcaacgggctaccagttccccgtctataactaccaggcattcccggcttatcctaactccccagtgcaggtcacaaccgggtaccagctgccagtgtacaattaccaatag

SEQ ID NO: 29258 - DNA, 1173 bp, Artificial Sequence
  Description of Artificial Sequence: Synthetic coding sequence
atgagcgccgcaaaccccgagaccccaaactccaccatatcgagagaggcaagcacacagtcttccagcgccgctgcatcacagggctgggttctgcccgagggcaagatcgttcccaatactgtgtttgtcgggggtatagacgcacgaatggacgaaacagaaatagggagctgcttcgggaggtatggtagtgttaaggaagtcaagatcataacaaataggaccggtgtgtccaaagggtatggcttcgtgtcttttgtaaacgacgtcgacgtgcagaagatcgtaggttcccaaattcacttccatggcaagaaattgaaactgggccctgctattcgcaagcagaaactctgtgcgagacacgtccaaccaaggcccttggtggtgaaccctccacctccccctcagttccaaaatgtgtggaggaatcctaatactgaaacatacctgcagccccagatcacccccaacccagtcacacagcacgttcaggcctacagcgcctacccccatagcccaggccaagtgattaccggttgccagttattagtatacaattaccaggagtacccaacctacccggattctgccttccaggttactacgggataccagttgcctgtctacaactaccagcctttccctgcctatcccaggtccccatttcaggtgacagccggataccagttaccagtctacaactaccaggccttcccggcatatcccaattcaccattccaggtagcaacggggtatcagttccctgtctacaactaccagcccttcccagcctatccaagttcaccatttcaggtcactgctgggtaccaactgcccgtatataactatcaggcatttcctgcctatccaaactcgccagtacaggttactacaggctatcagttgcccgtatacaattaccaggctttccccgcatacccaagctcacccttccaggtgacaaccgggtaccagctcccagtgtacaactaccaggctttcccagcctaccccaactccgctgtgcaggttaccactgggtaccagtttcatgtgtacaattatcagatgccgccacagtgccccgtgggagagcagcgcagaaatctctggaccgaagcctataagtggtggtacttggtttgtctaatccagaggcgtgactag

SEQ ID NO: 29259 - DNA, 1173 bp, Artificial Sequence
  Description of Artificial Sequence: Synthetic coding sequence
atgtcagcagctaatcccgagacacctaacagcaccatctccagagaagcttccacacaaagctccagcgctgcagcctctcaggggtgggtgctccccgaaggcaaaattgtcccaaatacagtctttgtcggtggaattgacgcaaggatggacgagacggagattggctcatgtttcggcagatatggatctgtaaaggaagtcaagatcattactaataggaccggagtatctaaaggatatggattcgttagcttcgtcaacgacgtggatgtgcagaaaattgtgggcagtcagattcatttccacggcaagaagctcaaattgggcccagccattcgaaagcagaaactgtgcgctagacatgtgcagccgagacctcttgtggtcaatccccctcccccaccgcagttccagaacgtgtggcgaaatccgaacaccgagacttacctacagcctcagataacccctaaccctgtgacccagcatgtacaagcctacagtgcctatcctcacagccccggacaggtgataacaggatgccagcttcttgtgtataactatcaggaatatccgacctatcccgactccgcttttcaggtgacgaccggctaccaattgcccgtgtataattaccagccctttcctgcctatccacggagcccgttccaagttacggccggttatcagctccctgtttataattaccaggccttcccagcctatccgaatagcccctttcaggtggctacaggctaccagtttcccgtttataactaccagccttttccagcctatccttcatctcccttccaggtgaccgctgggtaccaactgcctgtgtacaactaccaagcttttccagcttacccaaactccccggtccaggtcacaaccggttaccagttgcctgtgtataactaccaggcttttccggcttacccttcatccccatttcaggttacaacgggctatcagcttcccgtgtataattatcaggcatttcctgcgtacccgaattccgccgtccaagtgacaacgggctatcagttccacgtttacaattatcagatgccccctcagtgccccgtaggggaacagcgacggaacctttggacagaggcctataagtggtggtatctggtgtgtctgatccagcgcagggactag

SEQ ID NO: 29260 - DNA, 1101 bp, Artificial Sequence
  Description of Artificial Sequence: Synthetic coding sequence
atgtctgcagctaatcctgagacaccaaatagcactatcagtagggaggcctccactcagtcctcctctgccgctgcaagtcagggttgggtgctgcctgagggaaagatagtccctaatactgtgtttgtgggtgggatcgatgcaagaatggacgaaaccgaaattgggagttgcttcggacgctacggatccgtaaaggaagttaaaatcattaccaaccgcaccggtgtgtctaagggatacgggtttgtttcgtttgtgaatgacgtggatgttcagaagatcgtaggcagccagattcactttcacgggaagaagctcaaactgggccctgcaattcgcaagcaaaaactttgcgctcggcacgtccagcccaggccactcgtcgtcaatcctcctccgcctcctcagttccaaaatgtctggcggaacccgaacactgagacgtatcttcagccacagataactcccaatccagttacacaacatgtccaagcgtactcagcataccctcacagtcccggacaggtcatcactggatgccagctgctggtgtataattaccaggagtaccccacttatcccgactcagcattccaggtgacaacaggttatcagctacccgtctacaattatcagccgttcccggcttaccccagatcgccattccaggtcaccgctgggtaccagctccctgtgtataactatcaggcattcccggcatatcccaatagccctttccaggttgccaccgggtaccaatttcctgtgtataattatcagcccttcccagcctatcccagcagtccattccaggtcactgccggataccagctgccagtgtacaactaccaggcgttcccagcatatcccaatagccccgtccaggtgactactgggtatcagctgccggtctataattaccaagcattccccgcataccctaactcagccgtgcaggtcaccaccggatatcagtttcacgtgtataattatcagatgccccctcagtgccctgttggagagcagcggaggaatctgtggaccgaagcctataaatggtggtaccttgtgtgcctgatacagagacgcgattag

SEQ ID NO: 29261 - DNA, 1149 bp, Artificial Sequence
  Description of Artificial Sequence: Synthetic coding sequence
atgagcgcggctaaccccgagacccctaactctaccatatctcgagaggctagcacccaaagctcatcagccgctgcctcccagggttgggtcttgcccgagggtaagatagtgcccaacaccgtgttcgttggtgggattgatgcgagaatggacgagaccgagatcggcagctgttttgggagatatgggtctgtgaaagaggtcaagatcatcacaaatcgcaccggcgtctcaaagggctatgggtttgtgtcctttgttaatgatgtggacgttcaaaaaatcgtcgggtcacagatacacttccacggcaagaaattaaagcttggacctgctattcggaagcaaaagctctgtgccagacatgtgcagccccgacccctcgtggtgaacccaccgccacctcctcagttccagaatgtgtggcggaatcctaacaccgaaacgtaccttcagcctcaaatcactcccaaccccgtaacacagcatgtgcaggcctactcagcctacccccactcaccagggcaagttattacaggctgccagttgctggtgtacaattaccaggaatatccaacctaccctgactcggcattccaagttactacagggtaccagctgccagtgtacaactaccagccattccccgcttaccccagatccccattccaggtcactgcagggtatcagctcccagtctacaattaccaagcctttccagcttaccctaattccccctttcaggtggctactgggtaccagtttcctgtctataactaccagcccttcccggcatatccttcttcgccttttcaggtcacagccggatatcaactgcccgtgtacaattatcaggccttccccgcttatcctaacagtccattccaggtggccaccggctatcagttcccggtctacaattaccaagcctttcccgcatacccgaacagtcctgtgcaggtcacaactggctaccagctgcccgtctacaactaccaggctttcccggcttatcctaatagcccattccaggtggccaccggctatcagttcccagtgtacaactatcaggcatttcctgcgtacccgaactcccctgtgcaggtaaccacaggatatcagttgcccgtctataactaccagtag

SEQ ID NO: 29262 - DNA, 1842 bp, Artificial Sequence
  Description of Artificial Sequence: Synthetic coding sequence
atgtctgccgcaaaccctgagaccccaaactccacgatcagtcgggaagccagcacccagagctcctctgcagcagcgagccagggctgggttctgccggaagggaagattgttcccaacacagtgtttgtgggaggtattgatgccaggatggatgaaacagagatcggcagctgttttgggagatacggctccgtgaaagaagttaaaattatcaccaatcgtactggagtgtccaaaggatacgggtttgtctctttcgtaaacgatgttgatgtgcagaagatagtgggcagccagattcatttccatggaaaaaagttaaaactgggtcctgctatccgtaagcagaagctctgcgccagacatgtccagcctcgccctctagtggtcaatcctccgccaccaccacaatttcagaatgtgtggagaaacccaaatactgagacttacctccaaccacagatcactcctaacccggtgactcaacacgttcagtctgcagctaatccagaaacaccgaactctactattagccgggaggctagcacccagagctctagcgcagccgcaagtcaagggtgggtgctgccagagggcaagatcgtgccgaacacggtgtttgtgggcggaatagacgccagaatggatgaaacagagattggatcttgctttgggcgttacggttcagtcaaggaagtgaagattattaccaacagaacaggagtgtctaaaggatatggctttgtgtcctttgtgaatgacgtggacgtacaaaagattgtgggctcccagattcacttccacggcaaaaaactgaaattaggacccgcaattaggaaacagaagctgtgcgcgcgacatgtacagccccgacccttggtcgtgaaccctcctcccccaccacagttccagaacgtgtggcgcaaccctaatacggaaacatatctgcagccccagatcaccccgaacccagtaacacagcatgtgcagtccgccgctaacccagagactccaaactcgaccatctccagagaggctagtactcaatcctcctcagcagccgcttcacagggttgggtcctcccagagggaaagatcgttcccaatacagtgtttgtgggtggaatcgacgctcggatggatgaaacagagattggtagctgcttcgggcgatacggctctgtcaaggaggttaagatcattacgaatcggactggcgtctctaaagggtacgggtttgtgtctttcgtgaatgacgttgacgtgcagaagatcgtcggcagtcagatacatttccacggcaagaagttgaaactcggacctgctatccggaagcagaagctgtgtgccaggcacgtccagccccgtcccttggtggtgaatcctcctcctcccccacagtttcaaaacgtatggagaaaccctaacaccgagacatatcttcagccacagattacccctaatccagttactcagcacgttcaagcctattccgcctacccgcatagcccaggtcaggtcattactggatgccaattactggtctacaactaccaggaatatcccacctatcccgacagtgcattccaggtaactactggctatcagctgccagtatataactatcagccttttcccgcttacccaagaagccctttccaggtgaccgcaggctatcaactccctgtatacaactaccaagcgtttccagcctacccaaactctccgtttcaggtggccactggttaccagtttcccgtgtgtgaaatttgtaaaattctggttctgaagaatgccgctgccttcctctgtcatagcaaggtgaatcggtccatatag

SEQ ID NO: 29263 - DNA, 384 bp, Artificial Sequence
  Description of Artificial Sequence: Synthetic coding sequence
atgaggccactggatatagtcgagttggcggagcctgaggaagtggaggtgctagaaccagaggaggattttgagcagttcttgctacctgtcatcaacgaaatgcgcgaagatatagcttctcttactcgagagcacggcagggcctacctgcggaacagaagtaagctctgggaaatggacaacatgctaatccaaattaagactcaggtcgaggcctctgaggaatcggccctgaatcatttgcagaatccaggagatgcagcagaaggacgggcagccaagcgttgtgagaaggctgaagaaaaggccaaagaaatagctaaaatggcggagatgctggtagagttggtcagacggattgaaaagtccgagtcatcatag

SEQ ID NO: 29264 - DNA, 537 bp, Artificial Sequence
  Description of Artificial Sequence: Synthetic coding sequence
atgatgagagcaatgaagcccccaggcggtgagtctagcaatctcttcggctcaccagaagaggctactccttccagtcggcctaaccgaatggctagtaacattttcgggccaaccgaggagccacagaacattcctaaaagaacgaacccgcctggagggaagggctcaggcatctttgatgagtccaccccagtccaaactcgtcagcacctgaatccccctgggggaaagacttctgacatttttggctccccagtgacagctacttcccgtttagctcatcccaacaagccgaaggatcacgtgttcctctgtgagggcgaggagccaaagagcgatctcaaagcagcgagatccatccctgcgggagccgagcccggagagaaaggcagtgcccgtaaagctgggccagctaaggaacaagagccaatgcccacagtcgacagccatgaacctaggctggggcctcggcctcgatcacacaataaggtcctcaacccgcctggcggtaaatcctctatttccttttattag

SEQ ID NO: 29265 - DNA, 657 bp, Artificial Sequence
  Description of Artificial Sequence: Synthetic coding sequence
atgtttcaggtaccagacagcgagggtgggcgagccggatccagaaaatggcagttattgacgggatctttagcctcgacaagtccatctttattaagcggacaaggaccgtgggctccactccaacgggctatgaagccacccggaggagagagctccaatctgtttggatccccggaggaagcaaccccttccagcaggcctaaccggatggcttcaaacattttcggtccaacagaggagccccagaatatccccaagcggaccaaccccccagggggaaagggtagcggaatctttgacgaatccacacctgttcaaactaggcaacaccttaaccctcctggtgggaaaacaagcgatattttcggcagtccggttacagccactagccgtttagcccacccaaataaacccaaagaccatgtttttctttgcgaaggtgaggagcctaaatctgatttgaaggccgctaggagtattcctgccggtgctgaacccggagaaaaaggctcagcccgaaaggcaggaccggctaaagagcaagaaccgatgcctactgttgattctcacgaacccaggttaggacctcgaccacgatctcacaacaaggttctaaatccccctggaggaaaatcatccatctccttttactag

SEQ ID NO: 29266 - DNA, 4866 bp, Artificial Sequence
  Description of Artificial Sequence: Synthetic coding sequence
atggccggaggtagaggggctcccggtagaggaagggatgaaccaccggaatcatacccacagaggcaggaccacgagctgcaggcactcgaggcgatctacggtgcggactttcaagatctgcgccctgatgcctgtggaccggtaaaggagccacccgagatcaacctggtcctgtatcctcaaggcctgactggagaagaagtgtacgtcaaggttgatctgagagtcaaatgccctcctacatacccggatgtggtgcctgaaattgagctgaagaacgccaaaggtttgagcaacgagtccgtgaatctgctgaagtccaggctggaggaactggccaaaaagcattgcggtgaagtcatgatcttcgaattggcttatcacgtccagtcatttctgtccgagcacaacaagccacctcctaaatcatttcacgaagagatgctcgagcggagagcccaagaagaacagcagagactgctggaagccaaacgcaaagaagagcaggaacagagagagattcttcacgagattcagagacggaaggaggagattaaagaggagaaaaagcgcaaggagatggctaaacaggaaagacttgagatcgcttctctctcgaaccaggatcacacctccaaaaaagatccagggggacaccgaactgctgccatcctgcatggaggatcaccggacttcgtgggaaacggtaagcatcgtgcaaacagttccgggagatccaggcgggaaaggcagtattccgtgtgtaattcggaagacagtccaggcagttgcgagatactgtactttaacatggggagccctgatcagctgatggtacataagggcaaatgcataggttcagacgagcaactggggaaattagtctataacgccctggaaacagccactggaggtttcgtattattgtacgaatgggtactgcaatggcagaagaagatgggccctttcctgaccagccaggaaaaagagaagattgacaaatgcaaaaaacagattcaaggaaccgaaaccgagtttaacagcctagtgaagctgtcccatcccaatgtggtacgttatctcgccatgaatttgaaggagcaagacgacagcattgtggttgacatactagtcgagcatatttccggagtgtcactggctgctcatttgtctcatagcggcccaattcccgtccatcagctgcggaggtataccgcccagttgctgagcggactggactacctgcactctaattcggtcgtgcataaggtgctgtccgcctccaatgtcctggttgacgccgagggaaccgtgaaaatcacggactacagcatctctaagcgcctggctgatatctgcaaagaagacgtgttcgagcagacccgtgttagattctcagacaatgccttgccctacaagaccggaaaaaagggagatgtgtggaggctcgggcttcttttgctgagcctgtcccagggccaagaatgtggcgagtacccggtgacaattccaagcgacctgcctgccgacttccaggattttttaaaaaaatgcgtctgcttggatgacaaggagagatggtctcctcagcaattgctgaaacactcatttatcaatccccagcctaagatgccactcgtagagcagtcgcctgaggatagcgagggacaagactacgtagaaacagtgataccgtcaaatcggcttccttccgccgctttctttagtgagacacagcggcagttcagcagatatttcatcgaatttgaagaactgcaattattgggtaagggcgcatttggcgctgtcatcaaggtgcagaacaagctggacgggtgctgttacgctgtaaagcgaatcccaatcaatccagccagccggcagttccgtaggattaaaggcgaggttaccttgctgagtcgcctgcaccatgaaaacattgtcaggtactataacgcctggatcgagaggcatgagcgcccagctgggccaggcacacctccgcctgattccggtccactagccaaggatgatagagcggcacggggacagccagcttccgacacagacggattggacagcgtggaggctgcagcccctcctcctatcctgtccagttccgtggaatggagtacctcaggcgagcggtctgcatccgctagattcccggctaccggccctggcagctccgatgatgaggatgatgacgaggacgagcacggcggagtgttctctcagtcatttcttcccgcatccgactccgagtccgacattatctttgacaatgaggatgagaactccaagtcgcaaaaccagatggaatactgcgagaaatccacccttcgagacactattgaccagggactgtaccgcgatacagttcgactgtggcgattgttcagagagattttggatgggctggcctatatccatgaaaagggtatgatccaccgcgaccttaagccggtaaacatattcctagatagcgacgatcacgtgaagatcggcgatttcggcctggccacggaccatttagccttcagtgctgattccaaacaggatgaccaaaccggtgatctgatcaaatcagacccttcaggtcacctgacaggcatggtcgggacggcgctttatgtgagtccagaggtgcaggggagcacaaagagtgcatacaatcaaaaggtggacctcttctctctcggcattattttctttgaaatgagttatcatcccatggtgaccgccagtgagaggatttttgtcctgaatcagttgcgggaccccacctctcctaagtttcctgaggattttgatgacggagaacacgcgaagcaaaagtcggtcatctcctggcttctcaatcacgaccctgctaaaagacccaccgcaaccgagctcttgaaaagtgagttgctgcctccacctcagatggaagagagtgaactgcacgaggtcctccaccacacattgactaacgtggacggtaaggcgtaccgcacgatgatggcccagatctttagccaacgcatttcgccggctatcgattacacgtatgacagcgacatccttaaaggaaatttttctattcggaccgccaagatgcaacagcacgtctgcgaaaccatcatcagaatatttaaaaggcacggcgctgtgcaattgtgcacacctcttcttttacccaggaacaggcaaatttacgagcataatgaagcagccttgttcatggaccactcgggcatgctggtcatgctgcccttcgatctgagaattccctttgcgagatacgtcgctcgtaacaacatcctcaacttgaagagatattgtatagaaagagtcttcagacctcgcaaactcgatcggttccaccccaaagagcttctcgagtgtgcctttgacattgtgacctcaacaacaaatagcttcctgcccaccgcagagataatttacacaatttatgagattatccaggaatttccggcactgcaggaacggaattactctatctacctgaatcacactatgctgttgaaggctattctgcttcactgtgggattcccgaggataagctgagccaggtgtatatcatcctatatgacgccgtaaccgagaaattgacccggcgagaagtggaggccaagttttgtaacctcagcttaagcagcaacagcctctgcaggctctataagtttatagagcagaagggggacctccaagacctgatgccgaccatcaacagtttaatcaagcagaagactggcatcgctcaattggtgaagtacgggctgaaagatctagaagaagttgtcggcctactaaagaaactcggcatcaagctgcaagtactgattaacctcggcttagtatataaagtgcagcagcacaacggtatcatcttccagtttgtcgcgtttatcaagaggagacagcgcgctgttccggagatattagctgccggaggcaggtatgacttgctgattccccagttccggggaccccaggccctggggccagtccctactgccatcggcgtttccattgccatcgataagatttccgccgcagtacttaacatggaagaaagcgtgacgatctcgtcctgcgatttgctcgtggtgtctgttggacagatgtcaatgagtcgggcaataaatctgactcaaaagctctggacagccggaattacagccgagatcatgtacgattggtcacagagccaggaagaactgcaggagtattgtcgacatcacgagatcacatatgtagctctggtgtccgataaagagggaagccacgtcaaggtgaagagcttcgaaaaggaacgccagacagagaagcgggttcttgagacagagcttgtcgaccacgtattgcaaaaactgaggacgaaagttacagacgagaggaatggacgcgaggcatccgataaccttgcagtgcagaacctgaaggggagcttttctaacgcttcaggcctgttcgagattcatggtgccaccgtggtgcctatcgtgtcagtactggcccctgagaagttgagcgccagcactcggaggcggtacgaaacgcaggtgcagacccggctccagacctcacttgcgaacctacatcagaagagctcggaaatcgaaattctcgccgtggacctgcccaaggagaccatcctgcagtttctaagtttggaatgggacgctgatgaacaggccttcaacacaactgtgaaacagctcctttcccggctccccaagcaaaggtatctgaagctcgtatgtgacgaaatatataacatcaaagttgaaaagaaagtctccgtgttgttcttgtactcatacagggatgactactatcggatcctgttctag

SEQ ID NO: 29267 - DNA, 2388 bp, Artificial Sequence
  Description of Artificial Sequence: Synthetic coding sequence
atgaagtttacaaataccaaggtgcaaatgatgcaaaacgtccatctcgccccagaaacagacgaagacgacttgtatagcggctacaatgattataatcccatctacgacattgaagaattggaaaatgatgccgcatttcagcaagctgtgcggactagtcacgggcgaagaccgcctattacagcgaagattagtagcaccgccgttacccggcctattgccacgggctacgggtctaagacatccctggcgtcctctattgggagacctatgaccggtgcgatccaggatggggtcaccaggcccatgactgccgtgcgggcagctggcttcaccaaggctgctctcagaggctcagccttcgaccccttgagtcagagcagaggtcctgcctccccactggaggcaaaaaagaaggattcacctgaagagaaaattaaacagctcgaaaaagaggtaaatgagctagttgaagaaagttgtatagctaattcatgtggtgatctcaagctggccttggaaaaagctaaagacgccggtcgcaaggagagagtgctagtgaggcaacgtgaacaagttactacacctgagaacattaaccttgatctcacctacagtgtgttgtttaatctggcttcgcagtatagtgtgaatgagatgtacgctgaggcattgaacacctatcaggttattgtcaagaacaagatgttctcaaacgcagggatcttgaagatgaatatgggaaatatttatctgaagcagcggaactactcgaaagctataaagttttatagaatggctctggatcaggtcccatcagtcaataaacagatgcgtatcaaaattatgcagaatatcggggtaactttcatccaggctgggcagtattcagacgcaattaactcctatgagcacatcatgagcatggccccaaacctgaaggctggatacaacctgaccatctgttattttgccattggagatcgggaaaagatgaagaaggccttccagaaactgattacagtgccattggaaattgatgaggacaaatacatcagcccttcagatgatcctcataccaaccttgtgactgaagccataaagaatgatcacctgcgacagatggaaagagaaagaaaggctatggccgaaaaatacatcatgacaagcgcgaagctgatcgcgcctgtcattgagacctcatttgcagctggatacgactggtgtgtggaggttgtcaaggcctcacagtacgtggaattggccaatgacctggagatcaataaagccgttacctatctcaggcagaaagattacaaccaggccgttgagattctcaaggtcctggagaaaaaagactcaagggtgaaatccgccgctgccaccaatcttagcgcactatactacatgggcaaggatttcgctcaggcctctagctatgcggacattgccgtcaattctgataggtacaatccggcagctttgaccaacaaagggaacacggtgttcgcaaacggagactatgagaaagcagcggaattttataaggaggctttgcgcaacgacagctcctgcaccgaggccctgtacaacatagggctgacctacgaaaagctaaaccgcttggacgaagccctggattgctttctgaagctgcacgccatccttcgcaattccgccgaagtcctgtatcagatcgcaaacatctatgagctgatggaaaatcctagtcaagcaattgagtggctcatgcaggtagtctcggtgatccctactgatcctcaggtcctcagtaaactgggcgagctatacgacagagagggcgacaaatcacaagcattccagtattactatgaatcatatcggtactttccatgtaacattgaagtcatagaatggctgggggcatactacatagatacgcaattttgggaaaaagctatccaatactttgaacgcgcttctctcatccaacccactcaggtcaagtggcagctgatggtggccagctgtttcagaaggtctggtaactatcaaaaggctctggatacatacaaggacacacacagaaagttcccggagaacgtcgagtgctcgggcagcgtaaggacgggtcacatggaaagggatcctctgaacctcctccctcgtaagtcagtcctccctggccctgaaatcgccaaatgcaactatttctccggcgagaagtattaccttagcgcctttttgagcagctccctccacaggagctggattaagaggtgtagccggatctgccagaagacggaggaagtggggaagaacgaaaggaacaaaggaaccgctcacaaagtgcgtcagcgatggcagtggggcctgccatggcagaagcgtaggaagtgttag

SEQ ID NO: 29268 - DNA, 192 bp, Artificial Sequence
  Description of Artificial Sequence: Synthetic coding sequence
atgtcctattacagatcctactatggtggtctgggctatggctacggagggttcggcggttggggatacggatacggatgtggctacggaagctttaggcgcctcgggtacggctgcggctacgggggatatggtttttcctgctgtaggcccctgtattatggcggatacggttttagcgccttttattag

SEQ ID NO: 29269 - DNA, 135 bp, Artificial Sequence
  Description of Artificial Sequence: Synthetic coding sequence
atgagctattacgggaattattacgggggtctcggttacgggtacgattgcaagtactcttatacgtccggtttcggcgctttcaggatcctggattgtggttacagatgcgggtgcgggggtgtatggatatag

SEQ ID NO: 29270 - DNA, 135 bp, Artificial Sequence
  Description of Artificial Sequence: Synthetic coding sequence
atgtcatactactcccatctgagcggtggcctgggatgcgggttagcagtggcggttacaatgggcaggaccgtcgctgttgcagaatatggccgttgccgccatggctgtcacagtagttatagcgcgagatag

SEQ ID NO: 29271 - DNA, 138 bp, Artificial Sequence
  Description of Artificial Sequence: Synthetic coding sequence
atgtgttattatcacaattactatgggtcgttagactacgggtgttcctatggctctgagtacggaaactctggttacgcatgtaactttccgtgttcctatgggagattcctgctcgcacccagaaagaaattctag

SEQ ID NO: 29272 - DNA, 624 bp, Artificial Sequence
  Description of Artificial Sequence: Synthetic coding sequence
atgccccatagccactgtcacagcctacgaagctttcataacgcaccaccattaagcgctatcactcatgggacaaaccctattacgttcgaggatagactgtgcctcccctcctccttccatagcaggacgtgttttctcgataatttccaggagacatgtaacgagaccaccagctgtcagatgacgaactgcgaacaggacctgtttactgacgattcttgtgtccagtcaaattgctttcctggtgtggtgcagactacttacagtaacagtagaccatgcgagaggaccgcttgtcagtcagaaagcagctcggctgggctcgcatgtgttagccaaccgtgccaaagcgagtcaacgcagcaaatgggtttcgtggcccagtcctgccagcctgcgagcctgaaggggaacagctgtcctcccaaaacctcaaagtcaaagaacttcgagactctggaacgagccagctcacaatgtcagtgtcagagtcagaaccccgagtcctcaagttgcagaccactagtaaatgtcgctccagaacctcaactgctggaaagctctcctggagttgagcccacctgctgtgttactggtgggtcccagctgcccagcaaatag

SEQ ID NO: 29273 - DNA, 645 bp, Artificial Sequence
  Description of Artificial Sequence: Synthetic coding sequence
atggctcatgtctcaagtgaaactcaagacgtctcccccaaggacgagttgaccgcgtcagaagcttctactaggtctcctctgtgtgagcatacctttcccggagatagcgatttacgatctatgatcgaagaacatgcctttcaagtgctgtctcaagggtccctgttagaaagtccgagttataccgtttgtgtgtctgaaccggataaggacgatgatttcctaagcttgaattttccacgtaagctatggaagattgtggaatcagatcagtttaagtcaataagctgggacgagaatggcacttgtattgtgattaacgaagagctcttcaagaaggaaatactcgaaacaaaagccccttaccgaatttttcagacagatgccataaagagctttgtgaggcagttgaatctttatggcttctccaaaattcagcaaaactttcaacggagcgcattcctggcgacgtttttgtctgaggaaaaagagtcctccgtgctgtcaaagctccacgtcttcgtttttcaccactctctgtttggcgctacgttcggcgaacaccacttccaaccttgccccctaccctctggtaataaagcccctatctccacatggtcaggcgacagctggctactctag

SEQ ID NO: 29274 - DNA, 645 bp, Artificial Sequence
  Description of Artificial Sequence: Synthetic coding sequence
atggcacatgtgagcagcgaaacccaggacgtatctccaaaagatgaactgacagctagcgaagcctccactcggtcacccttgtgcgaacacacatttcccggtgactccgacctgcgcagcatgattgaggaacacgcctttcaggtgctctctcagggttccttgctggagtcccccagctacacagtgtgcgtctcagagcccgacaaagatgacgactttctgtccctcaatttccccaggaagctctggaagattgtcgaatctgatcagttcaaatcaattagctgggacgagaacggaacgtgcattgtcattaatgaagagctattcaaaaaagaaattttggagacgaaggcaccgtaccgtatattccaaactgatgctattaaaagtttcgtgcgacagctgaacctttacgggttctctaagattcagcaaaacttccagcgatctgcatttctcgccaccttcctgtcggaagagaaggagtcttcagttctgtctaagttacacgtgttcgtgtttcaccactcactcttcggtgctacttttggtgaacaccacttccaaccctgccccctgccatccgggaacaaggctcccatatccacttggtctggcgatagttggctcctatag

SEQ ID NO: 29275 - DNA, 1437 bp, Artificial Sequence
  Description of Artificial Sequence: Synthetic coding sequence
atggccgctgctctgaagtgcttactgacactagggaggtggtgtcctggcttgggtgttgcaccacaagctcgggcactcgcagctttggtgcccggtgtgactcaagtggataacaaatcaggattcttgcagaaaaggccacaccggcagcaccccggaattctcaagctcccccatgtccggctccctcaggcactcgccaacggagcgcaattattgctcctgggatctgcaggtccaacgatggaaaaccaggttcaaacgcttacatcctacctgtggagccggcatctgccagttgagcccgaagagctgcaacgaagagccagacacctggagaagaaatttctcgaaaaccccgacctgagtcagacagaagaaaaactgaggggggctgtgctccatgccctgcgcaagaccacttatcattggcaggagcttagttacacagaagggcttagcttagtgtatatggctgcccgacttgatggtgggtttgctgcggtgtctcgggcatttcacgaaattagagcacgcaacccagcattccagccgcaaactttaatggatttcggcagcggcactgggagcgtgacctgggctgcccattctatttggggtcagtccctgagagagtacatgtgtgtggatcgtagcgccgcaatgctcgtcttggccgagaagctgctgaaaggcggaagcgagtctggggaaccgtatatccctggcgttttcttccgtcagtttctccctgtctcccctaaggtacagtttgacgttgtggtcagcgctttttctttgagcgagctccccagtaaagccgataggactgaggtcgtgcagacattgtggaggaagacaggacacttcctggtgctcgtcgaaaacggtacgaaggccggtcacagcctcctgatggacgccagagacttagtactgaaagggaaagagaaatctcctcttgaccctaggcccggttttgtgttcgctccatgtccacacgagttgccttgcccacaactcacaaacttggcctgctctttcagccaggcctaccaccccatcccgttttcttggaacaagaagccgaaagaagaaaaattctccatggtcatcttagcccgtgggagtcccgaggaagcccatcgatggccaaggatcacccagcccgtcctgaagagaccccgtcacgtgcattgtcacctgtgttgccccgacggccatatgcaacatgccgtgctcacagccaggaggcatggacgatacggagggtgcgaccagaaccagtgggacgttgccggaagctgctctcctcgccagcatttattcccccaggggttcgtatctttgtgcccctgtcaactgctgggccgttctttcacttgcgcttattctgtttgcgtctcatctatctatggaagcggttccctgtag

SEQ ID NO: 29276 - DNA, 774 bp, Artificial Sequence
  Description of Artificial Sequence: Synthetic coding sequence
atggaggaagaggcctccagtcctggcctcgggtgcagtaagccacatctggagaagctgacactgggcatcacgcggatccttgaatcttccccaggcgtgaccgaggtcaccatcatcgagaagcctcccgcagaacggcacatgataagctcatgggagcaaaagaataattgtgtgatgccagaggacgtcaagaatttctatctgatgaccaacggcttccatatgacttggtcagtgaagctggacgcctcagacgatcagcctgaaaagcctcactttgatagcagaagtgtgatctttgaacttgacagttgtaacggttccggaaaggtttgtctagtttataagtcagggaaaccagcccttgcggaggacaccgagatctggtttttagatagggctctgtactggcacttcctcacggacacctttaccgcgtactaccgcctactgatcacccacctggggctgccccagtggcagtatgcatttacctcatatggcatttccccacaggctaagcagtggttctccatgtacaagcctatcacctacaacaccaacctgctcaccgaggagactgacagcttcgtgaacaagctggacccgtcaaaggtatttaagagtaaaaataaaattgtgattccgaagaaaaaaggacccgtgcagccagcaggcggtcagaagggaccctctggtcccagcggtccaagtacaagctccactagcaagtcctcctccggatccggcaacccaacgcggaaatag

SEQ ID NO: 29277 - DNA, 792 bp, Artificial Sequence
  Description of Artificial Sequence: Synthetic coding sequence
atgctgagctctaaaggcctgaccgtggtggacgtataccaaggctggtgcggtccttgtaagcccgtggtttccctttttcagaaaatgagaattgaagtgggtttagatctgctgcatttcgcacttgcagaggcagatcggctggatgtgctcgaaaagtatagaggtaaatgtgagccaaccttcttgttctacgctatcaaagacgaggcactgtctgacgaagatgagtgcgtctcgcacgggaagaacaatggcgaggatgaggatatggtcagttccgagcggacctgtaccctggcaatcattaagccagatgctgttgcccatgggaaaacagatgaaataatcatgaaaatccaggaggctggatttgagattctgacaaacgaggaaagaacaatgaccgaagccgaggtgcgtcttttctaccaacacaaggccggtgaagaagcctttgagaagcttgttcaccacatgtgtagcggaccatcgcaccttcttattctcacccgcaccgaagggttcgaggatgtcgtgaccacgtggcggacggtgatgggcccaagagatccaaacgtcgctcgaagggagcaacctgagtctctccgggctcagtatgggacagaaatgccttttaatgccgtgcacggttctagagatcgtgaggacgccgatagggaactcgccttgctatttccttcgctcaagtttagcgacaaggacaccgaagcccctcaaggcgagagtagcacacaaccacgactgaaaattaccgatttggattag

SEQ ID NO: 29278 - DNA, 390 bp, Artificial Sequence
  Description of Artificial Sequence: Synthetic coding sequence
atggcagagctgattcagaagaaactacaaggtgaagtggagaagtaccagcagcttcagaaagatctgtccaaatcaatgtcaggcagacaaaagttggaagcccagctgaccgagaataacattgtgaaggaggagctggcactgctcgacgggagcaatgtcgtgtttaagctcttgggccctgtgctggtgaaacaggaattaggagaggctcgggctaccgtgggcaaacggctagactacattaccgccgaaatcaagcgatatgagtcccaattgagggatttagagcgacagtctgaacagcaaagggaaaccctcgctcaacttcagcaagagtttcaaagagctcaagcagccaaggcaggcgcacctggcaaggcatag

SEQ ID NO: 29279 - DNA, 1626 bp, Artificial Sequence
  Description of Artificial Sequence: Synthetic coding sequence
atggaagctctgctcgagggcattcaaaaccgcggacacgggggaggatttctgacaagctgtgaggcagagctccaggaattgatgaagcagattgacattatggttgctcataaaaagtccgagtgggaaggacgaacacacgccctggagacatgcttgaagataagggagcaagagttaaaatccctgagaagtcagctcgatgtaactcataaggaggtcgggatgttgcaccagcaagtggaagagcacgagaaaataaaacaggagatgaccatggagtataagcaggaactgaaaaagcttcacgaggaactatgtatcctgaaacgctcgtatgaaaagctgcagaagaagcaaatgcgggagtttaggggaaacacaaaaaatcaccgggaggaccgcagtgaaatcgaacgactgaccgctaagatcgaagagttcaggcagaagtctcttgactgggagaagcagagactgatttatcaacagcaggtgagctcgctggaggcccaaagaaaggctctggccgagcagtccgagatcatccaggctcagctggtgaaccggaaacagaaattagaatccgtcgagctgtcttctcagtctgaaatccagcacttgtcaagcaaactcgagagagctaatgacactatctgcgcgaatgagctagaaatcgagcgcctcacgatgcgggtgaacgacctggtgggcacgtcgatgacagtcctgcaggaacagcagcagaaggaggagaaacttagagagagtgaaaagcttctagaagctctgcaggaggaaaaaagagaactgaaggcggcattgcaatcccaggagaacctcatacatgaagctcgtatccagaaagagaaactccaggaaaaggtgaaagcgacgaatactcagcatgctgtggaggccatccgtccccgtgaggagagcctcgctgagaagaaatacacatcccaaggacagggggacttagatagcgtgttatcgcagctgaacttcactcacacatccgaggatctattgcaagcagaggtgacctgcctcgaaggaagcttggaatctgtctcagccacatgcaagcagctgtcccaggagctgatggaaaagtatgaagaattaaagcggatggaggcccacaataatgaatataaggccgagattaagaagttgaaggaacagatattgcaaggggaacagagttactcaagcgcacttgagggtatgaagatggagatctcccatttgactcaggagctccatcagcgcgacattactatcgcttccactaagggctcatcaagtgacatggaaaaacgcctgcgtgctgaaatgcagaaggctgaggataaagccgtagagcataaggaaatcctggaccagctcgagtctctaaagctagagaaccgtcatctgagtgaaatggtcatgaaactcgaactggggctccacgaatgctctttgcctgtttcccccttagggtctatcgctacaagattcctggaggaggaggagctgcggagtcaccacatcctcgagcgcctggatgctcacatcgaggagttaaaaagggagtccgagaaaacagttcgacagtttactgctctgaaatag

SEQ ID NO: 29280 - DNA, 483 bp, Artificial Sequence
  Description of Artificial Sequence: Synthetic coding sequence
atggaggcggaacggccacaggaggaggaggacggggagcaaggcccaccccaggacgaagaaggctggccgcctccaaactcgaccacacggccatggaggtcagctcctccaagccctccacctccgggtacaagacacaccgccttgggccctagatcagcctctctgctgtctctccagaccgagctcctcctggaccttgttgccgaggcccagagcaggcgcctagaagaacagcgagcgactttctacaccccccagaacccctcatctctggctcccgctcctctgcgcccactggaggatcgcgaacagctgtacagcaccattctctcccaccagtgccagcggatggaagctcagaggtccgagccccctctgccccctggcggtcaagaactgttggaactgctgctgagagtgcagggcggtggcaggatggaggagcagcggagtcgtcctccaacacatacctgttag

SEQ ID NO: 29281 - DNA, 483 bp, Artificial Sequence
  Description of Artificial Sequence: Synthetic coding sequence
atggaggccgagagaccacaggaggaagaagacggggaacagggcccaccccaggatgaggaaggctggccccctcccaatagcactacgcgcccatggagaagcgctcccccaagtccgcctccccctgggacccgccacacagcccttggaccacgaagcgcctcactgttgagccttcagaccgaattgttgctggacttggtcgccgaagctcagtcccggcgactggaggagcaaagggcgacgttttatacaccccagaacccttcaagcttagcaccagcacccctgagaccgctggaggatagggaacagctgtactcgactatcttgtcccatcagtgccagcggatggaggcccagagatctgagccccctctgcccccagggggacaggagctcttggaactcctcctgcgtgtgcagggcggtggcagaatggaagagcaaagaagtagaccacccacgcatacttgttag

SEQ ID NO: 29282 - DNA, 3192 bp, Artificial Sequence
  Description of Artificial Sequence: Synthetic coding sequence
atgcctcatttacctctcgcttcattccggcctccattttggggactgcgacacagtcgtggtttacctcggttccattctgtaagcacacagagcgagcctcacggatctcctatttctcggcgaaacagggaagccaaacaaaagagactccgcgaaaagcaggctactctggaggccgagatagcgggagaaagtaaaagcccagcagagtctatcaaggcatggaggcccaaggaactggtcttgtatgagattccgaccaaacctggggagaagaaggatgtgagtgggccactacccccagcctacagcccccgatacgtggaggcagcttggtatccatggtgggtgcgagagggattttttaagccagaatatcaggcacgcttgccccaggctaccggcgaaacattttctatgtgtatccccccaccaaacgttacaggaagtcttcacataggccacgccctcaccgttgccatccaggacgctctcgttagatggcatagaatgcgtggtgaccaggtcctgtgggtgcccggatctgaccacgctggtatcgcaacccaagccgtggtcgagaaacagttatggaaggagagaggagtccgcagacatgaactgtccagagaggcttttctgagagaagtctggcaatggaaagaagcaaaaggcggtgagatttgcgaacagctgcgcgcactgggggcatctctcgattgggatagggagtgtttcaccatggatgtgggaagtagcgtggccgtgacagaagcatttgtgaggctctacaaagcaggactgctctaccgtaaccaccagttggtgaactggagctgcgcgctccggtctgctatcagcgatatagaagtcgaaaatcggccacttcccggtcatactcagctgcgcctacctgggtgcccgacccctgtaagcttcggccttctgttcagtgttgctttcccagttgatggggagcccgacgctgaggttgtcgtgggaactacgaggcccgaaactctccctggtgatgtagcagtcgccgtgcaccctgacgattcacggtacacccaccttcatggccgacagctgagacatcctctgatgggacagcctctgcctctgattaccgactacgcggtgcagcctcatgttggcacaggcgctgtcaaagtaaccccagcacacagcccggcagacgcggaaatgggcgctcgacatggcttgtcaccactgaacgtcatagccgaggacggaaccatgaccagcctctgtggagactggctgcagggtctgcatcgctttgttgcgagggagaaaattatgtccgtgctttctgaaaggggcctgtttagaggcctgcagaatcacccgatggtgctcccaatttgctcccggtctggcgatgttatagaatacttgctcaaaaatcagtggtttgtccgttgccaggaaatgggcgcacgcgctgctaaggctgtggaaagtggggctctggagctttcgccgtcattccaccagaagaattggcagcactggttttcacatatcggggattggtgtgtctcgcggcagttgtggtggggtcatcagatccctgcttaccttgtggtggaagaccatgcccaaggcgaggaggattgctgggtggtcgggagatcggaggccgaagctcgagaggtagcagctgaactgaccggcagaccaggcgctgagctcacccttgaaagggatcccgatgtgctggacacatggttttctagcgccttgtttcccttcagcgcactaggttggccacaagagacacctgacctggcgaggttttatcccctctccttgttggagaccggcagtgacctcttacttttctgggtggggaggatggtaatgctgggtactcagctaactggccagctgccctttagtaaagtccttctccaccccatggttagggatagacagggccgaaagatgagcaagtcactgggcaatgtcttggacccacgggacattatatccggcgtggagatgcaattactgcaggagaaactaaggtctggcaacttggatcccgcagagctcgcaattgtagcagccgcacaaaagaaggatttcccccatggaattcccgaatgcggaaccgacgcacttcggtttactctgtgttcacacggggtacaggcaggcgaccttcacctgtccgtttcagaagtgcaaagttgcaggcatttctgcaacaagatttggaacgccttaagatttatattgaacgcactcggcgaaaagtttgtgccacagccggcagaggagctttcaccatcctctcccatggacgcctggatacttagcagactggccctggcagcccaggagtgcgagcggggatttctgaccagggaattgagccttgtgacacacgctctgcaccatttttggttgcacaacttgtgtgatgtgtatctggaggccgtgaagcccgtgctctggcacagtcctcggcctctgggacctccacaagttctcttctcttgcgctgatttgggtctgagacttttggctccactcatgccattcctggctgaggaactttggcagcgcctacctccacgacctggctgcccgccagcaccctctatttctgtcgccccttacccctcagcatgctccctcgaacactggcgccagccagagctggagcgcaggttctcacgcgtccaggaggtcgtgcaagtcctgcgtgcgctgcgagccacatatcagctgactaaggctcgccctcgagtgttgctgcagtcatctgagcctggagatcaaggcctcttcgaggctttcctggagccactcgggaccctgggatactgtggtgccgtgggcctgctaccccctggcactgccgctccatccggctgggcgcaggcacccctatcagataccgctcaggtttacatggaacttcagggcctggtagacccccagatccaactccctcttttagcggctagacgttacaagctgcagaaacagcttgactccctgacagcgaggactccttcagaaggggaagccggaacccagaggcagcaaaaactcagctctttgcagcttgagctatctaaacttgataaggccgcatcacatttgcgccagctgatggatgaacctcctgcgcctggaagtccagagctctag

SEQ ID NO: 29283 - DNA, 1620 bp, Artificial Sequence
  Description of Artificial Sequence: Synthetic coding sequence
atggccacctccgccccactcaggtccctcgaagaggaagtgacttgttccatttgtctcgactacctgagagatcccgttacaattgactgtggccatgtgttttgtagatcatgcactacggatgtaaggcccatttcaggatctcggccagtgtgcccactgtgcaagaagcccttcaagaaggagaatattcgccctgtgtggcagctggcgtcactggtcgagaacattgagcgactaaaagtagacaaaggacggcagcctggagaggtgacccgagagcagcaagacgccaagctttgcgagcgtcacagagaaaaactgcactactattgcgaagacgatggcaagctcctgtgtgtcatgtgtagggagtccagggaacacagaccccatactgctgttcttatggaaaaggccgctcagcctcacagggaaaaaattctgaatcacctcagcacactgaggagagatcgtgataagattcaagggttccaggccaagggcgaggcagatattctcgcagccctgaagaaactgcaggaccaacggcagtatatcgtggcagaatttgagcagggtcatcaatttttaagagagcgcgaggaacacctgctcgaacagttggcaaagctggaacaagaactcaccgaggggcgtgagaaattcaaatcacgaggcgtgggcgaattggcgaggctggctctcgttatctctgagctggagggcaaggcgcaacagcctgctgcggaactgatgcaggatacaagggacttcttgaatcgttacccgagaaagaagttttgggtgggcaaacccatcgcgagggtggtgaagaagaagaccggggaattcagcgataaactgttatccttacaaaggggcctgcgagagttccagggcaaactgctgcgcgaccttgagtacaaaacagtctcggtcactcttgacccccaatcggcctctgggtatcttcagctgtcagaggattggaaatgtgtgacctacacgagcctatacaaatctgcgtatctccacccacaacagtttgattgcgaacctggcgtccttgggtctaagggattcacttggggaaaggtgtactgggaggtagaagtagagcgcgagggatggagcgaagatgaagaggaaggagatgaagaagaggagggagaggaggaagaagaagaagaggaggctggttacggagacggatacgatgattgggagacggacgaagacgaggaatccctcggcgacgaggaggaggaggaggaagaggaggaggaggaagtactcgagagctgcatggttggcgttgccagggacagcgtcaagcggaagggagacctaagccttaggccggaggacggggtgtgggcccttcgcctctcatccagcggtatttgggcgaacacctcccctgaagccgagctgttccccgcattgagaccccgacgggtggggatcgcccttgattatgaagggggaacagtgactttcacaaacgccgagtcacaggaactgatctatacattcacagcgacatttacgcggagactagttccatttctttggctcaagtggcccggaactagactgttattaagaccttag

SEQ ID NO: 29284 - DNA, 678 bp, Artificial Sequence
  Description of Artificial Sequence: Synthetic coding sequence
atggcagccggtagcgaggcaaccaccccagtgatagtggccgctggggctgggggagaggagggggagcacgtcaaacctttcaaacccgagaaggccaaggagatcatcatgtcactgcagcagccagctatattctgtaacatggtgttcgattggccagccagacattggaatgctaagtacctgtctcaggtgctacacggtaagcagatccggttccggatggggatgaagagtatgtctacagttccccagtttgaaacaacctgtaattatgttgaagcaactctggaggagtttctgacctggaattgtgatcagtcctctatctctggtccatttagggattatgaccactcaaagttttgggcatatgccgactataaatattttgtctcactgttcgaagacaagactgacctgtttcaggacgttaagtggtcagatttcggatttccaggaagaaacgggcaggagtcgacactgtggataggatctctgggagcgcatacaccgtgccacctggacagctatggctgtaacctggtttttcaggtgcaggggcgtcttgaatgcaacggaatgatcattgctccaggcccacaggccattctcttaccacaaccgctgaagtatttgggcctgcaggagacaatggcttcactgagttcctag

SEQ ID NO: 29285 - DNA, 2571 bp, Artificial Sequence
  Description of Artificial Sequence: Synthetic coding sequence
atggacatctccaaggggctgccgggtatgcagggaggcctccatatctggatctctgagaaccggaagatggtgcccgtccctgagggcgcttatgggaacttcttcgaagagcattgttacgtgatcctgcacgttccacaatcacctaaggccacccagggcgcatcaagtgacttacattattgggttggcaagcaggctggagccgaagcccaaggagctgctgaggctttccagcagagattgcaggacgagctgggcggacagacagtcctgcacagggaagcccagggccacgagtccgactgcttttgttcgtatttcaggccaggcatcatttatcgaaagggtggcctggcgagcgaccttaaacacgtggagactaatttattcaatatccagcgcctcctgcatatcaaaggcagaaagcatgtgagcgccaccgaggtcgaattaagctggaatagcttcaacaaaggcgacattttcctgcttgacctcggcaaaatgatgattcaatggaatgggccaaagacaagtattagcgaaaaagccagggggctcgctttgacatactctctccgagatcgggaacgcggaggcggaagggcccagattggggttgtcgatgacgaggctaaggccccagatctgatgcagattatggaagcggttttaggccgacgggtgggaagtctgagggcagccaccccttcgaaggacattaaccagttgcagaaagcgaatgtgcgcctgtaccacgtgtatgaaaagggcaaggatttggtagtccttgaattggcaacacctcccctgacccaggatctcttgcaggaagaagatttctatatcttggatcagggagggtttaagatttatgtgtggcaaggcaggatgtctagtctgcaagaaaggaaggcagctttctcccgggctgtgggcttcatccaggctaaaggatacccaacctatactaacgtcgaggtggttaatgatggcgctgaatctgctgctttcaaacagttatttcggacatggtccgagaaaagacgcagaaaccaaaagcttgggggaagagataagtccatccatgtgaagctggatgttggaaaactgcacactcaaccaaagttggcagcacagttgcgaatggtggatgatggatctggtaaggtcgaggtatggtgcatccaagacctacatcgacagccagttgatccgaaacggcatggacaactgtgtgccggtaactgttacctggtcctgtacacctaccagagacttgggcgagttcagtatatcctgtacctttggcaaggccatcaggcaacggctgacgagatcgaggctctcaactctaacgccgaggagctcgatgtgatgtatggcggagttctcgtccaagaacacgtaacgatgggaagtgaacccccacatttcctggctatcttccaaggccagttggtgatcttccaagaacgtgcagggcatcatggaaaggggcaatccgcgtccaccaccaggctgttccaggttcaggggaccgattcacacaacacgaggacaatggaggtgcccgcacgcgcttctagcctcaattcttctgatatttttcttctagtcaccgcgtccgtgtgctatctgtggttcggaaagggctgtaacggggatcagcgtgaaatggctcgagtggtggtaaccgtgatctcccgcaagaacgaagaaaccgttctcgaggggcaggagcccccacatttctgggaagcccttgggggaagagcaccctacccctcaaataaacgtcttccagaggaggtaccatcatttcagccgaggctgtttgaatgctccagccacatgggatgtctagtattggctgaggtcgggtttttttctcaggaggacttggacaagtacgacatcatgcttctggatacatggcaagaaatcttcctgtggcttggggaggccgcatctgagtggaaggaggccgtcgcctggggacaggaataccttaagacccatcccgcagggaggagcccagccactcccatcgtccttgttaaacagggccacgagccccctaccttcattggttggttctttacctgggatccctataagtggacttctcaccccagtcataaggaagtggtggacgggagtcccgcagccgcatccactatcagcgaaataacggccgaagttaacaatctgcgattgagccgttggcccggaaacggacgggctggcgcagtggccctgcaggctctgaaaggatctcaagactcaagtgaaaacgaccttgtgaggtcgccgaagtctgctgggagtcgtacatcaagcagcgtgagctccaccagtgcaacaatcaatgggggacttcggagagagcagttgatgcatcaggccgtggaggacctcccagagggagtagacccagccaggcgagagttttacctttcggactccgattttcaggacatctttggaaaaagtaaggaagaattttacagtatggcaacgtggagacagaggcaagagaagaagcagttaggttttttttag

SEQ ID NO: 29286 - DNA, 2607 bp, Artificial Sequence
  Description of Artificial Sequence: Synthetic coding sequence
atggcctcttttccggaaacggattttcaaatatgtctgctctgtaaggaaatgtgtgggagcccagctcccctgtcaagcaattcgtctgcctcatcaagcagcagtcagactagcacgtcctccggtggcggaggaggaggccctggtgcagcggcacgcaggctccatgtgttgccatgcctgcacgctttttgcaggccatgcctggaagcccaccggcttccagctgccggtggaggcgctgcaggggagcctttaaagttgcggtgccctgtgtgcgaccagaaagtggtccttgcagaagctgctgggatggatgcactaccgagtagtgcctttctactcagtaacctgcttgacgcggtcgtggccaccgcagatgaaccgcctcctaaaaacgggagagcaggtgccccagctggtgccggtggccattccaatcatagacatcacgctcatcatgcccatccaagagcttccgcctctgctccaccattaccccaggccccacagcccccagcccctagtagatcggcccctggaggacctgctgctagtccaagtgccctgctcttaaggaggccacatgggtgtagcagttgtgatgaaggaaacgccgctagcagccgttgtttggactgccaagagcacctgtgtgacaattgcgtaagagctcaccagagggtcagactaactaaagatcattatatcgagcgcggaccaccaggccctggcgcagccgctgccgcacagcaacttgggctcgggcctcccttccccggacctcccttttcgatactgtctgtctttccagagcgtcttggattctgccaacaccacgatgacgaagtgctccacctgtattgcgatacctgcagcgttcccatatgccgcgagtgtactatggggcgtcacggtgggcacagctttatctacctccaggaagctttgcaggatagccgtgcacttacgatccagctgctcgccgacgcccaacaaggtcgacaggcaatacaactttctatagaacaggcccagaccgtcgccgagcaggtggagatgaaagccaaggtggtgcagtcggaagtgaaagctgtgacagcacggcacaagaaagcgctcgaagagcgcgagtgcgagctgctgtggaaggtggagaaaatcaggcaggtaaaggccaagtcactctatttgcaggtggagaagctgcggcaaaatctcaacaaactcgaatcaactatcagtgctgtccagcaggtgctggaagagggacgggcattagatatactgctggctcgcgaccggatgttggcgcaagtgcaggagctcaagacagtgcggtctctgctccagccccaagaggatgaccgagtgatgtttacacctcctgatcaggcactctacctggctattaagtcgtttggcttcgtgtcatccggcgcttttgccccactgacgaaagctacgggggatggcttgaagcgtgccctgcagggcaaggtcgcttcatttacagttattgggtacgatcatgacggagagccacgtttgtccggtggggatcttatgagcgccgtggtgctgggtcccgacggcaacttgttcggggcagaggtgtccgatcaacagaatggcacatacgtggtgagttaccggccacaactggagggggagcaccttgtgagcgttacactctgcaatcagcatattgaaaattcaccttttaaggtggtcgttaagagcgggcgaagttatgtggggattggcctcccgggattatcattcgggtcagagggagattcagacgggaaattgtgcaggccttggggagtgtcagtcgataaagaaggatatattatagtggccgatcgttccaacaacagaatccaagtcttcaagccctgtggcgctttccaccataaattcgggactttgggctctcgtcccggacagttcgacaggcccgctggagtggcttgtgacgcgtcgcggcgtatcgttgtggcagacaaagacaatcatagaatacagatttttaccttcgagggtcagtttctcttaaagttcggcgagaaagggaccaagaatggccagtttaactatccatgggacgtagccgtgaacagtgaaggcaagatccttgtgtctgacacacggaatcacaggatacaactttttggccctgatggagtgtttctcaataagtatgggttcgagggcgctctctggaaacatttcgattcaccacgtggagttgcgttcaatcacgagggacatctagtcgtgacagactttaacaaccatcgcctcctcgtcatccaccccgactgccagtctgctcgttttctggggagtgaaggcactggtaatggtcaattcttgcggcctcagggcgtcgccgtggaccaggagggtcgcattattgtggccgactcacgcaatcaccgggtccagatgttcgagtcaaacggctcttttctatgtaaatttggggctcaggggagcggttttgggcagatggacagaccttctggcatcgctatcacccccgacggtatgatcgtggtcgtggactttgggaacaatagaattcttgtcttttag

SEQ ID NO: 29287 - DNA, 1107 bp, Artificial Sequence
  Description of Artificial Sequence: Synthetic coding sequence
atgcgagaacccgtattgacctggtgcgtacctctcgagctgctatgttctcatccacttccattgtccgcattcctcaagagtcaggtgaagttgtacacctatagggcctgcgcaggcaaagacgagatggggaagatggtttccgttatcaacactgtggatacgagccacgaggatatgattcatgacgcccaaatggactactacggcacgcgcttggccacgtgtagcagtgacaggtcggtgaagatcttcgatgttcggaacggcggacagattctcatcgcagacctgagagggcacgagggaccagtatggcaggttgcgtgggcccaccctatgtatgggaacattctcgcctcgtgcagctacgacagaaaggtgatcatatggcgcgaagagaatgggacctgggagaaatctcatgagcatgcgggacacgacagcagcgtgaactccgtgtgctgggctccgcatgactacggtttgattcttgcctgtggttctagcgatggcgctatttctctcttgacttacactggggagggtcagtgggaagtgaaaaaaataaataatgcacacaccattggctgcaacgccgtatcctgggcccctgcagtggtgccgggttctctgatagatcacccctcagggcagaaacctaactatattaagagatttgcctcaggtggatgtgacaatctcatcaagctgtggaaggaagaggaagacgggcagtggaaggaagagcaaaaactcgaagcccactctgactgggtgcgggacgtcgcctgggctcccagcattggcttgcccacatccactatagcctcttgctcacaggacggcagagtgttcatctggacctgtgatgatgcatcttctaatacctggtcccctaagctgctgcataaattcaacgacgtggtctggcacgtttcatggagtattaccgcgaatatactcgctgtgtctgggggagataacaaggtgacactctggaaggagtcagtggacggacagtgggtatgtatctcagacgtgaacaagggccagggctcagtgtcggccagcgtgaccgaaggtcagcagaacgaacagtag

SEQ ID NO: 29288 - DNA, 1059 bp, Artificial Sequence
  Description of Artificial Sequence: Synthetic coding sequence
atggacattgataaagaccttgaggcaccactgtacctaacgcctgaaggctggtctttatttctgcagcgctattaccaagttgttcatgaaggagcagagctgcgacatttagatacccaggttcagcgatgtgaggatatcctgcagcaactgcaggctgtcgtgccacaaatcgatatggagggtgatagaaatatctggatcgtcaaaccgggagctaaatcccgaggccgagggattatgtgtatggatcatttggaagaaatgctcaaactggtaaacggcaatcccgttgttatgaaagatggcaagtgggtggtgcagaaatacattgagagacccctgctgatttttgggactaagttcgacctgaggcaatggttcctggttacggattggaaccccctcactgtctggttctatagggatagttacattaggttttcgacccaaccattttctttaaagaacctggacaactctgtccatctgtgcaataattcaattcagaagcatctcgagaacagttgccaccggcatccgctgctccctcctgacaatatgtggtccagccaacgcttccaggctcatctccaggagatgggcgctcccaatgcgtggagcaccattatcgtccccggaatgaaggacgcagtgattcacgctctgcagacaagccaagacaccgtacagtgtcgcaaggcttcctttgaactgtatggcgctgacttcgtgttcggggaggacttccagccctggctcatagaaattaatgctagccctactatggccccttctacagcagtgacggccagattgtgtgccggagtgcaagccgataccctgagagtcgtgatcgaccgcatgttggataggaattgcgacacaggagccttcgagctgatttacaaacagcctgtgacaacatcccccgcttccactcccaggcccagttgcctgttgccaatgtattctgacacccgggcaaggtcaagcgacgatagcactgcgtcctggtgggccctgcgaccctgccgaccacaggcccgaccgtag

SEQ ID NO: 29289 - DNA, 579 bp, Artificial Sequence
  Description of Artificial Sequence: Synthetic coding sequence
atggggaaaggctgtaaggtcgtcgtgtgtggtctgctttctgtgggcaagacagccatcctggagcaactgttatacggtaatcacactatagggatggaggactgtgaaactatggaggatgtatacatggcctccgtggagaccgaccggggagtcaaagaacagctccatctgtacgatacccggggactccaggaaggcgtggagttgcctaagcattactttagcttcgccgatgggtttgtgctcgtgtacagcgtgaataacctggagtccttccagcgcgttgaattgcttaagaaggaaattgacaagttcaaggataaaaaagaggtcgcaatagtggtgctgggtaacaagattgatttatccgaacagaggcaggttgacgccgaagtcgcacagcagtgggcaaaaagcgaaaaggttcggctctgggaggtcacagtgaccgatcgaaagactctaatcgagcctttcaccctgctggcttccaaattgtcgcaaccacagtcaaaaagttcttttccattgccgggaagaaagaataagggtaattctaatagcgagaattag

SEQ ID NO: 29290 - DNA, 1419 bp, Artificial Sequence
  Description of Artificial Sequence: Synthetic coding sequence
atgtcccgccgagtggtccgccagtctaagttccgccatgtgtttggacaggccgctaaggcagatcaggcctacgaagatatcagggtctcgaaggtgacgtgggactcttctttttgcgccgttaatcccaagttcctggctattattgtggaggctggcggtggcggtgcgttcatcgtgttgcctcttgctaaaactgggagggtggataaaaattatcctttagtcaccgggcacactgcaccggtcttggacattgactggtgcccacacaatgacaacgtaatcgcctcggcttccgacgatactactattatggtttggcagataccagactataccccaatgcgcaatattaccgaaccaattatcaccctcgagggccacagtaagcgcgtgggtatactgtcctggcacccaaccgcccgtaatgtgctcttgtcagctggcggtgacaacgtgatcataatttggaatgtgggtactggagaagtgttgctaagtttagacgatatgcaccccgacgtcatccatagcgtgtgttggaattccaacggatccttgttggccaccacctgcaaggacaagacccttcggatcattgacccacggaagggtcaggtggtggccgagagattcgctgcccacgaagggatgcgcccaatgagggccgttttcactaggcagggtcacatatttacaacagggttcacacgcatgagtcagagggaactggggctgtgggaccccaataacttcgaagaacctgtggccctccaggagatggacacctctaatggggtgctcttgcccttctacgacccagacagttccatagtgtacctgtgcgggaaaggagatagttctatccggtatttcgagattactgatgaacctccattcgtccactacttaaatactttttccagtaaagagcctcagcggggtatgggcttcatgcctaagcgagggctggatgtatctaaatgcgaaattgctagattctataagcttcacgagaggaaatgtgaacccatcattatgaccgttcctcgcaagtctgacctgtttcaggacgacctttacccggacaccccaggaccagagccagcactggaagcagatgaatggttaagtggccaggatgcggagcccgtgttgatcagtttgcgcgatgggtacgttcctccgaaacatcgcgaactgagagtaacaaagcgcaacattctggacgtcaggcctccctcgggtccacgaaggtcccaatccgcatcagacgcccctctatcccagcaacatactttggaaacactgctggaagaaatcaaagccttacgggagagagttcaagcacaggagcaacgcatcacagctcttgagaacatgctctgcgaactggtggacggtaccgactag

SEQ ID NO: 29291 - DNA, 2628 bp, Artificial Sequence
  Description of Artificial Sequence: Synthetic coding sequence
atgggtgattctgatgacgagtatgataggcgccgtcgggataagttcagacgggaacgcagcgactatgatagatcacgcgagagagacgagaggcggagaggggacgattggaatgatcgagagtgggatagaggacgcgaaaggcgaagtcggggtgagtaccgggactatgaccgaaacagaagggaaagatttagtccacctagacacgaattgagcccaccgcagaagcggatgcgtagagattgggatgagcattcttctgacccctatcacagtggttacgaaatgccgtacgccggtggcggaggagggcctacctacggcccaccacagccttggggccacccggacgtgcacatcatgcagcaccatgtgcttccgatccaagcccgtctcggctctattgccgaaatcgacctgggagttcctcctcccgttatgaaaacattcaaggaattcttactgtccctggatgatagtgtcgacgagacagaagccgttaagcgctacaatgattacaaactggacttccgtagacagcaaatgcaagacttttttctggctcacaaggacgaggagtggtttcgatctaaatatcaccccgacgaggtgggcaaacgaaggcaggaagccagaggagccctgcaaaaccgccttcgggtttttctgagtctgatggagactgggtggttcgacaacctgctgttggacattgacaaagccgacgccattgtgaaaatgttagatgctgctgtgataaagatggaggggggtaccgagaatgacttgcgaatactggaacaagaggaggaggaggagcaggccggaaagccgggagagcctagcaaaaaggaagaaggcagagctggggctgggctgggagatggagaaagaaagaccaatgacaaggatgagaagaaagaggatggaaagcaggcggaaaacgacagctcgaacgatgacaaaactaagaagtcagagggagatggagacaaggaggaaaaaaaagaggatagcgagaaggaagcgaagaagagctccaagaagagaaaccggaagcactcaggagacgactccttcgatgaagggtccgtgtcagagtcggagtcagaatctgagagcggacaggctgaagaggagaaggaggaagctgaggccctgaaggaaaaggaaaagccgaaggaggaagagtgggaaaagcctaaggacgcagccggtttggagtgcaaacctcggccactgcataagacctgctctttgtttatgcgaaatatagctcctaacatttcacgagcggaaattatcagtctatgcaagaggtatcctgggttcatgcgcgtcgcactgagtgagccccaaccagagagacgcttttttcgcaggggctgggtaacctttgatcgtagtgtaaacatcaaggagatttgctggaacctccaaaacattcggttgcgggagtgtgagttgtccccgggagtgaatagggacctaacacgtagagtgcggaacatcaacggcataacccagcacaaacaaatcgtaagaaatgacataaagctcgccgctaaactgatacacaccctggacgaccgtacccagctatgggcctctgagccagggacaccgccattgccaacgagcttaccaagccaaaacccgatattaaagaatataaccgactacctgatcgaagaggtgagcgctgaggaagaggagctgttggggtcatctggtggggctcctcccgaggaaccccctaaagagggtaatcctgctgagatcaacgttgaacgggacgaaaagcttatcaaggtgctggataagctcttattatacctaagaattgtccactctctcgactactataatacgtgcgaatatcccaatgaggacgagatgcccaatcgttgcgggatcattcatgttcgagggcctatgccacccaatcgcatttctcacggtgaggtgctcgagtggcagaaaacttttgaggagaagctgacaccacttctcagcgttcgggagagcctgtctgaagaagaggctcagaagatggggcgaaaggaccctgagcaagaggtggaaaaatttgtcaccagcaatacccaggagctggggaaggataaatggctgtgtcccctgtcagggaagaagtttaaagggccagagtttgtgcggaaacacatcttcaataagcatgccgaaaagattgaggaagtgaaaaaggaagtcgcgttctttaacaatttcctgactgatgcaaagcgaccagccctcccagaaatcaaacccgcacagccaccaggtcccgctcagattctccctccaggtctcacacccggtctgccttacccacaccagacgcctcaaggtctgatgccttacggccagcctcgaccccctatactagggtacggcgctggagctgtcagaccggcagtgcctactggtggtcctccctacccccacgcgccatacggggctggacggggtaattatgatgcttttcgtgggcagggtggttaccctggcaagccaagaaacaggatggtccggggtgatccccgagccatcgtcgagtatcgcgatctcgatgcacccgacgacgtggattttttctag

SEQ ID NO: 29292 - DNA, 816 bp, Artificial Sequence
  Description of Artificial Sequence: Synthetic coding sequence
atggcagctgtcgagaagagacgccaggcggtgcctccaccagccggatttacggactccgggcgtcaaagcgttagtagggccgcaggtgctgcagagtccgaagaggattttctgaggcaggtcggcgtgacagagatgttgcgtgccgcacttctcaaagtgctggaagctcgccctgaggaaccaatagccttcttggcccattacttcgagaatatggggctccgctcaccagttaacggcggtgccggtgagcccccaggtcagcttctgctgcagcagcagaggcttgggagggccctgtggcatctccgcctagcccaccacagtcagcgggcagcctttaataacaacgtgagcgtagcttacgaatgcctgtccgcaggcggtcggagaaagcgccctgggcttgacgggcgaacttatagcgagctccttcgtagaatctgccgggacggacaggcaccagaagaagtggtggccccactcttgcgaaaagtccagtgtcgagatcatgaggccgtgcctctgtcggtcttccgagcaggaaccttaacctgcttcgttttactggagtttgtggcaagagcaggtgccctgttccaactgctggaggattcagccgctgcagtggctgacagaagggtgggccaggccgtgcttgacacactggagggcgctctgcaggctagcgacgccgctgcgcctgctcggttcctggaggcagggtccagattggccccaatgacccgcgaagagttcctggagagggctgccgctctgttcatcgccaaagtgaagcctgttggttag

SEQ ID NO: 29293 - DNA, 1977 bp, Artificial Sequence
  Description of Artificial Sequence: Synthetic coding sequence
atgggaggacatctgtctccgtggcccacatatacctccggccaaactattctccaaaacagaaaaccttgcagcgatgattaccgtaagcgagtggggtcatgtcagcagcacccttttaggactgcaaagcctcagtaccttgaagagctggagaactacttacgtaaagagcttcttctgctcgatctcggaacggactcaactcaagaactgcggttgcagccgtatcgcgagattttcgagttctttatcgaggattttaagacttacaagccactgctgagcagtatcaagaacgcctatgagggaatgctggcccaccagcgcgagaagatcagggcactggagccccttaaggctaaactcgtcaccgtgaatgaagactgtaatgagagaatcctggccatgcgcgctgaggaaaaatatgaaataagcctgctgaaaaaggagaaaatgaatcttctgaagttaatagacaagaaaaatgaagagaaaatctctctgcaaagtgaggtgactaagttgagaaagaatctcgccgaggagtaccttcactacctgtccgaaagggatgcgtgtaagatcctcattgcagacctgaacgagctccggtaccagagggaggacatgagcctggctcagtcacccggtatttggggagaagacccagttaaacttaccctggcactgaaaatgactaggcaagatcttaccaggacacagatggagctaaataacatgaaggcaaacttcggggacgtcgtcccaagacgagattttgagatgcaggaaaagactaacaaggacttgcaagagcaactcgacacactccgggcttcctatgaggaagtgcgcaaagagcatgagatccttatgcaactgcacatgagcactctgaaggaacgagaccagttcttcagcgaactgcaggagatacagaggacctctactcctaggccagactggacaaagtgcaaagatgtggtcgccggaggcccagaacgctggcagatgcttgctgaggggaaaaatagtgaccagttggtggatgtactactggaggaaattggcagcggactcctgagagagaaggattttttccccggtttggggtacggagaggccatccccgctttcctgcgattcgacgggcttgtggaaaataagaaaccatctaagaaagacgtcgttaatctcctgaaggatgcctggaaagagagactggccgaggagcagaaggagaccttccctgatttcttctttaactttctcgagcaccgctttggccctagtgatgccatggcctgggcctacactatattcgagaatattaaaatctttcattccaatgaggtgatgtcacaattctatgctgtgctgatgggcaaaaggtccgagaacgtgtatgtcacgcagaaggagacagtcgctcagctgttgaaagaaatgaccaacgcggacagtcaaaacgaagggttgctcacgatggagcagttcaacacagtactgaagtcaacgttcccactcaaaacagaggaacagatacaagaactcatggaagccggaggttggcaccccagctcttctaacgcagacctgctgaactatagaagtttgttcatggaggacgaagagggccagtcagaaccattcgttcagaagttatgggagcagtatatggatgagaaagatgagtatctgcagcaacttaagcaggagctgggcatcgagctgcacgaggaagttacactaccaaaactgcgcggagggctgatgactatcgatcctagtttagacaaacagactgtcaacacctatatgtctcaagcatttcaattgccggagtcagagatgccagaagagggcgacgaaaaggaagaggcagtggtggagatactgcagactgctctggagaggctccaagtgatagacatcagaagagtgggaccgcgtgagcccgagccagcctcatag

SEQ ID NO: 29294 - DNA, 1287 bp, Artificial Sequence
  Description of Artificial Sequence: Synthetic coding sequence
atggagcccctcaaggttgaaaaattcgccaccgccaagcgtggcaacggcttacgagcagttaccccactgagacctggagaacttttgttcaggagcgacccattggcgtacaccgtctgtaagggttcccggggtgtggtctgcgatcgctgccttctgggcaaagagaaactcatgcggtgctctcaatgccgggtggcaaaatactgctcagcaaagtgccagaagaaagcatggccagaccacaagcgtgaatgtaaatgtctgaagtcctgcaagccaaggtatccgcctgatagcgttagactgttgggtcgggtggtgttcaagttgatggatggcgcaccgagcgagagtgaaaagctttatagcttttatgatctggaatcgaacattaataagctcacagaggacaagaaagagggcctgcggcaactggtaatgacatttcaacacttcatgagagaagaaattcaggatgcatcccagcttccccctgcattcgatctgttcgaggcttttgcaaaagtaatctgtaacagcttcaccatatgcaacgcagaaatgcaggaggtgggggtgggcctttatcccagcatttctctgctgaaccactcttgtgacccaaattgttcgattgtgtttaatggccctcatctcctcctgagggccgtcagagacattgaggttggcgaagagttaaccatttgttacctcgatatgctgatgacaagcgaggaacggaggaaacagctgcgtgatcagtactgttttgaatgtgattgtttccgatgccaaactcaggacaaggacgctgatatgcttacaggtgatgagcaggtctggaaggaggtgcaggaatccttgaagaagattgaggagttgaaggcgcattggaaatgggagcaagtcttggcaatgtgtcaagctatcatttctagcaatagtgagcgtttgcctgatattaacatttaccagcttaaagttttggattgcgccatggacgcgtgtatcaacttaggcttgctcgaggaggctttgttttacgggactcgaaccatggaaccttataggatttttttccccggaagccatcctgtccgcggagttcaagtgatgaaggtgggtaaattacagttgcaccagggaatgttcccacaggccatgaaaaatctaaggttagcctttgacatcatgagggtgacacatggacgggaacactccctcattgaggacttgattttgcttctagaggaatgtgacgcaaacatccgggcttcctag

SEQ ID NO: 29295 - DNA, 1122 bp, Artificial Sequence
  Description of Artificial Sequence: Synthetic coding sequence
atgagttccggcaattatcagcagagtgaggcgctctcaaaaccaacatttagcgaggagcaggcatctgctctggtggaatcggttttcgggttgaaagtttcaaaagtgcggccattgcctagttatgacgatcagaacttccatgtgtacgtttccaaaaccaaagatggcccaactgagtacgtgctaaaaattagcaacaccaaggccagtaagaatcctgatctaatcgaggtgcagaaccacattatcatgttcctgaaagcggctggcttcccgactgcctccgtctgccatacaaaaggagacaacaccgcctccctggtgtcagtggattcggggtctgagatcaagtcatatcttgttcgcctgctgacctatctgcccggaagacccatcgccgaactccctgtctctcctcagctcctttatgagataggaaagcttgctgcgaagctcgacaagaccctgcaacgctttcaccatcctaagctgtctagcctgcatcgcgagaatttcatttggaacctcaagaatgtgccccttctagaaaaatacctgtacgcattgggacagaatcggaatcgggaaattgttgagcacgtgatccatctgttcaaagaggaagtaatgacaaagttatcccatttccgggagtgcattaatcatggagacctgaacgaccacaacatcctgattgagtcttctaaatcagccagtggcaacgcagaatatcaagtcagcgggatcctggatttcggagatatgagttacggctactatgttttcgaggtggccataacaattatgtatatgatgatagaatcaaagagccccatccaagttggtggccacgttctggcaggatttgagagcatcacccccctgacagccgtggaaaagggcgctctctttctgttagtgtgttctagattctgtcagagcctggtaatggcagcatacagttgtcagctgtaccccgagaataaggattacttgatggtcactgcaaagaccggctggaaacacctccaacagatgttcgacatgggccaaaaggcggtcgaggaaatttggtttgaaacggccaagagctatgagtccggtatcagcatgtag

SEQ ID NO: 29296 - DNA, 2766 bp, Artificial Sequence
  Description of Artificial Sequence: Synthetic coding sequence
atggcacttctgtgcggactggggcaggtcacattgcggatctgggtgtccctacccagtcaaagcgaaaatgggataggaagcggcggtatggaggcgctgaccacccaactcgggcctgggagagagggtagctccagtccgaactcaaaacaggagctgcagccgtactcaggcagcagcgctcttaaaccaaaccaggtgggtgaaacctccctctatggcgtgcccattgtctctctggtgatagacggccaagaacgactgtgcctcgctcaaatttctaacaccttactcaagaattactcctacaacgagatccacaatcggagggtggccttaggcatcacttgtgtgcagtgtacccccgtgcagctggagattctgcgtcgggctggagccatgccaataagctccagaagatgtggaatgattacaaaacgagaggcggagagactttgtaagagtttcttaggggagcataagcccccaaagttacctgaaaactttgcctttgatgtggtgcatgaatgcgcttggggctccagaggatcgttcattccagcacggtataattcgtctcgcgctaaatgcattaaatgcggttattgctccatgtacttctcgccaaacaagtttatatttcacagtcaccggacacctgacgctaaatacacccagcccgatgcagccaacttcaatagctggaggaggcacctcaagttaagcgacaagagcgcgactgacgagttgtctcatgcatgggaggatgtcaaagcaatgttcaatggcggaacccgatgcggagccgaaatggcgcctggaccccctccccacaaatccctgcggtgtggggaggacgaggccgctggtcctcccggtccacccccaccacacccacagaggggtctcggactggccaccggcgcatcaggcccagctggacctggtggaccagggggaggcgcaggagtacgctcatatcccgtgattcctgtcccgtcaaagggcttcggcctgctgcagaagctcccaccacctctgtttccccacccatatgggttccccacggccttcggcctgtgtcccaaaaaggacgaccctgtgctcggcgcaggggagcccaagggcggacctgggacgggctccggcggtggaggcgcaggtactggtggtggggctgggggacctggcgcttcccacctgccaccaggcgcaggggctggcccagggggaggggctatgttctgggggcaccagccatctggagccgctaaagacgcagctgcagtggcggcagcagccgcagccgctaccgtctatcctactttcccaatgttctggcccgctgccggatctctgccagttccctcgtatccagctgctcaaagccaggcaaaggcggttgctgcagccgttgccgctgctgccgctgctgcagccgctgcagctggaagcggcgctcccgaacccctggacggtgcagagccagccaaggaaagtggactgggtgccgaggagcgctgcccctccgcactgtcccggggaccgctcgacgaggatgggactgatgaagccctaccccctccgttggcaccactgccaccccctccccctcctccagcgaggaaggggtcctacgtgtccgcatttcgaccagtggtgaaggataccgagtccattgccaaactgtatggctctgctagagaagcatacggcgctggacccgctcggggacctggccctggagccggttcggggggttatgtgtctcccgatttccttagtgaggggtccagctcatataactctgccagccctgatgtggacactgccgacgaacctgaggtggatgtggaaagcaatcggtttcccgacgatgaggatgctcaggaggaaactgagccttccgcgccatccgcaggcggaggacctgacggtgaacaacctacaggccctccttccgccacttcttctggcgctgatggccctgcaaacagtccagacgggggtagccccagaccaaggcgcagactgggtcctccccctgctggcagacctgcattcggagatctggcggctgaggatttagtgcgacgacctgagcgctccccaccaagtggtggcggtggatacgaactgcgggagccctgcggcccactcgggggtccagcccctgccaaggtgtttgctccagaacgggacgaacacgtaaagtccgctgctgtggccttaggacccgctgcaagctacgtttgtacccctgaggcccatgagcctgataaggaggacaatcactcaccagctgacgaccttgagaccagaaagtcctatccggaccagaggagtatcagccaaccttctcccgctaacactgatcgtggcgaggacggactgactcttgatgtgactggaacccacctggtggaaaaggacatcgagaacctcgcacgcgaagagctgcaaaaactgctgctggagcagatggagctgaggaaaaagctggagcgggaatttcagtctctaaaggataacttccaggaccaaatgaagcgtgagctggcatacagggaggagatggtgcagcagctccagatcgtgagagacaccctctgcaacgagctcgatcaagagcgcaaggctcgttacgcaatccaacaaaagttgaaagaggctcacgacgccctgcatcattttagttgtaagatgctcactcccaggcattgtactggaaactgttctttcaagccacccctactgccttag

SEQ ID NO: 29297 - DNA, 1395 bp, Artificial Sequence
  Description of Artificial Sequence: Synthetic coding sequence
atggctatgacagcgggaactaccactactttcccaatgagcaatcacacccgagagagagtcaccgtcgctaagctcaccctggaaaatttctatagcaatctcattctgcagcacgaggaacgagagacgcgccagaaaaaactcgaggttgccatggaggaagaggggctggcagatgaggagaaaaagctccggcgatctcagcatgctcgcaaggagacggagttcctccgcctcaaacgaactcgattaggactggacgactttgaatctctaaaggttatcgggaggggagcatttggggaagtccgtttagtccagaaaaaggacacagggcacatttatgcaatgaaaattctcaggaagtcggacatgctagagaaagagcaagttgcacatattcgcgcagaaagggacatcttggtggaagccgatggcgcatgggtagtgaagatgttctatagcttccaagacaaacggaatttgtacctaataatggaattcctgccgggtggtgacatgatgacactgctcatgaagaaagatactctgaccgaggaggaaacccagttttacatctccgagaccgtcctcgctatcgacgcaatccaccagcttggattcattcaccgcgatattaagcccgacaatctgctgctggatgctaaaggccacgtaaagctgtccgatttcgggctgtgcactggtctcaagaaggcacacagaaccgaattctatcgcaatctgacacacaatccgccatccgatttctcatttcaaaacatgaactcaaagcgcaaagccgaaacttggaaaaagaaccggagacaactcgcctacagtaccgtggggacaccagattatatcgcccctgaggtgttcatgcagacaggctacaacaagttgtgcgattggtggagcctgggcgtgattatgtacgaaatgctgattgggtaccctccattctgtagtgagactccccaggagacttatcggaaggtgatgaattggaaagagaccctggtcttcccaccagaagtccccatctctgaaaaggcgaaggatctcattctgcgcttctgcatcgactccgaaaatagaattgggaactccggcgtagaggaaatcaaggggcacccctttttcgaaggagtagactgggaacacatcagagaacgcccagccgcaatccctattgagattaagtctattgatgatacctccaacttcgatgattttccggagtctgacattctgcaacctgtgcccaacaccactgagccggactacaaatcaaaggattgggtcttcctgaactatacttacaagcggttcgagggcctgacccagagaggatccatcccaacttatatgaaggcaggcaagttgtag

SEQ ID NO: 29298 - DNA, 3951 bp, Artificial Sequence
  Description of Artificial Sequence: Synthetic coding sequence
atggcctccaagggggctggaatgtcgttttccaggaaatcctaccgcctcacatctgacgccgaaaagagtcgggtgactggtatagtgcaagaaaaactgctaaatgactaccttaataggatcttctcatctagtgaacacgctccaccggctgccacgagccgtaagcccctgaactttcagaacttaccagagcaccttgaccagctgttgcaagtggataatgaagaagaggagtctcaaggccaagtcgaaggaagactgggcccttccactgtcgttttggaccataccggagggttcgagggcctgttactggtcgacgacgaccttctcggcgtgattggtcatagtaattttggaacaattcgaagcactacctgcgtctataaagggaagtggctctacgaagtgttgattagctcacagggactgatgcagattggctggtgcacaatttcctgccggtttaaccaggaggaaggcgtgggagatacccacaattcctatgcgtacgatggcaatcgagtccggaagtggaatgtcactaccacaaattacgggaaagcttgggcagccggagatatcgtctcctgcctgatcgacctcgatgacggaaccctgtctttctgcctcaacggggtttccctggggactgcctttgaaaacctatctagaggcttgggtatggcttacttcccagctatctctttatccttcaaagaatcagtcgcattcaatttcggatcccgacccctccgctacccagtcgctggctacaggccactccaggaccctccgtctgctgacctggtgcgtgcccagaggctgctcggctgttttcgggcagtcctgtctgtcgagctcgaccctgttgagggacggctgctggataaagagagctcaaaatggaggcttagagggcagcccacagtgttgcttacactggcacacatctttcatcactttgccccattgctgagaaaggtgtatcttgtggaggccgtgctgatgagttttctcttgggtattgtggaaaaagggacacctacgcaggcgcagtccgtggtgcaccaggtcctggacctgctgtggctgtttatggaggactatgaggtgcaagactgtctgaagcaattaatgatgagcctgcttaggttgtatagattcagtcctatcgttccagatttggggctgcagatccactacttgcggttaacaattgccatcctccgtcacgaaaaaagcagaaagtttctcctgtccaatgtgctgttcgatgtgcttagatctgtggtcttcttctacattaagtctcctttacgagttgaagaggcaggactccaggaattaattcctaccacttggtggccccactgctcatcgagggagggcaaggaatccacggagatgaaagaggagacagccgaagaaaggttacgtcggagagcttatgagagaggatgccagagattgcggaagcggatcgaggttgtcgaggaactgcaagtgcagattctcaaacttctgctggataacaaggatgacaacggcggagaggcctctcgttatatttttctgactaaattccgcaagtttctccaagaaaacgcttctggcagaggaaatatgccaatgctgtgcccacctgaatatatggtatgctttctgcacagactgatatcggccctaaggtactactgggacgaatacaaagcatccaaccctcatgcgtcctttagtgaggaggcttatatcccccctcaggtgttctataatgggaaggtcgactactttgacttgcaacggcttggcggactgctgagccatctgcgaaagactcttaaagacgacttagcctccaaggcaaacatcgttattgatcctttggaactgcagtcaactgcgatggatgaccttgatgaggacgaagagcctgcgccagcgatggcccaaaggccgatgcaagctcttgccgtcggagggcctcttccactgccccgtcccggatggctttccagccctacactggggagagccaataggtttctgtcaactgcagccgtctcgctgatgactcccagaagacccctgtctacttcggagaaggtcaaggtgcgtaccctcagcgtagagcagcgaactagagaagacatcgaaggcagccactggaatgaagggcttcttctagggcgaccaccagaggagcccgaacagcctttgactgaaaattcgctgctggaggtgctggacggagcggtgatgatgtataatttgtcagtacatcagcagctgggaaaaatggtgggtgttagtgacgacgttaacgaatacgccatggctctgagagatacagaagataaactccgcaggtgtcccaaacgacgtaaagatatactcgcggagctgacgaaaagccaaaaagtgttttcagaaaagctggatcatttgagcagacgactggcttgggtgcatgccactgtgtatagccaagagaagatgctggatatatactggctcctcagagtctgcctcaggacgatcgagcacggcgacagaacaggtagcctgttcgcctttatgccagaattttatttatccgtagctatcaacagctactccgctcttaagaattatttcggcccagtgcacagtatggaagaattacctggatacgaggagactctcacgcgcctggcggcaatattggccaagcactttgccgacgcgcgtattgttggaaccgacataagagattccctgatgcaagctctcgcaagttatgtctgctatcctcactcactgagggccgttgaaaggatccctgaagaacaacggatcgcaatggttagaaacctgctggccccatacgagcagcgcccatgggcacagacaaactggatccttgtccggctctggcgtggatgcggcttcggttacaggtataccagacttccccaccttctgaaaacaaagttagaggacgccaaccttccttccttacaaaagccttgcccatccaccttgttgcagcagcacatggccgacctgcttcagcaggggcctgacgtcgcgccatcattcctgaactccgtcctgaatcagctcaactgggctttctctgaatttattggcatgatccaagagatccagcaggcagccgaacgcctagaacgaaactttgtcgacagcagacaacttaaagtgtgcgctacatgtttcgatctgtcagtctcattgctcagagtgctcgaaatgaccatcacactggttcctgaaatctttcttgactggactcgacctacatccgaaatgcttctgaggcgacttgcccagctgcttaatcaagtcctcaaccgtgtgactgctgagcggaatctcttcgaccgtgtggtgaccctgagactacctggcctggagagcgtcgaccactatccaatcctggtggccgtcacaggaatccttgtccagctcctggtgcgcggacctgccagtgaacgcgaacaggctaccagcgtgctgctggctgatccatgcttccagctgcgatcaatttgttacttacttggtcaacccgaacctccggctcccggaacggccctgcccgcaccggaccgcaagcgtttcagtctgcagtcctatgccgattacatctccgctgacgagcttgcccaagtcgagcagatgctggcacacttaacatcggctagcgcccaggccgcagccgctagtttgcccacctctgaggaggacctgtgcccgatttgttacgcgcatcctatctccgcagtgttccagccttgcggtcataaaagttgcaaggcgtgtatcaaccaacacctgatgaacaacaaagattgttttttttgcaagacaactacaagcaatctattggcctgcctatatcctcactggtgggagccttcccacggacccaactgtgcttag

SEQ ID NO: 29299 - DNA, 2043 bp, Artificial Sequence
  Description of Artificial Sequence: Synthetic coding sequence
atgccaagcgtcagtaaagccgcagctgccgcacttagtggaagtccgcctcagactgaaaagcccacccattaccgctatctgaaggagttcaggacggagcagtgtcctctgttcagtcagcataagtgtgcgcagcaccggccattcacttgtttccactggcactttctgaatcaacgtcgaaggcgcccactgcggaggcgggacgggacatttaattattcaccagacgtttactgcagcaagtataatgaagcaacgggggtttgtcccgatggcgatgagtgtccctatctgcatcgaacaactggggatacggagaggaaataccaccttaggtactacaagaccggcacctgtatacatgaaacagacgccaggggccattgcgtaaaaaacggactacattgcgcatttgcccacggacctttggatctgcggccaccggtatgtgacgtccgagaactgcaagcacaggaggccctccaaaatggccagctgggaggaggcgaaggtgttcctgatctgcagcctggcgtgcttgcttcacaggccatgatagaaaagatactgtccgaggatccacgctggcaggatgccaactttgtgttgggcagttacaagaccgaacagtgtcctaaaccccctcgcttgtgtaggcaggggtacgcttgcccgcattaccataatagccgggatcgacgtcgcaatcccagacggttccaatacagatccacaccatgtccaagcgtgaagcatggcgacgaatggggggagcccagcagatgtgatggaggcgacgggtgccagtactgccatagcaggaccgaacagcagtttcacccggaatccacaaagtgtaacgacatgcgccagaccgggtattgcccacgcggaccattttgtgccttcgcacacgtggagaagtcacttgggatggtgaacgagtggggctgccacgacctgcacctcacaagcccgtcctccaccggctccgggcagccaggtaacgccaaaagaagagactcccccgctgaggggggaccaagagggtccgaacaggactcaaaacagaaccatctggccgtatttgccgctgtgcacccccctgccccatctgtctcatcttcagttgcgagttcattagcttcctccgctggttctggatcctcaagtcctaccgctttgccagcacccccagccagggccctccctctcggaccagctagttccaccgtggaagctgtattgggctccgccctagatttgcacctgtccaatgtcaatattgcttctctggaaaaggacctcgaagagcaagatggccacgatttaggcgcagcaggccctcgctcactggccggttctgctccagtcgcgattcctgggagcctgccgagagctccgtcactccattccccttccagtgcttccacttcgcctctggggagcctgtctcaacctttgcctggacccgtgggaagctcagccatgacccctccccagcagccacctcctttgcgctccgaacccggaaccctcggctcagctgcttcctcctactccccactgggcctgaatggggtcccaggatcaatctgggattttgtgtctgggtccttctccccttcgcccagtcctatcttgtccgctgggcctccctccagttcatctgcctctccgaacggcgcagagcttgcacgcgttcgtcgccagttagacgaagccaaacgaaaaatacgacagtgggaagaaagctggcaacaagtaaagcaggtatgcgatgcttggcagcgggaagcacaggaagctaaggaacgggcacgtgtggctgacagtgataggcagctggcattgcagaaaaaagaggaggtcgaagcacaagtcattttccagctgagagccaaacaatgtgttgcttgtcgggaaagggcgcacggcgctgtactacgaccctgccagcatcacattctttgcgagccctgcgccgctacagcccctgaatgcccctattgtaagggacagcccctccagtggtag

SEQ ID NO: 29300 - DNA, 462 bp, Artificial Sequence
  Description of Artificial Sequence: Synthetic coding sequence
atgtcttcacctctggcctctttgtcaaagaccaggaaagtgccactgccatccgagcccatgaatccaggaagacgcggtatcaggatctatggagacgtgcccgcttcccacgactcagagttgatggccttcatgacccggaagctgtgggatctggaacagcaagtgaaggctcagacagacgagatcctgtctaaagaccagaagatcgctgctttggaggatctggtccagacgctaagaccccatccagccgaagctactctccaacggcaagaggagcttgaaaccatgtgtgttcagcttcagcgtcaggtgcgggagatggagagattcttgagcgattatggcctccagtgggtgggtgagcccatggatcaggaggacagcgagtctaagactgtaagcgagcacggtgagcgtgactggatgactgccaagaagttttggaagccttag

SEQ ID NO: 29301 - DNA, 2382 bp, Artificial Sequence
  Description of Artificial Sequence: Synthetic coding sequence
atggggcagtgttacaacctggaggacgacgacctggagacggacgtaaacaagctctctagtaaacctggcctggatcgacccgaggaagaactgatgcagtatgaagtcatgtgtctcgagttgtcctactctttcgaggaactgcagtcgaagttaggagatgatcttaactctgagaagacccagtacgccaaccaccaccacatcccagcagcagcttcgagcaaacaacactgctattcgaaggatcaatcaagctgcggacaagaacgagagtacgcggtccagacttccttgctgtgcagggttaaaactggacggtcgaccgttcatctgggctccaagaaaaatcccggagtgaacttataccagaatgtccagagcaatagcctgaggcgcgatagtagcgagtccgagattccggacatccaggcttcacctaaagccgatgcctgggacgtagatgccatcttctgcccacgcatgagcgcctcgttttcaaactcgacccgaacaagagaagtggtcaaggtcattgataaacttcttcaaactcacctcaaaagagtaccattccatgacccatacttgtacatggcaaaggctaggcgtacctcctcagtggttgactttaaaatgatggcattccccgacgtgtggggacactgcccaccgccaactacacagccaatgctcgagagaaagtgcggtgtgcagagaatccgcatattcgaggacattcggagattgatacaaccaagcgacgtcattaacaaggttgtcttctcattggacgaaccctggcccctgcaggataatgctagcaattgtctgcgattcttctctaaatttgaatccgggaacctgcggaaagcgatccaggttagagagtttgagtatgacttgctggtgaacgcagatgttaattccacccaacaccagcagtggttctattttaaggtcagcggtatgcaggccgctatcccgtatcattttaatatcataaattgcgagaagcctaatagccagtttaactacgggatgcaacccaccctgtatagtgtaaaagaggcattgctggggaagcccacatggatccggaccggacacgaaatttgttactacaaaaatcattacagacagtctactgccgtcgccggtggcgcttctggaaagtgttactatacattaacttttgctgtgacatttccccattcagaagatgtgtgttacctcgcgtatcactacccttatacttataccgcactcatgacccacctcgatatccttgagaaatccgtcaacctaaaggaagtgtatttccggcaggacgtactgtgccagacgctcgggggtaatccttgtcctcttgtgaccatcaccgctatgcccgaaagcaacagcgatgaacacctggaacagtttcggcataggccgtatcaggtaattaccgcacgggtacacccaggtgagtccaatgctagctgggtcatgaagggtactctggagtttctggtgagtagtgacccggtggccagactcctccgcgagaatttcattttcaagataattcctatgttgaatcctgacggtgtgattaacggcaatcaccgatgctctctatccggcgaagacttaaacagacagtggctttctcctagcgcccatttgcagcctactatttatcatgccaagggattgttgtaccacctgtcctctatcggaagatctcccgttgttttctgcgactttcacggccatagccagaaaaagaacgttttcctgtatggttgttccattaaggaaactctgtggcaggccgcttgcaccgttgggacatcaaccatcctagaagaggtcaactaccggaccctaccaaagatccttgacaaactggcacctgccttcacaatgagcagctgctccttcctggtggaaaagtcccgtgcttccaccgctagggtggtcgtgtggcgcgagatgggagtctccagatcttataccatggagtccagttactgcggttgtaaccaggggccataccaatgtactcagcgcctactggaacggactaagaatgagcgggctcaccctgtggacggactacagggattgcaattcggaacccgagagctcgaggagatgggggcaatgttctgcctcggactcctcatactcgagctgaagtcagctagctgttcacatcagctgttggcacaggctgcgacgctcttatccgcagaagaggatgctctggaccaacaccttcaacggttgaagtcgagtaatttcctcccaaaacatatttggttcgcataccacttcttcgcgatcacaaattttttcaaaatgaacctattacttcatgtttcaccctag

SEQ ID NO: 29302 - DNA, 153 bp, Artificial Sequence
  Description of Artificial Sequence: Synthetic coding sequence
atgatgcaaaacgtccaccttgcaccagaaaccgatgaggatgacctgtattccggctataacgattataatccaatttacgacattgaggaactggagaacgatgccgcattccaacaggccgtgcgtacttctcatggaagacggccttag

SEQ ID NO: 29303 - DNA, 1299 bp, Artificial Sequence
  Description of Artificial Sequence: Synthetic coding sequence
atgaccgctgtgcgggctgcgggtttcacgaaggccgctctcagaggttcagcgtttgatcccctgtcacagtcgcgaggcccagcgtctcccctggaggccaagaaaaaagacagtcccgaagaaaagatcaagcagttagagaaagaggtgaacgaattggtcgaggaatcatgcatagccaactcctgtggggacctgaagttagccttagagaaagccaaggatgctggtagaaaggaaagggtccttgtgcggcaaagagagcaggtgaccactcctgagaacattaacctcgacctcacatattctgtgctgttcaatctcgcaagccaatatagtgttaatgagatgtacgcggaagcgcttaacacctaccaagtgatcgtcaagaacaaaatgttttcgaatgccggaattttaaaaatgaatatgggaaacatttatctcaaacaacgcaattactcgaaggctatcaaattttaccgcatggctctggaccaggtcccttctgtgaacaaacagatgcgcattaaaatcatgcaaaacattggggttacatttattcaggcggatagggaaaaaatgaaaaaggccttccagaaactgatcactgttccccttgaaatagacgaggacaagtacattagcccatctgacgacccccataccaacttggtcacagaagcgattaagaacgaccatctgagacagatggagcgcgaacggaaggccatggccgaaaaatacatcatgacctctgccaaactaattgccccagtcattgagacctcttttgccgcagggtatgactggtgtgtcgaggttgtgaaggcctctcagtatgtcgaactggccaacgatctggagatcaataaggccgtcacctacctgcgccagaaagattacaatcaagctgtagagattcttaaagtgctcgagaaaaaagactcacgtgtgaagagtgccgctgctacaaacttgagtgcactgtactacatgggaaaagacttcgcacaggccagtagttatgcagacattgctgtgaattccgaccggtacaatccagctgcattaacaaacaagggcaatactgtgttcgccaacggagactatgagaaggctgctgagttctacaaagaagccttgaggaatgattcgtcatgcaccgaagccctctacaacattggactgacatatgagaagctgaatagattagatgaggctctggactgcttccttaagttgcatgccatcctgaggaactccgccgaggtcctgtaccaaattgctaattag

SEQ ID NO: 29304 - DNA, 387 bp, Artificial Sequence
  Description of Artificial Sequence: Synthetic coding sequence
atggcagctgctgccgcagagcagcagcaattttacctgcttctgggaaacctcttgagtcctgacaacgtggtgcgaaaacaggcggaagcaagacaaatggctgctgttctcctacgtagactgctgtccagtgcgttcgacgaagtatatcccgctctgccttcagacgtacagacagcgattaaaagcgagctcctgatgatcatccagatggaaactcagtcctctatgcgaaagaaggtttgtgatatcgcagcggaactggcgaggaatctaatcgatgaggacggaaacaaccaatggccagaaggactgaaattcctgtttgactctgtgagttcccagaacgtggggcttagagaagccgcactgcacattttttag

SEQ ID NO: 29305 - DNA, 2766 bp, Artificial Sequence
  Description of Artificial Sequence: Synthetic coding sequence
atgagaccagaaggagctggaatggagctaggagggggagaagagcgtctacctgaggagagcagaagagaacactggcagctgcttggcaacctgaagacgacagtcgagggcctcgtctctacaaattctccaaacgtgtggtcgaaatatggcggtctggaacggctgtgcagggatatgcaatccatcctgtatcacggcttgatccgcgaccaggcttgccggaggcagacagactattggcaattcgttaaagacatcaggtggttatccccccactctgccctccacgtggaaaagttcatatcagtgcacgagaacgaccagagttccgctgacggcgcttctgagcgcgcagtggcggagctgtggctccagcattccctgcagtaccattgcctgtctgcccagctccgccctctacttggtgacagacagtacatacgcaagttctacacggacgctgctttcctgctcagtgatgctcacgtgacggctatgctgcagtgcttagaggcggttgagcagaataacccgagattgttggcgcagattgatgcttctatgttcgcgcgaaagcatgaaagcccgctgttggttacaaaaagtcagagtctcacagctctgccttcctctacctatactccaccaaattcatacgctcagcatagctatttcggatcattctctagcctccatcagtcagttcctaataatgggtcagagcgccgaagtacttctttcccgctgagcggcccaccacgcaagccccaagagagcagggggcacgtatcaccagccgaagaccagacaatacaggccccacctgtgtcagtttccgctcttgctcgcgatagccccctgactcctaacgagatgtcatcatccactttgacgagtccaatcgaagcctcctgggtgagctcgcagaacgacagccctggcgacgcctcagaggggcctgaatacctggcgattggtaacctcgaccctagaggcagaacagcatcatgtcagtctcacagctcaaacgcagaatcctcaagttctaatctattctcctcttcttcttcacaaaagccggactctgccgcatcgagtctgggagaccaggaagggggaggagagagccagttatccagtgtgctacggagatcctcatttagcgaggggcaaactctgaccgtcacttctggggcaaaaaagtcacatataagatctcacagtgatactagcattgcaagtcgcggtgcacctgaaagctgtaatgataaggctaagctgcggggacccctgccgtactcaggccaatccagcgaggtctctactccttcctcactttacatggagtatgaaggaggcagatacctctgcagtggcgaaggcatgtttaggagacctagcgaaggacagtcgctaatcagttacctgtctgagcaggattttgggagctgcgccgatctcgaaaaagaaaacgctcatttttcaatatctgaaagcctgatcgccgctatcgagctcatgaaatgcaatatgatgtctcagtgcctcgaagaggaagaggtggaggaggaagatagcgatagggagatccaagagctcaaacagaagattcggcttcggaggcagcaaatcagaaccaagaatctgctcccaatgtatcaggaggccgagcacggctcatttagagtcacctctagtagcagccagttttcctcaagggactctgcccagttatctgacagcggatcggctgatgaagtggacgagttcgagatacaagatgggagcgagggctcaaacttaactcatattagcaagaatgggctctccgtcagtcttgccagcatgttctcggatgccgatatccggaggaacacggcctcttccagcaaaagtttcgtaagttctcagtcattttcccactgcttcctgcacagcaccagtgccgaggcggtcgccatgggtctcttgaaacaatttgagggcatgcagctgcctgccgcaagcgaactggagtggctggtgccagagcacgacgctccgcagaagttgttgccaattcctgattctctcccaatctcccccgatgatggccaacatgcggatatctataagttgcgcataagggtgcgagggaacctggagtgggccccacctcgaccccagatcatttttaacgtccaccccgctccaacccgcaaaattgcggtcgcaaaacagaactataggtgcgctgggtgcgggattagaacagatcccgactacatcaagcgcttgcggtattgcgaatacttggggaagtacttctgtcaatgctgccacgagaacgcccagatggccattccatctcgcgtgcttagaaagtgggacttctctaagtattatgtttctaatttctccaaagatctgctgattaaaatttggaatgacccactgttcaatgtgcaggacattaatagtgccctgtatagaaaggttaaattattaaatcaggtgcgtctgttacgcgtgcaactctgccacatgaaaaacatgttcaaaacttgtcgactggctaaggaactcctggacagctttgatactgtcccaggacacctgactgaagaccttcatctgtattccctcaacgatctaaccgccaccaggaagggggaattgggccctcggttagctgaactaacgcgagcaggcgctactcatgtggagagatgcatggtgagaaagtctcactgctccatgcaactttccccctgcttctag

SEQ ID NO: 29306 - DNA, 1644 bp, Artificial Sequence
  Description of Artificial Sequence: Synthetic coding sequence
atgagagcactgactgtccagcgcgttaaattcgccatggatttgcccctgctgaagcgtgctgggcaggacctcgccgagaagaccaaaaatttcgtgtccagaagtctggtcatcggtgaggtgcttagtatggctgacatggcgaccggcgttaagtgtggaattatatactggctcttcggcggagccatccgtaacctggggagccccgaacacgtaacaaaatggttccagcctctgcaagagcagaagtacaccgggatgttcgctatgacagagcgtggccacgggagcaacgccagaggtattcagaccgaggccaccttcgatctctccgctcaggaattcgtaatcgataccccgtgtgaaaacgctgagaaaatgtatattggaaacgccatgtatggtaattacgctgccgtctttgctcagctgattatagatggtcgctcgcagggcccacattgcttcattgtccctgtgcgagacgagaacggctctttgtatcccggtgtaaccgcgattgatatgatgtataaagagggtctacacggagttgataatgggatcttgatcttcgataaagtacggatcccccgtgaaaatctactggacaagtttggctctgtcgccccagatggccagtatcacagcccaattcggaacaaaagcgcccgtttcaacgctatgctagcggcactcactccatcccgcctggccgttgcctttcaagccatgggggcaatgaagttaggtttaacaatcgccattcgctactcacacagccgaagacagtttggacccaagaccaaagaggaggttaaaatcatcgaacaccagacacaaacgttgaggctaatgccgcatctcgcgacggccctggctcttaccttcgtgagtcgttatgccggtgcactcctggatgaggacgtttttcaggggaaagagcttgtgaattcgaggagtctccaggcacttgtggctggacttaaagcgtatagtacatgggagaacattcgttgcctgcaggattgccgggagtgcaccggaggtatgggctacatgatggagaatcggatttcagggctgaagtgtgatactgatgtgttcgctaccttcgagggggacgatgttgtgatgctgcaggtggtcgggagggagttgttggctcagtacaccaaacagtacgaggagaaacccctctttggactactgcagaattgggcggaaagcgttggtgacaaactccgcacttcatttctggcttttaacatggacactgtggacgacctggcatttctcttgaaagctgtgaaattccgagaacgggtacttcagcggggactcgtggccagaatttattataaagtcaaaaccaagaaagaggacttctttcatgcctggaattcttgtcttcatcacgtggcctctctgtcacttgcacatacccaccgcgtgacgcttgaacagttcagccttgctgttaagagctgtccagatcaggaggaccagactcttcttatgaagttttgtctgctgtacggaacgaaactcgtttttcaggaacgtgcatggtaccttgagcacaaatacttgacaccaatggctagcacgcgtattcgaaaccaggagcgttgctag

SEQ ID NO: 29307 - DNA, 6086 bp, Artificial Sequence
  Description of Artificial Sequence: Synthetic coding sequence
atggatgtgaccgtgtcagaactgcttgagctcttcctccagagtccactagtgacatgggtcaaaacttttggcccttttggctcagggagccaggacaacttaaccatgtacatggacttagtggatggcatcttcctgaaccaaattatgttacagatcgatccccgtcctacgaaccagagaatcaataaacacgtgaacaacgacgtcaacctccggatacagaatctcaccatcctggtacggaacataaaaacctactatcaggaggtcctccagcagcttatcgtgatgaacctcccgaatgttctgatgattgggagggaccccttgtctggcaagtcaatggaagagatcaagaaagtgcttctccttgttctcggatgcgccgtgcagtgtgagcgcaaggaggagtttattgaacgaattaagcagttggacattgagacacaagccggaatcgtcgctcatatccaagaggtgacacataatcaggagaatgtattcgatctccagtggttggagctccctgatgtggctcccgaggaattagaggccttgagccggtctatggttttgcatctgaggcggcttatcgatcagcgcgacgagtgcactgagctgatcgtggacttaacccaggagcgtgactatcttcaagcgcagcatccgccatccccgattaagtcctcatccgcagacagcacccccagtcctacctcaagtcttagctcggaggataagcagcaccttgccgtcgagcttgccgatacaaaagccagactccgtcgtgtcaggcaggagttggaagataagacggagcagctagtggatactcgacatgaggttgatcagctggtgctggaactgcaaaaagtgaagcaggagaacatccagttggcggctgacgcacggagcgccagagcctacagagatgagctggatagcttgagggagaaagccaacagagtggagcgacttgaactggagcttactcggtgcaaggaaaagctgcatgatgtggatttctacaaagccaggatggaagagctgagagaagataatatcattttgattgagacaaaggccatgctggaagaacagctcacggctgctcgagctcgcggagacaaagtgcatgagctggagaaagagaatctccagctgaaaagtaagttgcacgacttggaactggatagagacactgacaagaagaggatcgaggagctgttagaggaaaatatggttctggaaatcgctcagaaacagagcatgaatgagtctgcccatttaggctgggagctggagcagttatctaaaaacgccgatctctccgatgcttctaggaagtcctttgtctttgagcttaatgagtgtgcgtcctctcgtatccttaaactcgaaaaggaaaatcagtccctgcagtcaactattcagggacttagggatgcctcactggtgctcgaagagagcggcctgaagtgcggcgagctggaaaaagagaaccaccaactgagtaaaaaaatagagaagttgcaaacacaactcgagagagagaagcagtcaaatcaagaccttgaaacattatctgaggagctcatcagagagaaggaacagctccagtctgatatggagaccctgaaagccgacaaagcacggcagatcaaagatctggagcaggagaaagaccatctcaaccgcgcaatgtggtctctgagagagagaagccaggtgtccagtgaagctaggatgaaggacgtggaaaaggaaaacaaggccctgcatcagactgttacggaggccaacggaaagctgtctcagcttgaattcgaaaagcgccagctgcaccgtgacctggagcaggccaaagagaagggggaaagagcagagaagctggagagagagttgcaacgcttacaggaagaaaacggcagactcgctagaaaagtgacatctctggagaccgcaaccgaaaaagtggaagccctggaacacgaaagtcagggtctgcagttggagaatcgaactctgcgcaagtccctcgacaccctccagaacgtatcactccagctcgagggtttagagcgcgataacaagcagctggacgcagaaaatctggaactcaggaggctcgtcgagacaatgcgcttcacctcaacaaaattagcacagatggagagggaaaaccagcagttagagcgagaaaaggaggaactgcgcaagaatgtggacctgctgaaagccttgggtaaaaaatccgaaagactcgagctttcctatcagagtgtgtccgccgaaaatctgaggctccagcagtcattggagagcagttctcacaaaacccagacactggagagcgagctgggagagctggaagccgagcgccaggctctgcgcagagatctggaggccctgagactagcaaatgcccagctggagggggcagaaaaggaccgcaaggctctggagcaggaagtagcgcagttagagaaagataaaaaattgctggagaaagaggccaagaggctctggcagcaggttgagctaaaagatgcagtgctggatgactctaccgccaaactgtcggccgtagaaaaggaaagtagagccctggacaaggagctcgcgagatgcagggatgctgctggcaaattgaaagagctcgagaaagacaaccgggatctaaccaagcaagtgactgtccacgccaggaccctcaccacactgcgcgaggatttagtgctcgagaaactgaagtcccagcagctctcaagcgagttggacaagctctcccaggagctggaaaaggtcggcctgaacagagagttgttgctccaggaagacgacagtggttctgataccaagtacaagattctggaaggtaggaatgagagcgccctgaaaacgacacttgcaatgaaggaggagaaaatagtcctcctcgaagcccagatggaagagaaagcttctctgaatcgccagctagaatcagagctacagatgctcaaaaaggagtgcgagaccttgcgccagaatcagggtgagggtcagcatctgcagaacagtttcaagcaccctgctggcaaaacggccgcaagccaccagggcaaggaggcctggggccctgggcataaggaagctaccatggagctcctgcgggtgaaagatagagctattgagcttgaacgtaataatgctgccctgcaagccgaaaagcaactgctcaaggaacagctgcagcacctggagacgcaaaacgtgactttttcttctcagattctcactctgcagaaacagtcagcattcctgcaggaacacaacacaaccctgcagacgcagaccgctaagctgcaagtagagaacagcaccctgagcagccagagtgctgctttgacagcccaatataccttgttgcagaatcaccacaccgccaaggagacagaaaatgagagcttgcagcgccaacaggagcaactgactgccgcttacgaggccctgttgcaagaccatgagcaccttgggacccttcatgagaggcaatctgcggagtatgaggcgctaatccgtcaacatagttgtctgaaaactctgcataggaacctcgagctagagcacaaggaattgggcgagcgccacggtgacatgttgaagcgcaaggccgagctggaagagagggagaaagtgctgacgacagagcgggaggccctgcaacaagagcaacgtactaatgcgcttgccatgggagagaaccaacgcctcaggggggaactcgaccgcgtgaacttcctgcaccaccagctcaaaggtgagtatgaggagttgcacgcccacactaaggagctcaaaacttcattgaataatgctcaactggagctgaataggtggcaggccaggttcgatgagctgaaggagcagcaccagaccatggatatttctctgacgaagttagacaaccactgtgagctgctgagtcggctgaaagggaacttggaggaggaaaatcatcacctgttaagtcagattcagctattatcccagcagaaccagatgctgctagaacagaacatggaaaacaaggaacagtaccatgaagagcagaagcagtatatcgacaagctgaacgccctgcgacgacataaagaaaaactggaagagaagataatggatcaatacaagttttatgaccccccacccaaaaagaaaaatcattggatcggtgcaaaagcccttgtcaaactcattaagcccaagaaggaagggtcgagagaaagattaaagagtactgtggacagccccccatggcagttggagagttctgaccccgcaagcccagctgcctctcagccactccggtctcaggctgaaaaccccgacaccccggctctggggtcaaattgcgctgaagaacgcgatgctcataacggcagcgtcgggaaagggcctggagatctcaaacctaaacgtggtagtccgcatcggggttctctggatcgtaccgatgctagcacagacctcgcaatgagatcctggcctagtgagctgggctcgaggacctgttccacgagcgccacaactacggccccttcgaattctactcctattgctcggcatccgggaaggacaaaaggttacaacagtgatgataacctgtgcgaaccatctctggagttcgaggttcctaatcatcggcagtatgtgtcacgcccaagcagcctggagagctccagaaatacttcctccaatagctctccgcttaacctgaaaggctcttccgagcagctgcatggccgttccgagagttttagcagcgaggacctgatcccatctcgtgatcttgctacacttccaagggaggcctccacacccggacgcaacgcactgggacgacacgaataccctctgccacgaaatggaccgctgccacaggaaggcgctcaaaaacgcggaacagctccaccctacgtgggcgtgcgcccatgtagcgcatccccatcgagtgaaatggtgaccctagaggaattcctggaggagagcaacaggagcagtcccacacacgatacgccctcttgtcgggatgatctgctgagtgactatttcagaaaagcgagtgacccgccagcaattgggggacagcctggaccgccagctaaaaaggaaggcgctaaaatgcccaccaactttgtggcccctacggtgaagatggcggcaccaacctcagaggggaggccactcaagcctggacagtacgtgaagccgaatttccggcttacggaggcggaggcgcctccctcagtcgctccacggcaggctcagcctccccagagcctgagtctgggacggccacggcaggcacctgtacccccagcctcacacgcccctgcaagcagaagtgcctccctgagccgagccttctcattggcctctgcagacctacttcgggcatcaggccctgaggcctgtaaacaggaaagcccgcagaagttgggcgctccggaggcactgggcggtcgtgagactggatcccacactctccagtcccccgctcccccaagcagtcactcactggccagagagcggacaccccttgtcggcaaggcaggctccagctgtcagggtcccggtccccgaagccgacccctggatactcgacggtttagtctcgctccaccaaaggaggaacgactggctcccctgcaccaaagcgctaccgctccagccatcgctactgccggagccggagctgctgctgcaggcagtggttccaatagccagctcctccacttttccccggcagccgctcctgcagcccgtacaaaacccaaggcaccacccaggtcaggggaagtcgccacaattacccctgtccgggctggtctgagcctgtccgagggcgatggcgttccaggccagggatgttccgaaggcctgcctgccaaatcacctggcagaagtcccgatctggctccgcatttgggtcgggcactggaagactgctctcgtgggtcggtctctaaatcatccccagcgtccccagagccgggaggagatccccagactgtctggtacgagtatggctgcgtgta

SEQ ID NO: 29308 - DNA, 3831 bp, Artificial Sequence
  Description of Artificial Sequence: Synthetic coding sequence
atggacgaggtggaacaggaccaacacgaagccaggctgaaagagctgtttgactcttttgatacaaccggcacagggagccttggccaagaggagctcacagacttgtgccacatgttgtcacttgaagaagttgctcctgtacttcaacagacactgcttcaggataatctcctgggacgcgttcatttcgatcagtttaaggaggctctgattctcattctgtcgcgcacccttagtaatgaagagcattttcaagagcccgattgttcactcgaggcacagcccaagtatgtccgaggcggtaagcgatacggcagacgtagtctgccggaatttcaggagtccgtcgaggagtttccagaggtgaccgtaatcgagcctttggacgaagaggcaagaccaagccacatccccgcaggggattgttccgagcactggaagacccaacgtagtgaggaatacgaggccgaaggccagctccgcttttggaatcctgatgacctgaatgctagccagagcggctccagccccccacaggattggatcgaggagaagctgcaagaggtgtgcgaggatctgggaataacaagggacgggcatcttaataggaagaaattggtcagcatttgtgagcaatacggccttcaaaacgtggatggtgagatgctcgaggaggtcttccacaacctggacccagacggcaccatgtcggtcgaggattttttctacggactttttaaaaatggtaaatctctgactccttcggcatcgactccttataggcagctcaagaggcacctcagcatgcagtcattcgatgaatcagggaggaggacgaccacctcttccgctatgacttccacaattgggttcagggtgttttcctgccttgatgatggcatgggccatgcaagcgtagagcgcattctggatacttggcaggaagaaggcattgagaatagccaggagatactgaaggcgcttgacttctcccttgacggaaacattaatttgacagaactgactcttgccttagagaatgaactgctggtaactaagaatagtattcaccaggcagccctcgccagtttcaaggcagagatccgtcaccttcttgagcgagttgaccaggtcgtgcgagaaaaggagaagctgcgatctgacttggacaaggccgaaaagctcaagtccctaatggctagtgaagtggatgaccaccacgccgcaattgaacgacgcaatgagtacaacctacgaaagctggacgaagaatataaggagagaattgctgctctgaaaaacgaactacgcaaagaaagggaacagatattgcagcaagcagggaagcagcgcctggagttggagcaggaaatcgagaaggcaaaaaccgaggagaactacatcagagaccgcttggcgctgagcttaaaggagaattccagactggagaatgaactgttggaaaatgccgagaagctggccgaatacgaaaatttaactaacaagcttcagcgcaacctcgaaaatgtgctggccgagaagtttggcgatttggatccatcttctgccgagttttttctgcaagaggaaaggctgacgcaaatgaggaacgagtatgagagacagtgcagggtgttgcaggaccaggtcgacgaactacagtcagagcttgaggaatacagagcgcaggggagagtcctccgactcccactcaaaaatagtcctagtgaagaggtggaggcaaactcaggcggaattgagcccgagcatggcctgggatctgaggagtgcaatcccctcaatatgagcattgaggctgagctcgtgatagaacagatgaaagagcaacatcatcgtgacatctgttgcttgagattggaactcgaagataaagtacgccactatgagaagcagctcgatgagactgtcgtgagttgcaagaaggctcaggaaaacatgaagcagcgacatgagaatgagacacatactctggaaaaacaaatttccgatttaaagaatgaaattgcagagttgcaggggcaagctgcagttctgaaagaggctcaccatgaagccacctgccgacacgaggaagagaagaagcagttgcaggtgaagctggaggaagaaaaaacacatctgcaggagaaattgagactgcaacatgagatggaactcaaagcacgactcacacaagcacaggcatcgttcgaacgcgaaagagaaggcttgcagtcctctgcttggactgaggaaaaagtgagagggctgacacaggagttagaacaattccaccaggaacagctgaccagcttggtggagaaacacactctcgaaaaagaagaactgcgcaaagagctgctggagaaacaccagcgagaactgcaggaaggacggtacgagtctgaaaagctccagcaggagaacagcattctgcgaaatgagataaccacacttaatgaggaagatagcatttccaatttaaaactcggcaccttaaacggttcacaggaagaaatgtggcagaaaactgagacagtgaagcaggaaaacgccgctgtgcaaaaaatggtagagaacctgaaaaagcaaatctcagaactcaagattaaaaatcagcagttggatctagagaacacggaactgagtcagaaaaactcccagaatcaagaaaaactacaggaattgaaccagcggttgaccgaaatgttatgtcaaaaggagaaagagccagggaacagtgccctggaagagagggaacaggaaaagtttaacttgaaggaggaacttgaacgatgtaaagttcagagcagcaccctggtgagctctctcgaggccgagctctccgaggtgaagatccagacacatatcgttcaacaggagaaccacttgctaaaagacgagctcgaaaaaatgaagcaactccaccggtgtccagacctgtctgatttccagcagaaaatctcatccgtgttatcctacaacgagaagctattgaaggagaaggaagcactgtcagaggagttaaactcttgtgtggacaagcttgctaaaagtagtttgttggagcaccgaatcgcgacaatgaagcaggagcagaaatcatgggaacaccaatcggcctcccttaagtctcaattggtcgctagccaggagaaagtccagaatttggaagacaccgtgcagaacgtgaatctgcagatgagcagaatgaaatcggatctacgcgtgacacagcaagagaaggaagcgctgaagcaggaagtgatgtcactgcataagcaactgcagaacgctggcggaaagagttgggcaccggaaatcgccacccatcccagcgggctccacaatcagcaaaagcgactgtcctgggacaagctcgaccacctcatgaatgaggagcagcagctgctgtggcaggagaacgagcgtcttcagaccatggtgcagaatactaaggctgagttaactcactcgcgggagaaggtgcgtcagcttgaatctaatctgttaccaaagcatcagaaacatctcaatcctagtggcacaatgaatcctacggaacaggagaaactgtcactgaagagagagtgcgaccagtttcagaaagagcagtcccccgctaatcgaaaggttagtcagatgaattctctcgagcaggaattggaaacaatccacctggaaaacgaagggcttaaaaaaaagcaggtaaagctcgatgaacagctgatggaaaattctgtcgtgggttcatccagggaagggtgcagcagcctccccgagatcgtgtgtgaagatgctgccccagaggtgcactgcgatgcttag

SEQ ID NO: 29309 - DNA, 2997 bp, Artificial Sequence
  Description of Artificial Sequence: Synthetic coding sequence
atgaaggactccggggattccaaggatcagcagctcatggtcgcgctcagggtaagaccaattagtgtcgccgagctggaagagggtgctaccctgattgcccataaggtggatgagcagatggttgtgctcatggatccgatggaagaccctgatgacatcctgcgcgctcacaggagccgagaaaagtcttacctttttgatgtggcttttgactttaccgcaacacaggagatggtctaccaagccaccaccaagtctctcatagagggcgtgattagcggatacaatgctactgtttttgcgtacggtccaactgggtgtggcaaaacatataccatgctcggcaccgatcaggagcccggaatctatgtccagactctcaatgacttattccgtgctatcgaagaaacgtccaacgacatggaatatgaggtttcaatgagttacctggagatctataatgaaatgatccgggacctcctaaatccatccctgggatacctcgagctgcgggaagactccaaaggcgtgatccaggtcgccggaataaccgaagtttccaccattaatgcgaaggaaattatgcaactcctcatgaagggaaatcgccagcggactcaagagccaactgccgcaaaccagacctcttcgaggagccatgccgtattgcaggtaacagtgcggcagaggtctcgcgttaaaaacatattgcaggaagtccgacaagggagactgttcatgatcgacctggcaggctcagagcgtgctagtcaaacgcagaataggggacaacggatgaaggaaggggctcacataaatagatcccttctagccctggggaactgcataaatgctctgtccgataaagggagcaataagtacataaattatagagattccaaactcactcgcctgctcaaggactcactcggaggcaactcacgcactgtgatgattgcccatatctccccagcctcgagcgcattcgaggaaagtcgcaacacgctgacttatgccggaagggccaaaaacattaagaccagagtcaagcagaacctgctaaatgtgagctatcatattgcacagtacactagcattatcgctgacctgagaggagaaattcagcgacttaagcgcaaaattgacgaacaaactgggaggggccaggcaagaggccgtcaggacagaggcgacatcaggcacatccaggcggaggtgcaattgcacagcggccagggggagaaagccggtatgggacagctgagagagcaactggcctccgcctttcaagaacaaatggatgttcgcagacggctcttggagctggagaacagggccatggaagtccagatcgacaccagtcggcacctactgacgatcgcaggatggaagcacgaaaagtccaggagagccttgaaatggcgcgaggagcagcggaaggaatgctatgcaaaagatgactccgaaaaagattccgacactggggacgaccagcccgacatcttggaacctcctgaagtggccgcagccagggagtctatcgcagccctcgttgatgagcagaagcaactgcgcaaacagaagctggcgctggaacagagatgtcgcgaactccgcgctagggggaggcggctggaagagacgctccctagacggattggatctgaggagcaacgggaggtgctctctttgttatgtagggttcacgagctggaggtggaaaataccgagatgcagagccacgcccttctgcgagacggagcccttcgtcaccgccatgaggcggttaggcgccttgaacagcacaggtcgctgtgcgacgagattatccaaggccagcgacagattattgatgactacaacctcgccgttccccagcgcttagaagaactgtacgaggtctacctgcgtgagctggaggagggttcgctggaacaggccacaatcatggatcaggtagcttccagagccctccaagactcgagtctccccaagatcacgcccgcaggcactagcctcaccccagattctgacttggagagcgtaaagacattaagtagcgacgcgcagcacctgcagaattcagcccttcctcctctgagtaccgagtccgagggccatcacgtatttaaggctggtactggcgcatggcaggccaaatcttcttccgtgcctactcccccacccatacaactggggtcacttgtaacccaggaggcacctgcccaggactctttgggctcatggatcaattcgagtcccgacagttccgaaaacctaagcgagatacctctgagtcataaagaacgcaaagagattttgaccggaacaaagtgcatatgggtgaaggctgctcggaggcggtcacgcgctctgggaacagaaggacgccatctgttggcacccgcaactgaaaggtcctcactgagcctgcacagcttatctgagggggatgatgccagaccgccaggccctttggcgtgcaaaaggcccccatcgcccactttgcagcatgcagcttcagaagacaacctctcttctagcactggggaggcccctagtcgagccgtcggacaccacggggacggcccaagaccttggctgcggggtcagaaaaaatctctaggcaaaaaacgcgaggagtcactcgaggctaagagacgaaagcgtcgctctcgctcttttgaggtgaccggacagggcctcagtcatcccaagacccacctgctgggcccacatcaggccgagcgcatatccgaccaccgtatgcctgtatgccggcaccccgcacctggaatacgccacttgggtaaagtgacgctccccctagccaaagtgaaacttcccccaagtcagaacaccgggcctggagatagtagccccctggctgtgcctccgaacccagggggtggctcacgcagagccaccaggggacctcgactgcctcatggcacctccacgcacggcaaagacgggtgctcccgtcacaactag

SEQ ID NO: 29310 - DNA, 1194 bp, Artificial Sequence
  Description of Artificial Sequence: Synthetic coding sequence
atgacggctgaagagggggtgcagctatcccaacagaatgccaaagacttcttccgtgtgttgaatcttaataaaaaatgcgacacgagtaagcacaaagtcttggtggtctcagtgtgcccccagagtcttccatactttgccgctaagtttaacctcagcgtgaccgatgcttcccgcagactctgtggtttcctaaagtcactcggagtgcactatgtttttgacacaaccatcgccgcagatttcagcatcttagagagtcagaaggagttcgtgagaaggtataggcagcacagtgaggaggaaaggacgctcccaatgcttaccagtgcgtgtccgggatgggtcaggtatgccgaacgcgtcctgggacgcccaattaccgcccatttgtgcacggcaaagagtccccagcaggtgatgggcagtctggtgaaagattatttcgcaaggcagcagaacctatccccagagaagatcttccatgtcatcgtggctccatgctacgacaagaaactggaggctttgcaggaaagtttaccacccgctttgcatggttctcgaggagccgactgcgtgctgaccagcggtgagatcgctcagatcatggaacagggcgacctcagcgtgcgcgatgccgcagttgataccctgttcggggatcttaaggaagataaagtgaccaggcatgatggagcctcaagtgacgggcacctggctcatatcttccgtcacgccgctaaagagctattcaatgaagacgtagaagaagtgacctatcgcgctttaagaaataaagacttccaagaagttactttggagaaaaatggagaggtggttctaaggtttgcagctgcctacggtttccggaacatccagaacatgatactaaagctgaaaaaaggcaagtttccatttcattttgtggaagtgctggcgtgcgccggaggatgcctgaacggcagggggcaggcccagactcccgatgggcatgctgacaaggctttactaagacagatggaagggatttacgccgacatccctgttagacgcccagaatcgtccgcccatgtacaagagctgtaccaggagtggcttgagggcataaatagccccaaggcgagagaggtgcttcatactacctaccaatctcaggaacgcggtactcacagtttggacatcaaatggtag

SEQ ID NO: 29311 - DNA, 3603 bp, Artificial Sequence
  Description of Artificial Sequence: Synthetic coding sequence
atgaaagttgcaggtgggctggagttgggcgcagccgctcttctgtctgcctcaccacgggcactggtgactctttctactggacctacctgctcaatcctgccaaaaaatcctctattccctcagaatttgagctcacagccgtgcatcaaaatggagggggacaagtctttgacattcagcagctatgggctgcagtggtgtttatatgaattagacaaagaagagttccaaacatttaaagagcttttgaagaagaagagttccgagtccacaacgtgttcaatcccacaattcgaaattgaaaatgctaacgtggagtgcctggctctgttgctgcatgaatactatggtgcaagccttgcttgggccacaagtattagcatatttgagaacatgaacctaagaaccttgagtgaaaaagcgagggatgatatgaagcggcattctccggaggaccccgaagccacgatgacggatcaaggaccctctaaagagaaagtgccaggaatatcacaggcagttcagcaagacagcgcaaccgcggctgaaacgaaagagcaggaaatttcgcaggccatggaacaggaaggagccaccgctgccgagacggaagaacaagagatttcacaggctatggaacaggaaggcgctactgcagcagagacagaggaacagggacacggaggggacacatgggactacaagagccacgtgatgacgaaattcgcagaagaagaagacgtgcggcgttcttttgagaacacagccgctgactggcctgagatgcagaccctggccggagcattcgactcagatcgatggggcttccggcctcggaccgtggtcctacacggcaagagcgggatagggaaatccgccctggcccgtagaattgtcctctgctgggctcaagggggtctctatcaggggatgtttagctatgtattctttctgcctgtgcgagagatgcaaaggaaaaaagaaagcagcgtcacagaatttatttcccgtgagtggcccgacagccaagctcctgtcacagaaatcatgagtcggccagaacgcctgcttttcatcattgatggatttgatgacctcgggtcagttttgaataacgacactaagttatgtaaagactgggccgagaagcaacccccattcacgctgattcgaagcttgctgcgaaaagtgctgctgcccgaatcatttttgattgtaactgtcagggatgtgggcaccgaaaaactgaagagtgaggtcgtttctcctagataccttctcgtgcggggaatatccggggaacagagaatccaccttcttcttgagcggggaattggtgaacatcaaaaaacccagggtttgcgtgcaattatgaataatcgcgaactcctcgaccagtgccaagtaccggctgtgggatccctaatctgcgtggccctgcagctccaggatgtcgtcggcgagagcgttgctccatttaaccagaccctgactggcctgcatgcggcattcgtcttccatcagctaactcccaggggagtggtacgtagatgcctcaacctcgaggaacgcgtagttcttaagaggttttgccggatggcagtagaaggcgtgtggaatagaaagtcagtattcgacggagacgacctgatggttcaggggctcggcgaatcagagttgagggccctgttccacatgaacattcttctacccgactcccattgcgaagaatattacactttttttcatttgtctcttcaagatttctgtgcagctctgtactacgtcttagagggccttgaaattgaaccagccctgtgccctctatacgtggagaaaacaaaacgtagtatggagttgaaacaggctggctttcatatacactctctctggatgaagcgctttcttttcggcctggtgagtgaagatgtccgcaggcccctcgaggtgctgctgggatgtccagtgcctctcggcgtcaaacagaagttattgcactgggtgagcctgctgggtcagcagccgaatgcaactacccccggagatacacttgatgcatttcactgcctttttgaaacacaagacaaggagttcgtgcggcttgccctgaactcctttcaggaggtctggttaccgattaaccagaacctggacctcatcgcctccagcttctgtctgcaacactgcccttacctgcggaagattagggttgacgttaagggcattttccctcgggacgagtccgccgaggcgtgccccgtcgtaccgttgtggatgcgggataagactctcattgaggaacagtgggaggatttttgcagcatgctcggaacccacccacacctacggcagcttgacttaggctcctcgatactgaccgagagagctatgaagaccctgtgtgcgaagctgcgccatcccacatgtaagatacagactctgatgtttcgaaacgctcaaatcaccccaggagtgcagcatctgtggagaatcgtgatggccaaccgcaatctccggtcactgaacctcggcggtacacatctcaaagaagaggacgttaggatggcttgtgaggccctgaagcaccccaagtgcctccttgagtccttgagactggattgctgcgggctgactcatgcatgttatcttaaaatctcacagatcctgaccacttctcctagtctcaaaagcctatcactcgccggtaacaaggtgacagaccagggtgtcatgcctctgagcgatgcgctgagggtttcccaatgcgccctgcagaaactgatcctcgaagattgcgggatcactgcaactggatgtcagagcctggcaagcgcactggttagcaataggtcactgacccatctgtgtctttccaataatagtctgggtaacgagggcgtgaatctgctctgtcgtagtatgcgcctgccccactgttccctccagaggctgatgctgaatcagtgccaccttgacacagcagggtgcgggtttctggcactggcacttatggggaacagttggcttacccatttgagtctgagtatgaacccagtggaggacaacggcgttaaactcctgtgtgaagtgatgcgagagccttcttgtcacttacaggatctggaattagtgaaatgtcaccttacagccgcttgttgtgagagtctgtcttgtgtcatcagtagatcacgccacctcaagagcctggacctgactgacaatgccctcggagatggaggggtggctgcgctgtgcgagggactgaagcagaagaactccgtactggctcggctgggcttgaaggcttgcggcctcacatcagattgttgcgaggcgctgagtctcgccctgagctgtaatcgtcatttaacgagccttaatctggtgcagaataacttttccccgaagggaatgatgaagctgtgcagtgcgttcgcctgcccaaccagtaacctgcagatcattggactttggaagtggcagtaccccgtgcagatccgtaaactcctcgaagaggtccaactgttaaagccgagggtggttattgacggatcatggcactcattcgacgaagacgaccggtactggtggaagaactag

SEQ ID NO: 29312 - DNA, 2787 bp, Artificial Sequence
  Description of Artificial Sequence: Synthetic coding sequence
atgaatgaagcaatggcaactgactccccgcgacggccaagccggtgcacgggaggggtagtagtcaggccccaggcagtaacggagcaatcttacatggagagtgtcgtcacatttttgcaggatgtcgtccctcaagcgtattcggggacacctctcactgaggaaaaagaaaaaattgtatgggtgcggttcgagaacgccgatctgaacgacacctctagaaacctggagtttcacgaaatacatagcacaggtaacgaacctcctctgctgattatgattggatactctgatggaatgcaagtgtggtctatacccatcagtggcgaggcgcaagagctattttcggtgcgacatgggccaatcagggcagcccgaatcctgcccgctccccaatttggcgcacaaaagtgtgacaatttcgctgaaaagcggcctcttttaggcgtttgcaagtctataggttcctccgggaccagtcccccttattgctgtgttgacctctatagcttgagaacaggcgaaatggttaaaagcatccagttcaaaacccccatttatgacctgcactgtaacaaaagaatcttggtcgtggtcttgcaggagaagattgctgcttttgacagttgtacctttaccaaaaagttcttcgtgactagctgctatccgtgccctggccctaatatgaatcctattgccttaggctcacggtggctagcctacgctgaaaacaagctgattaggtgtcatcaaagtagaggaggcgcatgcggggacaacattcagtcttacacagctactgtcattagcgccgctaaaactctgaagtccggcctgactatggtgggaaaggtagttactcagttaactggaacgctccccagcggcgtcaccgaggacgacgtcgccatccactctaacagccgtaggtcgcctttggtgccgggtattattaccgtcatcgacacagagaccgtcggagaaggtcaggtgttagtcagcgaagactcggacagtgatgggatcgttgctcacttccctgcccacgaaaagcccgtctgttgtatggccttcaataccagcggaatgctgcttgtgaccaccgatacgctgggacacgattttcacgtgttccagattcttactcacccttggtcgtcctctcagtgtgcagtgcatcacctctatacactacatagaggagagactgaagcaaaggtccaggatatttgcttttcgcatgactgccgctgggtggtcgtctcaaccctccggggtactagccatgtgtttccgataaatccctatggagggcagccatgcgtcaggacacatatgtctccccgagtggtcaatcggatgtcacgtttccagaagagcgccggtcttgaggagattgaacaggagctgacatccaaacaaggtgggcgttgctctcccgtcccgggtctgagttcatcaccaagtggctcccccttacacggcaagctcaattcccaagattcctataataacttcacaaataataaccctggcaatcctcgcctgtcccccctgcctagcctcatggtggtgatgccattggctcaaattaagcagcccatgacacttgggactattactaagagaacaggaccataccttttcggggctggatgcttctcaatcaaagcaccttgcaaagttaagccccctcctcaaataagtccatctaaatctatggggggtgagttctgtgtcgcggcaatcttcggcacatccagaagctggttcgcaaacaacgcgggactgaaacgcgagaaggaccagtctaaacaggtggtcgtggagtctctgtatattatctcctgctatggcacactcgtagagcatatgatggaacctcgaccccttagtaccgcaccaaaaatctcagatgatacaccccttgaaatgatgaccagtcctcgggcttcctggactctcgtgcggaccccacagtggaatgaattgcagcccccattcaacgcaaatcaccctctgttgctggccgctgacgcagtgcagtattaccaatttctcctggcaggcctcgtgccgccagggtcccctgggcctatcactcggcatggtagttatgactctctggcatccgaccatagcggccaggaagacgaagaatggctgtcacaggttgaaatcgtgacgcatacaggtcctcaccggcgactctggatgggacctcaatttcagttcaaaaccatccacccatccggacaaacaaccgtgattagctcttcctcatcagtgctgcagtctcacggcccttcagatacccctcagccactcctggactttgataccgacgacctcgatctgaatagcctgcgaatccagccagtgaggtcagatcctgtttctatgcccggttctagtcgacccgtgagtgaccgaagaggagtaagcacagtgatagacgctgcgtccggtacatttgatcgatcggtgacattgctggaggtgtgcggaagttggcctgagggtttcggtcttcggcacatgagctccatggaacacacagaagaagggctcagagaacgcctggcagatgcaatggccgaaagcccatcacgagacgtggtgggctctgggaccgaattgcagcgggaaggcagtatcgaaaccctgtccaacagcagtggatctaccagcggcagcatccctcgcaacttcgatggttacaggagccctctcccaacaaatgagtcccagcctttgtctctgttcccgacaggattcccttag

SEQ ID NO: 29313 - DNA, 501 bp, Artificial Sequence
  Description of Artificial Sequence: Synthetic coding sequence
atggttaacagctgttgcggcagtgtttgctcagaccaaggctgcggattagagaactgctgcagaccaagctactgccaaaccacttgctgtcggacaacctgctgccgacccagttgctgcgtgagcagctgctgcagaccgcaatgttgtcagactacttgctgccgcacaacgtgctgccatccatcctgttgtgtttcaagctgctgtcggccacaatgttgccagagcgtgtgctgccagcctacctgctgccggcctcagtgttgtcagaccacatgttgtcgcactacgtgctgcagaccttcatgctgtcgaccgcagtgctgtcagtcagtttgctgtcagccaacctgttgttgcccgagttactgcgttagcagctgctgcagaccacaatgttgccaaactacatgctgtcggactacgtgctgtagaccaagctgttgtgtgagccggtgttatagaccgcactgtggccagtctctgtgttgctag

SEQ ID NO: 29314 - DNA, 1104 bp, Artificial Sequence
  Description of Artificial Sequence: Synthetic coding sequence
atggatgacgctgcagtgttgaagcgaagagggtatctcctcggcatcaatctgggagaaggctcctatgcgaaagtcaaatccgcctacagcgagcgacttaagttcaatgtcgccatcaagatcattgaccggaagaaggcaccagcggattttcttgaaaaattcttaccgagagagatagaaatcttggcgatgcttaatcactgctccattatcaagacctacgagatctttgagacaagccacggcaaggtatatattgtgatggagctcgctgtacaaggggatctcctggagttgatcaagacccgcggtgccctacatgaggacgaagccagaaaaaagtttcaccaactgagccttgcgataaagtattgccatgaccttgatgttgtacaccgagacctaaagtgtgacaatttgttgctggataaagatttcaacattaagctctcggatttcagcttttccaagagatgtttgagagacgactctggtcgtatggccctaagtaagacattctgtggatctccagcctatgcggcaccagaagtactccaggggattccctaccaaccaaaagtttatgatatttggtcgctaggcgtcattctgtacatcatggtgtgtgggtcgatgccctacgatgattctaatattaagaaaatgctgagaatccagaaggagcacagggtgaacttcccacgatctaaacatctgactggggaatgtaaagatctcatttaccacatgctccagccagatgtgaaccggagactccacatagatgaaattctatcgcattgttggatgcagcctaaggccagaggatctccctctgtcgcgattaataaggagggtgagagtagtaggggcacagaaccactgtggacccctgagcctggctctgacaaaaaatctgctactaaattggagccagagggggaggctcaaccgcaggcccagccagagacaaagcccgagggtaccgccatgcagatgtcccgccagagtgagatcctggggttcccatcaaagccttctaccatggagacagaggaggggccaccccagcagccccctgaaactagggcgcagtag

SEQ ID NO: 29315 - DNA, 273 bp, Artificial Sequence
  Description of Artificial Sequence: Synthetic coding sequence
atgagccactatggaagttattacggtggcctcgggtatagctgcggtggctttggcggtcttggatacggatacggctgcggctgtgggtccttttgtcggaggggtagtgggtgcggttatggcggatacggatatggttccgggttcggcagctacggatatggaagcgggttcggaggttacggttatggttcaggattcgggggatacgggtatggctgctgtcgcccttcctataatgggggatacggtttctccggcttttactag

SEQ ID NO: 29316 - DNA, 519 bp, Artificial Sequence
  Description of Artificial Sequence: Synthetic coding sequence
atgagctataactgttgcagcagaaacttttctagctgctcacatgggggttacctccactatccagggtcgagttgcggatcaagctacccttccaaccttgtttatagcacagatctgtgcagtcctagtacatgtcagctcggaagtagcctgtaccggggatgccaagaaacatgctggcgtccaaattcttgtcagacactctgtgtggagtctagtccctgtcacacaagttgttattacccgaggacgcatatgttgtgcaatagttgtctgacaatgcacgtcggctcccggggatttggctccaatagttgttgtagtttgagttgcggttctcgctcttgtagctcattaggatgtgggagcaatggttttaggtacctaaactaccgtatccacactagtccctctcaatcatacaggtcacggttctgccatcctatctatttcccaccacgacgatggttccatagcagctgttaccagcccttctgcaggagcggattctattag

SEQ ID NO: 29317 - DNA, 1554 bp, Artificial Sequence
  Description of Artificial Sequence: Synthetic coding sequence
atgtccgggagttgtagcagccgcaagtgcttttccgtgcccgcaacaagcctgtgctccacggaagtgtcatgcggaggacctatctgcctgccttcttcctgccagagtcaaacatggcagctcgttacctgtcaggacagctgcgggtcttctagttgtggcccacaatgccggcagccttcatgcccggtctcaagttgcgctcagcccctgtgttgtgaccctgtcatctgtgagcccagctgttcagtttcaagcgggtgtcaaccagtctgttgtgaggctacaacatgcgagccaagctgctccgtgtccaattgttatcagccagtgtgtttcgaggctacgatttgcgaaccaagttgttcggtgtccaattgttgccagcctgtgtgttttgaagccactgtatgtgaaccttcctgcagtgtcagttcctgcgcccagcccgtgtgctgcgagcccgcaatttgcgaaccatcttgttccgtcagctcatgctgtcagccggttggcagcgaagctacatcatgccaacctgtcctctgcgtgccaaccagctgtcaaccagtgctgtgcaagtcttcttgttgccaacccgtggtgtgcgaaccgagttgctgcagtgccgtgtgcaccctgccgtccagttgccaacctgtggtctgtgaaccttcttgctgtcaaccagtttgtcctactccaacttgcagcgtgacgtccagttgccaggctgtgtgctgcgacccaagtccatgcgagccatcctgcagcgagtcttccatatgccagcccgcaacctgtgtcgccttggtttgtgaacccgtgtgtcttcggccagtctgctgtgtgcagtcctcatgcgagcctccgagcgtcccatccacctgccaggaaccctcttgttgtgtgagctccatttgccaacccatttgctctgaaccctccccttgcagtcctgctgtttgtgtgagttctccatgtcagcctacttgctatgtggtcaagagatgccccagtgtgtgcccagagcctgtctcttgcccatcaacaagttgccggccactcagctgctctcctgggtcaagcgcctctgctatatgcagacctacatgcccacgtacattctacataccgagcagttcaaagcgaccttgtagcgcgacaatttcctatcggcctgtttcacggccaatttgcaggccaatttgttccggactgctcacataccggcagccctatatgacttccatcagttatcggcctgcctgctatcgtccttgttacagcattttgaggcggcctgcatgtgtgacttcctattcttgccggcctgtatattttcgcccaagctgtactgaaagtgactcatgtaagcgggactgcaagaagagtaccagcagccagctggattgtgtggacaccacgccatgtaaagtggacgtgtcagaggaggcaccctgccaacctactgaagccaagcccatcagcccgactacccgcgaggccgctgccgcacagcccgctgcttcaaagccagccaactgctag

SEQ ID NO: 29318 - DNA, 1026 bp, Artificial Sequence
  Description of Artificial Sequence: Synthetic coding sequence
atggccgacggttgttgtccaggaaatacaacagctatccccgctgttcccacaatcactacctatcccgtcaaaggaggattcaggcacgcactgtgcttgccgagcagctgccactccagaatgtggcagctcgtgacatgccaggaatcctgccagccctcgattggcgcaccaagcgggtgcgaccctgctagctgtcagcctaccagactgccagccacgagttgcgtgggtttcgtgtgccaaccaatgtgctctcacgccgcatgctaccagtcaggcactgggcagtctccgtgcttggtgtcttcatgccagccatcctgcagtgaaagtacgtgctgtcaggagaaatgctgtgatgccagtccatgtcagcagtccagttgccaggaatcagtctgcatgtcaggctcctgtcaagctgcctgcggccagtcagtgtgctgcgacgcaggctcctgtcagcctagctgtagtgaggtaacatcttgcccagaaacatcgtgcctgccaaccatctgcaccgcttcaccatgtcaacctacttggtgtcagggaagctcttgtcaacccgtgtctggcgaggggcagccgtgcaaaagtacctattaccagcctatctgctatattttcaagccctgtcagtcagccctctacatgccagtgccatgtcagccctctacctgcgtttttagcagttgtaacaccacatgctgcgtcccttcgcattgccagccccctcactgtcagcttgtcccttcaacgtgtttcatttaccaacccgtggctaactgccaggcaccctgttctactaagaattgttgtaaacccgcatcttgcgataccgtcatctctggccagcctacctgcgatggaccaccatcctataatcagagtgggtgcaaatccgcctgctgcgttacaggactcggaacaagcccgtcttctggtagtaactgtcttccaacctcctgccagccttcctgcgaaagttccttttgcaaagctactctctgctag

SEQ ID NO: 29319 - DNA, 588 bp, Artificial Sequence
  Description of Artificial Sequence: Synthetic coding sequence
atggtgtctagttgctgtggttctgtctgtagcgatcagtcttgtggtcagggtctgggccaggagagttgctgcagaccaagttgttgccaaaccacatgctgtcggacgacctgctgtcgaccaagctgttgcattagttcgtgctgtcgccctagctgttgcatctccagttgctgtaaaccatcatgctgtagaactacttgctgtcggccttcatgctgcatcagcagttgttgtcggccatcctgttgcattagctcatgttgcaaaccctcttgttgccgcacgacctgctgccgcccatcgtgttgcatttccagctgctgccggccatcttgctgtatctcttcttgttgcaagccgtcatgttgccagacaacgtgctgtcgaccatcatgttgtatctctagttgctataggccacagtgttgccagcctagctgttgcagaccagcttgctgtatctctagctgttgccacccgagttgttgtgttagctcttgcagatgtcctttctcctgtccgactacgtgctgtcgcacgacttgcttccacccaatttgctgtggctcctcttgctgctag

SEQ ID NO: 29320 - DNA, 588 bp, Artificial Sequence
  Description of Artificial Sequence: Synthetic coding sequence
atggtcaacagttgttgtggctccgtatgcagtcatcaaggttgcggacgagatctttgccaggagacatgctgccggccaagttgctgcgagacaacgtgctgtcggaccacttattgcaggccctcttgctgcgtgtctagctgctgcaggccccagtgttgtcagtctgtctgctgccagcctacctgctgccggcctcggtgttgcatttctagctgctgtaggccatcctgttgcgtgtcttcttgttgcaagcctcaatgttgccagtctatgtgttgtcagcctacctgttgcaggcctcgctgttgcatctcatcctgctgcagacctagctgttgcgttagctcttgttgtagaccacagtgctgtcagagtgtgtgctgtcaacccacatgttgtcacccctcatgttctatctcttcctgctgcaggcccagttgctgcgaatcttcttgctgtcgtccctgttgctgtctgcggcctgtgtgcggtagggtgagttgccataccacttgctaccgacccacatgcgtcatcagtagttgtcccagacccctatgctgcgccagttcatgctgttag

SEQ ID NO: 29321 - DNA, 633 bp, Artificial Sequence
  Description of Artificial Sequence: Synthetic coding sequence
atggtgtccagctgctgtgggagcgtgtgcagcgaccagggctgcgggcaggacctatgccaagagacatgttgtcgaccctcttgttgtgaaacgacatgttgccgcacgacttgttgtagaccgtcctgctgtgtctcaagctgttgccgcccacaatgttgccagagtgtgtgctgtcagccaacctgctctcggccatcttgctgccagacaacctgttgtaggacaacgtgctacaggccgagctgttgcgtcagcagctgttgcagaccacagtgctgccaaccggcatgctgtcagccaacttgttgtagaccgtcatgctgtgagactacctgttgccacccaaggtgttgtattagtagctgctgcaggccctcctgttgtgtttcgagctgctgcaagccacagtgctgccagtccgtctgctgtcagccgaactgctgccgccctagctgctcgatcagctcttgttgcagaccaagctgctgtgagtcttcgtgttgtaggccctgttgctgtgtccggcctgtatgtgggagggtttcttgccataccacctgctacagaccaacctgcgtaatttctagttgtccccgaccattatgttgcgcaagttcttgctgctag

SEQ ID NO: 29322 - DNA, 387 bp, Artificial Sequence
  Description of Artificial Sequence: Synthetic coding sequence
atgactggttcctgctgcgggtccactctctccagtttgtcctatggcggaggatgttgtcagccttgttgctgcagggacccctgctgttgtcggccagtgacctgccagaccacggtgtgcaggcctgtcacttgtgtgccacggtgcacacggcctatctgtgagccctgtcggaggcctgtgtgctgtgacccctgttccctgcaagaagggtgttgtcgcccaataacttgttgccccagtagttgcacggctgtggtgtgtagaccatgttgctgggcaacaacttgttgtcagccagtgagcgtgcagagcccttgctgtcgccctccttgcggacagccaaccccttgtagtacaacatgtcggacctctagttgttag

SEQ ID NO: 29323 - DNA, 387 bp, Artificial Sequence
  Description of Artificial Sequence: Synthetic coding sequence
atgactggtagctgttgcgggtcgaccttttccagcctgagctatggagggggttgctgtcaaccgtgttgctgtagagatccatgttgctgtagacctgtaacttgccagacaacggtttgtcgacctgtcacctgcgtgccacgatgcacgcgacctatctgtgaaccctgccggagaccggtgtgctgcgatccctgtagtcttcaggaaggctgctgtagaccaattacatgttgcccgtctagctgcaccgctgtcgtgtgccgaccatgctgctgggccaccacctgttgtcagcccgtgtcagtgcaatccccctgttgcagaccgccttgtggtcaacccacaccatgctccaccacttgcagaacgtcctcatgctag

SEQ ID NO: 29324 - DNA, 297 bp, Artificial Sequence
  Description of Artificial Sequence: Synthetic coding sequence
atggattgctgcgcaagccgaggctgcagcgtcccaaccggcccagccacaaccatatgcagctctgacaagagttgtcggtgcggtgtttgcctgccaagcacttgtcctcatactgtttggctgctggaacccacttgctgcgacaactgcccgccaccctgtcacataccgcaaccgtgcgtcccaacctgttttctgctaaactcatgtcaaccaactcctgggttggagacgctgaatctgaccaccttcacacaaccttgttgcgagccgtgcctccctagaggatgttag

SEQ ID NO: 29325 - DNA, 297 bp, Artificial Sequence
  Description of Artificial Sequence: Synthetic coding sequence
atggattgctgcgcgtcacggagttgtagtgtccccaccggcccagccacaacgatctgcagctccgataaatcttgtcggtgtggcgtttgtctaccatctacctgcccccacacagtttggctgttggagccaatttgctgcgacaactgtcctcctccatgccatatcccacagccatgtgtgcctacatgtttccttcttaattcttgccagcctacccctggtttggagaccctgaatttgacaacctttactcaaccttgctgtgagccatgtctgccccgaggatgctag

SEQ ID NO: 29326 - DNA, 297 bp, Artificial Sequence
  Description of Artificial Sequence: Synthetic coding sequence
atgtattgctgcgccctgcgtagctgtagtgtgcccactgggcctgcaactactttttgctcattcgacaagagctgtaggtgtggtgtttgcttgccttccacttgtccacacgagatctctctgctgcagccaatttgctgcgatacatgccccccaccctgctgcaaacccgacacctatgtgccaacttgttggttacttaacaactgccatccaacgccaggacttagcgggattaatcttacaacttatgtgcagcccggatgcgaatccccctgcgagccacggtgttag

SEQ ID NO: 29327 - DNA, 291 bp, Artificial Sequence
  Description of Artificial Sequence: Synthetic coding sequence
atgtgtcataccagctgttcttctggatgccaaccggcttgttgcgctccttctccttgtcaggcctcctgctacatccctgtcgggtgtcagagctctgtatgtgtgcccgtatcctttaagcctgcagtgtgcgtgccagtaaggtgccagtcctcggtctgcgtgcctgtgagctgtcgacctgtcgtttacgccgcaccttcgtgccagagctccggatgttgtcagccaagctgtaccagtgtcctctgtcgtccaatttcatgttctaccccaagttgttgctag

SEQ ID NO: 29328 - DNA, 339 bp, Artificial Sequence
  Description of Artificial Sequence: Synthetic coding sequence
atgtgtcatactagtcattcaagtgggtgtccaatggcttgcccgggaagcccttgttgtgttcccagcacttgctaccctcccgaaggatatggcactagctgctgttgctcggctccttgcgtcgctttgttgtgtcgcccactgtgcggagtgagcacttgctgccagcctgcttgttgcgtgcccagcccctgccaggtcgcatgctgtgtccccgtgtcctgcaagcctgtgctgtgcgtggcgtctttctgccctacatctgggtgttgtcaacctttttgtcctactctggtctacaggcccgtcacttggtcgacccccacagggtgttag

SEQ ID NO: 29329 - DNA, 666 bp, Artificial Sequence
  Description of Artificial Sequence: Synthetic coding sequence
atggctactagcacaatgtctgtatgtagttcagcctacagcgactcatggcaggtggacgcatgccccgagtcctgttgcgagccaccgtgctgtgccactagctgttgcgcgcctgcgccatgtctaaccctggtctgcaccccagtctcttgtgtgtcttcaccgtgctgtcaggccgcttgtgagccctccccttgtcaaagtggctgcacaagtagctgcacaccatcctgttgtcaacagtcttcttgtcagcctgcctgctgcactagtagcccgtgccaacaggcatgttgcgtgccagtatgttgtaagccggtgtgttgtgtccccgtatgctgtaaaccagtgtgttgcaagcctatctgttgcgttcccgtgtgctcaggcgcttcttctagctgttgtcagcaaagctcacgacagccagcttgttgcactacatcctgctgcagaccatccagttccgtttcattgctttgcagaccagtgtgtcgatcgacgtgttgcgttcccattccttcttgctgcgctccagctagcacttgtcaaccatcctgctgccgacccgcaagttgcgtgagtttgctgtgtcggccaacttgtagcagactgtcttctgcctgttgcgggttgtcttctggacagaaatcatcctgttag

SEQ ID NO: 29330 - DNA, 768 bp, Artificial Sequence
  Description of Artificial Sequence: Synthetic coding sequence
atggcggcttctaccatgagtatatgcagctctgcttgcactaattcttggcaagttgatgactgccctgaatcctgttgcgagttaccctgtggcaccccatcgtgctgcgcaccagcaccatgtctcacacttgtctgcacgcctgtgtcctgtgtgagttcgccttgctgccaggcggcatgcgagccttccgcatgtcaatcaggatgtaccagctcctgcacaccttcttgctgccaacagagttcttgccagcctgcttgttgtacatcgtccccttgccagcaagcctgctgcgtgcccgtctgttgcaaacctgtctgttgcgttcccgtgtgttgcggtgcctcctcatgttgccagcagtcctcttgccaacctgcctgctgcgcctcaagcagttgccagcagagttgcagagtgccagtttgctgcaaggccgtgtgttgcgtgcctacctgttctgagtcttccagcagctgttgtcagcaatcaagttgccagcccgcttgctgcacatcctccccctgccaacagagctgttgcgtgtcagtgtgttgcaagcctgtgtgttgcaagtcaatctgctgtgtgcccgtgtgttccggggctagcagcccgtgctgtcaacaaagctcttgccagcctgcatgttgcacctcctcttgttgtcggccttctagttccgtgtccctcctgtgtcggccagtttgctcacgcccagctagctgttctttctctagtggtcagaagtcctcttgttag

SEQ ID NO: 29331 - DNA, 312 bp, Artificial Sequence
  Description of Artificial Sequence: Synthetic coding sequence
atgtgtggctcctattaccggaactacaatggcggtcacggctacggatgctgtggctatgggggtctgggttgcggatacgggggttgtggatatggctgctgcgggtacggcggtcttgggttcggatatggtggtctggactgtggctatggcggtctcggctgtggatatggatccttttgcggctgcggctaccgcggattagactgtgggtacggatgtggctacggatatgtttcccacagtttctgtgggtgtggttacagatgtggcagtggctacggcagttcctttggatattactactag

SEQ ID NO: 29332 - DNA, 3117 bp, Artificial Sequence
  Description of Artificial Sequence: Synthetic coding sequence
atggtgagctctgcgcagatgggatttaacctgcaggcacttctcgagcagcttagtcaggacgagctttctaagttcaagtaccttataactacgttttctttggcacacgaactgcagaaaattccgcacaaggaagttgataaagcggacggtaagcagctggtcgagatattgacgacccactgcgattcatattgggtggagatggcatcgctccaggtcttcgagaaaatgcacagaatggatctctctgagagagcgaaggatgaagtccgagaggccgcattgaagagctttaataaaagaaagcccctgagtctggcatttaccgagaccaaggggaacgtgatctgccttgggaaagaggtcttcaaaggaaaaaaacccgataaagacaatagatgtagatacattcttaagacaaagttcagagaaatgtggaagagctggccaggcgatagtaaggaggtccaggttatggccgaacggtacaagatgctgatacctttctctaacccgcgagtactgcctggacccttctcttatactgtagtgttgtatggaccggctggactggggaagaccacacttgcccagaaactcatgctggactgggcagaggacaatctgatccacaagttcaagtacgccttttacctgagctgtcgcgaactgtctaggctcggaccctgcagttttgccgaactggtattccgggactggcctgagttgcaagatgatataccacacatcttggcacaggcgaggaagatcctgttcgtgatagatggattcgatgaactaggagctgccccaggcgctttaatcgaggatatctgcggggactgggagaagaaaaaaccagtcccagtccttctaggatcactgctcaatagggtaatgctccccaaggccgctctgctcgtgacaacacgacccagagcactgcgggatctgcgtattttggcggaggagcccatttacatcagggtggaaggctttctggaggaagacaggcgagcatacttcctgagacactttggggatgaagaccaggccatgcgggcttttgaactcatgagatcgaatgccgcattgtttcagctgggcagcgcccctgctgtgtgttggatcgtgtgcacaacactcaagctgcagatggagaaaggggaagatccggttcccacctgtctaactaggacggggctctttttgcgtttcctgtgttcccgattcccccagggtgcccagctgaggggcgctttaaggaccctttcgcttttagcggctcagggcctgtgggctcagactagtgtactccacagggaagaccttgagagactcggcgtgcaagagagcgacctcaggctcttccttgatggcgacatcctcagacaggacagagtgagtaagggctgttactcattcatacacctcagtttccagcagttcctgacagccttgttctataccctggaaaaggaggaagaggaggacagggatgggcatacttgggacatcggggatgtgcagaagttactctcgggcgtggagcgactcagaaatcctgacctgatacaggccggatactattcattcggactggctaacgagaagagggcaaaggagctcgaagctaccttcggatgccgtatgtcccccgatatcaagcaggaactcctgcgctgcgacatcagttgtaaaggaggccactccacggttactgatctccaagagctgcttgggtgcctctatgaaagccaggaagaggagcttgtgaaagaggtcatggcacagttcaaggagatcagcctccatctgaacgctgtcgacgttgtgccaagctcattctgcgtgaaacactgtcgcaatcttcagaaaatgagccttcaggttattaaagagaacctccccgagaacgtgactgcgagcgaaagcgacgcagaggttgagagatcacaggatgaccagcacatgctgcccttttggacagatctttgctctatctttggctcaaataaagacttaatgggattggcaatcaatgatagctttctgtctgcttccctggtgcgcatcttgtgcgagcaaattgcttccgatacatgtcatctccaaagagttgtgtttaaaaatatctctccagcggatgcacatcgaaacttgtgcctggctttacgagggcacaagaccgttacgtatctgacattacagggcaacgatcaagatgacatgttccccgcattgtgtgaagtgttacggcatcccgagtgtaatctccgttatttgggcctggtgagctgcagtgccacgactcagcagtgggccgatctgtctctggccttggaggtgaaccagtcattgacatgcgtgaacctgtcggacaatgagctcctcgatgaaggcgcaaaactcttatatactaccttgagacaccccaagtgcttcctgcaaagactcagtctggaaaattgtcacctgacagaagccaattgcaaggacctggccgctgttctcgtggtgagtagagagctaacccatctgtgccttgctaagaaccccatcgggaacaccggtgtgaagtttctgtgtgagggcttacgataccccgagtgtaaactccagacccttgtgttgtggaactgtgatattacttctgatggctgttgcgatttgaccaagctcctgcaagagaagtcttcactgttatgtctcgacctgggcctgaaccacattggcgtgaagggcatgaaattcctctgtgaggcgctgaggaagcccctatgcaatttgcggtgcctttggctatggggatgctcaatccctcccttctcgtgcgaggacctttgcagtgccctttcgtgcaatcaatctctggtcacacttgatctcggccaaaacccgctcggctcttctggcgtgaaaatgttatttgaaacactgacctgttcctccggcacactcaggaccttaagattaaagattgacgactttaacgatgaactgaacaaattgcttgaggaaatcgaggaaaagaatccacagttgatcatcgacaccgaaaaacaccatccatgggcagaaagaccaagttcccacgattttatgatctag

SEQ ID NO: 29333 - DNA, 762 bp, Artificial Sequence
  Description of Artificial Sequence: Synthetic coding sequence
atggagctcgagcagagggaaggtactatggcagcagtgggcttcgaggaattctcagcaccgcctggctccgagttggcgctccccccactatttggcggtcacatcctggagtcagagctagagacggaggtggaattcgttagcggaggtttggggggaagcgggctgcgcgagagggatgaggaagaggaagccgctcggggacgccgaagaagacagcgggagctcaacaggcggaaataccaggcactggggagacggtgccgcgagattgaacaggtcaacgagagggtgcttaaccggcttcatcaggtgcaaagaataacacgaaggcttcagcaggagagacgattcctcatgcgcgttctggactcatatggggacgactaccgcgctagccagtttactattgtgctggaggacgagggctcgcagggcactgacgcgcctacccccggtaatgccgaaaatgaacctcccgaaaaggagacactgtccccacctagacgaacacccgctccaccagagccgggatcacccgctcccggagagggacctagtggaaggaagaggcgacgcgtgccgagagatggtcggcgagccggaaatgctctcactcctgaactcgctccagttcagattaaagtcgaggaagactttggctttgaggcagatgaggcactcgacagcagttgggtatcgaggggaccggataaactgttaccctaccccacactcgccagcccagctagcgattag

SEQ ID NO: 29334 - DNA, 2679 bp, Artificial Sequence
  Description of Artificial Sequence: Synthetic coding sequence
atgcttcgaacggctggaagagacggcctgtgcaggctgtcgacctacctggaggaactcgaggcggtagaactcaaaaagtttaagttataccttgggaccgccaccgagctgggcgaggggaagatcccctggggaagtatggagaaagccggaccattagagatggcccagttgcttataacccactttgggccagaggaagcctggagacttgccctctctacattcgaacggatcaaccgaaaggacctgtgggagcgtgggcaacgtgaagatctggtaagagatactccgcctggcggtccatcatccctaggtaaccagagtacatgcctgctcgaagtcagtctcgtcactcccagaaaggacccacaggagacataccgggattacgtgagacggaaattccgtcttatggaggatcgtaacgcgaggctgggagaatgcgtcaacctgtcacatcgatatactcggttgctgctggttaaggagcattccaatccaatgcaagttcagcagcagctcctggataccgggagaggccatgctagaaccgtaggtcaccaggcgtcaccaattaaaatcgagactttgttcgaacccgacgaagaacgacccgaacctcccaggaccgtcgtaatgcagggagctgccggtatagggaagtcaatgctggcccacaaggtaatgttggactgggccgacggtaagctttttcagggcaggtttgactatctgttctatatcaactgtcgcgaaatgaaccaaagcgcgactgaatgctccatgcaggaccttatatttagctgttggccagagcctagcgcacctctgcaggaactgatacgcgtaccagagcggctcctgtttatcatcgatggttttgacgagttaaaaccctcctttcatgatccacaggggccttggtgtctgtgctgggaagaaaagcgcccaaccgagttgctgttgaactccctaatcagaaagaagctcctgcctgagctctctctgctgataaccacaaggcctaccgcccttgaaaagctccatcgactcctggaacaccccagacacgtcgagatattaggatttagtgaagcagagcggaaggagtatttttataagtacttccataacgccgagcaggccggtcaggtattcaactacgttcgcgataatgaacccctctttaccatgtgtttcgtgcccctcgtgtgctgggtggtgtgtacttgcctgcagcagcagcttgaggggggaggcctgcttaggcaaacctcgcggacgactaccgctgtttatatgctgtaccttctgagtttgatgcagccaaagccgggagcaccccgtcttcagccaccaccgaaccagcgagggctatgtagcctagctgcagacggactgtggaatcagaaaatcttgtttgaagagcaggacctgaggaagcacggcctggacggcgaggacgtgtccgcatttctgaacatgaacatttttcagaaggacattaactgcgagagatattattcattcattcatcttagtttccaagagttcttcgctgccatgtattacatcctggatgagggagaaggtggagctggacctgaccaggacgtaacccgactattaacggagtatgctttttctgaacgcagttttctcgccctgacgtcacgcttcctctttggactgttaaatgaggaaacccgtagtcatttggaaaaaagcctttgttggaaggtgtcaccccatattaagatggatctcctccaatggattcaatccaaagcccaaagcgacggttctaccctgcagcagggatccctggaattttttagctgtctgtatgagatccaggaagaggaattcatacagcaagccctgtcccacttccaggttatcgtagtgagcaacatcgcctccaaaatggagcatatggtctctagcttttgccttaagcgctgccgctccgcccaagtactgcacctttacggagcgacttatagtgcggacggggaggatcgcgctcggtgttccgccggagctcatacgttactagtgcaattacgcccagaacgcacagtgctgctggatgcttacagtgagcatttggcagcagccctgtgtaccaatcccaatctgatagagttaagcttgtatagaaacgccctgggatccagaggagtgaagctgctctgtcagggattgcgacatcccaactgtaagctgcagaaccttaggctgaagagatgtcgcataagttccagtgcctgcgaggacttatccgccgcactgatcgccaacaagaacctgacccgcatggatttgagtggcaacggagttggattcccaggaatgatgctgttatgtgaagggctcagacacccacagtgccgattacagatgatccagctgcggaagtgccagttggagagcggtgcctgccaggaaatggctagtgtgctcggaacaaatccacacctagtggagctggaccttaccggcaacgcgctggaagatttgggtctaaggctcttgtgccagggactgaggcacccggtatgccggcttagaacactgtggtggctgttcggcatggacctcaacaaaatgactcacagtcgtctagcagctcttagggttactaaaccgtatctcgacattggctgttag

SEQ ID NO: 29335 - DNA, 3189 bp, Artificial Sequence
  Description of Artificial Sequence: Synthetic coding sequence
atgctgcgaacagcgggaagagacgggttatgccgactttctacctacttggaggaactcgaggccgtagagttgaaaaagttcaagctgtacctgggcacagctactgaactgggtgagggcaagatcccttgggggagcatggaaaaggcgggaccgctcgagatggcccagcttctgatcacccacttcgggcctgaggaggcgtggcggttggctttgtccacatttgaacgtattaatagaaaggatttgtgggagcgcggtcagcgggaagatctggtcagagatacccctcctggaggcccttcctcactcgggaatcagtccacgtgcttgctcgaggttagcctggttacaccccgaaaggacccacaggaaacctacagggattacgtgcgcaggaaatttagacttatggaagaccggaacgcccgacttggagaatgcgtcaatctttctcacagatacactaggctattattagtaaaggaacactccaaccccatgcaggtccaacaacaactcctggataccggaaggggacacgccaggaccgttggtcaccaggcttcgcctatcaagatcgagactctgtttgagcctgatgaagagagacctgaacctccgagaacggtggtcatgcagggagctgccggaatcggcaaaagcatgctggcccacaaagtgatgctggattgggctgatgggaagctgttccaaggaaggttcgattacctattctatattaattgtcgcgagatgaatcagtctgcaaccgagtgttctatgcaggacctgattttctcatgttggccagagccatctgcacccctccaggaactgattagagtaccggagaggctcctgtttattatcgacgggtttgacgaactgaaaccgagttttcacgatccccagggtccgtggtgtctgtgttgggaagaaaagaggcccaccgagctgctcctcaatagcctgattcgcaaaaaactgctgcccgaacttagcctgttgattacaacacggcctactgcgctggagaaacttcaccggctgttggagcaccccagacacgtggagatcctcggtttctccgaggccgagagaaaggaatacttttataagtacttccacaatgctgagcaggcagggcaagtgtttaattacgtgagagacaatgagccactgttcactatgtgctttgtgcctctggtatgttgggttgtctgtacctgcctgcaacaacagcttgagggcggtgggctgctcagacagacctctagaaccaccacagcagtgtatatgctttatctactgtccctgatgcaacccaagcctggggctcctaggcttcagcctccaccaaatcagcggggattatgcagtcttgctgccgacggactgtggaaccaaaaaattctttttgaagagcaggacctgcgaaaacacgggttggacggagaggacgtgtctgccttcttgaatatgaacatcttccaaaaagatatcaactgtgaaagatactactccttcattcacctatctttccaggagttttttgccgcaatgtactatattttggacgaaggggagggcggtgcgggtcccgatcaggacgttaccaggctgttgaccgagtatgcattcagtgagagatctttcctcgccttgactagtcggtttttgttcggcttactgaatgaggagaccagaagccatctcgagaaatccctgtgttggaaagtctccccccatatcaagatggacctgcttcagtggatccaatcgaaagcccagtctgatggatctacgctccagcaaggttccctggaatttttctcttgcctgtatgagatccaagaagaagagttcatccagcaagcactctcacactttcaggtgatagtagtgtctaacatcgcgtccaaaatggagcacatggtgagctctttctgcctgaagagatgcagatccgcccaggtgcttcacctgtatggtgcaacatactcagccgatggggaagatagagcgagatgctctgctggcgcacacactttgttggtgcagctcaggcctgaaagaactgtgctcctggacgcctatagcgagcacttggccgcagccctgtgcaccaatcccaatctgattgaactttccctgtatcgtaacgcgctgggttcccgtggggtcaagttgctttgtcaggggctgagacatcccaactgcaagctacagaatctgagattaaaaagatgcaggatttccagttctgcttgcgaagatttgtctgccgcactgatcgctaataagaatcttactaggatggatctcagtgggaatggagtcggctttcccggaatgatgttgctgtgtgaaggactgcggcacccgcagtgtcgattgcagatgatccagctcaggaaatgccaacttgagagcggagcatgccaggaaatggccagtgtgctgggcaccaatccacatctggtggagcttgatttgacaggcaacgcactggaggatctgggcctccggctgctctgccagggattgaggcatccagtgtgccggctgaggacattatggctgaaaatatgccgactgacagccgcagcgtgcgatgagctggcatccactctgtctgtgaaccagtctctgagagagttagatttgagcctgaacgaactcggcgatttgggagtcctgctgctgtgcgaaggtctacgtcatccaacctgcaagttgcaaacactccggcttggtatctgccgactggggagcgctgcttgcgaagggttgtctgttgttctgcaggcaaaccacaatctccgggaactggatctctctttcaacgacctgggagattgggggctgtggctgcttgcagagggcctccagcatccagcgtgtcgcctgcaaaagctgtggctcgacagctgcggactgacggctaaagcatgtgagaacttatattttacacttggaattaaccagactctgaccgatctgtatctgactaataacgctttaggtgataccggcgtgcgacttctgtgtaagcgattgtcccaccccggatgtaaacttagagtgctatggctgtttggcatggatctgaacaagatgactcattctagactggcggcacttcgcgtgaccaaaccttacctagacatcgggtgttag

SEQ ID NO: 29336 - DNA, 3015 bp, Artificial Sequence
  Description of Artificial Sequence: Synthetic coding sequence
atgctgaggactgctggccgtgacgggttgtgccggctctccacctatctggaggaactggaggctgttgaattgaaaaaatttaagctgtacctgggcaccgctactgaactgggcgaaggtaaaatcccatgggggagtatggaaaaggccggaccccttgagatggcacagctgctcattacccacttcgggcctgaggaagcctggcgcctggcactatctacattcgagcggatcaacaggaaggacctctgggaacgaggacaacgggaagaccttgtccgcgacacacccccagggggaccgtcaagcctcggaaaccaatccacatgcttgctggaagtgagcctggtaactcccaggaaggatccccaggagacttatagggactatgtaaggagaaaatttaggcttatggaagaccgcaacgccagattgggggaatgtgtaaacctgagccatcggtacacccggctcctgctggttaaggaacattctaacccgatgcaagtccaacagcagctgctggataccggcagggggcatgctagaactgtcggacaccaggcttcccccatcaagattgaaactctgtttgagccggatgaggagcggcctgagccgccacggacagtagtgatgcagggggctgcgggtatcggaaagtccatgctagctcacaaggtcatgttggactgggccgatggaaagctgtttcaggggagattcgactatctgttctacatcaattgtagggagatgaaccagagcgcaacagagtgttccatgcaagatctcattttttcttgctggcccgagccgtctgccccactgcaggagctgatccgggtgccagagagattgctgttcattattgatgggtttgatgagctgaagcctagtttccatgatccccagggaccctggtgcttatgctgggaggaaaagcggccaacagagttactcctgaacagtctcattcgcaagaaactgttacccgagctgagtctgctcatcacaaccaggccaacggccctggaaaagttgcataggctgctggagcacccgcgacatgtcgagattctcgggtttagtgaggccgagcggaaggagtatttctataaatatttccataacgccgagcaggccggtcaggttttcaattatgtgagagataacgagcccttatttaccatgtgttttgttcccctggtttgctgggtcgtgtgcacctgtttgcagcagcagctcgaaggcggaggactgttgagacaaacatcgcgcactacaacagccgtgtatatgctctacctgctgtctctgatgcagcctaaaccaggtgccccaagactgcagccacctcctaatcaacggggtctctgctcactggccgcagatggtctgtggaaccagaaaatattattcgaggaacaggatctccgaaaacacgggctcgacggggaagacgtatcggccttcctgaatatgaatatttttcagaaagatatcaactgcgaaaggtattactcgtttattcacctttcctttcaggagttttttgccgctatgtactatattttagatgaaggtgaagggggagccggaccagatcaagacgtcacgcggctgctgacagaatatgccttctccgaacggagtttcctggccctgacttcaaggttcctgtttggtctcctcaatgaggagacacgttcacatttagagaaatccctctgctggaaggtcagcccccacatcaagatggacttactccagtggatccaatccaaagcccagtccgacggaagcacccttcagcagggctccctggaattcttcagctgcctgtatgagatccaggaggaggagttcatccaacaagccctgtctcacttccaggtcatagtggtctccaatatcgcatcaaaaatggagcacatggtgagctccttttgcctgaaaagatgcagatctgcccaggtgctccacctgtacggggcaacgtattcagcggacggggaagatcgcgctcggtgtagtgcaggagcccacacactgctcgtgcaactacccgagagaacagtgctccttgatgcatacagcgagcacctggccgctgccctttgtaccaatcctaacctgatcgagctgtccctgtatcgcaacgccctggggtccaggggcgttaaactgctctgtcaggggttaaggcatcctaactgtaagttacagaacttgcggctgaagcggtgtagaatctcctcctctgcctgtgaggatctttctgccgcactgatcgccaataagaacctcacaaggatggatctgtccgggaatggagtcgggtttcctgggatgatgctgctttgcgagggcctacggcacccacagtgccggctacagatgattcagttacggaagtgccagctggagtccggagcttgtcaggagatggcctcggtgctggggacaaatcctcatctcgttgagctcgatttgactggcaatgcactggaggacctcggtcttcgacttctatgccagggactgcggcatccggtctgtcggcttaggactttgtggcttaaaatctgtagactgacagcagccgcatgcgacgagctcgcaagcaccctctcagtgaaccagtcgctgagagaattagatctgtcactcaatgagctaggggaccttggagtgctgcttctgtgcgagggtctgagacatcctacctgcaagttacagacactgaggctggacagttgtggcctaaccgccaaggcatgcgaaaatctgtacttcacactggggatcaatcagacgttaaccgatctctacctaaccaataacgccctgggcgacactggagtgcgactcctctgtaagcgtctgtcgcatcctggctgtaagctgcgggttctgtggctctttgggatggatctcaataaaatgacacattccagactcgctgctctccgggtgaccaaaccttacttagacattggatgttag

SEQ ID NO: 29337 - DNA, 327 bp, Artificial Sequence
  Description of Artificial Sequence: Synthetic coding sequence
atggcctctggacgtccagaggagctgtgggaagccgtggtgggagcagccgagcggttccgggcacggacgggtactgaactggtccttcttacagctgctccgcctcctcccccaaggccaggaccgtgcgcgtacgccgcacacgggcgaggcgctttagcggaggccgcacggcgatgcctgcatgacattgcattagcccatcgtgccgctacagccgcaaggccccctgcaccaccccctgccccacagcccccatctcctaccccatccccaccacgcccaacactggcgagggaagacaatgaggaagacgaggactag

SEQ ID NO: 29338 - DNA, 771 bp, Artificial Sequence
  Description of Artificial Sequence: Synthetic coding sequence
atggcctccggacgccctgaggagctctgggaggccgtggtgggggctgctgagagattcagagcccgaaccgggactgagctagttttgctgaccgccgctcctcccccacctccaagacccggaccttgcgcgtacgccgcacacggcaggggcgctctggccgaggcagccaggagatgcctgcacgacatcgctctggcccacagagcggctactgccgctcggccacccgcacctccccctgctccccaacccccttccccaacccctagccctccccgacccaccctggccagggaagacaacgaagaagatgaggatgagcccaccgagacggaaacgtcaggcgagcaattgggaatcagcgataacggaggactcttcgtcatggatgaagacgcaactttgcaggacctaccccctttttgcgagtcagacccagagagcaccgacgacggatcactgagcgaggagaccccagccggaccacccacgtgtagtgttcctccagcttccgcactgccaacacaacagtatgccaagtctctgccagtgagcgttccagtgtggggcttcaaagaaaagcggacagaggcacgctctagtgatgaagaaaatggacctccctcctcaccagacctggataggatcgctgcatccatgcgggcactggtgctcagagaggcagaggatactcaggtctttggggatctccccagacccaggctcaacacgagtgattttcaaaaattgaaacgaaaatactag

SEQ ID NO: 29339 - DNA, 771 bp, Artificial Sequence
  Description of Artificial Sequence: Synthetic coding sequence
atggccagcggcagaccagaggagctgtgggaggccgtggtaggcgctgcggaaaggttcagagccaggactgggaccgagctggtgctgttgacagccgctccacccccacccccacgccctggcccttgcgcttacgcagcccacggtcgcggagctttggctgaggccgctaggaggtgtctgcatgacatcgcgcttgctcaccgcgctgcaacagctgcccgacctcccgctcccccacccgcaccacagcccccatcccctacgccaagtccgccacgcccaaccttagcacgcgaggacaatgaagaggatgaggatgaaccgaccgagacagaaacgagcggcgagcagctgggcatttctgacaacggcggactgttcgttatggatgaggatgccaccctccaggatctcccaccgttctgtgaatccgatcccgaatcgacagacgatggtagtctgtccgaggagacccctgccggaccgcctacatgctccgtgcctccagctagtgctcttccgacccagcagtatgcaaaaagtctgccggtatcagtccccgtctggggctttaaagaaaaacgtaccgaagccaggtccagtgacgaggaaaatggccctcccagcagccccgacctcgataggatcgctgccagtatgagggcattagttctaagagaagccgaggacactcaggtgtttggtgatctgcccagacctagattgaatacctcagactttcagaagctgaagaggaaatattag

SEQ ID NO: 29340 - DNA, 771 bp, Artificial Sequence
  Description of Artificial Sequence: Synthetic coding sequence
atggctagcggcaggcccgaggaactttgggaagcggtggtcggggctgccgaaagattccgcgcacggaccgggaccgaactggttctcttaactgcagcaccccctccccctcctcgccctggcccatgcgcctacgcagcccacggcaggggtgcgttggccgaagctgccagacggtgcctgcacgatatcgcactagctcatcgggcagcgacggccgcacgtccccctgcccctcctcccgctcctcagcccccttccccaaccccatccccaccaagaccaacactcgccagagaggataatgaggaagatgaagatgagccaactgagaccgaaacgtccggtgaacagctggggatttcagacaatggaggactctttgtcatggacgaggatgccacactgcaggacctgccccctttctgtgagtcagatcctgaaagcaccgatgatggcagcctgagcgaagagacacccgcaggaccaccaacctgctctgtacccccagcctctgcgctgcctacacagcagtacgcaaaaagcctccctgtgagtgtgccagtgtggggctttaaagaaaagcgaactgaagccagaagttctgatgaggaaaatggacccccttccagtcccgacctggataggatcgcagctagcatgcgggctctcgtgctgcgggaggcagaggacacacaggtatttggtgacctacctcggccaagattgaacactagcgactttcagaagctgaagcgtaagtattag

SEQ ID NO: 29341 - DNA, 771 bp, Artificial Sequence
  Description of Artificial Sequence: Synthetic coding sequence
atggcctcagggaggcctgaggaactctgggaggccgtagtgggtgctgctgagcgttttagggcgcgaaccggcaccgagctggtactcctgacagctgctcccccaccccctccccgacctggcccttgtgcctatgccgcacatggccgtggcgcattggctgaggccgcaagacggtgccttcacgatatagcactggctcaccgggctgccacggctgcacggccaccagcacctcctcccgctccccagcctccaagcccaacaccctctccaccccgaccgacattggcccgagaggataacgaagaagatgaggacgagccaaccgagaccgagacctcaggcgagcagctcgggatttccgataacggaggtctgttcgtcatggacgaagatgcgactctgcaggacctgccaccattttgtgagtctgatcctgagtccacagatgatggcagcctgtcagaggaaacccctgccggaccccctacttgctctgttcctcccgcatcagcacttccaacccagcagtatgctaaaagcctacccgtctctgtgccggtgtggggttttaaggaaaagcgtactgaggctcgctcttccgatgaggaaaatggccctccatccagccctgatctcgataggatcgccgcatcaatgcgggctctggttctgcgcgaagccgaagacacccaggtgtttggcgatctgcccagacccagacttaacacttccgatttccagaaattgaaaagaaagtactag

SEQ ID NO: 29342 - DNA, 831 bp, Artificial Sequence
  Description of Artificial Sequence: Synthetic coding sequence
atgtccttcgaaggcggtgatggggcaggaccggcaatgctggcaaccggcaccgctaggatggcctccggaaggcctgaggaactgtgggaggcagtcgtgggggctgcagaaagatttcgtgccaggactggcacagagttagtgctacttaccgccgcaccccctcctcctcccagaccaggcccttgtgcttatgctgcacatggcaggggagcccttgccgaagccgctcggaggtgcctacatgatatcgctctcgcacacagagccgcaacagccgctcggcctccagcaccgccacccgctccccagcccccaagtcctactccctctcctccgagacccaccttggctcgagaagacaacgaagaagacgaagacgagcccaccgaaacagaaactagcggcgaacagctcggcataagcgataacggaggcctctttgtcatggacgaggatgccactctgcaggacctccctccgttctgtgagtcagatcctgagtctactgatgatggaagtctatcagaagaaacacccgcaggcccaccaacgtgctccgtgccgcctgcgtccgctctccccacgcagcagtacgctaagtccctccctgtaagtgttcccgtgtggggattcaaggagaaaagaaccgaggctcggtccagtgacgaggagaatggcccaccctccagtcccgatctggaccgaattgctgccagcatgcgcgctctggttttgagggaggcggaagacacccaagtgttcggtgacctccctaggccacggttgaacacctctgacttccagaaactcaagagaaaatactag

SEQ ID NO: 29343 - DNA, 906 bp, Artificial Sequence
  Description of Artificial Sequence: Synthetic coding sequence
atgacgaggcacggcaagaattgtaccgccggagctgtttacacgtatcatgagaagaaaaaagataccgccgcttccgggtacggcacacagaacatacggcttagcagggacgccgtcaaagactttgattgttgctgtttaagcctacaaccatgccacgaccccgtggtcacccccgacggttatctctacgagagggaagccatccttgagtatatactgcatcaaaaaaaagagatcgcacgccagatgaaagcttacgaaaagcagagaggtactaggcgagaagagcagaaggagctccagagggcagcctcccaggatcacgtgaggggtttcctagagaaagagtctgcaatcgtgagccggccactcaatccgtttacggcgaaggcactttctgggacctcccccgacgacgtgcagcctgggccatcagttggacctcctagtaaggacaaagacaaggttctgccatccttctggattccaagccttactcctgaagctaaggcaactaagctggagaaaccaagcagaacagtgacatgtcccatgagtggtaaaccactgaggatgtccgatctcacccccgtgcacttcacacctctggattcatcagtagacagagtcgggttgataacgcggtctgagaggtacgtctgtgccgtaacccgcgactccctctccaacgctacgccttgcgccgtcctcaggccatctggggcagtcgttactttagaatgcgtggagaagctgattagaaaggacatggttgaccccgtaactggggacaaactgactgacagggatattatagtcctgcagcggggagggacgggattcgccggttctggagttaaactccaggcagaaaaatcacgccctgtaatgcaggcctag

SEQ ID NO: 29344 - DNA, 612 bp, Artificial Sequence
  Description of Artificial Sequence: Synthetic coding sequence
atggcagaggttcaggtcctggtgctcgacggacgcggacacctgctcgggagactggccgcaatcgtggccaagcaggtgctgctcggccgtaaggtggtcgtggtgaggtgtgaggggataaatatctccggcaacttctacaggaataaactaaagtacctcgcctttcttcgaaagagaatgaacacaaacccctcaaggggaccataccattttcgtgcaccttcccgcattttctggagaacggttcggggaatgctgcctcataagacgaagagggggcaggccgcactagatcgcctcaaggtgtttgacggcataccacctccctacgacaaaaaaaagcgaatggttgtgcccgctgctctcaaagttgtacgactaaaacctacccgcaaattcgcatacctaggtcgtctggctcatgaggtcggatggaagtatcaggctgtaaccgctacactggaggagaagcggaaggagaaagccaagatacactatcggaagaaaaagcagttaatgaggttgcgaaagcaggctgaaaagaacgtagagaagaaaatcgataagtatactgaagtcctgaaaacccacggcctgcttgtgtag

SEQ ID NO: 29345 - DNA, 690 bp, Artificial Sequence
  Description of Artificial Sequence: Synthetic coding sequence
atgacctgttgcagtcaggtccctcccagaagaaggccaagcttagctttatctcccagactggactgtaacggactaaatggggtgcccggtagcatttgggatttcgtttccggaagcttctcaccttccccttctcccatcctctctgcgggacccccttcttcaagcagtgcgagccccaacggagccgaacttgcaagagttaggagacagctggacgaagccaagcggaagatccgacagtgggaggaatcctggcaacaggtcaagcaagtgtgcgatgcgtggcagcgcgaggcacaggaggcaaaggaacgagctcgcgtcgcagatagcgaccggcagctggccctgcagaaaaaggaggaagtcgaggcacaggtcaaacaattacaggaggaattggaagggctgggtgttgcctccaccctgcccggattacgagggtgcggggacatcgggaccatcccactgcccaagctgcacagtctgcagtcgcaactgagactggacctcgaagctgtggacggcgtgatattccagttgcgggctaaacaatgcgtggcttgtagggagcgggctcatggcgctgtgctgcggccttgccaacaccatatcctgtgtgagccttgcgcagcaaccgccccagagtgtccgtactgcaaaggccaaccactccaatggtag

SEQ ID NO: 29346 - DNA, 2283 bp, Artificial Sequence
  Description of Artificial Sequence: Synthetic coding sequence
atgatggaagagagagcagctgccgcagtcgctgccgcagcctcatcttgcagacctctcggcagcggtgcaggaccaggaccaacgggtgccgctcctgtgtccgccccagcgccaggccctggacccgctggtaaaggagggggaggtggcggttcccctgggccaaccgcaggccctgaacccttgagccttcccggaatcttacatttcatacagcacgagtgggcacgtttcgaggctgaaaaggccaggtgggaggccgagcgggcagaactccaggctcaggtcgcatttctccagggggagcgtaaaggccaagaaaacctcaagaccgacctggttcgacggattaagatgctcgaatacgcgttgaagcaggagcgcgctaaataccacaaactgaagtttgggactgacctgaatcagggcgagaaaaaagcggatgtgtccgagcaggtgtctaacggcccagtagagagcgtaactctggagaattctcccttagtctggaaagaaggtaggcagctactgcgacaatacctcgaagaggtgggctatacagatactattttggacatgagatctaagagagtgcgctctcttctgggtagatctctcgagctgaacggcgctgtggagccaagcgaaggagcccctcgggctcccccagggccagctgggctcagtgggggtgagagccttctcgtcaaacagattgaggagcagatcaagaggaacgcagccggaaaggatggaaaggaacgcctgggcggtagcgtacttggccagattccattcctgcagaattgtgaagacgaggattcagacgaagacgatgaactggacagcgtgcagcacaaaaaacagcgggttaaactaccctccaaggccctagtgcccgaaatggaggatgaggacgaggaagatgacagcgaagacgccattaatgaattcgactttctaggctccggcgaggatggcgaaggcgcacctgacccaaggaggtgcacggtggatggctcaccccatgagttggagagccgcagagtgaagctccagggaatactggccgatcttcgggatgttgacggtcttcctcctaaagtgactggtccacctcccggaacaccccaaccaaggccccacgagggatccttcggattctccagtgatgtattcataatggatacgatcggcggtggtgaggtcagcctgggcgatcttgccgacctgacggttaccaatgacaatgacctgagctgtgatctttccgattctaaagacgccttcaagaagacctggaatcctaaatttacattaaggagccactatgacgggatccgatcactggcattccatcactcccagtcagcactgctgacagcgagcgaggatgggactctcaaactttggaacctccagaaggcagtgacagctaaaaagaatgccgcactcgatgtagagcccattcacgcattcagagcgcaccggggtccagtactggctgtggccatggggagcaattccgagtattgttatagtggaggtgccgacgcgtgcatccatagttggaagattccagacctctccatggacccatacgatggctatgatccctccgtcttgtcccatgttctggaaggtcacggcgacgccgtctggggtcttgccttctctccgacctctcagaggctggcctcatgttcagccgacgggaccgtgagaatttgggatccgtcatcctcgtcccctgcctgcttgtgcactttccccaccgcctctgaacatggcgtgcctaccagtgtggccttcacctctactgagcccgctcacatcgtggcatctttccgctccggtgataccgtgctgtacgatatggaagtgggcagtgctctactcaccctcgagagccgcggaagctcaggccctacccagatcaatcaagtcgtgagtcacccaaatcagccgttgaccatcactgcgcacgacgatcgtggtatcagatttctcgacaaccgcacaggtaagcctgtgcatagcatggtggcacacctggacgcagtcacttgcctggccgtcgaccctaatggagcttttctgatgtctggatcgcacgactgctcgcttcgtctgtggtccctagataacaaaacctgcgttcaggaaattacagcacacagaaaaaaacacgaagaggccatccacgctgtagcatgccatccctccaaagctttgatcgcctcagcgggagcggacgcgttggctaaggtgtttgtttag

SEQ ID NO: 29347 - DNA, 327 bp, Artificial Sequence
  Description of Artificial Sequence: Synthetic coding sequence
atgactcccgaagagcttcagaaacgcgaagaggaggaattcaataccgggccacttagcgttttaacacagagcgtaaagaataatacccaggtgctgataaattgtcggaataacaagaagctactcggcagagtgaaggccttcgaccgacactgcaatatggtgctggagaacgtgaaggagatgtggaccgaggtccccaaatcaggcaagggaaagaagaagtccaaacccgttaataaggaccggtatattagcaagatgtttctgcgtggtgacagcgtgattgtagtgttaaggaacccgttaatagccggaaaatag

SEQ ID NO: 29348 - DNA, 1275 bp, Artificial Sequence
  Description of Artificial Sequence: Synthetic coding sequence
atggtgcagactctgtattactccgcagaccataagctcctggatggtaatctgttggacggacaggcagaggtgtttgggagtgatgacgaccacatacagtttgtgcagaagaagcccccacgtgaaaatggccataagcagatttccagctccagcacaggatgcctgtcctctccaaacgctactgtgcaatctcccaagcacgagtggaagatagtggcctcggaaaagacatctaataacacttatctgtgtcttgcagtgctggacggaattttttgcgttattttcctccatggcaggaatagcccccagtcgtctcccacctctaccccaaaactgagcaaaagtctatcctttgaaatgcagcaggacgagttgatagagaaaccaatgtctcctatgcaatatgctcggagcggcctggggacagctgaaatgaatggtaagcttatagccgctggcggatataacagagaggagtgtctgaggacagtggagtgttacaacccacatactgaccactggtcttttctcgcacccatgcgaactccaagggcacgttttcagatggccgtgcttatgggtcagctgtacgtcgtgggcggaagcaatgggcacagcgacgacctgtcatgcggcgaaatgtacgactctaacatcgatgactggatccccgtgcccgagctgcgaaccaaccgctgtaatgctggagtgtgtgcacttaatggcaagctgtatatcgtggggggtagtgacccctatggtcagaaggggttgaaaaactgtgatgtcttcgaccctgtgactaaactgtggaccagttgtgcccctctaaacatcagaaggcatcagagcgctgtgtgtgaattaggagggtacctatacatcatagggggtgcagagagctggaactgtctcaatacagtggaaaggtacaaccccgagaacaacacttggactcttattgctcctatgaatgtcgcgcgacgcggagctggtgtcgcggtcctaaatggcaaactcttcgtctgcggcggattcgacggcagccatgcaatttcttgtgtcgaaatgtatgaccccaccagaaatgagtggaaaatgatgggcaacatgacttcaccacgctctaacgctggcatcgcgactgtgggcaacaccatatacgccgtaggaggtttcgacggtaacgagttcctgaacacagtcgaagtctacaatttggaatcaaatgaatggtccccctacacaaagatttttcagttctag

SEQ ID NO: 29349 - DNA, 483 bp, Artificial Sequence
  Description of Artificial Sequence: Synthetic coding sequence
atgaacaacgccaggtacttgtggaagagaatacctcctgccattaaatcggcaaatagtgagcttggaggcatatggtcagtcggccagcgcatttggcagcgcgatttcccgggtatttatacaactatcaacgctcaccagtggtccgagactgttcaacccatcatggaggccttgcgcgatgctaccagaagacgggctttcgctctcgtcagccaggcatatacttccataattgcggacgattttgctgcctttgtcgggctgccagttgaggaagctgtgaagggcatcctagagcagggctggcaagcagactccacaactcgcatggttctgcctcgaaagccagtggccggagccctggatgtctcatttaacaaattcatcccgctcagtgaaccagcccctgtgccaccgatcccaaatgaacagcagctggcacgattgacagactatgtagcttttctcgaaaattag

SEQ ID NO: 29350 - DNA, 927 bp, Artificial Sequence
  Description of Artificial Sequence: Synthetic coding sequence
atgatggaagagataagtataatggtagcttacgacgctcacgtgttctcacagcttcatgatgaagactttcttaccagcctggtcgctatttctaagccccgatcgatggtgccaacaaagaagcttaaaaagtacgagaaggagtaccagacaatgagagaatcccagctacaacaggaggaccccatggatcgttacaagcgggagaacagaaggcttcaggaggctagtatgcggctggagcaggaaaacgacgatctggcccacgagcttgtcacctcgaagatcgctctccgcaacgatctggatcaggccgaagataaggccgatgtcctgaacaaagagctgcttctgaccaaacagaggctggtggaaacggaagaggaaaagcgcaagcaagaggaagaaactgctcagctcaaggaggtctttcgcaagcagcttgaaaaggccgaatacgaaattaaaaagaccacggctatcatcgccgaatacaaacagatttgttctcagttgagtacccgcttggagaaacaacaggctgcctccaaggaggaactcgaagtggtgaaaggtaagatgatggcctgtaagcattgctctgatatcttctccaaagaaggtgccttgaagctcgccgctaccggtagggaagatcagggcatcgagaccgacgacgagaaggacagcctcaaaaaacaacttagggaaatggagctagagttggcgcagacgaaactacagctggttgaggcaaagtgcaagatacaggaattggagcatcagagaggcgctttgatgaacgaaattcaagccgcaaagaattcatggttttctaaaaccctcaactccattaagactgcgacgggcacccagccccttcaaccggcaccagtgactcagccacctaaggaatctacatag

SEQ ID NO: 29351 - DNA, 3600 bp, Artificial Sequence
  Description of Artificial Sequence: Synthetic coding sequence
atggcatccgccggaactcagcactacagtatcggactgagacagaaaaattcctttaagcagagcggtccatccggaaccgtacccgctacacccccagagaagcctagtgaaggaagggtatggccccaagcccatcagcaagtcaagcctatttggaaactcgagaaaaagcaggtggagacattatctgcaggactggggcctgggctcctcggcgtgccccctcaacccgcatactttttttgtccgtccacattgtgtagctcaggcacaaccgccgtgattgccggtcattccagttcttgttatctgcatagtctccccgatctcttcaattctactttactgtatagacggagctcttaccggcaaaagccctatcagcagctggaatcattttgcctgcgatcatctccatccgagaagagccctttttctttacctcagaaaagtcttcccgtcagcttgaccgccaacaaggctacaagcagtatggtcttctcaatggctcaacccatggccagtagctcaacagagccttacctgtgcctggctgcggctggtgagaatccaagcggcaagtcgttggcttcggctatctctggcaaaataccttctcccctgtcctcgagctacaaacccatgttgaataacaactccttcatgtggccaaactcaacacccgtgcctctactccaaactacacaagggttgaagccggtgtctccaccaaaaatccagcccgtgagctggcaccacagtgggggtaccggtgactgcgctccacagcccgtagatcacaaggtcccgaaaagtattggcactgtacctgctgacgcctcggctcacatagctctgtccacagcgtcttctcatgacactagcacaacaagtgtggcctcgtcctggtataacagaaacaacctggccatgcgggcagagcccctcagctgcgctttggatgatagctcagactcccaggaccccacaaaggagatccgctttacggaagcggtgagaaaactcactgctcgcggatttgagaagatgccgagacagggttgccagctggagcagtcaagcttcctcaatccatctttccagtggaacgtgctgaatagatctcgccgttggaagcctccagccgtgaatcagcagtttccccaagaggacgccggttcagtaaggagagttctcccaggagccagcgataccttaggactggacaacacagtattttgcacaaagagaatttccattcatttgttagcgtctcacgcgtctggtttgaaccacaatcccgcttgcgagagcgtgatcgacagctctgccttcggcgaggggaaggctccgggaccgccttttcctcagacgctgggcatcgcaaacgttgctacccgtctgtcgtcgatccagctgggccaaagcgaaaaggaacggcctgaagaggcccgagaactggattccagcgatcgggatatttcgtctgctacggaccttcagcctgaccaggccgagaccgaagataccgaggaggaactggtggatgggctggaggactgctgctcccgcgatgagaacgaggaggaagaaggcgattccgaatgcagttccctgtcagcagtgtccccgagcgagagtgtggccatgatctcccggagctgcatggaaatcctcaccaagcccctcagtaaccacgaaaaggtcgttagaccagccctgatctactccctgttccccaatgtgccaccgacaatctattttgggacccgagatgagcgagtggaaaagctgccctgggaacagaggaaacttctgcgctggaaaatgagtaccgtgacgcccaatatcgtaaaacaaacaataggccgtagccattttaaaatctccaaaaggaacgacgactggctcggctgctggggccatcatatgaagagccctagcttccgcagtattcgggagcatcaaaagctcaatcacttcccaggttcctttcaaatcggcaggaaggatcgcctgtggaggaacctatctcgcatgcaatcgcgatttggtaaaaaagaattttctttcttcccccaatcttttatcctcccgcaagatgccaaattactgcgaaaggcttgggaatcgtcatcacgccagaagtggattgtcaaacctccggcttctgctagggggataggaatccaagttatccataagtggtcacaactacctaaacgccgacccctgctggttcagagatacttgcataaaccatacctgattagcggaagtaaattcgacctgcgcatctacgtatatgtaacatcctacgaccctctcagaatctatctgttttctgacggactcgttcggtttgctagctgcaagtattccccaagtatgaaaagtctcgggaataaattcatgcatcttaccaattattctgtaaacaagaagaacgccgaatatcaggctaacgccgacgagatggcatgccaggggcataagtgggctttgaaagccctttggaactacctctcccagaagggcgtgaactctgacgcaatatgggaaaaaatcaaggatgttgttgtgaaaaccattatctctagtgaaccttatgtcaccagcctgcttaagatgtacgtgaggcgaccttacagctgccacgaactctttggctttgacattatgttagacgaaaatctcaagccgtgggtacttgaggtgaatatcagtccctccctgcacagctcttcccctctggatatctcaatcaaagggcagatgatccgtgatctgttaaatctggccggattcgtgttgccgaacgccgaggatattatttcatcgccatcttcgtgcagtagtagtaccacctctctacccacgtcgcccggtgacaaatgccgcatggcccctgaacacgtaactgctcagaagatgaaaaaagcgtattacctcacacagaaaatacctgaccaggatttctatgcttccgtcttggatgttctgacaccagatgacgtcagaattctggtagaaatggaagacgaattctcccggagaggccagtttgagagaatctttcctagccacatatcctcccgatacttgcggttctttgagcagcctaggtactttaacattctgacgacccaatgggagcaaaagtaccacgggaataagttaaaaggcgttgatttacttaggtcttggtgctataaaggatttcacatgggcgtggtctccgacagcgctcccgtgtggagcctgccaaccagtcttctgacaatcagtaaagacgatgtgattttaaatgcatttagtaagagtgaaacctccaaattaggaaaacagtcttcctgcgaagtgtcgctgctcctctctgaggatggtacaacacctaagtccaaaaaaacccaagctggcctgtcaccttatccacagaagccctcttctagcaaggatagcgaggatacaagcaaggaaccttccctcagtacacaaacccttcctgttattaagtgttctgggcagacatcaaggttatctgcaagcagcacttttcagtctatttccgatagccttcttgcggtcagtccatag

SEQ ID NO: 29352 - DNA, 2337 bp, Artificial Sequence
  Description of Artificial Sequence: Synthetic coding sequence
cgtattcaggaacagttggaatcctcattcacaggactgaccgatgaaaaggtgaaggcctacttaagtctgcacccacaagtactggacgaattcgtgtctgaatctgtttctgcagaaacagtggagaagtggctgaaaagaaaaaataataaatcagaggatgagtcagctccaaaagaggtcagccgttatcaggacactaacatgcagggggtggtttatgaactgaacagttatattgagcagcgacttgatacgggcggagacaaccagctgctgctctatgaactgagttcaattattaagatagcaactaaagccgacggattcgccctgtattttttgggggagtgtaacaattccctctgtatctttactccccctggaattaaggaaggaaagcccagactgatccccgcaggtcctatcacacagggcaccacagtctctgcatatgtggctaagtcaaggaagaccctgcttgtggaggacattttaggcgacgaacggtttccgagaggaacggggctggagagcgggacgcggatacaatcggtgctctgtttaccaatcgtcaccgcaattggagacctgataggcatcctcgagctttatcgacattggggaaaagaagcattttgtctgtctcaccaggaggtcgcaactgctaacttagcgtgggctagcgttgctatccaccaggtccaggtatgcagaggcctggcgaaacagaccgagctgaacgattttctgctggacgtctctaagacctacttcgataacattgtggcgattgatagtctgctagagcatataatgatttacgccaaaaacctcgtaaacgccgaccggtgcgccttgtttcaggttgaccacaaaaacaaagagctgtatagcgacctctttgatattggggaggagaaggaaggcaagcctgtgttcaaaaagaccaaagagattaggttcagtatcgagaagggaatagcaggccaagtagcgcgaacgggcgaagtactcaacatccccgacgcttatgctgatcctaggttcaaccgggaagtggacctctataccggatatacaacaagaaacattttgtgtatgccgattgtgagcagaggatctgtcatcggtgtagtacaaatggtgaataagattagtggtagcgctttttcaaagaccgatgaaaataacttcaaaatgtttgccgttttctgcgccttggccctgcattgcgctaacatgtatcacaggattcgccactcggaatgcatctatagagttaccatggagaaactctcataccacagtatctgtacctccgaggaatggcagggattaatgcagtttacgttgcctgtgagactgtgtaaggagatagaactgttccatttcgatattggaccgttcgagaacatgtggcccggaatctttgtctatatggtgcaccggtcttgtggcacaagctgcttcgagctcgagaagctgtgtagattcatcatgtcagtcaaaaagaattacaggcgggtgccataccataattggaagcatgctgtgactgtggcccactgcatgtatgccattctgcaaaacaaccacaccctttttaccgaccttgaacgtaagggcttgctgatcgcgtgtttatgtcatgacctggaccaccggggattctctaattcctacctgcagaaatttgatcatcctttggctgcgctatattcaacaagtactatggagcaacaccacttcagtcaaacagtttctatactgcagttggaaggacacaacattttcagtactctctccagcagcgaatatgaacaagtgctggaaatcatccgcaaggctatcattgcaacggacctggcgctgtactttggcaatcgcaaacagttagaggagatgtaccagaccgggtcattgaacttgaacaatcagtcgcacagagatcgggtaatagggctgatgatgacggcatgtgatctgtgctctgtgactaagctgtggcctgtgactaagctgaccgcaaatgacatctacgccgagttttgggccgagggggatgaaatgaagaaactgggcatacaacctatcccaatgatggatcgtgataagaaggatgaggtcccccagggccagctcggattttacaacgccgttgctattccgtgttacaccacactgactcagatcctgccacctaccgagcctctgctgaaggcctgtcgagacaatctgtcacagtgggagaaagttatacgtggtgaggaaaccgcaacatggataagttcaccctccgttgcccagaaagcagctgccagcgaagactag

SEQ ID NO: 29353 - DNA, 1281 bp, Artificial Sequence
  Description of Artificial Sequence: Synthetic coding sequence
atgtggccgctcacagcgttgttgttactggtcccctctagcgggcaggctgccacattagagaaaccaatcctgagcctccacccaccttggaccaccatcttcaagggggaacgtgtgaccctgaaatgcgatggctaccacccactgcttctggagcttcagccaatcagtactttatggtacctgggtcaccttctcctgcctagccataagaagagtatcgaggtgcagacacccggagtttaccgttgtcagacccggggtgccccagtcagcgatcccatccacctaagtgtctccaacgactggctgattttgcaggtgccttacgcacccgtttttgaaggagagccattggtgctgcgatgtcggggatggtatgacaaggtggtctataagttacattattatcatgacggccaggcagtcaggtatttccattcatctgccaactatactgttctgcaagccagagcaagcgactcaggtcggtaccagtgctctggtaccatgcgcattcccgtcgagagcgcaccaatgtttagcgcgaaggtggccgtgacagtacaggagctttttagggcacccgttttaagggtgatgggtcctcgcgaagccaggggggcagcactcggcggtgttgtgttaaggtgcgatacccgcctgcacccgcagaaacgggatacccccttgcagttcgctttctataagtacagcagagccgtgcgaagattcgactggggtgccgagtacacggtccctgaaccagaagtagaggagttagaaagctattggtgcgaagctgcgacggcaaccaggtcagtgcgaaaacgcagcccctggcttcagctccccggacccggatctcccctggacccggctagcacaacagcccctgcgccatgggccgcagcactcgcccctggcaacagaccactgtcatttcggaagcctcccgtttccaggtctgtcccgctggttacatcggtgagaaatactaccagcaccggtctgcagtttcctgctagcggagcaccgacagccggtcctcctgcttgcgcccctcccacccccctcgaacagtctgccggagccctgaagcctgatgttgacctgctactcagagagatgcaattgctgaaggggttgctatccagggttgttctagagttaaaggagccccaggctcttcgggagctgaggggcacccccgagactcctacctctcattttgctgtttcgccgggaacccctgaaactactcccgtggagagctag

SEQ ID NO: 29354 - DNA, 1779 bp, Artificial Sequence
  Description of Artificial Sequence: Synthetic coding sequence
atggatgttatgctggaaaactactgccatctgatctcagtgggctgccacatgaccaagccagatgttatactcaagttagaacgcggagaagagccgtggacctcattcgcaggccacacatgtttggaagagaactggaaggccgaagactttttagtcaaattcaaggaacatcaggagaagtattccaggtcagtggtgtccattaaccacaagaagctggtcaaggagaagtccaagatctacgaaaaaaccttcaccctgggcaagaatccagtgaactcaaaaaatctgccgccagaatacgatacacacggtcggatcctcaagaatgtgtccgagctgatcatctctaatctgaaccccgctcgcaagagactctcagagtacaacggatacggaaagtcgctgttatcgacgaaacaagaaacaacacatcctgaggtcaagtctcacaatcagtctgcgcgagccttcagccacaatgaggtcctcatgcagtaccaaaaaaccgaaactccagctcagtcatttggatataacgactgtgaaaaatctttcctgcaaagagggggattgatcactcacagtcggccttacaaaggcgagaatccctcagtttacaacaagaagagacgcgctactaacattgagaaaaaacacacctgcaacgaatgtggcaaaagtttttgcaggaaatccgttctgattctgcaccaaggaattcattccgaggaaaaaccataccagtgccaccagtgcggcaacgccttcagacgaaagtcctaccttattgaccaccagaggacacatactggcgaaaaaccgttcgtctgtaatgagtgcggaaaatccttccggctcaaaaccgcactgaccgatcatcagcgcactcatacgggcgagaagtcctatgaatgtctccagtgtagaaacgccttccggctgaagtcacacctgattaggcaccagagaacccacactggtgagaagccctatgaatgtaacgattgtggaaaatccttccgccagaaaacaactctgtcgctgcaccaacgcatccatactggcgagaagccctatatctgcaaagagtgcggtaagtcttttcatcagaaggctaacctaacagtgcaccagcgaacccacactggcgagaagccctatatttgcaacgagtgtgggaagtcctttagccagaagacgacccttgctcttcacgaaaaaacgcacaatgaggaaaagccgtatatttgcagcgaatgtgggaagtcctttcggcaaaagactacactggtcgcacaccagaggacccacacgggcgagaaatcatacgagtgtccacactgcggaaaagcttttaggatgaaatcatacctaatcgatcaccacaggacacataccggcgaaaaaccttatgagtgtaatgagtgcgggaaaagcttttcccagaagacaaacctgaatttgcatcagagaatccacactggcgaaaagccctatgtttgtaacgaatgcggcaaatcatttcggcaaaaagcaacgttgactgtccatcagaagatacatacaggacagaagtcttacgaatgcccccaatgtggaaaggcattttccagaaagagctacctgatccaccaccagcgtacgcacaccggagagaaaccatacaagtgtagtgaatgtgggaaatgctttcggcagaaaacaaacctaatcgtgcatcagagaacccataccggtggagaggacggcctcacaggatgtctctcctag

SEQ ID NO: 29355 - DNA, 645 bp, Artificial Sequence
  Description of Artificial Sequence: Synthetic coding sequence
atggaagtgactggggtatccgccccaacagtcacagtctttattagcagcagtctgaatacgttcagaagtgagaagaggtacagtcgatctcttaccatcgcggagtttaagtgtaaactcgagcttctcgtggggtctcctgcaagctgtatggaactggagctgtacggcgtggacgacaaattctactccaaattggaccaggaagacgcacttcttggcagctatccagtggatgatggatgtcggatacatgtgattgaccactccggtgctcgcctaggtgaatatgaggacgtgagccgcgtggagaaatatacaattagccaggaggcgtatgatcagcgacaggataccgtgcgttcttttttgaagagatctaaactggggagatacaacgaagaggaaagagcgcagcaggaagccgaggctgcccagcggctggccgaagagaaagctcaagccagctcaatccctgttggctctaggtgcgaggtacgcgcagctggacagagccctcggagagggactgtgatgtatgtcggtgcgtggctggctggcccagttccagggagtagagctcccaggcctgggggtaatgtgggcggtacagtggagccaaggcgaccgagatccgcgtag

SEQ ID NO: 29356 - DNA, 189 bp, Artificial Sequence
  Description of Artificial Sequence: Synthetic coding sequence
atgtccatccagtggaagacccggcaattgcagtccaagcttcatgaagcagatattgtggtgctgggaagcccaaaacccgaggagattcccctgacgtggatccagcccggaactacggtgttaaattgcagccatgattttttaagcgaatccctgatcatcatcaggaggatggccatcttctag

SEQ ID NO: 29357 - DNA, 1269 bp, Artificial Sequence
  Description of Artificial Sequence: Synthetic coding sequence
atgtatccaaaccctctgatttactgcacctgctgggatccgtggaatctggggcctaggaagcttattaagacccctcagttgcccaggaaaaattcaactggatcatctaagttgactcccctggtgccagctcctaagaaccacaattacttgcagcccacaaagccagtagtatctcccaagatgaagatccacagtgcgaggcaggaggaaactaacaagtcgttttacgaggtcatcaatgtgtcaccaggctaccaactggtgaggaaccgggaacagatttcagtgacacttggtgatgaaatgtttgatcgtaagaagcgatgggaatcagaaatccccgataaaggtagattctcacgcactaacatcatatcggatttggaagagcagatatcagaattaaccgcgatcatcgaacagatgaaccgggatcaccaatctgcacagaaattgctgagctccgagatggacctccgttgtgccgaaatgaaacaaaatttcgagaacaaaaaccgcgagctgaaagaggctcatgaagctgagttatctgagctggaaaataattacaaagcagctctcaaggccgagaagttggccgcacaggaaaagctggaagagatgggcaaggagtacaagtaccttaagaacatgttcagaacctatcaggacagtatctatgatgagatggaggagaagtggagcaagcagaaagcaaaatggaagaaggatgagaagttcgaacgagaaaacatcctgttacagcaaaagaagaagatgacaaagaagttcgaaatggaaagtggtgaggaggataagaaaatcaacgagtcctgctcggcagtcttcgagaacttcatccaggagaaagaggagctcctcaaacagcaccagtctgatactctgcagctggaagagctgcggaagactaaagaagtgatgcaggaggagctccatgcccaagcactcatcctggaatccctgaacactaacctgtactatacgcagctcgagctccagaaggaaaaggccattgtaggcaatcttgagaagatgcttcagaccaagttcgctgagaccgaagaaaagtataaacatacaatccagattttaaccgaggagaacatccacctcaagcagaagataatttctaagaatgaagagatctgtgagggctgcagcggacggctggcttccattaccgtatccaaggatgattctgataccgtgcaagacggaagtaaaaaaggtcaagagagttag

SEQ ID NO: 29358 - DNA, 1380 bp, Artificial Sequence
  Description of Artificial Sequence: Synthetic coding sequence
atggttcccttcggcccatttgcctttatgcccggaaaactcgtgcacaccaatgaggtcacggtgctattaggggacaactggtttgcaaagtgcagtgcaaaacaggccgtgggcctcgtggagcatcgtaaggagcatgtgagaaaaaccatcgacgatctgaagaaggtaatgaagaatttcgaaagtcgggtagaattcactgaggatctgcagaagatgtctgacgccgcaggtgacattgtggatattcgcgaagagatcaaatgtgattttgagttcaaagcaaagcatcggattgcacacaagccccacagcaaacccaaaaccagtgacatctttgaggccgatatcgcaaacgacgtaaagtctaaggatcttttggcagataaagagctgtgggctcggctggaggaactcgagcgccaggaggagctgcttggagagctggatagcaaacccgacacggtgatcgccaatggcgaggacactactagctccgaggaggagaaagaagatagaaacaccaacgtgaacgcaatgcaccaggtgaccgatagccacactccgtgtcacaaagatgtggcgagcagtgagcctttttccggacaagtgaatagtcagttaaactgcagcgttaatggcagttcctcctaccactcggacgacgacgacgacgacgatgacgacgacgacgatgataacattgacgacgatgacggcgacaacgatcatgaagctcttggggtgggagataactctattccaactatatacttttcccatacagtggagcccaagcgcgtgcggatcaacacaggcaaaaatactactctaaaattctccgagaaaaaagaggaggcaaagagaaaacgcaagaattctaccggctcgggtcacagtgctcaggagttgcccacgattaggacccctgctgatatctacagagcctttgtcgacgtggtgaacggagaatatgttcctcgcaaaagcatcctcaagtcaagatcaagagaaaacagtgtttgctccgatacaagcgagagttctgccgctgaatttgatgatcgtaggggcgtgctgagatcaatctcgtgcgaggaagcaacctgcagcgacacaagcgaaagcatactggaagaagagcctcaggagaaccaaaaaaagctcctccccctgtctgtgacacctgaggctttttccggcacggttatcgaaaaggagtttgtgtctccctccctgactccacccccagctatcgcgcaccctgccttaccaacaattccggagcgcaaggaggtcctgttagaggcatccgaagagacggggaaacgcgtaagtaagtttaaggccgcaagactacagcagaaggattag

SEQ ID NO: 29359 - DNA, 1068 bp, Artificial Sequence
  Description of Artificial Sequence: Synthetic coding sequence
atgcgcgagattgtccacattcaagcaggccagtgtggcaaccagattggcgcaaagttctgggaagtcatcagtgatgagcacggtatagatcccaccggttcatatcacggcgacagcgatctgcaactgctaactcactcacttggaggcggaaccggctccgggatgggcacactcttgatcagtaaaatacgagaggaatatccagatcggattatgaataccttctctgtcatgcccagtccaaaggtgagcgacactgtggtggagccttataacgccacgcttagcgttcatcagctagtggaaaacactgatgagacatacagcatcgataatgaggcactgtatgatatttgtttcaggacgctgaagctcacaactcccacctatggtgatttaaatcaccttgtttccgccaccatgagtggggttactacgtgtcttcgatttcctggccagctcaacgcggacctaagaaagttggccgtgaatatggtaccattccctcgcttgcacttcttcatgccaggcttcgccccactgacatctagaggcagccagcagtatagggcgttgaccgtgcccgagctgacgcagcaaatgtttgactccaagaacatgatggccgcttgcgatcctcgtcatggacgatatttgaccgttgccgctatttttagaggccgtatgtctatgaaagaagtggatgagcaaatgctgaacgtgcagaataaaaattcttcctattttgtggagtggatccctaataatgtcaagacagcagtctgtgacatcccacctcggggactgaagatgtctgccaccttcatcggaaactctacagctatacaagagctcttcaagcgcatttctgagcagttcactgctatgtttaggcgcaaggcattccttcactggtacacaggggagggaatggatgaaatggagttcactgaggccgaatccaacatgaatgacctggttagtgaatatcagcagtatcaggatgcaaccgctgatgagcagggggaatttgaagaagaagaaggggaggatgaggcctag

SEQ ID NO: 29360 - DNA, 255 bp, Artificial Sequence
  Description of Artificial Sequence: Synthetic coding sequence
atgaaagtgaagatcaaatgttggaatggagtcgctacatggctgtgggtggctaacgacgaaaattgtgggatttgcagaatggccttcaatggctgttgtccagactgcaaggtgcccggtgatgactgcccgctggtgtggggccagtgttcccattgcttccacatgcactgtatcttaaagtggctacatgcccaacaggtgcagcagcattgcccaatgtgcaggcaggaatggaagtttaaggaatag

SEQ ID NO: 29361 - DNA, 1416 bp, Artificial Sequence
  Description of Artificial Sequence: Synthetic coding sequence
atgaaaatgcaggtgttttgtaaaagcatcgaggatatgactgtgaaagcagagcagtcccagcaggaagcagcaaagaagcacgaagaggagaagaaagagcttgagcggaagctctcggatctagagaagaaaatggagactagccataaccagtgtcaggaactgaaggcacgctatgaacgtgccacatctgagaccaagactaagcatgaggagatcctgcagaacctccagaagactctgctggatactgaagataaactgaagggcgctagggaggagaattccggtctcctgcaggagttagaggagcttaggaaacaggcagacaaagccaaggccgcacaaactgcagaagacgccatgcagatcatggagcagatgacgaaggagaagacagaaactctggcgagtcttgaagacaccaagcagaccaatgctaaattgcagaatgaactggacacgttgaaggaaaacaatcttaaaaacgtcgaggaactgaataagagcaaggaactgttaaccgtcgagaatcagaagatggaggagtttagaaaggagatcgagacactaaaacaggccgctgcccagaaatctcagcaactttctgcactccaggaagaaaatgtgaaactggccgaggagctgggccgatcccgggacgaagtgacaagccaccagaagcttgaagaggagcgtagcgtgctgaataaccagctgctagagatgaaaaagcgagaaagcaaatttattaaggatgcagacgaggaaaaagcttcgctgcagaagtccatttcaatcacaagtgctctactcactgagaaggacgcagaattagaaaagttgagaaacgaggttacagtcttgcgaggtgaaaatgcctcggccaagtccctgcactccgtagtccagacgctggagtcagataaggtcaagctggaattgaaggtcaaaaatctggagctccagctgaaagagaacaagcggcagctttcgtccagtagcgggaacacagacacccaggccgatgaggatgagcgggcacaggaatcccaggtcatgatagactttcttaacagcgtcatcgtcgatctgcagcgcaagaatcaggacttgaagatgaaagtcgaaatgatgagcgaggccgcattaaacgggaacggggacgatcttaacaattacgatagcgacgaccaggaaaagcagtcaaaaaaaaagccccgacttttttgtgacatatgtgactgtttcgacctgcacgacaccgaagactgcccaacacaggcccagatgtcggaggatccgcctcattctacccatcacgggagcagaggagaggaacggccatactgtgaaatctgcgagatgtttggtcattgggccactaattgcaacgacgacgaaactttctag

SEQ ID NO: 29362 - DNA, 1602 bp, Artificial Sequence
  Description of Artificial Sequence: Synthetic coding sequence
atgagttcttgcgtgtctagtcagccgtcatctaatcgcgcagcacctcaagacgaactcggcggaagggggtctagcagtagcgagtcccagaaaccctgcgaggctctgaggggactgagttcgctctcgattcacttaggaatggagtccttcatcgtggtcacagagtgcgaaccaggatgtgctgtggacctcggcctcgccagggatcgaccattagaagccgacgggcaggaggtgccactggatacctctggcagccaggccaggcctcacctctctggacggaagctgtctctccaagaaagatcacagggaggtctcgctgcgggtggttccctcgatatgaatgggagatgtatatgcccaagtttaccatactcgcccgtgtctagcccacagtcttctcccaggcttcccaggcggcctactgtggagtcccatcatgtatcgatcacagggatgcaggattgtgtgcagctgaaccagtacactctgaaggacgagattggcaaaggtagctatggtgtcgtgaagctggcttacaatgaaaacgataatacctattacgctatgaaggtgctcagcaaaaaaaaactgataaggcaggccggattcccacgtcgccctccaccgagggggactcgccctgcccctgggggttgtatacaacccaggggacctatagagcaggtgtatcaagaaattgcaattctaaagaaacttgatcacccaaacgtggtgaaacttgtcgaagtcctcgacgaccctaacgaggaccacctatacatggtgtttgagctcgtcaatcaaggacctgtgatggaggtacccacactaaaacctttgtcagaagatcaggctaggttctatttccaagatctcatcaaagggattgaataccttcactatcagaaaattatacatcgagatatcaagccatccaacctgctggtcggggaggatggtcacatcaagatcgccgactttggagtcagtaatgaattcaaaggctcggacgccctactgtctaatactgttggcaccccagcttttatggcaccagaatccctcagtgagactaggaagattttttcagggaaagcactcgatgtgtgggcaatgggcgttacactttattgtttcgtgtttgggcagtgcccttttatggatgagcgcattatgtgtctgcacagtaaaattaaatctcaagcattagagtttcccgatcagcctgatattgcagaggacctcaaagatctaattactcgcatgctcgacaagaatccggaatcaaggatcgttgttcccgaaatcaaactgcatccctgggtcacaagacacggcgctgagccactcccctctgaggatgagaattgcactctggtagaagttaccgaagaggaagtagaaaattccgtcaagcacatcccaagcctggccacggtcatcttagtcaaaacgatgattcgaaaaagatcattcggaaaccctttcgaaggctcaaggcgggaagaacggtctttatccgcccctggaaacctgctgacaaagaagccgaccagggagtgtgagagcctgtcggagctcaaaacgtag

SEQ ID NO: 29363 - DNA, 1671 bp, Artificial Sequence
  Description of Artificial Sequence: Synthetic coding sequence
atgagttcctgtgtgtcttctcagccttcctcaaatagggctgcaccacaggacgaattaggcggtcggggaagttccagcagcgagagccagaaaccgtgcgaggcattaaggggcctgtctagtctaagcatccatctaggcatggagtctttcattgttgtgaccgaatgcgagccgggttgcgctgttgatctgggcttggcccgagatagaccgctggaagctgacggacaggaggtgcctttggatacttcaggttcccaggccaggcctcatctgagtggccgaaaactttcccttcaggagcgcagccagggagggctggctgctggcggttctctggacatgaatgggagatgtatctgcccttcccttccctatagtccagtgtcaagcccacagagttcgcctcgtctgccacggaggccaactgtggaaagccatcacgtttctattacgggcatgcaggattgtgtgcagctcaatcagtatacactcaaggatgagattggtaaaggctcttatggcgtggttaaactggcctataatgaaaacgataacacttactacgcgatgaaagtgcttagtaaaaaaaaactaattcgacaggcaggctttccccgtagacccccaccgcgaggaaccaggcccgctccaggaggttgcatacagcccagggggcctattgagcaagtgtaccaggagattgctatcctgaagaaactggaccatccgaacgtggtgaagctggtcgaagtgctggacgaccctaacgaggatcatctatacatggtgtttgagctcgtcaatcaaggcccagtgatggaggtaccgaccctcaaacctctctctgaagatcaggctcggttttattttcaggacctgattaagggcatagagtatctgcattaccagaagatcatccaccgggatatcaaaccaagcaatttgcttgtaggtgaggatggtcacatcaagatagccgactttggcgtgtccaacgagttcaaaggaagcgacgctcttctgagcaacacagttggcacgcctgcattcatggccccagaaagtctgtccgagacccgcaagatcttttccggcaaagcattggacgtgtgggccatgggcgtgactctgtattgtttcgttttcggacaatgccctttcatggatgagaggattatgtgccttcactccaagataaaaagccaggcgctagaattcccagaccaacccgacattgccgaagatctcaaagacctcatcacacggatgctcgataagaatcccgaatcccgcattgtggtgcccgaaataaagcttcacccatgggtgacccgacacggcgctgaacctcttccatctgaagacgagaactgcacactagttgaggtgaccgaggaggaagtggaaaacagtgtaaagcatatccctagtctcgctaccgttatcctggtaaagaccatgatcaggaaaaggtcctttggcaatccgttcgagggttctagacgcgaagaacgctctctctcagccccaggtaatctgttgaccaaaaaacccactagagaatgtgagtctctttcagaacttaagggcaccaaaaagaaaaaaggactggatagcatgacgagcaccgttgcagccggatggctcgacaggcgagtttag

SEQ ID NO: 29364 - DNA, 309 bp, Artificial Sequence
  Description of Artificial Sequence: Synthetic coding sequence
atgctctccgaggaggagaaagaagaactaaaagccgagttagtgcagttagaggatgagatcacaacactccgccaggtgttgagcgccaaggagcgccacctcgtggaaatcaagcagaagttaggcatgaaccttatgaacgaactgaaacagaacttctcaaaatcctggcacgacatgcagacaactaccgcttataagaagacacacgagactctgtcccatgccggtcagaaggcaaccgccgctttttctaatgtgggaactgcaattagtaaaaaatttggtgacatgaggagaaagtag

SEQ ID NO: 29365 - DNA, 615 bp, Artificial Sequence
  Description of Artificial Sequence: Synthetic coding sequence
atggaggccgagcccaaaggtctcctagaaacagaaccgctgcaaggcaccgacgaggacgcagttgcctccgctgacttttcctccatgctcagtgaagaggaaaaggaggaacttaaggctgagctggtccaactggaggacgaaatcaccacactacgccaggtgctcagcgccaaagaacggcatctggtggaaatcaagcagaagctgggcatgaacctcatgaacgaactgaaacagaacttctctaaatcatggcatgatatgcagacaactactgcttataaaaaaactcacgagacactgtcacatgctgggcagaaggcaactgccgcatttagcaacgtcggtaccgctatttctaagaagtttggcgacatgtcctactctatacgccactctatttcaatgcctgctatgaggaactctcccaccttcaagtcctttgaggaacgcgtggagacaaccgttacctccctcaaaactaaggtagggggaaccaaccctaatggcggttctttcgaagaagtgttaagctctaccgcacatgccagcgcccagtctttggctggaggctccagaaggacgaaagaggaagagctgcaatgttag

SEQ ID NO: 29366 - DNA, 369 bp, Artificial Sequence
  Description of Artificial Sequence: Synthetic coding sequence
tgatatctcgtggccctgggttgtatcaagcctctgtgcgacttactcaccgtcatggacagtaagatcgtgcaagtcgcacttaacgggctggagaatattcttcggctgggtgaacaggaatccaagcagaatggaatcggcattaacccctattgtgcactgatcgaagaggcctatggcttggataagatagaattcttgcaaagccacgaaaaccaagaaatttaccagaaggcattcgatctcattgagcactactttggggtggaggaggacgatccgagtatagtgccacaggtggatgagaaccagcagcagtttatcttccaacagcaggaggcacccatggacggattccaactgtag

SEQ ID NO: 29367 - DNA, 1137 bp, Artificial Sequence
  Description of Artificial Sequence: Synthetic coding sequence
atggaggtgaagccaccccctgggaggccacagcctgactcaggcaggcggaggagacggcgtggtgaggagggtcatgacccaaaagaacccgagcaactgagaaagctctttattggcggactaagcttcgaaaccaccgatgattctctgagagagcacttcgagaagtggggcacactcacagactgcgtggttatgcgagacccacagactaaaaggagccgtggatttgggttcgtgacctactcctgcgtcgaggaagtggatgctgctatgtgtgccagaccccacaaagtagatggcagagtggttgaaccgaagagggccgtgtctagagaggactcagtcaaacccggagctcatctgacagtgaaaaagattttcgtgggtggtatcaaggaagatactgaggaatacaatcttcgagactattttgagaagtatggcaagatagaaaccattgaggtgatggaagacagacagagcggcaaaaagagagggtttgccttcgtgacattcgacgatcacgataccgtggataagatcgttgtgcagaaatatcacactattaacggccacaattgtgaagtgaagaaagccttgtcaaagcaggagatgcagagtgctggttcccagaggggccgaggtgggggaagcggcaacttcatgggtcgcggtgggaattttggcggtggtggtgggaatttcggcagaggaggtaactttggcggtcggggaggctatgggggagggggaggcggatctaggggttcctatggcggaggagatggcggatataacgggtttgggggagacggtggcaactacggaggcggaccaggatatagtagccggggaggctacggcggtggcggacccggatatgggaaccagggcggagggtacggtggagggggtgggtatgacggctataatgaggggggtaattttggcggtggaaattacggcggaggtggcaactataatgacttcggaaactatagtgggcagcagcaaagcaactacgggcctatgaaaggcggaagtttcggaggacggagctcgggctccccttacggaggcggatacggctctgggggtggctcgggaggttatgggagccgcagattctag

SEQ ID NO: 29368 - DNA, 3063 bp, Artificial Sequence
  Description of Artificial Sequence: Synthetic coding sequence
atgcgtcggttcttgcgcccaggacacgatcctgtgcgggagcggctcaaaagagacttattccagttcaataagactgtggagcatggcttcccccaccaaccatcagccttgggatacagccccagcctcagaattcttgcaatcggtacaagatccggagccatcaaactttatggcgcacccggagtggagttcatgggcctccaccaggagaataacgccgtgacccagatccacctccttccaggtcagtgtcagcttgtgactttgctagatgacaattctttacatttgtggagtctaaaagtgaagggaggcgctagcgaactgcaggaggatgaatccttcaccctgcgcggaccaccgggagcagctcccagcgccacccaaataacggtggtcctgccacattcatcttgcgaattgctgtacctgggtacagagagcggcaatgtctttgtggtgcaactgcccgcattccgggcactcgaggaccggaccataagtagcgatgctgtattgcaacgactccctgaagaagcaagacaccgacgagtgtttgaaatggtcgaagccctgcaagagcacccccgagaccctaaccaaatcttaatcgggtattctcgaggcttagttgtaatctgggaccttcaggggagccgcgtgctgtaccactttctctccagtcagcaactggaaaatatctggtggcaaagagacggtagactgttggtttcttgtcattctgatgggagttactgccaatggcccgtgtcttcggaagcccaacagcctgaaccacttaggtcattagtgccctacggccctttcccttgtaaggcaataacaagaattctctggctcaccacgaggcaggggctccccttcaccatttttcaagggggtatgcccagagcgagctatggggatcgtcactgtatctccgttattcacgatggacaacaaacagccttcgacttcacctctcgagttattggttttacggtcttgactgaggctgatccagctgctacgttcgacgatccatacgcactcgttgtgctggcagaggaggagctcgtcgtgatagacctccaaactgcgggatggcccccagtgcagctgccatatctagctagccttcactgttcagccatcacatgctcacatcacgtgtctaatatcccactgaagctctgggaaagaattattgccgcagggagccgacagaacgctcatttttcaactatggagtggcctatcgacggtgggacttcactgacccctgcaccgccacagagggacctcctgcttaccgggcacgaggacgggacagtgaggttttgggacgcctctggagtatgcctgcgcttactctacaaactgtctacggtgcgggtgtttctcacagacacagatcctaacgaaaacttctcggcacagggagaggacgagtggccacctctgagaaaagttgggagcttcgatccctatagcgacgatccaagattgggtattcaaaaaatctttctgtgcaaatattctggatatctcgcggtcgctggtactgcgggtcaggtacttgtgctagaactgaatgacgaggctgccgagcaagccgtggaacaggtcgaagccgatttgcttcaggaccaggagggctatagatggaaaggtcatgaacggctcgccgctcggagtgggccagtaaggttcgaaccgggatttcagcctttcgtgctggtgcagtgccagcctcccgctgtggtcacgtcacttgctctgcatagtgaatggcgcctcgtcgcctttggtaccagccacggcttcggcctgttcgatcatcaacagcgcagacaagtatttgttaagtgcaccctgcatccctccgaccaactcgctctggaaggccctctctctcgagttaagtccttaaaaaagtctctccggcagtcgtttcgccgaatgaggcggtcacgggtgagctcgcgcaaacgccatccggcaggtccacccggtgaagcgcaagaggggtccgccaaggcagagcgcccaggcctgcagaatatggaactggcccctgtgcagagaaaaatcgaagcacgctccgccgaagattcattcacgggatttgtcaggacactgtattttgctgatacctatctcaaagactctagtcgccactgtcctagcctgtgggcagggacgaatggcggtacaatctacgccttcagcctacgcgtcccacctgccgaacgcagaatggatgaacctgttcgggcagaacaggccaaagagatccaactcatgcatagggctccggtggtcggtatcctcgtcctggatggtcattcggttccactccccgaaccattggaggtggctcatgacctttcaaaatccccggacatgcagggcagccaccaactgttggtggttagtgaagaacagttcaaggtgtttactctgcctaaggtgagtgccaagctgaagctaaaactcaccgccctggaaggtagtagagtgagacgggtatctgtcgcccacttcggaagccgcagagctgaagattacggagaacaccatctagctgtgcttacaaatttgggggacatccaagtggtcagtctgccactgcttaagcctcaagtgcggtatagctgcattcgacgcgaggacgtgtccgggatcgctagctgcgtgttcacaaagtatgggcagggtttttatctcatctctccatcagaatttgagcgcttttctctatccacaaagtggttggttgagcccagatgcctggttgactcagctgagactaaaaatcacaggcccggaaatggagcgggacctaaaaaggccccaagccgcgcacgaaactcaggcactcaatccgacggggaggaaaagcaaccagggcttgtgatggagagagcattgctatcggacgagcgcgtcctgaaggagattcagtctaccctggaaggggaccgaggcagcgggaattggcggtcccacagagctgctgtggggtgcagcctgagcaacggtggagccgagtag

SEQ ID NO: 29369 - DNA, 1458 bp, Artificial Sequence
  Description of Artificial Sequence: Synthetic coding sequence
atggccgcagagttatacgctccagccagtgccgctgctgccgatttagccaatagcaacgctggtgccgcagtaggcagaaaagctgggccacgtagcccgccttccgcccctgcgcctgcccctccccctcccgctcccgcaccgccaacactggggaacaaccaccaggagtcaccaggctggcggtgttgtcgacccacactccgagaacggaacgccttgatgttcaataatgaactgatggctgacgtccacttcgttgtcggtcctcccggagcaaccagaacagtacccgcacacaagtacgtgttggctgttggctcgtctgtgttttacgccatgttctatggggacttggctgaggttaagagcgaaatccacatccccgatgtagagcccgctgcttttctcatcctgctgaaatacatgtattcagatgagattgacctcgaagcagacaccgtcctggctactctttatgcagctaagaaatatatcgtgcccgctttggccaaagcctgcgtcaacttcctcgaaacctccttggaggccaagaacgcctgcgtgctgctgtcgcagagccgcctattcgaggaaccggagttgactcagagatgctgggaggtcatagatgcacaggccgaaatggcactgagatccgaggggttctgtgaaattgataggcagacactagagataatagtgactagggaagccctgaacactaaggaagctgtggtattcgaagccgtcttgaactgggctgaagcggaatgcaagcggcagggtctgcctatcacccccaggaacaagcgccatgtattgggccgagcactttatctggtgcggatacctacgatgacactggaagaattcgccaacggcgctgcccagtcagatattctcaccctggaggagacccacagtattttcctatggtacacggccaccaataagcccagattagacttcccgttgacaaaacggaagggcttggccccacagcgttgtcataggtttcagtcctctgcatataggtcaaatcagtggcgatatcgagggaggtgcgactccattcagtttgccgtggacagaagagtgtttatcgccggtctcgggctctatggaagctcctctggtaaagctgaatacagtgtaaagatagaacttaaacggcttggggttgtcttagcacagaacttgaccaagttcatgtctgacggatctagcaacacgttcccagtctggttcgagcaccccgttcaggtggaacaggataccttctataccgcaagcgcggtcctggatggcagcgaactgagttacttcgggcaggagggcatgacagaggtgcaatgcggtaaggtggccttccaattccagtgtagttccgattctactaacggaacgggtgttcaggggggacaaatacctgaacttattttttatgcatag

SEQ ID NO: 29370 - DNA, 2883 bp, Artificial Sequence
  Description of Artificial Sequence: Synthetic coding sequence
atgagcaggctcatagttaaaaatctccctaacgggatgaaggaggaacggttccggcagctgttcgccgctttcggcaccctgacggactgtagccttaagttcacaaaggatggaaagttccgtaaatttggttttattgggtttaaatccgaggaggaagctcaaaaggctcaaaaacacttcaataagtctttcatagacactagtcggatcactgtggaattttgcaagtcgttcggcgatccagcaaaaccacgagcctggagtaagcacgcccagaagccgtcacagccaaagcaacctcccaaggatagtaccaccccagagatcaaaaaggatgaaaagaagaagaaagtagcaggccaactcgagaagctcaaagaagacacagaatttcaggaattcttgtccgtgcaccaacgaagagcccaggccgctacatgggccaacgatggcttggacgctgagccatcgaagggaaaatcaaagcccgctagcgactatctaaacttcgattccgacagcggccaggagtcagaagaggaaggcgctggcgaggacctggaggaggaagcttccctggagccaaaggctgccgttcagaaagagctgagcgacatggattaccttaaatccaagatggtgaaggccggtagctcatcaagcagcgaggaggaggaatctgaggatgaggccgtccactgtgacgaaggaagtgaggcagaggaggaggacagttccgccacccccgtgctccaggagcgcgactcaaagggagcgggacaggagcagggtatgcctgccggtaagaaacggccaccagaggccagagctgaaacagaaaaaccagctaatcagaaggaaccaaccacttgccacactgttaaattgcgcggagcaccttttaatgttaccgagaagaacgtaatggaattcctcgctcctctgaaaccagtggccatcaggatcgtgcgcaacgcacacggaaataaaacaggatacatcttcgtagacttttctaacgaagaggaggtcaaacaagcactgaaatgcaaccgcgagtatatgggcggtaggtacatcgaagtgttcagagaaaagaatgtgccaactacaaaaggcgctcctaaaaacaccacaaaaagctggcaaggccgtatcctcggagagaacgaggaggaagaggacctcgccgagtctggacggctcttcgtgaggaacctcccctacactagcacagaggaagatctggagaaactattttccaagtacgggcctcttagcgagttgcattatcctattgattctctaacaaaaaagccaaagggatttgcatttatcacattcatgttcccagagcatgccgtgaaggcgtatagcgaggttgacggacaggtgtttcagggtcgcatgctccacgtactgccaagcactatcaaaaaggaggcttctgaagatgcatcagccctgggcagcagctcatataagaagaagaaagaagctcaggacaaggccaattcagcatcttcacacaattggaatactctctttatgggacctaatgccgttgccgatgccatagctcagaaatacaatgcaaccaaatcacaggtttttgaccacgaaactaaggggtctgtggctgtgcgagttgctttgggtgagacccagcttgtgcaagaagtgcggcgattcctgattgacaatggagtctctctggattccttcagccaggccgcagctgagaggtcaaaaaccgtgattctcgtgaagaacctgcctgccggtacattagcagcccagctccaggagacattcggtcactttggatctctggggagggtcctgctgcctgagggaggtataactgcaatcgtggagtttcttgagcctcttgaagctcgcaaggccttccgtcatcttgcctactccaaatttcaccacgtgccactttatctggaatgggccccagtgggggtgttttcatctaccgcacctcagaagaaaaagctccaggacacacctagtgaaccaatggaaaaggatccagcagagcccgaaaccgtgccagacggcgagacaccggaggacgaaaatcccacggaggagggcgctgacaattccagtgctaagatggaggaggaagaagaagaggaagaggaggaagaggagagccttcccggatgtacgctgttcattaagaacctcaactttgacactaccgaggagaagcttaaagaggtctttagtaaggtagggaccgttaagtcctgttctataagtaaaaaaaaaaataaagctggcgtgcttcttagcatggggtttggctttgtcgagtacagaaagccggagcaggcccagaaggctcttaaacagctgcagggccacgtggtggacgggcacaagctggaggttcggatttccgaacgagctactaaaccagcagtgaccctggcccgtaagaagcaggtgcctcgcaaacagactactagtaagattctcgtgaggaatataccatttcaggcccattcccgggagatccgagagctgttcagcaccttcggagaacttaaaaccgtcaggctccctaaaaaaatgaccggaactgggacccacagaggtttcggattcgtggactttctgacaaagcaggacgcaaagcgcgcattcaacgccctgtgtcacagcacacatctctatggaaggcgcctggtcctagagtgggcagactctgaagttacgttgcaagccttacgcaggaagaccgctgcccacttccacgagccccctaaaaaaaagcggagtgtcgtcctggacgagattttggaacagctggaagggtctgacagcgattcagaggaacagactctacaactgtag

SEQ ID NO: 29371 - DNA, 669 bp, Artificial Sequence
  Description of Artificial Sequence: Synthetic coding sequence
atggagcgcatcgaaggtgcctctgttgggagatgtgccgcttcaccttacttaaggccattaactcttcattaccgacaaaacggagctcagaaatcatgggatttcatgaaaacgcacgactccgtcaccgtactcttgttcaatagctctaggaggagtttagtgttggtgaaacagttccggccagccgtctatgccggagaggttgagaggcgcttccctggatcattagcagcagtcgaccaggacggtcccagagagctgcagcctgctctaccgggtagcgcaggagtcactgtcgaactgtgcgccggactcgttgatcagcctggcttgtctctggaagaagtcgcatgcaaggaggcttgggaggaatgtgggtaccatttagcaccaagtgaccttcggcgtgtggcaacatactggagtggagtcggtctaacaggcagtagacagaccatgttctacaccgaggtcacagatgcccagaggtccgggcctgggggtggccttgtggaggagggtgagctgattgaggtggtgcacctcccactggaaggcgctcaggcgtttgccgatgaccctgatattccgaagacgctgggggtgatcttcggggtcagctggtttctttcccaggtcgccccaaacctggatttgcagtag

SEQ ID NO: 29372 - DNA, 876 bp, Artificial Sequence
  Description of Artificial Sequence: Synthetic coding sequence
atgaatatgatctggcgaaactccattagttgcttacgccttggaaaagtgccccaccggtatcaaagcggctaccatcctgtcgcacccctgggcagtcgtattctaaccgaccccgcaaaggttttcgaacacaacatgtgggatcacatgcaatggtcaaaggaagaggaagctgcggcacgtaaaaaagtgaaggaaaatagcgcagtacgcgtgctactagaggaacaggtcaagtatgaaagggaagcttccaagtactgggacactttctacaagatccacaaaaataagttcttcaaagatcggaattggctgctgcgagagttcccagagatcctgcccgtcgaccagaagcctgaagaaaaggccagggagtctagttgggatcacgtcaaaactagtgctaccaatcgttttagtaggatgcactgccccaccgtgcccgacgagaagaaccattacgaaaaaagctccggatcgagtgaggggcagtccaagacagaaagcgattttagcaatctggatagtgaaaagcacaagaagggcccaatggagaccggtctcttccccggaagcaacgcgacattcagaattttggaggtgggatgcggcgcagggaactccgtattcccaatcttaaatacactcgaaaactctcccgaaagttttctgtattgctgtgactttgcttcaggcgctgtcgagctcgtcaaatctcacagcagctatcgggcaacgcagtgcttcgccttcgtgcatgatgtttgcgacgacggcctcccctatccctttcctgacggaatactggatgtgatcctcctcgtgttcgtgcttagttccatacatccagataggactctgtttatctag

SEQ ID NO: 29373 - DNA, 630 bp, Artificial Sequence
  Description of Artificial Sequence: Synthetic coding sequence
atgaagaaggttcggcttaaagagctggaatcacgtctccagcaggttgacggcttcgagaaaccgaagcttctgctggagcaatatcctacacgcccacatatcgccgcttgcatgctctacacaattcataacacgtacgacgatatcgagaataaggtggtcgccgatctggggtgtggctgcggggttctctcgatcggcaccgcgatgcttggggcaggcttgtgcgtgggtttcgacattgacgaggacgctctcgagatcttcaatcgcaatgcagaggaattcgagctgacaaatatagacatggtacaatgcgatgtgtgtttactgtctaatcggatgagcaagagctttgatacggtcattatgaaccccccatttggcacaaagaacaacaaaggaaccgatatggcctttttaaagactgctctggagatggccaggactgcagtgtactccctccacaagagcagcacacgggaacacgttcaaaaaaaggccgcagagtggaaaatcaagattgatattatcgccgaactacgctatgacctgcctgcctcctataagttccataagaagaagtcagtggacatcgaggtggatttgattcgtttcagtttctag

SEQ ID NO: 29374 - DNA, 504 bp, Artificial Sequence
  Description of Artificial Sequence: Synthetic coding sequence
atgccagcttatcactcgagcctgatggaccccgatacgaaacttattggcaatatggcccttcttcctatccgatcccagttcaaaggaccagcgcctcgtgagacaaaggatacagatatcgtggatgaggctatttactactttaaggccaatgtattttttaaaaactatgagatcaagaacgaggcagaccgtaccctcatatacattactctttacatctccgaatgccttaaaaaacttcagaagtgtaactccaagagtcagggcgagaaagagatgtacaccttaggaataacaaacttcccaatccccggagagcctggttttcccctaaatgctatctatgctaagcctgccaataaacaggaagacgaggtcatgcgtgcctatcttcagcagcttcgtcaggagactggtctgagattgtgtgagaaggtgatcaaaggagacctcaagttctcagccgcactcaagctagccctcaataagaacaagtag

SEQ ID NO: 29375 - DNA, 4074 bp, Artificial Sequence
  Description of Artificial Sequence: Synthetic coding sequence
atggctgataccgatttgttcatggagtgcgaggaagaggagctcgagccctggcagaaaatctctgatgtgattgaggacagcgtggtcgaggactataattccgtggataaaacaactacagcaggcaatcccctggtacagcagggaggtcaaccgcttatcctgactcaaaatccagctcccggtctgggaactatggtgactcagcccgtcctacgcccagtccaggtgatgcagaacgctaaccacgtgacatccagccctgtggcaagtcagcccatctttatcaccacgcagggctttccagtgcgaaacgtgcggcctgtgcagaatgccatgaaccaggtcggcatagtgttgaacgtgcaacagggacagactgtacgtcccataactctggtccctgcccctggcactcagtttgtgaagcctaccgttggcgtcccccaagtgttttcgcagatgactcctgtgaggcctggatcaaccatgccggttcggcctacaaccaacacctttacaacagtgatcccggcaacgctcacaattaggtcaacagtgccacagtcccagtcacaacagactaagtcaaccccctcaacctcaacaactcccacagcaactcaacctacttctttggggcagctggcggtgcaatcaccaggacaaagtaatcagactaccaaccctaaattggcacctagttttcccagtcccccagccgtcagcatcgctagcttcgttacagtaaaacggccaggtgtgactggcgagaactctaatgaagtagcaaaactcgtcaacactctgaataccatcccgagcttaggtcagtcaccgggtcccgtggtggtcagcaataacagctccgcacacggtagtcagcggaccagcgggcctgaaagcagtatgaaagtgacatcaagtatcccggtgtttgacctgcaagacgggggacgtaagatttgtcctcggtgcaacgcacagttccgtgtgaccgaggccctgcgaggacacatgtgctactgctgtccagagatggtggagtatcagaagaaaggaaagagcttggattccgaaccatcagtccccagcgcagccaagccacccagtcctgaaaagaccgccccagtcgcctccactccctctagcacccccatccctgctttgagcccacccaccaaggtgcccgagccaaatgagaatgtgggtgacgccgtgcagaccaagctcatcatgttggtggacgatttctactatggaagagatggaggaaaggtggcacaactcaccaactttccaaaagtggcgacttccttccgctgccctcactgcaccaagcgtctgaagaacaatatcaggttcatgaaccacatgaagcaccacgtggagctggatcagcagaacggtgaggtggatgggcatacgatctgtcagcattgctatcgacagttcagtaccccgttccagctgcaatgtcaccttgaaaatgtgcactcaccctatgaatctaccactaaatgtaagatctgcgagtgggcctttgagagcgagccactattcctccagcatatgaaagacactcacaagccaggagagatgccttatgtctgtcaggtgtgccagtacagaagttccctatactctgaggtggacgtccattttcggatgatccatgaggacactcgacacctcttatgcccatactgcctcaaagtctttaaaaacggcaatgcctttcaacaacattacatgcggcaccagaagcgaaacgtataccactgcaataaatgtcgccttcagtttctgttcgccaaagacaagattgagcacaagctgcaacatcacaagacatttaggaagccaaaacagctggagggattgaaacccggaaccaaagtgactataagagcctccagagggcaaccacggaccgttcctgtctctagtaatgacacccccccaagcgcgctgcaggaagctgcaccactgaccagctctatggaccctctcccggtatttttatatccacctgtccaacgatcgatccaaaagagagctgtcaggaagatgtctgtcatgggtcgtcagacttgccttgagtgttcttttgagattcccgatttcccaaaccacttccccacctatgtccattgctccttgtgccgatacagtacctgttgttcacgcgcatacgctaaccacatgattaataatcatgtacctcggaagtcccctaagtatctggctctctttaagaatagcgtcagcggtatcaagctggcttgtacatcgtgcacattcgtgacatccgtcggggacgctatggccaagcacctagtgttcaatccatctcaccgctcctccagtattctgccacgcggactcacatggatagctcattcgcgccacggtcagacaagggatagggttcatgatcgtaatgtgaagaacatgtacccccctccatcttttcctacaaacaaggctgcaaccgttaagagtgccggtgccacccccgcagaacctgaggaactgctgaccccacttgctcctgcactgccttcacctgcaagcactgctacaccaccacccactcccactcatccccaggcattagccctgcccccacttgccaccgaaggggctgagtgcctgaatgtagatgatcaggacgaagggtcaccagtcacacaggaacctgagctagcatcaggtggcggtggatctggcggagtcgggaagaaagaacagttgtctgtgaaaaaattgcgggtggtgttatttgctctgtgttgcaacaccgagcaagccgcagagcattttaggaacccccagcggcgaattagacgttggctgcgcaggtttcaggcctctcagggagagaacctcgagggcaagtacctttcgttcgaggcagaagaaaaactagccgagtgggtgctgacccagcgcgagcagcaactgcccgtgaatgaagaaacgctgttccagaaggccaccaaaattggcagaagcctagaaggcggttttaaaatctcttatgaatgggcagtcagattcatgctacggcaccatttgacgccccatgctagaagagcggtggcccacactctgcctaaggacgtggcagaaaatgccggtttgttcatcgattttgtccagaggcaaatccataatcaggatctgcctctctccatgatagtagctattgatgagatttctctcttccttgacaccgaggtgctgtcatcggacgacagaaaggagaatgcacttcaaacagtggggactggtgagccatggtgcgacgtcgtgctagccatactcgcagacggcacagtgctgccaacactggtcttctatcgtggacagatggaccagccagccaacatgccagatagtattctgttagaagctaaggagtctgggtactccgacgatgaaattatggaattgtggtccactcgcgtgtggcagaaacataccgcgtgtcaacgctccaagggaatgctggtcatggattgtcatcggacccatttaagtgaagaagtcttggccatgctcagcgcctccagtacccttccagccgtggtgccagccggttgttcttctaagatccagcccctcgatgtttgtatcaagaggactgtgaagaattttctacataaaaagtggaaggagcaggccagggaaatggcagacactgcctgtgattctgatgtccttctccagctggtactggtttggctgggtgaagttctgggtgtgattggggattgtcctgagctggtccagagaagcttccttgtcgcatcagttttacccggacccgacgggaacataaacagccctacccgcaatgcagacatgcaggaggaactgatcgcctcccttgaggagcagctgaaactctccggagaacactcagaatcctctactccacgccctagatcttcgccagaggagactatagagcctgagtcgctgcaccaactattcgaaggcgaatcagaaactgagagcttctacggttttgaagaggcggacttggacctgatggagatttag

SEQ ID NO: 29376 - DNA, 288 bp, Artificial Sequence
  Description of Artificial Sequence: Synthetic coding sequence
atgctgaaaaacaagggacactccagcaaaaaagataatctggccgtaaatgccgtggccctgcaagatcatattctacacgacctgcaactgaggaacctgtctgtggccgaccattccaagacccaagtgcaaaaaaaagagaataaatcgctgaagagagatacaaaagccattattgacactgggcttaagaagacaacacagtgccctaagctagaggattctgaaaaggaatacgtgcttgaccccaaacctcccccactgactctcggctaccacagctag

SEQ ID NO: 29377 - DNA, 708 bp, Artificial Sequence
  Description of Artificial Sequence: Synthetic coding sequence
atgctcaaaaacaaaggccattcctcaaagaaagataatctggctgtgaatgccgtcgccttacaagaccacattttacacgacctccagttacggaatctgtccgttgccgaccattcgaagacacaagtgcagaagaaggaaaacaagtctctgaagcgggataccaaagcgataatcgataccggactgaaaaaaaccacccagtgtcccaaactcgaagacagcgaaaaagaatatgtcttggatccgaaacccccacccctgacactggctcaaaagctgggcttaatcggcccaccccctcctccactctcaagcgacgagtgggagaaggtcaaacagcgctcactgctccaaggcgacagtgtacaaccatgcccgatctgcaaagaagagtttgaactgcggcctcaagtactcctctcttgcagtcatgtgttccataaggcgtgtctccaagcctttgagaaattcactaataagaagacatgccctctgtgtcgtaaaaaccagtaccagacccgagtgattcacgatggcgctcgcctattccgcataaagtgtgtgacccgaatccaagcttattggagaggatgtgtggtaagaaagtggtatcgaaacctccgtaaaaccgtcccgccaacagacgctaaactgagaaagaagttctttgaaaagaagacccaggactggaaacccgcatag

SEQ ID NO: 29378 - DNA, 1089 bp, Artificial Sequence
  Description of Artificial Sequence: Synthetic coding sequence
atgctcaaaaacaaaggacatagctctaagaaagataatcttgctgttaatgctgtggccctgcaggaccacatattacacgatttgcagctaagaaacctgtcggttgcggatcactctaaaacacaggtccagaaaaaagagaacaagtcacttaaacgtgacacgaaggctatcattgacacaggcctaaagaaaaccactcaatgcccaaaactggaagatagcgagaaggagtatgtactggaccctaaaccccctcctttgactctggcccaaaagttggggctcattggacccccaccccctcctctttctagtgatgagtgggaaaaggtgaagcagcgatcactgctgcagggcgactccgtgcagccttgccccatatgcaaggaggagttcgagctccgcccacaggtcctattgtcttgttctcacgtgttccacaaggcctgcttacaggcattcgagaaatttaccaacaaaaagacctgccctctctgtcgaaagaatcagtaccagaccagagtgatccacgatggagccagactgttccggattaaatgcgtgacgaggatccaggcctattggagaggttgtgttgttcgcaagtggtatcgaaacctgcggaaaaccgtgcctcccacagatgctaagctgcggaaaaagttctttgagaagaagtttactgagatctcccatcgcatcctgtgcagctataatacaaatatcgaggaattgtttgccgagattgaccaatgtctcgcgatcaatcggagtgtgttgcagcaactggaggagaaatgcggccatgaaatcactgaagaggagtgggaaaagatacaggtgcaggccctcagacgggaaacccatgaatgcagtatttgtctggctccactctctgccgctggagggcagcgggtcggagctgggaggagatcccgggagatggccttactatcatgttcgcacgtctttcaccatgcatgcctccttgctctggaggagtttagcgtaggcgaccgtccgcctttccatgcatgccccctgtgtagatcctgttatcagaagaagattctggaatgctag

SEQ ID NO: 29379 - DNA, 1278 bp, Artificial Sequence
  Description of Artificial Sequence: Synthetic coding sequence
atggataagaatatcggggaacagctgaacaaagcttacgaagctttcagacaggcctgcatggatcgggactccgctgtgaaagaactccagcagaagaccgagaactacgagcaacgaattcgcgagcaacaagagcagctgtctctgcagcagacaataatagacaagctgaaatctcagctgctgttggtgaatagtacccaggacaacaactacgggtgcgtgccactcttggaggatagcgaaacacgcaagaataacttaacgctggaccagcctcaggacaaggtcatttctggaatcgccagggaaaagctccctaaagtgcgtcggcaggaagtgtcgtccccaagaaaggagacatcagcacgatctttggggagtcctcttctccacgagcgtgggaacatcgaaaagaccttctgggatctgaaagaagagtttcataagatatgtatgttagcaaaagcccagaaagatcatttatccaagctgaacatcccggacaccgcaacggagacacagtgctcagtcccgattcagtgcaccgacaagacagataagcaggaagcattgtttaaaccacaagcaaaggacgatatcaatcggggtgctccctccataacaagcgtgaccccccgaggactgtgtagggacgaagaggatacatctttcgaatccctgtcaaaattcaatgtgaagttcccacctatggacaacgatagcacattcctgcactcaactcccgagagacccggaatattgagccccgcaactagtgaagcggtgtgccaggagaagttcaacatggaatttcgcgacaatcctggtaatttcgttaaaactgaggaaactttatttgaaatacagggaatcgaccctatcgcttctgcaatccagaatttaaagaccactgataagacaaagccttcgaacctggtaaacacttgcattcggacgaccctggaccgggctgcatgcctccctccaggagaccataatgccctgtatgtgaattctttccctttgcttgatccctcagatgcaccttttccgagcctggattctcccggaaaggccattcggggtccgcagcagccaatttggaagcccttccccaatcaggattcagatagcgtggtgctgtcaggcactgacagcgagctgcatattccacgtgtttgcgagttttgccaagccgttttccctccatccattacatctagaggagattttctacggcacttgaattctcatttcaacggtgaaacttag

SEQ ID NO: 29380 - DNA, 639 bp, Artificial Sequence
  Description of Artificial Sequence: Synthetic coding sequence
atggctccgtgggggaagcgcctggctggcgttagaggtgtactactggacataagcggagtgctttacgatagtggcgcaggagggggaactgctatcgcagggtcagtagaagcagttgccagactgaagcgctcgcgcctgaaggtgcgtttctgcacaaatgaatcccagaagtccagagcagagttagtgggccagttgcagagactcggatttgatatcagtgagcaggaggtgacagcacctgcacctgccgcatgtcagatcctcaaggaacagggactgcgcccttacctcctgatacacgatggcgttcgaagcgaattcgatcaaatagacacctctaatccaaactgcgtggtcattgcggatgctggcgaaagctttagttaccagaacatgaataacgcatttcaagtccttatggagctggagaaacctgtgctgatatcgcttggcaagggtcggtactacaaggagacatctggcctcatgcttgatgtcgggccttacatgaaggctctggagtatgcctgcggcataaaggctgaggtagtcgggaaaccatctcccgaattctttaagagcgctcttcaagctattggtgtggaagcccatcagcttctctccgtatag

SEQ ID NO: 29381 - DNA, 2868 bp, Artificial Sequence
  Description of Artificial Sequence: Synthetic coding sequence
atggaagttggatctgaggaggaaaagtgggaaaaacttgacgcagagtttgaccacttcgtggtcgatatgaaacctttcgtgctgaaactgccccacagaaccgaacgccagaggtgtgctctgtggatccgcaagctgtgtgaaccaagcgggacaggggctgggattatgggcagaaagaatcgtaatctctacgccaagcttctgttgcatatgctgaaaagaggtgccctggaagggcctttcactcaccgccctgagcctggcaccctgaaaattctgcctagttatatgtctatttactttgacgaacccaaccctgcccgagcgaaagggagctccccagaaggtctccccgcttgggttctgggggaactcgaaacgagcgagcataagttgaatgagagttggaaactatctagcggggaagacaacaccctggtccagagcccgactgatgtatattccagggagcagtacacgggcaaactccgcgttcgaagtcatagtctgtctccgacacatagagaggacggacagaacataactccaaagatttgcgaggtgtacagtaagaagtctccagtgtccttagacgactccgatatagaggccaggcttaattcgtggaacctcggaatcgaaaaccccagatatctgaggcaaaagcctattccggtttccctgatgactccgaagttctcgcttaggaaaagttccagttttcacgatgatcacttcctctctaggatccgagaaaaggagctggacatgaaaactaagatgatggaggccaaatttcacgaggagaaattgaagctacagcaaaagcacgatgctgacgttcaaaaaatcctggagagaaagaataacgaaatcgaagagctgaagaccctgtatcgcagcaaacagcatgaaaccgaggagacgattaggaaactggaaaaaaaagtgcagactctgatccgagattgtcaggtgattagagagacaaaggaagaccagattgcagagctcaagaagatctgtgagcagtccaccgagtccctcaacaatgattgggagaagaagctacataacgccgtcgcagagatggaacaggagaaattcgatctccagaagcagcacacagaaaacatccaggaattgttagaggatacaaatgtccgcctgaataaaatggagtcagagtacatggcccagacacaaagcactaatcatatgatcaaagaactggaagcccgtgtgcagcaattgaccggagaagctgagaatagtaatctgcagcggcagaaactcattcaggagaaggcggaactggagaggtgttaccaaattacttgttccgagctccaggaagtcaaggcccgtaggaacaccctgcacaaggagaaggatcacttggtgaatgattatgagcagaatatgaagttgctgcagaccaaatatgacgcagacataaacctgctgaagcaagagcatgccctaagtgcctctaaagccagttcaatgatcgaggagttagagcaaaatgtgtgtcaattgaagcagcagctccaggaatcagagctgcaaagaaaacaacaactgcgtgaccaggaaaacaagttccagatggagaagtcccatttaaagcatatttacgagaagaaggcgcacgatctgcagagcgaattggacaaggggaaagaggatactcagaaaaaaattcataagtttgaggaagcccttaaagaaaaggaggagcagctcaccagggtcacagaggtccaacgccttcaagcccagcaggccgacgccgcactcgaggagtttaagaggcaggtcgaactcaactcagagaaggtgtatgctgaaatgaaagaacagatggagaaagtggaggctgatttgacaagatcaaagtccctgagagagaaacagtctaaagaattcctgtggcaactggaagatattcggcaacggtatgaacaacagatcgtggagctgaaactcgagcatgagcaggaaaaaacacacttactacagcagcacaatgcagagaaagactcgctcgtgagagatcacgagcgcgaaatcgaaaatctggaaaaacaacttcgggctgccaatatggagcacgagaaccagattcaggaatttaaaaaaagggatgctcaggtaatcgcggacatggaggcccaagtgcacaagctccgagaagaactgatcaacgtaaatagccaacggaaacagcaactggtcgaactcggattattaagagaggaggagaaacaaagagccacacgtgaacacgagattgtcgtgaataagctgaaagccgaatctgaaaagatgaagattgagctgaaaaaaacccatgctgctgagaccgagatgaccctggagaaagcaaattctaaactgaagcaaattgagaaagagtatactcaaaagctggcaaagtcctcccagattattgccgagctccagactacaatcagcagtctgaaggaagaaaactcccagcagcagctcgcagccgaaagacgactgcaggatgtgagacagaagtttgaggacgaaaaaaagcagcttattagggataacgaccaagccattaaagtacttcaggatgagctcgagaacagatcaaatcaggtgcgttgcgccgagaagaagctgcagcacaaggagctggagtctcaggagcaaataacctacattagacaagagtacgagacgaagctgaaaggccttatgccagcttcgcttcgtcaggaactcgaggatactataagcagcctgaagagtcaagttaacttcctgcagaagcgcgcaagcatcctacaggaggaattgaccacttatcaaggccgaaggtag

SEQ ID NO: 29382 - DNA, 1269 bp, Artificial Sequence
  Description of Artificial Sequence: Synthetic coding sequence
atgccccgaaaaggcactcagcccagcactgcgaggagacgggaagagggcccaccaccaccttcccctgacggggcatcttccgatgcagagccagagcccccatcaggcaggaccgagtccccagccactgccgcagaaaccgcctctgaggaactcgataatcgtagcctggaggagattctgaatagcatcccccctccaccaccccctgctatgacaaacgaggccggagccccaagactgatgatcacccatattgttaatcagaatttcaagtcgtacgctggagaaaagatcctcggccctttccacaagagattctcatgcattatcggacctaacggatctggaaagagcaatgtgattgattctatgctgtttgtgttcgggtaccgagcacagaaaattcggtccaagaagctgtcggtgctgatccataactctgacgagcataaagacatccaaagctgcacagttgaagtgcactttcagaaaataattgacaaagaaggggatgactacgaggtgatccctaattcgaacttctatgtttctcggaccgcttgtagagataatacctccgtttatcatatttcaggaaagaagaaaaccttcaaggatgtgggcaatctccttagaagccatggcatagatctggatcacaacagatttctgatcctccaaggcgaagttgaacagatcgccatgatgaagccgaagggccagacagagcatgacgagggaatgcttgagtaccttgaagatatcattgggtgcgggcgattgaacgagcccatcaaggttctttgcagacgagtcgagatcctcaacgagcaccgtggagaaaagcttaatagggttaaaatggtagagaaggagaaggatgctctggaaggagagaagaatattgctattgaattcttaaccctggaaaatgagatatttaggaaaaagaaccacgtgtgtcagtattatatttacgagctccaaaagcgtatagctgaaatggaaactcaaaaggagaaaatacatgaggacacgaaggaaattaacgagaagtccaacatcttgagcaacgagatgaaagccaagaataaggatgttaaggacaccgaaaagaagctaaacaaaataactaagtttattgaggaaaacaaagaaaagttcactcagctggatctggaggatgtgcaggtgagagaaaagttgaaacatgccaccagcaaggccaagacgggcgagactacctcaaaacgcaaaaaatag

SEQ ID NO: 29383 - DNA, 303 bp, Artificial Sequence
  Description of Artificial Sequence: Synthetic coding sequence
atgagaaaacgcctctccgcccctgaattacggctgtctctcactaaaggccctggtaatgacggcgcttcacccacacagtcggcgccttcgtctcccgatggaagcagcgatttggaaatcgatgagctggagacaccatccgattcagagcagttggacagtggccacgaattcgagtgggaagatgagctgcccagagcggaagggttaggcacaagtgagacggcggagcggttgggtaggggttgcatgtgggatgttacaggagaggatggccaccattggagagtcttcagatag

SEQ ID NO: 29384 - DNA, 1059 bp, Artificial Sequence
  Description of Artificial Sequence: Synthetic coding sequence
atgggcaaggttgagaacagcaaaagtgctcagggactggctggcttacgaaacctaggcaatacgtgttttatgaactccatcttgcagtgcctgtcaaatacgagagagctccgggactactgtctacagcggttgtatatgcgtgacctgcaccatgggtccaacgcccatacagcgttagtggaagagtttgcaaagctgatccagaccatatggacttcctcccccaatgatgtggtttccccttctgaattcaaaactcaaatacaacgctatgccccaaggtttgtgggttacaatcagcaggacgcacaggagtttctccggtttctactggacggcttgcacaacgaagttaatcgggtgaccctgaggcccaagagcaacccggaaaacttggaccatcttccagacgatgaaaagggcagacagatgtggcggaaatacctcgagcgggaagactcgcggatcggagatctgtttgttggccagctgaagtcctcactcacttgcactgactgtggctattgctctaccgtctttgacccattctgggatttgtccctccccatagccaaaaggggctaccccgaagtgacactgatggattgtatgcgtctgtttaccaaagaagacgtcttggacggagacgagaagcctacctgctgccgctgcagggggagaaaacgttgcataaaaaaattctccatccagagatttcccaagattctggttctgcatttgaaaaggttttccgagagtcggattagaaccagcaagctcaccacctttgtaaacttccctctcagagatctcgaccttcgcgaatttgcaagtgagaacaccaaccatgcagtctataacttgtatgctgtgtcaaaccactcaggaaccaccatgggcggtcactataccgcctattgccgtagcccaggcacaggcgagtggcacacttttaacgattcgtcagttacacccatgagctccagccaagtacgaacctcagacgcctatctccttttctacgagcttgccagcccccctagtcgcatgtag

SEQ ID NO: 29385 - DNA, 1497 bp, Artificial Sequence
  Description of Artificial Sequence: Synthetic coding sequence
atggtgatcgaagaagtgaattttatgcaaaatcacctggaaatcgagaaaacctgccgcgagtccgcggaggcactggctaccaagctaaataaagagaataaaaccttgaagagaattagtatgctttacatggccaagctgggcccagacgtcatcacagaagaaataaacatagatgacgaggacagcacaaccgacaccgatggggctgcagagacctgtgtctccgtccagtgccagaaacagattaaggagttgcgcgaccaaattgtgagtgtccaggaggaaaaaaagatcctggccatcgagctcgaaaacctcaaaagcaagctcgtagaagtcatcgaagaggttaacaaggttaaacaagagaagactgttctgaacagcgaagtgttggagcagcgaaaagtgttagaaaagtgtaatcgcgtgtctatgctggcagtggaggagtacgaagagatgcaagtcaaccttgagcttgagaaggaccttcggaaaaaggccgagtcattcgctcaggaaatgttcattgagcagaataagctcaaacggcagtcccacctgcttctgcagagctctatccccgatcagcagttgctgaaagccttggatgagaatgcaaaactgacgcagcagttggaagaggagcgaatccagcatcagcagaaggtgaaggagctggaggagcaacttgagaacgaaaccttgcacaaagaaatacacaatctcaaacagcagctggaactccttgaggaggataaaaaggagcttgaacttaaataccagaattctgaggaaaaagctaggaatctaaagcactccgtcgacgagcttcagaaacgtgtcaaccagtcagagaatagcgtgccaccgccaccccctcccccacccccactgcctcctccccctcccaatccgatcaggtctctcatgtccatgattcgtaagcgctcccatcccagcggaagtggtgccaagaaagaaaaggccacacagcccgagacaacagaggaggtcactgacctgaagcggcaggccgtggaagagatgatggatagaataaagaaaggggtgcatctgcggcctgtaaaccagactgcacgccctaaaacgaagcccgaatcatcaaaaggatgcgagtcggcagtggacgaactgaagggcattctcggtaccctcaataagtcgactagttctaggagcttgaaaagtttggatcccgagaatagcgagaccgagctggagagaattctgaggcgcaggaaagtcacggctgaagccgattcgagttccccaacaggaattcttgctacctcagaaagcaagtctatgcccgtgctggggtcagtctcttccgtgactaagactgcactcaacaagaagactttggaagctgagttcaacagcccaagcccacccaccccagagcctggcgaagggcctaggaaactcgaggggtgcacctcatcgaaagtcacttttcagtag

SEQ ID NO: 29386 - DNA, 1950 bp, Artificial Sequence
  Description of Artificial Sequence: Synthetic coding sequence
atgaattcaagcgatgaggaaaaacagctgcagctgattactagcctcaaagaacaggctataggagaatatgaggacctgcgtgccgaaaaccagaagaccaaagagaagtgcgacaaaattcggcaggagcgggacgaggccgtgaagaagctggaggaattccagaaaatttcacacatggttattgaggaggtgaacttcatgcagaaccacctggagatcgaaaaaacatgtcgagagagcgccgaggcgcttgccacaaaactcaacaaagagaataagactctcaagaggatttcaatgctctatatggcaaaactgggacccgatgttattacagaagagatcaacatcgatgatgaagatagcaccacagacaccgacggcgctgcggaaacctgcgtcagcgttcagtgtcagaagcaaatcaaggaactgcgggatcagattgtctctgtgcaggaagaaaagaagattctggctatagaattagagaatctgaagagtaaactggtggaggtgatagaagaagtgaacaaagtaaagcaggaaaaaactgtactcaactctgaggttctcgagcagcgcaaggtgttagagaagtgtaaccgtgtgtccatgctggcagtggaagagtacgaggaaatgcaagtcaacctcgagctagagaaagaccttagaaaaaaggccgagtccttcgcccaggagatgttcattgagcagaacaaactgaagcggcagagtcatctgctgctgcagagctcaattcctgaccagcaactcctgaaagcactggatgagaacgctaagcttactcagcagctggaggaagagcgcattcagcatcagcaaaaagtgaaagagttggaagaacaactggaaaacgagacactgcacaaggaaattcacaaccttaagcagcagcttgaacttctcgaagaagacaaaaaggaattggagctgaagtaccagaattccgaggaaaaggcacgtaatttaaagcactctgtggacgaactccagaaacgcgtgaatcagtcagaaaacagtgtccctcccccacctccaccccctccccctctgccaccccctccccctaaccctattcggagcttgatgtctatgatccggaagaggtcccatccaagtggctctggggcaaagaaagagaaagctacccaaccagagacgacagaggaggtgactgacctcaagaggcaggctgtagaggagatgatggaccgcatcaaaaaaggcgtccacctccgccctgtcaatcagacagctcggccaaaaactaagccagagtcaagcaaaggctgcgagagcgccgttgacgagctgaaagggatactgggaacactgaataagtccacaagttcgaggtctctcaaaagcctggatccagaaaatagcgagaccgagctcgagaggatcctgcgcagacggaaggttactgcagaagccgattcctcaagcccaaccggaattttggccacgtcagaatctaaaagcatgcccgtgctcgggtccgtcagctctgtcacaaaaactgctctcaacaaaaaaactctggaggcagaatttaattctccaagccccccaactcccgagcctggcgaaggaccaagaaagctcgaaggctgtaccagcagcaaagtcacctttcaaccgccaagttctatcggttgtagaaagaagtatattgatggcgaaaagcaggcagagccggtggtggtgttagatcctgtctccactcatgagccgcaaacgaaggatcaggtcgcagaaaaagatccaacccagcacaaggaggacgagggtgaaatccaacccgaaaacaaggaagacagtattgaaaacttcttcccttttcacttcgggttcgagggcgtgctccctctcgccggagtgaccttgagtacgaaggctcgtgaccccaagtag

SEQ ID NO: 29387 - DNA, 837 bp, Artificial Sequence
  Description of Artificial Sequence: Synthetic coding sequence
atgggcaagtcctctgagtggtgcgaaagaattgcaggcatccaaaagttcgtcttggagaaatggacaaaaaaagcaaagccggaggacacgcttaacctgtgccagctcctgaataacgaccttgccagtactgttgtctcctaccccagaaggttcgtgggcctgggcaccttgccgatgcaagcgccagaacttgcggtaaaggaaatggagagatgcgtaaaggagctcgggttccctggtgtccagatcggcacacatgtcaacgagtgggatctgaacgcacaagagttgttccctgtttacgctgccgctgagcggctgaaatgtagtctttttgtgcatccttgggacatgcagatggacgggcgaatggccaagtactggttgccctggctggtgggcatgccggctgagactactatcgcgatttgcagtatgatcatggggggagtgtttgagaaatttccgaagttgaaagtctgctttgctcacggtggcggagcatttccattcaccgtggggagaatttcccatgggttcagcatgagacctgacttgtgcgcccaggacaaccctatgaaccctaaaaagtacttgggatccttttacactgacgcgcttgtgcatgaccctctgtctctgaaacttctcaccgacgtgatcggcaaggataaggtcatactcggaaccgactaccccttcccattgggagaactcgagcccggtaaattgatcgaatctatggaagagtttgacgaggaaacaaagaataaactcaaggccggaaacgctcttgctttcttgggcctggagagaaaacagttcgaatag

SEQ ID NO: 29388 - DNA, 1368 bp, Artificial Sequence
  Description of Artificial Sequence: Synthetic coding sequence
atgtttaccgaaggagaggaaatgtatctgcagggttctacagtctggcaccccgattgtaagcagtcaaccaagacagaggagaagctaagactaccaaacatccggaggtcatcctccgatttcttctatagtaagagcttgattagacgaacaggccgtagtcctagcctacagccgactcgcactagttcagaatccatctattccagaccaggcagctccatccccggttcgccaggtcacaccatctacgctaaagtagataatgaaatcctcgactataaagacctggcagcaattcctaaagtgaaggccatctacgacatagaaaggcccgacctcatcacatacgagcccttctatacctccgggtatgacgacaaacaggagaggcagtctctgggagaatcacctcggaccctttcaccaactccaagcgctgaagggtaccaggacgtgcgagacaggatgatccacaggtccaccagtcagggtagcatcaactcacccgtctactcgcggcattcatatacccccactacttcacgaagcccccagcactttcatcgacctgatcagggaataaacatttacaggaagcctccgatatacaagcagcacgctgctctagccgctcagtccaaatcatctgaagatattattaaattttcaaaattcccagctgcccaggcacccgatccgtccgaaactcccaaaatcgagaccgaccactggcctggcccaccaagttttgctgtggtcggccctgacatgaaaaggcgatcgtccggcagagaagaagatgatgaagagctgctgcgtcgtagacagcttcaggaggaacaactgatgaagttgaactcagggctgggccagctgattctgaaggaagagatggagaaagaatctcgggagcgttcaagcctgttagcgtcacgctatgacagccccatcaattcagcgtcccatattccctcctcgaagacagccagtctgcctggctatggacgcaacgggttacatcgcccagtgagtacagattttgcacagtacaattcgtatggcgacgtgtcaggtggagttcgggactaccagacattgccagatggccacatgccagcaatgcgcatggacaggggagtgtctatgcctaacatgcttgagcccaagattttcccttacgagatgctgatggtgacaaatcgcggacggaacaaaatattgcgcgaggttgatcgaacgcgcttggagagacatttagctcccgaggttttccgcgagatctttggcatgtctattcaagagttcgaccgactacccttgtggaggagaaacgacatgaagaagaaggcgaaactgttttag

SEQ ID NO: 29389 - DNA, 1959 bp, Artificial Sequence
  Description of Artificial Sequence: Synthetic coding sequence
tagtctcatgccttcattagtcagtgggtgtgcagacattggcgggaccccgtcgcacatccccaggatcctcaccacccgtccgaaaaaccagtgattcactgccataaatgcggggagccctgtaaaggagaggttctccgggtgcaaacaaagcactttcatattaaatgcttcacttgcaaggtctgcggctgcgatctggcccaaggcggtttctttatcaagaacggcgagtacctttgcacgttagattaccaccctaactgcttcgcctgtaccatatgtaaacgaccattccctccgggagatagagtcacctttaacggacgcgattgcctttgtcaattatgcgcacagccaatgagcagttctcccaaagagaccaccttttcgagtaactgcgcgggttgtggacgggatataaaaaatggccaagccttgctagcacttgacaagcagtggcacttggggtgctttaaatgcaagtcttgcggaaaggtcctaacaggggaatatatcagcaaagacggggctccatactgtgagaaagattaccagggacttttcggggtcaagtgcgaggcctgccaccaatttattaccggcaaagtgctggaggccggagacaagcactaccatccaagttgcgcccgttgtagtagatgcaatcagatgttcacagaaggggaggagatgtacctgcagggtagcacggtgtggcacccagattgcaagcaaagtaccaagactgaggagaagcttcgaccgaccaggactagtagtgaatccatctactctagacccggttcgtctatccctggaagcccgggacacacaatttacgctaaggtggataatgaaatcttagactacaaagatctggccgcaatcccaaaagtgaaagcaatatacgacatagagcggcctgacctgatcacatacgaacccttttacacatctggctacgacgataagcaggaaagacagagcctgggagaaagcccccgaacactttcaccaaccccaagtgctgaagggtatcaggatgtcagggacagaatgatccaccggtcaaccagtcagggatccataaatagcccagtctatagccggcacagctatactccaacaaccagcagaagcccccagcacttccaccgtccggatcagggtataaacatctaccggaaaccccctatctataaacaacacgcagccctggccgctcagagtaagagtagcgaggatatcattaagtttagcaagttccccgcagcgcaggccccagaccctagcgaaactcctaagattgagaccgatcactggccgggtcccccttccttcgctgtggtgggtcccgacatgaagagacggtcgagcggacgggaggaggacgatgaggagctcctgcggagacggcagctgcaagaggagcagctcatgaagttgaatagcggtttggggcaactgatcctgaaggaggaaatggaaaaggagagcagggaaaggtccagccttctcgcctcgcgttatgattctcccattaactcggcttcacatatccctagcagtaaaacagctagcctccctggatatggcagaaacggattacaccgaccagtgtctaccgacttcgcgcagtataattcatatggcgacgtgagcggtggggttagagattaccagacactgcccgacgggcatatgcccgctatgagaatggatagaggggtgtctatgccaaatatgcttgagcccaagatttttccatatgaaatgctaatggttactaacagggggagaaacaagatcctgagggaagttgatcgtacccggctggagagacacctggctcccgaggtttttagggagattttcggaatgagcattcaagaattcgacagactgcccctatggagaagaaatgacatgaagaagaaggctaagctcttctag

SEQ ID NO: 29390 - DNA, 837 bp, Artificial Sequence
  Description of Artificial Sequence: Synthetic coding sequence
atgacccagcaatggagagaagttaacgaggacagagaggctgttgctcaggctagatcttggcaaagccttaacctcggagatcgagacatgggcgtgtctttcattgagaccgcactggcactgagcgccgctcgtgctcgcagaccattgctcacttcacaccccccaagccgtcctttccagccgccaaaacacacaccgtctccaccacccgctcctagggtcaactcaaggcacccaggtcgcagtgtcagcctgtctttaccttccgccagtcaggccccacccgttcctctggcctctccagagggacgacctcacacagttggtgccccacatgcctcgacatggaaaagaacaaggggacgccagcgggcaaggccacctaaaattgttaaagaagccgaagtgcctcaggccgcattgggagtgcccgctcaagggacaggggacaatggccatacacccgtggaagaagaggtcggagggatccctgtgcctgcaccgggtcttctgcaggtgaccgagcgcagacagcctctatcaagcgtctcttctctcgaagtgcacttcgacctcctcgatctgaccgaactgacagatatgtccgaccaagaactggcagaagtgttcgctgactctgacgacgagaatctcaatactgagagtcctgcaggactccaccctctgccgcgtgcgggatatctaaggagcccttcttggactaggactagggcagagcagtcacacgagaagcagcctctgggtgatcctgagagacaggcaaccgtgcttgatacatttctgacagttgaacggccacaagaggattag

SEQ ID NO: 29391 - DNA, 540 bp, Artificial Sequence
  Description of Artificial Sequence: Synthetic coding sequence
atgacagacttggttgcggtctgggatgtggctctatcagacggcgtgcacaaaatcgagttcgaacatggtacgacctcaggcaagagggtcgtctacgttgatgggaaggaagaaatacgaaaagaatggatgtttaagctcgtcgggaaagagaccttctacgttggggcagccaaaaccaaagccacaatcaacatcgacgcgatcagtggatttgcttacgagtacactctagagatcaatggtaagagcctgaaaaaatatatggaggaccggtccaaaacgaccaacacctgggtactgcatatggatggcgagaacttcaggattgtactcgagaaagacgcaatggacgtttggtgtaacggcaagaagctcgaaacagcgggagagttcgtggatgatggcacagaaacacactttagcattggcaaccacgactgctacataaaggccgtctccagcggcaagcggaaagagggtataattcatacactgattgtggacaatcgagaaataccggaaatcgctagttag

SEQ ID NO: 29392 - DNA, 540 bp, Artificial Sequence
  Description of Artificial Sequence: Synthetic coding sequence
atgaccgacctggtagcagtttgggacgtcgcgctgagtgacggggttcataagattgagttcgagcacgggaccacctctgggaaacgagtggtctatgtcgacggtaaggaagagatacgcaaagagtggatgttcaagttagttggcaaggagaccttctacgtcggggctgctaaaaccaaagccaccatcaatatagatgcaatatcaggtttcgcctacgaatacactctggagattaatggcaagtccttaaagaagtatatggaggaccgcagcaagacaaccaacacatgggtgttacacatggacggcgagaatttccggatagtgttggagaaggatgctatggacgtctggtgtaacggcaagaaattggaaactgccggagaattcgtcgatgatggcacagagacccattttagtattggcaaccacgactgctacattaaagcagtgagttccgggaaaaggaaagaaggcataattcacacgcttatcgtcgataatcgagagatccccgagattgccagttag

SEQ ID NO: 29393 - DNA, 1053 bp, Artificial Sequence
  Description of Artificial Sequence: Synthetic coding sequence
atggggccttgtaatcttagtagcgcagcgggacccaccgccgaaaagtcagttccttaccaaagaacactaaaagaggggcaaggaacatctgtcgtggcgcagggaccatctaggccccttccttctaccgctaatgtcgtggttatcgggggagggtcccttggatgtcagactctgtatcacttggcgaaactgggaatgtccggagcagtgctgctggagcgggagagactcacaagtgggaccacatggcacactgccggactcttgtggcaactgcgcccttccgacgtcgaggttgaactattagcgcacactcgccgagtagtgtctcgagagcttgaggaggaaaccggattgcacaccgggtggatccagaacggcggactattcatagcctcaaatcggcagaggctcgatgagtataaacggctcatgagtctcggcaaggcgtacggagtagaatctcacgtgctgagccccgctgagaccaaaacattgtaccccttgatgaacgtcgacgacctttatggaactctttacgtgcctcatgacggcaccatggaccccgctggtacttgtacaacactggctcgcgctgccagcgctcgcggagcccaggtgatcgagaattgcccagtgacaggtatacgagtgtggacagatgacttcggtgttcggagggtggcaggagtcgaaacacagcacgggtctatccaaacaccctgcgttgtgaattgcgcaggcgtctgggccagtgccgtggggcgaatggcaggggtgaaggtccccctagttgccatgcaccacgcatacgtggttacagagcggatcgaagggatccagaatatgccgaatgtcagggaccacgatgctagtgtttacctgcggctgcagggggatgccctcagtgtcgggggatacgaggccaaccccattttctgggaggaagcggtgaagtaccgccctagggctgccggaggtctttgtctgaaaaccagcacagagaaggtatgtgctgtgtggtccgacgatctgaggagggcttag

SEQ ID NO: 29394 - DNA, 2001 bp, Artificial Sequence
  Description of Artificial Sequence: Synthetic coding sequence
atggccagagcgggaagctgtggaggcgcagccgctggcgcaggaaggcctgagccctgggaattgtcgctggaagaggtcctcaaagcatacgaacaacctttaaacgaggaacaggcatgggccgtgtgtttccagggctgccggggactgaggggaagtcctgggaggcgactgcgagatacaggcgacctcctgctgcggggagacggaagcgttggcgctcgagaacccgaggccgctgaacctgccactatggtcgtccccctggctagcagtgaggctcagacagtgcagagcttgggtttcgcaatctaccgggcactggactggggcctggacgaaagcgaagagcgcgagctgagcccacagctcgagcggctcattgacctcatggctaataacgatagcgaggattctggatgcggcgcagctgacgaaggatatggagggcctgaggaagaagaagaagctgagggtgtgccaagatccgtccgaactttcgctcaggcaatgagactgtgcgccgcaagactgacggacccccgaggggctcaggcacactatcaagcagtgtgtcgcgctctattcgtcgagactcttgaactgagagccttcctcgctcgagttcgggaagccaaagagatgctgcaaaaactgagagaggatgaaccacatctggagacacccagggccgagttggacagcttgggtcatactgattgggctcgactttgggtacagctcatgcgggagttacgcagaggggttaagctgaagaaggtccaagagcaggaattcaatccacttccgaccgagtttcaacttacccctttcgagatgctgatgcaggatatcagggcgagaaattacaaattgagaaaggtcatggttgacggggacatacctcctcgcgtgaagaaggatgcgcacgaactgattctggactttatcaggtcccgccctcctctgaaacaagtctctgagaggcggctccgtccgttgcctccgaagcagcgaagcttacacgaaaaaattctggaggaaatcaaacaagagcgcagattgagacctgtaagaggcgaaggctgggccgctagaggatttggcagcctaccttgtattctgaacgcctgtagcggtgacgctaaatccacgagctgcatcaacttaagcgtcaccgatgccggtgggagtgctcagcggcctcgccctagggtcctcttgaaggctcccacgctcgcagaaatggaagaaatgaatacgtctgaggaagaagaatcaccttgtggagaagtaacattgaagcgggatagatccttcagtgaacacgacttagctcagctacgctctgaggttgcctctggcttgcaatccgccacccaccccccagggggtacagaacctcctcgcccaagggctggctccgctcatgtttggcgcccaggcagcagggaccagggcacttgtcctgcttcagtcagtgatccatcacaccctctgttgtctaatcgcggaagtagtggagatagaccggaggccagtatgactcccgatgcgaaacatttatggctggagttcagccacccagtcgagtctttggctctgactgtagaggaggtaatggacgtgcgcagggtgctggtgaaagccgagatggagaagttcctgcagaataaagaactcttttcatccctgaaaaaaggcaagatatgttgctgctgcagagctaaatttcccctgttctcttggccaccaagctgcctattctgtaagcgctccctccagggacctcaatggcagtcggttgaagaggctttccctcatatttatagccacggatgtgtcctcaaagatgtgtgctccgaatgcacaagctttgtggccgatgtggtgcgaagttcaagaaagtcagtggatgtgctcaacaccacaccacgacggtcaagacaaacccaatccctgtacattcccaatacaagaactctagacttcaaatag

SEQ ID NO: 29395 - DNA, 474 bp, Artificial Sequence
  Description of Artificial Sequence: Synthetic coding sequence
atggaaaccttacagagtgagacaaagactagagtgcttccatcttggctaaccgcccaagtggccactaagaacgtggctcccatgaaggcgccaaaaagaatgcgcatggctgcagtgcccgtggccgcagccagactgcccgcaactcgtacagtctactgcatgaatgaggctgagatcgtggatgttgcgcttgggatcctcatcgaaagtcgcaaacaagaaaaagcttgcgagcagcctgccctggccggtgcagacaaccctgagcactcccccccttgtagtgtcagtccgcatacatcttcaggttcttcgagcgaggaagaggattctggtaaacaggctttggcacctggcctgagcccttcccaaagaccgggagggtcatcttcagcctgttcccgatctccagaggaggaggaagaggaagatgtgttaaaatacgtccgtgagatcttcttcagttag

SEQ ID NO: 29396 - DNA, 804 bp, Artificial Sequence
  Description of Artificial Sequence: Synthetic coding sequence
atggccaattgcgagcgcacatttatcgccattaagcccgacggagtacagagaggcctggtgggagaaattatcaagcggtttgaacagaaggggttcagactcgtgggattaaagttcatgcaggcttccgaagatcttctcaaggagcattacgtggatttgaaagatcgacctttcttcgcgggactggtcaagtatatgcatagcggccctgtcgtggctatggtgtgggaaggactgaatgtcgtaaagacaggccgagtcatgctgggcgagaccaatcctgccgacagcaagcccggaacaatccgcggtgatttctgtatccaagtggggagaacaatggctaatctggagcgcacctttatcgctattaaaccggacggagtccaaagaggactggtaggagagataattaaacggtttgagcagaagggattcagacttgtggctatgaagtttctgagagcaagtgaagagcatctgaagcagcattacatcgacctgaaagaccgcccattcttcccaggcctggtcaaatatatgaactcaggaccagtagtcgccatggtttgggaaggcttaaacgtagtgaagaccggtagggtgatgctcggggagactaaccctgctgatagcaagcccggtactatccgaggtgacttctgcatacaggtgggaaggaatatcattcatggttcggactctgtcaagtcggcagaaaaggagatttccctgtggttcaagcctgaagaattggtggattataagagctgcgcccatgactgggtgtacgagtag

SEQ ID NO: 29397 - DNA, 879 bp, Artificial Sequence
  Description of Artificial Sequence: Synthetic coding sequence
atggtgctcctttccacactgggaatagtgttccaaggggaaggtcctcccatatcttcttgcgacacaggcacaatggcaaactgcgaacgtaccttcatcgccattaaaccggatggcgtgcaaagagggctcgtgggagagattatcaaacgattcgagcagaagggcttcaggttagtaggcttgaaattcatgcaggccagtgaagacctccttaaggaacattatgtggatttaaaggacaggccttttttcgccggactggttaaatatatgcactccggacctgtagtcgccatggtgtgggagggtttgaatgtggtcaaaacggggagggtgatgctgggcgagactaatcctgcggattccaaacccggaacgattcggggagacttttgcattcaggtcggtcgaacaatggctaacctcgagagaacgttcattgccatcaaacctgacggtgtccagaggggtcttgtgggggagatcattaagaggttcgagcaaaagggctttcggctcgtcgccatgaaattcctacgagccagtgaagagcacctcaagcagcattatattgatctgaaggaccgaccattcttccctggcttggtcaagtatatgaactccgggcctgtggtcgccatggtgtgggaagggctgaatgtcgtgaaaaccgggagagtgatgctcggcgagaccaaccccgctgattccaaaccaggcactattcgaggcgacttttgtatccaggtgggcaggaatattattcacggctcagattcagtcaagtccgctgaaaaggagatttccctctggtttaagccagaggagctggtggactacaaatcctgcgcccatgactgggtatatgaatag

SEQ ID NO: 29398 - DNA, 492 bp, Artificial Sequence
  Description of Artificial Sequence: Synthetic coding sequence
atgaaatcctctcagacattcgaggaacaaacagagtgtatcgtaaatacactactaatggatttcctgtctcccacactccaagtggcctctcgtaacctttgttgtgtggacgaagtggatagtggtgagccttgttctttcgatgttgccatcattgccggacgtctccgaatgctgggagaccaattcaacggcgagcttgaagcttctgccaagaatgtgatcgcagaaaccatcaagggccagaccggagccatccttcaggatactgtggaatctctctctaaaacctggtgtgcccaggacagctcactcgcctatgaaagagctttcctcgctgtgagcgtgaagctgctggagtacatggctcatatcgctccagaggtggtggggcaggtcgcaatcccaatgacgggaatgatcaacggtaatcaagcaattcgtgaatttatccagggccagggtgggtgggaaaatttggaaagctag

SEQ ID NO: 29399 - DNA, 558 bp, Artificial Sequence
  Description of Artificial Sequence: Synthetic coding sequence
atgggcaagaaacaaaacaagaaaaaggtcgaggaggtgttggaggaggaggaggaagagtatgtcgtagaaaaggtcctggacagaagagtggtgaagggcaaggtagagtacctgctgaagtggaagggtttctcagacgaggacaatacctgggaaccagaagagaatctggactgcccggacctgatcgccgagttcctccagtcccagaagacggcccatgaaaccgacaagagtgaaggcggtaaaagaaaagctgattccgactcggaggataaaggcgaagagtccaaacccaagaaaaagaaggaggaaagtgagaaaccgagaggcttcgccagggggctcgaaccagaacgcattattggtgccacggattcttctggggagctgatgtttttaatgaaatggaaaaattccgatgaggctgacctcgtccccgcaaaagaggccaatgtgaaatgcccccaggtggttatcagcttttacgaagaacggcttacctggcattcctaccccagtgaggacgacgacaagaaagacgataagaattag

SEQ ID NO: 29400 - DNA, 1350 bp, Artificial Sequence
  Description of Artificial Sequence: Synthetic coding sequence
atgatgctggggacagagggcggagaaggatttgtcgtgaaagtgagaggcttaccctggagctgtagcgccgatgaggttcagcgctttttcagcgattgcaagatccagaatggcgctcaggggattcggtttatttatacccgcgagggacgacccagtggcgaggcctttgtggaactcgagtcagaagatgaggtgaagctcgccttaaaaaaggatagggaaaccatgggccacagatacgttgaagtatttaagtcgaacaacgtcgagatggattgggttctcaagcatacggggcctaacagccctgatactgccaacgatggcttcgtgcgcctgaggggccttccctttggatgctcaaaagaagagattgttcagtttttcagtggtctggaaattgtgccgaatggcatcactcttcccgtcgatttccaggggcgatccacaggagaagccttcgtgcagtttgcttctcaggaaatagctgaaaaggctctgaagaaacacaaagagcgcattggacatcggtacattgaaattttcaaaagcagcagagccgaagtccggactcattacgacccgccacgcaagctaatggccatgcagcgccctgggccttacgaccggcctggggcagggaggggatataacagcatcggcaggggcgctggcttcgagcggatgcggcgtggtgcttacggcggaggctatggtggatatgacgattacaatggctacaatgatggatacggcttcggttccgaccgcttcggtcgtgacctaaactactgtttctcaggaatgtctgaccaccgctatggcgatggaggaagtacttttcagtctacaactggccactgcgtgcacatgaggggacttccctacagagccaccgagaacgacatctacaactttttctccccgctcaacccagtccgcgtccacatagaaattgggcctgacggaagggtgaccggagaggccgacgtcgaattcgccacacatgaggatgctgtcgcagcaatgtcaaaagacaaagcaaacatgcaacaccggtatgtggaactcttcctcaatagcacagccggagctagtggcggagcttatgagcatcgctacgtcgagctctttctgaattctacagccggagcctcaggaggtgcctacggaagccagatgatgggcggaatggggctctctaaccagtcttcctacggcggtccagctagccagcagctgtccggcggttatgggggtggctacgggggtcaaagctccatgtctggctatgatcaagtgttacaggaaaatagtagtgactttcagtccaacatcgcctag

SEQ ID NO: 29401 - DNA, 741 bp, Artificial Sequence
  Description of Artificial Sequence: Synthetic coding sequence
atgagcggcgcaggggaggcgctcgctcccggacccgttggcccacagcgggtggccgaagccggaggaggacagctagggagcacggcccaaggtaagtgtgacaaagacaacacagagaaagatattacccaggccactaacagccactttacacacggcgaaatgcaagaccagtctatctggggtaacccctcagacggagagctcatccggactcagccacagagactgccccagctccagaccagcgcccaagtgccaagcggcgaggagatcggcaagatcaaaaatgggcacaccgggctctcaaatgggaacggcattcaccacggcgctaagcacggtagtgccgataacagaaagctgagcgcacccgtcagccagaagatgcatagaaaaatccaatcctctctctctgtaaatagtgacatatcaaagaagtccaaagtgaacgccgtcttcagccaaaagactggctcatctcccgaagattgctgcgtccactgcatcttggcttgtctcttttgtgagtttcttacactctgcaacattgtgctcggtcaggcctcttgtggcatatgtaccagtgaggcgtgctgctgctgctgtggggatgaaatgggtgacgattgcaattgtccttgtgatatggactgtgggattatggacgcctgttgcgagagctctgactgtctagaaatttgtatggagtgctgcggaatctgcttcccatcttag

SEQ ID NO: 29402 - DNA, 30 bp, Artificial Sequence
  Description of Artificial Sequence: Synthetic coding sequence
atgtcatactatcagcgtccattttcctag

SEQ ID NO: 29403 - DNA, 2001 bp, Artificial Sequence
  Description of Artificial Sequence: Synthetic coding sequence
atgaacaccggacgagactctcagtcccccgactccgcaaaggggttcaggtccgtgagacctaacctgcaggacaagaggagccccacgcaatctcaaattaccgtgaacggtaactccggcggtgccgtgtcccctatgtcttactaccagagaccattctcaccatcagcctatagtctgcctgcctctctgaacagttcaatagtcatgcaacacggcacatctctcgacagcacagacacctacccccagcacgcccagtccttggacggcacaacgagcagttcaatacctctgtaccgctcctccgaggaagagaagcgggtcaccgtcattaaggcaccccactaccctggcataggcccagtggatgaaagcgggattcccacagcgattcgaactaccgtggatcgccctaaggattggtacaaaaccatgtttaagcagattcatatggtacataagccggacgacgacactgatatgtataataccccatatacctataacgccggtttgtataatcccccttatagcgctcagagtcaccccgcagcgaagacccagacttacaggccactctccaaatctcattcagacaattcaccgaacgccttcaaagacgcttcttcccccgtaccccctccacatgtgccacctcctgtgccccctctgaggccacgtgatcggagttccacggagaaacacgactgggatccccctgaccggaaagtagatacaagaaaattccggtctgaacctagatctatcttcgagtatgagcctggcaagagttctatattgcagcatgagagacccacggaccgcattaaccccgacgacatcgacctcgagaatgagccctggtacaagttctttagcgaactcgaattcggacggccacctccaaagaagcccctggactatgtgcaggaccatagcagcggggtcttcaatgaagcctccctgtaccagagttctatcgaccggtccctagaacggccaatgtctagtgcttccatggcatccgacttccggaagcggcgaaagtctgaaccagccgtgggccctcctcgaggacttggcgatcagtctgcctcccgcacttctcctgggagagtcgacttgcccggaagttcaactacgttaaccaaatcgtttacatcaagctcccctagctcccccagtagagccaaagatcgtgaatcacctagaagctattcgagtactctcacagacatgggcaggagtgcaccgcgagaacgccgtgggactcccgagaaggagaaactgcctgccaaggctgtatacgattttaaagcccagaccagcaaggagctttcttttaaaaagggggatacagtctacattctgcgaaaaatcgaccagaactggtacgagggtgaacatcatggcagagtgggcatatttcctattagttatgtggagaagctcacaccgcctgagaaggcccaaccagccagaccccctcctcccgctcagccaggagagataggggaagccattgcaaagtacaattttaatgcagatacgaacgtcgagttatccctgcggaagggcgatagggtgattttactgaagagggtagatcagaactggtacgagggcaagattccaggtacaaaccgccaaggaatatttccggtgagctacgtggaggtggtaaaaaagaacacgaagggcgcagaagactatcctgatcctccgattcctcacagttactcttccgatcgcatccactctctgagctcaaataaacctcagcgcccagtgtttacccacgagaatatccaggggggtggcgaaccctttcaggcactgtacaattacacacccaggaacgaggatgagctggagctaagggagtccgatgtcatcgacgtaatggagaaatgcgacgacggctggttcgtggggacatcaaggcgcaccaaattcttcggcacattccctgggaattacgtcaagcggctgtag

SEQ ID NO: 29404 - DNA, 2472 bp, Artificial Sequence
  Description of Artificial Sequence: Synthetic coding sequence
atgacactgctgtcgtctcagagcagcagcctggtggccccatccgggagcgtttctgcagagaaccccgagcagaggatgcttgagaaaagagctaaggtcattgaagagctgctccagactgaaagggactacatcagagacttagagatgtgtatcgagcgtattatggtgccaatgcagcaggcccaggtgcccaatattgattttgagggcctgttcggcaacatgcagatggtgatcaaagtgtcaaagcagttattagccgctctcgagatcagcgatgctgtcgggcctgttttcttaggtcatagggacgaactcgaaggaacctacaagatctactgccagaatcacgacgaagcgatcgccctgctagagatctacgagaaggacgaaaagatacagaagcatctgcaagattccctcgccgatctaaattcactcgtgttgaagaaggggtgcaccaactatatcaacctgggctccttcttgatcaagccagttcaacgtgtgatgagataccctttgctcctcatggagctgctgaacagtacacccgagtcacaccccgacaaggtgcccctgaccaacgcagtccttgcggttaaggagatcaacgtgaatattaacgaatacaagaggcgaaaggacctggttctgaaatacagaaaaggggacgaagactcacttatggaaaagattagtaaacttaacattcactcaatcattaaaaaaagcaacagggtgtcaagccatctgaagcatctgacgggattcgcccctcagatcaaggacgaggtctttgaagagacagagaagaactttcggatgcaggagaggcttatcaaaagttttattcgagacttgtcgttgtacttgcaacacattcgcgaatctgcctgcgtcaaagtcgttgccgcagtgagtatgtgggacgtctgcatggaaagaggacacagagacctggaacagtttgaacgggttcatagatacatctctgatcagctgtttaccaactttaaagaaagaacagaacgactggtaataagtccacttaatcagttactgagcatgttcaccggaccacacaaactggtgcagaagagattcgataaattactggacttctataattgcacggaacgtgccgaaaaactgaaggacaagaaaaccctggaggaattacagagcgctcggaacaactatgaggctctcaacgcgcagctcctggacgagttgccaaagtttcatcagtacgcccaaggcctgttcaccaattgtgtgcacggctacgccgaggcccattgcgactttgttcaccaggcactcgaacagctcaagccccttctttcattactgaaggtcgcaggacgggagggaaacctgatcgccatatttcacgaagagcattctagagtgctacagcagctgcaggtctttacttttttccccgagagtcttcctgcaactaagaagccgttcgaacgaaagactattgatagacagtctgcgagaaagcctctgctgggtctcccttcatatatgttgcagtccgaggaactgcgtgcttccctcctggcaagatatcctccagagaagctgtttcaggcagagcgtaacttcaatgcagcccaagacttggatgtgtctctcctagagggagacctcgtcggtgtgataaagaaaaaggatcccatgggatcccagaacagatggctcatcgacaacggcgtcactaaaggattcgtgtactctagcttcttaaaaccttacaatcccaggaggagccacagcgacgcgagcgtgggatcccactcaagtactgagtctgagcatggatcctcaagccctcggttcccgcgtcagaattccggatcgaccctgaccttcaacccgtccagcatggccgttagcttcacctctggaagctgtcagaaacaacctcaggacgctagccctccccctaaagagtgcgaccagggcactcttagtgcttcactgaatccttcaaatagcgagagcagcccatccaggtgcccctccgatcctgacagcacaagccagcctagatccggagattctgctgatgtggcccgtgacgtgaaacagccaaccgctacgcctagatcctatcgaaactttcggcaccccgaaatcgtcggttattctgtgcctggaaggaacggccagagccaggatttggtgaagggctgcgcgagaaccgcccaagcacctgaagacagaagtaccgaacctgatggatcagaggccgagggaaaccaggtctacttcgcagtttacaccttcaaggctagaaaccctaatgaactgtctgtcagcgccaatcagaagcttaaaatcctggagttcaaagacgttaccggcaacacggagtggtggctcgccgaggtgaatggaaagaagggatatgtccccagcaattatattcggaagacggagtatacctag

SEQ ID NO: 29405 - DNA, 2964 bp, Artificial Sequence
  Description of Artificial Sequence: Synthetic coding sequence
atggcagagtcgagtagtgagagtgatcacttcaggtgtagagaccgactttcaccttgggcagccaggtctacccatcgagggacaagatccttgcccacagtggaggtaactgagaaggtgaatactatcacatccacactgcaagacacgtcacgaaatctccgccaggtggatcagatgctggggagatacagagagtacagtaatggccaggcaggcgcaatcgagcacttgaaggagagcttggagcaatcaattgaccagctcagaagccagaggcttctccgcaactcaggaggtagatcaataagcgtgacatccttatcagcctcggacttggatgggggaacagggagtgaacttcaccacttccccccaacatccccattgaaggattatggtgatccccaggggattaagaggatgcggtctaggacgggagtcagattcgtgcaggaaaccgatgatatgactcagcttcacggctttcaccaaagtctcagggacttaagttctgagcaaattcgattaggtgacgatttcaatagggaattaagtcggcgtagccgatccgatgccgaaacgaaacgggctttagaagagctgaccgaaaagcttaatgaggcccagaagcaggaagtcgtgagcgacagggtggaacgcagacttcaggaactggagcgcgagatgaggaccgagagggagttggtcgaaaggaggcaggaccaactggggcttatgagcctgcagctccaagaggcactcaaaaagcaggaagccaaggccgacgaacacgaaggcgctattaaaaataaacttagacagaccgaaactgaaaagaaccaactggaacaagagctggagctgtctaggcgtttactaaatcagtccgaggggtctcgggagacgttgctccaccaggtggaagagttaaggacacagctaaccaaagctgaaggagaccgaaagggcctccagcaccaggtgtcacagatcagtaagcaacagagcaactaccaagacgaacaaggcgaggactggaggttcagaagaggtgtcgaaagggaaaagcaggatttagagaagcagatgagcgacttgcgggttcagctcaacttttctgcgatggcgtctgaacttgaggaggtcaaacggtgtatggagcggaaagacaaggagaaggcccaccttgcctctcaagtggagaacctgactagagagctggaaaatggggaaaagcagcagttgcaaatgctggacaggctcaaagaaattcagaaccacttcgacacttgcgaagctgagcgtaagcatgccgacctgcagatttcagaattgacacgccatgctgaggacgcaactaagcaagctgagcgctacctgagtgaattgcaacagtctgaggcactcaaggaggaggctgagaaacggagagaagatcttaagctgaaagcccaagaatccataagacagtggaaattaaagcataagaagcttgagagagctctcgagaaacagtcagagacggtggatgagcttaccggcaagaataaccagattctcaaggagaaggatgaactaaaaactcaactgtatgccgctcttcagcagatcgagaacctgagaaaagagctgaatgacgtgctgactaagagggccctgcaggaagaggagctgcattctaaggaggagaagttgagggatattaagtctcatcaggcggatctagagctggaagtgaagaactctttagacacaatccatcgcctcgagagcgagctgaagaagcagtcaaaaatccagtcacagatgaaggtggaaaaggcccatcttgaggaggagatcgcagaactcaaaaaaagccaggcccaggataaagccaaactacttgagatgcaggaaagtatcaaggacctgtccgccattcgggctgacctcgctaataagctcgcagaggaggaacgcgcaaaaaaggcagttctcaaagacctaagcgacctcactgcacaagcaaaatcccgcgatgaggaaacggctacaattatcacgcagctcaaactggagagggacgtccaccagcgcgagctgaaagacctgacgtcatctttacagtcggtaaagaccaagcacgagcagaacatccaggagctaatgaaacactttaagaaggaaaaaagcgaagcagaaaaccatatccgaacgctgaaggccgaatctctggaagagaaaaacatggccaagatccataggggtcaactcgagaagctcaaatcccagtgtgatcgtcttaccgaagaattaacacagaatgagaacgagaataagaagctaaaacttaaatatcaatgtctaaaagatcagctggaagaaagggaaaagcatatttcaattgaggaggaacatctacgcagaatggaagaagcacggttacagctgaaagaccaattactgtgccttgagactgaacaggagtcaattctgggcgtcatcggcaaagagatagacgctgcgtgtaagaccttctccaaggattcagttgagaagctgaaagtttttagctcgggacctgacatccattatgatccacataggtggctcgccgaatccaagacaaaactgcagtggctgtgtgaggagttaaaggaacgtgagaacagagagaaaaacctgcggcatcagctcatgctatgcaggcaacagctgaggaaccttacagagaataaagagagcgaactgcagtgcctgttccagcaaatcgagcggcaggaacaacttctcgacgagatccaccgcgaaaagcgggaccttctcgaggagacacagagaaaagacgaggaaatgggtagcctgcaggaccgggtcattgcactagaaaccagcacacaagtggctctggatcatctggaatcggtgcctgagaagctgagcttattggaagactttaaggactttcggagatag

SEQ ID NO: 29406 - DNA, 5156 bp, Artificial Sequence
  Description of Artificial Sequence: Synthetic coding sequence
atgtcagggacttcctcccccgaggccgtgaagaagctcttggagaacatgcagtctgacctgagggccctgagcctagagtgtaagaaaaagtttcccccagttaaagaagccgctgaatcgggaatcatcaaagtgaaaactattgccgctagaaacacggaaatcctggctgcccttaaggagaatagcagcgaagtcgtgcaaccatttctcatgggttgtgggaccaaagaacctaagatcacccagctttgtctggcagccatacagagactgatgagccacgaagtggtaagcgagaccgctgccggaaacatcattaatatgctgtggcagctgatggaaaacagcctggaagaactgaaattactccagactgtgctcgttctcctgaccacaaacacagtggttcacgacgaggccttgtctaaagccattgtgctgtgctttcgcctgcactttaccaaagacaacattacaaacaacactgccgctgccaccgtccgccaggtcgtcacagtggtcttcgagcgaatggtcgctgaggatgagaggcatagggacatcatcgagcaaccagtactcgtgcaagggaactccaacaggaggtccgtgagcacccttaagccctgtgcaaaggatgcatacatgctgttccaggacctgtgccagctagtcaatgccgatgccccttactggctagtgggcatgaccgaaatgactcgcactttcggactggaactcctagaatccgtgctcaatgactttccccaggtgttcctacagcaccaggaattcagctttctcctcaaagaacgcgtgtgtccattggtgatcaaacttttttcccctaacatcaagttccggcagggcagctctactagttcatctccagcaccagtggagaagccatacttcccaatttgtatgagactgctgagggtcgtgtcagtcctcattaaacagttttactctctgctggtgaccgaatgtgaaattttcctaagtctcctggtgaagtttctggacgctgacaaaccacagtggctgcgcgctgtggccgtagagtccatacacagattttgcgtgcagccacaactcttacgcagcttttgtcagtcttacgatatgaaacagcactccacgaaagtctttcgagatatcgtgaatgcactgggatcctttatccagtccctttttttagtgccacctactggtaacccggctactagtaaccaggccggtaataataacctcggtggcagtgtgagtgcaccagccaatagcggcatggttggtatcgggggaggagtaaccttactgccagccttcgaataccgcggtacatggataccgatcctcacaatcaccgtgcagggttccgcaaaagccacttacctagaaatgctggacaaagtagaaccacctaccataccagagggatatgctatgagtgtggcgtttcactgcttattagacctggtgagagggatcacatctatgatcgaaggagagctgggggagcttgagaccgaatgtcagacaactacggaagaaggaagttcccctacccagtctacagagcagcaggatctgcaatccaccagcgaccagatggataaggagatcgtctcccgcgcagtgtgggaggagatggtgaatgcttgttggtgtggcctgttggccgctctgagtctgcttctagatgcctcaacggatgaggcagccacggaaaatatcctgaaggccgagctcaccatggccgcattgtgcggtagactcgggctcgttacttcgagggatgcattcatcacagcaatctgtaaggggtccctgccaccccactacgcgctaacggtgttgaatactaccacggccgcaactctctcaaataagtcctactccgtccaggggcagagcgtcatgatgatcagcccatcatccgaatctcaccagcaggttgtggctgtgggccaacctctcgcagtgcaaccccaggggaccgtaatgttgaccagcaagaacattcaatgtatgcgcacgctcctcaatctggctcactgtcatggagctgtgcttggcacctcgtggcaattggtgcttgccactctccaacatctggtttggatactaggcctgaaaccctctagtggcggtgccctgaagccaggccgagcggtggaagggccaagcactgtgctgaccacagccgttatgactgacctgcctgttatcagtaatatactgagccgactctttgagagcagccaatacctggatgacgtcagcctacatcatctgattaatgctttatgttctctgagcttggaggcaatggacatggcctatgggaacaacaaggaaccctctctgtttgccgtagcaaaacttctggaaaccgggttagtcaatatgcaccgcattgaaatcctgtggagaccactgacagggcacctgttggagaaggtgtgccagcacccaaattctcgtatgcgcgagtggggcgctgaagcactcacaagtctcattaaagctggactgacctttaatcacgaccctcccctctcccagaatcagagattgcaactgcttctcctaaaccccctaaaggaaatgtctaacataaatcacccagacatacgactgaagcagctcgagtgtgttttgcagatcctccagtcacagggcgactctctgggccctggctggcccctggtgctaggggttatgggagcgattcgaaacgatcagggcgagagcttgattcggactgctttccaatgtctgcagctcgttgtgactgacttcctccccactatgccttgtacctgtctgcaaattgttgttgacgtggccggttcatttgggctacataatcaggaactgaacatctcccttacatccataggattactgtggaacataagcgactacttttttcagcggggtgaaactattgaaaaggaattgaataaggaggaggcagctcagcagaagcaagccgaggaaaagggagtcgtattgaacaggccattccatcctgctcctccctttgattgcctgtggttatgtctttacgccaaactgggggagctttgcgtcgatccccgaccagctgtgcgaaaatccgcaggacaaaccctttttagcactatcggcgcacacggcacactgctccagcacagtacctggcacacagtcatctggaaggtacttttccacctgctcgatcgcgtgcgggagtcttctaccactgcagataaggaaaaaatcgagagcggtgggggaaacattctgatacaccatagcagggataccgccgaaaagcagtgggccgagacatgggtactgactctggctggggtggctcgcatcttcaacacgcgccgttatttattacaaccattgggggacttcagtcgggcatgggacgtgctgttggaccatattcagtccgctgccctctccaaaaacaacgaggtgtccctcgccgctctcaagagtttccaggagattctacagatcgtgtcacctgtgagagatagtgataagcccgaaacgccgccagtggtgaatgtgccagtgcccgtgctgataggaccgattagtgggatgtctagaccctttgtcagaaccgactctatcggggaaaaactcgggaggtatagctcttccgaaccacccatcgttactgacgagttagaagatctgaatttatggtgggcagcctggaatacctggtacagaatagggagcgaaagcaccaagccccctataacgtttgataagctgacgtttatacctagtcaaccattcttaacagccctaatccagatatttccagcgctttatcagcatatcaagactggatttaatatggacgatctgcagaaactgggggtaattttgcattctgctatttcagtgccgataagcagcgacgcaagccctttcattctgccatcctacaccgaagctgtactgaccagcctgcaagaagctgtgctcactgctctggatgtgctacaaaaagcgatatgcgtgggtcctgaaaatatgcagatcatgtatccagcaatctttgaccaacttctggctttcgtggagttcagttgtaagccccctcaatacggccagctggaaaccaagcatattgccaacgctaagtacaaccaaattcagcttttcgcaccagctgaatgggtcgctctgaactacgtgcccttcgccgaacgctcactggaagttgtggtggacctctaccaaaaaactgcttgtcacaaagcagttgtaaatgaaaaggttctgcagaatattatcaaaactttgagggtcccgctgagcctgaagtactcatgtccgagtgagagcacttggaaactggccgtctccagtctgctgcgcgtcctatccatcgggttgcccgtcgcaagacagcacgcgagctccggtaaatttgatagcatgtggcctgagctggccaacacatttgaggattttttgttcaccaaatcgatacctcccgataacctgagcatccaagagtttcagcgtaacgagaacattgatgtcgaggtcgttcagctgataagcaatgagatcctcccttatgcaaatttcattccgaaagagttcgtgggtcagatcatgaccatgctaaataaagggagtatccattcccagtccagctcctttacagaggcagagatcgatataagacttagagaggagttcagcaaaatgtgcttcgaaacactcctgcaattcagcttcagcaacaaagtcactactccgcaagaggggtacatctcccggatggcactctccgtgcttttgaagcgttcacaagacgtgctccaccgttacatcgaggatgagcggctgtccggtaagtgtcccctgcccaggcaacaggtcacagaaattatttttgttctgaaagccgtgtccacattaattgactcactaaagaagacccaacccgaaaatgtggacgggaatacatgggcccaggtgatcgcactgtaccccaccctggtggagtgtatcacttgttcctcctcagaagtctgctccgcgctgaaggaggcacttgtccccttcaaggactttatgcaacctcctgcctcaagagttcagaacggagagtctta

SEQ ID NO: 29407 - DNA, 2100 bp, Artificial Sequence
  Description of Artificial Sequence: Synthetic coding sequence
atgagtagcagaaaggtgctcgccattcaagcacgcaaacgacggcctaagagggaaaaacatcctaagaagccagaacctcagcaaaaggcccctttagttccccctccccctccacccccacctccacctccgccacctttaccagacccgacgccacctgagccggaagaggagatcctgggaagcgacgatgaagaacaggaggaccctgccgattactgcaagggagggtaccatccagtgaagatcggagacttgttcaacggcaggtaccacgttataagaaaactcgggtggggtcatttcagcaccgtgtggttgtgttgggatatgcaggggaaacgctttgtggccatgaaggtggttaagtccgcgcagcactataccgagacagccctggacgagatcaagctgctgaaatgcgtgcgagagtcagacccgtcagatcctaacaaggacatggtggtgcagttaattgacgacttcaaaatcagtggtatgaatggcatacatgtatgtatggtgtttgaggtcctcgggcatcaccttcttaagtggattattaagtccaactaccagggcttgccagtgagatgtgtcaagagtatcatacgccaggtcttgcagggcttggattatctgcattccaagtgtaagattatacacacggatatcaaacctgagaacattttgatgtgtgtggatgacgcatacgtgagacgaatggcagccgaagccactgaatggcagaaggctggagcaccacccccatcagggtcggccgtcagtaccgcccctcagcaaaagcctatcggaaagattagcaaaaacaagaagaagaagttaaagaagaaacagaagcgacaagccgagttactcgagaagagacttcaggaaatagaagaactggaaagagaagccgaaagaaaaattattgaggagaatatcaccagtgcagctccgagcaacgatcaggacggagaatactgccccgaggtcaaacttaaaacgacaggacttgaggaggctgcggaagctgagactgctaaagacaatggcgaggctgaggaccaggaggaaaaggaagatgccgaaaaggaaaatattgaaaaggacgaagacgacgtagatcaggaactggcaaacatagaccctacgtggatagagagtccaaagacaaacggtcatatagagaacggccctttctctttggaacaacagcttgatgacgaggatgatgatgaagaggattgtccgaatcccgaggagtacaacctcgacgaaccaaatgccgagtcagattacacctactcctccagctatgaacagttcaatggcgaattgcccaacggcaggcacaaaatcccagagtctcagtttccagagttttctactagtttgtttagtggctctctggagcctgtcgcctgcggctcagtgctcagtgagggaagccctctgacagagcaagaagaatcctcccccagccacgatagatcgagaaccgttagcgcttctagtaccggggatctacccaaggcaaagactcgggctgccgatctgcttgtgaatcccctggatcccagaaacgctgataagattagagtgaagatagccgacttggggaatgcctgttgggttcataagcactttacagaggatatacagacaaggcaataccggtcaattgaagtgcttataggagcaggatacagtactcctgcggacatctggagtaccgcatgtatggccttcgagctggctaccggggactacctttttgaaccccattctggcgaggattactcaagagacgaggaccacatcgctcacataatcgaactactaggtagcattccaagacactttgcactcagcggaaaatatagtcgcgaattctttaacaggaggggagaactcagacatataactaagctgaagccttggagcttgttcgacgtgctcgtcgaaaaatacgggtggccacacgaggatgctgctcaattcaccgattttttaatcccgatgctagagatggtacccgaaaagcgagctagcgctggcgaatgtctgaggcacccatggcttaattcatag

SEQ ID NO: 29408 - DNA, 1113 bp, Artificial Sequence
  Description of Artificial Sequence: Synthetic coding sequence
atggggttcaatcggcctagcaagatccaagaaaacgcgctcccgcttatgctcgcagagcctccgcagaacctaattgctcagtctcagagcggaaccggtaagaccgccgcatttgttctagcaatgctttctcaggtggagccagcaaataaatatccacagtgtctgtgcctctccccgacatatgaactcgcactgcagaccggcaaggtcatcgagcagatggggaagttctacccagaactcaagctcgcctacgctgttcgaggaaataagctagaaagaggccaaaagatctcagagcagattgtcatcggaacccctggcactgtcctggactggtgctctaagctgaaattcattgatcctaagaagatcaaggtcttcgtgctcgatgaggctgacgtcatgattgcgacgcaaggccaccaggatcagtctattaggattcaacgaatgctgcctcggaactgtcaaatgctgctgttcagtgcaacattcgaggacagcgtgtggaaattcgctcaaaaagtggtgcccgaccccaacgtcattaaacttaaacgggaagaggagacgctagatacaattaaacagtattacgtcctgtgctctagcagggatgaaaaatttcaggccctgtgtaatctctacggggcaatcacaatcgcccaggctatgattttctgccataccaggaaaacggccagttggctcgccgctgagttaagtaaagaagggcaccaggtcgctctgctatccggtgagatgatggtcgaacaaagggccgctgtcattgagcgatttcgggaaggcaaagaaaaggtcctggtgactactaacgtctgcgcccgtgggatagatgtcgagcaggtcagtgtcgtgattaattttgatctccctgtcgacaaggatggaaaccctgataacgagacctatctccaccggattggcagaaccggcaggtttggcaaacgaggtcttgccgtgaacatggtcgatagcaagcactcaatgaatatcctgaatcgcatccaggagcatttcaataaaaagatcgagcgtttggacacagatgatttagatgagattgagaaaatcgcgaattag

SEQ ID NO: 29409 - DNA, 2640 bp, Artificial Sequence
  Description of Artificial Sequence: Synthetic coding sequence
atgttttggaagtttgatctgcactcttccagccacatcgatactcttcttgagcgagaggacgtgactctcaaggagctgatggacgaggaagacgttttgcaagagtgcaaggcccagaatagaaagttaatagaattccttctgaaagcagaatgtctcgaagatctggtgtctttcatcattgaggaacctccacaagacatggacgagaaaatcaggtataagtaccctaacatcagttgtgagctgctcaccagcgatgtttcacaaatgaatgataggctgggagaggacgaaagtctcctgatgaagttgtattcatttctcttaaatgacagcccactgaatcccctgctggcatcattcttctcaaaggtcctctccatcttgatcagtcgcaaacccgagcaaattgttgactttctgaagaaaaaacacgatttcgtggacctgatcataaagcatattggtacgagtgccatcatggatctgctgcttaggctgctcacctgtatcgagccgcctcaaccgcgacaggacgtcctgaattggctcaatgaagaaaagattattcagcgcctcgtagaaattgtgcaccctagccaagaggaggatagacattccaacgcgtctcagagcctgtgcgagatcgtcagactctctcgcgaccagatgttgcagatccaaaacagcacagaaccagacccactgctggccaccctggaaaagcaggagattatcgagcagctgctctccaacatctttcacaaggagaaaaacgagtccgcaatagtaagtgccattcagatcctgttgacacttctggagacccgtcgtccaacctttgaaggccacattgagatatgtcctcctggcatgtcccattctgcatgttctgtcaataagagcgtgctagaagctatcagggggcgtctaggctcgttccacgaattgctgctggagccacccaagaagtctgtcatgaagacgacttggggtgtcttggaccccccagtgggcaatacacggctgaatgtcatcagactgatctctagcttgcttcagaccaatacctcttcaatcaacggcgacttgatggaactgaattctatcggggtaatcctcaacatgttctttaagtatacctggaataacttcttgcatacccaagtcgagatctgcatagcactgattttagccagcccttttgagaacacagagaatgcgacaatcaccgaccaagactctacgggggataacctcctgctgaagcacctctttcagaagtgtcaactcatcgaaaggatccttgaagcctgggaaatgaatgagaaaaagcaggcagaaggaggaaggagacatggttacatggggcacttgacccgtatcgccaactgtatcgtgcatagtactgacaaaggaccaaacagcgcgctggtgcagcagttgattaaggacctgcctgacgaggtgcgtgagcgatgggagaccttttgcacgtcctcccttggtgagactaacaagcggaatactgtggatcttgtcaccacctgtcacattcatagttctagcgacgacgagattgacttcaaggagactggtttttcacaggattccagtctgcaacaggccttcagcgactatcagatgcagcagatgacctccaacttcatagaccaattcggctttaacgacgaaaagttcgccgatcaggatgacatcggaaatgtcagctttgatcgggtgtcagacatcaacttcacgcttaataccaacgaatccggaaacatcgctctctttgaggcctgctgcaaagaacggattcaacagtttgatgacggcggttctgatgaggaggatatatgggaggaaaagcatattgcctttacaccagaatcccagaggaggtcatcctcgggttcaaccgactctgaagagagtaccgactccgaggaggaggatggtgctaagcaggacctgtttgagccatcctctgccaacaccgaagataagatggaagtggacctgagcgagccccctaattggtcagctaatttcgatgtgcccatggaaacaacacatggagctcctctagattcggtgggatcagacgtatggtccacagaagagcctatgcctacaaaggaaacaggctgggcctctttcagcgagttcacctcctcactcagtaccaaggacagtctgagatctaatagccccgtcgagatggagacgtccacagagcctatggatcccctgacaccttccgcggcagcactggccgtgcagccggaggctgccggaagtgtagccatggaggccagtagtgacggagaggaagacgcggaaagcactgataaggtgacggagacggtaatgaatggagggatgaaggagacactgtccctcactgtggatgccaaaactgagactgcagtgttcaagcgcctcctcgggggatgcagcgaggagggaaagctaagtacctcacaagacgctgcatgtaaggatgctgaggaatgccccgagactgccgaggccaagtgtgctgctccgcgacccccttcttcttcgcccgagcagcggacagggcagccaagtgctcccggtgatacctccgtgaatggccctgtgtag

SEQ ID NO: 29410 - DNA, 2622 bp, Artificial Sequence
  Description of Artificial Sequence: Synthetic coding sequence
atgttctggaagtttgatctccactcttcaagtcacatcgataccctgctcgaacgggaagacgtgacgctcaaagagctcatggatgaggaggatgtgctgcaagagtgtaaggcacagaacagaaaacttatcgagttccttctgaaggccgaatgccttgaagacctagtcagctttattatcgaggagccaccccaggacatggacgagaaaattagatacaaatatcccaatatttcctgcgaactcctgacatcagacgtgtcccagatgaacgaccgtctgggcgaggacgaaagcctgttaatgaaactgtacagtttcctattaaacgactctccgctgaatcctctcttggcttctttcttctctaaggtgttgtctatccttattagccgtaagcccgaacagatagttgattttctgaagaaaaagcacgactttgttgacctgataattaagcatatcggcacatcagcaattatggatcttctcttgaggctcctgacttgtatcgaaccccctcaaccgcgtcaggacgtgttaaattggcttaatgaggaaaagatcatccagcgcctggtcgaaatcgtacatccgtctcaggaagaagatcgacattctaacgcttcccaaagcctatgcgagatcgtcagactttcgagggaccagatgcttcagattcaaaacagtactgagcctgaccccctgctggcgacgctggaaaagcaggagatcattgaacagctgttgtcgaatattttccacaaagaaaagaatgagagtgcaattgtcagcgccatccagatcctcctgactctgttagagacccggcgtccaacatttgagggccacattgagatatgtcctcctggaatgtcacatagtgcctgctcagttaataagagtgtgctggaggccatcagaggccgactgggttcatttcatgaactgcttctggagcctcctaagaagagtgtgatgaaaactacctggggcgtccttgatccacctgtgggcaacacgcgactaaacgtcattcggcttattagttccctgttgcagacaaataccagctcgatcaacggcgaccttatggagctgaactccatcggggtcattctgaatatgttcttcaaatacacctggaacaacttcctacatacccaggtggaaatttgtattgccttgatcctggcatctccctttgaaaatacggagaacgccaccattacagatcaagattcgactggcgacaatctcttgctcaaacacttgtttcagaaatgccaactcatcgagaggattctggaggcctgggagatgaatgaaaagaagcaggccgaggggggtcgacgccatggttatatgggccacctaactaggattgctaactgtatagttcatagtactgacaaggggccaaacagtgccctagtgcagcagctgataaaggaccttcccgatgaagtgagagaacggtgggaaaccttctgtaccagtagcctgggggagacgaataaacgcaacaccgtggacttagttacaacctgtcatattcacagctcatccgacgatgaaatagattttaaagagactgggttctcgcaagattcctcgttacaacaggcattcagcgactaccagatgcaacagatgacgtctaattttattgaccagttcggttttaatgatgagaaattcgccgaccaagatgacatcggtaatgttagttttgaccgtgtctccgacattaattttaccctgaatacaaacgaatctgggaatatagccctgtttgaggcctgttgcaaggaacgtatccagcagtttgacgacggtggtagcgatgaagaggacatttgggaggagaaacatattgcttttaccccggagagccagaggcggtcaagctctggctcgacagattctgaggagagtaccgatagtgaggaagaagatggggcaaaacaggacttgttcgagccatccagcgccaacacagaagacaagatggaagtagacctgtccgagccgccaaattggtctgccaattttgatgtacctatggaaactacccatggcgcacctcttgatagcgttggcagtgatgtttggtccaccgaggaacccatgcccaccaaggaaacgggctgggcaagcttttccgaattcacttcttctctctccaccaaggactcccttaggtctaattctcccgtggagatggagacctccacagagccaatggatccattgacaccgagcgccgcagcactggccgttcaaccagaagcagccggaagtgtcgccatggaagcttcatccgatggggaagaggacgctgagagtacagacaaagtgactgagactgtgatgaacggaggcatgaaggagactctctcgttgacagtggacgctaaaactgaaaccgcggtcttcaagtcggaagagggcaaactgtccacgagccaagatgcggcttgcaaggatgccgaggagtgtcccgagacagcagaagccaagtgtgctgcccctagaccacctagttcgtcgcccgagcagcggacagggcagccctcagccccaggcgatacttccgtgaacggcccagtctag

SEQ ID NO: 29411 - DNA, 2640 bp, Artificial Sequence
  Description of Artificial Sequence: Synthetic coding sequence
atgttctggaaattcgaccttcattcctcttcacacattgacacactgctcgaacgggaagacgtgactctaaaagagctcatggatgaggaggacgtgctgcaggagtgtaaggcgcagaataggaaattgatcgaatttctgttaaaagctgagtgcttagaagacctggtgtctttcattatcgaagagccaccacaggacatggatgaaaagatccggtataaatatcccaatatatcttgtgaactccttaccagcgacgtgtcacaaatgaatgatcggcttggtgaagatgagagcctccttatgaagctttacagttttctgcttaatgattctcctctgaaccccctgctcgcatctttttttagcaaagtgctctccattctaatctcacgtaaacctgaacaaattgtcgatttccttaaaaagaaacatgatttcgtggatctcattattaagcacatcggaacttctgcgattatggatctgcttctgaggctgctgacctgtattgaaccccctcagccacggcaagacgtgcttaattggttgaacgaggagaaaataatccagcggctggttgaaatagtccatccctcacaggaagaggaccgacactccaatgcatcgcagagcctgtgcgaaatagtgaggttatctcgggatcagatgttgcagattcaaaactccacagaaccagaccctctgctcgcaaccttagaaaagcaggagatcatcgaacagttgctcagcaacatattccacaaagagaagaacgaaagtgctatcgtcagtgctatccaaattttgctcaccctgctggaaacccgaaggcctactttcgaaggccatatcgaaatatgccctcccggaatgtcgcatagcgcatgctctgtgaacaaatcagtgcttgaggccattagaggcagactcggctctttccatgaactgctgctagaacccccaaaaaaatccgttatgaaaaccacctggggggtgttggacccaccagtcgggaatacacggctgaacgtgatcagattgatctcctctttgctgcaaactaatacttcgagtatcaatggcgacttgatggagctcaatagcataggagtcattctgaatatgttcttcaaatacacctggaataatttcctgcacactcaagtggaaatttgtatagcgttgatcctggctagcccatttgagaataccgagaacgccactatcactgaccaggattcaacaggagataatctgctgctgaagcatttgtttcagaagtgccaattgattgaacggattcttgaagcgtgggagatgaatgaaaagaagcaggcagagggagggagacgccacggctatatggggcatctgaccaggatcgctaactgtattgtccattcaaccgacaagggcccaaacagcgcgttggtgcagcagctcatcaaagatttgcccgatgaagttagagagaggtgggagacattttgcacctccagcctgggtgagactaacaagcggaacacagttgatttggtcacgacttgccacattcattcttccagcgatgatgaaatcgacttcaaggagaccggcttctcacaagattcctcactccagcaggcattctccgactatcagatgcagcaaatgaccagtaactttatcgatcagttcggatttaacgacgagaagttcgccgaccaagacgacatcgggaatgtttcatttgatagagtctctgacattaactttaccctgaatacaaatgagagtgggaatatcgcactgttcgaggcatgttgcaaggaacggatccagcaatttgatgatggcggttccgacgaagaggatatatgggaggaaaagcacatcgccttcaccccagagagtcaacgccgatcatccagcgggtcaaccgactctgaagaaagcaccgattccgaggaggaagacggcgcaaagcaggacctgttcgagccttctagtgccaatacagaggacaagatggaagtcgacctgagtgaacccccaaactggagcgccaacttcgacgtccctatggagactacacacggcgctccactggattctgtaggctccgatgtgtggtccacagaggaacctatgccaaccaaggagaccggatgggcctctttttcggaattcaccagtagtctatctaccaaagactctctccggtcgaattctcccgtggagatggaaacaagtactgaacctatggaccccctgaccccctctgccgcagcattggcggtgcagcccgaagcagcagggtccgtggccatggaggccagcagcgacggagaggaggacgccgaatcgaccgacaaggttacagaaaccgtgatgaatggagggatgaaagagactctgtcactcacagttgatgcgaagactgagacagccgtgttcaaacgcgtcctgaagtcataccgggaagaagggaagttgtcaacaagccaggacgccgcttgtaaggatgctgaagaatgtccagagacggccgaggccaaatgcgcagccccaaggcctccaagctccagtcccgaacagcgcactggacagccctctgccccaggtgataccagtgtgaacggaccagtatag

SEQ ID NO: 29412 - DNA, 1134 bp, Artificial Sequence
  Description of Artificial Sequence: Synthetic coding sequence
atgtctgacgaggtcttttctactactctggcatatacaaagagccctaaggtgactaagaggactacctttcaggatgaactgattagagcaattaccgctaggtcggctcgccagaggtcttccgaatatagcgatgactttgattccgacgaaattgtaagcctgggagattttagcgacacctctgcagatgaaaatagcgtcaataaaaaaatgaacgactttcacattagtgatgatgaggagaagaatccaagtaagttactgtttctgaaaacaaacaaatctaatggaaacataaccaaagatgagcccgtgtgcgcgatcaagaatgaggaggagatggctccagatggctgtgaggatattgtggtcaagtccttctctgagtctcagaataaggacgaggagttcgaaaaagacaagataaagatgaagcctaaaccccgtatcctatctattaagagcacctcttctgctgagaataacagcctagacacggatgatcactttaaaccttcacctcgcccacgatccatgcttaagaagaagagtcatatggaagagaaagatggactcgaagataaggagacggccctgagtgaagaattggagctgcattccgccccaagtagcttgcccactcccaatgggatccagctggaagccgagaagaaagcatttagcgaaaatttggatccggaggactcctgtctgacatcgctggctagcagctctctaaagcagatcctgggcgacagcttttcccccggttcagagggcaatgcctctgggaaggatcccaacgaggagatcactgagaatcacaattctctcaagagcgatgaaaataaagagaactctttcagcgccgatcatgttacaacagcggtggagaagagcaaagaaagtcaggtgacagccgatgacctcgaggaggagaaggccaaggctgaactgatcatggacgatgacagaaccgtggacccgttgctgtccaagtcacagtcgatactgatttctacgtcggccacagcgtcatccaaaaaaacgatcgaagacagaaacatcaaaaacaaaaaatctaccaataatagagctagtagtgcgtctgccagtaaggcctcctag

SEQ ID NO: 29413 - DNA, 576 bp, Artificial Sequence
  Description of Artificial Sequence: Synthetic coding sequence
atggggaagagctgtaaggtggttgtgtgtggacaggcctccgttgggaaaacgagcattttggagcaacttctctatggtaatcatgtggtggggagcgaaatgatcgaaacccaagaagacatttatgtaggaagtatcgaaaccgaccgtggtgttagagagcaggtgcgtttctacgacactcgagggcttcgcgatggcgctgagctgcctcgacactgtttttcatgcacggacgggtatgtcttggtttattctactgattcacgagagtcctttcagagggtcgaactgctgaagaaggagattgacaagagcaaggataagaaggaagtaaccatcgttgtactcggaaacaagtgcgacctacaggagcaaagaagggtggacccagatgtagcacaacactgggctaagtctgaaaaggtgaagctgtgggaggtgagcgtggccgaccgccgaagcctgcttgagcccttcgtgtaccttgcttccaaaatgacccagccgcagtccaagtccgcatttcctcttagccggaagaataagggaagtggctctttggatggatag

SEQ ID NO: 29414 - DNA, 576 bp, Artificial Sequence
  Description of Artificial Sequence: Synthetic coding sequence
atgggcaaatcttgtaaagtggtggtgtgtgggcaagccagtgtcggaaagactagcatactggaacagcttctgtatggcaatcacgtagttgggtcagagatgatcgaaactcaggaagacatttacgttggttcgattgaaaccgatagaggggtccgcgaacaggtcaggttttatgatactcgtggactcagggatggagccgagctacccagacattgcttttcatgcaccgacggttacgtacttgtgtattctacggactccagggagagctttcagcgcgtcgaactgctaaagaaagaaatcgacaagtctaaagacaagaaagaagtgaccattgtagtattggggaataagtgcgacctgcaagaacagcgtcgtgtggatccagacgtagctcaacactgggcaaaatccgagaaggtcaaactgtgggaggtgtcagtcgcagatcgacgatctctcctggaacccttcgtgtatttagcatctaagatgacacagccccagagcaaatcagcttttccccttagcagaaagaataaaggcagcggatccttggatggctag

SEQ ID NO: 29415 - DNA, 570 bp, Artificial Sequence
  Description of Artificial Sequence: Synthetic coding sequence
atggggaaatcctgtaaggtggtcgtgtgtgggcaggccagtgtgggaaaaacctctatactggagcagctactgtacggcaaccacgtcgtggccatgatcgaaacgcaggaggatatctatgtgggaagtatcgagaccgaccggggtgtgcgcgaacaggttcgcttttacgacacacgagggttacgcgatggggctgagctgcctcggcattgtttctcatgcaccgacggatacgtactagtttatagcaccgacagtcgtgaatctttccaacgggtggagcttctaaagaaagagatcgataaaagtaaagacaagaaggaggtcacaatcgttgtgttgggcaataaatgcgacctgcaggaacaaagaagagtagacccggacgtcgcccaacattgggctaaatccgagaaagtcaagctctgggaggtttcggtcgccgacaggcggagcctcctcgagccgtttgtttaccttgcttctaaaatgacccagccacagagtaagtctgcctttccactgtcacgcaaaaacaaaggaagcggttccctagatggctag

SEQ ID NO: 29416 - DNA, 576 bp, Artificial Sequence
  Description of Artificial Sequence: Synthetic coding sequence
atggggaagagctgcaaggtggtggtgtgcgggcaagcctctgttggcaagactagtatcttggagcagctgctctatggaaatcacgtggttggatctgaaatgattgaaacccaggaggacatatatgtgggttcaattgagactgatcgtggcgtgagggagcaagtgagattctatgacacacggggtctcagagacggggcagaactgccccgacactgctttagctgtaccgatgggtacgtcctggtctactccacagactccagggagagcttccaacgtgtggaactgctcaagaaagaaatcgacaaatccaaggacaaaaaggaggtgaccatagtagtgctgggaaataagtgcgaccttcaagagcagcgccgagttgaccccgacgtcgcccagcactgggcaaaaagtgaaaaagtaaaattgtgggaggtctccgtggccgatcgcaggtccctgcttgaaccgttcgtttatctcgctagtaagatgactcagcctcaaagcaagagcgcctttcctcttagtagaaagaacaagggaagcggctccctcgacggatag

SEQ ID NO: 29417 - DNA, 1005 bp, Artificial Sequence
  Description of Artificial Sequence: Synthetic coding sequence
atggcagaagaggtgcgacgggaggaagcaagtggcgtgggaagagccagaacccctacccctggcgcactgagagcacctcaattggtgaccgaagcaccccctcttcatcctggtcacacgttgatgaaagcaacagtactgatgcgacagccaggacgcgtgcaggagatcgtgggcgcattgcgtaagggtgggggagacagattgcaggttatcagcgatttcgacatgactttgtctcgcttcgcctataatggaaagaggtgcccaagctcttacaacatactggataatagtaagattatcagcgaagaatgtcgaaaagagcttaccgcgctcctgcatcattactatccaattgaaatcgacccacatcgcactgtgaaagaaaagttgccacatatggtggaatggtggacaaaagcccacaatctgctgtgccagcagaagattcagaagttccagattgcgcaggtggtgcgggaatctaacgcaatgctgagggagggctacaagacgttctttaataccctctatcacaataatatcccactttttatcttctccgccggaattggagatattctggaggagattattcggcaaatgaaggtatttcaccccaatattcacatcgtgtctaattacatggactttaatgaagacggtttccttcagggatttaaaggccagttgatacatacatacaacaaaaatagctcggcttgtgaaaatagtgggtattttcagcagctggaaggcaaaacgaatgtcattctcttaggggacagcattggcgacttgaccatggctgatggggtgccaggggtgcaaaacattctgaaaattgggttcctaaacgacaaggtggaggaaagacgggagcggtatatggattcctatgatattgtgttggagaaagacgaaactctggacgtggtgaacggattactccaacacatactttgccagggtgttcagctagagatgcaggggccttag

SEQ ID NO: 29418 - DNA, 531 bp, Artificial Sequence
  Description of Artificial Sequence: Synthetic coding sequence
atggccgcatccactgacatggctggtctggaagaatcgtttcgcaaattcgccattcatggagatccaaaagcgagtggccaggagatgaacggaaagaattgggccaaactctgtaaggactgcaaagttgctgacggtaaatcagtgaccggtaccgatgtagacatcgtgttctctaaggttaagggtaaatcagcccgtgtgatcaattacgaggaatttaaaaaggccttagaagagctcgctacaaaacgattcaagggtaagagtaaggaggaggctttcgacgccatttgccagttggtggccggtaaagaacctgctaacgtcggagtgaccaaagccaaaacaggtggcgctgtagacagacttacagataccagccggtacacgggttctcacaaagagcggtttgatgagtcagggaaaggcaagggtatcgctggacgtcaggacatactagacgactcagggtatgtctctgcctataaaaacgcaggaacttacgacgcgaaagtgaaaaagtag

SEQ ID NO: 29419 - DNA, 912 bp, Artificial Sequence
  Description of Artificial Sequence: Synthetic coding sequence
atggattcactgcccgatgaattttttgtgagacatcctgctgtggaagaccagagaaaagaggagacagagaataagctggagaagtcttcaggacagctgaataagcaagagaacgacattccgactgacctggtgcctgtgaatctactactggaggtgaaaaaattactcaacgctatcaatactcttcccaagggggtggtgccgcacattaagaaattcctgcaggaagatttctcgtttcagaccatgcaaagagaggtggcagctaactcacagaacggcgaagaaattgtgcctgccctcacactgagattcctcatcacccaactagaggcagccctccggaacattcaggcagggaactataccgcacatcagatcaacatcggctattatctgacactgctgtttctgtacggtgtcgctttgactgagcgcggaaaaaaggaagactataccgaagcagagaacaaatttctggtaatgaaaatgatgatacaagagaacgaaatatgcgagaactttatgagcctcgtttattttggtcgcggtctgcttaggtgtgcacaaaagaggtacaacggaggcctcttggaatttcacaaaagtctccaggagatcggcgataaaaacgaccattggttcgatattgatccaactgaggacgaagacctgcccacaaccttcaaggatctgttgaacaacttcattaaaactaccgaatctaatattatgaagcagactatatgctcgtacctcgattgtgaacgatcatgcgaagcagacatcctcaaaaacacaagttataagggcttttttcaactgatgtgcagtaaaagttgttgtgtgtattttcacaagatttgctggaaaaaattcaagaacctaaagtacccaggcttctag

SEQ ID NO: 29420 - DNA, 1869 bp, Artificial Sequence
  Description of Artificial Sequence: Synthetic coding sequence
atggacctgctgactcgggaaaatgtggcactgaaggtggaaagcgcccagcagccaaaacaggtccttaagatggaggtggccgtgcttaagaaactgcagggaaaggaccatgtttgcagatttatcggttgcgggagaaacgagaaattcaactacgtcgtgatgcagctgcagggcagaaacctcgcagatctgcgtcggtcccagcctaggggtacctttacactgtccactaccctgagactgggtaagcagattctggagtctatcgaggccatccacagtgtcggctttctacaccgggacattaaaccctccaatttcgcaatgggccgactgccatcaacgtatagaaagtgttacatgttagattttggcctggctcggcaatacactaacacaaccggcgacgtgcgccctcccagaaacgtggccggattccgcggaacagtgaggtacgccagcgtcaatgctcacaaaaaccgcgaaatgggtaggcacgatgatctgtggtctctcttttatatgttggtggaatttgctgtcggccagctcccatggcgtaagatcaaggacaaagaacaagtcggaatgatcaaagagaagtatgagcaccgtatgcttttgaaacacatgccgagtgagtttcatctattcctcgatcatatcgccagtctggactatttcacaaaaccggactaccaactgatcatgtctgtctttgaaaacagcatgaaggaacggggtatcgctgaaaacgaggcctttgactgggaaaaggccggaaccgatgcgctgttgtctacctccacaagtacaccaccccagcagaatactagacaaaccgccgcaatgttcggggtggtgaatgttaccccagtgcccggtgaccttctgcgcgaaaatacagaagacgttttgcaaggagagcatttgagcgatcaggagaacgcccctccgattcttccagggaggccaagcgaaggtcttgggccatctccgcatctcgtcccccatccaggaggacccgaggccgaggtatgggaggaaaccgacgttaatcgcaataagctgcgtattaacatcggaaagagcccctgcgttgaggaggaacagtcccggggtatgggggtcccctctagccccgtacgcgctcctcctgatagccccacaacccccgtgcgtagtctaagatacaggcgggtaaattctccagagtccgagcggctctcaactgcagatggcagagttgaactgcctgaacgaagatcaaggatggacctccctgggtcgccatctcggcaagcctgttccagccagccagctcagatgcttagtgtggatactggccatgcagatcgccaagcaagtggcagaatggatgtgagcgcttcagttgagcaggaagccctgagcaatgcatttcgcagcgttccattggctgaggaggaggattttgatagtaaagaatgggtgattattgacaaggagaccgagcttaaagattttcccccaggcgcagagccttccacatccgggacaaccgatgaggaaccagaggagctgcggccattacctgaggaaggggaagagcgtcgaagactgggagcagagcccccattccctctgactcccgctttgggaactcccccttctaccgagcgtgtcggtccacacagacccactgaaacggtcggcggagggcagacactgggcgctttaccccctgccgttcagcctcccgcaaccacgggtgtgcttcgcgtgctgctcctgcatgcaggcgacggagctcttcctagccctcggcgaagaagattgttaggtctgctcagatttccccactctgcacaacccttgggatag

SEQ ID NO: 29421 - DNA, 447 bp, Artificial Sequence
  Description of Artificial Sequence: Synthetic coding sequence
atggctgccgctatggttcctggaagaagcgaaagctgggagcgaggtgagccgggacgacccgcactatatttctgtggctctattcggggtggaagagaagaccgcactctttatgagcggatcgtgtctagattgaggcgcttcggtaccgtcctcacagagcatgtagccgctgctgagcttggcgctaggggggaggaagcagccggaggcgatagattgatccacgaacaggacctcgaatggcttcagcaggccgacgtagtggtagctgaagtcacccagccctccctcggtgtcggctatgagctgggcagggccgtggctttcaataaaaggattctctgtctgtttaggccacaaagcggacggggtgagcatccaaaaccccctagttggttgtctatggaccccgcactgagcagcttcccaggcggtttgtag

SEQ ID NO: 29422 - DNA, 606 bp, Artificial Sequence
  Description of Artificial Sequence: Synthetic coding sequence
atggtgaatagttgttgtggctctgtttgctctgatcaagggtgcgggctcgagaactgctgcagaccctcatgctgtcaaactacctgttgtcgcacaacctgctgcaggccaagctgttgcgtgagctcctgttgtagaccgcagtgctgtcaatccgtgtgttgccagcctacctgttgcagaccttcctgctgccagacaacctgctgtagaaccacttgctgtcggccaagctgctgtgtgagctcctgttgtcgccctcaatgctgccagagtgtctgctgccagcctacctgctgtaggcctagttgctgccagactacgtgttgccggactacttgctgtcggccttcatgttgtgtgagttcctgctgccgacctcagtgctgtcaatctgtgtgttgtcagccgacctgctgccgcccttcctgctgcatatcctctagctgttgcccatcatgttgcgagtctagttgttgccgaccatgttgctgcctgcgtccagtgtgtggccgtgtatcctgccacactacctgttatcggccaacatgtgtaatctccacttgtcccagaccactgtgctgcgccagcagctgctgttag

SEQ ID NO: 29423 - DNA, 387 bp, Artificial Sequence
  Description of Artificial Sequence: Synthetic coding sequence
atgacaggctcgtgctgtggtagcacactgtctagtctgtcctatggtggaggttgctgccagccttgctgttgccgggatccctgctgctgcagaccggttacctgtcaaaccaccgtctgtcgcccagtgacttgtgtgcccaggtgcactcgacccatttgtgaaccatgcagacgccctgtgtgctgcgacccatgctccctgcaggagggctgctgtagacccataacctgctgtccttcgtcctgcaccgccgtggtatgtcgaccatgttgctgggctactacctgttgccaacccgtgagcgttcagtccccctgctgccgccctccctgcggccagcccaccccttgcagtacgacatgccgcacatcctcatgctag

SEQ ID NO: 29424 - DNA, 1140 bp, Artificial Sequence
  Description of Artificial Sequence: Synthetic coding sequence
atgtcgcttcgtttgtctagcgcttcacgccgttcatgtcccaggcccacaaccggctctttacgcctgtacggaggcggaacatcgtttgggacggggaatagctgtggtattagcggaatcgggagcgggttcagtagtgcctttggagggtcttcatccggcggaaacaccgggggtggcaatccatgcgccggattcactgtgaacgagagggggctgctttctggaaatgaaaaggtgacgatgcagaatcttaacgatcggttggcttcctatttagattctgtgcatgccctggaggaggcaaatgccgacctggaacagaagattaaggggtggtatgaaaagtttggacctggctcctgtagggggctggaccacgactacagcagatatttccccatcatcgatgacttaaaaaaccagattatagcaagcacaacctcaaatgccaatgcagtcctccagatcgacaatgccaggttgactgccgatgacttccgactgaagtacgagaatgagctcgcactgcatcagagcgtagaggccgacgttaacgggctgaggagagtgctggatgagatcaccttatgccggaccgacctggagattcagtacgaaacactgagtgaggaaatgacatacttgaagaaaaatcacaaggaagagatgcaggtattgcaatgtgccgctggcggaaacgtcaatgtggagatcgagctccagagtctcctggctaccaaacattcattggagtgttccctgactgaaaccgagtcaaattattgcgctcaactggcccaaattcaggcacagataggagctttagaggagcagctacaccaggtaaggactgagactgaaggacagaaactggaatatgaacaactgctggatataaagctgcatctggagaaggaaatcgagacttattgtctgctgattggcggagacgatggagcttgcaaatctggcggatataaaagcaaagattatggaagtggcaacgtcggaagccaagtgaaggaccccgctaaagccatagtggttaagaaagtgcttgaggaggttgaccagaggtcaaaaatccttaccacgagactgcacagccttgaggaaaagtctcagtccaactag

SEQ ID NO: 29425 - DNA, 768 bp, Artificial Sequence
  Description of Artificial Sequence: Synthetic coding sequence
atggacaaagatgaggaggctctgaaggcagctcaggccgaacttaaggaggcaagacggcagtggcatcatcttcaagttgaaatcgagtccttgcacgctgtggagcggggactagagaactcactccacgcttctgagcagcattaccagatgcagctccaggatctggaaactgtgatagaaggcctggagaaggaactacaggaagttcgtcgaggaatcgaaaagcagctccaggaacacgagatgttactgaacacaaaaatgagactggagcaagagattgcaacctataggcatctcctggagaaggaagaaattaggtactatggctgcattcaaggcggaaaaaaggataagaagccaacaacgagtcgagtagggtttgttttaccaagtgcaatcataaatgagatctcatttacgaccaaagtcccgcaaaaatacgagaatgagaatgtggagaccgtgaccaaacaagctatattgaatggaagtatcgtgaaggagtcaactgaggcccacggtacaatacagaccgaaaaggtagacgaagtgattaaagagtgggaggggtccttctttaaggacaacccacgactgagaaaaaagtccgtgagcctaaggtttgatcttcatcttgcagctacagatgaaggctgcttagagacgaaacaggacaatttgcccgacatagaagtcagactgatcatgaggaggagttgctcaattcctagtatcaagccaccttcaacagccaattag

SEQ ID NO: 29426 - DNA, 888 bp, Artificial Sequence
  Description of Artificial Sequence: Synthetic coding sequence
atggaactaagtcaactgctgaatgagattcgcgctaattacgagaagattctgaccaggaatcagattgaaacagtgcttagcacgagaattcagctggaggaagacatatccaagaaaatggataaagacgaagaggctctgaaagccgcacaagccgaattgaaggaagccagacgtcagtggcatcatctccaggtcgaaattgagtcactgcatgctgtggagcgcggtctggagaatagcttacacgcatccgagcagcactaccaaatgcaactgcaggacttagagacagtgatcgagggtttggaaaaggagctgcaggaagtgcgacgcggtatcgaaaagcagctgcaagaacatgagatgctgctgaatacgaaaatgcgattagagcaggaaattgccacttatagacaccttctagaaaaagaggagatccggtactatggctgcattcaggggggtaaaaaggacaaaaagcccactaccagccgagtgggcttcgtgttaccgtctgcgattatcaatgagatttccttcaccaccaaggttccacaaaaatatgaaaacgagaacgttgaaactgtgactaaacaggcgattctgaacggatcaatcgtcaaggagtctaccgaggcacacggcacgatccagaccgaaaaggtcgacgaggtaataaaggagtgggagggctcattttttaaagacaatcccaggttacgcaagaaaagtgtcagtcttcggtttgacctgcatctggccgctaccgacgaaggatgcctcgaaacgaagcaggataatctaccagacatcgaagttagattgatcatgaggcgctcttgtagtatcccttctattaaacctccatctacagccaactag

SEQ ID NO: 29427 - DNA, 1860 bp, Artificial Sequence
  Description of Artificial Sequence: Synthetic coding sequence
atgtcagggttggtcctggggcagagggacgagcccgcaggccaccgcctttctcaggaagagatcttagggtccactagactagtgtcccagggccttgaagccctgcgttctgaacaccaggccgtgctccaatccttgagccagacaatcgaatgcctccagcaggggggacatgaggaggggctagtgcacgagaaggcccgacagctgcgaaggtccatggaaaatatcgagctggggctatctgaagctcaagtgatgctggctctggcatcacacctaagtaccgtggagtctgagaagcagaaacttcgcgcacaggtacggaggctgtgccaggagaaccagtggcttagagacgaactagcgggaactcagcaacggctgcaaagatccgaacaggctgtagctcagctggaagaagaaaaaaaacacttggagttcctgggacagctgagacaatacgatgaagacgggcacaccagcgaggaaaaagagggggacgcaaccaaggatagcctcgacgacctttttccgaacgaggaggaagaggacccctcaaacggtctgtctcgcggtcagggcgctactgcggctcagcaaggaggctacgagatccctgcgagactgcggaccctgcacaacctagttatccagtatgccgcacagggacgctacgaggtggctgtgccactgtgtaagcaggcgctcgaggacctggagagaacatccggacgtgggcatcctgatgttgctaccatgcttaacatactcgccctggtgtatcgtgaccaaaataagtacaaagaggccgctcacctcctcaatgatgcattaagtatcagagaatcaaccctggggcctgatcatcccgctgtggcagccaccctgaacaatctggcggtgttatacggaaaaaggggcaaatacaaggaagctgagcccttatgccagagagccttggaaatcagagaaaaggtgctgggcaccaaccacccagatgtagccaagcagcttaacaatctggctctgctgtgtcagaaccaaggcaaatacgaagccgtagaacggtattatcagcgtgcgctggcaatctacgaaggccaattaggcccagataaccctaatgttgccagaacgaagaataacttggccagttgttatcttaagcagggcaagtacgccgaggctgagactctttataaggagatactgacgcgtgcacacgttcaggagtttgggtccgtggatgacgaccacaagccgatttggatgcatgctgaagagcgagaggaaatgagcaagtcaagacaccacgagggaggtaccccctacgccgaatatgggggatggtacaaggcttgtaaggtctcaagtccgacagtgaacaccacattgcggaatctgggcgctttataccggcgacagggaaagctcgaggcagcggaaacactcgaggaatgcgcactgcgcagtagaagacagggtactgaccccatcagtcagaccaaagtggccgaattgctcggtgaatcagacggccgaagaacaagccaggaaggaccaggcgattccgtgaagttcgaggggggagaagatgcttccgtcgccgtcgagtggagcggcgatgggtccggaacacttcagcggtccgggagcctgggcaagatccgagacgttttaaggcggtcgtccgaactcctagtccggaagttgcaagggacagaaccgcgtcctagcagctcaaacatgaagagagcagcttctttgaactatcttaaccagccgagcgcggcaccgctgcaagtgagcaggggtctttccgcctccactatggacctgtctagttcttcttag

SEQ ID NO: 29428 - DNA, 1860 bp, Artificial Sequence
  Description of Artificial Sequence: Synthetic coding sequence
atgagcggactggtactgggccaaagagatgaacctgctgggcataggctgtcacaagaagaaattctgggcagcaccagactcgtgtcacagggcttggaagcactgcgctcagaacaccaggctgtcctgcagtcgctcagccagactatagagtgcctgcagcaggggggtcatgaggaagggctggtacacgagaaggctagacagttaagaagaagcatggaaaatatagagctggggctgtccgaagcccaagtcatgctggccctggccagccacttatcgaccgtggaatcagaaaaacaaaaacttcgggctcaggttagaaggctctgtcaagaaaaccagtggttaagggatgagctggccggaactcagcagcgtctccagagatctgagcaagctgtagcacagctcgaggaagagaagaaacatctagagttcttggggcagctgagacaatacgacgaggatggacacacaagcgaggagaaggagggcgacgcaaccaaggactccttggacgacctatttcccaatgaggaagaggaggatccctcaaatggcctgagccgcggtcagggcgctactgcggctcagcaggggggatatgaaattcccgcacggctccggaccctgcacaacctggtcatccagtatgcagctcagggcagatatgaggtggctgtgcctctctgcaagcaggcactggaggatctcgagagaaccagcgggcgtggacatccagacgttgctaccatgctgaacatcctcgcactcgtgtaccgcgatcaaaacaaatataaagaagctgcacacttgctgaatgatgccctcagtattagggaatctaccctgggccctgatcatcctgctgtagccgcaacactcaacaacttggcagtgctgtatggtaagcgcggaaagtacaaggaagccgaaccgctgtgccagcgcgctcttgaaattagagaaaaagtcctcggtaccaatcaccctgacgttgcaaagcaactgaacaacctcgctcttctgtgtcagaatcagggaaaatacgaagctgtagaaagatactatcagcgcgcactcgcgatctatgaaggacagcttggacctgataatccaaacgttgcaaggaccaaaaacaacctggcaagctgttacctgaaacagggtaaatatgctgaggccgaaacgttgtacaaggaaattcttacacgagcccacgtacaggagttcggctctgttgacgacgatcacaagcctatctggatgcacgcagaagaacgcgaagaaatgagcaaaagcaggcatcatgaaggcggtacgccctacgcggagtacggtggttggtacaaggcttgtaaggtatcgtccccaacagtgaacaccactctgagaaatcttggggcactatacagaagacagggtaaacttgaggccgctgaaacactggaagaatgcgctcttaggtcacggaggcaggggaccgaccctatcagtcagactaaagttgctgagctcttgggggaaagcgatggaaggaggaccagccaggaaggtccaggcgactccgtcaaatttgaaggaggggaagacgcaagcgtggccgttgaatggagtggagatgggagcggcacactgcaaaggagtgggtcattgggaaagatacgggatgttttacggcgatcttctgaacttcttgtccgtaaactgcaaggaactgaacctcggcctagctctagcaatatgaagcgggctgcaagtcttaattacttgaatcaaccttccgccgctcctctacaggtgtcccggggactgagtgcctccaccatggatttgagctctagctcttag

SEQ ID NO: 29429 - DNA, 1170 bp, Artificial Sequence
  Description of Artificial Sequence: Synthetic coding sequence
atgttacggtggaccgttcacctggaggggggacctagaagggtgaaccacgctgccgttgccgtgggacatcgcgtgtacagtttcggcggttactgttctggagaagactatgaaacactgagacaaatcgatgtgcacattttcaacgctgtgagcttgaggtggaccaagctgcctccagtaaagtcagccataagggggcaggcgcctgtcgtgccctacatgcgttacggtcattccaccgttttgatcgacgataccgttctgctatggggcggtcgaaatgacaccgagggagcttgcaatgtgctatacgccttcgacgtcaacactcataaatggttcacacccagggtttccggtacggtgccaggggcacgggatgggcatagcgcgtgcgtgttagggaagatcatgtatatcttcggcggatatgagcaacaggcggactgctttagtaacgacatccacaagctggacaccagcactatgacctggacgttgatttgtacaaaaggatccccggcacggtggagggacttccatagtgcgacgatgctaggatcacatatgtacgtgttcgggggtagagctgatcggttcggcccttttcattctaacaatgagatttattgtaatcgtataagggtctttgacactagaactgaagcgtggctggattgtccacccactcctgtcctccccgaagggcgaagaagtcatagtgcttttggctacaatggcgaactctacatttttggtggctacaatgctaggctgaatcggcattttcatgatctgtggaagttcaacccggtgtcctttacttggaagaaaatcgagcctaagggcaaggggccttgcccacggaggaggcagtgctgttgtatcgtgggagataaaattgtcctcttcggcggaacttcacccagccctgaggagggcttaggtgacgagttcgaccttatagatcatagtgatctgcacatcctagatttttctccgagcttgaaaaccttgtgcaaactggccgtgattcagtacaatctcgatcagagttgcctgcctcacgatattagatgggagctcaacgcaatgactaccaattcaaacatctctaggccaattgttagcagcccctttgcctaccccctaccctccgcctag

SEQ ID NO: 29430 - DNA, 549 bp, Artificial Sequence
  Description of Artificial Sequence: Synthetic coding sequence
atgccgattcccccaccaccccctccaccacctggaccgcctccccctcctaccttccaccaagccaatacagaacaacccaagctctcccgagacgaacagcgtggtcggggtgctctgctgcaggacatctgcaaaggaaccaaactgaagaaggtgacaaacatcaacgatcgctccgctcctattttggaaacccctccacccccaccccctgttatccgcaacggcgcacgggacgccccaccaccccctcctccctacagaatgcatggttccgaaccaccatcacggggtaaaccccctcctcccccttctcgcacgcccgcaggcccaccacctccgcctcccccaccacttagaaacggccaccgcgattcgattactaccgtccggtctttcctggatgatttcgaatctaagtacagtttccaccctgtggaagactttcccgcaccagaagaatacaaacactttcagcgaatttatccatctaagacgaacagagcagctagaggagccccacctctgcctcctatcctgaggtag

SEQ ID NO: 29431 - DNA, 831 bp, Artificial Sequence
  Description of Artificial Sequence: Synthetic coding sequence
atgacatcctttcggctggcactgatccagctacagatatcttccatcaaatctgataacgtgacacgtgcgtgttcttttatccgtgaggccgctacgcagggggcaaaaattgtgtccttgcccgaatgtttcaattcaccttacggagctaaatactttccagaatatgccgaaaagattcctggtgagagcacacagaagctgtcagaagtggcaaaggagtgttccatttatctgatagggggatcaatccccgaagaagacgccggtaagctgtacaatacttgtgcagtttttggacccgatggtaccttgctggccaaataccggaaaattcacctgttcgacatcgacgtcccaggcaagataacattccaggaatctaagacgctgagccccggtgattccttttctaccttcgacaccccttattgtagggtcggcttgggtatctgctacgatatgcgtttcgcagagttggctcagatatatgcccaacgcggatgccagcttcttgtgtatcccggtgcatttaatctcaccacaggtcccgcacattgggagttgttgcagcgaagccgagccgtcgacaatcaggtgtacgttgcaactgcaagtccggctcgcgacgataaagctagctatgtcgcatggggccactctactgtagtgaatccctggggagaggtgctcgccaaagctgggacggaggaggccattgtttatagcgacatagacctgaaaaaattggcagagatacgccagcagatccccgtgtttcggcagaagagaagtgatctttatgctgtggaaatgaagaaaccgtag

SEQ ID NO: 29432 - DNA, 1476 bp, Artificial Sequence
  Description of Artificial Sequence: Synthetic coding sequence
atggaggaaatccccgctcaggaagccgcagggtcaccaagggtgcagtttcagagcctcgagactcagtcagagtgtctctccccagaacctcagtttgttcaggatactgacatggaacagggactcacaggtgatggcgaaacaagggaggagaataagctactgattcctaagcagaaaatcagcgaggaagttcacagctacaaggtccgcgtgggccgacttaagcatgatatcacacaggtgccagagacaagagaggtgtataagtccgaagaccggttggagagactccaagagattttgagaaaattcttgtacctggaacgggagttccggcaaatcacaattagtaaggaaaccttcaccagcgagaagaataacgaatgtcatgagcccgaaaagtctttcagcctggactccacaatcgacgctgatcagagggtgttgcggattcaaaataccgacgacaacgacaagtacgacatgtcattcaatcagaattcagcctccggcaaacatgaacacttaaatctcacggaagatttccagtcatcagaatgcaaggagtcgctgatggacctcagccatctcaacaagtgggagtccattccgaacacagagaaatcctacaaatgtgatgtgtgcggaaagattttccaccaatccagcgccttaacgagacatcaaagaattcatacccgtgagaaaccttacaagtgtaaggaatgcgagaagtctttttctcaaagctcttctctctctcggcacaaacggattcacacacgggagaagccgtacaagtgcgaggcaagtgataaatcttgcgaagccagcgacaaatcctgctcgccctcctccggcatcatccagcacaagaagatacataccagagctaagagctataagtgcagttcatgtgagagagtgttcagcaggagtgttcatctgacccagcaccagaaaatccataaagagatgccctgtaagtgtacagtttgcgggtctgatttctgccatactagctatctgcttgaacaccagcgggtgcaccacgaagagaaagcttacgaatacgacgagtatgggttggcttacataaaacagcagggcatccactttagggagaagccatatacctgctctgaatgcggcaaggactttcgccttaattcacacctcattcagcaccagagaattcatacaggggagaaagcccatgaatgcaatgagtgtgggaaagccttcagtcagacaagttgtctgatccagcatcacaagatgcataggaaggagaaaagctatgagtgcaacgaatacgagggttcattctctcactctagtgacttaattctgcaacaggaggttcttacccggcagaaagcatttgattgcgatgtgtgggaaaagaatagctcccagcgcgcacatttagtgcaacaccaaagcatacacactaaagagaatagctag

SEQ ID NO: 29433 - DNA, 1089 bp, Artificial Sequence
  Description of Artificial Sequence: Synthetic coding sequence
atggcacattcatcttttttccccgatgagtactttacctgtagctcgctatgcttgtcatgcggagttggatgcaaaaagagcatgaaccatggcaaggagggggtccctcacgaggccaagagccgctgtcgctactcacatcaatatgataatcgagtctacacttgcaaagcctgttacgagcggggtgaggaggtgtccgtggtgccaaagacctcggcctctaccgactcaccctggatgggcctggcaaaatacgcatggtcaggatatgtgatcgagtgtcccaattgcggcgttgtttataggagcagacaatactggttcgggaaccaggatccagttgatactgtcgtccggaccgagatcgtgcacgtgtggccaggcaccgacggctttctgaaggacaacaataatgccgctcagcgcctgcttgatgggatgaactttatggcccaaagcgtcagcgaactctcattagggccaacgaaagccgtaacatcatggctcacagatcagattgcgcctgcctattggcgcccaaatagccagattctgtcttgtaataaatgtgctaccagctttaaagacaacgatactaagcaccattgtcgcgcttgcggcgaaggcttctgcgacagctgctcatcaaagaccagacctgttccagaaaggggttggggtcccgctcccgtacgcgtatgtgataattgctacgaagcccgaaacgtacagctggcagtcaccgaggcccaggtggacgatgaaggagggacactgatcgcgcgaaaagtcggagaggctgtccagaacaccttaggtgcagtggttaccgcgattgatatccctctgggtctcgtcaaggacgccgctcgtccagcatattgggttccagaccacgagattctgcactgccataattgtaggaaagaatttagtattaagctgagcaagcaccactgtagggcgtgcggccaggggttttgtgatgagtgcagccatgaccgtagagccgtgccttctaggggttgggaccaccctgtcagagtgtgctttaactgcaacaaaaagcccggagacctttag

SEQ ID NO: 29434 - DNA, 348 bp, Artificial Sequence
  Description of Artificial Sequence: Synthetic coding sequence
atgtctggtgagcctgggcaaactagcgtcgctcccccaccggaagaagttgagcctggctcaggagttaggatcgtagtcgaatactgtgagccgtgtgggttcgaggctacttatctcgagctggcctcagcagtgaaagagcagtaccccggaatcgagattgaatcaaggctgggcggtaccggagccttcgagatcgaaataaacggacagctggtattcagcaagttagagaacggcggattcccatacgagaaagacttaattgaagccattaggagggcctctaacggcgagactctagaaaaaattacaaattcaaggccaccatgcgtgatcctgtag

SEQ ID NO: 29435 - DNA, 507 bp, Artificial Sequence
  Description of Artificial Sequence: Synthetic coding sequence
atgctttttagactgtctgagcacagctctccagaggaggaggctagtccccaccagagggctagcggagagggccaccacctgaagtccaaacgtcctaatccatgcgcatataccccaccctccttgaaagctgtgcaacgaatcgcagagagccatctgcagtcgatttctaacttaaatgaaaaccaggcatccgaggaggaggatgagttaggcgagctccgagaattaggttatcctcgggaggaggatgaggaagaggaggaggacgacgaagaggaggaggaggaagaggacagccaggctgaggttttgaaggttatccgacaaagcgccggacagaagactacatgcggtcagggcctcgagggcccttgggaaagaccaccccctttggacgagtctgaaagagatggcggtagtgaggaccaggtggaagatcccgcactcagcgagccaggcgaggaaccacaacgcccttcgccaagcgaacctggaacgtag

SEQ ID NO: 29436 - DNA, 507 bp, Artificial Sequence
  Description of Artificial Sequence: Synthetic coding sequence
atgctgtttaggttgagcgaacacagctccccggaagaggaggccagcccccaccagcgcgcatctggagagggacatcatctgaaaagtaaaagacctaacccttgcgcttacacacccccatccctgaaggcagtacaaagaattgcagagagccacctgcaatcgattagcaatttaaacgagaaccaggcgtctgaagaggaggatgagctaggggaactgagagagcttggctacccacgtgaggaagatgaggaggaggaagaggacgatgaagaggaagaggaggaggaagactctcaggccgaagtgttaaaagtaatacgacagagtgctggacagaagacgacctgtggtcagggacttgagggcccatgggaacgtccaccacctcttgacgagtccgaacgtgacgggggatctgaggaccaagtcgaagaccctgcactatccgagcctggcgaggagccccagagaccctctccctcagagcctggcacatag

SEQ ID NO: 29437 - DNA, 648 bp, Artificial Sequence
  Description of Artificial Sequence: Synthetic coding sequence
atggacccaaaggaccggaagaaaatccagttttccgtgccagctcccccttcccagctggatccacgccaggtggagatgatccgaagacgaagaccgactcccgctatgctgttcagactatcagagcattctagcccagaggaagaagcctctcctcaccaagtgaccccactgacctggcatttcccgtggcagcgtgcatcgggtgaagggcatcacctcaagtcgaagcgccctaatccttgcgcctatactccaccttcactgaaggcagttcagcggatcgccgaatcacatttacagtctatttcaaatctcaatgagaatcaagctagtgaagaggaagacgagctgggcgagctgcgagaattgggttatccaagggaggaggatgaggaagaggaggaagatgacgaagaggaggaggaggaagaagatagccaggccgaggtactgaaggtcataaggcaatcagcaggacagaaaactacgtgtgggcagggattagagggtccttgggaaaggccccctccattggatgagagtgagagggacggaggcagcgaagaccaagtggaggatccggctttaagcgaacccggagaagaaccacagaggcctagccccagcgagccgggtacttag

SEQ ID NO: 29438 - DNA, 5168 bp, Artificial Sequence
  Description of Artificial Sequence: Synthetic coding sequence
atggagagcaactttaatcaggaaggagtgcccaggcctagctacgtatttagcgccgacccaattgccagaccaagtgagatcaatttcgacggtatcaagctggatctcagtcatgagttctcgctggtggcaccgaacacggaggcaaattcctttgaatccaaggattatcttcaagtgtgtctgcgaattaggccatttacgcagtccgaaaaggagttggagtcagaggggtgcgtccacatactcgattctcagacagtcgtcttaaaggagccccagtgtatcctgggcaggctgtcagaaaaatcttccggccaaatggctcagaagttttccttctccaaggtattcggccctgccactacccagaaggagttttttcagggctgcatcatgcagccagtcaaggacctgctgaagggccaatcaaggctgatctttacgtatggcctgactaacagcgggaagacatacacattccagggcacagaggagaacattggtattctgcctcggactctcaatgtgttatttgattctcttcaggagagactttacacaaaaatgaatctgaagccccaccgaagcagagaatacctccgcctgtcctctgagcaagaaaaggaagaaatcgccagcaagtccgcgctgcttcggcagatcaaggaggtcacggtgcacaacgatagtgacgatacgctttatggatccttgacaaactcgctgaatattagcgagttcgaagaaagcattaaggattacgaacaggctaatcttaatatggccaactctataaagtttagtgtgtgggtgagcttcttcgagatatataatgagtatatctatgatctgttcgtccccgtgtcaagtaagtttcagaagcgaaaaatgctgcgcctcagccaggatgttaaggggtatagctttatcaaggatcttcagtggatccaggtctcggactcaaaggaagcctaccgcttactgaagcttggaattaagcatcagtcagtggctttcactaagctgaataacgctagcagccgctcacactcaattttcaccgttaaaatattgcagatagaggacagcgaaatgagccgcgtgattcgcgtttcggagctgtccctgtgtgatcttgctgggagcgagcgcaccatgaagacacagaatgagggcgagcgactgagagagacgggcaacatcaacacatcacttctgaccttgggcaagtgtatcaacgtattgaaaaactccgagaagtcaaagtttcagcagcacgtccccttcagggaatccaagttgacccactatttccaatcatttttcaacggtaaggggaagatctgtatgatagtgaacatctcacagtgttatcttgcatatgacgaaaccctcaacgtattgaaattcagcgcaatcgcacagaaggtgtgtgttcctgacacactcaattcatctcaggagaaactgttcggtcccgtgaagagctcacaagacgtatcgcttgactctaattcaaattctaagatcctgaacgtgaaacgggcaaccattagctgggagaatagtctggaggatttgatggaagacgaggacctggtggaagaactcgagaatgccgaagaaacacagaatgtggagaccaagctactggatgaagacctagataagaccctagaagagaacaaggcttttattagccacgaagaaaagcggaagctgctcgatctcatcgaagatctcaaaaagaaactgattaatgaaaagaaagaaaagctcacgctggagtttaaaatccgcgaggaagtaacccaggagtttactcagtactgggcccagagggaggccgacttcaaagagacgctgctgcaagaacgcgagattctggaggaaaacgccgagaggagactcgcgatattcaaggacctcgtaggcaagtgtgataccagagaggaggccgcaaaggacatatgcgcaactaaggtggaaactgaggagacccataactacgtcggtttcgaagatatcatagactcactgcaggataacgtcgcagacattaagaagcaggcggagatcgcccatctgtatatcgcatccctacccgatccccaggaggcgacagcttgtctggagcttaaattcaatcagatcaaagcagagctagccaaaacaaaaggggagcttatcaagacgaaggaggagctgaagaagcgggaaaacgagtctgattctcttattcaggagcttgaaacttcgaataagaaaattatcacacagaaccagcgtatcaaggagctaattaacataatcgaccagaaggaagacactatcaacgagtttcagaatcttaagtctcacatggagaatactttcaagtgtaacgacaaggcggatacgtcaagcctgattattaacaacaagctgatttgcaacgaaaccgtagaggttcctaaagacagcaagtccaaaatctgttccgaacggaagagagtcaacgaaaacgaactgcagcaggacgaaccacctgccaagaagggatccattcacgtgtcaagcgctatcaccgaagatcagaagaaaagcgaagaagtccgtcccaacattgccgagattgaagatattcgcgtgttgcaggagaacaatgaggggcttcgggctttcttactcacaattgagaacgaattgaaaaacgagaaggaagagaaagccgaactcaataagcagattgtacactttcaacaagagctaagcttgtcagaaaaaaaaaatttgaccctgtccaaggaggtccaacagattcagtcaaactatgatattgcaatcgccgaactgcacgtgcagaagtcaaaaaaccaggaacaggaagagaaaatcatgaagctgtctaacgagatcgagacagcaaccagaagcatcacaaacaatgtgtctcagatcaaacttatgcacaccaagatagatgagttgcgtacattggatagcgtatcacaaatctcaaatatagatctgctgaacctgcgagacctgtccaacgggtcagaggaagacaatctgcccaacacacagctggaccttctcggaaatgattacttggtttccaaacaggtaaaggaataccgtatccaagaacccaacagggaaaattctttccactcttcaattgaggcaatttgggaggaatgcaaagagatcgtgaaagcatctagcaagaagtctcatcagatcgaggaactggagcagcagatcgaaaagctgcaagcagaggtaaagggctacaaggacgagaacaatagattgaaagagaaggagcataagaaccaggatgacctgctgaaagagaaggagaccctaatccagcaactcaaggaagaactgcaggaaaagaatgtaactctggatgtccagattcaacatgttgtcgaagggaagcgagctttatctgagttaactcaaggagtgacttgttacaaagcgaagataaaggagttagagacgatcctggagacacagaaggtggagtgctcccatagtgcaaaactggagcaggacattctggagaaagagagtatcattctaaagctggaacggaacctcaaggaattccaggaacacttgcaggactccgttaaaaatacaaaagatcttaacgttaaagagctgaaactgaaggaggaaatcacccagcttaccaacaatctacaggacatgaagcatctgttgcaactcaaggaggaagaggaggaaaccaacagacaggaaacggagaaactcaaggaagagctgtctgcttctagtgctaggactcagaaccttaaggccgatttgcagcggaaagaggaggattacgctgacctgaaggaaaagctgaccgatgccaaaaaacagattaaacaggttcaaaaggaggtatccgttatgagggacgaggataagctgctgcgcatcaagataaatgagctggagaagaaaaaaaaccagtgcagccaggaactggacatgaagcagcggacaatccagcagctgaaagagcagttgaacaatcagaaagtggaggaggccatacaacagtatgaacgagcatgtaaagatctgaatgtcaaggaaaaaatcattgaagacatgcgaatgacgcttgaggagcaggaacagacacaggttgaacaggatcaggtcctggaggctaaactggaagaggtcgaaaggctggccaccgagctagaaaagtggaaggagaagtgcaacgatcttgaaactaaaaataaccagcggtccaataaggagcacgagaataacaccgatgtgcttggcaagctaaccaacctgcaggacgaactgcaagagagtgaacaaaagtacaatgctgatcgcaaaaaatggctcgaagaaaaaatgatgctgataacgcaggcgaaagaagcagaaaacatccgcaataaggagatgaagaagtatgccgaggatcgtgagaggttctttaaacagcagaacgagatggaaattttaaccgcccagctgaccgaaaaagatagcgatctccagaaatggcgagaggaaagagaccagctggtcgcagccctggagattcagctaaaggctctgatcagttctaatgttcagaaggacaatgaaattgagcagttgaaaagaatcatcagtgaaacttccaaaatcgaaacacagatcatggacattaagcctaaaaggatttccagcgccgatcctgataaactgcagaccgaacccctcagcacatccttcgagatctcccggaataagattgaggacggcagcgtggtgttagattcgtgcgaggtgtccacagagaacgaccaatcgaccaggttcccaaaacctgaactagagatacagttcactccattgcagcccaataaaatggccgtcaaacatccaggctgtaccaccccggtcactgtaaagatacccaaggcacgaaagcggaaatcgaatgagatggaggagtcagcatctcccccacctaaggagtgttcatcatcccccgctatggagcaatcttggaaagaaaatgactttgacaagctccgtgaagagggatttagacgcagcaattatagtgaactgcaggaggaaatccagaccaaaggaaaggaagtcgaaaactttgaaaagaacctggacta

SEQ ID NO: 29439 - DNA, 1215 bp, Artificial Sequence
  Description of Artificial Sequence: Synthetic coding sequence
atgaggcgcgatgtgaacggggtaactaagagcaggttcgaaatgttttctaacagcgatgaggccgtcattaataagaagctccccaaggagttgctgctgcggattttttcctttctggacgttgtgacactttgccgttgcgcccaggtcagccgggcatggaacgtccttgcgcttgacggaagcaactggcagcgaatcgatcttttcgacttccaacgggacatcgagggtagggtagtcgagaatattagtaagcgatgcggcggtttcctcagaaaacttagtcttagaggttgtttgggtgtaggcgacaatgctctgcggacctttgcacagaattgtagaaacatcgaggtcctgaaccttaatggctgtactaagactaccgatgccgaggggtgcccactgcttgagcaattaaacatctcttggtgcgatcaagtcaccaaggatggaattcaggctctcgtgaggggctgcggtggtctcaaagccttattcctgaaaggctgtactcaattagaggatgaagcgctgaagtatataggtgcccattgtcccgagttagtaaccctgaatctgcagacttgtctgcagattacagatgagggactcatcactatatgtcggggatgccacaagttgcaaagcctctgcgcctccggctgtagcaatataactgatgccatcctcaacgcccttggacaaaattgtcccaggttacggatattggaggtggccaggtgcagtcagctgaccgacgtcggattcacgaccctcgcgagaaactgccacgagctcgagaagatggaccttgaggagtgcgtacaaatcacagacagtacgctgattcagctgagtattcattgcccccgtctgcaggttctctccctctctcactgcgaactcatcactgatgatgggattcgccacttgggaaatggggcttgtgcccatgatcagttggaagtgattgagcttgataattgcccgctgattaccgacgccagtcttgagcatctcaagtcatgtcactccctagaacgcatcgagctatatgattgccagcagatcactcgggctggaataaaacgcctgagaacccacctccctaacattaaagtccacgcctacttcgcccctgttacgccgccacccagtgtgggtgggagccgacagcgcttttgccggtgttgcattatcctgtag

SEQ ID NO: 29440 - DNA, 1251 bp, Artificial Sequence
  Description of Artificial Sequence: Synthetic coding sequence
atggcgcactccccagtggcagtgcaggtgcctgggatgcagaacaacatcgccgatcccgaggaactcttcacaaagctggagagaatcggcaagggcagcttcggagaggtctttaagggtattgataacaggacccagcaagtggtggcaatcaagatcattgacctagaggaagctgaggacgagatcgaggatatccaacaggagattacagtcctctctcagtgtgactctagctacgtgaccaaatattatggatcttacttgaagggatcaaagctttggattatcatggaatacctaggaggcggttcagccctggacctgttacgcgcagggcctttcgacgaatttcagatcgcaaccatgctcaaagagatactgaagggactggattacttacactcagagaaaaagattcatcgggacataaaggctgccaacgtcctgctctccgagcaaggagatgtgaagctggctgatttcggcgtcgcaggtcagctgacagacacacagatcaaacgcaatacgtttgttggcacgcccttttggatggctcctgaagtgattcagcagtcagcctacgatagcaaggcagatatttggtctctcggcatcacagccatcgagctcgctaaaggggagccccctaatagcgacatgcatcccatgcgggtgctgttcctgattcctaaaaataacccccctaccctggtcggcgatttcactaagtcctttaaggagttcatagatgcgtgtctcaacaaagatcctagttttcgaccaacagctaaggaactgttaaagcacaagtttatcgttaagaattccaaaaaaacttcctatctgaccgaacttatcgatcgctttaagcggtggaaggcagaaggccattcagatgacgaatccgactcagaaggttcagatagcgagtcaactagccgcgagaataacacccatccagaatggtccttcactaccgtccggaagaaaccagatcccaagaaggtgcagaatggggctgagcaggacttagttcaaacattgtcttgtctgtctatgatcattactcctgcattcgctgagttgaaacagcaggatgaaaataatgcctcacgcaaccaggccattgaggaattagagaagagtatagctgtcgccgaggcagcctgcccaggaattaccgacaaaatggtgaagaagctgatcgagaaatttcagaagtgtagcgcagatgaaagcccttag

SEQ ID NO: 29441 - DNA, 1020 bp, Artificial Sequence
  Description of Artificial Sequence: Synthetic coding sequence
atggctcactccccagtagcggttcaagtgcctggcatgcaggggtctaaattatggatcattatggagtatctgggagggggatctgccctggacctactccgggctgggcctttcgacgaattccagatcgcaaccatgctcaaggagattctcaaggggctcgactatctccacagtgaaaagaaaattcaccgggacatcaaggccgctaacgtcctgctgtctgagcagggagatgtgaaattagcggactttggggttgccggacaactgaccgacacccaaatcaagcgcaacacatttgtggggacgccattctggatggctcccgaagtgatacagcagagcgcgtacgactcaaaagccgatatttggtctctcggcatcaccgcgattgagctcgccaagggggagccaccaaatagtgacatgcatccaatgagggttctgtttctgatcccaaagaacaatccccctaccctggtgggtgacttcacgaagagctttaaggaatttatcgatgcgtgcttaaacaaagacccgtctttcaggccgacagccaaggaattattgaaacacaaattcatagtgaaaaacagcaagaaaaccagctacctgacagagttaatcgaccgattcaagcgctggaaggccgagggacacagcgatgatgaatccgattcggagggatcagactccgagtcaaccagccgagagaacaacacgcatccggagtggagtttcactacagtccggaaaaagcctgatcccaagaaagtgcaaaatggggctgagcaggatctcgtgcagacactgagctgcctgtctatgatcattacaccagcatttgctgagctgaagcagcaggatgaaaacaatgcaagccgcaatcaggctatcgaagagcttgagaagagcattgcagtagcggaggccgcttgccccggtatcacagataaaatggtcaagaagctcattgagaaattccagaagtgcagcgccgatgagagcccatag

SEQ ID NO: 29442 - DNA, 2625 bp, Artificial Sequence
  Description of Artificial Sequence: Synthetic coding sequence
atggaggtactgagagagaaggtggaggaggaggaggaggcggaaagggaggaggcagcggaatgggccgaatgggcccgtatggagaaaatgatgcgtcccgtggaggtaaggaaagaagagattaccctgaagcaagaaaccctccgtgatcttgaaaagaagctttctgagatacaaattacagtgtctgctgagctacccgcatttactaaggataccatagacatctctaagctccccatctcctataagacgaatactcccaaagaggaacacctgctccaggtggctgataacttcagccgccagtatagtcacctgtgtcccgatcgtgtcccattgttcctgcatcccttaaatgaatgcgaggtcccaaaatttgtgtctaccaccctgcgaccaactctaatgccctatcctgagctgtacaactgggatagctgtgcccagtttgtcagtgactttcttactatggtcccacttccagaccccctgaagcctccatcccatttgtatagcagcacaacagtcctgaaataccagaaagggaactgcttcgacttttctacccttttgtgctcgatgttgatagggtctggatatgatgcctactgcgtcaatgggtacggatctttggatctctgtcacatggacctgaccagagaagtgtgccccctgactgtgaaaccgaaagagaccattaagaaggaggagaaagtgttgcccaaaaagtataccatcaaacctccacgtgatctgtgctccaggttcgaacaggaacaggaggtgaaaaaacagcaagagattcgagctcaggagaagaagcggctacgtgaggaggaggagagactgatggaggccgaaaaggcgaagccagatgctctgcacggtctgcgggttcattcctgggtgttggttctgagcggaaagcgcgaagtgcccgagaattttttcattgacccatttactggccactcctacagtacgcaggacgaacactttctgggtattgaatcactatggaatcacaagaattactggatcaacatgcaggactgctggaattgttgtaaagacctgatattcgatctgggtgatcctgtgagatgggagtatatgctcctgggaaccgacaagagccagttgtcactaactgaagaggatgactccggcattaatgatgaagacgacgtcgagaacctgggcaaagaggatgaggacaaatccttcgatatgccacattcgtgggtcgagcaaatcgagatctcacctgaagccttcgagacccgttgtccaaatggcaagaaagtaattcaatacaagcgtgccaaactcgaaaaatgggccccttacctcaacagcaatggcttggtatcacggctgaccacatacgaggatctgcagtgcaccaatattctcgagatcaaggagtggtaccagaacagggaagatatgctggagttgaagcatatcaacaaaacgacagacctgaagactgactactttaaacctggccatcctcaggctctgcgggtacatagctataagagcatgcagccggagatggatagggttatcgagttctatgagaccgcacgggtggacggtctcatgaaaagagaggagacgccacgtactatgaccgagtattaccagggcagacctgatttcctgagttaccggcatgcgagttttggccctcgggtcaaaaaacttaccctgtcctccgcagagtccaacccgcgaccaatcgtgaagattactgagagattctttcgcaacccagccaagcccgctgaagaggatgtcgcggagcgggtgttcctggtggcagaagaacggatacagttgcgatatcattgccgtgaggaccacataacggcctcgaagcgagaattcctccgcaggaccgaggtggattcaaagggcaataaaatcatcatgacaccagacatgtgtatctccttcgaagtggaacctatggaacatactaaaaagctgctctaccaatacgaggcgatgatgcacctgaaacgggaggagaaactgagccgccatcaggtttgggaaagcgagctggaggtactggaaatcttgaaactcagggaagaggaagaagctgcacacactttgaccattagcatatacgatactaagcgcaacgagaaatccaaggagtatagagaagccatggagagaatgatgcacgaagagcatctccgtcaagtggagactcagctggactatttagcgccatttctggctcagttgccacctggcgaaaaacttacatgctggcaggctgtgagactgaaggacgaatgcctgtccgacttcaagcagcgactcattaataaggctaatttaatccaggcgaggttcgaaaaagaaacccaggaactccagaagaagcagcagtggtatcaagagaaccaggtgacactcacaccagaggacgaagatctgtatctctcctattgctcgcaggccatgttcagaattcggattttggaacagcggttgaataggcacaaggaattggccccactcaaatatttagcacttgaggaaaagctctacaaggatccaaggctgggcgaactgcagaagatctttgcatag

SEQ ID NO: 29443 - DNA, 1449 bp, Artificial Sequence
  Description of Artificial Sequence: Synthetic coding sequence
atggagcagtctaaccttgagaagctggagttgaatgttaggaaactgcaacaggagttggatcagcttaatagagacaagctgtccttgcacaacgacatctctgccatgcagcaacagctccaggagaaaagagaagccgtgaactccttacaagaagagcttgccaatgtgcaagaccacctgaacctcgctaagcaggacctcttgcacaccaccaagcaccaagacgtcctgctgtccgagcaaacacgcctgcagaaggacatcagcgaatgggctaatagatttgaggattgccaaaaggaagaggagaccaaacagcaacagctgcaagtactccagaacgagatcgaggaaaacaagcttaagctggtccagcaggagatgatgttccagaggctgcagaaggaaagagagtccgagaagtccaaactggaccaggtgctgagcaaggtcctggccgcagaggaacgcgtgagaaccctgcaagaggaagaaagatggtgtgagagtctggagaagactctgtctcagaccaagaggcaactctctgaaagggaacagcagctagtggaaaagtccggagaactgcttgcgcttcagaaagaggcggactctatgagggccgacttctcgctgctgaggaaccagttcttgaccgaacggaaaaaggctgaaaaacaagttgcctcactgaaggaggccctaaaaatccaacggtctcaattggaaaagaatctgcttgagcagaaacaggagaatagttgtatacaaaaggagatggcgacaattgagcttgttgcacaggataatcatgagagggcccgacggctgatgaaagagctgaaccaaatgcaatacgaatacaccgagttgaaaaagcagatggcaaaccagaaggatctcgagaggcgacagatggagatttccgacgcgatgcggactctgaagagtgaggtgaaggatgagattcgtacaagtcttaaaaatctgaatcagtttctgccagaactccccgcagatttggaagctatcctcgaaagaaacgaaaacctggaaggcgaactggagtccctcaaggagaatcttccatttactatgaatgaaggcccattcgaagagaaactcaacttttctcaggtccacattatggacgagcactggcgcggagaggccctgagggagaagttgcggcaccgggaggacaggctgaaggcacaactgcgacattgcatgagcaagcaagctgaggtgctgattaaggggaagcgacaaactgaagggacactgcactccctgcggaggcaggtggacgcattgggggagcttgttaccagcacaagcgctgactcagcatcttcgccaagcctcagccagcttgagtcatccctcactgaagacagccagctcggccaaaatcaggagaaaaatgcctcagcaaggtag

SEQ ID NO: 29444 - DNA, 3780 bp, Artificial Sequence
  Description of Artificial Sequence: Synthetic coding sequence
atggccctcaggccaggcgctggctccggcggtggcggagccgcaggagcgggagcgggatcggcgggtgggggaggcttcatgttcccggtggccggaggaattcgacctccgcaggctggactgatgcccatgcagcagcaggggtttcccatggtgtccgtcatgcagcccaacatgcaaggaataatggggatgaattatagcagccaaatgagtcagggccctatcgctatgcaggccggaattccaatgggacctatgcccgctgctggtatgccctacctaggccaggccccatttttgggaatgcgaccccctggccctcagtatacccccgacatgcagaaacagttcgccgaggaacaacagaaacggtttgaacaacaacaaaaactgctagaagaggagcgcaaacgcaggcagtttgaagagcagaaacaaaagcttcggttgcttagctctgtgaaaccaaagaccggagaaaagtctagagacgacgccctggaagccatcaaaggcaatttagacggattttctcgcgacgctaagatgcacccaaccccggcatctcaccctaagaaaccaggagttggcgtattcccatctcaggatccagcccagccacggatgccaccctggatctacaacgaatcactggtccctgatgcatataaaaagatccttgagactacaatgaccccaacaggaattgatacggccaagctctatccgatcctgatgagttcaggattgcctagggaaacactgggccagatctgggcgttggctaaccgcacaacccccggaaaactcacaaaggaagaactatataccgtactggcgatgatagcagttacccaaaggggcgtgccagcaatgtcccccgacgcactgaatcagttcccagccgctcccatccccaccctatcaggcttttccatgacactccccacccccgtgagtcagcccacagtgatcccctcagggccagcaggctccatgcctttgtccctgggacagcctgtgatgggcatcaatctggtgggtccagtaggtggtgctgctgcccaggcttcatctggattcatcccaacatacccagcaaatcaggtcgtcaaacctgaggaagatgatttccaagattttcaggacgcttctaaatcaggaagtctcgacgacagtttttcagacttccaggagctgccggcttccagcaagacctccaacagccagcatggcaactccgcacccagcctccttatgcctcttcccggaactaaggcactccccagcatggacaaatacgccgtgtttaaaggaatcgcagcggacaagtcttccgagaacaccgtgcctcctggcgaccctggcgataaatacagtgcctttagggaattagagcagactgccgagaacaagcctttaggcgaaagttttgcagaatttagatccgccggtactgatgacggatttaccgactttaaaacagccgactctgtgtcacccctggaaccacctacgaaggacaagaccttcccgccatcgtttccttcaggtactatccagcagaagcagcagactcaagtcaagaatccactaaatttagctgacctggacatgttctcaagtgttaactgttcatcagaaaagcccctcagcttctcagctgtgttttcgacttccaaatccgtcagcacccctcaatccaccggtagcgctgccacaatgacagcactggccgctacaaagactagttccctggcagacgatttcggagaattctccctgtttggggagtacagcggcctcgcgccagtgggcgaacaggatgacttcgctgacttcatggccttctccaactcctctatctcatcggagcagaaacctgatgacaagtacgacgcgctgaaggaggaggccagtcccgtgcctttaacctccaacgtaggatccaccgttaaggggggacagaacagtaccgcggcttctactaagtacgatgtctttcgccagttgtctctggagggttcgggattaggtgttgaggatctgaaagataacacaccctccggtaaatctgatgacgacttcgctgactttcattcctctaagttttcctctatcaactctgacaagtccttgggcgagaaggccgtggcatttcggcacactaaagaagactcagcctcagtgaagtccctcgatctgcccagtattggcggatctagcgtagggaaagaggattctgaagacgctctctcggtgcagtttgacatgaagctcgccgacgtgggaggcgacctaaaacacgtcatgtctgatagcagtctggacctgcccaccgtaagcggccagcatcctccagccgctgacattgaggacctcaagtatgcagccttcggtagctattccagcaacttcgcggtatccaccctcacaagctacgactggtccgatcgcgacgacgctactcaggggaggaagttatcacccttcgtgctgtctgccggatctggatctcccagcgccactagcattctgcagaaaaaggaaaccagttttggcagttctgagaacatcaccatgacaagcttgagcaaggtgactacatttgtatcagaagacgcactcccagagactacatttccggctcttgcctctttcaaagacacaataccacagacctccgaacagaaggaatacgagaatagagattacaaggacttcaccaagcaggatctgcccacagccgaaaggtcacaggaagcaacctgtcctagccccgcatcctccggagcttcccaggaaaccccaaatgagtgctccgatgattttggggagtttcagtctgaaaaacctaagatctccaagttcgattttctcgtcgcaactagtcaatccaagatgaaaagttctgaagagatgatcaaatcagaactggctacattcgatctgtcggttcaaggatcccataagagatccctgtcgctcggcgataaggagatctctcggagctcgccctcccccgcactcgagcagcccttcagggatcgctccaatactctcaatgagaagcctgccctacctgtgatccgcgacaaatataaagatctgaccggcgaggtggaggaaaatgagagatatgcttacgaatggcagaggtgccttggctctgctctaaacgtgattaaaaaagctaacgatacgcttaacggcatttctagctcctccgtatgcactgaggttatccagtctgcccaaggcatggaatatctgctgggcgtggtcgaggtgtacagggtgacaaaaagggtggagctcggaataaaagctaccgctgtatgcagcgaaaagttgcagcagttgcttaaggacatcgataaagtctggaacaacctgattgggttcatgtccctagcgacccttacatgttgctgggagaaaatgacggtgataaccaagcacctgtccccctatcatgaactgcttgaggaaaagccggatgagaactctctagacttctccagctgtatgttaagaccaggcattaagaacgcgcaggagcttgcgtgcggggtctgtctcttgaacgttgattctaggagcaggaaagaggagaagcccgcagaagaacaccctaaaaaggcgtttaatagcgagaccgactcatttaaactcgcgtacggaggacaccagtatcacgcatcttgcgccaatttctggatcaactgcgtcgaacctaagcctcctggcctcgtgctgcctgatttgctgtag

SEQ ID NO: 29445 - DNA, 1158 bp, Artificial Sequence
  Description of Artificial Sequence: Synthetic coding sequence
atggccttacgccctggcgctggcagcggaggaggaggagcagccggagctggggctggctctgcgggtggcggaggctttatgttcccagtggcgggtgggatcaggccacctcaggcaggcttgatgccgatgcagcaacagggcttccccatggtctcagtgatgcaaccaaatatgcagggcattatgggtatgaattacagctcccagatgagtcagggcccaattgcaatgcaggcaggaatcccaatggggcctatgcctgccgcaggcatgccatacctcggacaggcaccttttctgggcatgaggcccccaggcccacaatataccccagacatgcagaagcagtttgctgaggaacagcagaaacgcttcgaacaacagcagaagctgttggaagaagagagaaagcgtagacagtttgaggaacagaagcagaagctacgactgctgtcctctgtaaaacccaagactggcgaaaaatcgagggatgacgcgctagaagccataaagggaaatctggacggatttagccgggatgctaagatgcacccgacgcctgcttcgcatcccaaaaaaccagattgccctacgtcctcacactctacgaaaacagttagtccaagcccagccttcttggacgaggaggaattctcagacttcatgcaggggcctgtggaggtccccccttgcggaccttctagcacgagtcaaccatttcagtcctttcatcctagtacacccctgggtcagctgcacactcagaaagccggaacccagcccctccccccaagccagagccccgtcccctttgcactccacggagtcccaggccagattccttatttttcaactgcatccgcctctcacagtgttcctgaagcagggccaagcctcgaggagaaattcctggtgagctgcgacatctctaccagtggtcaggaacaaatcaagctgaacacttccgaggttggccacaaggcactcggccctggtagctccaagaagtacccctcactgatggctagtaacggagtcgcagtggacggctgcgtatgggagtactttccacatcgcattctgctgtctcctgagtgtctgctgggcttcaccatgcgtgtgtggtttcagatgccaattcggaaatcctag

SEQ ID NO: 29446 - DNA, 939 bp, Artificial Sequence
  Description of Artificial Sequence: Synthetic coding sequence
atggcagacttcgggatctccgctggccagttcgtggccgtagtatgggacaaatcatcaccagtggaagccctgaagggtctggttgacaaactccaagccctaacaggtaatgaaggacgggtgtcagtggaaaatataaaacagctgctgcagtctgcacacaaggaatcctcctttgacatcatactgagtggcctggtgccaggcagtactacattgcactcagcggagatccttgcggaaattgccaggatcctaaggccgggaggctgcctgttcctgaaggaacccgtggaaaccgccgtcgataacaacagcaaggtgaagaccgcctccaagttgtgctctgcccttacattgtcgggtcttgtagaggtcaaagagctacagcgggagccactcacacccgaagaagtgcagagcgtccgagagcaccttggccacgagagtgacaacctcctcttcgtacagatcactgggaaaaaacctaattttgaagtcggctcctcccggcagctcaagttgtctattactaaaaaatcgagcccttctgtaaagcccgctgttgacccagccgcagccaagctatggaccttgagcgccaacgatatggaggacgattcaatggatcttatagattccgacgaattattggatccagaggatcttaagaagccggaccctgctagtcttagagccgctagttgcggtgaaggtaagaaaaggaaagcatgtaaaaattgcacttgtggtcttgcagaagagctggaaaaggaaaaaagccgagagcagatgtctagtcagcctaagtccgcttgcgggaattgctatctaggagacgccttcaggtgtgcatcctgcccttaccttggcatgcccgcattcaagcccggagaaaaggtgctactgtctgactctaatttgcatgacgcgtag

SEQ ID NO: 29447 - DNA, 1056 bp, Artificial Sequence
  Description of Artificial Sequence: Synthetic coding sequence
atgaatgaatctaatgatagcaccaattacgatatggctccatactatgaggcactgtgtaagagtttggattggcagatagatgttgatctactgaacaagatgaaaaaggctaacgaagacgagctgaagcggctcgacgaagagctggaggacgctgaaaaaaatctgggcgagagtgagataagggacgcgatgatggcaaaggcggagtacttgtgcagaatcggcgacaaggaaggcgcactaactgccttcagaaagacctacgacaaaaccgtggctctgggtcacagactggacattgtcttctacctgctgaggatagggctattctacatggacaacgatttaatcacaaggaataccgaaaaggcgaagtcgttgatagaggagggcggtgactgggacagacgtaataggcttaaagtgtatcagggactttattgcgttgctataagagactttaagcaggctgcggaactgttcttggacaccgtgagcactttcaccagctatgaactgatggattacaaaaccttcgtgacttatactgtttacgtgagtatgatcgctctagagcgccctgacttgagggagaaagtgatcaaaggtgccgagatcctagaggttctgcactctctccccgctgtacgtcagtacttatttagcctgtacgaatgcaggtattctgtctttttccagagtctggccgtcgttgaacaggagatgaagaaagactggttattcgctccacactatagatattacgtccgagagatgagaattcacgcttactctcaactactggagtcttacaggtctcttaccctcgggtatatggcggaggcatttggcgttggtgtagaattcattgaccaggaactgtcccgtttcattgctgccggtcgtctgcattgcaagattgataaggtgaatgaaattgtcgaaacaaatcgacctgatagcaaaaactggcaataccaggagaccattaagaagggcgacctgttgcttaacagggtgcaaaagctgagcagagtcatcaacatgtag

SEQ ID NO: 29448 - DNA, 414 bp, Artificial Sequence
  Description of Artificial Sequence: Synthetic coding sequence
atgatcctgcctaccaaggcaatggctacacaggagctcacagttaagagaaagttatcgggtaacacactccaggtgcaggcgtctagtcctgtcgcgctgggcgttcgtatccccacagtcgcactgcacatgatggaactgttcgacactaccgtggagcagctttacagcatattcacggtcaaggagctcacaaacaaaaagatcattatgaagtggagatgtggaaactggccggaggagcactacgccatggttgccctgaacttcgtgcctactcttggccagacagagttgcagctgaaagagttcttgagcatttgtaaggaggagaatatgaaattctgttggcagaagcagcacttcgaagaaatcaaaggttcgttacagttaactccacttaatggctag

SEQ ID NO: 29449 - DNA, 2796 bp, Artificial Sequence
  Description of Artificial Sequence: Synthetic coding sequence
atggctgaagtggaggctgtgcagctgaaagaggagggaaacaggcatttccagctgcaggactacaaggccgctacaaattcttacagtcaggcgctaaaattaaccaaagataaggcgctactggctaccctttacaggaacagagctgcttgtggtctgaaaactgagtcttatgtgcaggccgcatcagacgcctctagagccatagacattaactcctcagacatcaaggccctgtaccgcaggtgccaggcactagagcacctcggaaagctagaccaggcctttaaagatgtgcagaggtgtgctaccttggaaccgaggaatcagaattttcaggagatgttacgtcgcctgaacacatcaatccaagaaaaactgcgagttcagtttagcaccgatagcagggtacagaagatgttcgagatcctgttggacgaaaattccgaggcagataaacgcgaaaaggctgcaaacaatctcatagtcctgggacgggaggaagctggcgctgagaaaatttttcagaataacggcgtggccctactgctccagctccttgacactaagaagccggagcttgtcctggcggctgtgcggactctgagtggcatgtgtagcggtcaccaagccagggccactgtgatcctacatgctgtgagaattgaccgtatctgctcactaatggccgtggagaatgaagaaatgagtctagccgtttgcaatctgcttcaggccatcattgactctctcagtggtgaggacaagagggaacacagaggaaaagaagaggctctggtactggacacgaagaaggacctgaagcagattaccagtcatctcttggacatgctcgtgtctaagaaggtctcagggcaaggtcgggaccaggccttaaacctgctgaataaaaatgtgccaaggaaggacctggcgattcatgacaactcccgtacaatatatgtggtcgataacggcctcagaaaaattctgaaggtcgttgggcaagtgcccgacctcccatcttgccttcccctaacagataatacgcgcatgctcgcttccattcttattaataagttatacgacgatctgcggtgtgaccctgagagggaccatttcagaaagatctgtgaggaatatatcacagggaagtttgatcctcaggatatggacaaaaacctgaatgctattcaaacagtttctggaatcctgcagggaccttttgacttaggcaaccaattgctggggctgaaaggagtcatggaaatgatggttgccttgtgtggcagcgagcgggagaccgatcaacttgttgctgtcgaagccctcatacacgcatctaccaagctctcaagggcaacgttcatcatcactaacggagtaagtctgctgaagcagatttacaaaacaacaaagaacgagaagatcaagattcgaacccttgttggcctgtgtaagctaggctcagctgggggaaccgactacggcctgcgacagtttgcagagggcagcaccgagaaactggccaagcagtgcagaaagtggttatgcaacatgtccatcgacactcgtactcgccgatgggctgtggaaggactggcttatctaaccctggacgctgatgttaaggacgattttgttcaggacgtgcctgccctgcaggcgatgtttgagctggccaaggctggtacgtcagacaagacaatactctatagcgtcgcgaccactctcgtgaactgtaccaatagttatgacgttaaggaagtgattcccgagttagtgcagctcgcaaaattttcaaaacagcacgttccagaggaacaccccaaggataagaaggattttatagacatgcgggtgaagagactgctgaaagccggagtcatctctgccctggcttgcatggtcaaagcagatagcgcaatattgactgatcagactaaggagctcctggcccgtgtgttccttgccctgtgtgacaatcccaaggatagaggcacaatagttgctcaggggggaggcaaggccctaataccccttgcattggagggaaccgatgtgggaaaagtcaaggctgcgcatgcactcgccaagatagccgcagtctccaatccggatattgcttttcctggtgagagagtatacgaggtagtcagaccgctggtgcgcttgcttgatacacagcgggacggcctccagaactatgaggccctgcttggactgacaaacctcagcggacggtctgataagctgagacagaaaatatttaaggagcgcgctctaccagatatcgaaaattacatgttcgagaaccatgaccagttgcgccaagccgctacagaatgtatgtgcaatatggtgcttcacaaggaagtccaagaacgattcctggccgatggcaatgatcgcctgaagctggtagtcttgctatgcggcgaagatgatgataaggttcagaacgccgcagctggagccttagctatgctgaccgcggctcacaagaagctgtgtctaaaaatgacacaagtgactactcagtggctagaaatccttcagcgactctgtctgcacgatcagctgagcgttcagcaccgcggattggttattgcttacaatttgctagccgctgatgccgagctggctaagaagctggttgaatccgagctactggaaatcttgacggtggtaggcaaacaggagcccgacgaaaaaaaggctgaggtggttcagaccgctcgagagtgtcttatcaaatgcatggattacggttttataaagcccgtcagctag

SEQ ID NO: 29450 - DNA, 318 bp, Artificial Sequence
  Description of Artificial Sequence: Synthetic coding sequence
atggcactgcggtaccccatggctgtgggcctaaataagggccataaggtcacaaaaaacgtatctaaacccagacactcccgcagaagagggagacttacaaagcataccaaattcgtacgggatatgatccgggaggtgtgcggctttgcgccatatgagagacgcgctatggagctcttaaaggtttccaaggataagcgagccctcaaatttattaaaaagagggtggggactcatatccgagctaaacgcaaaagggaggaactgtccaatgttctagccgctatgcggaaggctgccgctaaaaaggactag

SEQ ID NO: 29451 - DNA, 663 bp, Artificial Sequence
  Description of Artificial Sequence: Synthetic coding sequence
atgaattcgatggaccgccatattcagcaaacaaacgatagactgcagtgtattaagcagcaccttcagaacccagcgaacttccacaacgctgccacagaactactggactggtgcggtgacccacgcgctttccagcggccttttgagcagtctttaatgggctgtttgaccgtggtttcacgggtcgccgcacagcaggggtttgacctcgacctcggctaccgtctgctcgcggtatgcgccgctaacagggataaattcacgccaaagtcagccgctctcctctcttcctggtgtgaggagctgggaagattgctcctgcttcggcaccagaagtcgcgccagtccgacccaccgggaaaactcccaatgcaacctcccctgtcctctatgagttccatgaagcctaccctgagtcactccgacgggagtttcccctatgatagcgtgccatggctgcccgcatatcccgcatgtacccccccaccttctcagtcacatcccaattcttgtagtctcaagcagaagcagcccttggctttcccacctcccctgtgttctatatggttaaccacactgcagggtctgctcggatctctgtcctgcgtccacttcgtgagcgggtggagcgttcccagagagccccatgggctcggatag

SEQ ID NO: 29452 - DNA, 354 bp, Artificial Sequence
  Description of Artificial Sequence: Synthetic coding sequence
atggtgcaacgcttgacgtaccgacgcaggctgagttacaatactgcctccaacaagacgcgactgagcaggacgcccggaaaccgtatcgtctacctgtacaccaaaaaagtggggaaggcccctaagtccgcatgcggagtatgcccaggacggctgcgaggtgtgagggcagtgagacccaaagtccttatgcgattatcaaaaaccaagaagcatgtgtcacgcgcatatgggggatccatgtgcgccaagtgtgtccgtgaccgcataaaacgggcattccttatcgaagagcagaagatcgttgtgaaggtgctgaaggctcaggcacagtcccagaaggctaagtag

SEQ ID NO: 29453 - DNA, 354 bp, Artificial Sequence
  Description of Artificial Sequence: Synthetic coding sequence
atggtacagcgcctgacctatcggcgtagactgtcttataataccgcttccaataagacaaggttgagccgcacccccggaaaccggatagtttacctgtataccaagaaggttgggaaggcgcctaaatcagcatgcggtgtgtgccccggacgcttaaggggggtgagagccgtcaggccaaaggtgcttatgcggctgagcaagactaagaagcatgtgtctagagcctatggaggatctatgtgcgcaaaatgtgtgcgtgaccgcattaagagggcctttctgatcgaggaacagaagatagtcgtgaaagtgctaaaagcacaagctcagagccagaaggctaaatag

SEQ ID NO: 29454 - DNA, 354 bp, Artificial Sequence
  Description of Artificial Sequence: Synthetic coding sequence
atggtgcaacgtcttacttatcgccgacggcttagttacaataccgcgtcaaataaaacccgtctctcccgcacccccggtaacaggatagtgtatctgtacacaaagaaggttggtaaagcccctaagagcgcctgtggtgtttgtccgggtaggctacggggagtccgcgctgtgaggcccaaggtgctgatgcgcctttccaagaccaaaaagcacgtttccagagcttatggaggatcaatgtgcgccaagtgcgtgcgcgacagaatcaaacgagctttcctgatcgaggaacagaagatcgtggtgaaagtgctaaaggctcaggcgcagtcccagaaagccaaatag

SEQ ID NO: 29455 - DNA, 1902 bp, Artificial Sequence
  Description of Artificial Sequence: Synthetic coding sequence
atgaaagccatcaaaaaatccttgaccgaggaggaatatctgtacctggatttctctcatcagacagagggatgcatcttcccccttcataccagcgtgaccttgttcctgctgtcttactgcgattgtaagatatttaaaatctgcctcgtggtgaccaaagaggtatcacgggattcttctctgctgcgcgacgaccttatccaagacgtcgagatacagatcatatcccgccaggagctgccacccattgttcagaactgttgtctaccggcagtggttgaaagatctgacaacttttgtcgagccggtctggcggttgttctgaggcatataatccagaaaagctacgaagctgatccactgaagaaagaactgctagagctgttaggcttcaagaaaacatgcttaaaggcctgcgccgaggtatcgcagtggactaggctgtgcgagctcaccataccccttgccattgaaaatttcttgagagagtcctcagaccagcccccaacaattcctgtagagattttacagctggagaaaaagttatctgagccagtgagagtgcacaatgacgataaactccggcgacagaaactcaaacaacagaaagcagacggagtgggccctcccctcacgaagggcaaagccaagtcaaaggtgcacacacaggagacttctgaaggcttggactccagcagcaagagcttagagctcaaagtcgctttttcaaaactgactgttcaagaagaacccgctacaaccaaccgcgaaccatcccacattaggaaggcaaaggcgtccgacctcccacccctagaacacgtgttcgcggaagggctctacttcaccctggccgacatagttcttcttccctgcatccaccacttccttgtcattatcagcagaaagttttccgagaaactagttgaattccccttgctggccagttggtatcagcgtatccaagaggtaccgggtgtgaaaaccgctgcatcaaaatgtggcatccaatttcttcatctgccgaaactgcttacaacatctacagagcagcatccaaatctctgtgaagtgcctggggtcgaggagcagagcgatccattgtttatcggaggccctcggccaaccatggctaagctcatggagaaaggtattgaagtgatgttttccccacatccttgcccaacatggactcttgattggaatgtgcttcccgcagctgtgagtcccaaagaaggaaagatgagctctgaccgagccttgcgtaaacagcagcaattgaacaatctggtctatgtcgtaaccaatcaggccaagcctggcgaccgaatcgtggacttctgcagcggcggagggcacgtgggaatcgttctggcacatatgttgccgtcttgccaggtgactctgatagaaaataaggagctctcgttgattcgcgctaaaaaaaggtccgatgagttgggtctgtcaaatatttggttcatccaggccaatatggaatatttcacaggcatgttcaatattggagttgctctgcatgcctgtggagtggcaaccgacatggtgatagagcattgcattaaaacccgggcatcttttgtgacgtgtccatgctgttatgggttcatacaaaatacaagcaagttcaattttccaaaatcagagcagttcaaaaagacactgagctacaaggagcacatgatcctgtgtcgtttcgccgatcaaaccgcagtgcagctgcctccacaacggcgtttaatcggcaagcaatgtatgtgtcttgttgacctggatagagcccgagcagctgaggagtgtgggtatagtgtgcaggtcatctcgatggaaccggagagttgttctcccaaaaataatatgatcgtgggtgtgcccatctag

SEQ ID NO: 29456 - DNA, 1641 bp, Artificial Sequence
  Description of Artificial Sequence: Synthetic coding sequence
atgaaggcaattaagaagtcactgaccgaagaggagtacctgtacctggattttagccatcagaccgaaggatgcatttttcctcttcacacctcagtaaccctcttcctcctatcctattgtgactgtaagatttttaaaatatgtctggtagtaacgaaagaggtgtcccagtggacgcgtctctgtgaactgactatcccactggccatcgagaacttcttgagagagtctagcgaccagccgcctacaatacccgttgaaatcctgcagctggaaaagaaactgtctgagccagtgagagtgcacaatgacgataaattacgccgtcagaagttgaagcagcagaaagcagatggtgtcggcccacctctgacaaaaggcaaggccaagagcaaggtgcatactcaggagacctcggaggggctcgattcctctagtaaatccctcgagctcaaagtggctttttccaagctcaccgtccaggaagagcctgccacaaccaatcgagagccctctcatattcgtaaggcaaaggcttccgatctgccacctctggagcacgtgtttgctgaaggactgtactttaccctggccgacattgtgctgctcccatgtattcatcatttcctggtcatcatatctagaaaattctccgaaaagctcgttgagttccctttgctggcttcgtggtaccagagaatccaggaagtgccaggcgtgaagaccgctgctagtaaatgtggcatccagttcctgcacctacctaagttgctgaccacctctaccgaacagcatccaaatctgtgcgaagtccctggcgtggaagaacagtccgatcctctttttatcggtggccctaggcccaccatggcaaaactcatggagaaaggcattgaggtcatgttctcgccccacccttgcccaacttggacgctggactggaatgttctgcctgctgcagtgagtccgaaggaaggaaagatgagctccgatagggctttgcgtaaacagcagcaacttaataacctggtgtacgtggtaacaaatcaggcaaagcccggagatcgtattgtggatttctgttccggaggaggtcatgtaggaatcgtgcttgcgcacatgctgccctcctgccaggtcacactaatcgaaaacaaggaactgagccttatccgcgctaaaaaacgaagcgacgagctcggcttgagcaacatctggttcatccaggccaacatggaatattttacgggcatgtttaacataggtgtcgctcttcatgcctgcggcgtggccaccgacatggtgatcgaacactgtatcaagacccgcgcatcattcgtgacctgcccatgctgctatggctttattcagaacacctccaagtttaacttcccgaagagcgaacagttcaagaagactttgagctacaaggaacacatgatattgtgtcgctttgctgaccagactgctgtgcagttacccccacagcgcagactgatcgggaagcagtgcatgtgtttggtggacctcgatagggcaagagcagcggaggagtgcggatatagcgtgcaggtgattagcatggagcccgaaagttgtagtccgaagaacaatatgatcgtaggggtaccgatctag

SEQ ID NO: 29457 - DNA, 1542 bp, Artificial Sequence
  Description of Artificial Sequence: Synthetic coding sequence
atgctgctcgagaatctgacggataatgagagcgaaaacacaaatttgaaaaagaaagtctttgaaaaggaggctcacatccaagaactcagctgcttgttccagtccgagaaagcaaataccctcaaggccaacagattctcccagagtgttaaggttgtacacgaacgcttgcagatccagatacataagagggaagctgagaatgacaagctcaaagagtacgtgaagtcccttgagacaaagatcgcaaagtggaatttacaatccagaatgaataagaacgaggcgatagtgatgaaggaagctagtcgacagaaaactgtggccctgaagaaagcttctaaggtatacaagcagcggctggatcacttcactggggcaatagaaaagcttacaagccagatccgcgaccaggaggccaaattgtccgagaccattagtgcctccaatgcttggaagtcccactacgaaaagatcgtcatcgagaagaccgaactagaggtgcaaattgagacaatgaagaaacagatcataaatcttctggaggatctcaagaagatggaggaccatggaaagaacagttgtgaggaaatactgaggaaagttcatagtatcgagtatgagaacgagacgctcaacctggaaaacactaaacttaagaccactctggctgcactcaaggatgaggtggtttctgtcgagaacgaactctctgagcttcaggaggtggaaaagaagcagaaaacactgatagaaatgtacaaaacacaggtgcagaagctgcaggaggcagccgagattgtgaagagccgctgcgaaaacctcctgcacaaaaacaaccagatcaccaaaaccaaaaacaagaacgtcgagaaaatgagaggccagatggagagccatctcaaggagctggagcgggtctgcgactcactcactgcggctgaaagacgcctgcatgagtgccaagagtccctccagtgttgtaagggcaagtgtgcagatcaggaacatacaatccgtgagctacagggtcaggttgacggcaatcacaatttactgacaaagcttagtcttgaggaagagaattgcctcatccagctgaagtgtgagaacctgcagcagaaactagagcaaatggatgccgagaacaaagagttagaaaaaaagttagcaaaccaagaagagtgcttaaagcattccaacctgaaattcaaggaaaagagcgccgagtacaccgctttggcgagacaactagaggcagcattggaagagggccgacagaaggtagccgaagagatcgaaaaaatgtctagcagagagtctgcgctccagataaagatcttggacctcgagaccgagctacgtaaaaaaaatgaagagcagaaccagcttgtgtgtaaaatgaattctaaagcacagcaccaggaagtttgcctgaaggaagtgcagaacagcctggagaagagtgagaaccaaaatgagtcaataaagaactatctgcagtttctgaagactagctatgtgacgatgttcgagtag

SEQ ID NO: 29458 - DNA, 1167 bp, Artificial Sequence
  Description of Artificial Sequence: Synthetic coding sequence
atggctgcggctgctgctctggcaaggttggagcagaagcagagtagggcctgggggcctacttcccaggatacgattcgcaatcaggtcaggaaggaactgcaagctgaagcaactgtttctggctccccagaggcacccggaactaatgttgtatctgagccacgagaggagggcagcgcacacctagctgtgccaggcgtatactttacttgtcctcttacaggagcaaccctgaggaaagaccagagagacgcttgcatcaaggaggccattctgcttcatttctcaacagatcctgtcgccgcatctatcatgaagatctacacgtttaataaggatcaggatagggttaaacttggagtagataccatcgctaagtatttggacaacattcatttacatcctgaggaagagaaatatcgaaaaattaagttgcaaaataaggtgtttcaggagcggataaactgccttgaggggacccacgaattctttgaggcaattggatttcagaaggtgctgttgcccgctcaggaccaggaagaccccgaagagttctatgtgctcagcgagaccacactcgcccagcctcaaagcttagagcgacataaggaacagttactcgctgctgaacctgttagagcaaaactcgacaggcagaggagagtatttcagccctcccccctggcttcacaatttgaactgccgggagatttttttaatctgacggcagaggaaattaaacgagaacaacgacttagatcagaagccgtggagcgactgagtgtgctgagaactaaagctatgcgcgaaaaagaagagcagaggggcttgcggaaatacaactacaccctgttgagagtccggttgccagacggctgtctcctgcaggggactttttacgcacgggaacggcttggagccgtgtacggatttgtcagagaagccctccaaagcgactggttacctttcgagcttctggcttctggcggacagaagctgtccgaagacgagaaccttgctctcaatgagtgcggacttgttccgagcgcattgctgaccttttcttgggacatggctgtcttggaggatattaaggctgccggagcagaaccagattctatcctcaagcccgagctcctgtcagccattgaaaaacttctgtag

SEQ ID NO: 29459 - DNA, 2691 bp, Artificial Sequence
  Description of Artificial Sequence: Synthetic coding sequence
atggatggcgcagcaggccctggagatggccctgctagggaagctctgcaatctctctcccagcggctgcgcgtccaagaacaagagatggagctcgtaaaggcggctttggcagaagcactgcgtttgttgagactgcaggttccgccttcatccctgcaaggcagcggcactcccgctcctcctggtgattccttagcagcccctccgggactcccacctacctgtaccccatctcttgtcagcagaggaactcagactgagacggaggtggagttaaagtcctctcccggaccacctggactgtccaatggtcccccagcaccccagggcgctagtgaggagcccagcggcacccagtctgaggggggagggtctagtagctctggggctggcagtcctggtcctcctggaattctgaggcctttgcagccgcctcagcgcgctgatacaccacgaagaaatagctctagttccagctccccctccgagcgtcctcgtcagaagctgtcccgtaaggctattagttccgcgaatctcttagtaaggtctggaagcaccgagagcaggggcggtaaagacccgttgtccagtccgggaggtcctggttctcgcagatcaaattacaacctagagggcatatctgttaagatgttcctacgaggacgccctatcaccatgtatattccctccggcatccgatccctcgaagagcttccttcgggtcccccacccgagactttaagcctagattgggtttacggttatcgcggaagagattctcggtccaacctctttgtcctaaggagcggcgaggttgtgtacttcatcgcatgtgttgtggtgctctaccgaccgggagggggaccgggagggccaggaggcggtggccagaggcattacaggggtcacacagactgcgtcaggtgtctggcagtccaccctgatggagtccgggtcgctagcggtcaaacagctggcgttgataaagacgggaagccgctgcagcccgttgtgcatatctgggacagcgaaaccttgttgaaactccaagagatcggcttgggtgctttcgagcgcggagtgggcgcactggctttttcagccgctgaccagggagcattcctgtgtgtggtggacgatagtaatgagcacatgttatccgtgtgggattgtagccgcggaatgaagcttgctgaaattaagtccacaaatgactctgtgctcgcagtgggtttcaaccccagagatagctcctgcatcgtcaccagcgggaaatcccatgttcacttttggaattggagtggcggtgtcggagtgcccggaaatggaaccctgacaaggaaacagggtgtgttcggaaagtacaaaaaaccaaaatttattccctgcttcgtgttccttcctgacggggatatactaactggagatagtgagggcaacatcctgacctggggaaggtccccatccgattccaaaacccccggtcgcggaggggcaaaggaaacgtatggaatagtagctcaggcccacgcacatgaaggatctatcttcgctctgtgccttcgcagagacggaaccgtgctgagcggaggaggcagagacaggcgactggtccagtggggccctggactcgtggctctgcaagaggccgagatccccgaacactttggtgctgtcagggctatagctgagggcttggggtctgagcttctggtggggacgacaaagaacgcgctgttgcgcggagatctggcacagggtttcagtccagtgattcaggggcatacagatgaactgtggggtctatgtacccaccccagccagaacaggttcctgacatgcgggcatgatagacagctctgtctctgggacggagagtcgcacgctctggcctggtctattgatctgaaggagaccggcctgtgcgccgattttcaccctagcggggcagtcgtggctgtgggactcaacacaggccgttggctggttctggataccgaaacacgagaaattgttagcgatgtgatcgacggcaatgagcaactcagtgtggtccgctacagtccagacggtctatacctggcgattggaagccatgataatgtcatctacatctacagtgttagctcagatggggcaaagtcttcccggttcggaaggtgcatgggccactcaagctttattactcacttggactggtcaaaagacggcaatttcatcatgagtaacagtggtgattacgagatcttgtattgggatgtggccggtggatgcaagcagctaaaaaataggtatgaaagcagagacagagagtgggccacatatacttgtgtgctcggctttcacgtttacggcgtctggccagatggcagcgacgggactgacattaattccttgtgccgatctcataacgagcgggtcgtggctgttgcagacgacttctgcaaggtgcatctgtttcagtatccctgcgctcgcgcaaaagctccttctcgaatgtacggcggacatggatcacacgtgacttcagtgaggttcacacacgacgatagtcatctggtgagtcttggcggaaaggatgcctctatcttccagtggagggtgctcggagctggcggtgcaggaccggctccagcgacgccttcgaggactccttcgctttcacccgcaagtagcctagatgtttag

SEQ ID NO: 29460 - DNA, 2934 bp, Artificial Sequence
  Description of Artificial Sequence: Synthetic coding sequence
atgggtgcagaggaagaagtcttggttaccttgagcggtggtgctccttggggattccgcctgcacggtggtgctgagcagcgcaagcccttgcaagtaagcaagatccgcagacgcagtcaagctggtagagcaggactaagggaacgagaccagctactggccattaatggagtgtcctgtaccaatctaagtcacgcttctgccatgtcactgatagacgcatcgggaaaccagctggtgctgactgttcagcggcttgccgacgaaggcccagtccagagtccctcacctcacgaactgcaagtactgtcacctctgagtccattgtctccagagccgccaggggcacccgttccacagcccctgcagccaggaagcctgcggtcccctcctgattccgaagcctattatggagagacagattctgacgccgacggtcctgccacacaggagaaacctcggagacccaggaggagaggaccaaccaggcctacgcctccaggggcaccaccagatgaggtttacctttccgactctccagccgagccagcccctacaatcccaggcccacctagccaaggggattcaagagtatcatctccatcatgggaagacggggctgccctgcagccacccccagctgaagcgctcctgctgcctcacggccctctgaggccagggccacacctgatacctatggttgggccagtaccacatcccgtcgcagaggatttaacaacaacttatactcagaaggcgaaacaggccaaattgcagcgggcagagtccctgcaggaaaaaagcataaaagaggctaaaaccaagtgtaggacaatcgcttcccttttaacagctgccccaaatccacactctaaaggcgtgctgatgttcaaaaagagacgccagcgggcaaaaaagtatacgctggtgtcctttggcgctgctgcaggcactggggctgaagaagaggacggagtgcctcctacatccgagagtgagctggacgaggaggcatttagcgatgccagatctctcacaaaccagagtgattgggatagcccatatctcgatatggaacttgcacgcgcaggctctcgcgcttctgaagggcagggatctggattggggggacagctgagtgaggttagcggaaggggtgtacaacttttcgagcagcagcgccagcgggctgatagttctactcaagagcttgctcgcgttgaacccgctgcaatgctgaacggcgagggtctgcagtcccctccaagagcacagtccgccccacctgaggccgcagtgctaccaccttctccgctgcccgctccggttgcatctcccagaccatttcagcctggcggtggagcccctactcctgctccgagcatctttaaccgttctgcaagaccatttactcccggtcttcaaggtcaacgcccaactacaacatccgttattttccggcctctggctccaaagcgagccaacgactcgctgggagggctgagtccagcaccacctccattcttgagcagccagggacctactcccttacctagtttcaccagcggcgtaccctcacatgcccctgtgtctgggtcaccatccacgcctcgctcatccggccctgtcactgctaccagttctttatatatccctgccccttcacggccagtgaccccgggaggtgctcctgaacccccagcgccacccagcgccgcagccatgacatcgacagcaagcatttttcttagtgcccctctccgtcccagcgccagacccgaggcaccggcaccaggaccgggtgcgccagagcctccgtccgctcgagaacagcgcatcagcgtgcctgcggctagaactggtattctgcaagaagcgagaaggagaggcactaggaagcaaatgtttcggccaggaaaggaggaaactaagaacagccctaacccagaactgctctctctggtgcagaacttggacgagaagcccagggccggtggtgccgaatcgggaccggaagaggatgcactgtccctgggcgcagaagcttgcaacttcatgcaacctgtgggcgctcgttcctacaaaacactccctcatgtaacgccgaaaaccccacctccaatggcccctaagactcctccgccaatgactccaaaaacgcctccacccgtcgccccaaagccaccttctagggggctgttggatgggctggttaatggcgcagccagcagcgctggaattccagagccgcctcgcctgcaggggagaggcggagagctatttgccaagaggcagtctcgggctgacagatatgtcgtcgagggaacccccggtcccggtcttggacctcgtccacgcagtccatctcctaccccatcccttccaccgtcttggaaatactctcctaatatccgggctcctcctcccattgcttataacccgctgctcagtccattcttccctcaagctgcgcgaactttgcctaaggcccagtcccaaggacccagggctacacctaaacagggaatcaaagctctggacttcatgaggcatcagccttaccaactcaagacggcaatgttttgcttcgatgaggtgcctcctactccaggcccaatagcttccggaagtccaaagacagcaagggttcaggagattaggcgttttagcacgcctgctcctcaaccaacagccgagccccttgctcccaccgtcctggccccaagggccgctacgacactggatgaacctatatggcgaacagagctggcctctgcaccggtcccgtcccccgcaccaccacctgaagccccaaggggcttgggagctagcccctcatcctgcggctttcaggtcgcacggccaaggttttctgccaccagaacaggtttacaagcccatgtatggcgtcctggggcaggtcaccagtag

SEQ ID NO: 29461 - DNA, 2757 bp, Artificial Sequence
  Description of Artificial Sequence: Synthetic coding sequence
atgggcaccactgcaccaggtcctatccatcttttggaactgtgtgatcagaagctcatggagttcttatgcaatatggacaacaaggacctcgtatggctggaagagatacaggaggaggctgagcgcatgtttactcgtgaattttctaaggaacctgaattgatgcccaaaacaccaagccagaagaacagacgaaagaagcgccgtatttcatatgtgcaggacgagaatcgggacccaatccggaggcggctgagccggagaaaaagcaggagttctcagctttctagtagacgtctgcggagtaaggattcagtcgagaagctagccaccgtcgtcggggaaaatggatccgtcctgaggagggtgacccgggcagccgctgccgctgcagccgctaccatggccctggctgcgccaagtagtcccacaccagaatcacctacaatgctcaccaaaaagcccgaggacaatcatacccaatgccagcttgtccccgttgtggaaatcggtatttccgagcgccagaacgccgagcaacacgttacccagcttatgtcaacagagccacttcctaggacgctctccccaacccctgcaagcgccactgcacccacttcccagggtattcccacatccgatgaggaaagcacccccaagaaatcaaaggcacgcattctagagtcaattaccgtgtcttcactcatggctaccccgcaggacccaaagggccagggcgtggggacaggcaggtccgcgagtaagctaagaatcgcccaggtctctcctgggccacgcgactcacctgcgtttccagattcgccctggagggagcgggtgcttgccccaatactccctgataacttctcaacccctaccggatcacgaacagatagccagtccgtgagacattcccccattgcccctagcagcccctcgccccaggtcctggcacagaaatactcattggttgcaaagcaggagtcagtcgttagaagagctagtcgcagactggcaaagaaaacagctgaggaacccgctgccagtggcaggattatatgccattcatacctcgagagactcctaaatgtggaggtccctcagaaggtaggctcagagcagaaagagccaccagaggaagctgaacctgtggccgctgctgaacctgaggttccagaaaataatggcaacaattcctggccacataacgacaccgagattgctaacagcacacccaaccctaagcccgctgcctctagtcccgagactccttcagctggccagcaagaagccaaaacagaccaggccgatggcccaagagaacctccgcagagcgcccgacgcaagagatcctataaacaggctgtaagcgaacttgatgaggagcaacacctagaggatgaagagctacagcccccacgtagtaaaactccctcaagtccttgccccgctagcaaagtggttcgtccgctgcgaacattcttgcacacggttcagcggaatcaaatgctgatgacccccacgtccgcaccccgatctgtgatgaagtccttcatcaaaaggaacacccccctgcgaatggatcccaagtgcagtttcgtggagaaagaacgtcagagactggaaaatctaaggaggaaggaggaagctgagcagttgcgcaggcaaaaagtggaagaggataagaggcgtcgcctggaagaggtcaagctgaaaagggaggagcgtctgcggaaggtactgcaggctcgggaaagggtggagcagatgaaagaagaaaagaagaaacaaatcgagcagaagtttgcacagatcgacgaaaagactgaaaaagccaaggaggagcggctggcagaagagaaagcaaaaaaaaaagccgcagccaagaagatggaagaggtggaggcaagacgcaaacaagaagaggaagccaggcggctacgatggctgcagcaagaagaggaggaaagaagacaccaggagctgctccagaaaaagaaggaggaggagcaagaaaggttgcgaaaagctgctgaggcaaagcgcctcgcagaacagagggaacaggagaggcgcgagcaggagcggcgtgagcaggagcgccgtgaacaggaacgtcgggagcaggaacgacgagaacaagagcgtcagctggccgaacaagaaaggcggcgtgaacaggagcgcttgcaggcagagcgagaactccaggagagagagaaggccctgcgcctgcagaaagagcagttgcaacgcgaactggaagaaaagaagaagaaggaggaacaacaacgtcttgccgagcgccagctgcaagaggagcaagagaagaaggctaaggaagccgcaggtgcttccaaggctctgaacgtcactgtggatgtgcagtcccccgcatgtactagctaccagatgactccccagggtcacagggcgccacccaaaattaacccagacaattacggcatggacctgaattctgacgactccacggatgacgaggcacaccctcggaagcctattcccacatgggccaggggcacgcccctgagccaggccataattcaccagtattatcatccccctaatttgctcgagctctttggaactattcttccgctagatctggaagacatatttaagaaaagcaaacctagataccataagaggacatcctctgcagtgtggaacagtccccctctccagggagctagggtgccgtcctccctggcctattctctaaagaaacactag

SEQ ID NO: 29462 - DNA, 1728 bp, Artificial Sequence
  Description of Artificial Sequence: Synthetic coding sequence
atgacaagtaagaaactggtgaatagtgtagccggttgcgctgacgacgctctcgcaggccttgtggcctgtaaccctaacctgcaattgctccaaggccacagggtggctctgcgaagtgatctagatagtctgaagggaagagtagctctcttgagcgggggagggagcggccatgagccggctcacgcgggtttcataggtaaggggatgttgaccggtgtgatagcaggggctgtatttacaagtccagctgtaggatccatcttggcagccatacgagccgttgcacaggccggtacagtgggaaccctcctcatcgttaagaactacacgggcgatcggttaaactttggcctcgcccgagagcaagctagggctgagggaatcccagtggagatggtcgtaatcggcgacgacagcgcattcaccgtccttaagaaagccggacggaggggcctgtgtggtactgtgctgatccacaaagtggcaggcgctttagccgaagctggagtagggcttgaggaaatcgctaagcaggtaaatgtggtggcaaaagccatgggcactctgggggtctctctgtcttcgtgtagcgtgccgggttcaaagcctacgttcgagctcagtgctgatgaagttgagcttggactgggcatccatggagaagccggagtccgtcggattaagatggccacggccgatgagattgtgaaattgatgctggatcacatgactaacactaccaatgcgtctcacgtgcccgtccagccgggttcgagtgtcgtcatgatggtgaacaacctgggcggtctctcattcctcgagttgggcatcatcgcagacgctaccgtgaggagtctggagggccgtggggtcaagatcgccagagcactcgtcggcacctttatgtctgctcttgagatgccgggaataagcctgacccttttactggttgacgagccactcctgaaactgatcgatgctgaaaccaccgccgcagcctggcctaacgtcgcggctgtttccatcacagggcgtaagagatcaagggtggctcctgcggagccacaggaggcgccagacagtaccgccgctggaggctccgcttccaagagaatggcattggtacttgagcgcgtttgttcaacattactggggctggaggagcatctcaacgccctcgatagggccgctggcgatggcgactgcggaacgacgcattcacgcgctgcacgtgctattcaggagtggctgaaagaggggcctcctcccgcatctcccgctcaactgctgagtaagctcagcgttttgttactggagaaaatgggcggatctagcggggcactttacggcctgtttcttacggccgcagcacaaccactgaaggccaaaacgtccttaccagcgtggagcgcggctatggacgctggattggaggccatgcagaaatacggaaaggctgcacctggggacagaacaatgttggactccttgtgggccgcaggccaagaacttcaagcatggaagtcacctggagccgacctgctccaggtgcttaccaaagcagtgaagtcggcagaggcagccgcagaagcaactaagaatatggaggctggcgctggcagagcctcatacatctcttctgcccgactcgaacagccagatccaggcgcagtagccgcagcggctatcctgagagccattctcgaggtcttgcagagctag

SEQ ID NO: 29463 - DNA, 1080 bp, Artificial Sequence
  Description of Artificial Sequence: Synthetic coding sequence
atggccgcaccctgcgcagaggacccctcgcttgaaaggcatttcaaggggcaccgggacgccgtcacctgcgtggacttttccataaacaccaagcagctggcaagcggtagtatggacagctgcttaatggtttggcacatgaagccccaaagccgtgcgtatcggttcaccggccacaaagacgcagtgacctgtgtgaactttagtccgagcggccatttacttgcctccgggtccagggataagacagtccggatctgggtgcccaacgtcaaaggggaatccactgtgttccgcgcacacacagctacagtcagatcagtgcacttttgctccgacggccagtcctttgttacagccagcgacgataaaaccgttaaggtgtgggccacacaccgacagaaattcctattctctttatcacagcatattaactgggtccgctgcgccaagttctctcctgatggacggctcatcgtttccgccagcgatgataagactgtaaagctctgggataaatcttcacgcgagtgtgtgcatagctattgcgaacatggcggattcgtaacatatgtggactttcatcctagtggcacatgcattgctgcagctgggatggacaatacggtgaaggtctgggatgtgcggacccaccgcctgctgcaacattaccagctgcacagcgctgccgtgaacgggctttcttttcacccttcaggcaattatctgatcaccgcaagcagcgatagcaccctgaaaatcctagacctgatggagggcaggttactatacacgctccacggacaccaaggcccagccactaccgtcgctttcagccgtactggtgagtactttgcctcaggaggatccgatgaacaagttatggtgtggaagagcaacttcgatattgtcgaccacggcgaagtgactaaagttccgagaccacccgctaccctagccagcagcatggggaatttaactgttagcatcctcgaacaacgcctgacactgacggaggacaaattaaaacaatgtctggagaatcagcaactgattatgcagagagctactccctag

SEQ ID NO: 29464 - DNA, 633 bp, Artificial Sequence
  Description of Artificial Sequence: Synthetic coding sequence
atggctgctagcgtggagcaacgggaggggacaatacaggtccaggggcaagcactcttctttagggaggcactaccgggtagcggccaggcaagattctccgtcctcctgctacacggcatcagattctcaagtgagacatggcagaacttgggtaccctccatcgactagcacaggccggttaccgcgcagtggcaattgacctgcccggattgggtcacagtaaagaagccgctgcacccgctcctattggggagcttgctccaggttctttcctcgccgcagtagtcgacgctctagagctaggaccaccagtggtgatttccccatctttgagcgggatgtactccttaccattcctaaccgcaccaggtagccagctgccgggattcgttccggttgctccaatctgtacagacaagataaatgcggctaattatgcttccgtgaaaacgcctgcgctcatagtgtacggtgaccaagatccaatgggtcagacatcttttgagcaccttaaacagctgccaaatcatcgcgtgctcattatgaagggggctggccacccgtgttacttggacaagcctgaagagtggcacacagggctgcttgacttcctccaggggttgcaatag

SEQ ID NO: 29465 - DNA, 1491 bp, Artificial Sequence
  Description of Artificial Sequence: Synthetic coding sequence
atggatcaagattacgagcgaaggttgctgcggcagatagtaatccagaacgagaatacgatgcccagagttacagaaatgcggcgaaccctaacaccagcaagcagtcccgtgtcttcaccgagtaaacatggcgatagattcattcccagtcgagccggagccaattggagtgtgaacttccacaggattaatgagaacgaaaaatcgccctctcagaataggaaggcaaaagatgccacctctgacaacgggaaagacggattggcctattctgcccttctgaaaaatgagcttcttggagctggtattgaaaaagtgcaggatccccagactgaggaccgacggctgcagccatcaactccggaaaaaaagggcttgttcacgtattcactgagcactaaacgtagcagcccagacgatggaaatgatgtctccccttattctctaagccctgtgagtaacaaaagccaaaagctcttgaggagtccacgcaaacctacccgcaagatctccaagatcccctttaaagtcctcgatgctccagagcttcaagacgacttctatctgaatcttgtggactggagctccctcaatgtgctttccgtgggcttaggcacttgcgtttatctctggtcagcctgtaccagccaagtgacccggctatgtgatctatcagtggagggtgattcagtgacttctgtgggctggtctgagcgagggaatctggtcgccgttggtactcacaagggattcgtccagatatgggatgcagcagcagggaagaagcttagtatgttagaagggcacacagcccgtgtcggagccctcgcttggaatgccgaacagctgtcctctggatcacgtgaccgcatgatcttacagcgggacatccggacacccccactgcagagcgagagaaggctgcagggtcataggcaggaagtgtgcggcctcaagtggtccactgatcaccagctgttagccagtggtgggaacgataacaagttgctagtctggaaccactcgagtctgtctcccgttcagcagtacaccgagcatcttgccgctgtcaaggctatagcctggagcccccaccagcacggtttgttagcatccggtggaggtactgccgaccggtgtatccgattttggaatacgctaaccggccagccgctccagtgtattgacacaggaagccaggtatgtaacctggcttggtcaaagcacgcaaatgaactggtaagcacccatggatacagccagaatcagatcctagtttggaaatacccatcgctgacccaggttgccaagctgacaggccatagttaccgagtgttgtacctggctatgtcaccggatggagaggcaatagtgactggagctggcgacgaaaccctgagattttggaatgtgttttccaagacccggagtacaaaagtcaaatgggagagtgtttctgttctcaatctattcacaaggatcaggtag

SEQ ID NO: 29466 - DNA, 390 bp, Artificial Sequence
  Description of Artificial Sequence: Synthetic coding sequence
atggccgagttaatacagaaaaaattgcaaggagaggtcgagaaataccaacagctgcaaaaggatttgtccaaatcaatgagcggccgtcagaagctggaggctcagctgacggagaacaacattgttaaagaagagttggcattgctggatggatccaacgtggtcttcaagcttctgggccctgtgctagtcaaacaagagctgggagaagccagggcgaccgtgggaaaacgactggactatataactgcagaaattaaaaggtatgaaagtcaactgcgagatctggaacgccagtccgagcaacagcgcgagacgttggcccagctgcagcaggagttccagagggctcaggccgcaaaggccggagcccctggaaaggcatag

SEQ ID NO: 29467 - DNA, 888 bp, Artificial Sequence
  Description of Artificial Sequence: Synthetic coding sequence
atggagctaattcaggacacatctcgcccaccacttgaatacgttaagggcgttccactgattaagtacttcgcagaggccctcgggcctctccaatcctttcaggcccgtcctgacgatctgctgattaatacctatcctaagagtggtacaacgtgggtttctcaaatcctggacatgatctatcagggaggggatctggaaaagtgcaatcgcgctcccatatatgtgagagttccatttttagaggtgaacgaccccggtgagccgtctggcctagaaacacttaaggatacccctcccccaagactgattaagtcccaccttccactcgcgctactgccccagactcttctcgaccagaaggtgaaagtcgtttacgttgctcggaatcctaaggacgtggccgtgtcttattatcattttcatagaatggagaaagcacatcctgagcccggtacctgggatagcttcctagagaagttcatggccggtgaagtgagctacggtagctggtaccagcatgtgcaggagtggtgggaattgagtagaactcaccccgttctgtatttgttctacgaggacatgaaggagaacccgaaacgtgagatccagaaaattctcgaattcgtcggaaggagtctgccagaggaaaccatggactttatggtccagcacacctcttttaaggagatgaaaaaaaacccgatgacaaattacacaaccgttccacaggagctgatggaccacagcatttccccattcatgcgtaagggcatggcaggcgactggaaaactaccttcactgtagctcagaacgagaggtttgatgccgactacgcggagaaaatggctggatgctcattgtcctttaggagcgagttgtag

SEQ ID NO: 29468 - DNA, 888 bp, Artificial Sequence
  Description of Artificial Sequence: Synthetic coding sequence
atggagcttatccaagacacctcacgccctcctcttgagtatgttaagggggttccattaataaaatactttgcagaggccttgggcccacttcagtcattccaggcacgaccagatgacctcctgatcaatacttatccgaaaagcggaaccacatgggtgtcccagatcctggatatgatctatcagggtggagatctcgagaagtgcaacagagccccaatttacgtcagggtgccatttttagaagtgaacgatcccggagagcctagtgggctcgagacactaaaagacacacctccgcctaggctcatcaagtcccatttgcctctggccctgctgccgcagacccttttagaccaaaaggtaaaagtagtttacgttgcacgaaaccctaaggacgtggccgtgtcttactaccacttccatcgcatggagaaggcccaccccgagcccggtacatgggacagcttcctggagaagtttatggccggagaagtgagctacggaagctggtaccaacatgttcaggagtggtgggagttgtccagaactcaccccgtcctgtacttgttttacgaggatatgaaagaaaatcccaagagggagattcagaagattctggagtttgtgggtaggtctctccccgaagagactatggacttcatggtccagcacacctccttcaaggagatgaagaagaacccaatgaccaactataccacagtgcctcaggagctcatggatcattccatctcacctttcatgagaaagggcatggccggagactggaagacaacctttacagttgcccaaaacgagcgcttcgacgctgattatgcagaaaaaatggcagggtgcagcttgtcatttaggtcggagttgtag

SEQ ID NO: 29469 - DNA, 354 bp, Artificial Sequence
  Description of Artificial Sequence: Synthetic coding sequence
atgctctgctgggggaatgcttccttcgggcaactgggtctcggcggaatcgacgaggaaatagtgcttgagccaagaaagagcgattttttcatcaataagcgagtgcgcgatgttggatgtggtttgcgacatacagtgttcgtgttggacgatggtactgtttatacgtgtggttgcaatgacttggggcagctaggccatgaaaagagccggaaaaaaccggaaattctgaaggtttgccagatcagcagattataccgcctgcttgtcgtcaccattatccatttgcacttcctaaagcaagttaaatcatcagtgggagacaggatcaacatggccaattgggtgtag

SEQ ID NO: 29470 - DNA, 3174 bp, Artificial Sequence
  Description of Artificial Sequence: Synthetic coding sequence
atgctgtgttggggcaatgcctcctttggccagttaggacttggaggtattgacgaggagattgtcctggagccacggaaatcagacttcttcattaataagcgggtgagggatgtcgggtgtggccttagacacaccgtgtttgtattggacgatggcacagtctatacttgcggctgtaacgatctgggccagctgggacatgagaagagccgaaaaaaacctgagcaggtggtcgcacttgatgcccagaacatcgtggctgtatcgtgcggcgaggcccacactctggccctaaatgataagggccaggtttacgcctggggtctggatagcgatgggcagcttggcctcgtaggctccgaggaatgtatccgcgtcccgcgtaacataaagagcttatccgacatccagattgtacaggtggcgtgtgggtactatcatagcctggcacttagcaaggcaagcgaagttttctgttggggccagaacaagtatggccagctcgggttgggcacagattgtaagaagcagacatccccacagctgcttaagagcttgttgggcattcccttcatgcaggttgctgcaggaggcgctcactcttttgtgctaacactgagcggggcaatttttggttgggggaggaacaagttcggccagctgggcctgaatgacgagaatgacagatatgttcctaacctgctcaagtctctcaggtctcagaagattgtgtacatctgctgcggcgaggaccacaccgcagccctcactaaagaaggtggggttttcacatttggcgcagggggatatgggcagttggggcacaattctacttctcacgagatcaatccacggaaagtgtttgagctgatgggctcaatagttacagaaatagcctgcggcagacagcacacctcggcctttgtgccgtccagtggtagaatttattctttcggcctaggcggtaatggacagctcgggactggctctacctcaaacaggaagagcccgttcactgtaaaaggcaactggtacccttacaatggacaatgtttgccggatatcgatagcgaggagtatttttgtgtcaagaggattttctcagggggagaccagtccttcagccactattcatcgcctcagaattgcggccctcccgacgattttcggtgccctaatccaactaagcaaatttggaccgtgaacgaggctctgatccagaaatggctgagctacccatcaggcaggttcccggtggagatcgcaaacgagatcgacggaaccttttcctccagcgggtgcctgaacggctctttccttgcagtttccaacgacgaccactaccgaaccgggacaagattttccggcgtcgacatgaatgccgctaggctgctgttccacaagctcatccagccggaccacccccaaatctctcaacaggtcgcagcaagtctcgaaaaaaatctgattcctaagctgacctcgagtttaccggacgtagaggccctcaggttttatctgaccctacccgagtgccccctaatgagcgatagtaacaatttcaccacaatcgccattcctttcgggacagccctcgtcaatcttgagaaggcgccactaaaggtgctcgaaaactggtggagcgtcctcgagcctcctctgtttctgaagattgttgagctttttaaagaggtggtggtccacctcctcaaactgtataagatcggcattcccccatcagaaaggcgaattttcaattccttcctccatacagccctcaaagtactcgagattctgcatcgggtgaatgagaaaatgggtcagatcatccagtacgataagttttatattcacgaggtccaggaactgattgatatacgtaatgattatatcaactgggtccagcagcaggcttatgggatggacgtcaatcacggattgaccgagcttgccgatatccctgtcacaatttgcacctaccccttcgttttcgatgctcaggctaagacgactctgttgcagacggacgctgttctccagatgcagatggcaatagatcaggcccataggcagaatgtttcttctctgttcttgcctgttattgagtcagtcaatccatgtcttatcctggtcgtacggagagaaaacattgttggggacgccatggaggtactgaggaaaacgaagaacatcgactataagaaacccctgaaggtgatctttgtgggggaggatgccgtggacgccggaggagtgcgcaaagagtttttcttgctcatcatgagagaactcctggaccccaagtatggcatgttcagatattatgaggatagtcgactgatctggtttagcgacaagacattcgaggactccgacctgtttcatctaatcggcgtcatttgcggactggccatctacaactgcaccatcgtcgacttgcacttccctctggccttgtataaaaagcttctcaagaaaaaaccctcgctggatgatctaaaggagcttatgcctgacgtagggagatctatgcagcagctgctcgactatccagaggacgacatcgaggagaccttctgcctgaattttactattacagttgagaattttggagctaccgaggtcaaagaactggtattgaacggcgcagacacagcagtgaataagcagaatagacaggagtttgtggacgcatacgtggactatattttcaacaagtccgtggcttcactgttcgacgcctttcacgcaggctttcacaaggtatgcggcggaaaagtgttattgctgttccagcccaacgaattacaggcgatggtgattgggaataccaattacgactggaaggagctggaaaaaaatactgaatacaagggagagtactgggcggaacatcccaccatcaaaatattttgggaagtgttccatgaactgcccctggagaagaagaaacagttccttctgttcctcacaggaagtgataggatccctattttaggcatgaagtcactgaaactggtcatccagagcacaggtggcggagaagagtatttgccagtgtcccacacttgctttaaccttctcgatctcccgaaatataccgagaaggagacgctgcgcagcaagctgatccaggctatagaccataacgaaggcttctctctgatctag

SEQ ID NO: 29471 - DNA, 1080 bp, Artificial Sequence
  Description of Artificial Sequence: Synthetic coding sequence
atgtcataccgccgagagctcgaaaaataccgcgacctagacgaagacgaaattttgggcgctctgaccgaggaggaacttcgcactctcgaaaacgagctggatgaactcgacccggacaacgcacttttacctgcagggcttcgccagaaggatcagaccactaaagctcccaccggcccattcaaaagggaggaactcctggatcatttggaaaagcaagcaaaggaatttaaagaccgcgaagatctggtcccctataccggtgagaagcggggtaaagtatgggtcccaaagcagaagccattggaccccgtgctggaaagcgtgacgttggaaccagaactggaggaagctctggctaatgctagtgacgcagagctgtgtgatattgccgctatcctaggcatgcacaccctgatgtctaatcaacagtactatcaggccctgagctctagtagcataatgaacaaagaaggactgaactccgtgataaagcccacacaatacaaaccagttcctgacgaggagcccaattccactgatgttgaagaaacattagaaagaatcaagaacaatgacccaaaacttgaagaagtgaaccttaacaacattagaaatatacccatacccacgcttaaggcttacgccgaagctctcaaggagaactcatatgttaaaaagtttagcatcgtggggacccggtccaatgatccagtggcttacgctctcgcggagatgttgaaagagaataaagtactaaagacacttaacgtcgagtccaatttcatttctggcgcagggatcctgcgtctggtggaggctctcccttataatacaagcctggtggagatgaagatcgataaccagagtcagcctctgggcaataaggtggaaatggagattgtcagcatgcttgaaaaaaatgctactctgttgaaatttggctatcattttacacagcaaggaccccgactacgggcttccaacgccatgatgaataacaatgatctggtaagaaaacgacgtctggcagacttgaccggacccattatcccaaagtgtcgatccggtgtctag

SEQ ID NO: 29472 - DNA, 714 bp, Artificial Sequence
  Description of Artificial Sequence: Synthetic coding sequence
atggaagtcatggagggtccgcttaatctcgctcaccagcagtcaagacgagctgaccgattgctggcagctgggaaatacgaggaagcgatttcatgtcataaaaaggcagcggcatacttatctgaggcaatgaagctgactcagtcagagcaggcacacctcagccttgagctacagagggactctcacatgaaacagctgctgctcattcaggaaaggtggaaacgcgcacaaagggaggagaggctgaaggctcaacagaatactgtcctgtacctgctccaacagaagtccgagccggctgagccctgtattggctcgaaggcgccaaaagacgacaaaaccatcattgaagagcaggcgactaagatcgcagacctgaaacgacacgtggagttcctggtagcagagaacgagagactgcggaaagaaaacaagcaactgaaagcggaaaaggcaagactcttgaagggcccaattgagaaggaactggacgtggacgccgattttgtggaaacgtcagagttgtggagcttgccaccacacgcggaaacagccaccgcttcatctacatggcagaaattcgcagccaataccggaaaagctaaggatatccccattcctaacttgcctccattagattttccaagccctgaactccctctgatggagcttagtgaagatatactgaaagggttcatgaataactag

SEQ ID NO: 29473 - DNA, 1458 bp, Artificial Sequence
  Description of Artificial Sequence: Synthetic coding sequence
atgaatgggacgttggaccaccctgatcagccagatctcgacgccattaaaatgttcgtgggacaggtaccccgaacatggagcgaaaaagatttacgcgaactcttcgagcagtacggggctgtgtacgagattaatgtcctcagggatcggtcccaaaacccccctcagagcaaaggctgctgctttgtcaccttctacactagaaaggccgctttagaagctcaaaacgccctccacaacatgaaggtgttgcctgggatgcatcaccctatccagatgaaaccggcagattctgaaaagaataatgtagaagaccgaaagctgtttatcggtatgatatcaaagaagtgtactgagaacgatatcagagtgatgttctccagcttcggtcaaatcgaggaatgccgcatccttagagggcctgatggtctgtcccgaggatgcgcttttgtaacgttcaccacacgagcaatggcccagactgcgatcaaagctatgcaccaggcccagacaatggaagggtgtagctcacccatggtcgttaagttcgctgacacgcagaaggacaaggagcagaagcgaatggcccagcagttgcagcagcagatgcagcagattagtgccgcaagtgtgtggggcaatctggcaggactgaacacactaggcccacagtatttggctctgtatttacagctgctccaacagactgctagctcaggcaatctaaacacactctcttctctgcatccaatggggggactaaacgccatgcagttgcagaatctggccgctctcgctgcggctgcgtccgctgctcagaatacgccttcgggtacaaacgcactaacgacttctagctccccactgtcggtacttacatccagtggcagctctccaagcagctccagctcaaatagcgttaacccgatcgcctccctaggggcactgcagaccctcgctggggctaccgcaggtctgaatgtcggcagtctggctgggatggctgcacttaatggaggcctgggatcatctggcttatcaaatggtacgggctcaaccatggaagccctcacgcaggcatatagtgggatccaacaatatgctgccgctgccttacctaccctgtataatcaaaatctgctcactcagcagagcataggtgccgctgggagccagaaagagggacccgagggagccaacctctttatctatcacctgcctcaggaattcggtgatcaggatctcttacagatgttcatgcccttcggaaatgtggtgtcggctaaagtgttcatcgacaagcagaccaatttatcaaaatgtttcggttttgtttcatacgacaaccctgttagcgcccaggcagctattcagagcatgaacggatttcagatcggcatgaagcgacttaaagtccagcttaagagaagcaaaaacgactccaaaccatactag

SEQ ID NO: 29474 - DNA, 1452 bp, Artificial Sequence
  Description of Artificial Sequence: Synthetic coding sequence
atgaacgggacgctcgatcatcctgaccaacctgacctggatgccattaaaatgtttgtggggcaagtgccaagaacttggtccgaaaaagacttgcgcgagctgttcgagcaatatggtgccgtgtatgagatcaacgttcttagggaccgttcacagaatccaccgcagagcaaaggttgctgtttcgtgaccttctacactcggaaggctgcgctagaggctcaaaacgcccttcacaatatgaaagtgcttcctgggatgcaccacccaatccaaatgaagcctgcagacagtgaaaagaataatgcggtcgaggatcgaaaactctttatcggcatgatcagcaaaaagtgtactgaaaacgacatcagagtcatgtttagctcttttgggcagatcgaggagtgtcgaattctgagggggcctgatggactcagccggggatgcgcttttgttactttcaccacccgcgcaatggcccagacagccatcaaggccatgcatcaggctcaaactatggagggttgttcatctcctatggtggtgaaatttgccgatactcagaaggataaggagcaaaagcgcatggcccaacaactccagcagcaaatgcaacagatttcagccgctagtgtgtggggcaaccttgctggccttaacactctgggaccgcaatatttggccttgctgcagcagaccgcgtcatccggcaacttgaacacactcagctctcttcaccctatgggcggtctgaacgccatgcagctgcagaacctagctgcacttgctgctgcagcctcggctgcccagaatacgccaagtggcacaaatgccctgaccacgtccagcagccctctgagtgtgcttacatctagcgccggaagtagccccagtagcagctcctctaatagcgtcaatccgatcgctagtttgggcgcactgcagacactggccggagctaccgcagggctgaacgtgggctccctggccggaatggcagctctgaacggcggtcttggatctagcggactcagtaatggaaccggctcaactatggaggcactgactcaagcctattctggcatccagcagtacgcggcagctgcacttccaaccctctacaatcaaaacctcctgacccagcagagcattggggctgctgggtcgcagaaagaagggcctgaaggcgctaacctcttcatctatcatctgcctcaggaatttggggaccaagacctccttcagatgttcatgcctttcgggaacgtcgtgtccgcaaaagtgttcattgataagcagaccaacctatctaaatgtttcggctttgtgagttatgacaacccagtgtctgcacaggccgctatccagagcatgaatggctttcagattgggatgaagcgtttgaaagtgcaactgaagcgaagcaagaacgacagcaagccatactag

SEQ ID NO: 29475 - DNA, 3570 bp, Artificial Sequence
  Description of Artificial Sequence: Synthetic coding sequence
atggacgacaaaggggatcccagtaacgaggaggctccaaaggccattaaacccactagcaaagaatttaggaagacctggggtttccggagaactacgattgccaagcgagagggtgccggagatgccgaagccgaccccttagaaccccctcctccccagcagcaactcggcctgtctctccggaggtcaggtcggcaacctaagaggactgagagggtagagcagttcctgacgatagctagaaggagggggaggcggagtatgccagtgtcgttggaagattccggagagccaacctcctgccctgccactgatgcagaaacagcgagcgagggaagtgtggagtcagcttctgagaccaggagcggccctcagtctgcttctaccgccgtgaaggaacggcctgcctctagcgagaaggtgaagggtggcgacgatcacgacgacacctcagatagtgactcagatggtttgacactgaaagaactccagaaccgcctgaggcgcaagagggaacaagagcccaccgaaaggcccctgaaaggcattcagtctcggctgagaaagaaaaggcgagaggaaggtccagccgaaacagtcgggagcgaggctagcgacaccgtcgaaggcgtgttgccaagcaagcaggaacccgaaaatgatcagggggtggtgtcccaggccggaaaagatgatcgggagtcaaagctggaaggtaaagccgctcaagacataaaagatgaggaacccggtgaccttgggagaccgaaacctgagtgcgaggggtatgaccccaacgctctttactgcatttgccgacagccccacaataatcgatttatgatatgctgcgaccgctgtgaggaatggttccatggcgactgcgtgggaatcagtgaggcgagaggcaggctcctggagagaaatggtgaggattacatctgtccaaattgtaccatcctgcaggtgcaagatgagacacatagtgaaacagctgaccaacaagaggctaagtggcgcccaggtgatgcggatggcacagactgcaccagcatcggtacaatcgagcaaaaaagctctgaggaccagggaataaagggcagaatcgagaaggccgctaacccctcaggtaagaaaaagctgaagatcttccagccagtgattgaggcacccggagcctccaaatgtataggaccaggctgttgccatgtcgcccagcccgattctgtttactgtagcaacgactgtatcttaaagcacgccgcagcgacaatgaagttcttgtcctcagggaaggaacagaagccgaaaccaaaggaaaaaatgaagatgaagcctgagaagccatccttgcctaagtgtggagctcaagctgggattaaaatatccagtgtgcacaaaaggcccgctcctgaaaaaaaagagacaaccgtaaagaaggccgtcgtcgtccctgccagaagcgaagcccttgggaaggaagcggcttgcgaatcatcgacacccagctgggcaagcgatcataattataacgctgtgaagccagagaagacagccgcaccatcaccatcacttctctacaaatctaccaaggaagaccggcgatcagaggagaaggccgctgccatggccgcaagcaaaaagacggctccgccaggcagcgctgttggtaagcagccggctcccaggaacttggtccccaagaaaagtagtttcgctaatgttgccgctgcaacccccgctataaagaaacccccttctggattcaaaggaaccatcccaaagagaccttggctctcagcaactccatcatctggcgcaagcgctgcccgacaggctggaccggctccagccgcagctaccgcagcctcaaaaaagtttccaggcagcgcagccttggtaggtgctgtccgcaagcctgtggtgccaagcgtgccaatggcatcccccgctcccggacgacttggtgccatgtctgctgctccctcacaaccaaacagtcaaattcggcagaacatccggagaagcttaaaggaaattctgtggaagcgggtgaatgactccgatgacctgatcatgaccgaaaacgaagttggaaaaatcgccttgcatattgagaaggagatgttcaacttgtttcaggtgactgataataggtacaaaagcaagtatcgaagcattatgtttaacctcaaagaccccaaaaatcagggcctgtttcatcgtgtccttcgagaagagatcagcctggctaaactggtgcgtcttaagcccgaagaactggtcagcaaggagctgtctacgtggaaggaaaggcccgcacgatccgtgatggaatctaggaccaaattgcataacgaatcgaagaaaacagccccacggcaagaggcaataccggatttggaggactctccccctgtgtccgattctgaagagcagcaagaatccgcccgagcagtgcccgagaaatcaactgcgccactcctggacgtcttttctagtatgttaaaggatactacatctcagcaccgagcccacctgtttgacttaaattgcaagatatgtaccggacaggttccaagcgccgaggacgagcccgctccaaagaagcagaagttaagcgctagtgtgaaaaaggaagacctgaaaagtaagcatgatagcagtgcccctgacccagcccctgactctgcagacgaagttatgcccgaggcagtgcctgaagtcgcttccgaacccggactggaatcagctagtcaccctaatgttgaccggacctacttccccggtcctcctggggatgggcaccctgagccttcacctctggaggatctcagcccatgcccagcgtcatgtgggagcggggttgtgacgacggtgacggtttccggacgggacccacgcacggctcctagttcttcatgcaccgctgtagcctcagctgcgtcgagaccggacagtactcacatggttgaggctaggcaggatgtgcccaaacctgtgcttacgagcgtgatggtgcccaagagcatactcgcaaagccctctagttccccagaccctcggtatctgagtgttcccccttcccccaatatatctaccagcgagtctcgcagtccaccagagggcgacactacattgtttctgagcaggctcagtactatttggaaggggtttatcaacatgcagtccgttgccaagtttgtaactaaggcctatcccgtctccggatgtttcgactatctgtccgaagacttgcctgataccattcacattggtggacgcatcgccccaaaaacagtgtgggactatgtgggcaagctgaagtccagcgtgtccaaagaactctgtttaatcaggttccacccagctaccgaggaggaggaggttgcatatattagtctgtacagttatttcagtagtagggggagatttggcgtcgtcgctaacaacaatcgacatgtcaaggacctctacctgatccctttaagcgcccaagaccccgtgccctccaagttactccctttcgagggccctggtaagcgcagactatccggctggcgctag

SEQ ID NO: 29476 - DNA, 3570 bp, Artificial Sequence
  Description of Artificial Sequence: Synthetic coding sequence
atggacgacaaaggggatcccagcaatgaggaggccccaaaagccattaagccgacctcaaaggagttcaggaaaacctggggcttcagaagaacgaccatcgccaaaagagaaggcgcaggggacgctgaagctgacccgttggaaccacctcctccgcagcagcaacttggacttagtctgaggagatctggcaggcaacctaagcgcacagagagagttgagcaattcttaactattgcgagacggaggggacgcagaagcatgcctgtatcactggaagactccggagagcctacctcctgcccggctacagacgccgagaccgccagcgaaggtagtgtcgaatccgcctctgagaccagatccgggcctcagagtgccagtacagctgtaaaggagcgacctgcgtcatctgagaaagtgaagggcggagacgatcacgacgatacgtctgacagtgacagcgatggcttaacattaaaggaactgcaaaataggctgcgacgaaagcgcgaacaggagccaaccgagagacccctgaagggaatccaatcgcgactgcggaagaagagaagagaagaaggtcccgcagagaccgtggggtctgaggcctctgatacggtggaaggagtgctacctagtaagcaggaacccgagaacgatcagggggttgtgagccaggcgggaaaggacgaccgagagtcgaaactcgaggggaaagccgcacaggacattaaggacgaagagcccggtgacctgggtcggcctaaacccgagtgtgaggggtatgaccccaacgctctgtactgcatatgtagacagccccacaataatcgctttatgatttgctgcgaccgttgcgaggagtggtttcacggggactgcgtgggcatatccgaagccaggggtaggctgctggaaagaaacggagaagattacatctgtcccaactgtaccattttgcaggtccaggatgagactcactctgagaccgccgaccagcaggaagctaagtggaggccaggggacgctgatggcacagattgtaccagtattgggaccatcgaacagaagagcagcgaggaccagggcattaagggacggatcgaaaaggctgcaaatccgtcaggcaagaaaaagctgaaaatcttccaacccgtcatcgaagcccctggagcttccaagtgcatagggccaggttgctgtcatgtggctcaaccagactctgtctactgtagcaacgattgcatcctgaaacacgctgctgcgacaatgaagttcctgagctccggcaaagagcagaaaccgaaacccaaagaaaagatgaagatgaaaccagaaaaaccctctctccccaaatgcggggctcaggccggaattaagataagtagcgtgcacaagcgccctgcccctgagaagaaggagactacagtgaaaaaggctgttgtagtgcctgctcgttcagaagctttgggaaaggaagcagcttgtgagagctctacaccatcttgggcaagcgatcacaattataacgcggtgaagccagaaaagaccgcggctccatctcccagtctcctgtataaatctactaaggaagaccgcaggagcgaagagaaagctgcggcaatggccgcttctaaaaaaactgccccaccgggtagcgcagtgggtaagcaacccgctccccgaaacttagttcccaagaagagcagcttcgcgaacgtggccgcagccacccccgcaatcaagaagccacccagtggtttcaaaggcacaatacccaagcgcccatggctgtcagctacaccctcatcaggtgcctctgcagccagacaagcgggacccgctcccgctgcagccaccgctgcctccaagaagttccctggaagtgccgctctggtgggagctgtgaggaagccagtggtgccatcagtgcctatggcaagccccgctcctggtcggctcggggcaatgagcgccgctcctagccagcctaatagtcaaatcagacagaacattaggcgcagccttaaggagattttatggaaacgcgttaatgatagcgatgatcttataatgaccgagaacgaggtcggaaagatcgctctccatatagagaaggagatgtttaacctattccaagtgacggacaatagatacaaaagcaaataccgcagtatcatgttcaatctgaaagatcctaagaatcaggggttgtttcacagggtgctacgggaagagattagtctcgcaaagttggtgaggctgaagcctgaggaactggtgagcaaagagctgtccacctggaaggagcggccagcaagaagcgttatggagagcagaaccaagctgcacaatgagtccaagaaaacagccccacggcaggaagctataccagatcttgaggattcgcctcctgtctccgattccgaggagcaacaggagtctgcgagagcagtccctgaaaagtccacagctccacttctggatgttttcagcagcatgctgaaggatactaccagtcaacatcgggctcacctctttgatttgaattgtaagatctgcacaggccaggtgccctcggccgaggatgaacctgccccaaagaagcagaagttgagcgcgagcgtgaagaaggaagatctgaagagcaagcacgattcctcagcgccagaccccgcacccgattcagcggacgaggttatgcccgaggctgtcccagaagtagcgagcgaacctgggctcgagtctgcttctcacccaaacgtcgaccgtacttattttccagggccaccgggtgacggccaccccgaaccttctcccctggaggacctctcgccatgcccagcatcctgcgggtctggcgtcgtgacgacagtgactgtctctgggagggaccccaggacagctccttcttcctcatgcaccgccgtggcaagtgccgcatcccgacctgacagtacccacatggtggaggctcggcaggatgtgccaaaacccgtgctgacatctgtcatggtgccaaaaagtatcctggcaaaacctagctcatcaccggatcccaggtaccttagcgttcctccaagtcccaatatttcaacatctgagagtagatctccacctgaaggagataccacgctgttcctttcccgcctgagtacaatctggaagggcttcattaatatgcagtctgtcgctaagttcgtgacaaaagcctaccctgtgtctggctgttttgattacctctctgaggaccttccagacactattcacattgggggaagaatagccccaaagaccgtgtgggactacgtgggcaagctgaaatcttcagtctctaaagaattgtgcctgattaggttccatccggctaccgaggaggaggaagtagcatacattagtctgtatagttatttttcatcacggggtagatttggcgtagtggctaacaataatcgtcacgtgaaggatctgtacctgatccccctcagcgcgcaggaccccgtaccctctaaactcctgccattcgagggtcccggtaaaagacggctgagcggatggaggtag

SEQ ID NO: 29477 - DNA, 6722 bp, Artificial Sequence
  Description of Artificial Sequence: Synthetic coding sequence
atggatgacaagggtgatccctccaatgaagaagcacccaaagccatcaagccaaccagcaaagaattcagaaagacttggggttttcggaggacaacaatcgctaagagagaaggtgccggagacgcagaggcagacccactcgaaccccctcccccacaacaacaattagggctaagtctccgcaggtcagggaggcagccgaagagaacggaacgggttgaacagttcttgaccatcgccagacgccgaggaaggcgaagcatgcctgtgagcctggaggacagtggcgagcccacaagctgccccgctactgatgctgagaccgcttcagagggcagtgtcgagtccgcatccgaaaccagatcaggcccacaatcagccagcacagccgtgaaagagcgccctgccagcagtgagaaggtgaaaggcggagacgaccacgatgacacttctgattcagactccgacggcctcacgctgaaggaattgcagaacagattaagacgcaaaagggagcaggagccaaccgaacggccattaaaaggcatccaatctcgcctgcgcaagaagaggcgcgaagaaggaccagctgaaaccgtgggttctgaggcttccgataccgtggagggagtgctcccaagcaagcaggaacctgaaaatgaccagggagtggttagccaagccggaaaggatgaccgagaatcaaagcttgaggggaaggctgcccaggacatcaaggatgaggaaccaggcgatctgggacgccctaagcctgaatgcgaggggtatgatcctaacgcactgtattgtatctgccggcagcctcataacaatcggtttatgatctgctgcgatcggtgcgaggagtggtttcacggcgactgtgttggtatatcagaagccaggggcaggctccttgaacgaaacggagaagactacatatgcccaaattgtacaattctgcaagtgcaggatgagacccatagtgagaccgcggaccagcaggaggcaaagtggagacctggcgatgccgatgggaccgactgcacatcaataggtaccatcgagcagaaatcgagcgaagatcagggaatcaaaggccgaatcgagaaggccgctaacccctcggggaagaagaaacttaagatattccagccagtgatagaagcccctggagcatccaagtgcatagggcctgggtgctgtcacgtggcacaacctgacagcgtgtactgctcaaacgattgcatcttgaaacacgccgcagcaacaatgaaattcttatcatctggaaaggaacagaagcccaagccaaaggaaaagatgaaaatgaagccggagaagccatcacttccgaagtgtggtgcacaggctggcatcaagatatcttccgtacataaaagaccggctcctgagaagaaggaaacaaccgttaagaaggccgtcgtcgtccccgcacgtagcgaagctctggggaaggaggcagcttgtgagtccagcaccccgtcttgggcctcagaccacaattacaacgcggtaaaacctgagaaaactgcagcgccaagcccctcactcctgtacaaatcgacaaaagaagaccgcaggagcgaggagaaggccgctgcaatggctgcgagcaagaagaccgcaccccctggatcagccgtgggaaaacagcccgctccccgtaacctggtaccaaagaaaagctcctttgctaatgtcgccgctgcgaccccagctattaaaaagcctcctagcgggttcaaagggacaatccctaagcgcccatggctcagcgctaccccatcgagcggagcttccgcagcccgacaggcagggcctgcccctgccgctgcaaccgccgcttcaaaaaaattcccagggtccgctgctctggtcggcgctgtcagaaagccagtggtgccaagtgtgccaatggcatcacctgcacccggtaggcttggcgcaatgtcagctgccccaagtcagccaaactctcagatccgtcagaacataaggcggtccctcaaagagatactgtggaagcgcgtcaatgacagcgacgatcttatcatgacagagaacgaagttggcaaaatcgcccttcacatcgaaaaagagatgttcaatctctttcaggtgaccgataacaggtacaaatctaagtaccgttctatcatgttcaatctgaaagatcccaaaaaccaaggtctctttcaccgggtgctccgcgaggaaatctcgttagcaaagctggtacgcctaaagccggaagaactggtgtccaaggaactttcaacatggaaggagcgaccagctagaagcgtaatggaaagcagaaccaagctgcataacgagtcaaagaagaccgcgcctcggcaggaggctatccccgacctggaagattcccccccagtgtcagatagcgaagagcaacaggaaagcgctcgggctgtgcctgagaagagcaccgcccctctgctggacgtgttttctagcatgttgaaggataccacatcccagcatagggcgcatttgtttgaccttaactgcaagatctgcacaggccaggtgccctccgcggaggacgaacccgcacccaagaagcagaagctgagcgcctccgtcaaaaaggaagatttgaagtccaagcacgattcatctgcccctgatcctgcccctgattccgcagatgaagtcatgcctgaggcagtgccagaagttgcctccgaaccgggtctggagtccgccagccaccctaatgtggaccgaacttattttcccggacctcccggtgacggccatcccgagccttccccccttgaggatctctccccctgtcctgcgagttgtggttctggagtagtgaccaccgtgactgtctccggccgagatccacgcactgctccgagtagcagctgcacagcagtcgcatcagctgctagccgacccgatagtacacatatggtcgaagctaggcaggacgtcccaaagcctgtcctgacatcggtgatggtgccaaagagtatcctcgccaaaccctcctcttctccagaccctcggtacttatccgtccccccaagccctaatatttccaccagcgaaagccgttctccacccgaaggggatactaccctctttcttagccgactgagtacgatttggaaaggcttcatcaacatgcagagtgttgccaaattcgtcactaaggcctaccctgtcagcgggtgtttcgactatctctccgaagacctgcctgatactattcacataggtggacgcattgcacccaaaaccgtctgggactacgtcggcaagctgaagtcaagcgtcagcaaggaactctgcttaataagattccaccctgccacagaggaggaggaggtggcttacatcagtttatattcctacttctcttcgcgcggtagatttggagtggtggctaataataataggcacgtaaaagatctgtacctgattcccctctccgctcaggatcctgtgccatctaagttgttgccgttcgagggacctggactcgaaagccccaggccaaacatcatactcggactggttatttgtcaaaaaatcaagaggccagcgaattccggtgagctggataaaatggacgagaagcggacgcgtcttcagccagaggaagcggacgtaccggcatacccgaaggtcgccacagtaccccagtctgagaagaagcctagtaaataccccctgtgttcagctgacgccgcagtgtctaccactcccccaggtagtccccctccaccacccccactccctgagcctccagtgctaaaggttttaagttccctcaagcccgctgctccttcacccgctactgctgccactactgccgcagcggcaagcacggccgcaagctcaacagcctcctccgcttccaagaccgcaagcccactggagcatattctgcagacactgttcggtaaaaaaaagtcatttgatcccagcgcgagggagccaccgggaagtactgccggactgcctcaggagcctaagaccactgcagaggacggggtgcccgcacctcctctactcgaccccattgtacagcaattcgggcagttttcaaaagataaggcactggaggaggaagaagacgacaggccatacgatcccgaggaggaatatgacccagagcgggcattcgatacccaactagtggagagagggcgacggcatgaagtggagcgggcacctgaagcagctgcggctgaaagagaagaggttgcttatgatcccgaggatgaaaccattcttgaagaagccaaagtgacggtcgatgaccttcctaatcgcatgtgcgctgacgtgaggcgcaattctgtggagcgacctgccgagcccgtagccggagccgcaacccctagccttgtggagcaacagaaaatgctcgaggaattaaataaacagatagaggaacagaaaaggcagctggaagagcaagaagaggcattgaggcaacagcgggctgccgtgggcgtttcaatggcccacttctccgtgtccgacgcattaatgagcccgccaccaaagtcttcccttcctaaggccgaactctttcagcaagaacagcagagtgcagataaacccgctagtttgcctcccgctagccaggcttctaaccatcgcgatccccgtcaggcccgacgcctggcaacagagacaggtgagggcgagggcgagcccctgagccggttatcagccaggggggctcagggagcattgcccgaacgggatgcaagtagaggaggcctcgtcggacaggcccctatgcctgttcccgaggaaaaggaacctgcctcaagcccgtgggcctctggcgaaaaaccccctgccggtagcgagcaggatggctggaaagccgaacccggtgaagggaccaggccagccacagtgggcgacagctccgcgaggccagcaagacgagtgctattgccgactcccccatgtggcgctttacaacccggatttccgctgcagcacgacggtgaaagagatccctttacttgcccaggttttgcctcccaggataaggcgctggggagcgcgcaatacgaggaccctcgaaatctacattctgcagggagaagctccagccctgccggtgagacggaaggcgatcgagagccccaagcacgtcccggtgaaggaacagcccctttacctccaccagggcagaaggtgggcggaagccagcccccatttcagggccaacgcgagcctgggcctcatgccctgggcatgtctggactgcatggccctaactttccaggcccacgaggtccagccccaccgttccccgaggaaaacattgcaagcaatgacggccctcgcggtccacccccagcacggttcggggctcagaaaggtccgatcccttccttgttttcagggcagcacggtccccctccatatggagatagccgtgggccatccccctcatatctgggcggaccccgtggcgtagccccttcacagttcgaggaacggaaggacccccacggagaaaaacgcgagttccaagatgctccttacaacgaggtaacaggagcccctgcgcagtttgagggaacagagcaggctccctttctgggctctagaggtggggcaccctttcaatttggtggccagcgacgcccattgctgagccagctcaaaggacctcggggtgggcctccgccttcgcagtttggcggacagcggggtcctccaccaggacattttgtgggcccacggggtccccatccttctcagttcgagacggctagaggaccgcaccctaatcagttcgagggtccaagggggcaggctcccaatttcatgcccggacctcgcggaattcagccacagcagtttgaggaccagcgggtgcactccccaccgagatttacgaaccaacgggctcctgcccctctgcagttcggtggcctgcgcggaagtgctccttttagcgagaagaacgaacagaccccgtcacggttccactttcagggccaagctcctcaggtgatgaagccgggtccgagacccctattggagctccctagtcatccaccacaacaccgaaaggacagatgggaagaagccggacccccttcagctctgagtagtagtgcaccgggacaaggcccagaagccgacgggcagtgggcctcggccgactttagggagggcaagggacacgaatatcgaaatcagacctttgaagggcgtcagagagagcggtttgacgtgggacctaaagagaagccgctggaggaaccagatgcccagggtagagcctctgaggaccgtcgcagggagcgtgaacggggtaggaactggagtagagaacgcgactgggacaggccacgggaatgggaccggcatcgagacaaggatagctccagggattgggacagaaatagggagaggtccgcaaatcgagaccgggagcgcgaagcagatcggggaaaggagtgggatcggtcccgggaaagaagcagaaatagggagcgtgagagggatcggaggcgcgaccgggaccgctcgcgaagcagggaaagggaccgcgataaagccagagatcgcgagagggggagagaccggaaggacaggtctaagtctaaagagtctgctagagaccccaaaccagaagcaagcagagcctccgacgcagggaccgctagtcaggctta

SEQ ID NO: 29478 - DNA, 888 bp, Artificial Sequence
  Description of Artificial Sequence: Synthetic coding sequence
atggaactgattcaggatacctcccgtcccccactggaatatgttaagggtgtccctctgatcaaatacttcgccgaggccctcggccctctgcagtcgttccaggcacggcctgatgaccttttgattaacacgtaccccaagtcaggaacaacttgggttagccaaatcctagatatgatttaccaggggggagatctggagaagtgcaatagagctcctatttatgtccgtgttcccttcctggaggtcaacgacccaggtgagccatctggccttgagacacttaaagacaccccacctcctcgcctgataaagtcccacctgcccttggctttgctccctcaaaccctcctcgaccagaaggtgaaagtggtatatgttgcacggaatccgaaagacgtggcagtgtcgtactaccattttcatcgtatggagaaagctcacccggagccgggaacttgggatagtttcctcgagaaatttatggcaggagaagtcagttacgggtcttggtatcaacacgtgcaggaatggtgggaattgagccgaacccaccccgttctgtatctgttttatgaagacatgaaagaaaatcctaaacgagaaatccagaaaatcctagagtttgtgggacgcagcctgccggaggagaccatggacttcatggttcaacacaccagctttaaagagatgaagaagaacccaatgaccaactacaccaccgttcctcaggagctaatggatcacagtatttccccatttatgcggaagggcatggccggagactggaagaccacattcacagtggcccagaatgagcgttttgacgcggattatgccgaaaaaatggccggttgcagtctaagcttccgctcagagctttag

SEQ ID NO: 29479 - DNA, 834 bp, Artificial Sequence
  Description of Artificial Sequence: Synthetic coding sequence
atggaagctgctgagacggaagccgaggctgctgcactggaggtcctggcggaggttgccggtattttagagcctgtgggactgcaagaggaggctgagctgccagcaaaaatattggttgagttcgtcgtggatagccagaagaaggacaagctgctatgcagccagttgcaggtggcagactttctgcaaaatatcctcgcacaggaagacaccgccaaaggtctcgaccctctggccagcgaggatacgagccgacaaaaggcaattgctgccaaggagcagtggaaggagctgaaggctacgtacagagaacacgtggaggcaatcaaaatcggacttactaaggccctcacacagatggaggaagcccagcgtaaacggacccagctgagagaggccttcgagcagctgcaggcaaaaaagcagatggccatggagaagaggcgcgcagtgcaaaatcaatggcaactgcagcaggaaaagcatctccagcacctggcggaagtttcagcggaagtcagggaacgtaagactggcacacagcaggagcttgacagggtttttcagaagttggggaaccttaaacagcaggctgagcaagagcgggacaagctacaacgataccaaactttcctccagttactgtacaccctccaggggaaattgctgtttccagaggcggaagccgaagctgagaacctgccagatgacaagccccagcagcctacgcggcctcaagagcagtccaccggtgacacaatgggacgagatccaggtgtgtcttttaaagccgtgggtctgcaaccagcaggcgacgtcaacctgccatag

SEQ ID NO: 29480 - DNA, 1245 bp, Artificial Sequence
  Description of Artificial Sequence: Synthetic coding sequence
atggggaccgtcaccgaggatttgatcagaaggaacgctgagcacaacgactgtgtgatatttagtttggaagagctgagtctacatcagcaggagatcgaacgcctcgagcatatcgacaaatggtgtcgggatctgaaaatcctatatctgcagaacaacctgattggaaagattgagaacgtaagtaagttgaaaaaactggagtacctgaatttggcccttaataacatagagaaaatcgaaaacctggaaggatgcgaggagctggccaagctagacctgactgtaaactttattggagagttgtcctcaatcaaaaatcttcagcacaatattcacctgaaggagctttttttgatgggaaacccctgtgcaagcttcgatcactaccgcgagttcgtggtggccactctcccgcaactgaaatggcttgacggcaaggagatcgagccctctgagcggataaaggccctccaggactacagcgtgattgaaccgcagattcgggagcaggaaaaggaccactgcctaaaaagggctaaactgaaggaagaggcccaacgcaagcaccaggaggaggacaaaaatgaagataagcgatcgaacgccggattcgacggtcgctggtatacagacatcaacgcaactctgtcatcactagagtccaaagatcacttacaggcgcctgacacagaggagcataataccaaaaagttagacaatagcgaagacgacctcgagttttggaataagccctgccttttcacccccgaatcacggttggaaaccttgcgacatatggaaaagcaaagaaaaaaacaggagaaattgagcgagaagaagaagaaagtgaaacctcccagaacacttattaccgaagatggaaaggcacttaatgtaaacgagcccaaaattgatttctcacttaaggacaatgagaaacagattattctggacttggccgtctaccggtatatggacacgtccctgatagatgttgatgttcaaccaacttacgtccgggtgatgatcaaagggaagccattccagttggtcctgcctgccgaagtcaagcccgacagcagctcagccaagcgttcgcagactacagggcacctggtgatttgtatgcccaaagtaggcgaggtgattactgggggacagagagcctttaagtccatgaagaccactagcgatcggtccagggaacagaccaacacaagctatagcaccggcttttag

SEQ ID NO: 29481 - DNA, 2529 bp, Artificial Sequence
  Description of Artificial Sequence: Synthetic coding sequence
atgtcttcatcccactttgcaagcaggcaccgtaaagatatcagcactgaaatgatccggactaagatcgcccacaggaagtcattgtcccaaaaagagaataggcataaggaatacgagaggaatcgccactttggcttaaaggacgtgaatatacctacactggagggcaggattctcgtggagttagatgagaccagccagggcctggtgcctgagaagactaatgtcaagcctagagcgatgaaaacaattctgggagatcagcgcaagcagatgcttcagaagtataaagaggaaaagcagttgcagaagctcaaagagcaaagggagaaggctaaacgcggtatatttaaagtcggcagatacaggcctgacatgccgtgcttcttgctctctaaccagaacgcagtgaaggcggaacctaaaaaagcaattccctccagcgtgcggattacgaggtccaaagccaaggatcagatggagcagacgaagatcgataacgaatcagacgtccgtgcaatcaggcctggcccaagacaaacaagcgagaaaaaagtcagcgataaggagaagaaggtcgtccagccagtgatgcccacttcccttcgaatgaccagatcggccacacaagccgcaaagcaagtaccgaggactgtttcttcaaccacagctcgaaagccggttactagagccgctaacgaaaatgaaccagaagggaaagtgccctccaaaggtcggcctgctaagaatgtagaaacaaagccagataaagggatctcatgcaaagtcgattccgaggagaataccctgaactcccaaaccaacgctacctcaggcatgaatcccgacggggtcctgtcaaaaatggaaaacctccccgaaatcaacaccgctaagatcaaaggcaagaattcatttgcgcctaaggacttcatgttccagcccctggacggtttgaagacctaccaggtgacacctatgaccccaagatctgccaatgctttcttgactcccagctatacatggacgcccctgaagacggaagtcgacgagagccaggctacaaaagagattcttgcccaaaaatgtaagacgtactctactaagaccattcagcaggacagtaacaagctcccttgtcctctgggcccactgactgtgtggcacgaagaacacgtgctcaacaagaacgaggccactacaaagaacctaaatggcctacccatcaaagaggtaccaagtttggagaggaacgaagggcgtatcgcccagcctcaccacggcgtgccgtatttcaggaacatactacagtctgaaacagagaaattaaccagtcactgcttcgaatgggaccggaaattggaattggacatcccggacgacgccaaagacctcattaggacagctgtgggtcagacccggcttctcatgaaagaacgctttaagcagttcgaggggttggtggatgactgcgagtacaaacgtggaattaaggaaacaacatgtaccgacctggatggcttctgggacatggtctccttccagatcgaggatgttatccacaagttcaataatctgatcaaactggaagagtccggatggcaagtgaataataacatgaaccataatatgaataaaaacgtctttagaaagaaagtcgtctccggaatagcttccaaaccaaaacaggacgacgccggacggatcgctgccaggaaccgactggccgcaattaaaaatgcaatgagagagcggattcggcaggaagaatgtgctgaaactgccgtgagtgtaatccctaaagaggtcgacaagatagtgtttgacgctggattttttagagtggaaagcccagtgaaactgttctcaggtctgtctgtgagcagcgaaggcccttctcagaggctgggaaccccaaaatctgtcaacaaagccgtaagtcaatcaaggaacgagatgggaattccgcagcagaccactagtcccgagaacgccggaccacagaacactaagtctgaacacgtgaaaaaaaccctcttcctctccattccggagagtcggagttccattgaggacgcacagtgccccggacttcccgacctgattgaagagaaccacgtggtcaataagacagacctgaaggttgattgtctcagcagcgaaaggatgtctcttccgttgctggcaggtggtgtggcggacgacattaacactaacaaaaaggagggcatcagtgacgtcgtagaaggcatggagcttaactcctctatcacctcccaagatgttcttatgtcctcgcccgagaaaaataccgcgagccagaatagcatcttggaagaaggggagactaagatttcccagagcgaattgttcgacaataaaagtttaacgactgagtgccatctgttggattcggttgggagctgctatgttgcacgggcaggcttggaagtcctgggctcgagtgacccaaccacgagcgcctccagagtggccggaacaacagccagaagtaagctgcagtag

SEQ ID NO: 29482 - DNA, 1710 bp, Artificial Sequence
  Description of Artificial Sequence: Synthetic coding sequence
atgttgtgtagcccttctttctgtaagctgtgttggaaacggcagcgggagaacggtcagcgcaaatatggaggtcccccaccgggatgggacgccgctccacccgaacggggatgcgaaattttcattggcaagctgcctcgtgacctattcgaagacgaactcattccactgtgcgagaagattgggaagatctacgagatgaggatgatgatggacttcaatggaaacaacaggggatacgctttcgtaacattctctaataaggttgaagccaagaacgcgataaagcagctgaacaattacgagattcgtaacggaaggttactcggggtgtgcgccagtgtggataactgtcgactgttcgtggggggtattccaaaaactaagaaaagggaggagatattgtccgagatgaagaaggtgaccgagggggtagtggatgtgatcgtgtatccttccgccgctgacaaaacaaagaacagaggctttgcattcgttgagtacgagagtcaccgtgctgccgctatggctcgcagaaagctgctgccgggaagaattcagctttggggacatggaatcgcagtggattgggcagaacctgaagtggaagtggatgaagacactatgagcagtgtcaagatactctatgtacgtaacttgatgttatccacatcagaggaaatgattgagaaggaattcaacaatataaagccgggagccgttgaacgcgtaaagaaaatcagagattacgcattcgtacatttcagcaatcgagaagatgctgtagaggctatgaaagcacttaacggtaaggtgcttgacggcagcccgatagaggtcacactcgcaaaacctgtggacaaggacagctacgtgcgctataccaggggcaccggcggaagaggaacaatgttgcagggtgagtatacctactcgctgggccaggtgtacgaccccacgacgacctacctaggggctcccgtgttctacgcccctcagacatatgccgctattcccagcctccatttccccgctacaaagggtcacctatcgaatcgggcaatcattcgcgctccaagcgtgcgcggagccgcaggcgtgagaggactggggggtaggggctatttagcctatacggggcttggtcgcggatatcaggtcaagggagataaacgagaggataagctctatgatattttacctggcatggagctgacgcctatgaatccagtgacactcaagccacaggggatcaagctggctcctcagattcttgaggagatctgccaaaaaaacaattggggacagccagtttaccagcttcactcagcgatcggacaggatcagagacagctatttctctataagatcaccattccagcattggcctctcagaatcccgctatccacccatttacacctccaaaattaagtgcttttgtcgacgaagccaagacgtacgctgccgagtatacattacagacactcggtattcctaccgatggaggcgatggcacgatggctactgctgcagcagcagccaccgctttcccaggttacgccgtgcctaacgcaacggcaccggtgagcgccgcacaactgaagcaggccgtcaccctcgggcaggatttggccgcatatacgacttacgaagtgtatcctaccttcgctgtcactgcacgaggcgacggttatggtaccttctag

SEQ ID NO: 29483 - DNA, 1764 bp, Artificial Sequence
  Description of Artificial Sequence: Synthetic coding sequence
atgagtacagccatacctggcctgaaaaaaggcaataatgcccttcagtcaattatcttacagactctcctcgagaaagaaaacggccagcgcaagtacgggggtcccccacccggatgggacgcagccccaccagaaagaggatgcgaaatattcatcgggaagctgccgagagatctcttcgaggacgaactgatccctctgtgtgaaaaaattggaaagatctatgagatgcggatgatgatggattttaatgggaacaacagaggttatgccttcgttaccttttcgaacaaagtcgaagccaaaaatgcaatcaagcagcttaataattacgagattcgaaacggtcgtttattaggtgtctgcgcgagcgtggataactgtagacttttcgtaggtggaatacctaagaccaaaaagagagaagagatactgagtgagatgaagaaagtaacagaaggcgtggtagacgtcatcgtgtacccgagcgcagccgataaaaccaagaaccgcggattcgcctttgtcgagtatgaatcccatagagcagctgcaatggcaagaaggaaactgcttccaggccgaattcaactttgggggcatgggatcgccgtggattgggccgaacctgaggtcgaggtagatgaagacactatgagcagcgtcaagattctgtacgttagaaaccttatgctatctactagcgaggaaatgatcgagaaggagttcaacaatatcaagcctggcgcagtagagagagtcaaaaagatccgcgattacgcattcgtgcacttctcgaatcgagaggacgccgtggaggcaatgaaggctctgaatggcaaggttctggatggctctccaatcgaagtgacactggctaagcccgtcgacaaagatagttacgtccgttatacccggggtacaggaggtcgaggaaccatgctacagggggaatacacttacagcctagggcaggtgtatgaccccacgacgacatatttaggcgctcccgttttctatgctcctcagacttatgctgccattccttcactgcatttcccagcaaccaagggccatctgtcaaatcgagccattatccgcgctccttccgtccgggaaatttacatgaacgtacctgtcggcgcagcaggagtccgcggtcttggcggacgtggttatctggcctacacaggtctggggagagggtatcaagtcaaaggcgataagcgcgaagataaactgtacgacatccttccaggcatggaactgactccaatgaaccccgtcacacttaagccacagggtatcaaactcgccccacagatacttgaagaaatctgccaaaagaataactggggacagcccgtatatcagctgcatagcgccatcggacaggaccagcggcaactgttcctgtataagatcacaattcccgctcttgcctcccaaaaccctgcaatccacccattcacccctcccaaactttctgccttcgtagacgaagctaagacctacgccgctgagtatactcttcagaccctgggaatccccacagatggcggtgatggcacgatggcaactgccgcagccgcagctacggcattccctgggtatgccgtccccaatgccaccgcgccagtgagtgcggcacagctgaagcaggctgtgactctgggacaagacctagccgcttataccacttacgaagtttaccccacatttgctgtcactgcaagaggtgatgggtacggcaccttctag

SEQ ID NO: 29484 - DNA, 1620 bp, Artificial Sequence
  Description of Artificial Sequence: Synthetic coding sequence
atggagagcaaccataagtccggcgacggtctttccggtacccagaaagaggccgcactgcgagcactagtgcagcgcacaggatacagcttggtgcaggaaaacggtcagagaaagtacggcggaccaccgccaggatgggacgcagcccctcccgagagggggtgtgaaatcttcattggaaaactgccacgtgatctgttcgaagatgaactgattcctttgtgtgagaagattggcaagatctatgagatgcggatgatgatggacttcaatggcaataatcgtggatacgcctttgtgacctttagcaacaaggtggaagccaagaatgccatcaaacagttgaataattatgagattagaaatggtagacttctaggcgtctgtgccagtgtggacaactgtaggttattcgtagggggaatacctaagacaaaaaagagagaagaaatcctgtccgagatgaagaaggtcaccgagggtgttgtggacgtgatcgtttatccaagtgctgctgacaagacaaaaaaccgcggtttcgctttcgtggaatatgagtctcacagggcagctgccatggcacggagaaagttactgcctggggctgtcgaaagggttaagaagatccgcgattacgcctttgtgcacttttcaaatagagaagacgccgtggaggccatgaaggcactgaacgggaaggtgctcgatggctcgcccatcgaggtcaccctagcaaagcctgtggataaggattcttacgtgaggtacactcggggtactgggggaagagggaccatgctccagggagagtacacgtacagtcttgggcaggtatacgaccctactacaacttacctgggcgctcctgtgttttatgcccctcaaacctatgcggctatcccttcactgcacttccctgcgaccaagggacacctgagcaacagagcaattatccgggcacccagcgtgagagagatctacatgaacgtcccagttggcgctgccggagtgcgcggactaggcggtcggggatatctggcttacactggcctcgggcgaggttaccaggtcaaaggagacaagcgcgaagacaagttatatgatatcttgccgggaatggaactaactcctatgaatccagtgacattaaaaccccagggaattaagctggccccacaaatcctggaagaaatatgtcagaagaacaattggggccagccagtatatcagctgcacagcgcgatcggccaggaccagcggcagctgttcctgtacaaaatcaccatccctgccctggcctcccagaatcctgccatacacccctttacgcctccaaagcttagcgcctttgtagacgaggccaagacatacgcggcagaatacacattgcagacactcggaattcctactgacggaggggatggcaccatggcaacggcagccgctgctgctaccgccttcccaggctacgcagtccccaacgcgaccgcccctgtgtcagctgcccagttgaagcaggccgtgactctcggacaggacctggccgcttataccacctacgaggtctatcctacctttgccgtgaccgccagaggagacggctacgggacattctag

SEQ ID NO: 29485 - DNA, 1044 bp, Artificial Sequence
  Description of Artificial Sequence: Synthetic coding sequence
ttcagtctgttccccgctgtcgataatgaagaggcagcacttctccatgaggaggccactatgaccattgaagagctcctgactagatatggccagaattgccataagggaccaccacattccaagtcaggcgcaagcgataagttaccacgcgtggcaaagtctaagttcttcgaagactccgaggacgagagtgatgaagccgaggaggaggaggaggacagtgaggaatgttctgaggaggaagacggttattcttccgaagaagcagagaacgaagaggacgaggatgacaccgaggaggctgaggaagacgatgaagaagaggaggaggagatgatggtgccgggtatggaaggcaaggaggagccaggcagcgattctgggaccacagccgtagtcgcactcattagaggtaaacagctcattgtggcgaatgccggagattcacggtgcgttgtctcggaggcaggcaaggcactggacatgtcttatgaccacaagcccgaagacgaggtcgagctagcacggatcaagaacgctgggggaaaggtgacaatggacggaagggtgaatggtggcctcaatctgtctcgcgctatcggagaccacttttacaagaggaacaaaaacctgcccccagaggagcagatgatcagcgctcttcctgacatcaaagtccttacccttactgatgatcatgagtttatggtgatagcatgtgacggaatttggaacgtaatgagtagccaggaggttgtggatttcatacagtctaaaattagccaacgcgacgagaacggcgagttaaggctgttgtcatcaatcgtggaagagctgttagatcagtgtctcgcacccgacaccagcggcgacggcacaggctgtgacaacatgacttgcattatcatttgttttaagccaaggaacacagctgaattgcagcccgagtcaggaaagagaaagctggaggaggtgctctccacagagggcgctgaggagaatgggaactcagataagaaaaagaaggcaaagcgggactag

SEQ ID NO: 29486 - DNA, 1218 bp, Artificial Sequence
  Description of Artificial Sequence: Synthetic coding sequence
atggagacagatttaaatagccaggacagaaaggacttggacaaattcattaagtttttcgccttgaaaaccgttcaagtcatagtgcaggccaggctgggtgagaagatatgcaccagatcatcatccagtcccacagggtccgactggtttaacttggccataaaggacattccagaagtgacacatgaggcaaaaaaggcactcgctggccagttgccagccgtgggccgtagcatgtgcgtggagatttctttgaaaacctcagaaggagatagcatggaactagagatctggtgtcttgaaatgaacgagaaatgtgacaaggaaatcaaggtctcatacaccgtgtacaacagactgagtctgctgctaaaatctttgctggccataaccagggtcaccccagcgtataggctttcccggaagcagggacacgagtacgtcattctttaccggatctacttcggtgaagttcagctgagtggtttgggcgagggctttcagaccgttcgggtcggcacagtaggtactccggtgggcaccattacgttaagctgcgcttatcgcatcaacctggctttcatgtctactcggcaattcgagaggaccccaccaatcatgggtattattattgaccacttcgtggataggccttacccctcctcctcccctatgcatccctgtaactatcgtacagctggcgaagacacgggggtcatctatccttcagtagaagattcacaggaagtatgcaccacgtcttttagtacttcccccccatctcaactgatggttccgggaaaagagggaggcgtccctcttgctcccaaccagcctgttcatggtacccaagcggatcaggaacgccttgccacctgtaccccttcagaccggactcactgtgccgctaccccttcctcatcagaggacactgagacagtgtcaaactcgagcgagggaagagcttcccctcacgacgtgctggaaaccatatttgtgagaaaagtgggagctttcgtgaataaaccgattaaccaagtcacactgacttctttggatatcccattcgctatgttcgcccctaaaaacctcgagcttgaggacacagatcccatggtaaatccccctgattcccctgaaactgagagtccattgcagggctcactgccatgctcctggccactgccctgtttgctctcccctagcacagtgtag

SEQ ID NO: 29487 - DNA, 2025 bp, Artificial Sequence
  Description of Artificial Sequence: Synthetic coding sequence
atgcagacatcctcatcaaggtccgtgcacctgtccgagtggcagaagaactatttcgcaataactagtggtatttgtacaggaccgaaggcggacgcataccgggctcaaatcctccgcattcaatatgcttgggcgaattcggagatatcccaggtgtgtgcaaccaagctgtttaaaaagtatgcagagaagtattctgccattattgactccgacaatgtggagtctggtcttaataactacgctgagaatattcttacgctcgcgggttctcaacagacagacagtgacaagtggcagagtggtctgtcaatcaacaatgtcttcaaaatgtcttccgttcagaagatgatgcaggccggtaaaaagtttaaggattctctcctggagcccgcattggcttctgtagtgatccataaagaagcaacggttttcgatctgccgaagttcagcgtttgcggatcatcccaggagtccgactctctgcctaactcggcccatgaccgggaccggacccaggatttccctgagagcaaccgactgaaactgctccaaaacgcccaaccacccatggtgaccaacacggcgaggacctgccccaccttttccgccccagtgggagaaagcgctaccgccaagttccacgttacacctctgtttgggaacgtgaaaaaagagaatcattccagtgccaaggaaaatattggacttaatgttttcctgtccaaccagtcctgttttcctgccgcttgcgagaatccacaaaggaagtcattctatggatccggcactattgacgcactcagcaaccctatcctgaataaggcctgctctaagactgaggacaatggacccaaagaggatagctcactcccaacatttaagacagcaaaggagcaactctgggtggatcagcagaagaagtaccatcaaccccagagagcctctggttcatcctatgggggagtcaaaaaatccctgggagcatcgcgcagccggggtatcctggggaaattcgtgccccctatcccaaagcaagacggaggcgagcaaaatggcggaatgcaatgtaaaccctatggtgctggccctacagagcctgctcacccagtggatgaacgtctgaaaaatttagagcctaaaatgatcgaactaattatgaatgagatcatggaccatggcccaccggtaaactgggaggatatcgccggagtggagtttgctaaagcaacaatcaaggagatagtcgtctggcccatgctccgcccagacatctttactggacttagaggcccaccgaagggaatcctgctttttgggcctcccggtactggaaaaactctgattggtaagtgcattgcatctcagtcaggagccacctttttttcaatcagcgcgagcagcttaacctctaaatgggtcggagaaggcgagaaaatggtacgggcacttttcgccgtggctagatgtcagcagcccgcagtaatatttatagatgaaatcgactccctgctcagtcagcgaggggacggtgagcacgagtcctctaggagaattaaaacagagtttcttgtacagctggatggggcaacaacgagtagcgaggatcgtatcctcgtcgtcggggcaaccaatcgaccacaagagattgacgaggcagcacggagaagactcgtaaaaagattgtatataccgctgcccgaggcttccgccagaaaacaaattgttattaatctcatgtcgaaggagcaatgttgcttatctgaagaagagatcgaacaaatagtacagcagtccgatgccttttcaggagccgacatgactcaattgtgccgggaagcctccctcggcccaatccgctctttgcaaaccgcagacattgcaaccatcactccagatcaggtgcgcccaattgcatatatcgactttgaaaatgcattccgcaccgtgcggccatcagtgtctcctaaagacctcgagctttatgaaaattggaacaagacctttgggtgcggcaagtag

SEQ ID NO: 29488 - DNA, 2640 bp, Artificial Sequence
  Description of Artificial Sequence: Synthetic coding sequence
atgaattaccccggtcgtggttcacctaggtcccctgagcataatggtagaggcggtgggggtggagcttgggaactggggagcgatgcacgacctgcgttcggcggaggcgtttgctgcttcgaacatttgcccggaggcgatcctgatgacggcgatgtgcctcttgcgctgctgcggggtgaacctggtctccatctcgcccctggcaccgatgaccacaatcaccatctggctttggatccctgccttagtgacgagaactacgacttctctagcgccgagagcgggagttccctgcggtactatagtgagggggagtcaggcggaggcggatcttctctctcacttcatcctcctcagcagccacccctagtccccacaaactccggagggggaggagctacaggcggaagtccgggagaacgcaagagaactagactcggtggacccgctgctaggcatagatacgaagtcgtaacagagctgggcccagaggaggtacgatggttctacaaggaagataagaagacctggaagcctttcattggttatgacagcttgagaatcgagctggcctttcgtacgcttttgcagacaacaggtgccaggcctcaaggcggtgacagagacggagatcacgtttgctcaccaacaggccctgcatcctcaagcggcgaagacgatgacgaagatagagcttgtgggttttgccaatcaacaacaggacacgagcctgagatggtggaactagtcaatattgagcccgtttgcgtccgcggaggactgtacgaagtagacgttactcagggcgaatgctatccagtctattggaaccaggcagacaagatccctgtgatgagaggccagtggttcatcgatgggacatggcagcccctggaggaggaggaaagcaatctgatcgaacaggagcacctcaactgttttcgaggacagcagatgcaggaaaacttcgatatcgaagtcagtaaaagcatagatggaaaggacggcagcggtatcaattatagcgccgtgcatagctttaagctcagccgcaatcatgtagactggcactccgtagatgaagtgtacctttactcagatgcaacaacatcaaaaattgctagaaccgtcacacagaaactgggtttctccaaggcctccagtagcgggacccggcttcacagaggttacgtagaggaggctaccctggaagacaagccatctcagaccacacacattgtgttcgtggtgcatggcattggtcagaagatggaccagggacggatcattaagaatactgcaatgatgcgagaggccgcacgaaaaatcgaggagagacatttcagcaaccatgcaactcacgtagagttccttcctgtggagtggaggagcaagctcacactcgatggcgataccgtagactcaataactccagacaaggtgcgaggcttgcgagatatgcttaacagttcagcgatggatatcatgtattacaccagcccgctatatagggacgagctagttaaggggttgcaacaggagctaaataggctgtattctctgttctgtagtagaaaccccgatttcgaagaaaaaggcggaaaagtgtcaattgtcagccattcactcgggtgcgtcatcacctacgacattatgaccggatggaaccctgtccggctatatgaacagctccttcagaaagaagaagagctccctgatgaaagatggatgagttacgaggaacgacacctgctggatgagctttatatcactaaacgacgcttgaaagagatcgaagaaaggctgcatgggcttaaggcttcgtcaatgactcagactcccgcattaaagttcaaggtggaaaattttttctgtatgggctctcccttggccgtgttcctggcacttaggggaatcagacccggaaatacaggatcacaagaccatattctgccccgtgagatctgcaaccgtctccttaatatcttccatccaacggatccagtcgcctatcggcttgagccactgattcttaagcactacagtaacattagtcccgttcaaatccattggtacaacacatccaaccctctgccatacgagcatatgaagccttcctttctaaatcctgctaaggaaccaacgtcggtatccgagaatgaaggcatctccacaataccatcaccggttacatccccggtgctgtccaggaggcactacggtgagagtattaccaatatcggcaaagcttcaattctgggggcagctagcatcggtaaagggctaggaggaatgctgttttctcgcttcggccgtagctccacgacccagagctctgagaccagcaaagactccatggaggatgaaaagaagccggttgcctcccctagcgccactaccgtgggaacgcagactctgccacatagcagttctggctttttagacagcgcccttgagttagatcacagaattgacttcgaacttagagaagggttagttgagagtcggtattggtcagcagtgaccagccacacagcatactggagttccctggacgtggctcttttcttactcaccttcatgtacaagcacgaacacgacgacgatgccaagcccaatctcgatccaatctag

SEQ ID NO: 29489 - DNA, 2316 bp, Artificial Sequence
  Description of Artificial Sequence: Synthetic coding sequence
atgaactaccctggccgtgggtctcctaggagcccagaacacaacgggagaggcggaggcggtggcgcttgggagcttggcagcgatgctagacccgcttttggaggtggcgtgtgttgcttcgaacatctgccgggtggagaccccgatgacggagacgttcccctggccctccttagaggggaaccgggactacacctcgcaccgggaaccgatgaccacaaccaccacctcgctttggacccttgtctgtccgacgagaattacgatttctctagcgcagagagcgggagcagcttacgatactatagtgagggcgaatcagggggtgggggaagcagtctgtcgctgcacccccctcagcaacccccactcgtgccaacaaattctggaggcggtctgtatgaggtcgacgtaacccagggcgaatgctacccagtctactggaatcaggctgataagattcctgtgatgcggggtcaatggtttatcgatggtacctggcagcctttagaagaggaagagtcaaatctcattgagcaggagcacctcaattgttttcgtggccaacagatgcaggagaatttcgacatcgaagtgtcaaagtccattgacggtaaagacgccgttcacagctttaaactgtccagaaaccacgttgattggcacagtgtagatgaagtgtacttgtatagtgatgccaccaccagcaagattgcccgtactgtgacccaaaagctgggtttcagcaaagcctcttccagtggcacaagactgcaccggggatatgtagaggaagccaccctggaggataaaccttcccaaactacacatatcgtttttgtggtgcatgggattggtcagaaaatggaccagggcagaataataaagaacaccgcaatgatgagggaggctgccaggaaaatcgaagagcggcatttttcaaaccacgcgacacacgtcgagttccttcctgtggagtggcgaagtaaactcaccctagacggggatacggtagactcaataacccctgataaagtacggggactgagggatatgttgaactcaagcgctatggatatcatgtactacacgtcaccattgtatcgtgacgaactcgttaaaggtctgcagcaggagctgaatcggctgtactcactcttttgtagtcggaatccggactttgaggaaaagggaggcaaggtctcaatagtctcccacagtctcggctgcgttataacatatgacattatgaccggttggaaccctgtaagactttacgaacagcttcttcagaaggaggaagagctcccagatgagagatggatgagctacgaagaaaggcatctcttggatgagctatacatcactaagcgaaggctgaaggaaattgaagagagacttcacgggctcaaggctagttctatgactcagacgcccgctcttaaattcaaagtcgagaattttttctgtatggggtcacctctcgcagtgttcttggcccttagggggatccggcctggcaacactgggagtcaggaccatatcttgcctagggaaatatgtaaccgcctattgaacatttttcaccctactgacccagttgcttaccgactagaacctctgattctaaagcactactccaacatttcaccagtgcaaatccattggtacaacaccagtaatccacttccgtacgagcatatgaagccctctttcctgaaccccgctaaggaacctacctctgtctccgagaatgaggggatctccaccatccccagtcccgttacttctccagtcctgagccgtcgccattacggcgaaagcatcacgaacataggcaaagcctctatccttggtgcggcttcgatcggtaagggccttgggggaatgcttttctcacgattcgggaggagttcgaccacccaatcaagtgagacaagcaaagactctatggaagacgagaagaaacccgtggcctctccttcggctactactgttgggacacagacgctgccgcatagtagcagcgggtttctcgactccgcttattttcgtcttcaggagtcatttttcaacctgccccagcttctctttcccgagaatgtgatgcagaacaaggacaacgctctggtcgagcttgaccataggatcgattttgaattacgtgaaggcctggtggagagcagatactggagcgccgtgacatcccacacggcatactggtccagcctcgatgtggctttatttttactgaccttcatgtataagcacgagcacgatgacgacgctaaacctaacctagaccccatttag

SEQ ID NO: 29490 - DNA, 1179 bp, Artificial Sequence
  Description of Artificial Sequence: Synthetic coding sequence
atgggtaccacttgcctgcatcttgggacattagagcagagcttggtatttgagaataaagtgaacagcgagaaggtcaagctgtcacttcgcaatttccctcacaacgattacgaagacgttttcgaggagccctccgaatccgggtctgatccctcaatgtggacggccagggggccattccgcagggaccgatggagctccgaagatgaagaggccgctggcccaagccaggccctctccccgctgctgtccgacactagaaagattgtcagcgaaggcgagctggatcagcttgcccagatccgcccattaatttttaactttcatgaacagacagcaataaaggattgccttaagatacttgaagaaaaaaccgccgcatacgatatcatgcaggagttcatggcccttgaattgaagaatctacctggcgaattcaacagcggcaatcagcctagcaacagggaaaagaacagataccgagacattctgccatacgattctactagggtcccgctgggcaagagcaaagattatatcaacgcatcttacatccggatcgtgaactgcggtgaggagtacttttatattgccacacaaggaccgctactttctacgatagacgacttctggcaaatggtcctcgaaaacaattccaatgttattgctatgattactagggaaatcgagggaggaataattaagtgctatcattactggcccatttcgctcaaaaaacccttagagttaaagcattttcgggtcttcctcgagaactaccaaattttgcagtatttcataatcaggatgtttcaagttgtcgaaaagtctaccggcaccagtcactccgttaaacagctgcaatttaccaagtggccggaccatggaacacccgctagcgcggatagcttcattaagtacatcagatatgcaagaaaaagtcatctcaccggccctatggtggttcattgcagtgcagggatcgggaggacgggtgtgttcctgtgtgttgacgtggtgttttgtgcgattgtcaaaaactgctcttttaacattatggacattgtcgcccagatgcgggaacagcgtagtggcatggtccagactaaagagcagtaccacttctgctatgacatagtgctggaagtgctgaggaagttactgactctcgactag

SEQ ID NO: 29491 - DNA, 621 bp, Artificial Sequence
  Description of Artificial Sequence: Synthetic coding sequence
atgtctagcccaagagattttcgtgccgagcctgtaaacgattacgagggtaatgacagcgaggcagaggacttaaatttcagggaaaccctccccagctcatctcaggagaataccccaagaagcaaggtgtttgaaaacaaagtgaactctgagaaagtgaaactgtccctcagaaatttcccccacaacgactacgaagacgtattcgaagagcctagtgagagtgggagtgatccaagcatgtggacagctagagggccattcagacgggaccgttggtctagcgaggacgaggaagccgctggcccatctcaagctctttctccacttctatctgatacacgcaaaatcgtgtccgaaggggaacttgaccagctggcgcaaatcaggcctctcatctttaacttccatgagcagacagcgatcaaggactgcctcaagattttggaggagaagactgccgcttacgatatcatgcaagagtttatgtttaacatcatggatattgtggcacaaatgcgtgagcaacgatctgggatggtacagactaaggagcaatatcatttttgttacgatatcgtattggaggtgctccgcaaactgctgaccctcgactag

SEQ ID NO: 29492 - DNA, 438 bp, Artificial Sequence
  Description of Artificial Sequence: Synthetic coding sequence
atgtggacggcaagggggccatttcgaagggacagatggtcctcagaagacgaagaagccgctggacctagccaggccttaagcccactgctaagtgataccaggaagatagtgtctgagggagagttggatcagctggcccagatcagacccttaatctttaacttccacgaacaaacagcgataaaggactgcctgaagattctcgaggagaagacagccgcttacgatatcatgcaggaatttatggctttggaactgaagaatttgccaggggagttcaattccggtaaccagccgtctaatcgcgagaagaataggtaccgcgatattctgccctttcagcaccacgggtactcaggtcccaatgagaggactacattttggcatggcagcaatgagggtgcagtgagcctgcttctgaggtattgcgcctag

SEQ ID NO: 29493 - DNA, 1020 bp, Artificial Sequence
  Description of Artificial Sequence: Synthetic coding sequence
atgtggactgcacggggaccattcaggcgcgacaggtggagcagcgaggacgaagaggccgctgggccaagccaggctctctccccgctgctatctgacactcgcaagatcgtaagcgagggcgaattagaccaactagcccagattcgcccattgatcttcaacttccatgaacagacggcaattaaggattgtttgaagatcttggaggagaaaaccgctgcctatgacatcatgcaggagttcatggctcttgagctgaaaaatctgcccggagagtttaatagcgggaatcagccttccaatcgcgaaaagaaccggtatagggacatactgccctatgatagcactagagtaccccttggcaaatctaaggattacattaatgcatcctatatccgtatcgtgaactgcggcgaggaatacttttacatcgctactcaaggacctttactgtccaccatcgatgacttctggcagatggttctggagaacaacagcaatgtaatcgctatgatcaccagagagattgaaggagggattattaagtgttatcattattggcctatttcgttgaaaaagcccctcgaactcaagcacttccgcgtgtttctggagaattaccagattctccagtatttcatcatccgcatgttccaggtggtggaaaaaagcaccggcacgtctcacagcgtgaaacagctccagttcaccaaatggccagaccacgggacccctgcatccgcagatagcttcattaaatacatccggtacgctcgaaaaagtcatctcacaggccctatggtggtccattgttcggcaggcatcggacggacgggggtgtttctgtgtgtagacgtggttttttgtgccatagtgaagaactgctccttcaatattatggatattgtggcccagatgagggaacagaggtccgggatggtgcaaactaaggaacagtaccacttctgctacgacatcgtgctggaggtgttacgcaagctgcttactctggattag

SEQ ID NO: 29494 - DNA, 1047 bp, Artificial Sequence
  Description of Artificial Sequence: Synthetic coding sequence
atgcagtttggagaactccttgcagccgtgcggaaagcccaggcgaatgttatgctatttctggaggagaaggagcaggccgcactgtctcaggctaatggtataaaggcgcacttggagtacagaagcgccgagatggagaagtctaagcaggaactagagacaatggccgctatatctaataccgttcagttcctagaagaatactgcaaatttaagaacaccgaagacattactttcccttctgtctacatcggactgaaggacaaattatcaggcatccggaaggttattacagagagtacagtgcatctgattcaactccttgaaaattataaaaaaaagttgcaggaattctccaaagaggaggaatacgacattcgcacacaggtctcagccatcgtacagcgaaagtactggacctcaaagccagagccttctacacgcgaacagtttctgcaatacgtccacgatatcaccttcgaccctgacaccgcacacaaataccttcgtctgcaggaggagaataggaaggtcaccaacaccacgccctgggaacacccttacccagacctgcccagtcgctttctccattggaggcaggtcctgagtcaacaatccctctacctgcacagatactactttgaggtggaaatctttggagcaggcacatacgttgggctcacgtgtaaaggcatcgatcaaaaaggagaggagcggtccagctgtatcagcggaaacaacttctcatggagcctccaatggaacggaaaagaatttactgcatggtatagcgacatggaaacaccccttaaagctgggccattctggaggctgggcgtgtatatcgattttccagggggtatactgagcttctacggggtggagtatgactccatgaccctagtccataagttcgcctgtaaattttcggaacccgtctatgcggcattctggctctcgaagaaggaaaacgccatcaggatagtcgatttgggagaagagcccgaaaagccagctccaagcctggttgggaccgccccatag

SEQ ID NO: 29495 - DNA, 1047 bp, Artificial Sequence
  Description of Artificial Sequence: Synthetic coding sequence
atgcagtttggtgagctcctcgcagccgtgcggaaggcacaggccaatgttatgttgttcttggaggaaaaggagcaggccgcactgtctcaggccaacggaatcaaagcccacctggagtatcggagtgctgagatggaaaagtcaaaacaggagctggagactatggccgctattagcaacacagtgcaattcctggaggagtactgcaaattcaaaaacaccgaagatattacctttccgtcagtgtatattggacttaaggataagcttagcggcatccgcaaggttatcactgaaagcacagtgcacttgattcagctcctcgagaattacaagaaaaaactgcaagagttctccaaggaagaggaatacgatatcaggacccaggtttctgcaatagtgcagcgcaaatattggactagtaagcccgagcctagcactagagagcagtttctgcagtatgttcacgacattacctttgacccagatacagcacacaagtacctgcgactccaggaagagaaccgtaaggtaactaacacaacaccatgggaacacccgtaccctgatctccctagccgatttttgcattggcgacaagtactgtctcagcagtctttgtatctccataggtactacttcgaggtggaaatcttcggagctggaacgtatgtaggcctgacttgtaagggaatagaccagaagggagaagaaagatcatcatgcatcagcggaaataattttagttggagtctccagtggaatgggaaggagtttactgcctggtactcagacatggagacccccctgaaagctggaccgttttggcgccttggagtgtacatcgactttcccggtggcattttaagcttctacggcgtggagtacgactcgatgacactggtccacaaatttgcttgtaagttttccgagcctgtctatgcagcattttggctgagtaagaaagagaatgctattcgtatcgtggacctcggggaagaacctgagaagcctgcgccttccctggtcggtactgccccttag

SEQ ID NO: 29496 - DNA, 687 bp, Artificial Sequence
  Description of Artificial Sequence: Synthetic coding sequence
atgattgacgacagcacgcgggttcccctgggcaagagcaaggactacatcaatgccagctacattagaatcgtgaactgcggggaagaatacttctatatcgccacacagggtcccctgctgagcacaatcgacgatttttggcagatggtgctggagaataatagcaacgtcatcgccatgatcactagagagatcgagggcggaattatcaagtgctatcattactggccaatatctttgaagaaaccactggagcttaaacactttagagttttcctggagaactaccagattctgcagtactttattattagaatgttccaggtggtggaaaagagtacggggacttctcacagcgtcaaacaactccagttcacaaagtggccagatcacgggacgccagcctccgccgacagctttattaagtacatccgatatgccaggaagtcgcacctcactggccctatggtagtacactgctctgcaggcatcggacggacaggtgtttttctgtgcgtggacgtggtgttttgcgccattgtgaagaactgctcctttaacataatggatatcgtcgcacagatgcgtgagcagcgcagcggaatggtccagaccaaagaacagtatcacttctgctatgatatcgtactggaggtgctacggaagttactaacactagactag

SEQ ID NO: 29497 - DNA, 1449 bp, Artificial Sequence
  Description of Artificial Sequence: Synthetic coding sequence
atggtaatggaaaaacctagcccactcctcgtcggtcgtgaattcgtccgacagtactacactctccttaacaaggccccagaataccttcaccgcttttatgggagaaactcaagctacgtgcatggtggggtcgatgccagtggtaagccccaagaagctgtttacggccaaaacgacatccaccacaaggtactctctctcaactttagtgagtgccataccaagatcaggcacgtggacgcacacgcaaccttatcggatggcgtggtcgtccaggtgatgggcctgttgtcgaattcaggacagcctgagaggaagtttatgcagactttcgtcttggcacctgagggaagcgttccgaacaaattctatgtacataacgacatgtttcgctacgaggacgaagtcttcggggactctgagcctgagttggacgaggagagtgaagacgaagtcgaggaagagcaggaggaacggcaacctagtccagagccggtccaggagaatgccaactccggctattatgaggcacatcctgtcacaaacgggattgaagagcccctggaggagtccagccacgagccagagccagagccagagtctgaaaccaagactgaggaactgaaaccccaagtggaagagaaaaaccttgaagagttggaagagaagtccaccaccccacctcctgccgaaccagtgtccctgccccaggaacccccaaaggccttcagctgggcaagcgtgacctcaaagaatcttccacctagcggcacagtctcttcctccgggatcccgccacacgttaaggcacccgtgagccagcccagggttgaggcaaaacctgaagtccagtcccagcccccacgcgtgagagagcaacggcctcgggaacgcccaggatttccacctcgcggacccagacccggaagaggagacatggaacaaaacgatagcgacaatcgccgtattatccgctatcctgattcccaccagctgttcgtaggaaatctcccccatgatatagatgagaacgagcttaaagagttttttatgagtttcggcaacgtggtagaactaagaatcaatactaaaggagtgggaggcaaacttcccaactttggcttcgtggtgttcgacgacagtgagcccgtgcagcggattcttatcgcaaaaccaatcatgtttcggggagaggtgcgcctcaacgtggaggagaagaaaacccgtgctgcacgcgagagggagacccgaggcggaggtgatgacagacgcgatattaggcgaaatgacagaggtcccggaggcccacggggtattgtgggaggaggaatgatgagagatcgcgacggcagagggcctccacccagggggggaatggcccagaagcttgggtctggcagaggcacaggtcagatggagggccgatttacaggccagcggagatag

SEQ ID NO: 29498 - DNA, 1020 bp, Artificial Sequence
  Description of Artificial Sequence: Synthetic coding sequence
atgtggacagcgcgaggaccctttcgcagggacagatggtcctccgaggacgaggaagcagctggtccctcacaggctctgtcacctttattaagcgacacccgcaaaatcgtgtccgaaggggagctcgaccaactggcccagattagaccactgatatttaattttcatgaacagaccgccatcaaagattgtcttaaaatcctggaagagaaaaccgcagcgtacgatatcatgcaggagttcatggctcttgaattaaagaacctgcccggagaatttaattccggaaatcagccaagcaatagagaaaagaatcgctatagggatattctaccctatgactctacgcgggtacccctgggcaaaagtaaggattatattaacgcatcatacatccggatcgtcaactgtggggaagaatacttttacatagccacccaggggccactactgtccactatcgatgatttttggcagatggtgctggagaacaacagcaatgtgatagcaatgatcaccagggagatcgaggggggtataatcaagtgctaccattactggcctatctcgctgaaaaaacctctcgagcttaagcattttcgagtgttcctggaaaattaccagatccttcagtattttattattaggatgttccaggtcgtcgagaagtctacaggaacttctcactcagtgaagcaattacagttcacaaaatggccagaccacggtactcccgcttccgctgattcattcatcaagtatataaggtacgcgaggaagtctcatctgaccggcccaatggtcgtccactgcagcgcaggtattggcagaacgggagtgttcctgtgcgtagatgtcgtgttttgcgctattgtcaaaaactgctctttcaatatcatggacatcgtggcacagatgagggagcagcgcagtgggatggtgcagacaaaagagcagtaccacttctgttacgacatcgtactcgaagtgctacggaagttgctcacactggactag

SEQ ID NO: 29499 - DNA, 621 bp, Artificial Sequence
  Description of Artificial Sequence: Synthetic coding sequence
atgagttcgccccgagacttcagggctgagccagtgaacgactacgaaggcaacgattcagaagcagaggacctgaactttcgcgagacactgcctagctcctcacaggagaataccccccgaagcaaagtcttcgaaaacaaggtcaacagcgagaaggtgaagctgagtctccgaaacttcccccataacgactacgaggacgtgtttgaagagcctagtgaaagcggttctgaccctagtatgtggaccgctagagggccatttcgcagagacaggtggtccagcgaagacgaggaagccgctgggccatcacaggcactctccccgctcctcagcgacaccaggaagattgtgagcgagggcgagttagaccagctcgctcaaatcagacctctgatctttaatttccacgagcagaccgctataaaggactgtctgaaaatactggaagagaaaactgctgcttacgatatcatgcaggaattcatgttcaacatcatggatatcgtggctcagatgcgggagcagaggtcagggatggtgcagactaaggagcagtaccacttctgctatgacattgtgcttgaagtcctccgtaagttgctgacactcgactag

SEQ ID NO: 29500 - DNA, 438 bp, Artificial Sequence
  Description of Artificial Sequence: Synthetic coding sequence
atgtggacagctagggggccttttcggcgagacagatggtcctcagaggatgaggaggcagcaggaccatcacaggctctgagcccgctgctatctgataccagaaagatcgtgagtgagggtgagctggatcagttagcacagattcgtccactaatttttaattttcacgaacagactgccattaaagactgtctgaagatcctggaggagaaaacagctgcatacgacatcatgcaggaattcatggctcttgagctcaagaaccttcctggagaattcaattcgggcaatcaaccaagcaaccgagagaagaaccgatatagggacattttaccttttcagcatcacggctatagcggcccaaacgagagaaccacattctggcatggatccaatgaaggcgctgtgtctctgctcctgcgttactgcgcctag

SEQ ID NO: 29501 - DNA, 687 bp, Artificial Sequence
  Description of Artificial Sequence: Synthetic coding sequence
atgattgacgattccacacgggtacctttagggaagagcaaggattacatcaacgcaagctacattcggatcgtcaattgtggagaagagtacttctacatcgccacgcaggggccactactttccaccatcgacgacttctggcaaatggtcttagaaaataattctaatgtaatcgcgatgataacccgggagatcgaaggtggcataattaagtgctatcattactggcctatatctttaaagaagcctttggagctgaagcactttagagtgtttctggaaaactatcagatcctgcagtacttcattattagaatgtttcaggtggtggagaaaagtactggaacatcacattcagtgaagcagctacagttcacaaaatggccagatcatggcacacctgccagcgctgactcatttatcaagtacatccgttatgcgagaaaatctcatttgacagggccaatggtcgtacactgctccgctggaatagggcgtacaggcgtattcctgtgtgttgatgtcgtgttctgtgccattgtaaagaactgctctttcaacattatggacatcgtcgctcagatgcgcgaacagcgttcgggcatggtgcagacaaaagagcagtaccatttttgctatgatatagtgctcgaggtcctacgcaaactgcttactctagactag

SEQ ID NO: 29502 - DNA, 2802 bp, Artificial Sequence
  Description of Artificial Sequence: Synthetic coding sequence
atgttttggaaatttgacctgaatacgactagccatgtggacaagctgctggacaaggaacatgtgaccttgcaggaactgatggacgaagatgacatcttgcaagaatgtaaggctcagaaccagaagctattggatttcctttgtagacagcagtgtatggaagaactcgtctctctgatcacccaagatcccccactggatatggaagaaaaagtccgcttcaaatacccaaatactgcttgtgagctgttgacctgcgatgtgcctcagattagtgatcgcctgggaggagatgaatcacttctctcactcctctacgacttccttgatcacgaacctccgcttaaccctctgctggccagcttcttttcaaagaccattgggaatttgatagcacggaagacagaacaggtgatcacatttctcaagaagaaggacaagttcatctccctcgtactgaagcacatcggaacctctgctctcatggacttactgttgaggcttgtatcctgtgtagagccagctggcctccgccaggacgtgttgcactggctgaatgaagagaaggtgatacagcggctcgtcgaactgatccacccctcacaggatgaagatagacagtccaacgcctcccagaccctctgcgatattgtcagactggggagggatcagggctcgcagttacaggaggccctcgagcctgaccctctgctgacggcacttgaaagccgtcaggattgtgtcgaacagttattaaagaatatgttcgacggtgacaggacagagtcgtgcttggtgagcggtacccaagtgctcctcaccctcctggaaactagaagggttggaacagaagggctggtcgattcattctcacagggacttgagagatcgtacgcagtctctagtagcgtcctgcatgggatcgaaccaaggttgaaagattttcatcagctgctgctgaatcctccaaagaagaaagcaattctgacgaccataggggtgctcgaggagccactagggaacgcaaggctacatggcgcacgtctcatggctgcacttctgcataccaacaccccgagcattaatcaggaactgtgccggctgaacacaatggacttacttctggatttgttctttaaatatacctggaataatttcctgcactttcaggtggagttgtgtatagcagccattttgtcccacgccgctcgagaggagcggaccgaagcatcgggctcagaatcacgtgtagagccgcctcatgagaatggcaatcgtagcctggagacaccacagcccgctgcgtctctgcctgataatacaatggtcacgcatctgttccaaaaatgttgtctcgtccagcggatcctggaagcctgggaggcaaacgaccacactcaagcagccggaggaatgcgcaggggtaacatggggcacctgacgcgaattgctaacgccgtcgttcagaatctggagaggggcccagtccagacccatattagcgaggtgatcagaggcttacctgccgactgtcggggacgctgggagtcatttgtcgaggaaaccctgactgaaaccaacaggcggaataccgtcgatttagccttctccgattaccagatccagcagatgaccgctaactttgtggaccagtttggcttcaatgacgaagagtttgctgatcaggatgacaatatcaatgccccttttgatagaattgcagagataaatttcaacatcgatgctgacgaagatagcccctccgccgctcttttcgaggcgtgttgctccgacaggattcagcctttcgacgatgacgaggatgaggacatctgggaagactcagacacaaggtgcgccgcacgtgtgatggctagaccacggtttggagcgccacatgcttccgaatcctgttccaagaatggccctgaaaggggcggacaggatgggaaggcctcactggaggcccatagagacgcccctggagccggagccccacctgccccaggtaaaaaggaagccccaccagtagagggggattcggaaggcgctatgtggaccgccgtctttgatgaacctgccaatagcacccctaccgctccaggagttgtgcgagacgtgggctcttcagtttgggccgcaggcaccagtgcccctgaggaaaaagggtgggccaaattcacggatttccaacccttttgttgttctgagtccggcccaagatgcagctcaccggtggatactgagtgttcccacgccgagggctcgcggtcacagggacctgaaaaagctttctctcctgcctcgccttgtgcatggaacgtctgtgttactcggaaagctcccctcctggcctctgattcatctagcagcgggggttcccattccgaggatggggaccagaaggcggcatctgccatggacgccgtgtctcgcggaccaggcagggaagcaccaccattgccaactgtggctaggacagaagaagccgtgggtcgcgtagggtgtgctgactcccgtctcctaagtccagcttgtccagccccaaaggaagtcacagccgcacccgctgtggctgtcccaccagaagcgacagtcgcaataacaacagccttgtcgaaggcgggtcccgcaattcctacaccggcagttagtagtgctctcgcagtcgccgtccccttgggaccgatcatggctgtgactgcagcccctgccatggtggccacgctcggtaccgtgacaaaggacggaaagaccgatgctccaccagaaggggcagcgctgaacggacctgtgtag

SEQ ID NO: 29503 - DNA, 2799 bp, Artificial Sequence
  Description of Artificial Sequence: Synthetic coding sequence
atgttttggaaatttgacctgaacacgacgagtcatgtcgataagctgctggacaaagaacacgtgacgctgcaagagctgatggacgaagacgacatcctgcaggaatgtaaggctcagaatcaaaagctattagacttcctttgtagacaacagtgtatggaggagctggtctctctcatcactcaggaccctccactggacatggaggaaaaggtccggttcaagtatccaaatacagcctgcgagttgctaacatgcgatgtaccccagatctcagacaggttgggaggggacgagtctctgctgagcctcctatacgatttcctggaccacgagcccccactgaatcccctcttggcgtctttcttcagtaaaactatcggtaatctaatcgctcggaagacggagcaggtgatcactttcctgaagaaaaaggacaaattcatcagcttggtactgaaacatattgggacctccgcactcatggatctcctcctgcggctggtttcctgcgtggaaccagccggactcaggcaagatgttctgcactggctgaatgaggaaaaagttatccagaggttagtggaactgattcacccaagtcaggatgaggacaggcagtcaaatgcttcacagactttatgcgatatcgtaaggctgggcagagatcagggctcccaattacaagaagctctggagccggacccgctgctgacggctctggaaagccaagattgtgtcgaacagctcttgaagaacatgttcgacggagataggaccgagtcatgcttagtgagtggcacacaggtgctgctaacccttttagagactagaagggtcggaactgaaggtctggtggatagtttcagtcaggggctcgaacggtcgtatgctgtaagctcgagtgtattacacggcatcgagcccagactgaaagacttccatcaacttctgttgaatccccctaaaaagaaagctatcttgacaacaattggggtcctcgaggaaccgctggggaacgcgcgactgcacggcgcaaggctgatggccgctctgctacacacgaataccccaagcataaaccaggagttgtgtcgtttgaacacgatggatctactgctggacttgtttttcaagtatacatggaacaactttctgcacttccaagtggagctgtgtatcgcggctattttgagtcacgcagccagagaagagcgtactgaagccagtggatcggaaagtagggttgagcctcctcacgaaaatggtaatcggtctctggagacaccgcagcctgccgcatctctgcctgacaacacaatggtcacccacctattccaaaaatgctgcctcgtgcagcggattctcgaagcatgggaggccaatgatcacacccaagcagccggaggtatgaggcgcggaaacatgggtcacctaacccgaatcgctaacgccgttgtgcagaacctggagcgaggtcccgtccagacccatatcagcgaagtaataagaggactccccgctgattgccgtggaaggtgggaaagttttgtcgaagagaccctgacggaaacgaaccggagaaatactgtggatctggcctttagcgattatcagatacagcagatgactgctaacttcgtcgatcagtttgggtttaacgacgaggagttcgcggatcaggacgacaatatcaatgccccattcgatcgtatagctgaaatcaattttaacattgacgccgatgaggactcaccgagcgccgcactattcgaggcttgctgctctgataggattcagccgtttgacgacgacgaagatgaggacatctgggaggactctgacacccgctgcgcagccagggttatggctaggcctcggtttggcgctccccatgccagcgaatcttgcagcaagaatggccctgagcgaggagggcaggacggtaaggcctcactagaggctcacagggatgccccaggggcaggcgctcctccagcacctggtaagaaagaggccccacctgttgagggcgactcggagggcgcaatgtggactgccgtttttgacgaacctgccaacagcacacctactgctccaggagttgtgcgcgatgtgggaagtagcgtatgggccgcaggcactagcgcgcctgaggagaagggctgggccaaattcaccgattttcaaccattctgctgcagtgaaagcggccctcgctgcagttctcccgtcgatacagagtgctcccatgcggaggggtctcgttcacagggccctgaaaaggcattttcaccagcctcaccatgcgcttggaatgtttgtgttacacggaaggccccactcttggcctctgactcgagctcttccgggggttcccactccgaggacggggatcagaaagctgccagtgctatggatgccgtaagcagaggcccaggacgggaggcccctccactgcccacagtagccaggacagaggaggctgtgggccgagtgggatgcgccgacagccgactcttaagcccagcttgccctgcccctaaggaagtgacagcagccccagccgtggctgtgccccctgaagctactgttgccatcaccactgccttgtcaaaagcgggtccagccattcccacccccgctgtctcctccgccttagcagtggctgtgcccctgggacccataatggcagttacggctgcgccagctatggttgccacgttaggtaccgtcaccaaagacggaaaaacagatgccccacctgaaggcgctgctctcaatggaccagtctag

SEQ ID NO: 29504 - DNA, 789 bp, Artificial Sequence
  Description of Artificial Sequence: Synthetic coding sequence
atggctctgagtcttgggtggaaggcccaccgcaatcattgcggactgctgctccaggccttgaggtcttccggtctactgttgtttccatgcggtcaatgtccctggcggggagcgggtagctttttggacccagaaatcaaagcttttttggaggagaacacagaggtaacgagctccggatcgctcactcccgagattcaactccgcctgttgacccccaggtgcaagttttggtgggaacgcgctgacctatggccacattcagacccttactgggccatctattggcctggaggccaggctctgtctaggtacctgctcgacaatccagacgtggttcgcggaaagtccgtgctcgatttgggcagcggctgtggcgcaacggccatcgcggctaaaatgagtggagcttccagaattctggcaaacgacattgatcctattgctggaatggctatcaccctgaattgcgagctgaatcggttaaacccctttcctattcttattcaaaacatcttgaacctggagcaggacaaatgggacctcgttgtgctgggtgatatgttctacgatgaagatcttgccgacagtctccaccaatggctgaaaaagtgcttctggacttacaggacccgggtactcattggtgaccccggtagacctcaattttcaggtcactctattcagcatcatttgcataaagtcgtagagtactctctgctggaatcaacgaggcaggagaattcagggttgacgactagcaccgtgtggggcttccagccatag

SEQ ID NO: 29505 - DNA, 2718 bp, Artificial Sequence
  Description of Artificial Sequence: Synthetic coding sequence
atggaggtgcaggttagccaggctagcctgggctttgagctcacgtccgtagaaaagtccctgagggagtggagccgccttagtcgggaagtcatcgcctggctatgtccaagttctcccaatttcatcctgaattttcccccacctccatcggccagctccgtgagtatggtgcagttgtttagttcacctttcgggtaccaaagtcccagtggacatagcgaggaggaacgggagggcaacatgaaatctgctaagccccaggtcaaccacagtcagcatggtgaatcacagcgggcactgtctcccctgcagagcaccttgagctctgccgcaagcccatcacaggcgtatgaaacctatatcgaaaacggcctgatatgtctgaagcataagattcgcaatatcgaaaagaagaagctcaagctggaggattacaaagatcgtttaaagagcggcgaacatctgaatccggaccagcttgaggccgtggagaaatatgaggaagtgctgcacaacctggaatttgccaaagaactgcagaagactttctctggcctgagcctggatctcctgaaggcacagaagaaagcgcaacgaagagagcacatgcttaaactcgaggctgagaagaagaagctcaggaccatcctccaggtgcagtacgttctgcagaatctgacacaggagcacgtgcaaaaagattttaaaggcggactcaacggagcagtgtatcttccatccaaggaactggattatttaatcaagttctcaaagctgacctgtcctgagcgcaatgagtcacttagtgtggaagatcagatggagcagtccagcctgtacttctgggacctgttggaggggtccgagaaggcagtagtgggcacgacatacaagcacctgaaagatctgttatccaagctcttgaacagcggatattttgaatcaatccccgtgcccaagaacgctaaagagaaggaagtgccattggaggaagagatgttgatccagagcgaaaaaaaaacccagctgtccaagacggagtcggtcaaggagtcagaaagccttatggaattcgcacagccagagatccagcctcaggagtttctcaatagacggtacatgaccgaggtcgattactcgaataagcagggtgaagagcagccttgggaggcagactatgcaaggaagccaaacctgcccaagagatgggatatgttgactgaacccgatggccaggaaaagaagcaggagagctttaaatcctgggaggccagcggcaagcatcaggaagttagcaagcccgcagtctctcttgaacagaggaaacaggatacaagcaagctcagaagcaccctccctgaagagcagaaaaaacaggaaatatccaaatccaagccatccccctcccagtggaaacaagacactccaaaaagcaaagctggctacgtccaggaagaacaaaaaaagcaagagacgccaaaactctggcctgtgcaactccagaaggaacaggaccccaaaaaacagactcccaagtcgtggaccccatcaatgcagtctgagcagaatacgacaaagagttggacaacaccaatgtgcgaagagcaagattccaaacagcccgagacccctaaaagctgggaaaacaacgtggaatcccagaagcactcccttacgagccagtcccagatatcccctaagtcctggggtgtagccaccgcttccttgattcctaacgaccagctcctgccccgaaaactaaataccgagcccaaggacgtccccaagcctgtgcatcagccagtgggctcatcatctacacttcccaaggaccccgtgttgagaaaggaaaaactgcaggatctcatgacccagattcagggcacctgcaactttatgcaggaaagcgtcctggacttcgataaacccagctccgccattcctacgtcacagccaccaagcgcaacacccggaagtcctgtagccagcaaggagcagaacctgagtagccagagcgatttcttacaggagcctctgcaagccgctatacccccaggcaaacagccttccagtctggcttcacctaatcccccaatggctaagggctctgagcaaggctttcagagtccgccagctagcagtagcagcgtcacaattaatacggcaccatttcaggccatgcaaaccgtgtttaacgtgaacgcaccactgccaccccgaaaggagcaggagatcaaagagagcccttattcccccggatacaatcagtcgtttacgactgcatccactcagactcccccacagtgccaactgccctccatccatgtggaacagactgtgcactcccaggagaccgcccagacaaacgtctttcctagacccacccagccatttgttaattctaggggctcagtaagggggtgtacccggggtgggagactgatcacaaacagttacaggtcccccggaggatataaaggtttcgacacgtaccgtgggctgccctccatcagcaacggaaactattcccagttacagtttcaggcccgtgaatacagcggcgcaccatattctcagcgtgataacttccagcagtgctacaagagaggcggtacaagtggcggaccacgggctaactcacgcgctaactgtttcatcatgagaaactcccttctgctgataaagcagcagggcggagtgattcttctgagatag

SEQ ID NO: 29506 - DNA, 1107 bp, Artificial Sequence
  Description of Artificial Sequence: Synthetic coding sequence
atgagcttgtttggcaccacgtcagggtttggaactagcggaaccagtatgtttgggagcgcaaccacagacaaccataaccctatgaaagacattgaggtcactagctcccctgacgactcgatcggctgtctgagtttctctccccctactctccctggcaattttctgatagcgggaagttgggccaacgacgtgcgatgctgggaggtgcaggactccggccagacaattcccaaagcccagcagatgcatactggcccagtgctggacgtatgctggagtgatgacggctccaaggtgttcactgcgagttgcgataaaacggctaagatgtgggacctatcttccaatcaggccattcaaatcgctcagcacgatgcccctgttaagacaatacactggatcaaagcccctaattattcgtgtgtcatgacgggcagctgggataagaccctcaagttttgggacaccaggtcctctaacccaatgatggtactgcagctcccggaaaggtgctactgtgccgacgttatttacccaatggcagtggttgccaccgcagagcgtgggctgattgtttatcaattagagaatcaaccatccgagtttcgcagaattgagtcaccattgaaacatcaacataggtgtgtcgccatctttaaagacaagcagaataagcctaccggcttcgctttaggatctatcgagggccgtgttgctattcactacatcaacccacccaacccagcaaaggataacttcacatttaaatgtcaccgttcaaacggcacaaatactagcgccccacaggacatctacgctgtcaatgggatcgccttccatccggtgcatggcaccctcgcgactgttggcagcgacggcagattttcgttctgggacaaggacgctcgaaccaagttaaagacctcggaacagctcgatcagccgatcagcgcttgctgtttcaaccataatggcaacattttcgcctacgcgagcagctatgattggagcaagggccatgaattttataaccctcagaagaagaattatatcttcctgcggaacgccgcagaggaattgaagccacggaataagaaatag

SEQ ID NO: 29507 - DNA, 1107 bp, Artificial Sequence
  Description of Artificial Sequence: Synthetic coding sequence
atgagtttgtttggcacaacatcaggttttgggactagtggtacgtctatgttcgggagtgccacaaccgacaaccacaaccctatgaaggatatcgaggttaccagtagccctgacgactcaattggatgtctgtccttctccccccctactctgcctggcaattttctgatcgcagggagttgggctaacgacgttaggtgttgggaggtgcaggattcgggccagaccatccccaaggcccaacagatgcacaccggccctgtgctcgatgtttgctggagcgacgatggaagtaaagtgtttactgctagctgcgataaaacagccaaaatgtgggacctttcctcaaaccaggctatccagatcgctcagcacgacgcccctgttaaaacgatacactggattaaagctccaaattactcatgcgtgatgactggttcctgggataagaccttaaaattttgggatactagaagttcaaatcccatgatggtgttgcaactacccgagcggtgctactgcgctgacgtgatctatcctatggcagtggtggccacagctgagcgcggtctcattgtttaccagctagaaaaccagcccagtgagttcagaagaatagagtcgcctctgaagcatcaacatcgatgtgtcgctatctttaaggataagcaaaacaagcctaccggctttgcgctcgggagcatcgaggggagggtggccatacactatataaacccaccgaaccctgcaaaggacaactttacattcaagtgccaccgttcgaatggcaccaacacaagcgccccacaggatatctatgcggtgaacggaatcgcattccacccagtgcacggtactctggcgactgtgggctccgatggccgtttctccttttgggataaggacgccagaactaagctaaagaccagtgaacaattagatcagcccataagtgcctgctgttttaaccacaacggcaatatctttgcctatgcctcttcatatgactggtctaagggacacgagttttataatccccagaagaaaaattatatattcctcaggaatgcggctgaagagcttaaaccgcgtaataaaaagtag

SEQ ID NO: 29508 - DNA, 2745 bp, Artificial Sequence
  Description of Artificial Sequence: Synthetic coding sequence
atgagtagctctggatatcctcccaatcagggggcatttagcactgaacagtcccgatatcccccacattcagttcagtatacttttccgaacacccgccaccagcaggaccctgcctttggcggtaagcacgaggctccatctagtccaatctccgggcagccgtgcggcgatgatcagaatgcaagtccgtccaaattgagcaaggaggagctcatccagtctatggatagggttgatagagagatcgctaaggtggaacaacaaatcctgaagctgaagaagaagcagcaacagctagaggaagaggccgctaaacctccagaacctgaaaagcctgtgagtcctccgcctgtggagcaaaaacaccggtccatagtgcaaatcatatatgacgaaaaccggaagaaagcggaggaggctcataagatttttgagggcctggggccaaaagtcgagttgccgctttataaccaaccatctgacactaaagtgtatcatgagaatattaaaaccaatcaggtcatgcgtaagaaactgatccttttcttcaagcgtagaaaccatgccaggaagcagcgtgaacaaaagatctgtcagcgttacgatcagctgatggaggcctgggaaaaaaaggtcgatcgcatcgagaataatcctcgccgtaaggcaaaagaatccaagacaagagagtactatgaaaagcagttccctgaaatcaggaagcaacgtgaacagcaggagaggtttcagagagtagggcagcggggagccggtcttagcgccacaattgccagaagcgagcatgagatctcagaaataattgatggactgagcgagcaggagaataacgagaagcagatgagacaactcagtgtcataccgcctatgatgtttgatgctgaacaacggcgtgtgaagtttatcaacatgaatggcttgatggaggaccctatgaaggtatacaaagacagacaattcatgaacgtctggaccgaccatgaaaaggagatctttaaagacaagttcattcagcatcccaagaatttcggactcattgcaagctatttggagagaaagtcggtgcctgattgtgttctgtactattacctgacaaagaagaacgagaattataaagctcttgtccggagaaattacggtaagagacgaggacgaaatcaacagatagccagaccttcccaagaggaaaaagtggaggagaaagaggaagacaaggcagaaaagactgagaagaaggaggaggagaaaaaagacgaagaggaaaaagatgaaaaagaggatagcaaggagaacaccaaagagaaggacaagatagatggtaccgctgaggaaacggaggaaagggaacaggctaccccgagaggcaggaaaaccgccaactcccagggcagaaggaaaggtcgtataactcgctccatgactaacgaggcagccgctgcttcagctgccgctgctgccgctaccgaagaaccaccacctcctttaccgccaccacctgaaccaataagcactgaaccggttgaaacctcccgctggacagaagaggagatggaggtggcgaaaaaagggttggtcgagcacggtcgtaactgggcggctattgcaaagatggtgggcactaagagcgaagcccagtgcaaaaatttctactttaattataagaggcgacacaatctggacaatctccttcagcagcacaaacagaagacgtccagaaaacccagggaagaacgggatgtgtctcagtgcgagtccgtcgcttctactgtgagtgctcaggaggacgaggatatagaagcgtctaacgaagaggagaacccagaagactcggaaggggcagagaattcctcagacacagagtctgccccaagtccctcccctgtggaagcagttaagccaagcgaagatagccctgagaacgcaacatccagagggaacaccgagcccgcagtagagctggaacccacaaccgagactgctccttctacaagcccctcactcgccgtgccctcaactaagcccgctgaagacgagagtgtggaaactcaagtaaacgactcgatttccgccgaaacagcagaacagatggacgtggatcagcaggagcattccgctgaggaggggtccgtgtgcgacccccctcctgcaactaaggctgattcagtagacgtggaagtacgagtcccagagaaccacgcatcaaaagtagaaggcgataacacaaaagaaagagacctggaccgggcatcagaaaaggtggagcctagagatgaagacttagtggtcgcacaacagatcaacgcccaacgccctgagccccaatcagataacgacagtagcgccacctgctccgccgacgaggacgtggatggggaacctgagcgccagcgtatgtttccaatggactctaaacccagtctgttgaatccaacgggctctatcttggtctcctctccactcaaaccgaacccgcttgatctaccacagctacaacaccgggcagccgtcataccgccaatggtatcttgtacaccttgcaatattccaattggtactccagtcagcggatacgctctctatcaacgccatatcaaggctatgcacgagtccgccctgctggaagagcagcggcaaagacaggaacagattgatctcgagtgtaggagtagcacatccccctgcggtacctctaaatcaccgaacagggaatgggaggggcgatag

SEQ ID NO: 29509 - DNA, 7031 bp, Artificial Sequence
  Description of Artificial Sequence: Synthetic coding sequence
atgagtagctccggctaccctccaaatcagggcgctttttcaacagagcaatctagataccccccacactctgtgcagtatacatttccgaacactcgacatcagcaagacccagcctttggagggaagcacgaggcacccagctccccaatttccggacaaccctgcggcgacgaccagaacgcctcccccagtaaactctccaaagaggaactgatccagtctatggatcgggtggaccgcgagatcgccaaggtggagcagcagattctaaagctgaaaaagaaacagcagcaactcgaggaggaggcggctaagcccccagagcccgaaaagcctgtgtcgcccccaccagttgagcagaaacacagatcaatagtccagattatctatgatgagaataggaaaaaagcagaggaggctcacaagatatttgaggggctagggcctaaagtggaattgccactctataatcagccctctgacactaaagtgtaccacgaaaacattaagacaaaccaagtcatgagaaagaagctgatcctgtttttcaagcggcgaaatcacgcacgcaaacagagggaacagaagatctgccagcggtacgaccagttgatggaagcctgggagaaaaaagtcgatcgcattgagaataacccaaggagaaaggccaaagagtctaagaccagggagtactatgagaagcagttccctgaaatccggaaacagagggagcagcaggagcgctttcagagagtggggcagcgtggggctggactcagtgccacaatcgccagaagcgagcatgagatttctgaaatcatcgacggtctgagcgaacaggagaataacgagaaacagatgcgtcaactctcagtcatcccccctatgatgtttgatgcagaacagcgcagagtcaagtttatcaatatgaacggcctgatggaagatccgatgaaggtctacaaggaccgacagttcatgaacgtgtggacagaccacgagaaggagatctttaaggacaagttcattcaacaccctaaaaactttggcctgatcgcttcgtatttggaacgaaagagtgtgccggattgcgtcttgtattactacctgactaagaaaaatgagaactacaaagctctagtccggagaaattatgggaagcgtagaggcaggaaccaacagatcgcccgtcctagtcaggaggagaaagttgaggaaaaggaagaagacaaggccgagaaaactgaaaaaaaagaggaggaaaagaaagacgaagaggagaaagacgagaaagaggacagcaaggaaaacacgaaggagaaggacaagatcgatggcactgccgaggagacagaagagcgggagcaagctacaccgaggggcaggaagactgccaattcacagggtcggaggaagggcaggataaccaggtccatgaccaacgaagcagcggctgcgtctgccgcagcagccgcagctactgaagagcctcccccaccgctccccccacccccagagccaatctccactgaaccggtggaaacaagtaggtggacggaggaagaaatggaggtcgcaaagaaaggactggttgaacacggtcgaaattgggcagcaatcgcaaagatggtgggtactaagagtgaggcacagtgcaagaacttttacttcaactacaagcgccgacacaacctggataaccttttgcagcagcataagcaaaaaacctcgcggaaacctcgagaggagcgggacgtgtcccaatgcgagagcgtcgcaagcacggtgagtgcccaggaggacgaagatatcgaagctagtaacgaagaggagaatccagaggattcagaaggggctgagaattcctccgatacggaaagcgcccctagtccaagcccagtggaggccgtgaagccctccgaggatagccccgaaaacgccacgtctcgcggtaacaccgagccagctgtcgagctggaacctaccactgagactgcgccatcaactagccccagcctggccgtaccctcgacaaaacctgcagaagatgagagcgtggaaacccaggtgaacgatagcatcagcgctgagacagccgaacagatggacgtagatcaacaggagcattctgccgaagagggatccgtgtgtgatcctcctcccgctaccaaagccgatagcgtggacgtggaggtgcgagtcccagaaaatcatgcgtctaaagtggagggggacaacacaaaagagcgggacctggacagagcctcagaaaaggtggagcccagagacgaggacctcgtagttgcccaacagatcaacgcccagcgtcccgagccccagtccgataacgatagcagtgcaacgtgcagtgctgacgaggatgtcgatggggaacctgagagacagaggatgttccctatggactccaagcccagtttgttaaaccccacaggatccattcttgtctctagccccctcaagccaaatcccttggacctcccccagttgcaacatagagcggctgtcatcccgcctatggtgtcatgcaccccctgcaacatacccatcggcactcctgtgtccggctacgcactgtatcagaggcacattaaggccatgcatgaaagcgcccttctcgaagagcagagacagcgacaggagcagatagatttggagtgtaggtcttctacaagcccttgtggcacaagtaaatcgcccaaccgcgagtgggaggtgcttcagcccgctccacaccaggtaatcacgaatctgcctgagggggtacgcctgcccacgacccgacctacgaggcctcctcccccactgattccatcatccaaaacaacagtggcgagcgaaaaaccctccttcataatgggcggttctatatcccaggggactccaggcacatacctcacatcccacaaccaggcctcgtacacccaggaaacccctaagccttcagtgggctcaattagtctgggcttgcccagacagcaggaatccgccaaaagtgccactttgccatacatcaagcaggaggaattcagccccaggagccagaacagccagcccgagggcctactagttagggcccagcacgaaggcgtggtccgcggaacagctggagcaattcaagagggctccatcacccgagggacacctacatctaagatatcggtggagagcattccctccttacgaggctctatcacacaaggcaccccagccctgccacagacaggcattccaacggaagccctagtcaaggggtccattagccgtatgcccattgaagatagttctcctgagaaaggcagagaggaggcggcttctaaaggtcatgtaatctatgaggggaaatcaggccatattctatcctacgacaatatcaagaacgccagagaggggactcgcagcccaagaaccgctcatgaaatctccctgaagagatcatacgaatccgttgaagggaacatcaaacagggaatgagcatgcgggagtctcctgtatccgctccactggaaggactgatctgtcgtgcactgcccagaggctctccacactcagatctgaaagagcggacagtgttgagtggtagtatcatgcagggtaccccaagagccacgaccgaaagcttcgaggatgggcttaagtaccctaagcagatcaagagggaaagtccgcctatccgggctttcgagggagctattaccaagggtaaaccctacgacggcataacaacaataaaagagatgggaaggtcaattcatgagatccctcgacaggacatccttactcaggagtctcgaaaaaccccagaagtggttcagtcaacgaggccgatcatagagggcagcatctcacaaggcacccctatcaagttcgacaataacagtgggcagagcgctattaagcataacgtcaagtcacttataaccggtccatccaaactgagccggggaatgccacctttggaaatcgtgccagaaaacatcaaggtagtggaaaggggtaagtatgaggatgtcaaggccggagaaaccgtccggagccgccacacctccgtggtctctagcggtccctccgtgttgcgttccactctgcacgaggcccctaaagcccaattgagtcctggcatttacgacgacacatctgcacgtcgaactccggtctcatatcaaaataccatgagtcggggttcacccatgatgaatagaaccagcgacgtgagttccaacaaaagtaccaaccacgaaagaaagtcaactcttacacccacccaaagagaatcaattcccgctaagagccccgtgcccggtgtggatcccgtcgtgtcacacagtccattcgaccctcatcatcgtggaagcacagccggagaggtgtatagatcacatttgcccacacacctggatcctgccatgccatttcatcgggctctggatcctgccgcagcctacctgttccaacggcagctcagtcccacacctggttatccaagtcagtaccaactgtacgctatggagaacacgaggcagacaatcctgaacgattacataacatctcaacagatgcaggtgaacctgagacccgacgtcgctagggggctatcccctagagaacagccacttgggctgccgtatccagcgacgcgcggaatcatcgatcttacaaatatgccccctacaatcctggtgccgcaccctggaggcacaagcacgcctccgatggatcggatcacctacatccccggaacacagatcaccttcccgccaaggccttataacagtgccagtatgtctcctggccaccccacgcatttggctgccgcagcttcagccgaacgcgagagggagcgtgaacgagagaaggagcgcgagcgcgagagaatcgctgccgcatctagtgacctctatctgagacccggatccgaacagcccggtaggcctggttcccatgggtacgtacgttccccatctccctccgttaggacccaggagaccatgcttcaacaacggccatctgtgtttcagggaactaatgggactagtgtcattactccgttagatcctacagcccagctccgaataatgcctctgccagctggcggtcccagtatttcccagggcctgcccgctagtagatacaacacagctgccgatgctctagccgctctcgtggacgcggcagcctcagcccctcagatggacgtcagtaaaaccaaagaatccaaacacgaggcagctcgcctggaagagaaccttagatcaagatctgccgcagtgagtgagcaacaacagttagaacaaaagaccctggaagtcgaaaagcgctccgttcaatgtctgtacacctctagcgcgttccctagtgggaagccccagccacactcctctgtggtctactcagaggccggaaaggacaaaggcccacctccaaagtctcgatatgaagaagaactgcggactcggggaaaaaccacaataacagccgctaacttcattgacgtgattataactcgacagatcgctagcgacaaagatgccagagagcgagggtcccaatcatctgactcttccagcagcctgtcttctcataggtacgagactccaagtgatgcaattgaggtgataagccccgcttcaagtcctgcaccgccacaagagaaactgcaaacgtatcagcccgaagtggtgaaagcaaaccaggctgagaatgatccaacacgtcaatacgaagggcctctgcaccactaccgaccccagcaggagagcccgagtccccagcagcagttaccgccatcttctcaggctgaaggcatgggacaggtgcctcggacacatcgactcatcaccttggcagaccatatttgtcaaatcatcacccaggacttcgcccgaaaccaggtttctagccagactccacagcagcctcccacttcaacctttcagaattcaccttctgcactggtgtccaccccagtgagaactaaaacgagcaatagatatagcccagagagccaggcccagtccgtccatcaccagcgacctggatcccgcgtttccccagaaaaccttgtggacaagagccgcggtagccggccaggcaaaagtccggagcgcagtcacgtgtcctctgagccatatgagccaatctctccaccccaggttcctgtggtccacgagaagcaggattccctgctgcttctgagccagcggggtgcagaacccgcagaacagcgaaatgatgccaggtctcccggaagtattagctatctgcccagcttcttcacaaaactggagaatacttcgccaatggtgaagtcaaaaaaacaagagatttttaggaaactgaattcaagcgggggtggtgacagtgatatggccgcagctcaacctggtacggagatatttaacctgccagcggtgacgaccagtggcagtgtgtcatcccggggtcatagttttgctgaccctgcctctaacttggggctggaggacattattcgtaaggccctgatgggcagtttcgacgacaaggttgaggaccacggggttgtgatgtctcagcctatgggagttgttccgggaaccgcaaatacttccgtagtgacgtcaggagaaacccggagggaggagggggaccccagtcctcatagcggagtttgtaagcccaaactcataagtaaaagcaattcccgaaagtccaagagtccaatcccaggtcagggctacctgggcaccgagcggccatcaagcgtgagtagcgttcactcggaaggggattaccacaggcagaccccaggttgggcctgggaggatcggccaagttctacgggctccacccagttcccctacaaccctctgactatgagaatgctctcatctacccccccaacgccaattgcttgtgctccatccgccgtcaaccaagcagctcctcatcagcagaatcggatctgggaacgagaaccagccccacttctatcggctcagtatgagactctttcagacagtgacgacta

SEQ ID NO: 29510 - DNA, 7013 bp, Artificial Sequence
  Description of Artificial Sequence: Synthetic coding sequence
atgtcaagttctggttatccacctaaccagggagctttctctaccgagcaatcccgataccctcctcacagcgttcagtatacgtttcccaacactagacaccagcaagagtttgcagtgccagactataggtcctctcacctggaggtgtcacaggccagtcagctgttgcagcagcagcagcagcagcagctccgcagacggccttcgttgttgtcagagttccaccccggaagcgaccggcctcaggaacgtcggacaagctatgaaccttttcacccaggccctagccccgtggatcacgactccctggagtccaagagaccccgtctggaacaggtgtccgactcccacttccagcgcgtttcagccgctgtgctgccactggtgcatcctctaccagagggcttacgggcatctgcagacgccaagaaggacccagctttcggagggaaacacgaggcgccttcaagtcccatctccggacagccctgcggcgacgatcagaatgcaagtccatcaaagctgagtaaggaggaactgattcagtctatggatcgcgttgatagagaaatcgctaaagtggagcaacagatcctcaagctgaagaaaaaacaacagcagctagaggaagaagccgcaaagcctcctgaaccagagaagccagtttccccgcctccggtggagcagaaacatcgctctatcgtccagataatctatgacgagaataggaagaaagccgaggaggcccataagattttcgaagggttagggcctaaagtagagctgcctctttacaatcaaccaagtgacacaaaagtttaccacgagaacataaagaccaatcaggtcatgcgtaaaaaactgattctcttcttcaagcgacgcaatcacgccaggaaacagagagaacaaaagatctgccagcgctacgaccagcttatggaggcctgggagaagaaagtcgacagaatcgagaataatccgaggagaaaggctaaagaaagcaagacgcgggagtactacgagaaacagttccctgagattcggaaacaaagggagcagcaggagagattccagcgcgtagggcagcgaggtgccggattgagtgcgacaatcgccagatcagaacatgaaatttccgagattattgatggcctgtccgaacaggaaaacaatgagaagcagatgaggcagctgtccgtaatcccacctatgatgttcgacgcagagcagcggagagttaaatttattaatatgaatggtctcatggaagatcccatgaaggtatacaaagaccggcagtttatgaacgtgtggaccgatcatgaaaaagaaattttcaaggacaagtttattcagcaccctaaaaacttcggcctgatcgcttcctacctggaaaggaagagcgtcccagactgcgtgctatactattaccttactaagaagaacgaaaactacaaggcactcgtgaggagaaactatggtaagcgcagggggagaaatcagcagattgccagacctagccaggaggagaaagtggaagaaaaggaagaggacaaagccgagaagacagagaaaaaagaggaagagaaaaaggatgaggaagagaaggatgagaaggaggacagcaaagaaaacacaaaggagaaggataaaatcgacgggacagccgaagagaccgaagagcgtgaacaggccaccccgcgtggcaggaagaccgctaacagtcagggacgcagaaaagggagaattacgaggtctatgactaatgaggctgcagcagcatccgccgctgccgcagccgcaacagaggaaccaccccctcccctgcctccccctcccgaacctatctcaactgagccagttgagacgtctaggtggacggaagaagagatggaggtagccaagaaaggactcgtagagcacggaaggaattgggccgcaatcgccaagatggtgggcaccaaaagcgaagcacagtgcaagaatttttatttcaattataaaaggagacacaacctggacaacctcctgcagcagcataaacagaaaactagtcggaaaccaagggaggagcgagatgtctcacagtgcgaatccgtcgcctctactgtttcagcacaggaggatgaggatatcgaagcctccaatgaagaagagaatcccgaggactcagaaggggctgagaacagctccgacacagaatccgcgccatctccttctccagtggaagccgtgaagccaagtgaggactcaccagaaaatgccacctctaggggcaataccgagcccgcagtggagctggagccaactacggagaccgcaccctctacaagcccttccctcgccgtgcctagcaccaaaccggctgaggatgagagcgttgagacgcaggtcaacgactccatttcggctgagacggcagaacagatggacgtagaccagcaggagcacagcgccgaggagggctcagtatgcgatccacccccagctacaaaggcagactccgtggatgtggaggtgagagttcctgagaaccacgcgtctaaagtagagggggataatacaaaagagagggacttggaccgggcatctgagaaggtggagcccagagacgaggacctggtcgtagctcagcaaatcaacgcccagcgcccagaaccccagtccgacaatgactcaagcgctacatgttccgccgacgaagacgtggacggcgaacccgaacggcagaggatgttccccatggattccaagccatccctgctgaacccaactggaagtatcctagttagctcccctctgaagcctaatccattagacctaccccagctgcagcacagggccgctgttatcccccctatggtgagctgcaccccatgcaatatcccaataggcacaccagtgtcaggctacgctctgtatcagagacacatcaaggccatgcacgagtcagcactgctcgaggagcagcgccagcgtcaggagcaaatcgatcttgagtgtcgctcctctacctccccctgtggaaccagtaagtctcccaacagagaatgggaagtccttcaacctgcgcctcaccaagtgattaccaacctccctgaaggcgtacgactgccaaccactcgccctacaaggccgccaccacctctcattccgtccagcaagaccactgtcgcctcagagaaaccctctttcatcatgggcggttccatttctcagggcactccgggtacttacctgacctcacataatcaggcaagttatacacaggagacgcctaagccctcagtgggctccatctccctgggactgccccgtcagcaagagtccgctaaatctgccacactgccttacatcaagcaggaagaattcagccccagatctcaaaactcacagcctgagggactcctggttagggcacagcatgagggcgtggtgaggggaaccgcaggcgctatccaggagggaagcatcacaaggggtacccccacatctaaaatttctgtcgagagtattcccagcctgcggggatctataacccagggtacccccgcactccctcagaccggtatccctactgaggccttggtcaagggatctatctctcgcatgccaatagaagactcaagtcctgaaaagggtagggaagaagccgctagcaaggggcatgtgatttacgaaggcaagtctgggcacatcctatcctacgacaatatcaagaatgccagagaaggtacacggagcccaagaactgcacatgagattagcctgaaacgctcttacgagtccgtcgaaggaaacataaagcaaggaatgtccatgcgcgagtctcccgtctctgctcccctcgaaggcctaatctgccgcgctctgccccgtggttcacctcactcagatctcaaagaacggacagtgctcagcgggagtatcatgcaaggcacgcctcgcgctacaacagagtcctttgaggacggcttgaaatatcccaaacagatcaaaagggaatctcctcctatccgcgcatttgaaggagctatcaccaaagggaaaccatacgatggcataacaaccattaaagagatgggacggagcatccacgagattcctagacaggatatccttacccaggagtccaggaagacgcctgaggttgttcaatccacccggcctatcattgaggggtctatatcccagggtactcctattaagttcgacaacaactccggacagtctgccatcaagcataatgttaagagtctgataacaggcccttcaaagttgagtaggggcatgccccctctcgagatcgtccctgagaacattaaggtcgttgaaaggggcaaatacgaggacgttaaagccggagaaactgtgaggagtcggcacacaagcgtggtgtccagcggaccttcggtgcttcgaagcacactgcatgaagcccctaaagcgcagctctcaccaggcatatatgatgatacaagcgcacgacggacccctgtcagttatcagaacacaatgtctagaggatctccgatgatgaacaggactagcgacgtgacaatctcgagcaacaagagtaccaaccatgaaagaaagtccaccttaaccccaactcagagggagtccattccagcaaagtcccccgtccccggagtggatcctgtggtctcacactctccttttgacccccatcaccgcggtagcaccgcaggagaagtgtatcgctcccacttaccgactcatctcgatcccgcaatgccattccatagagcactggacccagctgctgccgcatacttgtttcaacgtcaattaagcccgacgcccggttatcctagtcaataccagctttatgctatggagaatacaaggcagactatccttaacgattacataacctctcaacagatgcaggtgaacctccggccagacgtagcacgaggactgagtcctcgtgaacagccattgggcttgccttacccagcaacacgtggtatcatcgaccttacaaatatgccacctaccatcctggtcccgcatccaggaggtacgtccacccctccaatggatagaatcacctatattccgggtacccagatcacctttcctcctcgaccttataattcagcaagcatgtcccccggacaccccacccatctggccgctgccgcttcggcagaaagggagagagaacgggagcgtgaaaaagagcgtgagcgcgaacggattgcggctgcctcctctgatttgtatctgaggcccggatcggagcagcctgggagaccagggtcccatggttatgtgcggtccccttctcccagtgtgcgaactcaagagaccatgctgcagcagcgcccatccgtcttccaggggacgaacggtacctcggtcataaccccactggatcccactgctcagctgaggataatgcctttgccggctgggggacctagcatcagtcagggcttacccgcaagccggtacaatactgccgctgatgccttggctgcactcgtggatgctgctgcgagtgctccacagatggatgtgagtaaaacgaaggagatcagtagccatcggtacgagaccccatcagatgcaattgaggtcatctctccagctagttcgccagcgcctccccaggagaagcttcagacctatcagcctgaagttgttaaggcaaatcaggcagaaaatgaccctacgagacagtacgagggccctttgcaccactaccggcctcagcaggaatctccaagccctcaacagcagttgcctcctagctcacaggccgaggggatgggacaagtgccacggacacaccggctgattacccttgcagaccatatctgtcagattatcacccaagattttgcaagaaatcaggtgtcttcacagacaccgcaacagcccccaacctccaccttccagaacagcccctctgctcttgtatctacgccggtacggaccaaaaccagcaatcgctatagcccagaatctcaggcccaatctgtgcaccaccagaggcccggatcaagagtgagccctgaaaacctggtagataagagcaggggtagcaggcccggtaaaagccctgagagaagccacgttagttccgagccttacgagcctatctcgccaccccaagttcctgtggtccatgaaaagcaggattccctcctgcttctcagtcagagaggggctgagcccgcagagcaaagaaacgatgccaggagtcccggttcaattagttacttgcctagctttttcacaaaactggaaaacacatctcctatggtgaagtctaaaaagcaagagattttcaggaaactcaatagttcaggcggaggagatagcgacatggccgcagcccaaccgggaaccgaaatcttcaacctgccagccgttactacgagcggcagcgtatcctcacgaggacacagttttgccgatcctgccagtaaccttggtctggaggatattatacgcaaagccctgatggggagctttgacgataaggtggaagatcatggtgttgtcatgtcacagcctatgggtgttgttcctgggaccgccaatactagcgttgttacctccggtgagacccgcagggaagagggagacccttctccacactctggcggtgtatgcaaacccaagttaattagtaaaagtaactcacggaaaagtaaatctcccatcccaggtcaagggtacctggggacagaacgcccttcatccgtgtcctccgttcacagcgaaggtgactaccacaggcagactcccggatgggcttgggaggaccggccttcgtcaaccggttctactcagttcccctacaaccctcttaccatgaggatgctgtctagtacccccccaaccccaatagcttgtgctccgtcggctgtgaatcaagccgcacctcatcagcaaaatcggatttgggaacgcgaacccgcaccactcctgtctgcccagtacgagacactgtcagatagtgatgatta

SEQ ID NO: 29511 - DNA, 3075 bp, Artificial Sequence
  Description of Artificial Sequence: Synthetic coding sequence
atgcctccattggagattgtgccagagaatataaaggtagtggagcgaggcaaatatgaagacgtaaaggcaggcgaaaccgtaagaagccgtcacacttctgtagtcagttccggacctagtgtcctgcgttctacgctgcatgaagcccctaaggcccaactgagccccggaatttatgacgatacttccgcgagacggactcctgtatcatatcagaacacgatgtctaggggttctccaatgatgaatcggacaagtgatgtcactatttcatcaaacaaaagtaccaatcacgagcgtaagtctacattaactcccacacagagagagtcaatccccgctaagtcccccgtgcccggtgtggatcccgtggtatcccattctccgtttgatccccatcatcggggttctacggcgggtgaggtgtaccgtagccacctcccgacccatttggacccagccatgcctttccatagagctctcgaccctgccgcagctgcatacctctttcagagacagctctcacccactccagggtaccctagccaataccagctctacgccatggagaacacaagacagaccatactgaatgattacattaccagtcaacaaatgcaggtgaacctcaggcccgatgtggccaggggattgtcccctagagagcagcccctcgggctgccctacccggctacacgaggtatcatagatctcaccaacatgccgcctaccatcctcgtccctcaccctgggggtacaagcacgcctcccatggatcggatcacctacatcccagggacccagatcacgttcccacctcggccatacaactccgctagcatgagccccggtcaccctacacatttagccgctgccgcttctgcagagagggagagagaaagagagcgggagaaggagcgggagagagaacgcattgccgcagcttctagcgacctttatctgaggcccggaagcgagcagccagggagacctgggagccacggctacgttcggagcccatccccatccgtccggactcaggaaaccatgctgcagcagcgccctagcgtgttccagggaactaacggcacgtcagtcatcactcctctggatcccaccgctcagcttaggataatgccattgccggctggcggaccaagcatatcgcagggcctccccgcatcccgctataacacagctgccgacgctctggccgctctggtcgatgccgctgcgtccgccccacagatggacgtctcgaagacaaaagaatcgaaacatgaagccgctcggctggaagaaaatctgcgcagtcggagcgccgcagtttcagaacagcagcagctggagcaaaagaccctagaggtcgaaaaacgctccgtgcagtgcctctatacaagttcagcttttcctagcggcaaacctcagcctcacagctctgtagtgtactctgaggcgggaaaggacaagggccctccgccaaagagcaggtacgaggaggaactccgtactcgaggcaagaccaccattaccgctgcaaattttatcgatgtaattattacacgacaaatcgcaagtgacaaggatgcgagggagcgtggtagtcagagcagtgatagctcttcaagtttgtcttctcaccggtacgaaacgccctctgatgcgatcgaggtgatctcacccgcttcctcacccgctccaccccaggaaaagctgcagacttatcagcctgaagttgtcaaagccaaccaggccgaaaacgatcccacaaggcagtacgaagggcctctccaccactacaggccccaacaagagtcccctagcccccagcaacagttgcctccttcttcacaggcagaaggaatggggcaggtgcctcgtactcaccggctgattacactagccgaccacatttgccagatcattacccaggactttgcacgcaaccaggtgtcctcacagaccccccaacagcctcccacgagcactttccaaaactcaccatcagcactggtgtctactcctgttcgcaccaagaccagtaaccgctatagccccgaaagccaggcccagagtgtccaccaccaacggccaggctctcgagtcagtcccgaaaacctcgttgacaagtcccggggttctcgcccaggaaagagccctgagagaagccatgtaagcagcgagccatatgagcctatcagccccccacaggtgcctgtagtgcatgagaagcaagattcactactgttgctaagtcagcggggtgcagaacccgcagaacagcggaacgatgcgagatccccaggaagcatatcctatctgccatcatttttcaccaaattagagaacacgagcccgatggttaaatccaagaaacaggagatttttcgaaagttgaactctagcggaggaggggatagtgatatggccgcagctcagcccggaactgaaatcttcaacctaccagccgttaccacaagcggctctgtgtcctcacggggacatagctttgctgacccggcttccaatttaggactggaggatataattagaaaagccttaatggggtccttcgacgataaggtggaggatcacggggtggttatgagccagccaatgggggttgtgcctgggactgctaacacaagtgtggtcacatcaggagaaactagaagggaagagggtgatccaagcccgcactccggaggagtttgtaaaccaaaactgataagtaaaagtaatagccgtaaatcaaaatctcccattccaggccaggggtacctggggacagagagacccagcagcgtgagctccgtccattcggaaggagactaccatcgccagacccccggatgggcctgggaggaccgtccaagtagcaccggcagcactcagtttccctataatcctctgacaatgcggatgctgtcttccactccgcctaccccaattgcatgcgcacccagcgctgtgaatcaggcagccccacaccagcagaataggatttgggaaagagaacccgcacccctgctgtcagcccagtatgagactctctctgattcagacgattag

SEQ ID NO: 29512 - DNA, 4821 bp, Artificial Sequence
  Description of Artificial Sequence: Synthetic coding sequence
atgctgctgcatctgtgctctgtcaaaaacctgtatcagaatcgcttccttggcttagccgcaatggcatcacccagccgcaattcgcagagtaggcgtcgctgtaaggagcctctgcgctactcatacaaccctgaccaatttcataacatggatttgcgcggtggcccacatgatggagtgaccatcccgcgatccacttcagatacagacctggtgactagcgattctaggtccactttaatggtatcgtcgtcttattacagcatcggccattcacaggacttagtgatccactgggacatcaaagaagaagtcgatgctggcgactggatcggcatgtatttgattgatgaggttctgtccgaaaactttctggactacaaaaatcgcggagtgaacgggtcccaccggggtcagattatttggaaaatcgacgctagctcctatttcgtggaacccgaaacgaagatctgctttaagtactatcatggtgtgtcgggagcccttcgcgctaccacaccaagtgtgacagtcaagaacagcgcggcacctatctttaagtccataggcgctgatgagaccgtccaggggcagggtagccggagattaatcagcttctccctcagcgacttccaggccatgggcttaaagaagggaatgttctttaacccagacccatacctcaagataagcatacaaccgggtaaacactctattttccctgcactgcctcaccacggccaggaacgaaggagcaaaattatcgggaatacagtgaaccccatctggcaggccgagcagttctccttcgtaagcctacctacagacgtccttgaaattgaggtcaaggataaatttgccaagtcaaggcccattataaagcggtttctcggcaaacttagtatgcctgtccagcgtctgcttgagcgacatgccattggagatcgggttgtgtcatatacccttggaaggcggctgcccaccgatcacgtgtccgggcagctgcagtttagattcgagatcacatcatctattcacccggacgatgaagagatctcactgtcaacagaaccagagagcgcgcagatccaggattctccaatgaataacctgatggagtccggcagtggagagccacgaagcgaggctccagagagcagcgagagctggaaacccgaacagctcggcgaaggtagcgtacctgatggtcccggaaatcaatcaatcgagctttccaggccagccgaggaggcagctgtgatcaccgaggccggtgaccaaggtatggtcagcgtaggcccagagggagcaggagagctgctggcccaggtgcagaaggacatccagcctgcaccgagcgccgaagagctggccgaacagctggacctgggggaagaagcatctgccttacttctcgaagatggcgaggccccagcctcaaccaaggaggagcccttagaggaggaggctactacccaaagtcgggctggccgagaagaagaggagaaagagcaggaggaggagggcgatgtgagtactctcgagcaaggtgagggcaggcttcagctccgcgcatcggttaagaggaaatctaggccctgttcactcccagttagtgaattagagaccgtgattgcctcggcctgtggtgatcctgagaccccaagaacgcattatatccgcatccacacacttctccactccatgccatcagctcagggcggaagcgccgctgaggaagaagacggtgctgaggaagagtcaacactgaaggacagttcagagaaggatggtctaagcgaagtagatactgtagcagcagatccatccgcccttgaggaggatcgagaggagcccgaaggagctactccaggaaccgcacaccccggtcatagtggaggtcactttccgagtcttgcaaatggcgctgcgcaggatggcgacactcaccctagtaccggatcagagtccgacagctccccgaggcaggggggtgaccattcctgtgagggctgtgacgcatcttgttgtagtccatcttgttatagttcctcatgctactccacatcttgctactccagcagctgctacagtgccagttgttacagcccctcctgttacaacggcaaccgctttgcatcccacacccgtttctcctccgtggactccgctaagatcagtgagagcacggtctttagtagccaggatgacgaggaagaagagaactccgcttttgaatcagtgcctgacagtatgcagtcgccagagctagaccctgagtcgacgaatggtgctggaccctggcaagatgagcttgccgcaccttccggtcatgtggagagatcacctgagggtttggaaagtcccgtcgctggcccttccaaccgccgagagggcgagtgtcccatacttcataacagccaaccagtgtctcagctaccctccttacgcccagagcatcaccactatcccacgattgacgagcctttgcctcccaactgggaggcgagaatagatagccacggcagggtcttttacgtagaccacgtgaataggacaacaacatggcagaggccaactgccgcagctactcctgacgggatgcggagatcggggtccatccagcaaatggaacagcttaatagacgataccagaatatacagagaaccattgcaacagagcgcagtgaggaagactccggatctcagagttgcgagcaggcccctgcaggcggaggaggcggtgggggaagcgattcagaggccgagagcagccagtcatcccttgacctgcgcagagagggctccttgtccccagtgaacagtcaaaaaattactctactgctccagtcccctgctgtgaagtttattacgaatccagagttctttacggttctccacgccaactattctgcctacagggtctttactagtagtacctgcctcaaacacatgatcttgaaagtgcggagggacgcgagaaactttgagcgttaccagcacaaccgcgatcttgtgaactttatcaacatgttcgcagatactcgccttgaactgcccagagggtgggagatcaagaccgatcagcaggggaagtcctttttcgtggatcacaactcaagagcaacaacctttatcgatcccaggatccccctccagaacggccgtctcccaaatcatctgacgcatcggcagcacctgcaacggcttcgttcgtactcagccggagaagcatcggaggtgagccggaatagaggagcctccctgctggctaggcctgggcactcacttgttgccgcaattcggagtcagcatcagcacgaatcactccctctggcctacaatgacaagatcgtcgccttcctgcgacagccaaatatctttgagatgttacaggagagacagcccagtctggccaggaaccatactctcagagaaaaaatccattacatccgcaccgaaggcaatcacggcctggagaagctgtcctgtgatgcagacctggttatacttctttcactctttgaagaggaaatcatgagttacgtgcccttgcaagcagcttttcacccagggtattccttctcacccagatgctccccatgctcctcaccccagaactcacctggtctccagagggcatccgcccgtgccccttcgccgtatcgccgagatttcgaggctaaactgcgtaacttctatagaaagcttgaggcaaagggatttggccaggggccaggaaaaatcaagctcattatccgtagggatcacctgcttgagggtactttcaatcaggtgatggcctattcccgcaaagagctgcagcgaaataaactctacgtaaccttcgtcggcgaagagggcctcgactactccggaccctctcgtgaattcttctttttgctttcccaggaactgttcaatccctactacggtttgtttgagtactccgccaacgatacttacaccgtgcagatctctcctatgagcgcatttgtcgagaaccacctggaatggtttaggttttctgggaggatcctcggtctggcactcatacatcagtacctattggacgccttcttcactcgacctttttacaaagcactgcttcgactaccctgcgacctcagtgaccttgagtatttggacgaagagttccatcagagcctgcagtggatgaaggacaataacatcacagacatactagacttaacgttcaccgtgaacgaagaagtgttcggccaggtgaccgaacgggagctgaaaagtggcggagctaatacccaagtgaccgaaaagaacaaaaaagagtacatcgaaagaatggtgaagtggcgagtggagcgtggcgtggtccagcagaccgaggccttggtccgtggtttctatgaagtagtggattcccggctcgttagtgtgtttgacgcaagagagctcgaactcgtgatcgctggcacggctgagattgacctgaacgattggaggaacaacaccgagtaccggggtggataccatgacggacacctcgttattaggtggttttgggctgctgtggaacgcttcaacaacgagcagcgactaagactgctccagtttgtcaccggcaccagcagcgtcccctatgagggctttgctgccctcaggggaagcaatgggctgaggcggttctgcatagagaaatggggcaaaattacatccctaccacgcgcacacacatgcttcaatagactggaccttcccccttatccgtcctacagcatgctatacgaaaagttgcttacagcggtcgaggagacatctacattcggccttgagtag

SEQ ID NO: 29513 - DNA, 1209 bp, Artificial Sequence
  Description of Artificial Sequence: Synthetic coding sequence
atggcagctctgtgtcggaccgctgagagccaagcagaacttcagtgcacgcagctggatcttgaaaggaaattgaaactaaacgagaacgccattagtcggctacaggctaaccagaagtctgtcttagtgtccgtctccgaggtaaaagccgtggcggagatgcagtttggagaactcctcgctgctgttagaaaggcccaggcaaacgtgatgctgtttctggaggagaaagagcaggccgcacttagtcaggccaatggcatcaaggcacacctggaatataggagcgctgagatggagaaaagcaagcaggaactggagacgatggcggctatttccaatacagtgcagttccttgaggaatattgcaaattcaaaaataccgaagatatcaccttcccatctgtgtacatagggctgaaggacaagttatccggaatccgtaaagtgatcaccgaatccaccgtgcatctgattcagctgttagagaactataagaaaaagctacaggagtttagcaaggaggaggagtacgacattcgcactcaagtgagtgccatcgtccagcgcaagtactggacaagtaagcccgagcctagtacacgagaacagttcctacagtacgtgcacgatataactttcgatcccgacacagcccataaatacctccgactgcaggaggaaaatcgaaaagttaccaatactactccctgggagcacccctaccctgatctgccttcaaggttcctccattggagacaggttctgtcccagcagtcgctctatctgcataggtattactttgaagtggaaatattcggcgcaggcacttatgtaggcctgacgtgtaagggtatagaccagaagggagaggagcgcagcagctgcatcagcggaaacaatttctcttggtcactccaatggaatggaaaggagtttaccgcatggtactccgacatggaaacgcctctgaaagcaggaccgttttggagactcggcgtctacatcgacttccccggaggcatactgtctttttacggtgttgaatacgacagcatgaccctggtacacaagttcgcatgcaagttcagcgaacctgtctacgctgccttctggctttcgaaaaaagaaaatgctatcagaattgtagacttgggcgaggagcccgagaaaccagccccttcactggtgggcacagctccatag

SEQ ID NO: 29514 - DNA, 1677 bp, Artificial Sequence
  Description of Artificial Sequence: Synthetic coding sequence
atgcatcgctctgcaccttcacagacaactaagcgttccagatctcccttttccactacgcgcaggtcctgggatgactcagagagttccggcacaaacctcaatatagataatgaagattattcaagatatcctccaagagaatacagggcctccggcagccggcgtggaatggcctacgggcatattgactcctacggagccgacgacagcgaggaagaaggcgcagggccagtcgagaggcccccagtgcgtggcaagacaggcaaatttaaagatgacaaactccttgatcctgttccagccgcaaggtgcagtgcaagccgggcagactttctgcctcagtcttccgtggcctcacaaagcagttctgaagggaagctagctacaaaaggagacagtagcgaacgcgagcgacgggaacaaaatctgcccgctcggcctagtcgtgcccctgttagtatatgcggcggtggcgagaacaccagcaagtctgctgaggaacctgtggtgcggcctaagatcagaaatctggcctcgcccaattgtgtcaagcctaagatattttttgataccgatgacgatgacgatatgccacactccacaagccgttggcgggacacagcaaacgataatgagggacacagtgatggtctggctaggcgcggtagaggcgaatcttccagcggataccccgaacctaaatatccagaagacaaaagagaggcgagaagtgatcaggtgaagcctgaaaaggtgcctaggcggagaaggactatggctgaccctgatttctggactcactcagacgattactataaatactgtgatgaagactctgactccgacaaagaatggattgctgctcttagacggaaatacaggtctcgggagcaaactctgtcatcttctggtgaaagctgggaaaccttgcccggaaaggaggagcgggagccccctcaggctaaggtgtcagcctcgaccggcacatctcccggaccgggagctagcgcaagtgccggagccggagcgggtgctagcgcgggatctaatggctccaattacctagaagaggtccgggagcctagcctgcaggaagaacaggccagtctcgaagaaggtgaaatcccttggctgcaatatcacgagaacgattcatcctctgagggcgataatgattctgggcacgagctcatgcaaccaggagtgtttatgttagatggaaataataatctggaggacgactccagcgtgtccgaagatctggaggtagattggtccctgttcgatggtttcgcggatggcctaggtgttgcagaagcaatttcctatgttgaccctcagtttctgacttacatggcactagaagagcgcctagctcaggctatggagacagcgcttgcccatctggagagcttagcggttgatgttgaagtggccaacccccctgcctctaaggagtccatcgacgcgctgcctgagatcctagtaactgaagatcatggggctgtgggccaggagatgtgctgtcccatttgctgttccgagtacgtaaagggcgaagtcgccacagagttgccctgtcaccactatttccataaaccatgcgtgtcaatttggcttcagaaatccggaacatgtccagtatgtcgatgcatgtttcccccacccttgtag

SEQ ID NO: 29515 - DNA, 3591 bp, Artificial Sequence
  Description of Artificial Sequence: Synthetic coding sequence
gtgccgccatgtcccgctgaactgaggtccgtgactaatggccaaagtaatcagccaagcaacgaaggagacgcgatcaaggtatttgtgcgaatcagacctcctgcagagaggtctgggtcagctgatggagagcagaatttatgtctaagtgtgctatcctctacatctcttagactgcattcaaatccagagccgaagacattcacttttgaccacgtggccgacgtggacaccacacaggaatctgtctttgctaccgtagcaaagtcgatcgtcgagagctgtatgtcaggttataatggcacaatttttgcgtacggccagacaggatctgggaaaaccttcacaatgatgggtccgtctgagtcggataacttcagccacaatctgcggggagttattccgagatcttttgagtatttgttcagcctcattgaccgcgagaaagagaaggccggagccggaaagtccttcctttgcaaatgctctttcattgagatctacaatgaacagatatacgacttgctggactctgctagcgccggattgtacctgcgagagcacatcaaaaagggagtctttgtggtgggggctgttgaacaagtggtcacttctgctgctgaagcgtaccaagtcctaagcggtggatggagaaacaggcgagtcgcttctacctcgatgaaccgggaatcatcacggtcgcacgccgtttttacaattactatcgaatctatggagaagtcaaacgaaatcgtgaacatcagaaccagtttgctgaatctggtggacctggcaggatcagagagacagaaggatacgcacgccgaggggatgcgtttaaaggaagccggaaatatcaaccggagtctgtcctgccttgggcaggtgattacagctctggttgacgtgggcaacggaaagcagaggcacgtttgctaccgcgacagtaagttaacatttctgctgagggattcgctgggcggaaacgcaaagactgcgataatcgcaaatgtccatcctgggtcacgctgtttcggtgaaaccctgagtacgttgaactttgcacaaagggctaagctgatcaaaaacaaggctgtggtcaacgaggatactcagggaaatgtgagccagctccaggctgaagtcaagcggctgaaggaacagttagctgagctcgcatcagggcagacccccccagagtccttcctgacacgtgacaagaagaagaccaattatatggagtatttccaggaagccatgctcttcttcaagaaatcagagcaagaaaaaaaaagtctcatcgaaaaagtaacacaactggaagacctgaccctcaagaaagagaaatttattcagtcgaataagatgattgttaaatttagggaggaccagataattcggctggaaaaactgcataaagaatctaggggtgggtttctccccgaagaacaggatagactgttgtccgaactgagaaacgagatccagaccctaagagaacaaatcgagcatcaccctagagttgccaagtatgccatggaaaaccactctctacgggaagagaatagacggctgcggctgctggagcccgttaagcgggcacaggagatggacgcacagactatagcaaaactggagaaagcctttagtgagatctctggaatggagaaaagcgataagaatcagcagggattcagtccgaaggcccaaaaagaaccctgtcttttcgcaaacacagagaaactgaaagcccagttgctgcagattcagacggaattaaataattccaagcaggaatatgaggaatttaaagagctgacacggaaaaggcagttagagctggaatctgaacttcaatccctgcagaaggccaacctgaacttggaaaacctgttggaggctaccaaggcctgcaagcgccaagaggtatcccagctcaacaaaatccatgccgaaacccttaagattataaccactcctacgaaggcataccagctgcattcccgtcctgtccctaaactgagtcccgaaatgggctcgtttggaagcctgtatacacaaaactcaagcatccttgataacgacatcctgaatgagccggtgcctccggaaatgaacgaacaagcgttcgaggccatcagcgaagaactgaggaccgtgcaggaacagatgagtgccttgcaggccaagctggacgaagaagagcacaagaatcttaagttgcaacagcatgtcgacaagttagagcatcacagcacccagatgcaggagctgttctccagcgaacggattgattggaccaaacagcaggaagaacttctttcccagctgaatgtcctggaaaagcaattgcaggaaactcagacgaagaatgacttcctgaagtctgaagtccatgatcttcgagtggtattacatagcgccgataaggagttgagcagtgtcaaattagaatactcatcttttaaaacaaaccaggaaaaagagttcaataagctgtctgagcgtcacatgcatgtgcagttacagcttgataacctgaggctggagaatgagaagctactggagtctaaggcttgtctccaagattcctacgacaacctgcaagaaataatgaagttcgaaatagatcaactgagcaggaacctgcagaacttcaagaaagagaacgagacacttaaaagtgatctgaataacctgatggagcttcttgaagctgagaaggaacggaataacaagctctcactccagttcgaggaagacaaagaaaactctagtaaggaaattcttaaagtgctggaagccgttaggcaagaaaaacaaaaggagactgctaagtgcgagcagcagatggccaaagtccagaaactggaggaatctctcctggctactgaaaaagttatatccagcttggaaaagtctcgggactctgataaaaaagttgtggcagacctgatgaaccagatacaggagcttagaaccagtgtgtgcgagaagacagagacaatagacacattgaaacaggagctgaaagacatcaattgcaagtacaatagcgcactggtcgatagagaggagagcagggtgttgatcaaaaaacaggaggttgatatcctcgacctaaaagaaactctcaggctgcgtatcctgagtgaagatattgagagagatatgctgtgtgaggacctggcacatgcaactgaacagcttaacatgctaactgaagcgtcaaagaagcatagcggcttgctccagtccgcccaacgcactgatcaggagggctctcccgattctgggaccagtgcacaagccaaaccgaaggaacgcggatccaggaccgaagaagagtacaacttcaaaatgcgccaactggagcacgtcatggattccgccgctgaggaccctcagagccccaagacgcctccacacttccagactcaccttgcaaagctgctcgagacacaggaacaggagattgaggacggcagggcgtctaagaccagcctggagcatctcgttacaaaactcaacgaggatagagaggtcaaaaatgccgagatacttagaatgaaagagcagctccggtag

SEQ ID NO: 29516 - DNA, 3264 bp, Artificial Sequence
  Description of Artificial Sequence: Synthetic coding sequence
atggacccattcacagaaaaattgttggaaagaacacgcgctcgccgtgaaaatctacagaggaagatggccgagaggcctaccgctgcccctcgtagcatgacccatgctaaacgtgcgagacagccattgagcgaggctagcaatcagcaaccactgagtggaggtgaggaaaagagctgcacaaagcctagcccgagtaagaagaggtgctcggataacaccgaagtagaagtgagcaatctggagaataaacagcctgtggagtccaccagcgctaagtcatgcagccctagcccggtgtcgccacaggtgcagccccaagccgctgatacaatctccgattccgtcgcggtccctgctagcctgctcggaatgcgacgtggccttaactcaaggctggaggccacagcagccagcagcgtcaagactcggatgcaaaaattggccgaacagcgccgacgctgggataacgatgacatgacggatgatatcccagagtcctccctctttagtcccatgcctagcgaagagaaggctgcctctcctccccgtccgctattgagtaatgcgagcgccactcctgtcggcaggagggggcgtctcgcgaatctggccgcaacaatctgttcatgggaggacgatgttaatcatagcttcgctaagcagaactcagttcaggagcagcctggtaccgcctgtctgagcaaattcagctctgcctccggagcctctgcaaggattaattcaagctccgtgaagcaggaggccaccttttgtagccagcgcgacggcgatgcctctctgaacaaggccttgtcctcgagcgcggatgatgcatctctggtgaacgccagcattagtagttctgtgaaggcgacctctccagtgaagtccaccacctcaatcaccgacgccaagtcttgcgaagggcagaatcccgagctgcttcccaagacaccaatttctcccttaaagacaggtgtctcaaagccaatcgttaagagcaccctcagccaaactgtccctagcaaaggggagctgtccagggagatttgtctgcagagccagtccaaggataagagcacaacaccagggggaacaggcattaaacccttcttagagcgctttggagaacgatgccaagaacactcaaaggagtctcccgcaaggtccaccccacacagaacccccataattacacccaacacaaaagctattcaggaacggttatttaaacaggatacctcttctagtacaacccatctggctcagcagcttaagcaagagaggcaaaaagagctggcttgtttgcgtggacggttcgacaaggggaatatctggagtgccgagaaagggggaaactccaagagcaagcagctcgaaaccaagcaggaaacgcactgccagagtacccctcttaagaagcatcagggcgtgagtaaaacccagagcctcccagtgactgagaaggtcaccgaaaatcaaattccggcaaaaaacagttcaactgaacccaaggaagtgatacgggagattgagatgtcagtggatgacgatgacattaacagcagtaaggtcatcaacgacctgttttcagacgtgctagaggaaggagagttggatatggaaaaatctcaggaggagatggaccaggccttagcggaatcatccgaagagcaggaagacgcactgaacatctcgtctatgagtctgctcgccccactcgcgcagaccgttggcgttgtgagccctgagagcctagtgtctacaccccgacttgaattgaaggacacgtcgagatcagacgagtcacccaagcctggtaagtttcagcggaccagggtgccgagagccgagagtggagattctctcgggtctgaagaccgtgacctactctactctattgatgcgtataggagccagcggttcaaagaaacagagagaccaagtatcaaacaggtcatagtccgcaaggaggacgtgacatccaagctagacgaaaagaataatgccttcccttgtcaggtgaatattaagcagaaaatgcaggagctgaacaatgagatcaacatgcaacaaacggttatctaccaggcgagccaggcactgaattgctgcgtggatgaagaacacgggaaaggcagcttagaagaggcggaagctgagaggctgctattgatcgccaccggcaaacgcacactgctgattgatgagctaaataaattgaaaaacgagggtccacagcgaaagaacaaagcttccccacaatccgagtttatgccatctaaggggtccgtgaccctttccgagatccgcctgcctctgaaagcagacttcgtgtgtagcacagttcaaaaacctgatgcagccaattactattacctaatcatcctaaaagctggggcagagaacatggttgctacaccgttggcaagcacctccaacagcctgaacggagacgctctgaccttcaccaccacattcaccctgcaggatgtttctaacgacttcgaaatcaacatcgaagtctactccctggttcaaaagaaagatccatccggattagataagaagaaaaagacgtccaagtcaaaggctattacccctaagcggctgctgaccagcatcaccacaaaatccaacatccattcctctgttatggcttcgccgggtggcctgtccgcagtgagaacgagcaattttgctctggttggttcttatacgttgagcttaagctctgtgggaaatacgaagttcgtgctagacaaagtgccgttcctgtcgtctctggagggacacatctatctgaagatcaagtgtcaggtaaactcaagcgttgaagagagaggcttcctgacaatatttgaggacgtcagcggtttcggagcatggcaccgccgttggtgcgtcctgagcggtaactgtatctcttactggacatacccagatgatgagaaaaggaagaatccaatcggcaggattaacctggccaactgtacatcgagacagatagagccagcgaacagagagttctgtgctagacggaacacgttcgagctcattacagtgcgccctcaaagggaggatgatagagaaacattggtgagccagtgcagggataccctgtgtgtcaccaagaactggctgtctgctgatacaaaagaagagcgagacctgtggatgcagaaactgaaccaggtcctggtggatatccgcctgtggcagcccgatgcgtgctacaagcccataggaaaaccatag

SEQ ID NO: 29517 - DNA, 648 bp, Artificial Sequence
  Description of Artificial Sequence: Synthetic coding sequence
atggtgttcagacgcttcgtcgaggttggaagagtggcctatgtttcatttggtccccacgccggtaagctagtggccattgtggacgtgatcgaccagaaccgcgcattggtcgacggaccctgcactcaagttagacggcaagcgatgccattcaagtgtatgcagctgaccgacttcatcctgaagttccctcattcagcccatcagaagtacgtaaggcaagcgtggcagaaagccgacattaataccaagtgggctgctacacgatgggccaagaagatcgaagcacgggaacggaaggcgaaaatgaccgactttgatcggttcaaagtcatgaaagcaaagaaaatgagaaataggattatcaagaacgaagtgaagaagcttcagaaagcggctcttctcaaagcatcccccaagaaagcacctggcaccaaagggaccgcggctgccgctgcggctgcagcagctgcgaaggttcccgcaaaaaaaattaccgccgcatccaagaaagcaccagcccaaaaggtgccagctcagaaggcgactggccaaaaggcagcgccagcgcctaaagcacagaaaggacagaaagcacccgctcagaaagcgcctgcacctaaagcctccgggaaaaaggcatag

SEQ ID NO: 29518 - DNA, 2976 bp, Artificial Sequence
  Description of Artificial Sequence: Synthetic coding sequence
atggaggaatacgagaagttctgcgaaaagagcctcgctaggattcaagaggcttcactctccacagagagcttccttcccgcacagagcgaatccatcagcctgatccgttttcacggagtggccatcctgagtcctctgttgaatatcgagaaacgaaaagagatgcaacaggagaagcaaaaggctctggacgtggaggcccgtaagcaggtgaacaggaagaaagcgctcttgacaagagtccaagaaatactcgataacgtgcaagtgcgaaaggcgcctaacgcctccgacttcgaccagtgggagatggagacagtatactcaaacagcgaagtcagaaatctgaacgttcctgcaacctttccaaatagtttcccatcacacactgaacactctacagcagccaaactggacaagattgctggaattcttcctctggacaacgaggaccagtgcaaaaccgacggaatagacctggccagagactcggaggggttcaatagccccaagcaatgtgattcctccaacatctcacacgttgagaacgaggccttcccaaaaacatctagtgctactccccaagaaactctcatctctgacggaccttttagcgtaaatgagcagcaggatttgccattgttggctgaagttattccagacccatacgtgatgagcttgcagaacctcatgaaaaagtccaaggagtatattgagagagaacagagtcgacgatccttgcgtggctcaatcaaccggatcgtcaacgaaagccaccttgacaaggaacatgatgccgtggaggtggcagactgtgtcaaggaaaaaggtcagctcaccggaaagcattgtgtttccgtgatccccgataaaccttcattaaataagtcaaacgttctgctgcagggggcatccactcaggcttccagcatgtcaatgccagtcctcgcttcattcagcaaagtcgatatccctattaggactggacaccccaccgtgctggagagtaactctgacttcaaagtgattcccactttcgtgaccgaaaataacgtgattaagtcactgacgggttcctatgccaaactccccagccccgaaccttcaatgtcgccgaagatgcacaggcgccgttcaaggacgagttcggcgtgtcacattcttatcaataatcccataaatgcgtgtgagctgtcccccaagggtaaggaacaggcgatggacttaatcatacaggacactgatgaaaatacgaacgttccggaaattatgccaaagctcccaactgatctggccggagtgtgctctagcaaggtctatgtgggcaaaaatacctcagaggtgaaggaggatgttgttttaggaaaatcaaatcaggtttgccagagttcgggaaatcacttagaaaacaaggtgacgcatggattggtgaccgtagagggccagctgacctctgacgaaagaggcgctcacattatgaactcaacctgcgctgccatgcccaagctgcatgaaccgtacgcctcctcccaatgcatcgccagccctaatttcggcaccgtctcaggcttgaaacccgctagtatgttggagaagaactgtagcctccagaccgaactgaataaaagctatgacgtcaagaacccatccccgctcctgatgcagaaccaaaacaccagacagcagatggacacgcccatggtgtcttgcggcaatgaacaatttctggataattccttcgagaaagtgaagcgtagactggatctggatattgacggtttgcagaaggaaaattgtccctatgtgattacgtctggcatcacagaacaagaaaggcagcacctacccgaaaaacgctaccccaagggctccgggttcgttaacaaaaataagatgctcgggacaagttccaaggaaagcgaggaactgctgaagtctaagatgctggctttcgaggagatgaggaagcgcctggaggaacagcatgcacaacagctgagcctgctaatcgcggagcaggagcgagagcaggaacggctccagaaagaaatcgaggagcaagagaagatgctcaaggaaaagaaagctatgacggcggaagcctctgaactagacataaacaatgccgttgagctggagtggcgtaagatatccgattccagcctcctggaaaccatgttatcacaggctgatagcttgcatacctctaattccaacagctccggctttacaaatagtgccatgcaatattctttcgtgtctgcaaatgaagctcctttttacttgtgggggagctcaacttcaggactgactaaactgtctgttactcgcccatttggcagagctaagacacgctggagccaggtctttagtctcgaaattcaggctaaattcaacaaaattacggccgtcgccaaagggtttctcacaagaagactgatgcagaccgacaaactcaagcagctgaggcagaccgtcaaagacaccatggagtttattcgtagtttccagagcgaggctcctctcaagcgtggaatcgttagtgcccaggacgccagtctgcaggaaagagtgctggcccagctgagagctgcgctctacggcatccacgatatcttttttgtgatggacgctgctgaacgaatgtcaattctccatcacgatagagaggtgcggaaggagaagatgctgcgacagatggacaaaatgaaaagccctcgtgtcgctttgtctgctgccactcaaaaaagcctggacagaaaaaaatacatgaaggccgctgagatgggtatgccgaacaaaaagtttttggttaaacagaatccctccgagacccgagtgctccagccaaaccaaggacagaatgcccctgtccacagactcctgtcccgccaggggtccatctgcaggaagaatccaaaaaaggccgcaaaatgttgcgacaatctccggaggcagcatagcctcggatag

SEQ ID NO: 29519 - DNA, 2976 bp, Artificial Sequence
  Description of Artificial Sequence: Synthetic coding sequence
atggaagagtatgaaaaattctgtgaaaagtccctggcccgaattcaggaagcctctctctctacagagagtttcctgcccgctcagtcagaaagcataagtttaattcgatttcacggggtggctatcctttcaccactactgaacatcgagaagaggaaagagatgcagcaggagaagcaaaaggcgttggacgttgaagcaagaaaacaggtcaacagaaagaaggcccttctgacacgggttcaggagatcctggataatgtacaagtgagaaaagcaccgaatgctagtgattttgaccagtgggaaatggagacagtctattcaaatagcgaggttcggaatctgaacgtacctgctacgtttccaaactcctttccctctcacaccgagcactcaactgccgcaaaactggataagatcgccggtattttgccgttggacaatgaggaccagtgcaaaacagacggcatcgacctcgccagggattccgagggcttcaactctcctaagcagtgtgacagttctaacatctcccacgtggagaacgaggcatttccgaagacttccagtgctacgccccaagagacactcatttctgacgggcctttcagcgtcaatgaacagcaggatctcccactactggccgaagtgattcctgacccttatgttatgtcactacagaacctaatgaaaaagtcaaaagaatatatagagagagaacaatcaaggaggtccttgaggggcagcatcaatcgcattgtgaatgaaagtcatctcgataaggagcatgacgcagtcgaggtcgccgattgtgtgaaggagaagggtcaactgacaggtaaacactgtgtctctgtgattcctgacaaaccttctttgaacaaatctaacgtgctgttgcagggcgcttctacacaggctagctccatgagcatgccagtgctcgcctcattctctaaggtcgatatccccatcagaactggccatccaactgtcctggagtctaacagtgacttcaaggtaatccccaccttcgttacagaaaataatgttatcaaatccctcaccgggagttacgccaagttaccctccccagaaccctctatgagccctaaaatgcatagacggcgttcccggacaagttccgcatgtcatatactgataaataacccaatcaatgcctgtgagcttagccctaagggaaaggagcaggctatggatctcatcatccaagataccgacgaaaacaccaacgtacccgagatcatgcccaaactcccaaccgacctagccggtgtttgctcatcaaaagtttatgtcggtaagaatacatccgaagtgaaggaggacgtcgtgcttggtaagagcaaccaagtgtgccagtcgtccggaaaccatctggaaaacaaagtgacgcacggcctggttaccgtcgaaggccagttaacatccgacgagagaggggcacatattatgaactcgacttgtgccgctatgcctaaactccacgagccctatgcatctagccagtgcatagccagccccaattttggaacagtgagtggactcaagcccgctagcatgttggagaaaaattgcagcctgcaaacagagctgaataagagctacgatgttaagaatcccagcccactgctgatgcagaaccagaacacccgtcagcagatggataccccgatggtcagctgcgggaacgagcaatttctggataacagttttgaaaaagtaaaaagacgtctcgacctggacattgacgggcttcaaaaagagaattgtccttacgtcataacaagcggcattacagagcaggagagacaacacttgccagaaaaaagatatcctaaagggtcaggttttgtcaacaagaacaagatgctcggaacaagttctaaggaaagtgaggaattgctaaaaagtaagatgctggctttcgaagaaatgcgcaagcgccttgaagagcagcatgcgcagcaactctcactcttgatagcggagcaggagagagagcaggaacggctgcagaaagagattgaagaacaggagaaaatgttgaaagagaagaaagccatgactgcagaagcctccgagctggatatcaataatgctgtggagcttgagtggaggaagatcagtgactcatccctactggaaaccatgctctcacaggcggattctcttcacacctcaaactcgaacagctccggcttcactaactccgctatgcagtactccttcgtcagtgccaatgaagctccattctacctgtgggggtcgagcacatctggtctaaccaagctcagtgtcacgcggccttttggtagagcaaaaacaaggtggagccaagtgttcagtctggagatccaggccaaattcaataagattactgcggtcgccaagggtttccttaccaggcggttgatgcagacggataaactgaagcaacttcgacagaccgtcaaagatacaatggagtttatacgatctttccagagcgaagccccacttaaacgcggaatagtgagcgctcaggacgcttctctacaggagagggtcctggcccagctgagggcggcactttacggcatccacgacattttcttcgttatggacgcggcagagagaatgagtatcttgcaccatgatagagaggtacggaaggaaaaaatgctacgccagatggataagatgaaaagtcccagagtggctttatctgcagctactcagaagagcctggatcggaagaaatacatgaaggcggctgagatgggaatgcctaacaagaaatttcttgtgaagcagaatccttccgagactcgcgtgcttcagcctaatcagggacagaatgcaccagtccaccgcctcctctccagacagggatctatctgtcgtaagaaccccaaaaaggctgccaaatgttgtgacaacctcaggcgtcagcacagccttggctag

SEQ ID NO: 29520 - DNA, 999 bp, Artificial Sequence
  Description of Artificial Sequence: Synthetic coding sequence
atggcaactattaaaagcgaactgatcaaaaacttcgcggaagaggaagccatccaccacaataagatctccatcgtcggaaccggatctgttggcgtagcatgcgctatctccatcctgctgaagggcctctcagacgaattagtgctggtagacgtcgatgagggaaaacttaaaggcgagacaatggacctgcagcatggctcccccttcatgaagatgcccaacattgtttccagcaaggattacctcgtgacagcaaactctaaccttgtgatcatcacagcaggtgcaaggcagaaaaaaggcgagactagactcgatttggtgcagcggaatgtcagcatcttcaaactgatgatcccaaacattactcagtattctccacactgcaaattgctgattgttaccaatccagtcgatattctcacatacgtggcgtggaaactttcaggctttccgaagaaccgggttattggcagcggatgtaaccttgacagcgccaggttccggtatttcataggccagcgacttggcatccactcagagagctgtcacggcttaatacttggcgaacacggcgattcgagtgtgcccgtctggtcaggcgtcaatatcgccggagtccccctgaaggacctgaatcctgacatcgggaccgacaaggatccagagcaatgggagaatgtgcataagaaggtgatcagcagtggatacgagatggtgaaaatgaaaggttatacctcctggggaataagtctgtccgtcgcagatcttacagaatcgatactgaagaatttacgcagagtccacccagtcagcactctgagcaaaggtctatacgggattaacgaagatatcttcctgtccgtgccatgtattttgggggaaaatggtatcactgacttaattaaagtcaagttgactctcgaagaggaggcatgtctgcagaaatccgcggagactctgtgggagatccagaaggagctcaaactgtag

SEQ ID NO: 29521 - DNA, 888 bp, Artificial Sequence
  Description of Artificial Sequence: Synthetic coding sequence
atgatggccaaaaaaccgccaaaaccagctcctagaaggatttttcaggaaaggcttaagattacggcattacccctctacttcgaggggtttctcttgatcaaaagatctggttaccgggaatatgagcactactggaccgagctgaggggaaccactctgttcttttataccgacaagaagagcatcatctacgtcgacaagctagatatcgttgacctgacttgcctcactgagcagaactcaacggagaagaactgtgccaagttcaccttagtcctcccaaaggaagaagtgcaactgaagacagaaaataccgaaagtggtgaggagtggaggggttttattttgaccgtgaccgaactttccgtccctcagaacgtcagcctgctgccaggccaggtcattaagctacatgaggtcctggaacgagaaaagaaacgacggatagagacagaacagagcaccagcgtcgagaaggagaaggagccgacggaggactatgttgatgtgctcaaccccatgcccgcatgtttctataccgttagtcggaaggaagccactgagatgttgcaaaagaacccatctctaggtaacatgatcttgcgccctgggtcggatagcaggaactacagtattacgattagacaagaaatagacatcccaaggattaaacattacaaagtcatgtctgttggccagaattacaccattgagctggagaagcccgtgacccttcctaacttgttctccgtcatcgattactttgtgaaagagactcggggaaatctccggcctttcatctgctctacagacgagaacacaggtcaggaaccttctatggaaggaaggagcgagaagctaaagaagaatccacacatagcctag

SEQ ID NO: 29522 - DNA, 1368 bp, Artificial Sequence
  Description of Artificial Sequence: Synthetic coding sequence
atggagggcgtgctctataaatggacaaattacctgagtggctggcagccccgttggtttctcctttgcggtggaatcttaagctattatgatagccccgaagacgcctggaagggctgcaagggaagtatccagatggcggtgtgcgaaatccaggtccattctgtcgacaatactcggatggaccttatcattccgggagagcaatacttttacctcaaggctaggtccgtggcggagcgccagcgctggttggtggctctgggcagcgccaaggcttgcctaaccgattctcgcactcaaaaggaaaaagagttcgcagaaaatacggagaacttgaagaccaagatgtctgaactgcgactctactgcgacttactcgtccagcaggttgataagactaaggaagtgacaaccacaggggtcagcaactccgaggaaggtatagacgtaggcacacttcttaagtctacgtgcaatacctttctcaaaacactggaggaatgcatgcaaatagcaaatgctgcgttcacttctgaactactgtacagaaccccacctggaagtccccaactggctatgctgaagagttctaagatgaagcatccaataatccctattcacaattcccttgagagacagatggaactgagcacttgcgagaacggcagcctgaacatggagattaatggcgaagaggagatattgatgaagaacaagaactccttatatctcaagtcggcggagattgattgcagtatttcctctgaagagaatacagacgacaacattacagtgcagggcgagattaggaaggaggatggaatggaaaatctgaagaatcatgataataaccttactcagtcgggcagcgatagcagctgtagtcccgaatgtctctgggaagagggcaaggaggtaattcctactttttttagcaccatgaacaccagcttctccgacattgagttgctggaagactccggaattcccacagaggcgttcttggcatcttgctatgccgttgtaccagtgctggacaagctcggacccacagtattcgctcctgtcaagatggacctggtaggcaatatcaagaaagtcaaccaaaagtatattacaaataaggaagagtttactacgttacagaaaatcgtgcttcatgaggtcgaagcagatgttgcacaggtccggaattcagctacggaagccctgctctggttgaaaagaggcctgaaattcctgaagggtttcctgaccgaggtgaagaacggcgagaaagatattcaaactgcactcaataacgcatacgggaaaactctgcgccaacatcatgggtgggtcgtgagaggtgtgtttgcagtgtag

SEQ ID NO: 29523 - DNA, 1320 bp, Artificial Sequence
  Description of Artificial Sequence: Synthetic coding sequence
atggagggggtgctgtataaatggaccaactacctgtctggctggcagcctcgttggttcctcctgtgcggaggcatcttgtcttattacgattcacctgaggatgcttggaagggctgcaaaggatcaattcagatggcagtgtgcgaaattcaggtccactccgtggacaatacaaggatggatctgatcatcccgggagagcagtatttttacttgaaagctagaagcgtagccgagaggcaaagatggctagtcgccctgggttcagctaaagcttgccttactgatagtaggactcagaaagagaaggaatttgctgagaatactgagaacctgaaaacaaagatgtcggagcttaggctctattgtgacttgctagtccaacaggtggataagacaaaagaagtgactaccactggcgtttctaactctgaagaaggaattgacgtgggcaccctgcttaagagcacctgtaacacctttttgaagacactggaggagtgcatgcagattgccaacgctgccttcacgtccgagttgctctaccggacccccccagggtccccccagttagcaatgctaaaatctagcaagatgaagcacccaatcatcccaatccacaacagtctggagcggcagatggaactcagcacctgcgagaacggcagtctgaacatggagatcaacggcgaggaggaaattttgatgaaaaataaaaatagcctgtacctgaaaagcgcagagattgactgcagtatttcatccgaggaaaatacggatgataacattacagtgcagggagagattaggaaggaagacggtatggaaaaccttaagaaccacgacaacaatctgacgcagagcggctcagatagcagctgcagtcccgaatgtctgtgggaggaagggaaagaggttattcctacctttttctcaactatgaatacatctttctccgacatcgaactgctggaggactccggaattcctaccgaagcttttttggcttcatgctacgccgtcgttccggttctggacaaactggggcctactgtgttcgcccctgtgaaaatggatttagttggcaacatcaagaaggtcaaccagaaatacattacaaataaagaggaattcactaccttgcagaagatcgtattgcatgaggtcgaagcggacgtggctcaggttcgcaactccgcgaccgaggctttgctgtggttgaagagagggttaaaatttctgaaagggtttttgacagaagtgaagaacggcgaaaaagacatccagacagccctctctgttggaatgtgggtttag

SEQ ID NO: 29524 - DNA, 984 bp, Artificial Sequence
  Description of Artificial Sequence: Synthetic coding sequence
atgtgctccacttcagggtgcgacttggaggagattcccttggacgacgacgacctcaacaccattgagttcaaaatcctggcttattacactcgtcatcacgtctttaagtcaaccccagcactgtttagcccgaaactgttgcgtacaagaagcctcagtcagagaggattggggaactgcagtgcaaatgaatcatggacagaagtgagctggccgtgtcggaactcacaatcctctgagaaagcaattaatctggggaagaaaaagagcagttggaaagcgtttttcggagtcgtggagaaggaagatagtcaaagcacccccgcaaaggtttctgcgcaagggcagcgcacacttgaatatcaagactctcattcacaacagtggagtaggtgtctctccaatgttgagcagtgtttagagcacgaggccgtggaccctaaagtgataagcattgctaacagggtggcggagatagtttatagctggccaccccctcaagccacacaggcaggcggattcaaatccaaggaaatattcgtgaccgagggtttgtcctttcaactgcagggccacgtgccagtggcctcatctagcaagaaagatgaagaggaacaaatcctggcaaagatcgttgagctgctcaaatatagtggcgaccagctggagcgaaagctaaagaaagacaaggctttaatgggtcactttcaggacggcctcagctatagcgtctttaaaacgatcacagaccaggttctgatgggagtggatcccaggggggagtcagaagtaaaggcacagggcttcaaagctgctctggtgattgacgtgaccgctaaactgacggccattgacaatcaccctatgaatcgggtactgggattcggcaccaaatacctcaaggaaaatttctccccatggattcagcaacacggcggatgggagaagatactgggaatcagtcacgaagaggtagattag

SEQ ID NO: 29525 - DNA, 5228 bp, Artificial Sequence
  Description of Artificial Sequence: Synthetic coding sequence
atgatggaaggaaacggaactgagaactcttgctccagaactaggggttggctccagcaggacaacgatgccaagccttggctgtggaagttctcaaactgcttttcgcggccagaacaaaccctgccacacagcccgcaaacaaaagagtacatggagaacaaaaaggtggccgtagagcttaaggacgtgccatcgccacttcatgctggaagcaaactgttccccgcagtgccccttcccgacatcaggagcctgcagcagccaaagattcagctgtcaagcgtaccaaaggtcagctgctgcgcgcactgtcccaacgagcccagcacttcccccatgcggtttggcggtgggggaggcggatctgggggaacttcttctttaatccacccgggagcattacttgactcccagtcaacgcggacgattacctgtcaagttgggtcgggattcgcctttcagtccgcatcctctcttcagaatgcaagcgccagaaacaacttagcgggaatcgcgtccgactttccgagtatgtgcttggagtcaaacctttcttcatgtaagcacctgccctgttgcggaaaactgcattttcagtcttgccacggtaacgtccataaactgcaccaatttccttctttgcagggatgtacctcagccggttatttcccatgtagcgacttcacatccggtgctccgggacatttggaggagcacatttctcagtccgaactcaccccccatctgtgcaccaatagcttgcatttaaatgtggtgccccctgtatgcctgaaaggaagcctctattgcgaagactgcctcaacaagcccgcacgcaactctatcatcgacgctgcgaaagtctggccgaacatcccaccaccgaatactcagcccgctccccttgctgtgcctctatgcaacgggtgtggaacgaagggaaccggcaaggaaaccaccttgctcctcgcaacctctttaggcaaggctgccagcaagtttgggagtcctgaggtggcagtggcaggacaggtattagagaacctgccacccatcggcgtcttttgggatatcgagaattgcagcgtgccttccggacgctctgccactgcagttgtgcagaggataagggagaagtttttcaagggacatcgcgaagccgagttcatatgtgtttgcgacatttcaaaagagaataaggaggtgattcaggaacttaataactgccaagtgacggtcgcccacattaatgcgacagccaagaatgctgcagacgacaagctgcgccagtctctgcgcagatttgcaaatacccataccgctcccgcaacggttgtgcttgtctcaactgacgtcaactttgccttagagttgagcgacctgagacatcggcacggcttccacatcatcctggtgcacaaaaaccaggcaagtgaggccctgctccaccatgcaaatgagctgattaggtttgaagaatttattagcgatttgcccccacgactgcctcttaagatgccccagtgccacaccctgctgtacgtctataacctgcccgcaaataaagacggcaaatccgtgtccaaccggctgcgcagattgtctgacaactgcggagggaaggtcctgtcaatcacagggtgttccgctattctgcgcttcattaaccaggattccgcagagcgggctcagaaaagaatggagaacgaagacgtgttcggaaaccgcatcattgtcagtttcaccccaaagaacagagaactttgcgagactaagtccagtaatgccattgcggacaaagttaaatctccaaagaagttgaagaatcccaaattgtgcctgattaaggatgcctctgaacagtcttcaagtgccaaggccacaccagggaaagggagtcaggctaattccggatcagccaccaagaacacaaacgtcaagagcctgcaagaactttgccgaatggagtctaagaccggacaccggaattcggagcaccagcagggacatttaaggttggtggtgccaacgcatggcaactcttcggcagctgtctctaccccaaagaatagcggcgtcgcagagcccgtgtacaagacatctcagaagaaagaaaacctaagcgccagatccgtcactagttctcccgtggagaagaaggacaaggaggaaacagtgttccaggtatcatacccgtccgccttcagcaaacttgtggcgtctcggcaagtttctcctttactcgcgtcgcagtcatggtcttcaaggtccatgagtcccaaccttctgaatcgcgcaagccctcttgctttcaatatcgcaaactcctcttctgaagctgactgccctgacccgttcgctaatggtgcggatgtgcaagttagtaatattgattatcgcctatctcggaaggagttgcagcagctgctgcaggaggcgtttgccaggcatgggaaggtgaaaagtgtggagctgagccctcacacagactatcaattaaaggcagtggtgcagatggaaaacttgcaggacgcgattggcgctgtgaactcccttcaccgctataagatcggatcaaaaaagattctcgtatcacttgcaacaggagccgcaagtaaatccctgagtctcctgtcggccgaaacaatgagtgtactccaggacgctcctgcctgctgcctgcccctcttcaagttcaccgatatttacgagaaaaagttcggccacaaactgaatgtgagtgatttgtacaaactgaccgacacagtggccattcgtgagcagggaaatggcagactcgtgtgcctgcttccaagtagtcaagcacggcagtcacctctcggctctagccagtcacacgacggtagctctacaaactgttcccccataatctttgaggaactggagtatcacgagccagtctgccgccaacattgctcaaacaaggatttctctgagcacgagttcgaccccgactcatacaaaatcccttttgtgattctttcacttaaaactttcgctccccaggtgcattctctgttgcagactcacgaggggacggtgcccctgctgtcgttcccagattgctatatcgcagagttcggagatctggaggtggttcaagagaaccaggggggtgtgccacttgagcatttcatcacctgtgtacccggagtcaatatcgccacagcccagaacggaatcaaagtggtgaagtggatccacaacaagcctccacctcctaataccgacccatggctccttagaagcaaatccccagtggggaatcctcagctgattcagtttagtagggaggtaatcgacctgctcaaatcgcagccatcttgtgtgattccaatcagtcatttcatcccttcctatcaccaccatttcgctaagcaatgcagagtcagcgactacggttatagtaaactgatcgagttactggaagcagtgcctcacgtgctccagattttgggcatgggatccaaaagactactgactctcacccatagggcccaggttaaacgctttacccaggacctgctcaaactgctgaagagtcaggcaagtaagcaggtgattgtccgtgagtttagccaggcttaccactggtgcttttctaaagactgggacgtgaccgagtatggagtgtgtgagttaatcgatattgtgtccgaaattcccgacacaaccatctgcctctctcagcaagataatgagatggtgatctgcattcccaaacgtgagcgcacccaggatgagattgaaaggacgaagcagttctcaaaggatgtcgttgacctgttaagacatcagccacactttcgtatgccatttaacaagtttatcccttcttaccaccaccatttcggtagacagtgtaaactagcttactatgggttcacaaaactgttggagttatttgaggctatccccgacacgctccaggtcctggagtgcggcgaagagaagatactcacgttgacagaagtggaaagatttaaggctctcgccgcacaattcgtgaagttgttacgcagccagaaggataattgcctgatgatgactgatttgctgacggagtatgctaagacttttggctatacgtttcgcctgcaagattatgacgtgagcagcatctcagcgttgacacagaaactgtgccacgttgtgaaggtagcagacattgaaagcggcaggcagattcagcttatcaaccggaagagccttagatcactgactgcccagctcctagtgctgttaatgagttgggaaggtaccacccacctcagcgtggaggagctgaaacgacactacgagtcaacccataatactcccctgaacccgtgtgagtacggatttatgactctgacagaacttctcaaaagcctgccttacctggtagaagtgttcacaaatgacaagatggaggagtgcgtaaaattgacaagcctttatcttttcgcaaaaaacgtgcgatcactactccacacataccattaccaacagatctttctccatgagttttctatggcctatactaaatacgtgggtgaaaccctgcagcctaagacctacggccacagttctgtggaagaattgctgggtgctattcctcaggtggtctggattaaggggcatggtcataaaaggatcgtagtgctgaagaacgatatgaaatcaaggctgtccagcctgtcattatccccggctaatcacgagaaccagcctagtgaaggggagcgcattctggaggtacccgaatcgcataccgcctctgagcttaagctcggcgcagatgggtcagggccttctcatacggagcaggagttgctaaggctgaccgacgattcacccgtggatctcctctgcgcgccagtgccaagctgtctgcccagtccacaactccgcccagaccccgtcatactgcagagtgctgacttgattcagtttgaggagagacctcaggagcctagtgagatcatgattttaaatcaagaagagaagatggaaatccccataccaggaaaatcaaaaaccctcacaagcgatagctcttcttcctgcatctcagccgctgtgccggtgcctccatgtcccagctctgaaacatcggagagtctgctgtctaaggaccctgtcgagtctccagccaagaagcagccaaaaaatcgagtaaaactggccgctaacttttcactcgcacctataaccaaactata

SEQ ID NO: 29526 - DNA, 831 bp, Artificial Sequence
  Description of Artificial Sequence: Synthetic coding sequence
atgtgcagcacatctggatgcgacctggaggagatcccccttgacgatgacgatctgaacaccatcgaattcaagattttagcctactacacccgacatcatgtcttcaagtcgacccccgctctctttagtccaaaacttctgcggacaagatcactgagccagaggggcctcggcaactgtagcgcgaatgagtcttggactgaggtaagctggccttgcagaaactcacaaagcagcgaaaaagctataaaccttgggaaaaaaaaaagctcttggaaggccttcttcggggttgtagaaaaggaggacagccagtccaccccggcaaaggtgtctgcccaaggacagaggaccctggagtatcaagactctcactctcaacagtggtcacgatgcctttcaaacgtcgaacagtgtctggagcacgaagccgtcgacccaaaggttatcagcatagctaacagagtcgcagagatcgtgtacagctggccacccccacaagcaactcaggctggagggtttaaatccaaggagattttcgtcacggagggtctgagcttccagctccagggtcatgtgccagtggcatcatcttccaaaaaggacgaagaggaacaaatccttgctaagatagtggaacttcttaagtattccggggaccagttggaacggaaggagaaggagtgggaagaatccgccaagaccaaaatcaaaatggccctcctttggaggtctagtggtgggggtcctagggttttgagcatccccgaggcttttatgaagaattcattcacactcactccaccaggcttttccgaacataactag

SEQ ID NO: 29527 - DNA, 552 bp, Artificial Sequence
  Description of Artificial Sequence: Synthetic coding sequence
atggcctctaacaagacaacattacaaaaaatggggaagaagcaaaatggaaaatctaaaaaggtggaagaagctgaaccggaggagtttgtcgtagaaaaagtgctggataggcgggtcgtgaacggcaaagtcgaatacttcctgaaatggaaaggctttactgatgccgataatacctgggagcccgaagaaaatcttgattgtccagagcttatcgaagcctttctgaatagtcagaaggcgggtaaggagaaggatggcaccaagcgtaaaagtctttcagatagcgagtcagatgatagcaagtctaaaaaaaagcgcgatgcggcagacaagccaagaggttttgcacgcggactggaccccgaacggattataggcgctaccgacagctccggggaactaatgttcctgatgaagtggaaagattcagatgaagctgatctggtgcttgcaaaggaagccaatatgaagtgtccgcagattgttatcgccttctatgaagagcggctcacctggcacagctgccctgaagacgaagcccagtag

SEQ ID NO: 29528 - DNA, 960 bp, Artificial Sequence
  Description of Artificial Sequence: Synthetic coding sequence
atgctcaggtgtgggcagatgatattcgctcaggccttggtctgccgccatctcggacgcgactggcgatggactcagcgcaagaggcagcctgattcttacttttcagtgctgaacgcatttatcgatcggaaggattcctattactccatacaccagatcgcacagatgggtgtgggagaaggtaagtcaatcggacagtggtatggtccaaataccgtggcccaggtattgaagaagttggctgtttttgacacctggtctagcctggctgttcatatcgctatggacaacaccgtggtgatggaggaaattcgtagactgtgcaggacatcagtgccttgtgccggagcaactgcttttcctgctgattcggaccgtcactgcaatggtttccctgccggtgcggaagtgacaaacagaccaagtccatggcgaccgctggtgctgctaatcccacttcggcttggccttacagacattaatgaggcgtatgtggaaacccttaaacactgctttatgatgcctcagagcttgggagtgataggaggcaagcctaactccgcgcattatttcatcggttatgtaggcgaggagctgatctatcttgacccccacaccactcagccagctgtcgagcctacagatgggtgtttcatccctgatgagtcttttcactgccaacacccaccttgtagaatgtcaatcgccgagcttgacccaagcattgccgtcggttttttctgcaaaaccgaagatgacttcaatgattggtgtcagcaggtcaaaaagttaagtttactggggggagctctccccatgtttgagctagtcgaactgcaacctagtcatctggcttgccctgacgtattgaatttaagtctcgactcgagcgatgtggaacggctcgagagattcttcgactccgaagatgaagattttgaaatcctcagcctttag

SEQ ID NO: 29529 - DNA, 564 bp, Artificial Sequence
  Description of Artificial Sequence: Synthetic coding sequence
atgaacggacgcgcagacttcagagaacctaatgcagaagtgccacgtcccattcctcacatcggcccagactacatcccaaccgaggaggaacggagagttttcgctgagtgcaatgatgagtccttctggtttcgttctgttcctcttgctgcgacatctatgctgattacccaaggactgatttcaaaggggatcctttcaagtcatcccaagtacgggtctatccctaaattgatacttgcgtgtattatgggctattttgcaggcaagctctcatacgttaaaacttgccaagagaaattcaaaaaattagagaactctccattaggcgaggcattacgctcaggacaggcacggcgttcctcaccgccaggccattattatcagaaatctaagtacgattcatccgtaagcggacagagctcctttgtgacctcgcctgctgccgataatatagagatgcttcctcactatgaacctattccattttcaagctcgatgaacgagtctgcccctacaggtatcacagatcatatcgtacagggacgaaatttcagttag

SEQ ID NO: 29530 - DNA, 270 bp, Artificial Sequence
  Description of Artificial Sequence: Synthetic coding sequence
atgtcagaacaaggggacctcaaccaggccattgctgaggaggggggaacggaacaggagaccgcaacccccgagaatggaatcgtcaaatccgagagcttagacgaggaagaaaaactggaactccagcgtcggttggaagcccagaaccaggaaaggagaaagagtaagagcggcgctggtaaaggcaagttgactcgttctctggccgtgtgcgaggagtcaagcgcaaggccgggaggtgaaagcctccaggatcaaaccttatag

SEQ ID NO: 29531 - DNA, 270 bp, Artificial Sequence
  Description of Artificial Sequence: Synthetic coding sequence
atgagcgagcagggggacttaaatcaggctatcgccgaagagggagggacagagcaggagactgccacacctgaaaacggtattgtgaaatccgaatccctagacgaggaggaaaagctagagctgcagagaaggctggaggctcagaatcaggagagaaggaagtccaagtccggagccggaaagggaaaactgactcgctcattggctgtctgtgaggagtcctccgcgaggcccggtggagagagtctacaagatcagacgctctag

SEQ ID NO: 29532 - DNA, 1473 bp, Artificial Sequence
  Description of Artificial Sequence: Synthetic coding sequence
atggaggattccgccagcgccagcttaagtagtgcagctgctactggcaccagtacgagcactccagctgccccaactgcaagaaaacagctggataaagagcaagtgcggaaggccgttgatgccctgctgacccactgcaaatcccgaaagaataactacggcctcttgctgaacgagaatgaatctctgttcctgatggtggtgctgtggaagataccgtccaaagagctgcgcgtgcggcttactcttccacactccatccgatccgattccgaagacatctgtctgttcacaaaagacgagcccaactccacccccgaaaagacagagcaattctatcgcaagctactgaacaaacatggaattaaaaccgtttcgcaaatcatctccctccagactttgaaaaaggagtataagagctacgaggcgaagctgcgtctgctgagctcctttgatttctttctgacggacgccaggattcgtagacttctaccgtcgctgattgggaggcacttctatcagaggaaaaaggtgcccgtctctgtgaacctgcttagcaagaacctgtccagggaaattaacgactgcatcggcggtactgtgctgaatatctccaagtcggggagttgctctgcaattagaatcggacatgtgggtatgcagatcgaacacattattgaaaacatcgtggctgtgactaaaggcctctccgagaaacttcccgagaaatgggagagcgtcaaactgctgttcgtcaagacagagaagtcagccgcactcccaattttctctagttttgtgtctaactgggatgaagccacaaagcggagcctcctgaacaagaaaaaaaaggaggctcgtcgtaagcgacgtgagcggaattttgagaaacagaaggaacggaaaaagaaaagacagcaagcaagaaagactgcctccgttctttcaaaagacgatgtggctccggaatctggcgacactaccgtgaaaaagcctgagtcaaaaaaggagcagacccccgagcacggaaaaaaaaaaagagggagaggcaaggcacaagtgaaggctaccaacgaatctgaagatgaaattccgcagctggttcccatcgggaagaagactccggctaatgagaaggttgagatccagaagcatgcaaccggcaaaaagtcaccagcgaaatcccccaatccaagtacccctaggggaaaaaagcggaaagcgctgccagcatctgaaactcccaaggctgcggaatctgaaactccaggcaaatcacccgagaaaaagcctaaaattaaggaggaggcagtgaaggagaaatccccttctctgggcaaaaaggatgctaggcagacaccgaagaagccagaggctaaattctttacaaccccctcgaagtctgttaggaaggcatcccacacccccaaaaagtggccaaagaaacctaaagtcccacaatccacatag

SEQ ID NO: 29533 - DNA, 495 bp, Artificial Sequence
  Description of Artificial Sequence: Synthetic coding sequence
atggccgaacccgcttcagttgctgcggagagtctggctggtagcagagcccgagcagctcggacagtgctggggcaggtggtgctgcctggagaagaactgcttctgccagaacaagaggacgctgagggccctggcggagcagtagagagacccctctcactcaatgctcgcgcttgttccagggtgcgggtggtgtgtggccctggtttacggagatgtggagaccggctgcttgtgaccaagtgcggccgtttacgccataaggaacccggtagcggaagcggcggaggtgtgtactgggtcgacagccaacagaagcgatatgtgcctgtgaagggagaccacgtcatcgggatcgtcaccgccaaatcaggggatattttcaaggttgatgtaggcggatctgaacccgcttctcttagctacctgtccttcgaaggtgcaacaaagcgaaaccgtcccaacgtccaagccattagctcgcgtttgtag

SEQ ID NO: 29534 - DNA, 2508 bp, Artificial Sequence
  Description of Artificial Sequence: Synthetic coding sequence
atgacttgtaataagcatgggtgtagacaggcctttcacgtcacatgcgcccagttcgctggcctcctctgcgaagaggaaggtaacggcgcagataacgtgcagtactgcggatactgcaagtatcacttctctaaattgaagaaatccaagcggggtagcaacagatcatatgaccagtcactttcggatagcagttcccattcccaagacaagcatcatgagaaagagaagaagaagtacaaggagaaggataaacataagcagaagcataaaaagcagcctgagccgtccccggcactcgtaccgagcttgacagtgaccactgaaaaaacttatacgtccacaagtaataattccatatctggtagcctgaaacggctagaagatacaacagctaggtttactaacgcgaatttccaggaggtgagcgcacatacttctagtgggaaggatgtgtcagagactaggggcagtgaaggaaaaggaaaaaaatcatctgcgcacagctctggacagcgtgggagaaagccgggtggcggtaggaaccccggaacaactgtgagcgctgctagtcccttcccacagggatctttcagcggcacccccggatcagtaaagagctcttcaggaagttcggtgcagtcaccgcaagatttcctgtcgtttacagacagcgacttgcgaaacgatagctattcacattcccagcagtcttcggcaacaaaggacgtacacaagggagagtctgggtcacaggaggggggagtcaactccttctcaacccttatcggcctgcccagtacctctgccgtgactagtcagcccaagtcattcgagaatagtcccggtgaccttggcaactcttctctccctaccgctgggtacaagcgggcacagacctcagggattgaagaagagaccgtcaaggaaaaaaagaggaaggggaacaaacagagcaaacacggcccagggaggccgaaaggcaacaagaatcaggaaaatgtcagccacttatccgtctcctcagcgagtccaaccagtagtgtggcatcggccgctggcagcataacatcctcttcccttcaaaaatctcctacgctgctccggaacggtagcctgcagtcgctgtctgtggggtccagtccagtcggttccgaaatttctatgcagtatagacacgatggcgcatgcccaacgactagcatctacaattccaatgacgtggccgtctcgttccccaacgtcgtatcaggcagcggctcatccactcccgtctcgtcctctcacttgcctcagcaaagttccggccaccttcagcaggtgggagcgctgagtccgagcgcagtgtccagcgcggcaccagccgtcgctaccacgcaagctaacaccctgagtggctcatctttatctcaagcccctagccatatgtacggaaaccgctccaactcttccatggctgcactaatcgcacagagtgagaataatcagacagatcaggatctgggcgataacagccgaaacctggtcggcaggggcagcagcccaaggggatcgctgtcccctcgatcgcccgtcagttccctgcaaattcgatatgatcagccgggaaacagttctctggagaacctgccccctgttgccgctagcatcgaacagctgcttgaacggcagtggtctgagggccaacagttcctcttagagcagggaacaccaagcgatatccttggcatgttaaaaagcctgcaccagctgcaggttgagaaccgccgactagaggagcagattaaaaacctgacagctaaaaaagaaaggctacagctgctgaacgcccagttgagtgtgccttttccaacgatcacggccaacccatcaccttctcaccagatacatacattttctgctcagactgctccaacaacagattcattaaactctagtaaatctccgcacattggcaactctttcctccctgataacagtctgcctgttctaaaccaagaccttacaagtagcggccagtcgaccagtagcagttcagccctgagcacaccccctccggcaggccagtctcccgctcagcaaggcagcggggtctccggagtacagcaggtgaatggggtcacggttggagccctggcgagtgggatgcagcctgtgacctcaacaatacctgccgtgagcgccgttggaggtattatcggggctctgcccggaaaccagttggccataaacggtattgttggagcactgaatggcgtcatgcagactccggtcaccatgagccagaaccctacccccttgacccatacaaccgtcccacctaacgcaacacaccctatgcccgcaaccctgacgaacagtgcatctgggctgggtctgctttcagaccagcaaagacagatccttatccaccaacagcagttccagcagctcctaaactcccaacaactgacaccaaatatggtgaaagaattcagcgcccagattattgcttggcgcccatag

SEQ ID NO: 29535 - DNA, 1620 bp, Artificial Sequence
  Description of Artificial Sequence: Synthetic coding sequence
atggctacttcggccccactgcggtctcttgaagaggaagtaacctgcagtatttgtttggactatctcagagacccagtaaccatcgactgtggccacgtattttgccgcagttgcaccacagacgtccggcctatctccgggagcaggccggtttgtccactgtgtaagaagccgtttaagaaggagaatataaggcctgtttggcagttggcgagcttggtggagaatattgagcgtctcaaagtagacaagggaagacaaccaggtgaggtgactcgggaacagcaagacgccaagctgtgcgaacgtcacagagaaaaattacactattattgtgaagatgacgggaagctgctttgcgtgatgtgtagggagagtagggagcataggccccatacagccgtgctgatggagaaagctgcccaaccccacagggagaagatcctgaatcatctaagtactctgcggagagatcgggataaaatacagggctttcaggcgaagggcgaggcagatattttggcggctctcaagaagttgcaagaccagcggcaatatatcgtcgcagagtttgagcagggacaccagtttctccgtgagagagaggagcacctcctcgagcaattggccaagctagagcaggaactaaccgaagggagagaaaaattcaaatcacggggtgttggtgagctggccagattggccctcgtaatctccgagctagagggtaaggcacagcagcccgctgctgaactcatgcaagacacaagggatttcttgaatagatacccacgaaaaaaattctgggtgggcaagcctatagctcgcgtggtaaagaaaaaaacgggcgagttcagtgataagttacttagcctgcaaaggggtctgagagagttccaggggaagttattgagagacctcgaatacaaaacggtctccgtgaccctcgatccccagtccgcctcaggctacctgcaactcagcgaggattggaaatgcgttacctataccagcctgtataagagtgcttacctccatccacaacaatttgattgtgaaccaggagtgctggggagtaaggggtttacatggggaaaggtctactgggaggtagaggtggaacgggaggggtggagtgaagacgaggaagaaggcgatgaggaggaagagggtgaggaagaggaggaggaagaagaggcagggtatggcgatggctatgacgactgggagaccgatgaggacgaagaatcgttgggcgacgaagaagaagaggaggaggaggaggaggaggaggttctcgagtcatgcatggtgggcgtggcacgcgattctgttaagagaaaaggagatctatcccttcggcctgaagacggcgtgtgggccctcagactgtcctccagcggcatttgggctaacaccagtcccgaggctgagctatttccagccctgcgacccaggagggtaggtattgcacttgactacgagggcggtaccgtgacttttactaacgcagagtcacaggaacttatttacactttcacagccacgtttactaggaggctggtgcccttcctgtggctgaagtggccgggaacgcgcctgctgctgaggccttag

SEQ ID NO: 29536 - DNA, 444 bp, Artificial Sequence
  Description of Artificial Sequence: Synthetic coding sequence
atgtcatccgagccacccccacctcctcagccccctactcatcaggcatctgttggcctcttggacacacctagatcccgggagcgttctccatcccccttgagggggaacgtcgtccccagtccgctgcccacaagaaggaccagaacattcagtgctacggttcgcgcaagccaggggcctgtgtacaagggagtatgcaagtgtttctgcagaagtaagggccatgggttcatcactcctgcggacggcggtccagatatctttcttcatatatcagacgtggagggcgaatatgttccagtggagggcgacgaggtcacatacaagatgtgtagcatccccccaaaaaatgaaaagttgcaagcagtcgaggtggttatcactcacctggcccctggcactaaacatgaaacctggtcagggcatgtgatctcctcttag

SEQ ID NO: 29537 - DNA, 951 bp, Artificial Sequence
  Description of Artificial Sequence: Synthetic coding sequence
atgaccccctctgagggggcacgcgctggcaccggccgtgaacttgagatgctggattcacttctggcgttggggggactagttctactgagagactctgtggagtgggagggccgaagcctgctgaaagccctggtaaaaaagagcgccctctgtggtgagcaggtgcatatcttaggttgcgaagtgagtgaggaagagtttagggagggctttgattccgatataaacaacaggctggtttaccacgattttttcagggacccgctaaactggagtaagacagaagaggcatttcccggtgggcctttgggcgctttgagggccatgtgtaaaagaaccgaccctgttcctgtgacaatagccctggattccttgagttggctgttactgcggctcccctgcacaacattatgtcaggtcctgcatgcagtaagccaccaggactcatgtcctggagactccagcagcgtaggtaaagttagtgtcctgggactcctgcatgaagagctgcatgggcctgggcctgtcggcgcactgagttcattagcacagacagaggtaactctcgggggtaccatggggcaggcctccgctcatatactgtgcagacgcccacgtcagcgcccaaccgaccagactcagtggttttctatacttcctgacttttctctggacctgcaggaggggccttccgttgaaagccagccctattccgatccccacatcccgcctgtagaccccaccacccacctgaccttcaatctccacctgagcaagaaggaacgcgaggcgcgagactccttaattctaccttttcagttttcaagcgaaaagcagcaggctcttctgaggcccagacccggtcaggccaccagtcacatcttttatgagcccgacgcatatgacgatcttgaccaggaggaccctgacgatgatcttgatatctag

SEQ ID NO: 29538 - DNA, 951 bp, Artificial Sequence
  Description of Artificial Sequence: Synthetic coding sequence
atgacgccgtccgagggggcacgggctggcacaggcagagaattagagatgctcgattctctgctggcactgggaggactggtcctgctgagagatagcgtggaatgggagggtcggtctctgttgaaggccctcgtcaaaaaatccgccctgtgtggggagcaagttcacattcttgggtgcgaagtctcagaggaagagtttcgggaaggttttgactcagacataaacaacagactcgtttaccacgatttttttcgcgatccactgaactggagtaagaccgaggaggcttttccaggcggtccgctgggtgcgcttcgggcaatgtgtaaacgtacagaccctgtgcctgtgaccattgcactcgacagtttgagttggttactccttagactgccctgtaccactctctgccaggtgttacacgctgtgtcccaccaggactcatgccccggagacagttccagtgtcggcaaagtatctgtgctaggactgctacacgaggaactccatggacctggccctgtgggagccctgtctagtttagcacagaccgaggtgaccctgggaggaaccatgggacaggcgtctgcgcacatcctgtgcagaaggcccagacagagacccactgatcaaacccaatggttttcaatcctgccagacttctcgctggacctgcaggagggccctagcgtggagtcacagccctattccgacccacatatcccaccagtggatcccactacccatttaacgtttaatcttcatctgtctaaaaaagagagagaagcgcgagacagcctgatccttcctttccagttcagcagtgaaaaacagcaggctctgctgcggcctcgaccgggtcaggcaaccagtcacatattttacgaaccggacgcctacgacgatctggaccaggaagaccctgatgacgatctcgacatttag

SEQ ID NO: 29539 - DNA, 810 bp, Artificial Sequence
  Description of Artificial Sequence: Synthetic coding sequence
atgaatcaagaggacctggacccggatagcacaacggatgtcggcgacgtcaccaacacagaagaggaactcataagagagtgcgaagagatgtggaaagacatggaagagtgccagaacaaactgtcactgatcggcaccgaaacactcacagacagtaacgcccagttatccctactcatcatgcaggtcaagtgcttgacagctgaactgtcccagtggcagaaaaaaacacccgaaacaattccgttaaccgaagatgtgctcattactctggggaaagaggagtttcagaaactccgtcaagacctagaaatggtccttagtactaaagaatccaagaatgagaagctaaaggaagatctggaacgggagcaacgctggcttgatgagcaacagcagatcatggagtctctcaacgtgttacatagtgagttaaagaataaggtcgaaacattctctgaatctaggatttttaatgaactcaagacaaaaatgcttaacatcaaggaatacaaagaaaagctcctgtccacattgggagagttcctcgaggaccattttcctttgccagatcgctccgtcaaaaagaagaagaagaacatccaggaatcatcagtaaatctgatcaccttgcatgaaatgctcgaaattttaatcaatcgattgttcgacgtccctcatgatccctatgtgaagatcagcgactctttctggcccccttatgtggagctgctcctgcggaatggaatagccttgaggcaccctgaagatccaacaagaatccggttagaagcattccaccaatag

SEQ ID NO: 29540 - DNA, 1173 bp, Artificial Sequence
  Description of Artificial Sequence: Synthetic coding sequence
atggccactggggacctgaagaggtctttgaggaacttagagcaggtactccggctcttgaactacccagaggaggtcgattgtgttggattgatcaagggcgacccagctgcttctctgcccattatttcttattcgtttacctcttattctccctatgttacggagctgatcatggaatctaacgtcgagctcatcgccaagaatgacctcaggttcattgatgctgtttacaaattgctacgagatcagttcaactataaacccatcttaactaaaaagcagttcatccagtgcggatttgccgaatggaagattcaaattgtgtgcgacatacttaactgcgttatgaagaagcataaggagttgagctcattgcaaaagattccctcacagcaaagaaagaagatttcgtctggaaaaagtgaacccccattaggaaatgaaaagatctctgcagaggctgtaggggtggatatctcgggccgtttcatgacaagcgggaagaaaaaagccgtggtgatcagacatttgtacaacgaggataacgtcgacatttcagaggatactctgagccctataaccgatgtgaacgaggctgtggatgtctctgacctgaacgcaacagagattaagatgcctgaagtgaaggtgcccgaaattaaggctgagcagcaggacgtgaacgtgaatcctgagattacggcactccaaacaatgttagccgaatgccaggagaatctgaagaagctaacaagtatagaaaagcgtcttgactgcttggagcagaaaatgaaagggaaagtgatggtagatgaaaacacatggaccaacctcttgtcaagagtgacattgctggagacagaaatgcttctgagcaaaaagaacgacgagtttattgagttcaatgaagtgagcgaggactatgcctcttgctccgatatggacctactcaatccacatcgtaagtcagaagtagagcgccctgcctcgatccctctgagctccggatacagtacagcatcctcagactccacaccacgggcatcaaccgtgaattactgcgggctgaacgaaatcagcgaagagacaaccattcaaaaaatggagcgcatgaaaaagatgttcgaagagaccgccgaactgctgaagtgcccgaaccattacctttag

SEQ ID NO: 29541 - DNA, 381 bp, Artificial Sequence
  Description of Artificial Sequence: Synthetic coding sequence
atgcctttcttcgggaataccttctcaccaaaaaaaacacctccacgaaaatcggcctctttgtctaacttgcattctctggaccggagcacacgggaggtcgagctgggcctggagtatggttcacccactatgaatttggctggccagtcattgaaatttgaaaatgggcagtggatcgctgaaaccggggtctcagggggtgtggataggcgcgaggtgcagcgcctgcggcgtagaaaccagcagctggaagaggagaataacctactccggctgaaagtggacattctcctggacatgctcagcgaaagtaccgctgagtcccatttgatggagaaggaattagacgaactgcgtatcagcagaaagcgtaaatag

SEQ ID NO: 29542 - DNA, 711 bp, Artificial Sequence
  Description of Artificial Sequence: Synthetic coding sequence
atgcaagtgcaggacgacggggtgaacttaattcccttcgcaaagtgctcccgcgtggtgagcaggtctccaccgccacgcctgcctagccagagtctgcggcctatgcctcagcgttacggtgacgttttctggaaaaatctgaaccagcgaccaacacccacatggttagaagaacaacacataccacccatgctcagagcaactggttgttctcagcttggcctgtatcctcctgagcagctgcccccacctgagatgttatggaggcgcaaaaagagaaggccttgtctagaggggatgcagcagcagggcttgggcggagttcccgcacgtgtgcgagcagtgacataccaccttgaagacctaagacgtcgacagtccatcatcaacgaacttaagaaagcccagtggggatcatctggcgcagctagtgagccggtggtgctcggagaggaaggttgcggtttccctagtacaaacgagtaccctgatttggaggaggaacgggcaacgtatccacaagaggaggatcgcttcctgacacccggaagagcccagctgctctggtccccctggagccccctcgaccaagaggaagcttgcgctagtagacagctccattcgctggcctccttttccacggtgaccgctcgcagaaatcctttacacaacccatgggggatggagctggctgccagtgaagaatag

SEQ ID NO: 29543 - DNA, 1680 bp, Artificial Sequence
  Description of Artificial Sequence: Synthetic coding sequence
atgaatcccctatttgggcctaacctgtttttgctgcagcaggaacaacagggcctcgctggcccactgggagattcccttggcggagaccatttcgcaggcggtggggacctacctcccgctcccctgagccctgcgggaccagccgcatattcaccacctgggcctggaccagcaccacctgccgctatggccctgagaaatgaccttggatctaacattaacgtcttgaagacactgaacctccggttcagatgtttcctggcaaaagtgcacgagcttgagaggcgaaaccgcctcttggaaaagcaattgcagcaagccttggaagagggtaagcagggcaggcgcggtcttggacggagggatcaggccgttcagaccgggtttgtgtcgccaatccgccctctcggcttgcagctgggagcacgtccggctgcagtgtgcagtccctcagctagagtgcttggcagtccagccagatcacctgctggccctcttgcgccttccgccgcaagcctgtcttcctcctctacatcaacatcaactacttactcaagctcagctaggttcatgcccggtacaatctggagcttttcacacgccaggcggttgggcccaggcctggaacccaccttggtacaggggccaggactctcctgggttcatcctgatggtgtgggagtgcagattgacacgatcacacccgagattcgcgcactctataacgtgttggcaaaagttaagagagagagggacgaatacaagcgacggtgggaggaggaatatacagtgaggattcagctgcaagatcgcgtgaacgaactgcaagaggaggcccaagaagccgacgcttgtcaggaagagctcgcattgaaagttgagcaactcaaagcagagcttgtggtcttcaaagggctgatgtctaataacctgtctgagctggatacaaagattcaggagaaagctatgaaggtggatatggatatctgccgaaggatagatataaccgcaaagctatgtgatgtggctcagcagcggaactgcgaagacatgattcagatgttccaggtaccatctatgggtggtcggaaacgggagcgcaaggctgctgttgaggaggacacatctttaagcgagtctgaggggcctagacagccagatggcgacgaggaagaatcaactgcgctgtcaattaatgaggaaatgcaaagaatgctcaatcaattgcgcgaatatgactttgaggacgactgtgactccctgacctgggaagagaccgaggaaaccctgctgctatgggaagatttttccggctacgctatggcggctgctgaggctcagggagagcaggaggactcgctggaaaaggtcattaaggacaccgagagtctgttcaagactagagaaaaagaatatcaggaaacaatcgaccagatagagctggagcttgccaccgccaagaacgacatgaatagacacttgcatgagtatatggagatgtgttccatgaagcgcggactagatgtgcagatggagacttgtagacgtctgattacccagtcaggcgacagaaagagcccagcctttacggccgtgccactaagtgacccacccccaccacctagcgaggccgaagactcagatcgggacgtgtccagcgacagcagcatgcgctag

SEQ ID NO: 29544 - DNA, 1182 bp, Artificial Sequence
  Description of Artificial Sequence: Synthetic coding sequence
atggcttcaggcagagctagatgcacgcggaagttgagaaattgggtcgtggaacaagttgagagcggtcagtttcctggtgtatgttgggacgacacagcaaaaaccatgtttaggattccctggaaacatgctggaaagcaagacttccgtgaggaccaggacgcagctttcttcaaagcctgggccatcttcaaagggaagtacaaggagggggataccggcggacccgctgtttggaaaacccggctgcgctgtgcattaaataaatcctccgagttcaaggaggttccagagcgcggacgcatggatgtggccgaaccttacaaggtttatcagctgttgcctccgggaatcgtgtccggacagcccggaacccaaaaagtgcctagcaaacggcagcatagtagtgtgtcttccgagaggaaagaagaggaggacgccatgcagaattgtacactaagccccagtgtcctgcaggattccctcaacaatgaggaggagggcgcaagcggcggagccgtccatagcgacattggcagcagtagttcctcgagcagcccggagccacaagaagtgacagataccacagaggctcccttccagggcgaccagaggagtctggagttcttattgcctccggaacccgattactcactgctcttgacctttatctacaatggtagggttgttggcgaagcgcaggtgcaatctctcgattgcagactggtggctgagcccagtgggtctgaaagttccatggaacaggtgctcttccctaaacccggtccacttgagcccacccagcgcctcctcagccagctggaaaggggcattttggtggcctcgaacccaagggggctgtttgtccagcggttatgccctatccccattagttggaacgcaccccaggcgcctccgggacccggaccccacctcctaccttccaatgaatgcgtcgagctctttaggactgcttatttctgcagagacctggtccgctatttccagggcctgggccctccccctaagtttcaggtgacgttaaacttttgggaggagtcccacgggagcagtcacactcctcagaaccttatcactgttaaaatggagcaggctttcgctcgctatctgttggagcaaacgcccgagcaacaggccgctattctttccctagtttag

SEQ ID NO: 29545 - DNA, 2454 bp, Artificial Sequence
  Description of Artificial Sequence: Synthetic coding sequence
atgtggtctctgactgcaagcgagggagagtccactactgctcacttcttccttggagcaggagacgaggggctaggcacccgaggcatcggaatgcgtcccgaggagtcagattctgaactgctcgaggacgaggaggacgaggtcccgccagaaccccaaatcattgtcgggatttgtgccatgactaagaaaagtaaaagcaaaccgatgacccagattcttgaacggctgtgccgcttcgactatctgaccgttgttattcttggagaagatgtgatcctcaatgagcccgtggagaactggccctcctgtcattgcctgatcagctttcacagtaaggggtttcctttggacaaggccgtggcttattccaaactgaggaatccctttctcataaacgacctggccatgcagtactatatccaggaccggcgagaggtatacagaatactgcaagaggagggcattgacctgccacgctatgcagttctgaaccgggaccccgctcgcccagaggagtgcaatctgattgaaggcgaggaccaggtggaagtcaatggggcagtgttcccaaagccctttgttgagaaacccgtgagtgccgaggatcacaacgtgtatatatattacccctcttcagccggaggcggtagtcagcggctctttaggaagatcggttccagatctagtgtatattcacccgagtcctctgtcaggaagaccggctcatatatatacgaagaattcatgcccacagacgggaccgacgtcaaagtgtacacagtaggtcccgactacgcccacgccgaggctcgaaaatctcccgcactggatgggaaagtggaacgggatagtgaaggtaaggagattcaatacccagtgatgctgacggcaatggagaagttggttgccaggaaggtgtgtgttgcctttaagcaaactgtatgcggattcgatttgctcagggctaatggacattcttttgtatgtgatgttaatgggttcagcttcgtcaagaattccatgaaatactatgacgattgtgcaaaaattcttggaaacaccatcatgcgggaactcgcaccgcagtttcaaatcccctggtcaataccaactgaggccgaagatatcccgatcgtgccaaccacatcagggactatgatggagttgcggtgtgtaatcgccattatccgacatggcgatcgcactcctaagcagaagatgaaaatggaagtcaaacaccctcgcttcttcgctttgtttgagaagcatggaggctataagactggcaagctcaagctgaaacgccctgagcagctccaggaggtactcgatattacaaggttgctgctggccgaattggagaaagaacccggtggggagatcgaggagaagacaggaaagctggagcagctgaagtccgtgctggaaatgtatggacacttcagcggcatcaaccgcaaagtccaactgacctattacccccacggggtgaaggctagcaatgaaggacaggacccccagcgcgaaaccctcgcccctagccttctcctggtgctgaagtggggcggagaattgacccctgcgggacgggtgcaagccgaggaactcgggagagcatttcgctgtatgtatcccggtggccagggcgactacgccggattcccagggtgcggcctgctgaggctgcatagtaccttccgacatgacctcaagatctacgcttccgatgaaggacgggtacagatgaccgcagccgcattcgccaaggggttactcgcattggaaggggagctgacaccaatcctggtgcagatggtgaagagcgccaatatgaatgggctgcttgactccgacggtgattctctgagttcatgccaacatagggtaaaggcccgattacaccatatattacaacaagatgcccctttcggcccagaggattacgatcagctggctcctacaagatcaacttccttgcttaactcgatgacaattattcagaatcccgtgaaggtgtgcgatcaagtgtttgccttaatcgaaaatctaacacaccagatccgagaacgtatgcaggatccgcgatcagtggatctccagctgtaccactcggagactctggagcttatgttgcagaggtggagcaaattagaacgcgatttcagacagaagtcgggtagatacgacatatcaaagattcccgatatttacgactgcgtaaagtacgacgtccagcacaacggaagtctgggtttgcagggcacggcggagttgcttagactctcaaaggctctggcagacgtcgtgattccccaagaatacggaataagtcgcgaagagaaattggagatcgccgtaggcttctgtttaccgttattacgaaaaattctgctggatctccagcggacccatgaagatgaatcggttaataagcttcatcctctctag

SEQ ID NO: 29546 - DNA, 417 bp, Artificial Sequence
  Description of Artificial Sequence: Synthetic coding sequence
atgatattgcagcagccgctgcagagaggcccacagggtggggctcagagattaccccgtgccgctctaggcgtgacctggggcctggacgcctcgtcgccacttaggggcgctgtccctatgtccactaagcgacggctagaggaggaacaagagcctctccggaaacagttcctatcagaagagaacatggctacacacttcagccagctgagcctgcacaatgaccacccgtactgttcccctcccatgacattttccccagctttgcctcctctgaggagcccttgctctgagctgctattgtggcgctaccccggttccctgatcccagaagccctcagattgctgaggctgggcgacacaccctctccaccttaccctgccactcctgcgggtgatatcatggaactgtag

SEQ ID NO: 29547 - DNA, 4302 bp, Artificial Sequence
  Description of Artificial Sequence: Synthetic coding sequence
atgtggtcgttgacagcttctgaaggagagtccacaactgcccatttctttctgggcgctggcgacgagggcttgggaacacggggtatcggaatgagaccggaggagagcgatagcgagctgttggaggacgaggaagatgaggtgccgccagagccgcaaatcatagttggtatatgcgctatgaccaaaaagtcgaaatcaaagcccatgacacaaattctcgagcgactatgtcggttcgactacttaacggtggtgatcctcggggaagacgtgatcttgaatgaacccgttgagaattggccctcttgtcactgcctgattagctttcactcaaagggttttccgttggataaggctgttgcatatagcaaacttcgtaacccgtttctcattaacgacttagccatgcagtattatatacaggatcggagagaagtctataggatcctgcaggaggagggtatcgatttacccaggtacgccgtcctgaaccgagatccggctcgaccagaggaatgcaacctgatcgagggagaagaccaggtcgaggtgaatggagctgtgttccctaaaccattcgtagagaaaccagtctccgcagaagatcataatgtgtatatctattatccctcatccgctggaggcggttcacaaagattgtttcgcaaaatcggctctcgatctagtgtgtattcacctgagtcctccgtccgtaaaacaggctcctacatttatgaagaattcatgcccaccgacggtacggacgtgaaggtgtatactgtggggcctgattacgctcatgcagaagcgcgaaaatcacccgctcttgatggaaaggttgagagggattccgagggcaaggaaatacgctacccagtgatgctgactgctatggaaaaactagtagccagaaaggtctgcgtagcttttaagcagaccgtttgtgggttcgacctgctgcgggcaaatggtcacagttttgtgtgtgatgtgaacggcttctcgttcgtcaagaatagcatgaaatattacgatgactgcgctaagattctcggcaataccataatgagggaattggcccctcagttccagatcccctggtccatacccacagaagccgaagatattcctatcgtacccactacttccggcacaatgatggaattgcgctgcgtcattgctataattcgtcacggtgatcggacgcccaagcagaaaatgaaaatggaggtgaaacacccaagatttttcgctctgttcgagaagcatggaggatacaagactgggaagttgaagctgaagaggccagagcaacttcaggaggtgttggatatcacgcgacttctcctagcagaattagagaaagaacccggtggagaaatcgaggaaaaaacagggaagctcgaacagctcaagtctgtcctagaaatgtacggccacttttccggcattaataggaaagttcagctgacctattatccacacggcgtgaaggcttcgaatgagggacaggatcctcagcgcgaaactcttgctccatccttgctactcgtcctgaagtggggaggggaattaactcctgccggtcgggtgcaggcagaggaactaggaagggccttcagatgcatgtatcccggaggtcagggggattacgccggattcccgggttgcggcctgctgaggcttcacagcacttttcgacatgacctcaagatttatgcttccgatgagggcagggttcagatgaccgctgcagccttcgctaaaggactgttggctctggaaggggaattaacacctattctggtccagatggtgaagtccgcaaatatgaacgggctcctcgattctgacggcgatagcctgagctcttgtcagcatagagtcaaggcccgtctgcaccatattttgcaacaggacgccccattcggcccagaagattatgatcagctggctccaacaaggtccacatcacttttgaacagcatgaccataattcagaaccctgttaaagtatgcgaccaggtcttcgcattaattgaaaatttgactcaccagattagggaaaggatgcaggacccaaggtccgtagacctgcagctgtaccactctgagacactggaactaatgctgcagcgatggagtaagttagagagagattttaggcagaagagtggccgatatgacattagcaaaatccccgatatatacgattgcgttaagtacgacgtacaacacaatgggagtcttggactgcagggaaccgcagagctcctgcgcctatcaaaggccttagccgacgtcgtgatcccccaggaatacggcatctctcgagaagaaaaactggagatcgcagttggcttctgtctacccctccttcgaaaaattctgctcgatttgcagagaacgcacgaggatgagtccgtcaataagctccatcctctctgctatttacgctatagcagaggggtattatcaccgggacgccatgtgcgaacccgtctttattttactagcgaaagccacgttcatagtctcttgagcgtgtttcgctacggaggccttctggacgagactcaagacgctcagtggcagagagctcttgactatctttctgcaatcagtgagctgaactacatgacacagattgttatcatgctgtatgaggacaatacgcaggaccctctcagcgaagaacgctttcacgtggaattgcattttagtcccggtgtgaaaggcgtcgaagaagaagggagtgcacccgctgggtgtgggtttcgcccagccagttctgagaacgaagaaatgaaaacaaaccagggctcaatggaaaacctttgtcctggcaaggcaagtgacgaacctgatcgagcactgcagacgtcccctcagcctccagaggggcctgggttgcccaggcgtagtccactgattcgcaataggaaagctggctctatggaggtgctttctgaaactagttctagcagacctggtggctatagattgttttcgtcctcgcgtcctcccacggaaatgaagcagtcaggtttaggaagccagtgcacaggccttttcagtaccaccgtgctggggggttcctccagcgcgccaaacctccaggattacgctcggtcccacggcaagaagctccccccagcatctctgaaacacagggacgagctgttatttgtgcccgcagttaagcgattctccgtgtcattcgcgaagcaccccactaacggctttgagggttgcagcatggtgcccaccatatatccactagagaccctgcataatgccctgagtctgcgacaggtgtccgagtttctcagtcgtgtctgccagcgccacacagacgcccaggcccaggcatctgcagctctatttgacagcatgcactcaagtcaggcctcagacaatcctttctctccaccgagaaccctccacagtccacctctgcagctgcagcagcgaagcgagaagcctccgtggtactcttcagggccatcttcgactgtgtcatctgctggaccctctagcccaactacggtcgacgggaatagtcagttcggcttctccgatcagccctcgctcaattctcacgtggccgaagagcatcagggcctgggcctcctccaggagacccctggtagcggagcccaggaactctccatcgagggtgaacaggagctgtttgaaccaaaccagtctccccaggttcccccaatggagacatcccagccgtatgaagaagtctctcagccctgccaggaggttcccgacatatcccaaccgtgtcaggacatcagtgaggctctttcccagccgtgtcagaaggtgcccgacatatcccagcaatgccaagagaaccacgacaatgggaaccacacttgccaagaggtgccacacatttcccaaccatgccaaaagtcttctcagctctgccagaaagtttccgaggaggtgtgtcagctgtgcctggaaaattccgaagaagtgtcacagccatgtcagggcgtttcagtagaagtcggaaagctggtgcacaagtttcacgtgggggttgggagcctggtgcaggagacgctggtcgaagtgggctcaccggcagaggagattcccgaggaggtgatccagccataccaggagttcagcgtcgaagttggccgattggcacaagagacctcagctatcaacttgttgtctcaagggatcccagagatagataaacccagccaggagtttccagaggagatcgacctgcaggcacaagaagttcctgaggaaattaactag

SEQ ID NO: 29548 - DNA, 435 bp, Artificial Sequence
  Description of Artificial Sequence: Synthetic coding sequence
atggcggaagtgcaggtgttagtgctggacggtcgagggcacctattgggacgactagcggctatcgtggccaagcaggtgctgttgggtcgcaaggtggttgtcgttcggtgtgagggcattaacatttctgggaacttttacaggaataagctcaagtacctagcattcctgagaaagcgcatgaatactaacccttcccggggaccttatcacttcagggctccctcccggattttttggagaactgtacgaggcatgcttccacataagactaaacgaggtcaggccgctctcgatcggctgaaggtgtttgatggaatcccacccccatacgggaacaggcccaggcgtacgtggaggagaaaactaaccaatactcagcggagctcccgtccaaccgactcctggtccgaacccaataaagactgttag

SEQ ID NO: 29549 - DNA, 408 bp, Artificial Sequence
  Description of Artificial Sequence: Synthetic coding sequence
atggccgcactgcgccctctggtaaagcccaagattgtcaaaaagcgtactaagaaattcatcagacaccagtctgacaggtacgtgaaaattaagagaaactggcggaagccacggggaattgataatcgggtgcggaggaggtttaagggacagattttgatgcccaatatcggctacggatccaataagaagaccaagcatatgctcccttccggattcaggaaatttctggttcacaatgttaaagagctggaggtgttactaatgtgtaacaaaagttactgtgccgagattgcccacaatgttagcagcaaaaacaggaaagctatcgtggagcgggctgcccagcttgctatccgcgttactaatcctaacgctagattgagatccgaagagaacgagtag

SEQ ID NO: 29550 - DNA, 408 bp, Artificial Sequence
  Description of Artificial Sequence: Synthetic coding sequence
atggccgctcttcgccctctggtaaagcccaagattgttaaaaagagaacaaagaaatttattagacatcagtctgacaggtatgtgaagatcaaacgcaactggagaaagcctaggggcatagataacagggtaagaagaagatttaagggtcagatcctgatgcctaacattggctacggaagtaataaaaagacaaagcacatgttgccttctggcttccgaaagtttcttgtgcataacgtcaaagaactggaggttctactgatgtgtaataagtcgtactgcgccgaaatagcacacaatgtaagttcaaagaatcggaaagcaatagtagaacgggcagcacagctggctatccgggttactaacccaaatgcacgtctccggagcgaagagaatgagtag

SEQ ID NO: 29551 - DNA, 684 bp, Artificial Sequence
  Description of Artificial Sequence: Synthetic coding sequence
atggaacctcagggatacccagccttcggttgggaccactccctccacaagaggaagaggttgcctccagtcaagcgctctctggtgtattatctgaaaaaccgggaggttcgacttcaaaatgaaactagttacagtagagttctacacggctacgcggctcaacagttgccgtcactgttgaaggagcgagagttccatttgggaactttgaacaaggtgtttgcctctcaatggctgaaccaccggcaggttgtctgtggcacaaagtgtaacaccttattcgtcgtagatgtgcagacaagtcaaatcaccaagatcccaatactaaaggatcgggaaccaggtggggtgacccagcaggggtgcggaatccacgccatcgagcttaatccatccaggacactgctcgctaccggtggcgacaaccctaattcattggcgatttatcgccttcctactcttgatcctgtctgcgtgggtgacgatggacacaaggattggattttcagcattgcgtggatctccgatactatggccgttagcgggagccgtgacgggtccatgggcctgtgggaggttactgacgacgttttgaccaagtcagacgccagacataatgtcagcagggttcccgtatatgcccacataactcacaaagctctcaaggacattcctaagtag

SEQ ID NO: 29552 - DNA, 1554 bp, Artificial Sequence
  Description of Artificial Sequence: Synthetic coding sequence
atgaccagactcgggaccgtaccaagaaaagctctggaaatgagttgtgccatacagaaccagttggcgaggatccttgccgagttcgaaatgaccctcgagcgtgacgtgctgcaacccctttctcgcctctctgaggaagaacttccagccatcttgaaacacaaaaagagcctgcagaagctggtttctgattggaatacccttaagtcccggctgtcgcaggccacaaagaattcaggttcgtcgcaagggctcggtggcagcccaggaagccacagccacacaactatggcgaataaagtggagacactgaaagaggaggaagaggaactaaaaaggaaagtcgaacaatgtagagacgagtatttggctgatctttatcactttgtaaccaaggaggactcctacgctaactactttatccggctgcttgaaatccaggccgattaccataggcgcagcctcagtagccttgatactgctctcgcagaattgagagaaaatcacgggcaagccgaccatagtccatcaatgactgcgacgcacttccccagggtgtacggtgtgagtttggcaactcacctccaggagctcggaagagagatcgccttgccgatcgaggcatgcgtgatgatgctactctcagaaggcatgaaagaggagggcctttttagacttgctgccggtgcctcggtgctgaagcgacttaagcagaccatggcgtctgaccctcattcactcgaagaattttgttcggacccccatgctgtcgccggtgcccttaaatcatacctgagggaactccccgagcctctgatgacattcgatctttacgatgattggatgagggcagctagcctaaaggaacccggagctagattacaggccttacaagaagtgtgtagtcgcttgccgcctgaaaatcttagtaacctgcggtacttgatgaagtttctggcgagactcgctgaagaacaggaagtgaacaaaatgaccccctcgaatatagcaatcgttctcggtcctaacttgctgtggccccctgagaaagagggcgaccaagcccaactggatgctgcctctgtgagctctatccaggtcgtcggggtggtcgaggcccttatccagtcagctgatacattgtttccaggtgatatcaatttcaatgtaagcggtctgtttagcgcggtgactctgcaagataccgtgtctgaccgtctagcttccgaggagctgccttcaaccgcagttcccacacccgctacaacaccagctccggcacctgctcccgcacctgcccctgcgccagccctcgcctctgcagccaccaaggagagaaccgaaagtgaagtaccacctagaccggctagcccgaaagtgactaggagtccaccagaaacggcagctcccgtagaggatatggcacgacggagtccacgcggtgctaccggcagaaaggagagatttgcttgctcatatggaacggatagtagtttggccgatatgttcttcgtgcgactcgtaaataaactgttttggacgaagctgtag

SEQ ID NO: 29553 - DNA, 918 bp, Artificial Sequence
  Description of Artificial Sequence: Synthetic coding sequence
atggatttgagcggggtgaagaaaaagtcactgttgggggtgaaggaaaacaacaagaagtcttccacccgcgctccgagccccactaagcgcaaagataggtcagatgagaaaagtaaggatagatctaaggacaagggagcaactaaggaatcatccgagaaggaccgcggacgtgacaagacgcgcaaaaggaggagtgcctcttcaggatcctcctcaaccaggagcaggtcttcatctacttcatcctctggcagctctactagcactggatcttccagcggctcatctagttccagtgcatcctcgcggtccggatctagtagtacctctaggtcttcttcctcatcctcctcctccgggtcaccctcaccaagccgcaggaggcacgataataggaggaggtcccgttcaaaaagcaagccccctaaaagggatgagaaagagcggaagcggcgtagcccctctcctaagcccaccaaggttcatatcgggagacttaccaggaacgtgaccaaagatcacattatggaaattttttctacatatggcaagataaaaatgattgacatgcccgtagaacgaatgcacccgcacctgtccaaggggtacgcctatgtggagtttgagaacccagatgaggctgagaaggcgctcaaacatatggatggcggtcagatagacggtcaggaaatcaccgcaacagctgtcctggctccatggcccaggcctccacccagacgtttctcccctcctagacgaatgcttcccccaccacccatgtggaggcgaagccctccccgaatgaggcgaaggagccggtcccctagacggagatccccggtgcgccgaagaagcaggagccccggacgccgtagacatcgctctcgaagtagttccaactcctccagatag

SEQ ID NO: 29554 - DNA, 927 bp, Artificial Sequence
  Description of Artificial Sequence: Synthetic coding sequence
atgattcacgacgcccagatggattactatggcactcgcctcgccacatgctcatccgatcgatcagtgaaaatctttgatgtgaggaacggagggcagattttaatcgccgatctgagaggtcacgagggacctgtctggcaagtggcctgggcccacccaatgtacgggaatatcctggccagctgtagttacgacaggaaagtcattatctggcgggaggagaatggtacctgggagaaatcccatgaacatgctggccacgactcatccgtcaacagcgtgtgttgggccccacacgactacggtctcatcctagcttgtggaagctcggatggcgctatatccctgctgacatacactggcgaaggacagtgggaagtgaaaaagattaataatgcccatactattggttgcaatgcagtctcctgggccccagcagttgtgcctggatcactcattgaccacccttccggacagaaaccaaactacatcaaacggttcgcaagcggcggatgtgacaacctcatcaaactttggaaagaagaggaagacggccaatggaaagaagagcaaaagctggaggcccactctgactgggtcagggatgtggcctgggccccaagtattggcttaccaacaagcacaattgcgagctgttctcaagacggcagggtattcatctggacatgcgatgacgcatcctccaatacatggtccccaaaactcctgcacaagttcaatgatgttgtttggcatgtgagttggagcataacagccaacatcctagctgtaagcgggggtgacaataaagtgaccctctggaaggaaagcgtggacggccaatgggtgtgcatttctgacgtgaacaagggtcagggatctgtcagcgcgtccgtaaccgaaggacagcagaacgaacagtag

SEQ ID NO: 29555 - DNA, 1542 bp, Artificial Sequence
  Description of Artificial Sequence: Synthetic coding sequence
atgtctatcgagattgagtctagcgatgtcatccgtttgatcatgcagtacttgaaagagaactctctacacagggctctcgctaccctccaggaagaaacgaccgtgagtctgaacactgtggactccattgagagtttcgtcgccgacattaactccggccactgggacacagtactccaggcgatccaaagcctgaagctgccagataagaccctgatcgatttatacgaacaagttgtgctcgaacttatcgaactgcgcgagttaggggctgctcggagcctactcagacaaacagatccaatgatcatgctgaaacaaacacaacctgagcgctacattcatctagagaatttgctcgcacgatcatattttgacccaagagaggcctatcccgacgggtcatcaaaggaaaagcgcagagccgcaatagcccaggctctggctggcgaagtgagtgtcgttccaccctccaggctcatggccctgttgggccaggcgctgaagtggcagcaacaccagggattgctgcccccaggtatgacaatcgacttattcagagggaaggctgctgttaaagatgtcgaggaggagaaattcccaactcaactgtctagacatattaagttcggacagaagtcacatgtcgaatgcgccaggttttctcccgatggccagtacctcgtgactgggagtgtcgacgggttcatagaggtctggaacttcaccacaggtaagattcggaaagatttgaaataccaagctcaggacaacttcatgatgatggatgacgctgttctctgtatgtgcttttcccgagataccgaaatgctggctacaggggcacaggacggaaaaattaaagtgtggaagatccagtccgggcaatgtctccggaggtttgagcgggcacattcgaaaggcgtaacatgtctctctttctccaaagattcctcccagattctttctgcctctttcgatcagacaatccgcatccatgggttgaaaagtggaaagacccttaaagagtttagaggacattcaagctttgtgaatgaggccacttttacccaggatggccattacatcatatctgcttccagtgatgggaccgtgaagatctggaacatgaaaacaacagaatgcagcaatacgttcaagtccttgggtagtaccgccggaactgacatcacagtgaactcagtcattctgctgcccaagaatcctgaacacttcgtggtgtgtaaccggtccaataccgtagtaattatgaacatgcaaggtcagatcgtgcgtagcttttcttctggcaagcgggaggggggtgactttgtctgttgtgcccttagcccacggggagaatggatttattgcgttggcgaggacttcgtgctgtactgtttcagcacggtcactggtaagctcgagagaaccctcaccgttcacgagaaggacgtgataggcatcgcgcaccacccccaccagaacctgatcgccacctactccgaagacggcctgctcaaattgtggaagccatag

SEQ ID NO: 29556 - DNA, 2136 bp, Artificial Sequence
  Description of Artificial Sequence: Synthetic coding sequence
atgtcttcggtgcagtcccagcaggagcagctgtctcaatccgatccatctccatcccccaattcctgctcctcatttgagcttatcgatatggatgcaggcagtctgtatgagcccgttagtcctcactggttctattgtaagataatcgactcgaaggagacatggatcccctttaatagcgaggactcccagcagcttgaggaggcctactcatccggcaaggggtgtaatggcagagtggtgcccacagatggcggtagatacgacgtgcacttgggagagaggatgcggtatgcggtctattgggacgagttggcctctgaggtgagacgctgtacatggttctataagggagacaaagataacaaatatgtgccttactcggaaagcttctcacaggttctggaagaaacgtacatgctggcagtgactctggatgagtggaaaaaaaagctcgagtcccccaaccgggagatcatcattctccacaaccccaagttaatggtgcactatcaaccagtggccggttcagacgactggggctccacccctaccgaacaggggagaccacggacagttaaacggggagtcgaaaatatttccgtggatattcactgcggagaacctcttcagattgatcatcttgtgttcgtggtgcatgggatcggcccagcatgtgatctcaggttccgtagcattgtgcagtgtgtgaatgattttaggtctgtaagcctcaacctgctgcagacgcactttaagaaagcccaggaaaaccagcagattggccgagtcgaatttttacccgttaactggcactcacctctccattccaccggagtagacgtagacctacagagaatcacactgccaagtatcaacagattgaggcacttcaccaacgacaccatcctcgacgtctttttctacaacagtccaacctattgtcagacaattgtagacactgtagcctcggagatgaacaggatctacaccttgttcctacagagaaatcccgatttcaagggcggagtttcgatcgccggtcactcattgggatcactgattctgttcgacattctgactaatcaaaaggattcgcttggtgatatcgattctgaaaaggactctctgaacattgtcatggatcaaggcgatacaccaactctggaggaagatttaaaaaagttacaactgagcgagttcttcgacatatttgagaaggagaaggtggataaagaggccttagctctctgcaccgaccgggacctccaagagatcggcatccccctgggccctcgtaaaaaaatcctgaactatttctccacacggaagaacagtatgggtattaagcggcctgcccctcagcctgcctccggagccaacatccccaaagagtctgaattctgctccagttctaatactcgaaatggggattacttggacgtgggtatcggccaagttagcgtgaagtaccctcggctcatttataaacccgaaattttttttgctttcggctcacctattggcatgttcctgacagtgcggggtcttaaaaggattgacccaaattataggttcccaacttgtaagggcttcttcaacatataccatcccttcgatccggtagcgtaccgtattgagcctatggtcgtgcccggagttgaattcgaacctatgctgatacctcaccataaaggcaggaaacgcatgcacttggaactccgcgagggccttaccagaatgtctatggacctgaaaaataatctgctgggttcactccggatggcttggaaaagtttcacccgcgcaccttaccccgctttacaagcgtcagagacgccggaggaaaccgaggctgagcctgaatcaacctctgagaaaccatccgatgtcaacaccgaggaaactagcgtggccgtcaaagaggaggtgcttccaatcaacgtgggaatgttgaacggaggccaacggattgattatgtattgcaagaaaagcctattgaaagtttcaatgagtacctgtttgcgcttcagtctcatctttgctattgggagtccgaggacaccgtgctgttagttctcaaggagatctaccaaacacagggaatcttcctggatcagcccctgcagtag

SEQ ID NO: 29557 - DNA, 3351 bp, Artificial Sequence
  Description of Artificial Sequence: Synthetic coding sequence
atgtatggcagcgcccgatctgtgggcaaagttgaaccgagctctcagtcgcccggacggagcccccgattaccccgatcccctcggttaggccacagacggactaattctaccgggggtagttctggatcctccgtgggtggcggaagcgggaagacactctctatggaaaatattcaatcactgaacgcagcttatgcaacgtccggaccgatgtatcttagcgaccacgaaaatgtgggttctgaaaccccgaaaagcaccatgaccctgggacgctcaggtggccgattgccgtacggagtgaggatgaccgcaatggggtccagcccaaatattgccagcagcggggtggccagtgatactatagcttttggtgaacaccacctccccccagtgtccatggcaagcactgtgccccatagcctgcgtcaggcaagagataatacaatcatggatctgcaaacccagctcaaggaagtgttgcgagagaacgatctgctgcgtaaggatgtggaagtaaaagagagtaaactaagctctagcatgaactccattaagaccttctggagccccgaactcaagaaggagcgggctctgcggaaggatgaggcatcgaaaattacaatctggaaggaacagtacagggtggttcaagaagagaaccaacacatgcagatgaccattcaggccttacaggatgaactccgcatccagcgcgacttaaaccagttgtttcagcaggactcctcttcccggactggtgagccctgtgtggcagagcttactgaggaaaactttcaacgcctacacgcggaacacgagcgccaggctaaggagctcttccttctgaggaagactcttgaggaaatggaactgcgaatagaaacccaaaagcaaaccctcaatgcaagagatgaaagcatcaagaagctgctcgagatgctgcagtcaaagggtctgtccgccaaggcgactgaggaggatcacgaacgcaccaggcgcctcgctgaagctgagatgcacgtccaccacttggagtctcttttggagcaaaaggagaaagagaacagcatgctgcgcgaagaaatgcaccggcgtttcgaaaacgcccctgattcagcaaaaacaaaggccctccaaactgtgatcgaaatgaaggactcaaagatctccagcatggagagggggttgcgagatctcgaagaggaaattcaaatgttgaagtcaaacggggctttgagcaccgaggagcgggaagaggagatgaagcagatggaggtataccgctcccacagcaagtttatgaaaaataaagtcgagcagctcaaggaggagctttcaagcaaagaagcacaatgggaagaactgaaaaagaaagcggcagggctgcaggcagagattgggcaggtcaaacaagaactgtctcgaaaagataccgaactgttggccctgcagactaagcttgaaaccctgaccaatcagttctccgacagcaaacagcatatcgaggtgttgaaggagtctttgaccgccaaggagcagcgcgctgccatattgcagaccgaagtggacgcgttgaggctgcgcctagaggagaaagaaacaatgctaaacaagaagacaaaacagatccaggacatggcggaggagaagggcactcaagccggagaaattcacgatctgaaagacatgctcgacgtgaaggagagaaaggtgaacgtactgcagaaaaaaatagaaaatctgcaggagcagctccgtgacaaggagaagcaaatgtcaagcctaaaggaaagagtgaagtccttgcaagctgacacaacaaatacagacacagccctaaccaccctggaagaggccttggcagagaaagaaaggactattgaaagattgaaggagcagcgggaccgagatgaacgggagaaacaagaggagatagacaactacaagaaagacctgaaagatctgaaagagaaggtttcactgttacaaggcgacctatcggagaaagaggcttccctgctggacttgaaagaacacgcgtcatcccttgccagcagcgggttgaaaaaagattctagactgaagacccttgaaattgcactagagcaaaagaaagaggaatgtctcaagatggagagtcagttgaaaaaggcccatgaagccgctctcgaggcccgagcctccccagagatgtctgatagaatccagcacctggaacgggagataacacggtacaaggacgagtcttctaaagcccaggctgaggtcgaccgtctcctagagatactgaaggaggttgagaatgaaaagaacgataaagataagaagatcgctgagcttgaaagacaggtgaaggaccagaacaagaaagtagcaaatctgaagcacaaagagcaggtggagaaaaaaaaaagcgcccaaatgcttgaagaggctcgcaggcgggaggataacctaaatgattcatcccagcagctgcaggatagtttaagaaagaaggacgatcggattgaggagctcgaggaagcactcagggagtcagtccagatcactgctgaacgggagatggtactcgcccaagaggaatctgctcgaaccaacgccgaaaagcaagtagaggaactcctgatggccatggaaaaggtgaagcaagaactggagagcatgaaggctaagctctcctccacacaacagagtctggcagagaaagagacccatttgacaaatctgagggctgagcgcagaaaacacctggaggaggttttggagatgaaacaggaggccctacttgcagccattagcgagaaggacgcaaacatcgctctgctggaactatcttcctccaaaaagaagacgcaagaggaggtcgccgctcttaagagagaaaaagatcgactggtgcagcaattgaagcaacagacacagaatcggatgaaactgatggcggacaactacgaagacgaccacttcaagtctagtcactctaatcagaccaatcacaagccctctcctgaccagatcatccagccacttctggaactcgatcagaatcgctcaaaactgaagttgtacattggacacctcacaaccctgtgtcacgacagggatccgcttattctccggggactgactcctcccgcatcatataacctggacgatgatcaggccgcttgggagaatgaactccagaaaatgactagggggcagcttcaggatgagctggagaagggggagcgcgacaacgccgaattgcaggaatttgccaacgcaatcctgcagcaaattgctgaccactgccccgacattctggagcaggttgtcaatgccttggaggaaagcagctag

SEQ ID NO: 29558 - DNA, 1233 bp, Artificial Sequence
  Description of Artificial Sequence: Synthetic coding sequence
atgcagaacatacacggcaaagagatcgacttgctcaggactactgtgaaggttccaggaaagcgtcttcccagagccactcctgctaccgcacctggaacaagtcctcgtgctaatggcttatccgtcgagcgctccaatacacaactcggaggtgggacggctagtggacccgcagaggtgctcagttcttcacctaagctagacccacctcccagtccccactctaaccgcaaaaaacatagacgaaagaaatcaaccggcacccccagacccgacggtccctcttcagcaacagaggaggctgaagagtcatttgagtttgtggtcgtatcgctgaccgggcagacctggcacttcgaagcatccaccgctgaggaaagggagctatgggtgcagtcagtacaagcccaaatactcgcttctcttcagggatgtcggagcgcaaaggacaagaccaggttaggaaatcagaacgctgccttggctgtgcaagccgtacggactgtcaggggcaatagcttttgcattgactgtgatgctcctaacccagattgggctagcctgaatttgggggcactgatgtgcattgagtgttccggcatccatcgccatttgggcgctcacttgagccgggtgcgtagcctggacctcgacgactggcccccagagctgcttgcagtcatgaccgccatgggtaatgctctggcaaatagcgtgtgggagggtgccttggggggatatagcaagccgggtccagatgcctgtcgcgaggaaaaggaaaggtggattagagccaaatatgagcaaaaactgtttctggcccctctgccttccagtgatgtgccactcgggcagcagctgttgagagcagtcgttgaagatgacctgcgcctgctcgttatgctcctggcacacggcagtaaggaagaggtcaatgagacttacggcgatggcgatggacgtacagctctccacctgtcaagcgcaatggccaatgttgtgttcacccagctactgatatggtatggcgtggacgtgagatccagagacgcgcgtggattgactccattggcctacgcccgtcgggctggatcacaggaatgcgcagatattcttatccagcacggatgccctggggaaggatgcggactggcccctaccccaaatagggaaccggctaatggtaccaacccatcggctgagctgcaccgttctccgtctcttctatag

SEQ ID NO: 29559 - DNA, 492 bp, Artificial Sequence
  Description of Artificial Sequence: Synthetic coding sequence
atgtcggacagtcctgccggatccaaccccaggacgcctgagtcatctggatcaggcagtggaggcggagggaagaggcctgccgtgcccgctgccgtttcattgctccccccagccgatcccctgaggcaggccaatcgactcccaatcagggtcctgaagatgttgtccgcccataccggccacctgctgcaccccgagtatctgcaaccattaagcagcacgcctgtgtccccgattgagctggatgcaaaaaaatctccacttgccctcttggctcagacatgctcccagattggctccccagggagcctttccctccgaaatccgcacacactcggcctgagcaggtaccacccttatgggaagagtcacttatcaactgcagggggattggctgtaccatccttacccacagcagggccttattactcaccctacgcactgtacggtcaaaggctcgcatccgcatcggcgctaggctaccagtag

SEQ ID NO: 29560 - DNA, 2736 bp, Artificial Sequence
  Description of Artificial Sequence: Synthetic coding sequence
atgaactttcaagcaggaggcggtcaatctcctcagcagcagcagagcctcgccgctcctggaggcggaggtgcagctgcccagcagctggtttgtgggggacagttcggaggcgctggccctggggctggaggcggaggtgggccttctcagcaactggcagggggacctcctcagcagttcgccctcagtaacagtgccgctatccgagccgaaatccagagatttgaatccgtgcatcctaacatttacgccatctacgacctaattgagcggatcgaagatcttgccctgcagaatcagatcagggagcatgttatcagcatcgaagatagcttcgttaattcgcaagaatggactctctccagaagtgtgcccgagttaaaagttggcatcgtgggaaacctgagctccggtaagtctgcgctggttcaccgctaccttacaggcacatacgtgcaggaagagagccccgaaggcggtcgcttcaaaaaggagattgttgtggacggtcaatcttatttgctgctcatcagagatgaaggtggcccaccagagcttcaattcgctgcatgggtcgacgcagtagtctttgtgttcagccttgaggatgaaatcagcttccagactgtgtacaattactttcttaggctctgttccttcaggaatgcaagcgaggtgcccatggtactggttggcactcaagatgccatatcagccgcaaatcccagagtgatcgatgattccagagctaggaagttaagcacggatctaaaaagatgcacttactatgagacctgtgctacttacggccttaatgtggagcgcgtgttccaggatgtagcccaaaaggtggtggccctacgcaaaaagcaacagttagctattggcccttgcaagtctctgcccaattccccgtcacacagcgccgtgtctgccgcttccatcccggcagtgcatatcaaccaggcaacaaatgggggaggttccgcattcagtgactattcgagctccgtcccctctacaccatccatatctcagcgggaacttcgcattgaaaccattgccgctagtagtacgcccacccccattcgtaagcagagtaagagacgctcaaacatttttacaagtagaaaaggcgctgacctggatagagaaaagaaggctgctgagtgcaaggtagatagcatcggcagcgggagagctattccaataaaacagggcatcctactgaagcgcagtggaaaaagtctgaacaaagaatggaagaaaaaatatgtaacactctgcgataatggtttgctcacctatcacccctccttacacgactatatgcaaaacatccacggtaaggagattgatcttttaaggaccacagtgaaggtgcccggtaagaggttacctcgcgcaacgcccgctacagctccaggcacaagtcccagagctaacggattgtccgtcgaaagatccaacactcagttgggcggaggtacgggagcaccgcacagcgcttcaagtgctagcctgcactccgagcgcccactgtccagtagcgcctgggctgggccacggccagagggccttcaccagaggtcttgctctgtgtcctctgcagatcagtggtcagaggcaacgacctccttgccccctggcatgcaacatcccgcatccggacccgctgaggtcctaagctcctctccaaagcttgacccccctccatctcctcatagcaatagaaagaaacataggcgcaagaagtcaacagggactcctcgacccgatggaccctccagtgcaacagaagaggcggaagagtctttcgaattcgtggtagtgtccctgaccggtcagacgtggcactttgaggcttcgacagccgaagaaagggagctgtgggtccagtccgtgcaagcccaaattctggcctcattgcagggttgtcgcagcgcaaaagataagaccaggctagggaatcagaacgccgctctggcggtgcaggctgtgcgtaccgttcggggaaactctttttgtatcgactgtgacgcaccaaaccccgattgggcttctctgaacctgggagctcttatgtgtattgagtgcagcggaattcaccgccacttgggcgctcatttgagcagggtgcggtctctggacttggacgactggcctcctgagctgcttgcagtgatgactgcaatgggaaacgctctggccaacagtgtttgggagggtgcactagggggttactcaaagcccggaccggatgcctgccgcgaggagaaagagcgatggatccgcgcaaaatacgaacagaagttatttctggctcccctccccagttcggacgtgcctttagggcagcagctgttgcgtgcagtggttgaggacgacttgagactgttggtgatgttgcttgcgcacggtagcaaagaggaggtgaacgagacttacggagacggcgatggccgaactgctctacatttgtcatcagctatggcaaacgtggtgttcactcagctgctgatttggtacggagtggacgtgcgcagccgggatgccaggggcctaacgcccctggcatacgccaggcgcgctggcagccaggaatgcgccgatatcctgatccaacacggctgtcctggcgaggggtgcggactcgcccctacacccaatcgagagccggcaaacggaactaatccttccgccgaactgcaccgcagtccctccttgttgtag

SEQ ID NO: 29561 - DNA, 1059 bp, Artificial Sequence
  Description of Artificial Sequence: Synthetic coding sequence
atggatatcgacaaagatttagaggcacccttgtacctgaccccagagggctggtcactgttccttcagagatactaccaggtggtccacgagggtgccgaattacgccacctcgatacccaggttcagcgatgtgaggatatcctgcagcaactgcaagccgtggtccctcagatcgacatggagggagatcggaacatttggatcgtgaagccgggtgccaagagtcgcggtagaggaatcatgtgcatggaccatctcgaggagatgctgaaattggtgaacgggaatccagtagtgatgaaggatggaaagtgggtagtacaaaagtacattgaaagaccactgctgattttcgggaccaagtttgacctgcgacagtggtttctggtgacggattggaacccgcttaccgtgtggttttatagggattcctacatcaggttttctacccagccttttagcttgaaaaacctggacaactccgtccacctgtgtaataatagtatccaaaagcacctcgaaaacagttgccaccggcatcccttattgcccccagataacatgtggtcctcacagcggttccaggctcacctccaagagatgggtgcccctaacgcctggtcaaccattattgtaccaggtatgaaggatgctgtgatccacgcgcttcaaacttcacaggatacagtgcagtgtagaaaggccagtttcgaactatacggcgcagatttcgtgtttggcgaggacttccagccttggctgatcgaaatcaacgcgtcccccacaatggccccatctactgcggtgacggccaggctttgtgcaggggttcaggcagatacgttgcgtgtcgtgatcgaccgcatgttagacagaaattgtgataccggagctttcgagctgatctacaagcagcccgtgaccacctcacccgctagcacccctcgtccaagctgcctgctgcccatgtatagcgacacaagagcgaggtcttccgatgactcaacagcctcatggtgggcgctccgcccttgtcggccacaagccagaccctag

SEQ ID NO: 29562 - DNA, 507 bp, Artificial Sequence
  Description of Artificial Sequence: Synthetic coding sequence
atgaccgccacgcttaggccctacttgtccgccgtccgcgctacgctgcaggctgcgctatgcctggaaaacttcagcagtcaagtggttgagcgacacaataaacctgaggtggaggtcagatctagcaaggaactgctgctccagcccgtgaccatctctcgaaacgagaaggaaaaagtgctgattgagggatcgataaactccgtgagggtgtccattgcagtgaagcaagcggatgaaatcgagaagattttatgccacaagtttatgcgctttatgatgatgagagcggagaattttttcattctccgcaggaaacccgtcgagggttacgacatatcatttctcatcacaaactttcacaccgagcagatgtataagcacaagctcgtcgacttcgttattcacttcatggaggaaattgacaaggaaatctcagaaatgaaacttagcgtcaatgcacgagccagaattgtggccgaagagtttctaaagaatttctag

SEQ ID NO: 29563 - DNA, 993 bp, Artificial Sequence
  Description of Artificial Sequence: Synthetic coding sequence
atggagcgctttatggagcaggtcgtgtttaaatacctgagagccgagccggaggaccactactttctaatgacagagccccctttgaacactcccgaaaaccgcgagtacctggcagaaataatgttcgagtcatttaatgtcccaggtctctacatcgcagtccaggccgtcctcgcactggctgccagctggacctctagacaagtcggagagcgcaccttgacagggattgtgatagactctggggacggagtcacccacgtcatcccggtagccgagggatacgtgataggttcttgtatcaagcatatacctatcgctggccgtgacatcacgtacttcattcagcagctattgagggagcgcgaggtcggaataccccctgaacagtccttggaaactgcaaaagcaataaaggagaagtactgctacatttgtccagatatagtgaaggagtttgctaagtatgacgtcgacccgaggaaatggattaaacagtacaccggcatcaacgccatcaaccaaaagaagttcgtaatcgacgtaggttacgagcggtttctgggacccgagattttctttcaccccgaattcgctaatcccgatttcatggagtcaattagcgacgtggtcgatgaagtgatacagaattgtcccattgatgttaggcgccctttgtacaagaatgtggtgctgtcaggcggttcaaccatgttccgcgattttggccgtcgcctccagcgtgatctgaagagagtcgtggatgcgaggctgcgtctgtcggaggagttgtctgggggacgcattaagcctaaaccagtggaggtgcaagtggttacccatcacatgcaacgttacgccgtctggtttggagggagtatgctggcctccaccccggaattctttcaggtctgtcacacaaaaaaggattacgaagaatatggcccatctatttgtcgacacaatccagtattcggcgtgatgagctag

SEQ ID NO: 29564 - DNA, 894 bp, Artificial Sequence
  Description of Artificial Sequence: Synthetic coding sequence
atgaagactctatcccctgacaggatacagcctcacatcatgaccgatgtccctgctacattcacccaggctgagtgtaacggcgataaaccaccagagaatggccagcagactattacaaaaatttcagaggaactgaccgatgtggactccccgctgccacactatcgggtcgaaccgagcctggaaggtgcgctcaccaaaggctcccaggaggagcggcgaaagctgcaagggaatatgcttctcaactccagcatggaggacaagatgttgaaggagaatcctgaagaaaagctattcattgtgcataaggcaatcactgatctcagcctgcaggagacctcagccgacgaaatgacctttcgtgagggccaccagtgggagaagatcccgctcagtggatcaaatcaggaaatacggcgtcagaaagagagaatcacagagcagcctctgaaagaggaggaggatgaggatcgcaaaaataagggccatcaagcagcagaaatcgaatggcttgggttccgcaaaccaagccaagccgacatgcttcactctaagcatgatgaggagcagaaggtctgggacgaggaaattgatgacgatgacgatgataattgtaataacgatgaggatgaagtgagagtcatagagttcaaaaagaagcacgaagaagtgtctcagttcaaagaagagggcgacgcctcagaggactcaccactctcttccgcatcttctcaggcggtgacgccggacgaacagccgaccctgggcaaaaagagcgacatctcccggaatgcatactcaaggtacaacactatttcgtaccgtaaaatcagaaagggaaacacaaaacagcgcattgatgaattcgaaagcatgatgcacctgtag

SEQ ID NO: 29565 - DNA, 1074 bp, Artificial Sequence
  Description of Artificial Sequence: Synthetic coding sequence
atggtacagccgtttacaactattccctttcccccaccaccacaaaatggcattcccaccgaatatggggttccacacacgcaggattacgccggtcagaccggtgaacataacctgactctgtacggttctacgcaggcccacggtgaacagagtagcaactcaccgagtactcaaaacggctccttgacccagactgaagggggagcacagacagatggccaacaaagtcaaactcagtccagcgaaaatagcgaaagcaagagcaccccaaagcgcttgcacgtttcaaacatcccttttagatttcgtgaccctgatctccgacagatgtttggtcagttcgggaaaatactcgatgtggagatcatttttaacgagagaggctccaagggcttcggatttgttacgtttgaaaattcagccgatgctgaccgcgctagagagaagctccacggaacagtggtggagggtcgtaaaatcgaggtgaacaatgctactgcgagggtaatgaccaacaaaaagatggtaaccccctacgccaacggctggaagctctcccctgtcgtgggtgccgtgtacggccctgagctttacgctgcaagcagctttcaggccgatgtgtccctcggcaatgatgcagccgtgccactctcaggcagagggggaatcaacacatacatcccactgatcattccgggatttccttatccaaccgcagctactaccgccgcagcgtttaggggggcacacctgcgagggcgagggagaaccgtgtacggagccgttcgagccgtcccaccaacagctatcccagcctaccccggagtagtatatcaagacggattctatggggcagatctatacgggggttacgccgcttaccggtatgcgcagcccgcaacagcgaccgccgcaaccgcggcagctgctgccgcagcggcatactccgacggctatggtcgcgtgtatactgccgacccatatcacgccctcgcgccagcagcgagctacggcgtgggggctgttgcatctttataccggggaggttattcaaggttcgctccatattag

SEQ ID NO: 29566 - DNA, 387 bp, Artificial Sequence
  Description of Artificial Sequence: Synthetic coding sequence
atggtgcagccattcaccactattccgttccccccaccgcctcagaacggaattccaacagagtatggagtgcctcacacccaggattatgcgggtcagacaggagaacacaatctgacgctgtacggctcgacccaggcacatggcgaacagagctcaaactctcccagtacccagaatggctcactcactacagaggggggtgcccagacagatggacagcaatcccagactcagagtagcgaaaatagcgagtctaaatcaacgccgaaacggctccacgtgagcaacataccctttaggttccgagatccagatctgaggcaaatgttcggctttggaaaaatcctggacgtggaaattatctttaacgagcgaggatcttag

SEQ ID NO: 29567 - DNA, 1071 bp, Artificial Sequence
  Description of Artificial Sequence: Synthetic coding sequence
atgcagggcattttgctactcgttttcgcgaagtatcagcacctgccctacattcagatattgagtacaaagagtactcctaccggcttgtttggctactggggcaataaagggggtgtgaatatttgtcttaaactatacggttactatgtgtctattattaactgtcatctgcccccacatatttccaacaactaccagaggctcgaacactttgaccggattttagagatgcagaattgtgaaggtagggatattcccaatatattggaccatgatctgattatctggtttggggacatgaacttcaggatcgaagacttcggtctgcattttgtgcgggagtctatcaagaatcgttgctacgggggactatgggaaaaggaccaattgtccattgcaaaaaaacatgaccccttgctccgggagttccaggagggcaggttgctctttcccccaacttataagtttgacagaaacagcaatgactacgacacgtcagaaaagaaaagaaagcccgcatggactgataggattctgtggagacttaagcggcagccctgcgcgggtcccgatactcctattcccccagcttcacacttttccctgtctctccgcggatactctagtcacatgacctacggtatcagcgaccacaagccagtatccggaaccttcgatctcgaacttaaacctcttgtttccgcccctttgattgtgctgatgccagaagacctctggactgttgagaacgatatgatggtctcctattcctcgacttcagattttcccagcagtccctgggattggatcggactttacaaggtgggactgagagatgtcaatgattacgtaagctatgcatgggtgggtgattctaaagttagttgtagcgataatcttaatcaggtgtacatcgacatctccaatatcccaaccacggaagatgagtttcttctgtgctactactccaattcccttcgcagtgtcgtgggtataagtcggcctttccagatccctccaggcagcctgagggaggaccctcttggagaagcccagccacagatatag

SEQ ID NO: 29568 - DNA, 1752 bp, Artificial Sequence
  Description of Artificial Sequence: Synthetic coding sequence
atgctctctgagtccaaagaaggcgaagagaaggaggaggtaacaatggacacatctgagaatagaccggagaacgacgtccccgagccacctatgcccatcgcagaccaggtatctaatgacgatagaccagagggtagtgtagaagatgaggaaaagaaggaaagttctcttcctaagtccttcaagagaaaaatatcagtcgtaagcgcaacgaagggggtgcccgcaggaaactccgacaccgagggcggacagcccggtagaaagagaagatggggcgcatcaactgcgactacacagaaaaagccatccatatctattaccactgagtcactgaagagcctaattcctgacattaagccattggcaggccaggaggccgtggtggacctccacgccgatgactcaagaatttcagaggatgagactgagagaaatggtgacgatgggacacatgacaaggggctgaaaatctgtcgtacagtgacacaggtggtgccagccgagggccaggaaaatgggcagcgtgaggaggaggaagaagaaaaggaacctgaggcagaacccccagtgccccctcaggtgtcagtggaggtggcactgcctcccccagccgaacatgaagttaaaaaggtcacattaggagacaccctgactcgcaggagcatttcccagcaaaagagcggtgtgtcaataactattgacgaccccgttcgtactgcccaggtcccttccccaccgcgtggaaaaatcagcaatatcgttcacattagcaatcttgtcaggccatttactctcggccagctcaaagagctgctgggtagaactggaactcttgttgaagaagccttctggatcgacaagataaagtcacactgcttcgtgacctatagcaccgtcgaggaagcggtagccaccaggacagctctgcatggcgtaaaatggcctcagagcaacccaaaatttttatgcgcagattacgccgagcaggatgaactggattatcatcggggtctcctggtggacagaccgtccgagacaaaaacggaggagcagggaatccctcggcctctgcacccacctccccctcctcctgtgcagccaccgcaacaccctcgggcagagcagcgcgagcaggagagagccgtgcgcgagcagtgggctgagcgtgagcgagaaatggagcgcagagaacggaccaggagcgagagagaatgggatcgggacaaagttagggagggaccaaggagccgttcccgctcacgagaccgacgtaggaaagaacgcgcaaagagtaaggagaagaagagcgagaagaaagagaaagcacaggaggaaccgcctgcaaaactacttgacgatttgttccgcaagaccaaggccgctccttgcatatactggttgccactgaccgatagccagattgtccagaaagaggcggagcgagccgagagagcaaaggagcgcgagaaaagaagaaaggagcaggaggaagaggaacagaaggaacgcgaaaaagaagcagagcgcgaacggaacaggcagctggagagggagaaacggcgtgaacattccagggaacgggatagggagcgtgagcgcgaacgggaacgtgatcgcggagacagagatagggatcgcgagcgcgatagggaacgtggccgagaaagggatagacgcgatacgaaaaggcattctcggtcccggagcagatcgactccagtgagggatagaggcggaagacgttag

SEQ ID NO: 29569 - DNA, 1329 bp, Artificial Sequence
  Description of Artificial Sequence: Synthetic coding sequence
atggcaaatagcttcgctgcccgtatcttcacaacactaagcgatctccagactaatatggcgaatctgaaggttataggcatcgtgatcggcaagactgacgtgaaggggttcccggaccgcaaaaatattggttccgagcgatatacattctctttcacgatcagggattctcccgctcacttcgtaaacgccgcttcatgggggaacgaggattacattaaatccttaagcgatagttttcgcgtgggagattgcgtcattatcgagaacccactcatacaacgcaaggaaattgagagggaagagaagtttagccccgctactcccagtaattgcaaattactgctcagcgagaatcacagcactgtgaaagtctgctcttcctatgaggtggatacaaagttgctgagcctgattcatctgccagttaaggaaagccacgattattatagcttgggggatatcgtggctaacggacacagcttaaacggcaggattataaacgtgcttgccgcagtgaagagtgttggtgaaccgaagtactttacaaccagcgacagaaggaaaggacagcgctgtgaggtccggctttacgatgagaccgagtcatccttcgctatgacctgttgggataacgaaagcatcctcctcgctcagagctggatgcctcgtgaaactgttatcttcgcttccgacgtgcgaattaacttcgataagttcagaaattgcatgacagccaccgttatttcaaagaccattatcacaaccaatcctgatattcctgaagccaatattctgttaaattttatccgcgagaataaagagacaaatgttcttgatgacgagatcgattcctactttaaagagagtataaacctgtccacgattgtggatgtctacacagtggaacaattgaaaggcaaagccttaaaaaacgaggggaaagctgatccaagctatggtatcctttacgcttacatatctaccctcaatatagatgatgagacaacgaaggtggtgagaaataggtgttcttcatgtggctacatcgtgaacgaggcttccaacatgtgcactacgtgtaataaaaactccctcgatttcaaatcagtgttcctaagctttcatgtgttaatcgacctcacggaccatacagggacactgcactcatgttcacttactggcagtgtggccgaagaaaccctgggttgtacattcgtcctaagccatagagcccgtagtggacttaagatcagtgtcctgtcttgcaaactggccgatcctacagaagcctcccggaacctaagcggtcagaagcacgtttag

SEQ ID NO: 29570 - DNA, 627 bp, Artificial Sequence
  Description of Artificial Sequence: Synthetic coding sequence
atggcaggaactgcccgtcacgatcgggagatggctattcaggccaaaaaaaaacttactaccgctacggacccaatcgagcgcctgcgccttcagtgtctggccaggggctccgctggaatcaagggccttggacgcgtatttaggatcatggatgacgacaacaatcgcaccctagacttcaaggagttcatgaaagggttgaacgattacgctgtggttatggagaaggaagaggtggaggaactattccggcgattcgacaaagacggaaatggaacgatagactttaacgagtttctgctcacactacgacctcctatgagtcgagccaggaaagaggttataatgcaggccttcaggaaactggataaaacaggagatggcgtgattacaattgaagatctccgcgaggtatataacgctaaacaccatccaaaatatcagaacggagaatggtctgaggagcaagtgttccgcaaattcttagataactttgatagtccctatgataaggacggcctggtgacacctgaagaattcatgaattattatgctggggtgagtgcttccatcgacaccgacgtgtactttatcatcatgatgcgcaccgcttggaagttgtag

SEQ ID NO: 29571 - DNA, 627 bp, Artificial Sequence
  Description of Artificial Sequence: Synthetic coding sequence
atggccggaaccgccagacatgatagagagatggccattcaagctaaaaagaagctgactactgcaactgatcctatcgaacgtcttcgcctgcagtgtttagcacgaggtagtgctggtattaagggattaggcagggttttcaggatcatggatgatgataataaccggactctggacttcaaggaatttatgaagggtctgaacgactatgccgtcgtcatggaaaaggaagaagtggaggagttgtttaggcgattcgacaaagatggcaatgggaccattgattttaatgagttcctgctcacgctgcgccctccaatgagccgggctcgaaaggaggtgataatgcaggcctttcgaaaactggacaaaaccggagatggagtgatcactatcgaggacctgcgtgaagtgtataatgccaagcaccaccccaaataccagaacggggagtggtccgaggaacaagtcttccggaaatttctcgacaactttgactcaccgtatgataaggatggattggtgactcccgaggagttcatgaattactacgccggagtgtctgcctcaatcgataccgacgtttacttcattatcatgatgagaactgcctggaagctgtag

SEQ ID NO: 29572 - DNA, 789 bp, Artificial Sequence
  Description of Artificial Sequence: Synthetic coding sequence
catagctactctgaaggcttgggccatccgagagtgtcacaggcgctggtcaccttccaccagcagaagccaattgaaccgaggcgcgagctcctaactcagccgtgtagacagaaggacccagccaacgtggattatgaggacttgtttctctattctaatgcagtggcagaggaagctgcctgtcctgtgtctgctcccgaagaagcgtcaccgaaaccagtcctctgccaccagagtaaagaacgcaagccctctgctgaaatgaatcgaattacaacaaaggaggcaacctcctcttgccccccaaaatcacctctcggcgagactcgacaaaagttatggagatcactcaaaatgctgccggagaggggacagagggtgagacagcagaaaagccacctggctactgtgaatctgagcagcttgctggatgtccggaggagcaccgtgatttctgggccaggcaccgggaaggggtcacaggatcactccggggatcctacatcgggggatagggggtatacagatccgtgcgtcgctaccagcctgaaatccccaagccaaccgcaggccccaaaagaccgcaaggtcccaacccgaaaggcagagcgatctgtgtcttgcatcgaagtgacgcccggagatcgctcttggcaccagatggtagtcagagccctgagtagccaagagtccaagccggagcatcaagggttagctgaacccgagaacgaccagctgccggaagaataccagcagcccccacccttcgcacctggttactgctag

SEQ ID NO: 29573 - DNA, 1941 bp, Artificial Sequence
  Description of Artificial Sequence: Synthetic coding sequence
atgtcctatacggggttcgtgcagggctcggagacaacattgcagtccacctattctgacacttccgcacaacccacttgcgattacgggtacggcacgtggaactctggcactaaccgaggatacgaggggtatggctatggttacggatatgggcaggacaatacaaccaactatgggtatggcatggccacaagtcacagctgggaaatgccgagtagtgatactaatgccaacacaagcgcatcaggaagcgcctccgccgacagcgtgctgagtcgtatcaaccagagactggacatggtgcctcacctggaaactgacatgatgcagggcggtgtttatggaagcggaggagaaaggtacgactcttacgagtcttgtgacagccgcgcagtattaagcgaacgagatctgtaccggtcaggatatgactatagtgagctggaccccgaaatggaaatggcctacgaggggcagtacgacgcctacagggatcaattccggatgcggggaaacgacacattcgggcctcgtgcccaaggttgggccagggacgcgagaagcggcaggcccatggcttccggatacggccgtatgtgggaggaccctatgggcgctaggggacagtgcatgtccggcgctagcagactgccgtcccttttctcccaaaatatcatccctgagtatggtatgttccaggggatgcgcggtggcggtgccttccccggtggcagtcgtttcggcttcggattcggtaatggcatgaagcaaatgaggcggacttggaaaacctggaccaccgctgatttccgcactaaaaaaaagaaaaggaaacagggcggatctcccgatgagccagattctaaagccacccgcaccgactgttccgataatagtgatagcgacaatgatgagggtaccgagggagaggccactgagggtctggaaggcactgaggctgttgagaaaggtagtagagtcgacggtgaggacgaagaaggtaaagaggacggccgagaagaggggaaagaagacccagagaagggcgctctgacaactcaagatgaaaacggtcagactaagaggaagctgcaggccggaaaaaagagccaggacaaacagaagaaacgccagagggaccgcatggtggagcgcattcagttcgtgtgcagcctttgtaagtaccgtacattttacgaggatgagatggccagccacctggattccaagttccacaaggagcattttaagtatgtaggcaccaagctgccaaagcagactgccgacttcctgcaggagtacgtgaccaataaaaccaagaagacagaggaactgagaaaaacggtcgaggatctcgacggattgatacatcaaatctaccgagaccaggaccttacgcaggagatcgctatggagcatttcgttaagaaggtggaggcagcccactgcgcagcctgtgatctgttcatccccatgcaatttgggattatccaaaaacatttgaagactatggaccacaaccggaatagaagactgatgatggagcagtccaaaaagtcctccctgatggttgcccgaagcattctaaataataagctgattagcaagaaactggagcgctatctaaagggcgaaaatccttttacagattcccctgaggaagaaaaggagcaggaagaggcagagggcggagccctggacgagggcgcacagggcgaggcagcaggtatctcagagggggcagaaggcgtaccagcccagccgcctgtgcctcccgagccagctcccggtgcggtgagtccccctcccccaccaccacccgaggaagaagaggagggggctgtgcccctactcggcggagccctgcagagacagatcaggggaatccctggtcttgatgtcgaagatgacgaggaggggggtgggggagctccctag

SEQ ID NO: 29574 - DNA, 1401 bp, Artificial Sequence
  Description of Artificial Sequence: Synthetic coding sequence
atgcgaggacctaacagcggtaccgaaaagggaagacttgtaattccagaaaagcaggggttcgactttctttgtatgccagtgttccaccctagatttaagcgggaatttatccaggagccagccaagaaccgcccaggtccacagactcgatctgacctgttgctgagcggcagggactggaatacgctgatagtcggcaagctgtcgccttggattaggcccgactccaaggttgagaaaataagacggaattctgaagccctggaggttcagtttattatcacgggaaccaatcatcactccgagaaggagttttgctcctacctgcaatatctggagtacttaagtcagaaccggcctccacccaacgcttacgagttgttcgccaaagggtacgaagattatttacaatcccctttgcagcccctgatggataacctcgaatcgcagacttacgaggtgttcgagaaagatccaattaagtactcacagtaccaacaggcaatctacaaatgcttgcttgacagagttcccgaggaggagaaggatactaatgtccaggtgctgatggtgctcggcgcaggccgtggccctctcgtcaatgcctcactacgagcagcaaagcaagctgaccggaggattaaattgtatgccgtggagaagaaccccaatgccgttgtaaccctcgagaactggcaatttgaggagtggggtagtcaggttacggtggtcagctctgatatgagagaatgggtggctccggagaaggcggacattatcgtgagtgagctgctcgggagcttcgctgacaacgagctctcccccgagtgtctggacggggcacaacactttctcaaagacgatggagtcagcatccccggagaatacaccagctttctggcccctatctcatcaagcaagctctataatgaagtgcgcgcatgtagggaaaaagaccgagaccctgaggcacagtttgagatgccctacgtggtgcgacttcataatttccaccaactcagcgcccctcaaccttgttttacattctcacacccaaatcgggatccaatgatagataacaataggtattgtactctggagttccccgtggaggtgaacaccgtacttcatggattcgccggttactttgagaccgtcctgtatcaagatatcacactgagcatacgcccagagactcactcccccggaatgttttcatggtttcccatactttttccaatcaagcagccaatcacagtgagagagggacaaacaatctgtgtgcgattttggagatgcagtaatagcaaaaaagtctggtatgaatgggcagtgactgccccagtctgtagtgcgattcacaacccaacaggccgatcatataccatcgggctctag

SEQ ID NO: 29575 - DNA, 1863 bp, Artificial Sequence
  Description of Artificial Sequence: Synthetic coding sequence
atgcgtggccctaactcaggaacagaaaagggccgactggtgatccccgaaaaacaaggattcgatttcctgtgtatgcccgtgttccacccacgattcaagagagaattcattcaggaacctgctaaaaaccgacctggacctcaaacccgcagtgacttgttgctaagtgggagagactggaatactctgattgttggtaagcttagcccatggatcagacctgatagtaaggtggaaaagatcaggcgtaattccgaggccgcaatgctccaagagctgaactttggggcttacctgggattacccgcattcttgctgcccctcaaccaggaggataatacgaatttagccagagtcctgacgaaccatatccatacaggacaccattctagtatgttctggatgcgcgtgccacttgtggctccggaagacctcagggacgatattattgaaaacgccccaacaactcacactgaggagtattcaggagaagagaaaacgtggatgtggtggcacaactttcggacgctgtgcgactatagtaaacgcattgctgtggccctcgaaattggtgccgatttgccgtccaatcatgttattgatagatggttgggggagcctatcaaagctgcgattttgcctacttccatcttcctgaccaataaaaaggggttccctgttttatctaagatgcatcagaggttaatctttcgtttacttaagctcgaagtacaattcataatcaccgggacaaaccatcattccgaaaaggaattctgcagttacctccagtacctcgagtatctgtctcagaatcgccctcctcccaacgcttacgagctgtttgccaagggctacgaggactacctccaaagtcctctgcagcctctcatggataacctcgaatcacagacttacgaagtatttgaaaaggaccccatcaagtattctcaatatcagcaggcaatttacaagtgtctcctcgatcgagttcctgaggaagaaaaagacaccaacgttcaagtgctgatggtacttggggctggaagaggacctctggtgaatgcatctctgagagcagccaaacaggcggaccgccgaatcaagctatatgccgtcgagaaaaaccctaacgcagtggtgacgctggagaactggcagtttgaggagtggggttcccaggtgactgttgtgtcctctgatatgcgggaatgggtggcccctgagaaagctgatattatcgtcagcgagctgctcggttcatttgcggataacgaactctctcctgaatgcctggacggggcacaacacttcctgaaggacgacggagtctcaatacccggtgagtacacttccttcttggctcccatcagcagcagtaagctctacaacgaggtacgagcctgtcgcgagaaggacagggaccccgaggcccagtttgaaatgccctacgtcgtccggctacataacttccatcagttatctgccccacaaccctgcttcacgttctcccaccctaacagagacccaatgatcgacaataatagatactgcactctggaatttcccgtggaggtgaacactgtgttacacgggttcgcaggctactttgagacagtcctctatcaggacataacactttcaatacgtcctgagacccactcacctggtatgttctcgtggttcccgattctgttccctataaagcaaccgataacggtgagagagggccaaaccatctgtgtgagattctggagatgctccaattcgaaaaaagtctggtatgagtgggccgtaaccgccccagtgtgcagcgcaattcataaccctacaggaaggtcatacacgatagggctctag

SEQ ID NO: 29576 - DNA, 2271 bp, Artificial Sequence
  Description of Artificial Sequence: Synthetic coding sequence
atgcccagcgtgtccaaggcagccgcagccgctctgagcggctccccgccacagaccgagaaacctacacactaccgctatttgaaagagttcaggaccgaacaatgccctttatttagccaacacaagtgcgcacaacatcggccttttacctgctttcattggcacttccttaaccagcgacggagaaggccgctgaggcgacgggacggtaccttcaattatagtcctgatgtctactgttcgaaatacaacgaggccacaggcgtatgtccagatggagatgagagcctactcggagtgctgtaccctctttgggctccacctcctgttccagctcctgtcggggctccgaccgttcaccccttcttggctagatggttttcccatgtcccctgggagccagccggatctgcagatcctagggcatcctcaactcctgctggagggacgacctgggctacaggcctactgggtgacttcgatgcttgtggttcccagagccgagaatgcgttaagggcgtgtggtggacactgctcggatttcgatgtccctacttacacagaaccacaggtgatacggagagaaagtaccaccttcggtactataaaaccggcacctgcatccacgagaccgacgcacgtggccattgcgtgaagaacggactgcattgtgccttcgcgcacgggcctttggatttgaggcccccagtctgcgacgtcagagagctccaagcacaagaagccctccagaacggtcagctaggtggcggtgaaggtgtgcccgaccttcagccaggagtcctggcgtcccaggcaatgatcgagaagattctttctgaggatcctcgctggcaagcccttctgcccgtcgcgctcctacgccacagagtggcacactttagcgatgcgaattttgttttaggatcgtacaaaactgagcagtgtccgaagccccctcgcctgtgtagacagggctatgcgtgcccgcactaccacaatagccgtgaccggagaagaaacccaaggcggttccagtatagatcaacaccttgtcctagcgtgaaacatggcgatgagtggggcgagccaagtagatgtgacgggggtgacggttgtcagtattgtcactcgaggactgagcagcagttccaccctgaagggcctgtgggctccccagtgagcggcgctttctctgtatttagtcacgctggcctagttgccgacccctctctttggtacccggcagaatggtcctggcaccacgtgggccactcacggaccatcaacccggagggtgacaaaccttctcgcctagggcctgcacccgaaaatattaagcggggtaacgatttcgcttgtgatgggagagcagacgccgcaggaatggccccacatgtgtgtgtattccctatatataaatcaacgaagtgtaacgacatgaggcagacggggtactgtccccgtggaccattctgtgcttttgctcatgtggaaaagtctctcggtatggtaaatgaatggggctgtcatgacctgcaccttacctctccgtcctcaacggggtctggccagccgggaaacgcaaaacgaagggactcaccagcagagggaggccctagagggtcggagcaggattccaaacagggtgtcagggctcatggagtctatgtattcgagcagaaccacctggcggtctttgccgctgtgcatcctcccgctccctccgtgagcagctcggttgcctctagcctggccagttctgctggatccggtagtagctcgcctacagccctgccggcaccaccggctagagccctgcctctgggacctgcttctagtaccgttgaggccgttttggcgttagagcccacaccatcctctcctacctcttccgccgtccagggggttgccggagagctgggtatgggaagcggcggacaggggtgctggtcacatgttgttggagcattggcggcagtgccggcatggacgcatagcggggatctcgagtgggacccaagtaccatacggaccagagtgaacgtcggtggcggtcccgcagcacgaccagctatgactcttgcgagagaaccacagttattggtcgtgggtggctgccccacaaggaattgcagcggacctgcagcctcaccacagcagctcttggatgacgccggtcagggtgggagaggtgaacgcgatagtagtcagagacctctgcggcctcagaccactcatcgacaggatacacgacctgtgccctcatag

SEQ ID NO: 29577 - DNA, 549 bp, Artificial Sequence
  Description of Artificial Sequence: Synthetic coding sequence
atgacgccccctcaacagccccctccactgaggtctgagcctggcaccctcggttccgctgcctcatcctatagccctcttggtttaaatggggtacctggcagtatttgggattttgtgtcagggtctttctctcccagccctagtcctatcttgtctgccggacctcccagctcatcaagcgctagccccaatggcgcagaactggcaagggtgagacgccagctggacgaggctaaacggaagattcggcagtgggaggaatcctggcagcaggtcaagcaggtctgcgatgcttggcagagagaggcccaggaagccaaggaaagggccagggttgccgatagtgaccgacagcttgccctgcagaagaaggaggaggtcgaggcacaagtcatattccagctgcgcgcaaagcagtgcgtcgcctgtcgggagagggcccatggagccgtgttgaggccctgtcagcatcacatcctctgcgaaccatgtgccgcaaccgctcctgagtgtccctactgcaaaggacaaccgttacagtggtag

SEQ ID NO: 29578 - DNA, 444 bp, Artificial Sequence
  Description of Artificial Sequence: Synthetic coding sequence
atggaaggagagcccccaccagtcgaggagcgccgaagactgcaagaggaattaaacgagttcgtcgagtctggctgccgcacgctggaggaggtaacagcatcgctaggatgggatttggactcactcgatcccggagaagaagaagctgcagaggatgaagtggtcatttgcccatacgactcaaaccatcacatgccgaaatccagcctggctaagcatatggcaagctgccgcttgagaaagatgggttacactaaggaagaggaagacgagatgtataatcctgaatttttttatgagaacgttaagatccctagcattacattgaataaggacagccagttccagattatcaagcaggccaggaccgccgttggcaaagacagcgattgctacaatcagattatcggggtttcaataaagcgcaactacaaaatttag

SEQ ID NO: 29579 - DNA, 522 bp, Artificial Sequence
  Description of Artificial Sequence: Synthetic coding sequence
atgggcactttcgatctatggaccgactaccttgggctggcccacctcgttcgggctctcagtggaaaagaagggcctgaaacccgattgagtcctcagccagagccagaacccatgctggaaccggaccagaagaggagtctggaatcaagtcctgccccagagagactctgcagtttctgcaaacacaatggagagtcccgcgctatctaccagagccacgtgctgaaagatgaagccggacgagttctttgccccatcctccgagattatgtgtgtccacagtgcggcgctaccagggaacgcgctcacacaaggcgtttttgccccctgacaggtcagggatacacatctgtttacagtcatacaacaaggaactctgcaggcaaaaagctggtaagaccagataaggcgaagacgcaagataccggccaccgcagggggggtgggggaggggctgggttcaggggcgctggcaagtcagagccgagcccatcatgttcgccaagcatgtcgacttag

SEQ ID NO: 29580 - DNA, 1722 bp, Artificial Sequence
  Description of Artificial Sequence: Synthetic coding sequence
atgtctgctttctgcctgggcctggtgggaagagcatctgcgcctgctgaaccagattctgcttgctgcatggaactgcccgctgccgctggagacgccgtgcgtagcccagccgctgccgcagccctgatattcccgggaggctcaggggagctggagttggcactagaagaggagcttgcgcttctcgccgctggtgagaggccttcagacccgggtgagcatccccaggcagaacctgggtcactggctgaaggcgcagggccacagccacccccatcccaagatcccgaactactgtctgtcatccgtcaaaaagagaaggatcttgtgctggcggctaggctgggcaaggctctgcttgagcggaaccaggatatgtccaggcagtacgagcagatgcataaagaactgacagacaagctcgagcatctggaacaggaaaaacacgagctgcgcagacggtttgaaaatcgcgagggggagtgggagggccgtgtttcagaattggaatccgatgtaaagcagctccaggatgagctggagcgccagcagattcatctgcgtgaggccgatagggaaaaatccagggctgtgcaggagttatctgagcagaatcagaggttgctggaccagttgtctcgggcaagcgaagtagagcgccagttatccatgcaggttcatgccctccgagaagacttccgggaaaaaaactcgtctaccaaccagcatattattcggttggagagcctccaggctgaaattaaaatgctgagcgacaggaagcgagaactcgaacatcggttatcagcaaccctagaagaaaatgacctgctgcaggggacagtcgaggaattgcaagaccgcgtgctgatactagaaaggcagggccatgataaggatctacagctgcatcagagccagctcgaattgcaagaagttagactatcctgtaggcagctgcaggtgaaagtcgaagaattgactgaagagagatctctgcaaagcagcgcggcaactagtaccagcctactgtccgagatcgagcagagcatggaagctgaggaactcgaacaggaacgggaacagcttcgccttcagctctgggaggcttactgtcaagtaagatatttgtgtagtcatttacgtgggaacgattcagccgacagtgcagtgtctaccgatagcagcatggacgagagttctgagacatccagcgctaaagacgtgcctgccggttcactcagaaccgccctgaacgaattgaaacgcctgatccagagcattgtggatggcatggagcccactgtgactctgttgtcagtcgaaatgactgcactcaaagaggagagagatagattaagagtcacctccgaggacaaggagcccaaagaacagctgcagaaggccatcagagatagagatgaggccatagctaaaaagaacgctgttgagctggagctcgcgaaatgtaggatggacatgatgtctcttaattctcagctgctagacgccatccaacagaagctcaacttgtcccagcaacttgaggcctggcaggacgacatgcatagagtgattgaccgccaactcatggacacacacctgaaagaaaggtcccagccagcggctgccctctgccgaggtcactcggccggtagaggcgacgagccgagcatagccgagggcaaaaggcttttctccttttttaggaaaatctag

SEQ ID NO: 29581 - DNA, 1086 bp, Artificial Sequence
  Description of Artificial Sequence: Synthetic coding sequence
atggccttgaacgttgcccctgtcagagacacaaagtggttgactctggaggtttgccggcagttccagcgcggtacttgtagtcggtccgatgaagagtgtaagttcgcacatccacctaaaagctgtcaggtagagaacggaagagtaattgcctgctttgacagtctaaagggcagatgcagtagagaaaattgtaagtacctgcatccgcctacccatctcaagacacaattagagatcaatggccgaaacaatctgatccagcagaaaacagccgctgccatgctggcacaacagatgcagtttatgtttcctgggactcccctccatcccgtgccgactttccctgttggaccagctatcggtaccaacaccgcaatctctttcgctccctacctagcacccgtgaccccaggagtcggactggttcctacggagattcttccgacaacacctgttatcgttccaggtagtcccccagttacagtgcccggaagtactgcgacccagaagcttttgcgtactgacaaactggaagtgtgtagagaatttcagcgcggaaactgtgccaggggggagaccgattgtaggttcgcccatccagccgatagtacaatgattgacacctcagataacaccgtcaccgtgtgcatggattatatcaaaggaagatgcatgcgtgagaagtgcaaatactttcatccgcctgcccaccttcaggctaagatcaaggccgcacagcaccaggccaatcaggctgcagtggccgcacaggcggcagcggctgcggctacagtgatggcattccccccaggagcccttcatccattgccaaaaagacaggccttagaaaagagtaacggcacctccgccgtgtttaatccctctgtcctccactaccaacaggctttgacttcagctcaactgcagcaacacgccgcatttattcctaccgataactctgagatcatctctcgcaacggaatggaatgtcaggagagtgctctgcggattacaaagcattgttactgtacttattatccagtgagtagtagcattgaactgcctcagacggcatgttag

SEQ ID NO: 29582 - DNA, 3099 bp, Artificial Sequence
  Description of Artificial Sequence: Synthetic coding sequence
atggccttcactaactatagctccctcaatcgggcacaactcactttcgagtacctgcacacaaacagtacaacacatgagttcctgttcggggcactggccgaactagtggataatgctcgggacgctgacgctactcgtatcgacatctacgcggagagacgtgaagatctgagaggaggctttatgctctgcttcctggatgacggagctggtatggacccctccgacgcagcctcagttatccagtttggaaagtctgccaagcgcaccccggaaagtacacaaattggccagtatggtaatgggcttaaatccggctcaatgcgcattggcaaggactttatcctctttaccaaaaaagaggataccatgacctgtctctttctgtccagaacattccatgaagaggaaggaatcgatgaggtgattgtgcccttgccgacttggaatgccaggacacgcgagcccgtgactgacaacgttgagaagttcgccatcgagaccgaactcatctataaatatagcccattccggacggaggaagaggtgatgacgcagttcatgaaaattccaggcgacagcggcacgttggtgataattttcaacctgaagctgatggataacggcgagcccgaattagacattatctccaatccacgtgacattcagatggcagagacctcccctgaagggacaaagcctgagcgacgctcatttagagcctatgcagccgtcctatacatagatcctcgcatgcgaatcttcattcatgggcacaaggtacagaccaaaagactatcatgctgtttgtataagcctaggatgtataagtatacctcttctagattcaagactcgcgcagaacaggaagtcaagaaggcagaacatgtggcccgaatagccgaagaaaaggccagagaagccgaatctaaggcacgaaccttagaggttcggttaggcggtgatttgactcgggattctcgcgtgatgctccgccaggtgcaaaacagggcaattactctgcgaagagaggcagatgtgaagaagaggatcaaggaagctaagcagcgagccctgaaggaaccaaaggaactgaactttgttttcggggtgaacattgaacacagagaccttgacggaatgttcatctataattgctcccgcttgattaaaatgtatgagaaagtgggcccacagctggaaggcggtatggcctgtggcggagtggtaggggtcgttgacgtaccctatctggtgctcgagcccacacacaataaacaggattttgccgatgcaaaagagtataggcacctgctgcgagccatgggagaacacttggcccagtactggaaggatatagcgatcgcccaacggggaattatcaagttctgggatgaattcggatacctgtccgctaactggaatcagcctccaagctccgaactccggtacaagaggcgacgggctatggagataccgaccaccatccaatgtgacctttgcctaaaatggcgtacgctgccatttcagctgtcttctgttgagaaggactaccctgatacctgggtttgcagcatgaatcctgacccggagcaggatagatgcgaggcttcagagcaaaagcagaaggtacccctcggtacttttaggaaggatatgaagacccaagaggagaagcagaagcagctgactgaaaaaatcaggcagcaacaggaaaaacttgaggcactgcagaagacgacgcccattcggtcccaagctgatctgaagaagctccctctggaggtaacgacgcggcctagtaccgaagagcctgtgaggcgacctcagaggcctagatcaccccctcttcccgcagtgatccggaacgctccttcaaggcctccatcattgccgacacctagacccgcttcacagcccagaaaagctcctgtgatcagtagtacacctaaactgcctgccctggctgctcgtgaagaggcctcgaccagccgactcctgcagccacccgaagcacctagaaagcccgctaacacgcttgtgaagactgcctcacggccagctcccctggtgcagcagctgtcccctagcctgctgcctaatagtaaaagtcctcgtgaggtgccatcccccaaggtcatcaagacaccggtagtgaagaagaccgagtcccctattaaattgtcccctgccacaccctccagaaaacggtctgtagccgtctctgatgaggaagaggttgaggaagaagcagaacggaggaaagagcgatgtaagcgcggtcgcttcgttgtcaaggaggagaaaaaagattctaatgagctcagtgattcggccggagaagaggatagcgcggatttgaaaagggctcagaaggataagggacttcacgtggaggtgagggtgaaccgagagtggtatacaggtagagtgacggcggtagaggtgggcaagcacgtagtgagatggaaagttaagtttgactatgttccaactgataccactcccagggacaggtgggtggaaaaagggagcgaggacgtgaggcttatgaaacctccgtcaccagaacaccagtccttggacacacagcaagagggaggggaggaagaagtcgggcctgttgcgcagcaggccatcgctgtcgccgagccctcgacatcagagtgtctgaggattgagcctgacaccacagcactgtcaactaatcatgaaactatagatctgctagtgcaaattctccggaattgcttacgctacttcctgccgccttcattcccaatcagcaagaaacaactgtccgcgatgaatagtgatgagctcataagtttcccactcaaggaatactttaaacagtacgaggtcgggttacagaacctgtgtaattcctaccagtcaagagcagattcacgggctaaggcttctgaggagagtttaaggacatccgagcgtaagcttcgcgagactgaagagaagttacagaagctccggaccaacattgttgccctactgcaaaaagttcaggaggatatagacataaacacggacgatgaactggacgcctatatcgaggacttgataacgaaaggggactag

SEQ ID NO: 29583 - DNA, 5942 bp, Artificial Sequence
  Description of Artificial Sequence: Synthetic coding sequence
atgaatccaaccaatcccttcagcggtcagcagccttcagcattttccgcatccagttctaatgtcggcaccctgccatccaagcccccatttcggttcggacagccttccctgttcgggcagaactccacgctgtcaggtaaatcttcgggatttagccaggtctccagctttcctgccagtagtggagtgtcacactcgagtagcgtgcagacgttgggcttcacccagactagtagcgtgggccctttcagcggcctagaacatacgtctacgtttgtcgccaccagtggcccatcctcgagcagtgtcttggggaataccggtttttcttttaagtccccaacctctgtgggggcattccccagcacatctgccttcggacaggaagccggagagatcgttaattccggctttggaaagaccgaattttccttcaaacctctagagaacgctgtcttcaagcctatcctgggggcagagtccgaaccagaaaagactcaatcccagatcgcttccgggttctttacctttagccacccaatcagttccgctcccggaggcctcgccccatttagctttccacaagtgaccagctccagtgctactacctctaactttaccttttctaagcccgtgagcagcaacaacagtctgagtgcgttcacccccgcattatcaaaccagaatgtggaggaggagaaaaggggacccaaaagcatcttcgggtcaagcaataattctttctcttcttttcctgtgtcatccgccgtgctgggagagccctttcaagcttcgaaagccggagtgcggcaaggctgtgaggaagctgtgagccaggtggagccgctcccatcgttgatgaagggcttaaagagaaaggaagatcaggaccgttcacctagaaggcacgggcacgaacctgccgaagacagtgaccctcttagcaggggggaccatccgcctgataagagacccgtgcgtcttaaccggccacggggagggacgctgtttggacggacaattcaggatgtattcaagagcaataaggaggtggggagactcggcaacaaggaggcaaagaaggaaactgggttcgtagagagcgctgagtcagaccacatggcaataccaggaggaaatcagtccgtgctcgccccatcgaggattcctggcgtgaataaggaggaggaaacagaatctcgggaaaagaaagaagattctctgcggggaacccctgcaaggcagagcaacaggtctgagtctacagattcactgggcggtctgagtccttcggaagttacagccattcagtgcaaaaatatccctgactacctcaatgatagaaccatactggaaaatcacttcggcaagattgcaaaagtgcaaaggatttttacacgcagatctaaaaagctggccgttgtccactttttcgatcacgcaagtgcggcactggctaggaaaaagggcaaaagcctgcacaaggatatggctatcttctggcaccgtaagaaaatctctcccaataaaaaaccattttctctgaaggagaaaaagcccggagatggagaggtcagcccctccacagaggatgcgcctttccagcactctccactggggaaggctgccggtagaactggcgcaagctctctgctgaacaaatccagccccgtcaagaagccatccctattaaaggctcaccagttcgagggagacagttttgacagcgcctctgagggctccgagggactcgggccatgtgttctgagtctgtcaactttaatcggcacagtcgctgaaacaagcaaggagaagtatcgactgctggaccaacgagacaggatcatgcgacaggccagggtgaagcgcactgatctagacaaagccaggacgtttgtcggcacttgcctggacatgtgcccagaaaaggagcgttacatgcgggaaacacggtcccagttgagcgtcttcgaggtagtaccaggaaccgaccaagtcgaccacgcagctgcagtgaaggaatactctcggtcctcagccgaccaagaggaaccacttccccacgagttaagacccctacccgtgctgtcaagaactatggactatctggttactcagattatggatcagaaggagggttcactgcgtgactggtatgacttcgtctggaatcggacacggggaattaggaaagacatcacacagcaacatttgtgtgacccactcacagtgtctctgattgaaaaatgcacaaggtttcacatccattgtgctcacttcatgtgcgaggagcccatgtctagtttcgatgctaagatcaataatgaaaatatgaccaaatgtctgcaatccctaaaggagatgtatcaagacctgagaaataaaggggtgttctgcgccagtgaggccgagttccagggatataacgtgctcctgagcctgaacaagggagacatcctgcgcgaggttcagcagttccaccctgccgtgcggaattcttctgaggtcaaattcgctgttcaggcgtttgcagctctgaacagcaacaatttcgtgagatttttcaagctggtgcaaagcgctagttatctcaatgcttgtctgcttcactgctattttagtcagatacgcaaagatgcattgcgggctctcaacttcgcatacaccgtttctacacagaggagcacaatatttcccctggacggggtggttcggatgttgctgttcagggactgcgaagaagcaacagatttcctgacgtgccatggactgactgtaagtgatggctgtgtcgaacttaatagaagtgcatttctggaacctgagggcctgagtaagacccgtaaatcagtgttcatcacgcgaaaactgactgtcagcgttggtgagattgtaaatggcggacctctccctccagttcctcgccacaccccagtatgttcattcaacagccagaacaaatatattggagaatcgttggccgctgaacttcctgtttctacccagcggccaggttccgatacagtagggggaggccgtggagaagagtgcggcgtggagccggatgcgccattgtcaagtctcccccagtctcttccagctcctgctcccagcccagtgccactgcctccggtgcttgcactgaccccatcagtcgcccctagtctgtttcaactctctgtccagccagagcccccaccgccagaacccgtgcctatgtacagcgacgaagacctcgcccaagtggtcgatgagttgatccaagaagctctccaaagggactgtgaggaggtgggcagcgccggtgcggcttatgccgcagccgctctgggcgtctccaatgccgctatggaggacctactgactgcggcaaccactggaatcctgaggcatatagcggctgaagaagtttccaaggagcgggagcggcgtgaacaggagcgccagagagccgaggaggaacggctaaaacaggaaagagagctggtgctgtccgagctcagccagggcctcgcagtggaactcatggaaagagttatgatggagtttgtgcgagaaacttgctctcaggaactgaaaaacgccgtagagacagatcagcgggtgcgagttgcacgctgctgcgaggacgtgtgcgcccatctggtggacctttttctcgtggaagaaattttccagacagcgaaagaaaccctccaagagctgcaatgcttctgcaagtatttgcaacgctggcgcgaggccgtgactgcaaggaaaaagctaaggaggcagatgagagcatttcctgccgcaccatgttgtgtggatgttagtgaccggcttcgcgctctggcaccatctgccgagtgccccatagccgaggagaatctggccagagggctgctcgacttgggccatgccggaagacttggcatttcctgtacgcgactgagacgcttgaggaacaagactgcccaccaaatgaaagtgcagcacttctatcagcaactgctctccgacgtagcatgggcttccttagacttgccttccctagtggcagagcacctacccggacggcaggaacacgttttttggaaactggtgcttgtgctgcctgacgtcgaggagcaaagccccgaatcctgcggccgaatcttagcaaattggctgaaggtgaagtttatgggtgacgaaggatcagtagacgacacttcctcagatgccggaggtatccagacactctcactgttcaactcactgagctctaagggggaccagatgatctcagtcaatgtctgcataaaggtagcacatggtgctctaagcgacggagctatcgacgccgtggagacccagaaggatcttcttggagcgtctgggcttatgctcctcttacccccaaagatgaaaagtgaagacatggctgaagaagacgtgtactggctctcagccctgctgcaactgaaacagctgctccaggctaagcccttccagccagccctcccactggtggttttggtgccctctccaggaggcgatgcagtggagaaggaggtggaagatgggttgatgctacaggacctggtttcggccaagctcataagtgactataccgttactgaaatacctgacaccattaatgacttgcagggcagcacgaaagtactgcaggcagtgcaatggctagtaagccactgtcctcacagtttagatttgtgttgtcaaacactgattcaatatgtcgaggacgggatcgggcatgagttcagtggacgtttttttcacgacagaagggagcgacgcctgggcggtctggcctctcaggagccaggtgcgattatcgaactgtttaattcagtattgcagttcctggcatccgtcgtctccagcgagcagttatgcgacctgagttggccagtcaccgagttcgcagaagctggcggatcacgtctgctgccgcatctgcattggaacgcccctgagcacctggcctggctgaaacaagcagtcctgggtttccaactcccgcaaatggacctgcccccactcggagctccatggctgccggtgtgcagtatggtcgtccagtacgcaagccagatcccgtcttctcggcagacccagcctgtgctgcagagccaggttgagaaccttcttcaccgtacatattgtcgctggaagagtaagtcaccatctccggtgcacggcgcaggacccagcgtgatggagataccctgggatgatctgatagccctttgcatcaaccataaactgcgggattggactcctcctaggcttcctgtgacttctgaggccctgagtgaggacggccaaatctgcgtgtacttttttaagaatgacctgaagaagtacgatgtgcccctgagttgggagcaggcaaggcttcaaacccagaaagagctccagttgcgagaaggtcggctggcaattaagcccttccacccctcggcaaataatttcccgattcctttactgcacatgcaccggaactggaaaaggagcacagagtgtgcccaagaagggagaatccccagcactgaagacctgatgaggggggcaagcgcagaagaactcttggctcagtgccttagtagcagcctcctgctcgagaaagaagagaacaagagatttgaagatcaacttcaacagtggcttagcgaggattcaggagcctttacagatttgactagcttgcctctctatctgccacagactctggtcagtctatcacataccatagaaccggtgatgaagacttcggtcaccacgagcccccaaagcgatatgatgcgcgaacagttacagcttagcgaggccaccgggacatgcttaggggagagacttaagcaccttgagcgcttgatcagatcgagtcgcgaggaggaggtggccagtgagctacacctctccgccctcctggatatggtcgacattta

SEQ ID NO: 29584 - DNA, 513 bp, Artificial Sequence
  Description of Artificial Sequence: Synthetic coding sequence
atggggaaacgttacttctgcgactactgtgacagaagcttccaagacaaccttcacaaccgcaaaaagcatcttaatgggctccagcaccttaaagccaagaaagtctggtacgatatgttcagggatgccgcagcaatcctgctggacgaacagaataagagaccctgccgaaagttcctattgacaggtcaatgtgatttcgggagcaactgtagattttctcatatgtctgaacgagacttgcaggaattgagcatacaggtggaagaggaaaggagagccagggagtggctccttgatgctcccgagcttcccgaggggcacttggaggattggctggaaaagagggccaaacgtctgtcatccgcacctagctcccgagcagagcccattcggaccaccgtgtttcagtaccccgtgggctggcctcccgtgcaggagctcccccctagtctgagggcacctccaccgggaggctggccactgcagccgagggtgcaatggggctag

SEQ ID NO: 29585 - DNA, 291 bp, Artificial Sequence
  Description of Artificial Sequence: Synthetic coding sequence
atgtgccatacatcctgcagtcccgcatgccaacctacttgctgcatccacagcccctgtcaggccagctgctatgtgcccgtgtcatgtcagagttcagtttgtatgccagtatcttgcacgcgaatcgtgtgtgtcgcaccatcttgccagccaagcgtctgcgtgcccgtgagctgtagaccaataatatatgttactcctagctgtcagagctccgggtgttgccagccaccttgcaccactgcactatgtagaccgatcagctgctcaacgcccagctgttgctag

SEQ ID NO: 29586 - DNA, 879 bp, Artificial Sequence
  Description of Artificial Sequence: Synthetic coding sequence
atggcagcctcgacgatgtcaatacgctctagtgcctattccgatagttggcaggtggacgattgtccagagtcatgttgtgagccaccctgttgtgcaactagctgttgcgcaccggctccttgcctgacattagtgtgtactccagtctccagggtgagctccccttgctgccaggtaacatgcgagccttccccctgtcagagtgggtgtacatcatcatgcaccccctcttgttgccagcagagcagctgtcagccagcatattgtacatcgagtccgtgtcaacaggcatgctgtgtgcctgtgtgctgtaagcccgtgtgttgcgtaccagtgtgctgcggtgcttcctcttgctgccaacagagttcctaccaacctgcgtgctgcgcgtcctccagctgccaacccgcttgctgtgtccctgtctgctgtaaacctgtgtgttgcgcccctacttgcagcgaggacagctactcctgttgtcagcagtcttcttgtcagcccgcttgttgcaccagctcaccgtgtcagcaatcctactgcgtgccagtatgctgtaagcctgtgtgttgtaaaccaatctgctgtgtgcccgtgtgctccggagccagtagcctatgttgtcaacagtcagggtgccagccagcatgctgcactacatcctgctgccgcccatcctcttctgtatcgttactgtgtagacccgtgtgccggccagcttgttgcgtgccggtctctagctgctgcgcgcctacgtccagtcgccagccttcctattgccggcaagcgagttgcgtatcgcttctctgtcggcctgtttgtagccgtccagcatgctactcattctcatccggacaaaagagctcctgctag

SEQ ID NO: 29587 - DNA, 1608 bp, Artificial Sequence
  Description of Artificial Sequence: Synthetic coding sequence
atgaagaagataagtctgaaaacgctgcgtaaaagttttaatctaaacaaatctaaagaggagaccgattttatggttgtgcagcagccttccctcgctagcgattttggcaaagacgattccctctttgggagctgctatggaaaggacatggcctcgtgtgacatcaacggcgaggatgagaaggggggtaaaaatagaagcaaatctgaatctctgatgggcaccctcaagcgaagactctccgcgaagcagaagagtaagggtaaggctgggacacccagcgggtcctccgccgatgaagataccttttcatcctcttcggctcctatcgtgtttaaggatgtccgggcacagaggccaattaggtccacatcattaaggtcccaccactatagccctgccccttggcccctgaggccaactaactccgaagagacttgcattaagatggaagttcgcgtcaaagccctagtgcattcctccagtccttcacccgctctgaatggcgtgcggaaagatttccacgatctgcagagcgagactacttgtcaggaacaggccaattctttgaaatcgtccgcctcccacaacggagacctccacctgcacctcgacgagcacgtgccggtggttatcggattgatgccacaggactacatccagtatactgtgcccctggatgaaggaatgtaccccttagagggctcaaggagctactgtctggactcctcatctcctatggaagtgtctgcagtaccccctcaggtgggtggccgagcttttcccgaggatgagagccaggtggaccaagacctagtggtggcacctgaaatattcgtggaccagtcagtgaatggtctcctgattggaaccacaggggtgatgttgcaatctccaagagctgggcacgatgatgtgcccccactctcccccttgctgcctccgatgcaaaataaccagatccaacgaaacttctctggtctgactggcacagaggcccatgtggccgaatccatgcgctgccacttgaattttgacccaaacagcgccccaggtgtggcacgggtttatgactcagtacagagttccgggcctatggtagtcacctccctgacagaggaactcaaaaagctcgctaagcagggctggtactggggtccaatcacccgctgggaagcggaaggcaagttggccaacgtgcccgatggctctttcctggtcagggacagtagcgacgatcggtatctgctctcgctgtccttccgaagtcacggtaagacactacatacgagaatcgagcacagcaacggtcgcttctcattttatgagcaacctgatgtcgagggccacacttctatcgtcgacctgattgagcattctatacgcgactccgagaacggagctttttgctacagtcgatcccgcttgccagggtccgcaacgtacccagttagactgacaaatcccgtatcgcgcttcatgcaggtgcggtctctccagtatctttgtaggtttgtgatccggcaatataccaggattgacttgatccagaaactgcctttacccaataaaatgaaggattatctccaggaaaaacattactag

SEQ ID NO: 29588 - DNA, 1260 bp, Artificial Sequence
  Description of Artificial Sequence: Synthetic coding sequence
atggccgcaagttctcttgaacagaagctgtcccgccttgaggcaaaattaaaacaggagaacagagaagccagaagaaggatcgatcttaatctggacataagcccccaacgtcccagacctaccctgcagttaccgctggctaatgacggaggatcaagatcaccaagtagtgaatcatcaccccaacaccccaccccccctgcgaggccgagacacatgctagggcttcccagcacgttattcactccgcgttccatggaatctatcgaaatcgatcaaaaacttcaagagatcatgaagcagacgggatacctcacaattggaggccagagatatcaggccgaaatcaatgatctggagaacttgggtgaaatgggcagcggcacatgcgggcaagtgtggaaaatgaggttcagaaagacaggacacgtaatcgccgtaaaacaaatgcgtaggtctggcaataaagaggagaacaagcgaatcctgatggacctcgatgtggtgctaaagtcccacgactgtccttacattgtgcaatgttttggcacctttatcaccaataccgacgtgtttatagccatggaacttatgggaacttgtgccgaaaagttgaaaaaaagaatgcaagggccaatccctgagcgcatactggggaagatgactgtggcaatcgtcaaggccctttactacctgaaagaaaagcacggggtcatccatcgggatgttaagcccagtaacatactcctcgatgagcggggacaaattaaactgtgcgacttcgggatttctggtcgcctcgttgattccaaagctaagactaggtccgctgggtgtgccgcatatatggcaccagagcgcattgacccccctgatccaaccaagcctgactatgacattagggcagacgtctggtcactgggtatcagtctggtggagcttgctactgggcagttcccctataagaattgcaagaccgacttcgaagtgcttactaaagtcctacaggaggagccccctttgttgccaggtcatatggggttcagcggcgatttccagtcattcgtgaaggactgcttgacaaaggaccatcgcaagcgaccaaaatataacaagctgctggaacatagtttcattaaacggtacgagacgctggaggtcgatgtggcttcttggttcaaagatgtgatggccaagaccgaatctccacggacctccggcgtgttgtcacagccacatctgcctttctttagatag

SEQ ID NO: 29589 - DNA, 963 bp, Artificial Sequence
  Description of Artificial Sequence: Synthetic coding sequence
atgtcaaagtccgcatccccgaaagaacccgaacagctgaggaaactgttcatcggagggctctctttcgaaaccaccgatgagtctttgcgatctcattttgaacagtgggggactcttactgactgcgttgtgatgcgggatcctaacactaagagatcaagaggttttgggtttgtgacatacgctactgtggaagaagtggatgcagcgatgaataccacccctcataaggtcgacgggcgagtggtggaaccaaagcgggctgtctctcgcgaggactcacaaaggccgggtgcccacctgaccgtgaaaaagatctttgtggggggaataaaggaggataccgaggagcatcatctgcgcgattactttgaacaatatggaaagatcgaggtgatcgagatcatgactgacagagggtcgggcaaaaagcggggttttgcgtttgtgacatttgacgaccatgacagcgtggacaaaattgttatacagaagtaccacactgttaaaggtcataactgtgaagttcggaaagctctgcccaaacaggagatggcttcggcctcatccagtcagcgcggacggcgaggctctggcaattttgggggaggcaggggtgacggttttggcggaaacgataatttcggccgtggcggaaatttttctgggcgtgggggttttggcggaagttgtggtggagggggttacggcggttctggtgatggctacaacggattcggcaacgacggctctaactttgggggaggcggttcatataacgattttggtaactacaacaaccagagttccaactttggccctatgaaagggggtaactttggcggtagatcctctggaccatacggaggcggtggacaatatttcgccaagcctcagaaccaaggaggctacggggtgagcagctcaagctcgtcctacggctctggcaggaggttttag

SEQ ID NO: 29590 - DNA, 1737 bp, Artificial Sequence
  Description of Artificial Sequence: Synthetic coding sequence
atggaactcgaaaatattgtcgccaatagcctgctgctgaaagcaagacagggcggatacgggaagaagtctggcaggagcaaaaaatggaaggaaattctgactttgccgccagtgtcccagtgctctgaactgcggcactctatcgagaaagattactcttcactgtgtgacaaacagcctatcggacggagactgttcagacagttttgcgacacaaaacccactctgaagcgccacatcgaatttcttgatgccgtggccgaatatgaggtggccgacgatgaggacaggtccgattgcggtctaagcattttggaccgcttcttcaacgacaaacttgctgctcctctcccagagatcccacctgatgtcgtgactgaatgtcgactgggcctcaaggaggagaacccctccaagaaagcctttgaggagtgcactcgggtcgcccataattatcttcggggtgaaccatttgaggaatatcaggaaagttcatacttttctcagtttctgcagtggaagtggctcgaacgccagccggtgaccaaaaatacgttccgtcactacagagtcctcgggaaagggggattcggggaggtttgcgcctgccaggttcgagctactggtaaaatgtatgcttgcaaaaagctgcaaaagaagaggattaagaagaggaaaggagaagccatggcattaaatgagaagaggatactggaaaaggtgcagagccggttcgtcgtgagcctcgcgtatgcatacgagaccaaagacgctctgtgcctggtcttgacgatcatgaatggtggagatttgaaattccatatatataacctggggaatcccggtttcgacgagcaacgagctgtcttctacgcagccgaactctgctgcggactggaagacttacagagggaaaggattgtttatcgcgatctgaagcctgagaacattctgctggatgacaggggccatattcgcatttccgatctgggcctggccaccgaaatccctgaaggacagcgcgtccggggtcgggttggcactgtcggctatatggcgcctgaagtcgtcaacaacgagaaatacacctttagccccgattggtggggtcttggatgtctcatttatgaaatgatccagggccacagtccattcaaaaaatataaggagaaggttaagtgggaggaagtggatcagagaattaagaatgacacagaggagtattccgaaaaattctctgaggacgcgaagtccatttgccgcatgttgcttacgaagaacccctcgaagcgcttgggatgccgaggggaaggcgcagccggtgttaaacagcacccagttttcaaagatatcaactttcgtaggctggaggccaacatgcttgaaccgccattttgccccgatcctcacgccgtgtattgtaaggatgtgttggatattgaacagttctctgtggtgaagggaatataccttgacaccgcggacgaagatttttatgcaaggtttgctaccgggtgcgtttccatcccttggcaaaatgaaatgatagaatcgggatgcttcaaggatatcaataagtccgagtctgaggaagctctgcccctggacctcgataagaacattcacacccccgtctcgagaccaaaccgaggcttcttctacaggttgttccgaagggggggatgtctgacaatggtaccttccgaaaaagaagtggagcccaagcagtgctag

SEQ ID NO: 29591 - DNA, 2625 bp, Artificial Sequence
  Description of Artificial Sequence: Synthetic coding sequence
atgaaccaacgctctcatttaggtaccacttatctggacaccgcaaagggcgcagtggaaacctttatgaagctcagagctagagatccagcatcgagaggagatcgctatatgctggtaacatttgaggagccaccctatgcaatcaaagcaggatggaaggagaaccacgcaacatttatgaatgaactgaagaatctccaggccgagggcctcacaaccctcggccagtctctccgcacggctttcgacctcctcaacctcaaccggttggtgactggcattgacaattatggccaagggcgtaacccattcttccttgaaccagccattattattactataactgatggttcaaagcttacaaccacctcaggggtgcaagacgaactacatctgcctctcaactccccactccccggatctgagcttacaaaagagccattccggtgggatcagcgcctgttcgccctcgtgctacgactcccgggtaccatgagtgtcgaaagtgaacaattaaccggcgtcccactcgacgactccgcgattactccaatgtgtgaagtaaccgggggaagatcttactctgtgtgtagccctagaatgctgaaccagtgcctcgaaagtctagtgcagaaagttcagagcggagtggtcattaattttgagaaggccggtccggatccatcacctgtcgaagatggacagcccgatatctcacgcccttttggcagccagccctggcattcctgtcacaagcttatttatgtacggccaaaccccaagaccggagtgcccatcgggcactggccagttccagagtcattttggcctgaccagaattctccgaccttgcccccacgaacttctcacccagtggtcaaattcagctgtactgactgcgaaccaatggttatagacaagctgccttttgacaagtatgagctggagccctctccattaactcagtttattttggagcggaaatcccctcaaacctgttggcaggtgtacgtctctaattccgctaagtactcagaactgggtcacccatttggttatttgaaagcctctacagcccttaattgcgttaacctctttgtcatgccctacaattatccggtgttgttgcctctattggatgatctgtttaaagtgcacaaagccaagccaaccctgaagtggcgtcagtcatttgagagctatctgaagaccatgccaccatactatctgggaccgctgaaaaaggccgtccgaatgatgggggctccgaatctcatagcagattctatggaatacggactgtcctacagcgtgatttcctacttgaaaaagttgtcccaacaggccaagattgaatcagatagagtgatcggttcagtcggaaagaaagtggtgcaggaaacaggaattaaagtgcggtcccgtagccatggcttatccatggcttacagaaaagacttccaacaactgctccagggcatcagtgaagatgtgccccacagactgctagacttaaatatgaaggagtacacagggtttcaagtggcacttctaaataaggacttaaaaccacaaacgttccgcaatgcctatgacattccgagaaggaaccttctcgaccatttaacgaggatgaggagtaatctgctcaaatcgacacgacgcttcctcaagggtcaggatgaagatcaagtgcatagcgttccaatagcccagatggggaattatcaggagtatctaaaacaggttcctagtcccctcagagagctcgatcccgaccagcctagaagactccacactttcggtaatccattcaagctggacaaaaagggcatgatgatcgatgaggccgatgagtttgtggcagggccacagaacaaacacaaacgcccaggcgaacctaacatgcaggggatccctaagagacgtaggtgtatgagtcctctcctgcgaggacgccagcagaacccagtagtcaacaaccatattggcggtaaaggtcccccagcccctacgacgcaggcacagcccgacctcataaaacctttgcctctccataagataagtgagaccaccaatgacagtattattcacgatgtggttgagaatcacgtggccgatcaattgtctagcgacattacaccaaacgcaatggacacagaattttccgcctcttcgcctgcctctctgttggagcggcctaccaaccacatggaggccctgggccatgatcatcttggaacaaacgacttaaccgtggggggattcctcgagaatcatgaagagccaagggacaaggaacagtgtgcggaggaaaacattccagctagctcactgaataaggggaagaagctcatgcactgtcgctcgcacgaggaagtgaacacagagctgaaggctcaaattatgaaagaaatccgaaagcctggcaggaagtatgaacgaattttcaccctgttaaagcatgtgcaaggttcactgcagacacgactcatatttcttcaaaacgttattaaggaggccagcagattcaagaagaggatgctgatcgagcagctcgaaaacttcctcgacgagatccacaggagagcaaatcaaatcaatcatatcaactcaaactag

SEQ ID NO: 29592 - DNA, 2340 bp, Artificial Sequence
  Description of Artificial Sequence: Synthetic coding sequence
atggccgattactccaacaaactgtattaccaacttgagcaggagaccggaattcagaccggctatacccgcactggttccattttcctcgctcagacccaagaccggctaatcagcctaaagcgcatcaatgcaggtctgaacgtgatcgggatcccttcagaaatcatctcgcccaagaaggttgccgagttacaccatcttctcaatgttcatgatctggtgggcgcaatgcacgtacctgaagacgctgtggtatcttctgcggatgttgccctggccctggcgagcgcggcaagtcagaacggggtacagatctatgatcgcacatcggtattacatgtgatggtgaagaaggggcaggtgaccggagtggaaaccgataagggccagatcgaatgccagtatttcgtcaactgtgcagggcagtgggcctatgagctgggactgtccaacgaagagcctgtttctattcccctccacgcctgcgagcacttttatctgctgaccaggccgctggagacacctctccagtccagcacccctacgatcgtcgatgccgatggtaggatctacattcgcaactggcaaggagggattctcagtggaggatttgaaaagaatccaaaacctatatttactgaggggaaaaatcagttagaaatacagaacctccaggaggattgggatcacttcgagccgctccttagctccctcctgcgaaggatgccggaactggagacactcgaaattatgaaactcgtcaactgtcctgagacttttaccccagacatgcggtgcatcatgggcgaatcacctgcagtccaggggtattttgtactggctggcatgaatagtgctggcctgtcttttgggggtggcgctggaaagtatcttgcagaatggatggttcatggctacccctctgagaatgtttgggaactcgaccttaagcgcttcggcgctctccagagttcccgcacctttctgcgtcatagagtgatggaagtcatgcctttgatgtatgacctcaaggtgcctagatgggatttccagacaggaagacagcttcgaacctctcctttatatgatcgattggacgcacagggcgctcggtggatggagaaacacggcttcgagcggccaaaatactttgtgcctcctgataaagatctgctagccctcgagcaaagtaagacattctataaaccagattggttcgacatagtcgaaagtgaagtgaaatgctgtaaggaagccgtgtgcgtgatagacatgagttcgtttacgaagttcgaaattacatccactggtgaccaggccctcgaggtgctgcagtatctttttagtaatgacctcgacgtgccagtgggacatatcgtgcacaccgggatgcttaatgaggggggagggtatgagaatgactgttctattgcaagactcaacaaacgatctttcttcatgatctcaccaacggatcagcaggtgcactgctgggcctggcttaagaaacacatgcctaaggactccaatctattactggaagatgtgacctggaagtacacagcgctgaacctcatcggcccacgggcagtggatgtactctccgagctttcctatgcacccatgactccagaccactttccttctctgttctgtaaggagatgtcggtgggatacgccaacggtatccgcgtgatgtcaatgacacacacaggagagcctggcttcatgttgtacattccgatcgagtatgcactccatgtctacaacgaagtgatgtccgttggacagaagtacggaatacggaacgctggttattacgccttgagaagcctccggattgagaagtttttcgcattttgggggcaggacatcaacaacctgactaccccacttgagtgtggtagagaatcccgtgtgaagctcgaaaaaggtatggatttcattgggcgagatgcccttttgcagcaaaagcagaatggagtttacaagcggctgaccatgtttatcctggatgatcatgacagtgatctcgacctctggccctggtggggtgaaccaatttataggaatggacaatatgtcggtaagacaacttcaagtgcttattcctattccctggagagacacgtgtgccttggctttgtgcataatttttctgaagatactggagaggagcaagtggttactgctgattttataaacagaggagagtacgagatagacatagctggctatagatttcaggctaaagcgaagctttaccctgtcgcgtctttgtttacacaaaaacgcagaaaagatgatatggagctaagcgacttacacggaaaatag

SEQ ID NO: 29593 - DNA, 1191 bp, Artificial Sequence
  Description of Artificial Sequence: Synthetic coding sequence
atggccaccagagtggaagaagccgcacgaggcaggggagggggagccgaagaagccactgaagccggaaggggtggcaggcggagaagcccacgtcaaaaacttgaagagtcgcgcagcgttcagaagcaaatgaaaatactccagaaaaagcaagctcagatcgttaaagagaaagtccatttgcagagtgagcactccaaggccatcttggcccgaagcaaactagagtctttatgtcgagaactgcagcgccacaacaaaacactgaaggaggagaacatgcagcaggccagggaggaggaggaacggcgtaaggaggccaccgcccacttccagattaccctgaacgaaatccaggcacagctggagcagcacgatatacataatgccaaactgaggcaggagaatatcgagttgggtgaaaaactgaaaaagctcatagagcagtacgctctcagagaagaacatattgacaaagttttcaagcacaaggaacttcagcaacagttggtagacgctaaattacagcagactacccagctgatcaaggaggctgacgaaaaacatcaacgggagcgggaatttctgctgaaggaagccacggagtccaggcataagtatgagcagatgaagcagcaagaggtgcagctgaagcagcagctgtctctgtatatggataagtttgaagagttccagacaacaatggccaagtccaatgagctgtttactacgtttaggcaggagatggagaagatgacgaagaagataaagaaactggaaaaagaaacgattatttggcgtactaagtgggagaacaacaacaaagccctgctgcagatggcagaggaaaaaacggtacgagacaaggagtacaaagcacttcaaataaagctggagcgactagagaagctgtgccgtgctctgcagactgaaaggaatgaactgaatgagaaagtggaggtcctgaaggagcaagtgtccataaaggcagccatcaaagccgctaatagggacctggcaactcccgtgatgcagccttgcacggcccttgactcacacaaggagcttaacacctctagcaaacgcgctctgggcgctcacctggaggcagaaccaaaatcacagagaagtgcagtacagaagcccccatccacagggagtgcacccgcaattgagtcagtcgactag

SEQ ID NO: 29594 - DNA, 1443 bp, Artificial Sequence
  Description of Artificial Sequence: Synthetic coding sequence
atggcagggtaccttagcgagagcgacttcgtaatggttgaagaaggatttagcactcgcgacttgttaaaggaactgaccctgggagcatctcaggccaccaccgacgaggttgccgctttctttgtggctgacctcggggcaattgtccgcaagcacttttgcttccttaaatgtctgcctagggtgaggccattttacgcagtgaagtgcaactcaagcccaggagtgttaaaagtattggcacagcttggcctcggcttttcatgcgcaaacaaagccgagatggaacttgtccagcatatcggcattcctgcctccaaaatcatctgcgccaacccttgcaagcagattgcacagataaagtacgctgccaagcatgggatccaacttttgtcattcgacaatgaaatggagcttgccaaggtcgtgaagtcccacccctctgctaaaatggtgctgtgcatcgccactgacgacagtcattctctctcttgtctttctcttaagttcggagtgagcctgaagagctgtcggcatctgttggagaatgccaagaaacaccacgtggaagtagtaggagtctccttccatatcggctccgggtgcccggatcctcaagcatatgcccagtccatagccgatgccagactcgttttcgagatgggcaccgagctgggccacaaaatgcatgtgctggatctggggggtgggttccccggaacagaaggagcaaaggtgcggttcgaggaaattgcctccgtgatcaactctgcgctggatctttattttccagagggatgtggcgtggatatatttgcagagctcggtagatattatgtgacctctgcattcacagtggcagtaagtattattgccaagaaagaggtgctcctggatcagcccggtcgcgaagctccgctgccccctccccacattgcaacctgcgctgcctctgagccatcaccaccagctgaggaaaacgggtctacatcaaagactattgtatatcacctagatgaaggggtgtatggcatcttcaactcagtactgttcgacaatatctgtcccactcctatcctccaaaaaaagccttctaccgaacagcccctgtactcctctagcctatggggacctgccgtcgacgggtgtgactgcgtcgccgagggactgtggctgccacagctgcacgtcggcgactggcttgtctttgataatatgggagcttataccgtcggtatggggtccccattctgggggactcaggcatgtcacatcacctatgccatgtcaagggttgcctgggaggctttgagaagacagcttatggctgccgaacaggaagacgatgtggaaggcgtgtgcaagccactctcttgcggctgggaaataacggataccctgtgcgtggggccagtgtttacacctgcgtctatcatgtag

SEQ ID NO: 29595 - DNA, 3774 bp, Artificial Sequence
  Description of Artificial Sequence: Synthetic coding sequence
atggcccacttcagcagtgaggatcaagctatgttacaagccatgttgcgtcggttgtttcagtctgtgaaggaaaaaattacgggggctccaagtctggaatgtgcggaagaaatcctgctccacctggaagagactgacgagaacttccataactacgagttcgtcaagtatctcaggcagcacataggtaacaccctgggttccatgatagaggaagagatggaaaaatgcactagcgacagaaaccaaggcgaagagtgtggctacgataccgtagtccagcaggttactaaaaggacacaggaatctaaggaatacaaagaaatgatgcattacctcaagaatatcatgattgctgttgtcgagtctatgatcaataaattcgaggaagatgagacacggaatcaggagcgccagaagaagatccagaaagaaaaaagccatagctaccgaactgacaactgtagcgactccgattcttcacttaaccaatcttataagttctgccaggggaagctacagctgatactagaccagctggaccccggacagcccaaggaagttagatacgaagcgttgcaaaccctttgttcagctcccccttccgacgtgctcaattgcgagaattggacgacactgtgtgaaaagttaacagtatcattgagtgatccagatcccgtgttctccgacagaattctgaagttctgtgctcagacctttctgctttcccctttgcacatgactaaagaaatttatacaagtctggctaaatacctcgagtcatacttcctgagcagagagaaccacattcccacactcagcgcaggtgtggatatcaccaaccccaatatgactcgactcctcaaaaaagtcagattgcttaatgaataccaaaaggaggccccatcattctggatccgccaccccgaaaagtatatggaagagatagttgaatcaaccctttcccttttgaccgtaaagcataatcaaagtcacgtggtgtcacagaagatactagatccgatctactttttcgcgttagtggatacgaaagctgtgtggttcaaaaagtggatgcacgcccactattcaagaactacagttctaagactcctggagaccaaatataagtccttagtgactacagcaatccagcaatgcgtgcaatatttcgaaatgtgtaaaactagaaaggccgatgagaccctgggacactccaaacattgcagaaacaaacagaagactttctattacctgggccaagaactgcaatatatttatttcatccactctctctgcctgttgggtcggctgctgatttacaaacagggaagaaagcttttccccatcaagctcaagaataaaaaagggctagtatcactaattgaccttctggtcctgtttacacagttgatttattacagcccaagctgtcctaagatgacttctgccgctcacagtgaaaactacagtcctgcgtcaatggttaccgaggttttgtggatcctgtctgaccaaaaggagtgcgctgttgagtgcttgtataacaatatagtgatagagactctcttacagcctattcataatctcatgaaaggaaacgaggcctccccaaactgctcggagactgccctcatccacatcgccggaatccttgcccgaatcgcctctgtggaggagggtctcattttactgctgtacggagccaatatgaactcctcggaggaaagcccgacaggtgcccatataattgcacagttcagcaagaagctcctggatgaagatatctccatcttctccggtagtgaaatgttgcctgtggtgaagggagcatttattagcgtgtgccggcatatatacagcacctgcgaaggactgcaagtcctgattacatataacctgcacgaatcaatcgctaaggcctggaagaaaacctccctgctcagcgagcggattcccacccctgtggagggtagtgattccgtctctagcgtctcccaggaatctcaaaacatcatggcatgggaagacaaccttctcgatgacctcctccattttgcagctacacccaaggggctgctactattacagcgcaccggggcaattaacgaatgcgtaaccttcatattcaaccgctacgccaaaaaattacaggtgtcaaggcataaaaaatttggttatggagtgctggttactcgcgtggccagtactgctgccggagggatagctcttaagaagtcaggcttcatcaacgagttaattactgaactgtggagcaatcttgagtatgggcgtgacgatgtgagggtgacacatcccagaacaacaccagtcgatccaatcgaccggtcttgtcaaaaatcatttcttgccctggtcaacttactttcctatcccgcaatctatgaactggtgagaaaccaggatctacccaacaaaactgagtacagcctccgcgaggtgcccacatgcgtgattgacattatagaccgcctgattatattaaactcagaagctaaaataaggtcattattcaactatgagcagagtcacatctttggcctgcgggactttatcattgatgggttgtccgtggaaagaaatcacgtgcttgtcaggataaacttagtgggcggacccctggaaagaattctgcctcctagattgctggagaagagcgacaatccctacccttggcccatgttttccagttatccgctgccgaactgttacttgtcagacattacacggaatgctgggatcaaacaggataacgacctggataagttattactgtgtctgaagatctccgacaaacagacggagtggattgagaactgccaaagacagttttgtaagatgatgaaggctaagcctgacattatctcaggcgaggcgctaattgaactgctagagaagttcgttctgcacctgacggagtcaccatctgaatgctacttcccctcagtggagtatacggccaccgatgccaatgtgaagaacgagtcactctcatctgtacaacaattgggtatcaagatgacagtacgctatgggaagttcttaagtttactaaaggacggagccgagaacgacctgacctgggtacttaaacactgtgaacgatttctaaaacagcagcaaaccagcatcaaaagcagtctgctttgcctccaggggaattatgcaggccatgattggtttgtaagttctttgtttatgataatgttaggggataaggaaaagactttccagttcctgcaccaattctcacgattactcacatccgctttcctatggctccctcgactccatatatccagctacctccctaacgacacggtggaatccggtatccacccagtgtatttctgtagtacacactacatcgaaatgctgcttaaagcggaactgcccctggtgtttagtgctttccatatgtcgggttttgcaccctcccagatatgtctccagtggattactcagtgtttctggaattacctggattggattgagatttgccactacattgccacctgcgtgtttctgggccctgattaccaggtttacatatgtatcgccgtctttaaacatctgcaacaagacatactgcagcatacccagacacaggatctgcaggtttttctgaaggaggaagctctgcatggctttcgagtttcagactactttgaatatatggagatactggagcagaactaccgcaccgtcttgcttagagacatgagaaacataagactgcaaagcacctag

SEQ ID NO: 29596 - DNA, 612 bp, Artificial Sequence
  Description of Artificial Sequence: Synthetic coding sequence
atggcaaccccatacgtcacagatgaaacagggggaaaatatattgcttccacccagcgccctgacggaacatggaggaaacagcgtagggtgaaagaagggtacgtcccgcaagaggaagtgcccgtttacgagaataagtacgttaaatttttcaaaagcaagccggaactgcctccaggactctccccggaagcaactgctcccgttactccaagtaggcctgagggcggagaacccggtctctccaaaactgctaaaagaaacctgaaaaggaaagaaaagcgaaggcaacaacaagaaaagggagaggccgaggctctgtcccgcaccctcgacaaagtgagcctggaagagaccgctcagctgcccagcgctccccagggcagcagggccgctccaaccgcggcttccgaccagccagactctgcggctacgactgaaaaggccaaaaagatcaagaatctgaaaaaaaagctgcgacaagttgaagagctgcagcagaggattcaggccggtgaagtgtctcagccatcaaaagagcaattggagaagctggcacggagaagggctctggaagaggaactggaggatctcgagctaggactgtag

SEQ ID NO: 29597 - DNA, 729 bp, Artificial Sequence
  Description of Artificial Sequence: Synthetic coding sequence
atggctgcagtgaaggcctctactagtaaagcgaccagaccttggtattcacacccggtttatgcacggtactggcaacactatcaccaggcgatggcgtggatgcagtcacaccataacgcataccgcaaggcagtagaaagttgcttcaacctcccctggtatctgcccagtgcattactgcctcagtcatcctatgataacgaggcggcatatcctcagagcttttacgaccatcatgttgcttggcaagactatccgtgctcctccagccactttaggcggagtggacagcatccccgttattccagcagaattcaggctagcacaaaagaggatcaagcattatcaaaggaggaggaaatggaaactgaaagtgacgccgaggttgagtgcgacctgagcaacatggagatcacagaagaactgcgacaatactttgcggaaactgagcgacatcgcgaggaacggaggcgccagcagcagctcgacgctgaacgccttgacagttacgttaatgccgaccatgacttgtactgtaatacccgccgttccgtggaggcgccaactgagcggccaggggaaaggaggcaagccgaaatgaagcggctctatggagatagcgccgcaaagatacaggctatggaggccgctgtccagctttccttcgataagcactgtgatcgtaagcaacctaaatattggccagtgatcccattgaagttctag

SEQ ID NO: 29598 - DNA, 738 bp, Artificial Sequence
  Description of Artificial Sequence: Synthetic coding sequence
atgatcggcgtgtccttcgaggaagctaagagtataattactggcgcaaaactctccactcgcctcgaaagcgcctgggaaattgcttttattcggcaaaagtctgacaacattcagcccgaaaatctgtcttgcacctcgctaatcgaggcctctggcgagtatggtcctcaagccagtacactgtcccttttttcatctcctcctgagattttgattccaaagacctcttctactcctaaaacaaataacgacattctgtcttcatgcgaaatcaaaacggggtacaataagaccgtccagattccaataacctcagagaactcaacagtgggactgtccaacactgatgtggcatccgcatggactgagaattacggactccaagagaaaataagcttgaacccgtcagttcgctttaaagctgaaaagcttgaaatggcactcaactacttagggattcaacctactaaagaacaacaccaagctctcagacaacaggtgcaagcagacagcaaaggtactgtgtccttcggagatttcgtgcaggtcgctaggaacttgttttgcctccagttggatgaggtgaacgttggggctcatgagatttctaacattctcgactcgcagcttttgccatgcgacagtagcgaagcagatgagatggaacgtttgaaatgcgagagagatgacgctttgaaagaagtgaacactctcaagtggccaggacagaactag

SEQ ID NO: 29599 - DNA, 1020 bp, Artificial Sequence
  Description of Artificial Sequence: Synthetic coding sequence
atgatggattcccagcttgtggccggtgtggcatttaaaaagacgttcagctatgcaggatttgagatgcagcctaaaaaataccataacccaaagatcgccctcctgaacgtcgagctggaactgaaggcagagaaggacaatgccgaaatccgagtgcacactgtggaggactaccaggcaattgtggatgccgaatggaacattctctacgacaagctggaaaaaatacatcactccggtgctaaagtggtcctgagtaaactaccgattggcgatgttgctacgcagtattttgccgaccgcgatatgttctgcgctggcagggtcccagaagaagacttaaaaaggacaatgatggcatgcggtggatccatccagactagcgtgaatgcactgagtgcagatgtgctgggccgttgccaggttttcgaggagactcaaatcggaggggagcggtacaacttctttaccggctgtccaaaagctaagacctgtacatttattctgcgcggtggtgccgagcaattcatggaagaaaccgaacgctccctacacgacgcaataatgattgttcgtcgcgcaatcaaaaatgactctgtggtggccggtggcggagccatcgaaatggaactgtccaaatacctgagggactatagtcgtaccattcccggtaagcaacagctgctaatcggtgcttatgcaaaggcccttgaaattatacctcgccagctgtgtgataacgctggctttgacgcaacaaacatcctgaacaagctacgcgcaaggcacgcccagggcggaacatggtacggcgtggatattaacaacgaagacatagccgataactttgaggccttcgtgtgggaacccgctatggtgaggatcaatgctctcactgccgcttcagaagcggcatgcttgatcgtgtccgtcgacgaaactatcaagaatccccgatctacagttgatgctcctactgctgctggaaggggccgaggcaggggcaggccccactag

SEQ ID NO: 29600 - DNA, 768 bp, Artificial Sequence
  Description of Artificial Sequence: Synthetic coding sequence
atggcctcctctgacctggagcagctatgctcacacgtgaatgaaaagatcgggaacatcaaaaagacgctaagcctcaggaattgtggccaggaaccgacattgaagacagttctgaacaaaataggcgacgagattatcgtcatcaacgagctcttaaataagctggagctggagatacagtatcaggagcagaccaataactctctgaaagagctctgcgaaagccttgaggaggactataaggacattgagcacctcaaagaaaacgtcccctcccacctgcctcaggtcactgtgacccagagctgtgtcaagggctcagatttagaccccgaggagcccatcaaagtagaggaaccagagccagttaagaagccccctaaggagcaacggagtatcaaagaaatgccttttattacctgtgacgaatttaatggggtcccctcatatatgaaatcacgtctaacgtataatcagattaacgacgtgattaaggaaattaacaaggctgtcatttccaagtacaagattctgcatcagcctaagaagtccatgaactccgttacacgtaatctgtaccatcggttcatagatgaggaaacgaaggatactaaagggagatacttcatcgttgaagctgacatcaaagagttcactacactgaaggccgataagaagttccacgttctgcttaacatcctcagacactgcaggcggctgtcagaggtccgcggagggggattaacaaggtatgttatcacatag

SEQ ID NO: 29601 - DNA, 441 bp, Artificial Sequence
  Description of Artificial Sequence: Synthetic coding sequence
atggttaattcttgctgtggatcggtgtgcagtgatcagggttgcgaccaggggctgtgtcaggagacatgttgtaggccctcttgctgccagactacctgttgctgtccttcgtgcgtggtaagtagctgctgccggccatcatgcagtcaaactacttgctgtcagacaacctgctgtcgtcccagttgttgccatcccgtttgttgccagacgacctgcagaccctcgtgtggggtctcttcctgctgtcggcctctttgctgccagacaacatgtcatccaagctgcggcatgtcctcctgttgcagaccactgtgttgccagacaacttgcagaccaagttgcggggtgtctagctgttgtaggcccctttgctgccagactacatgctgtcgggcaacctgttgccggccttcatgttgcggctcctcctgttag

SEQ ID NO: 29602 - DNA, 1296 bp, Artificial Sequence
  Description of Artificial Sequence: Synthetic coding sequence
atgacctctgattgcagctcaacccactgttcccctgagtcttgtggcacagcgtctgggtgcgccccagctagctcctgctctgtcgagacagcctgcttacccggtacatgtgcaacctctcggtgccagacaccttcattcctgtctcggtctcgaggcctgacaggatgcctacttccctgttactttacaggtagctgcaatagcccatgtctggttggtaactgtgcttggtgcgaagacggggtcttcacctccaacgaaaaggaaacaatgcaatttctcaatgacagactggcctcttatcttgagaaggttcgatccctggaggaaaccaatgccgagctcgagagtcgaattcaggaacaatgcgaacaggatatcccgatggtgtgtccagactaccaaaggtattttaacaccatcgaagatctccagcagaaaattttatgtacaaaggccgagaatagtcgtctcgcggtgcagctagacaactgcaaactggctactgacgacttcaaaagcaaatatgaaagcgagctttcactccgccagctgttggaggcggatatatcctcgcttcacggcatcctggaagaacttacactctgcaaatcagaccttgaggcacatgtcgagtcccttaaggaggacttgttgtgcctcaaaaagaaccacgaggaagaggtcaatcttctgcgggaacagctgggggaccgcctctcagtggaactcgacactgcccctacactggacttgaacagggtgctcgacgaaatgcgctgccagtgcgagactgtactagctaacaaccgcagagaggccgaggagtggcttgcggtccagaccgaggaattaaaccagcagcagctgtcctccgctgaacagctccagggttgccagatggagattctcgagctgaagcggaccgccagcgccctagagatcgaattgcaggcccagcagtcattgaccgagtctctggaatgtaccgttgctgaaactgaagcacaatactcctctcagttggcccaaattcagtgcctgattgataacctggagaatcagctggctgagattaggtgtgacttggaacgccagaaccaggagtaccaagtcctgctagacgttaaggctcgcctggagggtgagatcaacacgtactggggactgctcgactcagaggactcgcgactctcctgttccccctgttccacgacttgtacgtcctcaaacacctgcgagccctgtagcgcctacgtgatctgtactgtggaaaactgctgcctgtag

SEQ ID NO: 29603 - DNA, 471 bp, Artificial Sequence
  Description of Artificial Sequence: Synthetic coding sequence
atgggctgttgcggttgtagcggcggatgtggtagcggttgcggcggatgtgggtccggatccggaggctgcggaagtgggtgtgggggatgcgggtcaagctgttgcgtcccaatctgttgttgcaagccggtttgctgttgtgtacctgcttgtagttgctcatcttgcgggtcatgtggaggttccaaggggggatgcggttcttgcgggagtagcaaaggcggttgcggctcttgcggatgctcacagagcaattgttgcaagccatgctgctcatcatctggatgcggaagtttctgttgccaatcttcttgttctaaaccgtgctgttgtcaatcctcatgttgccagtcgagttgctgcaagccatgttgctgccaatcctcttgttgtcagagtagctgctttaagccctgttgttgtcagagctcgtgctgcgtgcctgtatgctgccagtgtaaaatctag

SEQ ID NO: 29604 - DNA, 609 bp, Artificial Sequence
  Description of Artificial Sequence: Synthetic coding sequence
atgggctgttgtgggtgcagcggtggctgcgggtcaggttgcgggggttgcggatccggttgcggcggttgtgggagcgggtgcggcggttacggtagcggctgcggcggatgcggatcatcctgttgtgtacccgtttgttgttgcaaaccggtttgctgttgcgttcccgcttgttcctgcagtagctgtggctcttgcggcggatcgaaaggggattgtggcagctgtgggggatcgaagggagggtgtggaagctgtggcggatcaaagggcggatgcggctcatgtggaggttcaaagggcggatgcggttcatgcggaggttcgaagggcggatgcggaagctgcggtgggtcaaagggcggatgcggttcttgtggtgggtccaaggggggatgtggttcctgcggatgctcacagtgcaactgttgcaagccctgctgctgttcaagcgggtgtggcagttgttgtcagtctagctgctgtaacccttgctgttgccaatccagctgctgcgtcccagtgtgttgtcagtccagctgttgcaagccttgctgctgccagtcttcctgttgcgtaccagtatgttgtcaatgtaaaatttag

SEQ ID NO: 29605 - DNA, 498 bp, Artificial Sequence
  Description of Artificial Sequence: Synthetic coding sequence
atgggatgctgcggttgctccgaaggctgcgggagcggatgtggaggttgcgggtcagggtgtgggggatgtgggagtgggtgcggcggatgtggctccagttgctgtgtgccagtctgttgttgtaaacccgtctgctgctgtgtgccagcctgctcatgctcatcttgtgggagttgcggcggatccaaaggcggttgcggaagttgcggtggaagcaaaggagggtgtggctcctgtggcggaagtaaaggaggatgtggtagctgtggttgctcccaatgctcttgttacaaaccttgctgctgttcttcaggatgcgggagcagctgctgccagtccagctgttgcaagccttgctgctgccagtcttcttgctgcaaaccttgttgttgtagtagtggttgcggctcctcctgctgccagagctcttgctgtaatccatgctgtagtcagtctagctgttgcgtcccagtctgttgccagtgcaaaatatag

SEQ ID NO: 29606 - DNA, 3105 bp, Artificial Sequence
  Description of Artificial Sequence: Synthetic coding sequence
atggcaagcgtttttatgtgcggggtggaggatctgctgttcagcgggagccgcttcgtgtggaacctgaccgtgagcacacttagacggtggtataccgagcggctcagagcatgtcaccaggtgctgagaacttggtgtggccttcaagatgtctatcaaatgactgaagggagacattgtcaggtgcacctgttggacgaccgtaggctcgaactgctcgtgcagcccaagctgttagctagggagctgctagatcttgtcgcgagtcactttaatctgaaggagaaggaatatttcggcatcactttcattgacgatacgggccagcagaattggttgcagctggaccaccgagtattggatcacgacctgccaaagaagcctggacccacgattttgcacttcgccgttcggttctatatcgaatccatcagtttcctgaaagacaaaactactgtggaactgttcttcctcaatgccaaggcatgcgtgcataagggccagatagaagtggaaagtgagactatcttcaagctcgccgctttcatactgcaagaggcgaaaggtgattacaccagcgatgaaaatgctcgtaaggacctgaagactctgcccgctttccctactaaaactcttcaggagcacccatctttagcttactgcgaagatcgagtgattgaacactatctcaagatcaaaggcctaacgcgcggtcaggccgttgtccagtatatgaagatcgtggaagcactgccaacttacggagtgcactactacgccgttaaagataaacagggtctaccctggtggctgggaatctcgtacaagggaatagggcagtacgacatccaagataaggtgaagcctaggaaactgtttcagtggaagcagttagagaatctctatttccgggagaaaaagtttgcagtggaggtgcacgatccacggaggatttccgtgtcacgaagaacttttgggcagagcggtctgtttgtccagacttggtatgctaatagcagcctgataaagagcatttgggtgatggccattagccagcatcaattctacctcgaccgaaagcagtctaaagctaagatccctagcgctcgatccctagacgaaatcgcaatggatctcacggaaacaggtactcagcgggcttcaaagctcgtgaccttagagacaaaatctcaatttatcatggcgtccaacggttcgctgatcagttccggctcccaggacagcgaagtgagcgaggagcagaagagggagaagattctcgaactgaagaagaaagaaaaattgctgcaggagaagctcctcaagaaagtggaagagcttaaaaagatctgtctgagggaggccgaactgactggtaagatgcctaaggaatatcctctgaatattggcgagaagcctcctcaggtgaggcgaagagtagggacagcctttaagctggacgacaatctgcttcccagcgaagaggatcccgctttgcaggaactcgaatccaactttctaatccagcagaagcttgtggaggctgcaaaaaagctggctaatgagccagatctctgtaaaactgtgaagaaaaagaggaaacaagattacaccgatgctatgaagaagctgcaggaaatagagaatgctataaacgaatatagaattcggtgcggaaaaaaaccctcacagaaggctacagtccttcctgaagacattatcccatctgagtctagttctttgagtgacacaacaacctatgacgatccttctgacgctttcacatttccagggcagagatcgtcttccgtgccccactccccgaggattctgcctcccaagagcctgggaatcgaacgcatccattttagaaaaagtagcataaatgagcagtttgttgatacacgacagtctcgtgaaatgctgagtactcatagctcaccctacaagacactggaaaggaggccacaaggcggtcgcagtatgccaacaaccccagtgctgacccgtaacgcctactctagcagtcatctggagccagaaagcagttctcagcattgtcgccagcgtagcggctctctcgagtcacagagccatttgctttctgaaatggacagcgataaaccgttcttcagcttgagcaaatcccagagaagctcttccaccgagatcctcgacgatgggtcctcttacacgtcccagtccagcaccgaatactattgtgtgactccagtcacaggcccttactacaccacacagactctggacacacgaacgcggggtagacgcagatccaagaagcagaacgtcagtacaagtaacagcggctctatgcccaatctggcacagaaagactccctgcgaaacggagtgtacagtaagtctcaagaacccccatcaagctcatattatatagccggttacactccgtacgcagaatgcgacttctattattccgggggatacgtgtacgaaaatgacactgaggggcagtacagcgtgaatccctcttacaggagcagcgcccactatggttatgaaagacagcgcgactattcccgctcttttcatgaagacgaagtggacagggtgccccacaacccctatgccacactccgcttgcccagaaaagccgcagccaagtctgagcacatcaccaaaaatatccataaagcactggtggcagaacatttgcggggatggtaccagcgtgcctcagggcagaaggatcagggccatagtccacagacctctttcgactctgaccgtggctcccagaggtgtctgggtttcgccggactgcaggtgccgtgctcccccagctcacgggcttcaagctactctagcgtttcatcgaccaacgcaagtgggaactggcggactcagctgacgattggactgtccgattatgagaccccagctcatagctcctatacatcctgctacggaaacgtgtacaacccactccctagtccaagcaggcaatacactgaaataagccagctcgacggcaccgacgggaaccagctggaagacaacctcgaaagttctgagcagagactgttctggcacgaggattccaaaccgggtactttggtctag

SEQ ID NO: 29607 - DNA, 501 bp, Artificial Sequence
  Description of Artificial Sequence: Synthetic coding sequence
atgttgagccagtcatgtaatctcgaccctttgaccgaaacttacggaatccccttctacctgcagtacttggcccactggcctgagtatttcatcgtggcagaggccccaggcggagagttgatgggctatataatgggcaaagctgaaggatctgtagcgcgagaggagtggcacggacacgttacggctctcagtgtggcccctgaattccggcgattggggctggccgctaagctgatggagctgctggaagaaatatccgaaaggaagggcggattcttcgtagacttattcgtgagagtgtctaatcaggtggccgtgaacatgtacaaacagttagggtactctgtctatcggacggtgatagaatactactcagcatctaacggagaaccggacgaagacgcatatgatatgagaaaggcgttatccagggacacggagaagaaaagcattattccgctgccccaccccgtgcgacctgaggatattgagtag

SEQ ID NO: 29608 - DNA, 399 bp, Artificial Sequence
  Description of Artificial Sequence: Synthetic coding sequence
atgcgtgcctccccctgcatttctcagccagcagcctcatggcatccacgcccaagcgctttgcggccaaccgctggctccggaccagatacccggacacccggaactgtcgaggacggttcggcaccttgtcccgcttttcgatctcccgctgtttctccttgcggagaagagccctgttgctttcagatttccccagctgaagagacacttgagctgggaagactggtgtccccgggtaattgtgacacgctttctcccagagcggcaggattttacgcctgtcacgtcaggagcttgattccctgccggtcaacaaaaggcagatggcccctaacagccagcgctgccggattatcccggcacgcacaatgcgggccatctttaggcctggggtag

SEQ ID NO: 29609 - DNA, 375 bp, Artificial Sequence
  Description of Artificial Sequence: Synthetic coding sequence
atgagggcgagtccgtgtatcagtcagcctgcggcatcatggcaccctcgaccctcagccctcaggcctaccgctggcagtgggcctgacacgcgaaccccaggcactgtcgaggatggttctgccccttgcccggcatttcgttcccctgccgtctccccctgtggcgaagagccttgttgctttcaaataagccccgctgaggaaactctcgagcttgggagactcgtatcaccgggaaattgtgatactctgtcgccgcgagctgccggattttacgcgtgccacgtgcgctccctcatcccttgtcgttcaacaaaggggagatggccccttactgccagtgcagcagggctcagctcgttcagtggctag

SEQ ID NO: 29610 - DNA, 336 bp, Artificial Sequence
  Description of Artificial Sequence: Synthetic coding sequence
ctgatggacctggattctggagatgtcaagaggagagtccacctgttcgagacgcagcgacgcaccaaagaggaggaccccattatccccttcagcgatggccctatcatatccaaatggggcgcaatctctagaagtagccggaccgggtatcacacaacagacccggtgcaggctacggcaagtcagggttccgccaccaaaccaatctcagtgagcggcggtgttcacatggccacaaggccacatcatcagcacacaatgttgaagggaaccgactctctgctgctcatataccttgtgatcgagtcaatccctgtgttgggaacattctag

SEQ ID NO: 29611 - DNA, 399 bp, Artificial Sequence
  Description of Artificial Sequence: Synthetic coding sequence
atgcgcgctagcccgtgcatcagtcagcctgccgcttcttggcatccacggccatctgctctccgccctaccgccggatccgggcctgacactcgaaccccaggcacagtggaggatggatcggcaccctgtccagctttccgtagccctgctgtgagtccgtgtggagaggagccctgctgctttcagatctcacccgctgaagagacccttgagctgggccgtctggtgtctccagggaattgcgacaccctgtcgcccagggccgctgggttttatgcatgccacgttaggtccctgatcccgtgtcggtcaactaaagggagatggccactcacagctagtgccgcagggctcagccgacatgcacagtgcggacccagcttgggtctcggttag

SEQ ID NO: 29612 - DNA, 375 bp, Artificial Sequence
  Description of Artificial Sequence: Synthetic coding sequence
atgcgggcttcaccctgtatttctcagcccgcagcatcctggcaccccagaccgtccgccctccgccctacagcaggctccggacccgatacaagaacccccggtacggtggaagacgggtccgctccctgtcctgctttcaggtcaccagcggtttccccatgtggtgaggaaccatgctgttttcagatatctcctgccgaagaaacacttgagcttggccgtttggtttcaccgggtaactgcgatacgctgagccctagggctgctggcttctacgcgtgccatgtgcggagcctcattccctgccgcagcactaagggcaggtggcccctgacggcgtcagctgctggcctgtcttcattttcaggatag

SEQ ID NO: 29613 - DNA, 1038 bp, Artificial Sequence
  Description of Artificial Sequence: Synthetic coding sequence
atgctgcccaatacgggacgactcgccggttgcactgtgttcatcactggtgcttcgcgtggcatcgggaaggccattgcactgaaggcagcgaaggacggggctaatatcgttatcgcagccaagacagcccagccacaccctaagctgcttggcactatctataccgctgctgaggaaattgaggccgtgggcggaaaagctctcccatgtattgtcgacgtgagggatgaacagcagatcagcgctgccgtcgagaaggctatcaaaaagtttggagcgtacaccattgctaaatacgggatgagtatgtacgtgctgggcatggcagaggagttcaaaggcgaaatagctgtgaatgcactgtggccaaagacggcaatccacactgctgccatggatatgctgggtggccctgggattgaatcacagtgtcgaaaggtcgatattattgctgacgcagcgtacagcatctttcagaaacccaagtcatttacaggtaactttgttattgacgagaacatacttaaagaagagggcatcgagaactttgacgtctatgcaataaaacctggccatcctctccagcccgacttcttcctggacgaatatccagaagctgtttcaaagaaggtggagagcacaggcgctgtcccagaatttaaagaggagaagctgcagctgcagcctaaaccccgttctggtgcagtggaggagacgtttagaatcgtgaaggactctctgagtgacgacgtggtaaaagccacacaagctatctatttgtttgaactcagcggcgaggacggcggaacctggtttctagacctaaagagtaagggcggaaacgtcggatatggggaaccgagcgatcaagcggatgtggttatgtcaatgacaaccgatgacttcgttaaaatgttctctggaaaactgaaaccaaccatggcctttatgtcaggcaaactcaagatcaagggtaacatggcactggcaattaagttggagaagctcatgaaccagatgaatgcacgtctttag

SEQ ID NO: 29614 - DNA, 1257 bp, Artificial Sequence
  Description of Artificial Sequence: Synthetic coding sequence
atgctgcctaatacaggtagactggccggatgcactgtctttatcacgggtgcttcccgaggcatcggaaaagctattgctctgaaggcagccaaagatggtgcgaacatcgtgatcgctgccaagactgctcagccacaccccaagctgctgggcactatctatacagccgcagaggaaattgaggctgtcgggggaaaggcactgccatgtatcgtcgatgtaagagacgaacagcaaatctccgcggctgttgagaaagccattaagaaatttggcggaattgacatcctcgtgaataatgcttccgcgatcagcctcaccaatacactggatactccgaccaaacgtctggacctaatgatgaatgtcaatacccggggtacttacctggcctccaaggcctgcatcccatacctgaagaagtcaaaggtcgcgcacattttgaatatcagtccaccactgaatctcaatcccgtgtggtttaagcagcactgtgcttatacaatcgctaagtacggaatgagcatgtatgtcctcgggatggccgaagaattcaagggcgagattgctgtgaacgctctgtggccgaagacagctattcataccgccgctatggacatgctgggcggaccgggtatagaatcacaatgtcgcaaggtcgatatcatagcagacgctgcctactctatctttcagaaaccaaaatccttcaccgggaactttgtaattgatgaaaatatcctcaaggaagaagggatcgaaaactttgatgtctatgccataaaacctggacatcccttgcagcccgacttttttttagacgaatacccagaagccgtgagcaagaaggtggaaagtacaggagcggtaccagaattcaaggaagaaaaactccagctgcagcccaaaccccgtagcggggctgtcgaggaaactttcagaattgtgaaagacagcctgtcagatgacgtggttaaggcaacccaggcaatctatcttttcgagctgagcggcgaagacggagggacctggttcctggacctcaaaagtaaggggggtaacgttggatacggagagccttccgaccaagccgacgtggtgatgagtatgaccaccgatgattttgtgaagatgttcagtggaaagctgaaacctacaatggctttcatgtctggcaaactgaagattaagggaaatatggccctggcaattaaattggagaaattaatgaatcagatgaatgccaggttgtag

SEQ ID NO: 29615 - DNA, 1077 bp, Artificial Sequence
  Description of Artificial Sequence: Synthetic coding sequence
atgccaggatgcgaattaccagttggaacttgtcccgacatgtgcccggctgctgaaagagctcagcgcgaaagggagcacaggttgcataggttagaagtggttcccggttgtaggcaggatccccctagggccgacccacagagggccgtcaaggagtattcccgcccagccgctgggaaacccagacctcctccctcccaattgcggcctccatctgtcctactggctacggtgcgctatctggcaggagaagtcgctgagtcagcggacattgctcgagcagaagttgcaagctttgttgcagataggctcagggccgtgttgttagacctggctttgcagggggcaggagacgccgaagccgcagtagtgcttgaggcagctttggccactctgttgaccgtcgtcgccagacttggccctgatgcagcccgtgggcctgcggatccagtgctgcttcaggcacaggtccaggagggcttcggtagcctgaggagatgctacgctcggggagccggtccacatcctagacaacctgctttccaggggctgtttctattgtacaacttgggctctgtcgaggctctgcacgaggttcttcagttaccggctgccttgcgggcttgtcctccactccggaaggctctggccgtcgatgctgccttcagagaagggaacgcagcaagactgtttcgcctgctgcaaaccctgccttaccttcccagctgcgcagtgcagtgtcacgtaggccacgccagacgtgaggcactcgccaggtttgccagagccttttcaaccccgaagggtcagacgctgcctctagggtttatggtaaacctgcttgccttagacgggctccgcgaggccagggatttgtgtcaggcccatgggctgccgctcgacggagaggaaagggtggtgttcctgcggggtcggtatgttgaggagggcctccctcccgcttctacatgcaaagtgctggttgagagcaaactgcgcggacgtacactggaagaagtcgtcatggccgaagaagaagacgaaggcacagatcgccctgggtctcccgcttag

SEQ ID NO: 29616 - DNA, 150 bp, Artificial Sequence
  Description of Artificial Sequence: Synthetic coding sequence
atgtcctcctgcgtgagttcccaacccagtagtaatcgcgctgctcctcaggacgagctgggcggaagaggttcctctagttctgaatcacagaaaccttgcgaggccctccgcggactttcaagtctgagcattcacctgggcatgtag

SEQ ID NO: 29617 - DNA, 2598 bp, Artificial Sequence
  Description of Artificial Sequence: Synthetic coding sequence
atgcccgcagtatcattgcctccaaaggagaacgccctgttcaaacgtattctacgttgctacgaacataagcagtatagaaatggtctgaagttttgcaagcagatcctcagcaaccctaaatttgcagaacacggggaaacactcgcgatgaaggggctgaccctcaattgtctagggaagaaggaggaagcctacgagctggtgcggagaggcctacggaacgatctaaagtctcatgtgtgttggcatgtctacggtcttctgcaaaggagcgataagaagtacgacgaggccattaagtgctatcgcaacgccctcaagtgggataaggataatcttcaaattctgcgagatctgtcgctccttcaaatccagatgcgggatttggagggataccgggaaacccgatatcaacttctgcagttgaggcccgcacagcgggcatcttggattgggtatgcaattgcctaccatctgctcgaggattacgaaatggcggctaagattttggaggaatttcggaaaacgcagcagaccagccccgataaggtcgactacgagtatagtgagctgctgctctatcagaaccaggtcttgcgcgaggccggtctctaccgggaagctctggagcatctctgtacatacgaaaagcagatctgcgacaagctcgcggtcgaagaaacaaagggcgagttactgctgcagctctgtcgtctcgaagatgcggcagacgtataccggggactccaggaacgcaacccggagaattgggcatactataaaggccttgaaaaagccttgaaacctgccaatatgctagaaagactcaagatctacgaagaggcatggactaagtacccgaggggcctcgttccacgacggctgccactcaacttccttagtggcgaaaagttcaaggaatgcttggacaaatttttaagaatgaatttctccaaggggtgtccgccagtgtttaatactctgcgatctctgtacaaagacaaagagaaggtggcaatcattgaggagttagtggtaggctacgaaacctctctgaaatcttgcagactgtttaatccaaacgacgatgggaaagaggagccaccgaccactttgctctgggtgcaatattacctggctcagcattacgataagattggacagccttcaattgctttggaatacataaatacagctatcgagtcaacacccacactcattgagctgttcctggtaaaggctaagatctacaagcatgcaggtaacatcaaagaggccgctcgctggatggatgaagcccaagcactcgacactgcggaccggttcatcaactccaagtgcgcaaagtacatgttgaaggccaatctgatcaaagaagcggaggaaatgtgctccaagttcactcgcgagggcacatccgctgtcgaaaatctgaatgagatgcagtgcatgtggttccaaactgaatgtgcccaggcctataaagccatgaataagttcggcgaggcactgaaaaaatgtcacgagatcgaaagacactttattgagatcactgatgatcagttcgatttccatacctactgtatgcgaaagataacgctccgatcatacgttgatctgcttaagcttgaagatgtgttgcgtcaacaccctttttacttcaaggccgcacgaatagctattgagatctatctcaagcttcacgacaatccgcttactgacgaaaacaaagagcacgaggctgataccgctaacatgagcgataaggaactgaaaaagctgcgcaacaaacagcggcgagctcagaaaaaggcccagatagaagaggaaaagaagaatgcagaaaaagaaaaacagcagcggaaccagaaaaaaaagaaagacgatgatgatgaagagattggcggacccaaggaggaactgattccggaaaagctggccaaggttgaaacaccgctggaggaggctatcaagttcctcactcccctgaaaaacttggtgaaaaataaaatcgaaacacacctgtttgctttcgaaatatatttcagaaaagagaagttcttgcttatgttgcagtccgttaaacgcgcttttgcaatagactcctctcatccatggctgcatgaatgcatgatcagactattcaacacagtctgtgagagtaaggatctttcagacactgtgaggactgtactcaaacaggaaatgaaccggttgtttggtgccaccaaccccaaaaactttaatgagaccttcctgaagcgaaattctgacagtctcccccacaggctctccgccgctaaaatggtgtactatctggacccaagcagccagaaaagggctatcgagctggcaacgactcttgacgaatctttgacaaaccggaatctccaaacttgcatggaagtgttggaagcgctgtatgacggaagtctgggagactgcaaagaggcggcagagatttaccgagcaaattgccacaagctgttcccctacgcattggcttttatgccgcctggttacgaagaggatatgaaaatcacagtgaacggtgacagctccgctgaagcggaggagctggctaacgaaatctag

SEQ ID NO: 29618 - DNA, 1797 bp, Artificial Sequence
  Description of Artificial Sequence: Synthetic coding sequence
atgggcggatgcttttcaaaacccaagcctgtggagctcaagattgaagtggtgcttcccgaaaaggaaaggggtaaagaggagctgagcgcatctggcaaggggtcacctcgggcttaccaagggaatggtaccgcccgacactttcacaccgaggagcgtttatccaccccacacccgtatcccagcccccaggactgcgtcgaggccgctgtgtgccacgtaaaagacctggaaaatggccagatgcgagaagtggaacttgggtggggcaaggtgctcttggtgaaggataacggggaattccacgctttaggacacaaatgtccgcattatggtgctccacttgtgaagggcgtcctgagtcggggtcgcgttcggtgtccctggcacggagcatgctttaatatatctaccggagacctcgaagatttcccaggtctggatagccttcataagtttcaggtgaaaattgaaaaagaaaaggtgtatgtacgtgcgtcgaagcaggccctgcaactccagcgcagaacaaaagtcatggccaaatgtattagcccctcagcagggtactcatcttccaccaacgtgttgatcgtcggagcaggcgcagcgggtcttgtatgcgcagaaacattgcgccaagaggggttttcagaccgaattgtcctgtgtacccttgatagacacctcccctatgaccgccctaaattaagtaaaagcttggatacacaacctgaacagttggctctgaggcccaaggagttttttagagcatatggtatagaagtcctaacagaggcccaggtcgtgaccgtggacgtgcgaaccaaaaaggtcgtgtttaaagatggcttcaaactcgagtacagtaaactgctgctcgcgccaggttctagtccaaaaaccctgagttgcaagggcaaagaggtggaaaacgtcttcactattcgaaccccagaggacgcgaatagagtggtccgccttgctaggggaagaaacgtggtcgtcgttggggcaggattcctgggcatggaggtagctgcctacctgactgaaaaggcccatagcgtctccgttgttgagttagaggagacccccttccgcagatttctgggagagagagtaggcagggcactaatgaagatgttcgagaataatcgcgtaaaattctacatgcagacggaggttagcgagctcagaggccaggagggcaaactgaaagaagtcgtgctgaaaagctctaaggttgtgagagctgacgtgtgcgtggttgggataggtgccgtgcctgccaccggtttcctgaggcagtccgggataggattagattccagaggattcatccccgtgaacaagatgatgcagaccaacgttcccggagtgtttgccgcaggcgacgcggttactttccctttggcctggcgtaacaataggaaggttaatattccccactggcagatggcacacgctcaggggagggtggcagctcagaatatgctggcccaggaagccgaaatgagtactgttccttatctgtggaccgccatgtttggaaagagtctaaggtacgccggttacggcgagggcttcgacgatgtcattatccagggtgacttggaggaactgaaatttgtggccttttacacgaagggggacgaggtgatagctgtagcttccatgaactatgacccaattgtgtcgaaggttgccgaagtgctcgcgtcgggtcgagccattcgcaaacgagaggtagaaacaggcgacatgtcttggctgacagggaaaggttcatag

SEQ ID NO: 29619 - DNA, 1818 bp, Artificial Sequence
  Description of Artificial Sequence: Synthetic coding sequence
atgggcggatgcttctcaaagcctaagccagtagagctgaaaatcgaagttgtgctgccagagaaagaaaggggtaaagaagagttgtcggcctctggcaaggggtcaccgagggcgtaccagggtaacggcacagccagacatttccacacagaggagaggttgagcactccccacccctatccgtcccctcaggattgcgttgaggcagccgtgtgtcacgtaaaagatttggagaacggacagatgcgcgaggtcgaactaggctgggggaaggtgctcctggtgaaagacaatggagaatttcacgcgctggggcacaagtgtccgcactacggggctcccctggtgaaaggagtgctgagtcggggacgagtgcggtgcccttggcacggagcctgttttaatatctctaccggtgatctggaggattttccaggcctggattcactgcataagtttcaggtcaaaatcgagaaagagaaggtgtacgtgcgagctagtaagcaagcattgcagctccaacgcaggactaaggtcatggcgaagtgtatatccccctcagctggatattcctctagcacaaacgttctgatcgtgggcgcaggagccgctggactagtgtgcgccgagacactgcgtcaggagggtttttctgataggatcgtgctatgtacattagatcggcatctgccctacgatagaccgaaattaagcaagagtctcgacacccagccagaacagctcgctcttaggcccaaggaattcttccgcgcatacggcatcgaagtcctgacagaagctcaggtggtgaccgtggacgttaggaccaagaaagtagtgtttaaggatggatttaaattagaatacagtaaacttctgctggcgccaggaagctcccctaagaccctgtcatgcaaaggcaaggaggtggagaacgtgtttactattaggacaccggaagacgctaatcgcgtagtcaggcttgcccgaggacgaaatgttgtggttgtgggcgctggcttccttggaatggaagttgcagcttacttgaccgaaaaagcacacagtgtatccgtggtagagcttgaagaaacaccgttcagacgctttctcggagagcgagttggacgcgctctgatgaagatgtttgaaaataaccgcgtgaagttctatatgcagactgaggtctccgagctgaggggccaggaaggcaagctgaaagaagttgtgctgaagtcatctaaagtggtccgggctgacgtgtgcgttgtcggcatcggggctgtgcccgcaacaggattcctgaggcagagcggaattggactagactccaggggatttattccggttaacaagatgatgcagaccaacgtgcccggagtgtttgccgctggtgacgcggttactttcccactggcgtggcggaacaaccggaaagtgaacattcctcactggcagatggcccacgcccagggcagggtggcagcccagaacatgctcgcccaggaggcagaaatgagtacagtgccgtacctgtggactgccatgtttggcaagagtctgaggtacgctgggtacggagagggttttgatgacgtcatcatacagggtgacctggaagaattgaagtttgtggcgttctacacgaagggagacgaagtgatcgccgtagcatcaatgaattatgatcccatagtgtccaaggttgccgaagtgctggcgtcaggacgggcaatacgcaaaagagaagtagagctgttcgtgctgcatagcaaaactggggatatgagctggctgaccgggaaagggagctag

SEQ ID NO: 29620 - DNA, 1374 bp, Artificial Sequence
  Description of Artificial Sequence: Synthetic coding sequence
atgaatcaaccttgtaactcaatggaaccgagagtcatggacgacgatatgctgaaactggcagtcggggaccagggacctcaggaagaagctggacagttggcaaaacaggagggcatcctctttaaagacgtgctctcccttcagcttgattttcggaacatcctccggatcgataatctgtggcagttcgaaaacctgcgaaaactacaactcgacaacaatatcattgagaaaatcgaagggctcgagaatttagcgcatttggtgtggctagatcttagttttaacaacattgaaacaatcgaaggcctggacaccctcgtcaatctggaggatctgtcattattcaacaatcgtatttctaaaatcgactccctggacgcgctggttaagctgcaggtgctctccctgggaaacaatcggatcgataatatgatgaacataatttaccttaggaggttcaagtgtctccgaacgctgtcgctgagccgtaacccaatctctgaagcagaagattacaagatgttcatatgcgcttatctgcccgacctgatgtacctagactatcgcagaatcgacgatcataccaagaagttagctgaagccaagcaccagtattcaatagacgagctcaagcatcaggagaacctcatgcaggctcagcttgaagatgaacaagcccagagggaagaactcgagaagcacaagactgcctttgtcgagcatctgaacgggagtttcctgtttgactctatgtacgcagaagactcagagggtaacaaccttagctacttgcctggggtcggggagttgctcgaaacttacaaggacaagttcgtgattatctgcgtgaacatattcgaatatggcttaaagcaacaggaaaaaagaaagactgagttggatacgttcagtgagtgcgtcagagaggccattcaagagaatcaagagcaaggtaagcgaaaaattgccaaatttgaggagaagcatttatcatcactgagcgcaatcagagaggagctggaattgcccaacatcgaaaagatgatccttgagtgtagtgctgatatttccgagctctttgatgcactgatgactcttgaaatgcaactggtcgagcagttggaagaaactatcaacatgtttgagagaaatatagtcgatatggtggggttgtttatagagaacgtgcagtcattgatggcgcagtgcagggacttagagaatcaccatcacgaaaaactgttagagatcagtatctccacactggaaaagattgtagagggcgacttggatgaggatcttccgaacgatctgcgcgcagggaggtttcaaaagtttaactacgttgaggcttcgggcactttctag

SEQ ID NO: 29621 - DNA, 1374 bp, Artificial Sequence
  Description of Artificial Sequence: Synthetic coding sequence
atgaatcagccctgcaactctatggagcctagggttatggacgacgatatgctgaagcttgcggttggagaccagggcccacaggaagaggctgggcaactggctaaacaggagggcattctgttcaaggatgtgttgagcctgcagttggactttcggaacatactgaggatagacaatctatggcagtttgagaatcttcgaaaactccagttagacaataatattatcgagaaaatagaaggactggagaatttggcccacctggtctggctcgacttaagttttaataacattgaaacaatcgaggggctggacaccctcgtgaacctagaggatctatcattgttcaataatagaatcagcaagattgacagcctcgatgcgctggtgaaactccaggtgctgagcctggggaacaatagaattgacaacatgatgaacataatctacctgcgacgttttaaatgtctgagaacattaagcctctcaaggaaccctatctccgaggccgaagactataagatgttcatctgtgcataccttcctgacctgatgtatctggactaccggagaatcgatgatcatacaaaaaagttagccgaggccaagcaccagtacagcatcgacgagctgaaacaccaggagaacttgatgcaggcacagctcgaggatgagcaggcccagagggaggagctggaaaaacacaagaccgcttttgtcgaacatctgaatggaagttttctcttcgatagtatgtacgcggaggactccgaggggaacaatttgagttacctgccaggagtcggcgagctcctcgagacttacaaagacaagtttgttatcatatgtgtcaatatttttgagtacgggctaaagcagcaggagaaacgaaagacagaattggatactttctctgaatgtgtacgcgaagccatacaggagaatcaggagcaggggaaaagaaagatcgcgaaattcgaagaaaaacacctgtcatcgctctctgcgataagagaggagctggaactccccaacattgagaagatgatcctggagtgttctgctgacatctccgaactgtttgacgcactaatgacgttagaaatgcagcttgtcgagcaactcgaagagaccatcaatatgttcgaacgaaatatcgtggacatggtgggcttattcatcgagaatgtgcagtccctcatggcccagtgccgagacctggaaaatcaccaccacgagaaactattggagatcagcatcagtaccttggagaagatcgtcgagggcgacttggatgaggatttgccaaatgatctgagagcaggcagattccagaagtttaattatgtagaggctagtgggacattttag

SEQ ID NO: 29622 - DNA, 1572 bp, Artificial Sequence
  Description of Artificial Sequence: Synthetic coding sequence
atgaatcagccctgtaattcgatggaacccagagtgatggacgatgatatgctcaaattagcagtgggcgaccagggccctcaagaggaagctggtcaactggctaagcaggaggggatcttgttcaaagacgtgctgtctcttcaattagatttcaggaatattctcagaatcgacaatctgtggcagtttgagaacctgcggaaactgcagctagacaataacataatcgagaagattgaagggttggaaaatcttgcacaccttgtttggctggatctcagctttaacaacattgagacaattgaaggacttgacaccctagtcaacttggaggacttgtcgttattcaataatcgaatcagcaaaattgatagtctggacgcactggtgaaacttcaagtcttgtctctgggaaacaatagaatcgataacatgatgaacataatctacctgcggaggttcaaatgtctccgcacattgagcctgagccgtaatcctatctctgaagccgaagattataagatgttcatttgtgcctacctacctgatctcatgtacctggactatagaagaattgacgatcacaccaagaagctggccgaagccaagcaccaatactcaatagatgagctgaagcatcaggagaacctcatgcaagcccaactggaagacgagcaggctcagagggaagaactggagaaacacaaaacagcctttgtggagcatttgaacggctcgtttctatttgattcaatgtacgcagaagacagtgaaggtaacaacctgtcctacctccccggagtgggcgagctcctggagacttacaaagacaaatttgtgataatttgtgtgaacatctttgagtatggcctgaaacagcaggagaaacgcaaaaccgagcttgataccttctctgagtgtgtgagagaggcaatccaggaaaatcaggaacaaggcaaaagaaagattgctaagttcgaggagaaacatttatccagcctgtcagcaatcagagaagaactcgagctgccaaacatagagaaaatgatcctggagtgctccgcagacatttctgagctgttcgatgctttgatgaccctcgaaatgcaacttgtggagcagttagaggagactattaatatgttcgagcgcaatattgtggacatggtgggcctgttcattgagaatgtgcagtctctgatggctcagtgccgcgacctcgaaaatcaccaccatgagaaactgcttgaaatttctatttcaacactcgaaaaaattgtggaaggcgatctggatgaggacttacccaacgacctccgagctctgtttgtggacaaggatacaattgttaacgcagtgggtgcttctcatgatatccacctcttgaagatcgataacagagaggatgagctagtcacaaggattaactcttggtgcacacgactcattgacaggatccacaaggacgagatcatgagaaacaggaaacgcgttaaggagatcaaccagtacatagaccacatgcagtcggaattagacaatctggaatgcggtgacatattggattag

SEQ ID NO: 29623 - DNA, 1572 bp, Artificial Sequence
  Description of Artificial Sequence: Synthetic coding sequence
atgaatcagccatgtaactctatggaacctcgggttatggatgatgacatgctgaaacttgcagtaggagatcagggccctcaggaggaggccggacagttggctaaacaagagggaatactctttaaggacgtgttatcccttcagttagattttcggaacattctgcgtatcgataacttatggcagttcgagaatttacgtaaactgcaattagacaacaacatcatagaaaaaattgaaggactcgagaatctagctcatctagtgtggctcgacctgtcatttaacaacatcgagactatcgaggggctcgacaccttagttaatctggaagacctgagcctgttcaacaaccggatctcaaaaatcgatagcctggacgccttggtgaagcttcaggtgttgagtctgggaaacaataggattgacaacatgatgaatattatctacctgagacgatttaagtgcctccgcactttatctttgtctagaaaccctatctctgaagccgaagattacaaaatgttcatatgtgcctacctgcctgatctgatgtatctcgattaccgcaggattgacgaccatacaaagaagctagccgaggcgaaacaccagtactcaattgacgaacttaaacaccaggaaaacctgatgcaggcgcagctggaggacgagcaggctcaacgggaggagttagagaagcataaaacggccttcgtcgagcacctaaatggttcctttctcttcgattctatgtatgctgaagattccgagggaaataatctgtcctatttgccaggagtgggtgaactgctcgagacttataaggacaagttcgtgattatttgtgtgaacatatttgagtacggacttaaacaacaggaaaagaggaagaccgaacttgacactttctccgagtgcgttagagaggctattcaagaaaaccaggagcaggggaagaggaaaatagccaaatttgaagaaaagcacctttcaagtctttctgccattcgtgaagagctcgaacttcctaacattgagaagatgatcctggagtgtagtgcggacattagcgagttgtttgacgccctaatgacactagaaatgcagctggtcgagcagcttgaggaaacaattaatatgtttgagaggaatatcgtagatatggtaggccttttcatagaaaatgtgcagtccctgatggcgcagtgcagagacctggagaatcaccatcacgaaaagctgctggaaattagcataagtacgctggagaagatcgtcgaaggagacttagacgaagacctgcctaacgacctccgggcattgttcgtggacaaggacaccattgtgaatgcagtgggcgcaagccatgacatccacctgctgaagattgacaatagggaagatgagctagtgactcgcataaattcctggtgtaccaggcttatcgaccggattcataaggatgaaatcatgagaaataggaaaagagtgaaggagattaaccagtacatcgatcacatgcagtctgaactggacaacctggagtgtggggatatcctcgattag

SEQ ID NO: 29624 - DNA, 1842 bp, Artificial Sequence
  Description of Artificial Sequence: Synthetic coding sequence
atggcaactattcctgattggaaattacagctgctagcgcgacggagacaggaagaagcttctgtcagggggcgagaaaaggcagagagggaacgcctttcccagatgcctgcctggaagcgaggactgctagaacgaaggagagccaaactagggctgagccccggagagccatcccctgtgctgggcactgtcgaagccggaccaccagatcctgacgagagcgccgtcttgctggaagccattggcccagtgcaccaaaaccgctttatccgacaggaacggcagcagcaacagcagcagcagcagcgtagcgaagagcttctagccgagcggaagccaggcccactggaggccagggagaggagaccctctcctggagagatgcgagaccagtcccctaagggcagagaaagccgggaggaacggttatccccacgcgagactcgtgaaagaaggctgggaatagggggagcccaggagctttctctccggcctttagaagctagagactggagacaatcacccggagaggttggggatcgtagttcccgcctctcagaagcatggaaatggcggctctccccaggcgagacccccgagcgatcactacgacttgctgagtctcgcgaacagtcacctcggcgtaaagaagtggagtcccgcctcagcccaggtgagtccgcgtaccaaaagctggggttgaccgaggctcacaagtggcggccagactcaagggagagccaggaacagagtcttgtgcaactggaggcgacggagtggcggcttcggagtggcgaggagagacaggactatagcgaggaatgtggcagaaaggaggagtggccagtcccaggggtggcccctaaggagaccgccgagctgtctgagacgctgactcgggaggcgcaagggaactcttcagcaggcgtggaagccgctgagcagaggcctgtggaggacggggagagagggatgaaaccaactgaagggtggaaatggactttgaacagcggaaaagccagagagtggactccgagagacattgaggctcagacacagaaaccagagccgccagagtccgccgagaagttactggaaagccccggtgtcgaggccggtgagggggaagctgagaaggaggaggctggggcacaaggccgtcctctccgtgctctccagaactgctgcagtgttccctcccctctgcctccagaggatgccggaacaggaggtttgcgacagcaggaggaggaagctgtggaattacagcctcccccaccagccccactgagccccccacccccagctcccaccgctccgcagcccccaggggacccccttatgtcacggctgttctatggcgtcaaagcaggccctggggtgggagcaccccgacgcagtggccacacctttaccgttaatcccaggcgctccgtgcctcctgccaccccagccactcctactagccctgctactgtcgacgcagccgtcccaggcgcagggaagaaaaggtatcccaccgccgaggaaattctagtcctcggcggatacctgaggctctccagatcttgtctggccaaggggagtcctgagagacaccacaagcagctaaagatctccttctctgagacggctctggaaacaacataccagtatccttccgaaagttctgtactggaggaattggggcctgaacctgaggtgccctctgctccgaatcctcctgccgcacagccagacgacgaggaggacgaagaggagttactgctgttgcagccagagcttcaggggggtctccgaacaaaggctctgattgtggatgagtcttgtcgaaggtag

SEQ ID NO: 29625 - DNA, 390 bp, Artificial Sequence
  Description of Artificial Sequence: Synthetic coding sequence
atggccgagttgatccagaaaaagctacagggtgaggtggaaaagtaccaacagctgcagaaggatctctctaaatcaatgagtgggcgacagaaactggaggcccaactgacagaaaacaacatcgtgaaggaggaactggctctgcttgacggaagcaacgtggtgtttaagctgctcggacccgtccttgtgaagcaggagctgggtgaagcgcgtgccacagtgggcaaaaggctcgactacatcacggccgaaatcaagcggtacgagagccagctgcgtgatctggaaaggcaatccgaacagcagcgggagaccctggcccagttgcaacaagagttccagagagcacaagccgcaaaagcgggtgcgcctgggaaggcatag

SEQ ID NO: 29626 - DNA, 390 bp, Artificial Sequence
  Description of Artificial Sequence: Synthetic coding sequence
atggctgagctgattcagaaaaagctccagggggaggtggagaaatatcagcaacttcaaaaggacctgtcaaaatccatgagtggccgacagaagctcgaggcccagcttacagagaacaacattgtcaaagaggaactggctttattagatggctctaacgtcgtgttcaagttgctcggcccagtgcttgttaaacaggagctgggagaagcccgtgccactgttggaaaaagactggattatataaccgccgaaatcaaacggtacgagagtcagttacgtgatcttgagcgacagtccgagcaacaacgtgagactctcgcccagctacagcaagagttccagagggcacaggcagccaaagccggagccccaggaaaggcctag

SEQ ID NO: 29627 - DNA, 4128 bp, Artificial Sequence
  Description of Artificial Sequence: Synthetic coding sequence
atggttcccggtgaagagaaccaactggtaccgaaagaagacgtgttctggcgctgccgccagaacatcttcgacgaaatgaagaaaaagttcttgcagattgaaaatgctgcagaagagcctcgcgtgctgtgcatcattcaggatacgactaactcaaagaccgtgaatgagaggattacgttaaatttgcccgcttctacacctgtccgtaagctgttcgaagatgtagccaacaaagtggggtacattaatggtaccttcgatctcgtgtggggcaacggcattaatacagctgacatggcgcctcttgatcatacatcagataaaagcctcctggatgctaatttcgaacctgggaagaaaaacttcctccacttaacagacaaggacggggagcagccacagattctgttggaagattcctctgccggtgaagacagcgttcacgaccggttcattggaccgctaccacgtgaaggtagcggtggttcaacgtccgattacgtgtctcagagctattcctatagtagcatacttaacaagtctgagactggctacgttgggctcgtgaatcaggctatgacctgttatctcaacagtcttctccagaccctgttcatgaccccggagttccgcaacgctctgtacaagtgggagttcgaggaaagcgaggaggatcccgtgaccagtattccctatcagcttcaacgcctttttgtgttgctccaaacttccaagaagagggctattgagactacggacgtgacacgctcctttggatgggattcgagcgaggcttggcagcagcacgacgttcaggaactatgcagagtcatgttcgacgcgctggagcagaagtggaaacagaccgaacaggccgatctaatcaacgagctgtatcagggcaagttgaaggactatgttaggtgcctggagtgcggctatgaaggctggcgcattgacacatacctcgacattccactagtgatccgtccctatggctcaagccaggctttcgcctccgtggaggaggcgctgcatgcgtttattcagcctgagatcctggacgggccaaaccagtatttttgcgagagatgcaagaaaaagtgcgacgctcgcaaaggccttcgcttcctccatttcccatatctactgaccctccagctgaagcgcttcgatttcgactataccaccatgcatagaatcaagctgaatgatcgaatgacttttccagaagaactggacatgagcacctttatcgacgttgaggacgaaaagtctcctcagaccgagtcttgcacagacagtggagcagaaaatgagggatcatgccacagtgaccagatgagcaacgatttctcaaacgatgacggagtggacgagggaatctgtctagaaaccaattcgggaaccgaaaaaatcagcaagtctggcctggagaagaattctctcatctacgagctgttctcagtgatggtgcacagtggaagtgccgctggcggtcactactacgcatgcatcaaatctttcagcgacgaacaatggtactcctttaacgatcaacacgttagtcggataacccaggaagatattaaaaagacacacgggggatcaagcgggtcccggggttactactcaagcgctttcgcatcttccaccaacgcatacatgctaatctaccggcttaaggatccagcaagaaacgctaagtttctggaggtcgacgagtatccagagcacatcaaaaacctcgtgcagaaggaaagggaattagaggagcaagagaaacggcaaagagaaattgagaggaatacttgtaaaattaagttattctgcttacaccccacaaagcaggtcatgatggaaaataagctggaagtgcataaagataaaactctcaaggaggctgtggagatggcttacaagatgatggatttggaggaggtgattcctttggactgttgcagactggtgaagtatgatgaattccatgattatctcgagaggagctacgagggggaagaagacactccgatgggtctgctgttgggaggtgtaaagagtacatatatgtttgacctacttctggaaacccgtaagcccgaccaggtgtttcagagctacaaaccgggtgaggtcatggtgaaagtgcacgtggtagatctgaaggcggaatctgtggctgcccctataactgtgagagcctatctgaatcagactgtcacggaatttaaacagttgatttctaaggctatacacttgccggctgagaccatgcgcattgtgttggagcggtgttacaatgacctaaggctgctctcagtgagttcaaaaacactgaaggccgagggcttttttcggtcaaacaaagtgttcgtagaatcttccgaaacactggattatcagatggcctttgctgatagccatctatggaagctcctggatcggcacgccaatactatccgattgttcgtgctcctgcccgagcagtccccagtgtcatacagcaagaggacggcgtatcaaaaggcagggggagatagtggtaatgtggatgacgactgtgagagggtgaagggcccagtagggtcactcaagtcagtggaagcaattttggaggagagcacagaaaagctcaagagcttgtctctgcagcagcagcaggatggcgacaacggcgatagcagtaagtctacagaaacttcagacttcgagaacattgaatccccacttaacgagcgggatagctctgcctctgtcgacaaccgggaactggagcagcacatccagacctccgaccccgagaactttcagtcagaggagcggagcgattctgatgtgaataacgaccggtccacctcttctgtggatagcgacatcctttcctcttcccatagttcagacacgctgtgtaatgccgacaacgcccaaattcccctagctaatggtctggactcacactctattacctcttcaaggagaacgaaggctaatgaagggaagaaggaaacttgggatacggcagaggaagactctggcactgattccgaatatgacgagtctgggaagtctagaggcgagatgcagtacatgtattttaaggcagaaccatacgccgctgacgagggttcgggggaggggcataagtggctcatggtgcatgtggacaaaaggattaccctggctgccttcaagcagcatttggagcctttcgtaggtgtgctcagcagccattttaaggtgttcagagtgtacgcttccaaccaagagttcgaatccgtgcgacttaatgaaaccctgtcaagcttttccgatgacaataaaattactatacggctcggccgtgccctgaagaaaggagagtatcgggttaaagtttatcagctcctcgtgaacgagcaggagccatgcaagtttctgctagatgcggtgtttgctaagggcatgacagtacgtcagtctaaagaggaactcatcccccagctgagagaacaatgcggtctggagctgagtatcgaccggtttcgtctgagaaagaaaacttggaagaacccaggaactgtttttctggactatcacatatacgaagaggatattaatatctcctccaattgggaagtttttctggaggtacttgatggcgtggagaaaatgaagtccatgagtcaactggccgtgctgagtagaagatggaagccctccgaaatgaaactcgatccctttcaggaagtggtcctcgaatctagctcagtagatgagctaagggagaagctgtctgagatttccgggattcctctggatgatatcgaatttgccaaggggagaggtaccttcccctgtgatatttccgtgctggacatccatcaggacttagactggaatcctaaagtcagtacactgaatgtatggcccctgtacatttgcgatgacggagccgtcattttttacagggataaaactgaagagctgatggaattgactgatgagcagcgaaacgagctcatgaaaaaagagagctcgcgcttgcagaaaaccggccatagagtaacctactcgcccagaaaggaaaaggctctcaagatctatctggacggcgctcccaacaaggatctgacacaggactag

SEQ ID NO: 29628 - DNA, 600 bp, Artificial Sequence
  Description of Artificial Sequence: Synthetic coding sequence
atgaggaccgcggatagggaagcgaggcctggactcccgtctctgttactcctcctcctcgccggagccggtctgtccgccgctagccccccagccgcacctaggtttaatgtgagtctggacagcgtgcctgagctgagatggctgcccgtcctccgccactacgatctcgatctggtcagagccgctatggctcaggtgattggcgacagggttcctaaatgggtacacgttcttatcggcaaggtggttttagagctggagaggtttctgccccagcctttcaccggagagattcgaggcatgtgtgatttcatgaacctgtctttagctgactgcctgctggtgaatctggcctacgaatcctccgtgttttgcacttccatcgtggcccaggactcccggggacatatctaccacgggaggaacctggactatcccttcggcaatgttctcagaaagctgactgtagacgtgcaattcttaaagaatgggcagatcgcctttactggaaccacattcatcgggtatgtcggcctgtggacggggcagtctccccacaaatttacggtgtccggcgacgaacgcgacccccattag

SEQ ID NO: 29629 - DNA, 972 bp, Artificial Sequence
  Description of Artificial Sequence: Synthetic coding sequence
atgcgaacagcggacagagaagccaggcccggattgccatctctcttgctcctcctgctcgcgggagctgggctgagtgccgcatcaccaccggctgcccctaggtttaatgtctctttggactccgtccctgaacttcgctggctgcctgttcttagacactacgatctggatctggtgcgcgcagccatggcacaagttataggcgatagggttcccaaatgggtccatgtgctcatcggcaaggtcgtgttagagctggagcgattcttgcctcagcccttcacgggcgagatccgcggtatgtgcgactttatgaacctgtctctcgcagattgtctgcttgtgaacctcgcctacgagagttcagtcttttgcaccagcatagttgcccaggattctagaggtcacatttatcatgggagaaacctcgattacccttttggcaatgtgcttcgcaagttaaccgttgacgtgcagtttttgaagaatggacaaatcgcttttacaggtacaacttttatcggatacgtgggcctatggacgggtcagtcccctcacaaattcacggtaagcggagacgagcgcgataagggctggtggtgggaaaacgctattgctgccctgttccggaggcacatcccagtgagctggctcatccgagcgactttaagcgaatctgagaactttgaagccgctgtcgggaagcttgctaagactcctctgattgcagatgtctactacattgtcggcggaacgtctcctcgcgaaggcgtagtcattactcggaacagagatggccctgcggacatttggcccctcgatccgttgaatggcgcatggttcagagtggagacaaactatgaccattggaagcctgccccaaaggaagatgatcggcgtacatctgccattaaagccctcaacgcaactggccaggccaatctgtcgctggaggccctattccagtag

SEQ ID NO: 29630 - DNA, 4539 bp, Artificial Sequence
  Description of Artificial Sequence: Synthetic coding sequence
atggccgctgcagcgggaaaccgcgcttcaagtagcggcttccccggagctcgggcaacatctcctgaggccggaggaggcggtggagcccttaaggcaagctccgccccagccgctgccgcaggcctgttgagggaagccggtagcggtggtagggagcgggctgactggcgcagaagacagctgcgaaaagtgcgttctgtggagcttgaccagctaccagagcaaccccttttcctcgccgcatcccctcccgcttcatcgacatccccatctcccgagcctgccgacgcggcaggctcagggacaggattccaaccagttgcggtgccaccgcctcatggtgcagccagccgagggggagcgcacctcaccgagtcagtggctgcccctgacagcggagcgtctagcccagcggcagccgagcctggggagaagagggctcctgccgctgagccctcaccagctgccgcacctgccggacgcgagatggaaaataaagaaactctgaaaggcttacataagatggacgaccgccctgaagagaggatgatcagggagaagttaaaagccacctgtatgccagcttggaagcacgaatggcttgaacggagaaatcggaggggaccagtagtcgttaaaccaataccggtgaagggggacggctccgaaatgaatcacctggccgcagaatcacctggagaggtacaagcttctgccgcatcacctgcatccaagggcaggaggtcacccagtcctgggaattctcccagcggtcggacagttaaaagcgagagccctggtgtcagacgcaagagagtctcacctgtgccgttccagtctggccgaatcacccccccacgtcgcgctccatcccctgacggtttctccccttatagccccgaagaaaccaaccggagggtaaataaggttatgcgcgctaggctgtacttgctgcaacagatcggcccaaactcattcctcattggaggggattcccccgacaacaaatatcgggtgtttattggccctcagaactgttcctgcgctaggggcaccttctgcattcatctgttgttcgtcatgctccgagtttttcagctcgagcctagtgatcccatgctgtggagaaagactttaaaaaactttgaggttgagtcgcttttccagaaataccattcacgtcggagctcacgcataaaggcccctagcagaaacaccatccaaaagttcgtgagccgcatgtccaattcacataccctttcctcctccagcactagcacttcctcgagcgagaactctatcaaggacgaagaagagcagatgtgtcctatatgcctgctagggatgctggatgaggagagtctcacggtatgcgaagacggttgcaggaacaaactgcaccaccattgcatgagcatatgggccgaggaatgccggcgtaaccgcgaaccacttatctgccccctatgtcggagcaagtggaggtcgcacgatttttattctcacgagttgtctagtcctgttgactcccccagcagtcttcgggctgcacagcagcaaaccgtgcagcagcagcctttggccggatccagacgcaaccaggaaagtaatttcaatctgacacattatgggacacaacagatcccacccgcatacaaggatttggctgaaccttggattcaggtcttcgggatggagctcgtgggatgtctattcagcaggaactggaatgtgcgcgaaatggctctgcgccgtctgtctcacgatgtgtcaggcgctctgttgttagctaatggtgagtccactgggaactccggcggttcctccggatcgtctccctctggcggagccacctccggaagttcgcagacctctatcagtggggatgtcgtggaggcctgctgctccgttctatcaatggtttgtgccgatccagtttataaggtctacgtagctgccctgaagaccctccgcgcaatgctggtgtataccccatgtcactctctcgccgagcgaatcaagttgcagagactgctgcagcctgtcgtagacacaatcctcgttaagtgcgcagacgccaacagccgcacatcacagttgagcatcagcacactgctcgagctgtgcaaaggccaagcaggggagttggccgttgggagggagatcctgaaagccggtagtatcggaataggcggagttgactatgtcctcaactgcatattaggaaatcagactgaatccaacaactggcaggaactcctcgggagattgtgcctcattgacagactgctcctggaatttcctgctgagttctatcctcatattgtttctactgacgtcagtcaggccgaaccggtggagattaggtacaagaaattgctttcactcctgaccttcgccctgcagtccatcgataatagtcattccatggtaggaaagcttagcagacgcatttatctcagcagtgcgagaatggtgaccactgtgccccatgtgttttccaaactgttggaaatgttgtctgttagctccagcactcacttcacccgcatgcgccgtaggcttatggctatagccgacgaggtcgaaatcgccgaggcaattcagctcggagtcgaagataccctggacggccagcaagactcgttcttgcaagcatctgtcccgaataactatttggaaactaccgaaaattcttccccagaatgcactgtgcacctggaaaaaactgggaaaggcctgtgcgcaactaagttaagcgcgtcgagcgaagatatttcagagagacttgcctctattagcgtgggtccatcctcatccactactaccaccacaacaacaaccgagcagccgaaaccaatggtgcagacaaaaggacggcctcactcacagtgtctcaatagcagccctctgtcccaccactcacagcttatgtttcccgcactaagcacaccttcctcctccaccccttctgtgccagcgggaacagcaaccgacgtgtcgaaacaccgcctccaggggttcatcccctgtagaattccctcagcaagcccccaaacccaaagaaagttctcactgcagtttcaccgcaattgccccgagaacaaggacagcgacaaactgtccccggtgttcacacagagccggcctctgccaagttcgaatatccacagaccaaagccttctaggcccaccccgggtaatacaagcaagcagggcgacccctctaagaattcgatgacattagacctgaactcttccagcaagtgcgacgattccttcggctgttcctccaattcatctaatgcagtgatacctagtgacgaaacagtattcaccccagtagaggagaagtgcaggttagacgttaacaccgaactgaacagttctattgaagatcttcttgaggctagtatgcctagcagcgacacaaccgtcaccttcaagtctgaagttgctgtactgtcgccagagaaagccgaaaacgacgatacctataaggacgacgtaaatcataaccagaagtgtaaagaaaagatggaggccgaggaggaggaggcactggctatcgcaatggccatgtcggcttcacaagatgcactgccaattgtacctcaattgcaggtggaaaacggtgaggacattattattatacagcaggatacgcctgagactctgccgggacacaccaaagcgaagcagccttacagggaggatacagagtggttgaagggccaacagattggtctcggcgctttctcaagttgttaccaggcccaggatgtcgggaccggaactttgatggcagtgaaacaggtcacatacgtacgcaatacctcttccgagcaggaggaagtagtggaagccctccgtgaggaaatacgtatgatgtcccatctgaaccatcctaatattatcaggatgctgggggctacatgtgagaaatctaactacaacctgtttattgagtggatggcaggcggttcagttgcccatttgttgtctaagtatggtgccttcaaggagagtgttgtgatcaactacacagaacaattgctgcgagggctgtcatacctgcatgagaaccagatcatccatagggacgtaaaaggagcaaacctgctaatcgacagcactggacagcgccttaggatagcagattttggcgctgccgcacgcctggcgagtaaaggaaccggtgcaggggagtttcagggccaactccttggaactattgcatttatggcacctgaggtcctgcgcggacagcagtatggacgcagctgcgatgtctggagtgtcggatgtgctattattgaaatggcttgtgcaaagccaccatggaacgctgagaagcactccaaccatctagcccttatcttcaagattgcgtccgccacaaccgctccttccataccgtcccatctgtcccccggactgcgcgacgtggccctccgctgtctcgaattacagcctcaggaccggcctccatctagagagctcctgaagcatcctgtcttcagaaccacctggtag

SEQ ID NO: 29631 - DNA, 2274 bp, Artificial Sequence
  Description of Artificial Sequence: Synthetic coding sequence
gcagacgggggagacagccaagcatttaggtgtacctcctgtgggcatgccggaactaccccggctccgagggaagctctatcacctgctgatgctcatgtgggcagaggatttgcagagcgcgagcctataccggctcagggcctactggttctggcggtcctctccgatggagcaggcgatcacatccgtcaacgcctgctccctccactgctgcaaattgtttgtaaaggactcgaggacccttctcaggtcgttaggaatgctgcgctgttcgctctgggccagttttcagaaaatttacagccccatattagcagctatagtagggaggtcatgcctttattgctcgcctatctaaaatcagttcctcttgggcacacccatcacttggccaaggcctgttacgcactggagaacttcgtcgaaaatctcggaccaaaggtgcagccctaccttccagagttgatggaatgtatgctacagcttcttagaaatccatctagccccagggccaaggaactcgccgtctccgctctgggagctattgccaccgcagcccaagcttcgttgttgccctatttccctgctattatggaacacttgagggagttcctgcttaccggccgagaggatttgcagcccgtccaaatccagtccttggaaacactcggggtactcgctcgggctgtgggcgagcccatgcggccattagccgaggaatgctgccaactcgggctcggcctttgcgaccaggtcgatgaccccgacctaaggaggtgtacctattcgttgtttgcagctctgtcgggtctgatgggagagggattagccccacaccttgaacaaattacgaccctgatgcttcttagcttgcggtccaccgagggaatcgtgccccagtatgacggtagctcaagcttcttgctatttgacgacgagtcagacggcgaggaggaggaggaactaatggatgaagacgtggaagaggaggacgactccgagattagtggctattccgtggagaatgcatttttcgacgagaaggaagatacctgcgccgctgtaggagagatcagcgtgaataccagtgtcgcatttctgccatatatggagagtgtgtttgaggaggtgttcaaacttttggaatgcccccacctgaatgtcagaaaagctgctcacgaggcattgggccagttttgctgcgctctacacaaggcgtgtcagtcatgcccctcagaaccgaacacagcagctcttcaggccgcactggccagagtggtgcctagttatatgcaagctgttaacagagaaagggagaggcaggtcgtgatggccgttttggaggcactgactggggtgcttcggtcctgtggtaccttgactttgaagccccctggtcgcctggccgagctgtgcggggtgctgaaggcagtgctgcagagaaaaacggcctgccaggacacggatgaggaggaggaggaggaagatgacgaccaggcagagtatgacgccatgttgctcgaacacgccggagaggctattcccgcactggccgctgcagctgggggtgattcctttgcgcctttcttcgcagggtttctgcctctacttgtgtgcaaaactaaacagggctgtacggtggctgagaagtcgttcgccgtgggcactctggccgagactattcaagggctcggggctgccagcgctcagttcgtaagccggctccttcctgtgttgctgtctacagcacaggaggccgaccccgaggtgcgatctaatgccatatttgggatgggcgtgctggccgaacatgggggtcatcctgcacaagaacacttccccaaactccttggactcctgttccctttgttagccagagaaagacatgatcgcgtgcgcgataacatttgtggcgctctggcccgattgctcatggcctcacctactcgcaagcctgagccccaggttctggccgctttattgcacgcactacccctgaaggaagacttggaagagtgggtaaccattggaagactcttctccttcctctaccaatcctcgccagaccaagtcatcgatgtcgcccctgaactcctgaggatttgttcactgatcttagcagacaataagatcccaccagacactaaagctgcactgctactgcttctcacgtttctcgcgaaacagcatacagatagcttccaggctgccctgggaagtttgcccgtggacaaagcacaagagctgcaggcagttctgggattatcctag

SEQ ID NO: 29632 - DNA, 1812 bp, Artificial Sequence
  Description of Artificial Sequence: Synthetic coding sequence
atgggcgtgattcctgagggcccactttgggtcagcgggtccgatgacaatctctcaggtacgagcggcatggaggtggacgatagagtctctgccctcgaacaaagactgcagctccaggaggatgaactggcagtgctgaaggctgccctcgctgatgcgcttcgcagattaagggcttgtgaggaacagggggctgccctgcgagcaagggggaccccgaaagggcgtgcaccgccacgccttggcacgaccgctagcgtgtgccagcttctgaaaggcctgcctacacgaacccccctgaacgggagcggaccacctcgcagagtcggaggctatgccacaagtccttcatcccccaagaaagaggcgacgtctggtcgatcatctgtgagaagatatctctcgcctgaacgtctggctagtgtgcggcgagaagacccgagatcacgcaccacatcatcgagcagtaattgctcagcaaaaaaagagggcaagacgaaggaagtcatattctcagtggaggacgggtccgttaaaatgttcctcaggggtcgcccagttcctatgatgattccggacgagctggcaccaacttacagcctggacactaggtctgaactgccaagctgccgcctgaagctggaatgggtttatgggtacaggggaagagattgcagagcaaacttgtatctgctccccaccggtgagattgtctacttcgtcgcatcagtagcagtgctgtactcagtcgaggagcagcgccagaggcactacctcgggcacaatgatgatatcaaatgtctcgctatccacccggatatggtgacaatcgcgacaggtcaggtagctggcactaccaaagagggaaaaccactaccaccccacgtgaggatctgggactccgtttccctgagcaccttacacgtacttggactgggcgtgtttgacagagctgtttgttgcgtggggttcagtaaatcaaacggcggaaacttgctgtgtgccgtggatgagtccaatgaccatatgctcagcgtgtgggactgggcgaaggaaactaaggtggtggatgttaaatgtagtaatgaggccgtccttgtagccacttttcatcctactgacccgaccgtgctgattacctgtggaaagtctcacatctacttctggactctggaggggggttcccttagcaaaagacagggtctattcgagaagcatgagaaaccaaaatacgtgctttgcgtcacatttttagaaggcggagatgttgtcaccggcgacagcggcggaaatctgtacgtgtggggaaaaggaggaaaccggatcactcaagcagttctcggagcacacgatggtggggtgttcggactgtgcgcacttagggacggtaccctagtgtctggcggtgggagggatcgacgagtcgttttatggggaagtgactatagcaagcttcaagaggtggaggtgccggaagatttcgggccagttcggacggttgctgagggtcatggagacacactgtacgtcggaactacgaggaacagcatcctgcaggggagtgtgcacacgggcttcagtttattggtacaaggccatgtagaagaactgtggggattggcaactcatccttcccgggctcagttcgtgacctgtggacaggacaaactggtgcacctgtggtcctctgactcccaccagccgctatggtccaggataattgaggtggagagtcggtcagtgacccaggcgggaggccaatggcatgatctgggctcactgcagccaccccctcctggtttcaagtag

SEQ ID NO: 29633 - DNA, 996 bp, Artificial Sequence
  Description of Artificial Sequence: Synthetic coding sequence
atggcagagggaggtggtcccgagccaggtgagcaggagagacggtcgtctggacccaggcccccatcagccagggatctacagctcgcattggcagaattgtacgaggatgaggtcaagtgcaaatccagcaaatcgaataggccaaaagcaactgtgtttaagtcacccagaacacccccacagagattttacagttctgagcacgaatatagcggccttaatattgttcgaccttctaccggcaagattgttaacgagctgttcaaagaagccagagagcatggagccgtgcccctcaatgaggccacccgggcatccggagacgacaagagcaaaagtttcaccgggggaggctataggctgggatcatcattttgcaaaaggtccgaatatatctacggggaaaaccagctgcaggatgtgcagatcctcctgaagctctggagcaatggctttagcctggatgatggagaacttcgtccatataatgaacccaccaatgcccaattcctggagagtgtgaagcgcggagaaatccctctggagcttcaacgactggttcatggaggccaggtcaatctcgatatggaagaccaccaagaccaggaatatattaaaccgaggctgcggttcaaggctttttcaggggagggacaaaaactgggcagtctgacacctgagattgttagtactcccagctctcctgaggaagaagacaagtcgattctcaacgccgtcgtgttgatcgatgacagtgtgcctacaacgaaaatccagatccggctagcagatggctccaggctgatccagaggtttaattctactcaccgcatcctggatgtcaggaatttcatagtccagagtaggcccgagtttgcagctctggactttattctggtgacctcatttcccaataaggaactgaccgatgagagcctgactttgttggaggcagatattctgaacacagtgttgctgcagcagctgaaatag

SEQ ID NO: 29634 - DNA, 2064 bp, Artificial Sequence
  Description of Artificial Sequence: Synthetic coding sequence
atggacggtggcgctctaacagacacctccctgactgattcctatttcagcacctccttcattggggtgaatggtttcggaagtcctgtcgagactaaatatcccttaatgcagagaatgacaaactccagtagtagccccagcctattgaatgacagtgctaagccttactctgcccacgatcccctgacgagtccggcatcctccctgttcaatgatttcggagccctcaacattagtcagaggcgaaagactcctaatccaaccgcatcagaattcatccccaaaggcggatcaacaagccgcctcagcaacgtctctcagtccaacatgtctgccttcagccaagtgttcagccacccctcaatgggatctccggcaaccgctggtctggcgccaggcatgtctctgtcagcgggaagttccccactccattctccaaagatcacacctcacacatcccccgctccgagaagacgatcccataccccaaaccccgcatcatacatggtgccaagctctgcttctacctctgtgaataatcccgtcagtcaaaccccttcctctggtcaggtcatacagaaggagacggtgggaggaaccacctacttctataccgataccacaccagcgcctttgaccggcatggtgttccctaattaccatatttatccacccacagctcctcatgtggcctatatgcaaccaaaagcgaacgccccttccttcttcatggcagacgagttgcgccaagagctcattaaccgtcatctgataaccatggcacagatagaccaggccgatatgcccgcagtcccgaccgaagtcgatagctaccattccctgtttcccttggaacctctgccgccacctaacaggatccagaagtcctcaaattttggctatatcacctcctgctataaagccgtgaactccaaggatgatttaccatactgtttgcgcaggattcatgggtttaggctggtgaacaccaagtgtatggtgctggtggacatgtggaaaaaaatacagcacagtaacattgtgacattaagagaggttttcaccacgaaggccttcgcggagccctccctggtctttgcctacgacttccacgccggaggggaaacaatgatgagtaggcattttaatgaccctaatgcggatgcttactttaccaagcgcaaatggggccagcacgaaggccctctcccaaggcagcatgcgggactgctgcccgagagcctcatctgggcttatatcgtgcagttgagcagtgcactcaggaccatccataccgccggactggcttgccgagtgatggaccctaccaagatcctgattaccggtaagacccgccttcgagtgaactgtgtgggcgtcttcgatgtcctaaccttcgataattcacaaaataataatccgctggcacttatggcccagtaccagcaggctgacctaataagccttggtaaggtggtcttagcactcgcatgcaatagcctagctggaatacaacgagagaacctacaaaaggccatggagctggtaacaattaattatagttcggatctgaaaaacctaatcttgtatttgttgacagatcagaataggatgcggagcgttaacgatattatgcccatgatcggtgcccgtttttacacgcaacttgatgctgctcagatgaggaacgacgttattgaggaagatcttgcaaaggaagtgcagaatggacgtctgtttcgcctactcgcaaagctcggtacaatcaatgagcgacctgagttccagaaagatcctacctggtccgagactggagacagataccttcttaagctgtttagagaccatctgttccaccaagtcaccgaggcaggcgcaccatggatagatctgtcccatatcatctcatgcttgaataagctagatgctggagtgccggaaaaaataagcctcatttccagagatgagaagtccgtgctggtggtaacttatagcgacctgaagcgctgctttgaaaacacatttcaggagttaatagcagccgctaatgggcagctgtag

SEQ ID NO: 29635 - DNA, 6950 bp, Artificial Sequence
  Description of Artificial Sequence: Synthetic coding sequence
atggacggagtctcctcagaggccaatgaggagaacgataacattgagcggcctgtccgtcgcaggcacagcagtattctgaaacctccacgcagccccttgcaggatctgcgtggagggaatgagagagtccaagaaagcaatgcgctgcggaataagaagaactcgagaagggtttcttttgctgacaccattaaggtgttccaaactgagtcccatatgaaaatcgtgcgtaagtctgagatggaagagacagaaaccggcgaaaaccttctcttgatccaaaacaaaaaattagaagataactactgtgaaattacagggatgaatacactgctcagcgccccaatccacacacagatgcaacaaaaagaattcagcatcattgagcataccagagagaggaagcatgcaaacgatcagacagtgatctttagtgacgagaaccagatggacttgaccagcagccatacagtgatgatcaccaagggactccttgacaaccctatcagcgagaagtccaccaaaatcgatactacctccttccttgctaatctcaagctgcataccgaggattctaggatgaaaaaagaagtgaactttagcgtagaccaaaacacttccagtgagaacaagattgactttaacgacttcattaagcgtttgaagacaggcaagtgctcagctttccctgacgttcccgataaggagaattttgagatcccaatctattccaaagagccgaatagcgcttccagcacacatcaaatgcacgttagcctcaaggaagacgagaacaactccaatatcacccggctgttccgcgaaaaggatgacggaatgaatttcacgcagtgtcatactgcaaatattcagacattaatccctacatccagcgaaacgaacagcagagagagtaaggggaatgacatcaccatatatggaaatgatttcatggatcttaccttcaatcatactttgcagattctgcccgctaccggcaatttctctgagatagagaaccagactcaaaatgccatggacgtaactacgggatacggcaccaaggcatcaggcaacaaaaccgtcttcaaatccaaacaaaacaccgcattccaggatctgtctataaactcagctgacaagattcacattactcggtctcacatcatgggggctgagacgcacatcgttagtcaaacatgtaaccaggatgcccgtattttggcgatgactccggagagcatctacagtaatccatctatacagggctgtaagacggtattttatagctcttgcaacgatgctatggaaatgacaaaatgcctttccaacatgcgggaggagaagaatctgctgaaacacgactccaattatgcaaaaatgtactgcaaccccgatgcgatgagctctttgactgagaaaaccatttatagcggggaagagaatatggacattacaaaaagtcacaccgtagcgattgataatcagatcttcaaacaggatcaatccaacgtgcagattgccgcagcgcctacgccagagaaggagatgatgctgcagaatcttatgaccacgagcgaagatggaaagatgaatgttaattgtaattctgtcccacatgtctcaaaggagcggatacagcagagcttatcgaatcctctgtccatttcactcacggaccggaaaacagagttactgagcggagagaacatggaccttacagagtcccacactagcaatctgggctcccaggtgccccttgcggcatataatctcgccccagagtcaacctccgagtcccatagccagtcaaagtcatcctccgacgagtgtgaggagattactaaatcacgcaacgagcccttccagagaagtgacattattgcaaagaacagcctcactgacacatggaataaggacaaggactgggtcctgaagatattaccctatctagataaggatagccctcagtctgcagactgcaaccaagagattgcaacttctcataacattgtctattgtggcggagtgctcgacaagcaaattacaaaccggaatactgtgtcctgggaacagtccctctttagcacaaccaaaccactcttttctagtggccagttctctatgaagaaccatgataccgcgatttcatcccacactgtgaaatccgtactgggtcagaactctaagctggccgaaccactgaggaagtctctgtcgaatcccactccagactattgccacgataagatgatcatctgctcagaggaagagcagaacatggacctgacgaaaagccacaccgtggtcataggatttgggcctagcgaactgcaggaactcggtaagacgaaccttgaacatacaaccggccagctcactacaatgaacagacaaatcgccgtcaaggttgagaagtgtgggaagtcgccaatcgaaaagagcggtgtgctgaagtctaactgtatcatggacgtcctggaggatgaaagcgttcagaagcccaagttccctaaggagaagcagaatgtcaaaatctggggtagaaagagtgtgggtggtccgaaaattgataagactatagtgttttccgaggatgacaagaatgatatggacataactaagtcctataccattgaaataaatcatagaccactgttggagaagcgggactgccacctggtgccattggctggcacatcagaaacgatcctctatacatgccgccaggatgacatggaaatcactcgatcccatactaccgcattagaatgcaagacagtgagccctgatgagatcacaaccaggcctatggacaaaaccgttgtattcgtcgacaaccatgtggagcttgagatgactgagtctcacacagtgttcatcgactaccaggaaaaagagagaaccgacaggcccaatttcgagttgtcccagcgaaagtcgctcgggacaccgacggtcatttgtacacctacagaagaatctgtattctttccagggaacggagaatctgatcgccttgtggcgaatgattcccagcttacccccctcgaggaatggagcaataaccgaggcccagtcgaagtcgctgataacatggaactgagcaagtctgcaacctgcaagaacattaaggacgtgcagtcaccgggattcttaaatgagcccctatcttctaagtcccagagacgaaagtctcttaaactgaagaatgacaagacaatcgtgttcagtgaaaaccataagaacgatatggacataacacagtcctgcatggtggagattgataacgagagcgccctggaggacaaggaggatttccacttggcaggcgcaagcaaaactatcctttatagctgcggtcaggatgacatggagatcacgcgctcacacaccacagcacttgaatgcaagacactgctgcccaacgaaatcgcaattaggcccatggataagaccgtgcttttcacagataattacagtgatctagaggtcacagactcacacacagtcttcatcgattgtcaggccaccgaaaagattttggaggaaaatcctaagtttgggatagggaaggggaagaatctaggcgtgtcatttcctaaggacaactcttgtgtgcaggagatcgcggaaaagcaggcattagcagtcgggaataagattgtgttacataccgagcagaaacagcagctgtttgccgcaacgaaccggacaactaacgaaatcatcaagtttcattccgccgctatggacgaaaaagttattggaaaggttgtagaccaagcatgtaccctagaaaaggcccaagtagaatcctgccagcttaacaacagggatcggaggaacgtagactttacaagctcacacgccactgccgtttgtggaagctctgataattactcatgcctccccaatgtgatttcttgcacggataatctagagggaagcgctatgctactgtgcgacaaagatgaggagaaagccaattactgcccagtccagaatgatttggcatacgctaacgattttgcatcagaatactacctggaatcagagggccaaccccttagcgctccatgtcctttattagagaaggaggaggtgatacagacaagcactaagggccagctggattgtgtaatcaccttgcacaaagatcaagacctaatcaaggaccctcgcaatctgctcgctaatcaaaccctcgtttacagccaggacctcggcgagatgacgaaactgaatagcaaaagagtctccttcaaattgcctaaagaccaaatgaaggtctatgtagacgacatttacgtgatcccccagccgcatttctctacggaccagccacctctgccgaaaaagggacagtcctctattaataaagaagaagtgatcctgtctaaggctggaaacaaaagcctaaacattatcgagaacagctccgcccctatttgcgaaaacaaaccaaagattttgaacagcgaggaatggttcgcagcagcatgcaagaaggagctgaaggaaaatatccagactaccaactataacacagccctcgactttcacagtaacagcgatgtcactaagcaggtcatccagactcacgtgaatgccggtgaggcgccagacccagtgatcacgtcaaatgtgccctgcttccattccattaaaccaaacttgaataatcttaacggaaaaacaggggagttcttggcttttcaaaccgtccacttgccgcctcttcccgagcagctcttggagctgggaaacaaggcacataacgatatgcatatcgtgcaggccacagaaatccataatatcaatatcatcagctccaacgctaaagactcccgggatgaggaaaataagaaatcacacaacggtgctgagacaaccagtcttcccccaaaaaccgtcttcaaggacaaggtcaggcgctgcagtttaggaatctttctgccaaggctgcccaataagcggaattgtagcgtcactggcattgacgaccttgagcagatccctgcagataccaccgacataaaccatctggagactcagcctgtgagttccaaagactccggaataggaagcgtggctggcaagctgaatcttagcccctcgcaatatattaatgaggagaacctcccggtctacccagacgagattaattcttccgattcgattaatatagagaccgaggaaaaggccctaatcgagacctaccagaaggagattagcccctacgagaacaaaatgggaaaaacatgcaattctcagaagagaacatgggtccaagaggaggaggatattcacaaagagaaaaaaatacgcaagaatgagattaaattctccgataccacacaggaccgtgaaatctttgaccaccatactgaggaagatatcgataaaagtgccaacagcgtcctaataaagaatttgagtcggacgccatcaagctgttccagctccctggactcaatcaaggctgatggcacgagcttggactttagcacatatcggtcgtcccaaatggagtcccagttcttgagagataccatctgtgaggaaagtctgcgtgagaaactccaggacggaaggatcacaatccgcgagttcttcattctcttgcaggtgcatatcttgatccaaaagcctaggcagtcgaacctgcccggtaattttaccgtgaatacgccccctacacctgaggacctcatgctcagccaatatgtttacagacctaagatacagatttatagagaagactgtgaagccagacgtcagaaaatcgaggagctgaagctctctgccagcaaccaggataagctgctggtcgatatcaataagaacctttgggagaagatgaggcactgctctgacaaggaactcaaggcctttggaatctacctcaataaaattaagagctgctttacgaagatgactaaagtatttacccatcagggaaaggtggcactgtatggaaagctagtgcagtctgctcagaacgagcgcgagaaacttcaaattaagattgatgagatggataaaattttgaagaagatcgacaattgtctcacggagatggagaccgagactaagaacctagaagacgaagaaaaaaacaaccccgttgaagaatgggactccgagatgcgggctgcggaaaaggaattggaacaactgaagacggaggaagaagagttacaaaggaacctactggagctcgaggtgcaaaaagaacaaactctggcccagattgactttatgcaaaagcagaggaatcgcaccgaagaactcttggatcaactgagcctgagcgagtgggatgtggttgaatggagcgatgaccaggccgtttttaccttcgtgtatgataccatccagctgacaatcacatttgaggaaagtgtggtcgggtttccttttctggacaaaagatatagaaagatcgttgacgtgaattttcagtcgctgttggatgaagatcaagccccacccagttcgctcctcgtacataagctgatttttcagtacgtggaggaaaaggagagctggaaaaagacttgcaccacccagcaccaattacctaagatgctagaagagttttctctggtggtccatcactgcaggttgctgggcgaagagatagagtacctcaaacgctggggcccaaactataatcttatgaatattgacatcaacaataatgaattaagactcctgttctcttcttcggccgcatttgctaagttcgagattacgctgttcctttcagcatactacccttctgttccgctaccttccacaattcagaaccatgtgggcaacacctcacaagatgacatcgcaaccatcttgtctaaggtgccccttgagaacaactatctgaagaatgtcgtgaagcagatttaccaggaccttttccaagattgccatttctaccacta

SEQ ID NO: 29636 - DNA, 714 bp, Artificial Sequence
  Description of Artificial Sequence: Synthetic coding sequence
atgggatgctgtgggtgttccgggggttgcggctctgggtgtggcggaagaggctctggttgcgggggatgcgggagtgggtgtggaggctgcggtagtgggtgcgggggttgtggtagcggctgcgggggttgtgggggatgtgggtctggctgcgccggttgtggcggttgcgggagcggctgctgcgtccccgtatgctgttgtaaacctatgtgttgttgtgtgcccgcttgttcatgttcatcgtgtggtaaagggggatgtggttcatgcgggggaagcaagaggggctgcgtgtcatgtggggtgagcaagggcgcttgcggctcctgtggcggatctaagggtgggtgtggctcgtgcgggggatcaaaaggcggatgtggctcctgtggaggctctaagggaggatgcgggagctgcggaggtagcaaaggtgggtgcggaagttacggatgctcgcaatcctcctgctgtaagccttgctgctgcagctccggatgcgggagtagctgttgccagtctagttgctgcaagccgtattgttgccagtcatcttgttgtaagccttactgttgtcaatcaagctgttgcaaaccatgttcctgcttttctggctgtggaagttcgtgttgccaatcttcgtgctataaaccctgttgttgtcagtcctcctgttgcgtacccgtgtgttgccagtgtaagatttag

SEQ ID NO: 29637 - DNA, 717 bp, Artificial Sequence
  Description of Artificial Sequence: Synthetic coding sequence
atgggctgttcagggtgttcaggcggttgtggcagctcgtgcgggggatgtgggtcaagctgtggtgggtgcgggtcaggatacgggggttgcggtagcgggtgctgcgtgcccgtttgttgctgtaagccagtctgctgttgtgtccccgcttgttcttgctcctcatgtggcagttgcggcggaagcaagggagtgtgcgggtcatgtgggggatgtaagggcggttgtgggtcatgcgggggatcaaagggaggatgcggatcttcttgttgcgtgcccgtttgctgttcctcaagttgcggatcctgcggaggctcgaagggagtttgtgggttcaggggaggctccaagggcggatgtgggagctgcggatgctcccaatgttcttgttataagccctgctgctgttcatccgggtgtggatcgtcttgctgtcaatcctcctgttgtaaacctagctgttcacagtcatcgtgttgcaagccatgctgttcccagagttcttgttgtaagccatgctgctgctcctcaggctgtggcagtagctgctgccagtccagttgttgtaagccgtgttgttctcagtcctcatgctgtaaaccgtgctgttgtagttccggctgcggatcctcgtgttgccagtctagttgttgcaaaccttgcagtagccaatcctcttgctgtgtccctatctgctgtcagtgcaagatatag

SEQ ID NO: 29638 - DNA, 1473 bp, Artificial Sequence
  Description of Artificial Sequence: Synthetic coding sequence
atgaacggcgcactggaccattctgatcaaccggatccagatgccattaaaatgtttgtaggacaaattcctcggtcatggagcgagaaagagctcaaagagttgtttgaaccctacggcgcagtctatcagataaatgtgctgcgagatcggagtcaaaacccaccacaatctaagggatgttgcttcgtgaccttctataccagaaaggccgctcttgaggcccagaatgcactacacaatattaagacactgcccggaatgcatcaccccatccaaatgaaacccgctgactcagaaaagagcaacgccgttgaagacaggaagttatttatcggcatggtgtccaagaaatgtaatgaaaatgatattcgtgtgatgttttctcctttcggccagatagaagaatgccgcatcctgcggggacccgatggcctcagtcgcggatgcgcattcgtgacattctccacgcgcgcaatggcacagaatgctatcaaggccatgcaccagagccagacaatggaaggttgttcgtcccccatagtggtgaaattcgccgatacacagaaagacaaggaacagcgccgtttacagcaacaactcgctcaacagatgcagcagcttaacactgctacctggggtaatctgacagggctggggggattgaccccccagtatcttgccctcttgcagcaagcaacctcctcctcaaatctgggtgctttctcaggcattcaacagatggccggaatgaacgccttgcaactacagaacttagccactctggccgcagcagctgctgccgctcaaactagcgctacgtcaacaaacgcaaaccctttgtcaacaacttccagtgcattgggcgcattaacgagtcctgtcgctgctagtacccccaacagcaccgcgggtgcagcgatgaactccctgaccagtctgggcacgcttcagggtctagcaggcgctaccgtgggactgaataatatcaatgccttagctgtagcccaaatgctttccggaatggccgcacttaatgggggactcggagctacgggactaactaacggcacggccggaacaatggacgccttgacacaggcgtactccggcatccagcagtatgccgctgccgctcttcccaccctgtatagtcagagcctgttgcagcagcagagcgccgcaggctcccaaaaggagggcccagaaggcgcaaatctgttcatttaccacctgccgcaggagtttggcgaccaggacatccttcagatgttcatgccttttggtaatgtgatctctgctaaagtcttcattgataagcaaacgaacctcagtaaatgcttcgggttcgtcagctacgacaatccggtgtcggctcaggcggctatccaggcaatgaatggctttcagatcggaatgaaacgtctcaaggtgcaactgaaaagatcaaaaaatgattccaagccttattag

SEQ ID NO: 29639 - DNA, 5825 bp, Artificial Sequence
  Description of Artificial Sequence: Synthetic coding sequence
ctgttgacatctgtgctcatgcctagtttcggttactttattcggtcccccgagaagcgggaacccatagcccttattcggaaaagtgatgtgtctaggggaaatcttgagaaggagatggcgcatcttaatcacgatctgtattcaggagacctcaatgagcagagccaggcccagctttcggagggaagcatcaccctgcaggtcgaggcagttgaaagcacatcacaggtggacgagaacgacgtcaccttgacagccgataaaggtaaaacagaggatacgttcttcatgtccaacaagccccagaggtataaggacaaactgccagattctggtgacagtatgttgcggatatccacaatagcaagcgcgatagctgaggccagcgtaaacacggatcccagccagctggcagccatgattaaagcgctttcaaacaagactagggataagacattccaggaagacgaaaagcagaaggactacagccatgtgagacattttcttcccaatgatctggaaaagagcaacggctctaatgctctcgacatggaaaaatatttgaaaaagacagaggtgagccgctatgaatccgcactggagaatttctcccgagcctctatgagtgacacctgggatctcagtttgcccaaagagcagactactcaggatattcacccagtggacctctccgctaccagtgtgagcgtgcgcgcaccggaagagaatactgccgctattgtttatgtggagaacggtgaatctgagaaccaggagagcttccggaccattaatagttctaattctgtgaccaaccgcgagaacaactctgccgtggttgatgtgaagacatgctcaatcgacaataagcttcaggatgtgggaaacgatgagaaggccacctccatttccactcccagtgatagctactcatccgtccgtaatccaagaatcacttccctctgtttgctgaaagattgtgaggaaattagagataaccgcgaaaaccagcggcagaatgaatgtgtgagcgaaatctccaacagcgaaaaacacgtgacattcgagaaccataggattgtctctcccaagaattctgatttgaagaatacaagtcccgagcacggtgggagaggcagcgaggacgagcaagagagcttcaggccaagtactagccccctaagccactcctctccctccgaaatttctgggacctccagctccggatgcgccctggagtcttttgggtcagcagcccagcagcagcagccaccttgcgagcaggagctttctccactggtatgttccccagccggtgtatctaggctgacatacgtttcagaacccgagtcttcctatccaacaactgcgaccgatgacgccttggaagatcgcaagagtgacattacgagcgaactctctaccacgattatacagggatcgccagctgccctagaagagagggccatggagaaattgcgggaaaaagtcccattccagaatcgtggtaaaggtaccctgtcatctattatccagaataacagcgacactcggaaagcaaccgagacaacatccctgagctccaagccagaatatgtcaagccagactttaggtggtctaaagatccctcgagtaaatctggaaacctattggaaacctccgaagtgggctggacctctaatcctgaagagcttgacccaatccgactcgctctgcttggcaaaagtgggctgagctgtcaggtgggctctgcgacatctcaccccgtttcttgccaggaacctattgatgaggatcagcggatctcccctaaagacaaatccaccgctggaagagaatttagtggtcaggtaagtcaccagacaacctccgagaaccagtgcacgcctatccctagcagcactgtccactcctcagtagcagacatgcaaaatatgccagctgcggtgcatgcccttcttacacaacctagcctgtcagccgcaccgttcgctcagcggtacctcggcacactcccctccactggcagcacaaccctaccccagtgccacgctggaaacgccactgtttgcggttttagcgggggactgccgtacccggctgtcgccggtgagcccgtacagaatagtgtcgcggtgggcatctgtcttgggagcaatataggaagcggttggatgggaacgagctccctctgtaacccttacagcaacactctgaatcagaaccttttatcaaccaccaaacctttccctgttccatccgtgggcacgaattgtgggatcgaaccatgggactcgggggtgacttcaggcctcggttcagtccgtgtgcccgaagagctgaagctaccccacgcttgctgcgtcggaatcgcaagtcagactctcctgagtgtactgaaccccactgaccgctggctacaggtttccataggcgttctatccatctcagtgaacggcgagaaggtagacttgtcgacatatcgatgccttgtgttcaaaaataaggcaataatccggccacacgcgacagaagagatcaaggtgctgttcattccctccagtccaggtgtctttcggtgcactttctctgttgcgagctggccctgctcgaccgatgccgaaacgattgtacaggcggaagctttggcctcaactgttactctcaccgctatcgccgagtccccagttatcgaggtggagacggaaaaaaaagacgtgctagatttcggcgatctcacctacgggggatggaaggctctgcctctgaagctcattaaccgaacgcatgccacagtgccgatccgacttatcattaacgcgaatgccgtggcctggagatgtttcaccttcagcaaggagtcagtgagagcccctgtcgaggtagccccatgcgcagatgtcgtcacgcgcctggcaggaccctcagtggtaaaccacatgatgccagcatcatatgacggtcaggatcccgaattcctcatgatttgggttctcttccacagtcccaaaaaacagatttcgagctcggacatcctggactctgccgaggaattttccgcgaaagtggatattgaggttgattcccccaaccccacgccagtgctcagaagcgtgtcccttcgagctagggctggcatcgcccgtatccatgctccaagagacttacagaccatgcattttctggctaaagtcgcttcatcgcgaaaacagcaccttcccctaaagaacgccggaaacattgaagtgtatcttgacatcaaggtgcctgagcagggttcacacttttctgtagaccctaagaaccttctccttaagccaggcgaggagcatgaggtgattgtctctttcacacccaaggatcccgaggcctgcgaggagaggatcctgaagatcttcgtgcagccatttggcccacagtatgaggtggtgcttaaaggggaggtcattagcagtgggtcaaaaccattaagccccggtccttgtctggacatcccgtccatcctttccaataagcaattcttagcctggggaggggtgccactcggcaggactcagctgcagaagctagctctgcgcaataactctgcctctaccacacagcacctccgactgctaataagagggcaggaccaagactgcttccaactgcaaaacacattcggatccgagcagaggttaaccagcaattgcgaaattcgaatccacccgaaggaggatattttcatctcagtgttattcgccccaacccgactgagctgcatgctggctcggctagagattaagcaactggggaatcgctctcaacctgggataaaattcactatacccttgtccggatatggtggcacctccaacctgatcctagaaggagtcaagaagctttctgattcttatatggtgacagttaatgggctggttcccggaaaagaatcgaagatagtgttctcagtcaggaatacaggcagtagggctgcgttcgtgaaagctgtggggttcaaggacagccagaaaaaagtgctgcttgatccgaaagtcctaagaatttttccagacaaatttgtgctcaaggagcgcacgcaagagaacgttactttaatatacaatccatctgatagaggtataaacaataagactgccactgagctgtctaccgtttatctttttggtggagacgaaatctcgcggcagcagtacagaagagcgctccttcataagcccgagatgataaagcagatcctgcccgaacacagtgtgctccagaatattaactttgtggaagcttttcaggacgagctacttgttactgaagtgtatgacctgccccagagaccgaatgacgtgcagctgttttatgggtccatgtgcaaaattatactgagcgtaattggtgagttccgcgactgcatctcttcccgcgaattcctccagccatctagcaaagcaagcttggagagtacaagcgacctgggagcatccgggaagcacggcggtaacgtttccttggatgtcctgcccgtcaagggcccacaggggagtcccctgctgtctagagcggcaagaccaccactcgaccagcttgcttccgaagaaccctggaccgtgctgcccgaacaccttattctggtcgcccctagcccctgtgacatggcgaaaaccggtaggttccagatcgtaaacaactctgtgcgacttttgcgctttgagctgtgctggcctgcccactgtctgaccgtaactccgcagcatgggtgcgtcgcacccgaatcaaaactgcagatcttggtttctccaaactcctcattaagtactaaacaaagcatgttcccctggagtgggttgatctacatccattgcgatgacggccagaagaagatcgtgaaggtacaaattcgcgaggatctcacacaagtggaactccttactaggctcacctccaagcccttcgggatacttagtcctgtgtcagaaccgagtgtgagccatctggtcaagcccatgacaaagccaccttctactaaagtggagatcagaaacaaaagtatcacatttcctactacggagcccggagaaacctccgagtcatgccttgagctagagaatcatggcactaccgacgtgaaatggcacctgtcgtcattggcaccaccatatgtaaaaggcgtggatgagtcgggagatgtattcagagcgacatacgctgcttttcgctgttccccaatctctggactgcttgagtcacacggcatccagaaggtgagtattacatttctgccgagggggagaggtgactatgcacaattttgggatgtggaatgtcacccccttaaagaaccacatatgaaacataccctgcgatttcaactttctggacagagtatagaggccgaaaacgaacccgaaaacgcatgtctatctaccgatagcctgattaaaatcgaccacttggtgaaacccagaagacaggccgtcagcgaggcctctgcacggattcctgagcaattggatgtgactgccagaggagtgtacgctcccgaagacgtatatcggttccggccaacctccgtcggggagtcaagaaccctcaaagtgaacctccgcaacaacagcttcatcacccatagtttaaagttcctgtcaccaagagagcctttctatgtgaagcactctaaatactctctcagagctcagcattatatcaatatgccagtacagttcaagccaaaatctgccggaaaattcgaggcgctgctagtgattcaaaccgatgaagggaagagtattgcaattcggttgattggcgaggctctcggcaagaacta

SEQ ID NO: 29640 - DNA, 111 bp, Artificial Sequence
  Description of Artificial Sequence: Synthetic coding sequence
atgtgttattacggcaattattacggcggatatgggtatggagggttaggttgtggctatgggagctgctgtggttgcggtttccggagactgggttgtgggtacggatag

SEQ ID NO: 29641 - DNA, 528 bp, Artificial Sequence
  Description of Artificial Sequence: Synthetic coding sequence
atgagctataattgttgcagcggtaacttttcatctcgatcttgtggagactatctacggtaccctgcctcatccaggggtttttcatacccttcaaatcttgtctactcaaccgatctgtgcagcccaagtacgtgtcagctgggctcctctctgtatagaggttgtcaggagatttgttgggagccgacatcgtgtcagacgtcttacgtggaatccagtccttgccagacgagttgctatcggccacgaacatctctgctctgctccccatgcaaaacgacgtactcaggtagcctggggtttgggagcagctcctgcagaagcctggggtatggatctcgttcatgctattccgttggctgtgggtcgagcggggtgcggagccttggatacggatcctgtggcttccccagcttggggtacgggtctggcttctgccgacccacctaccttgcctcgcggagctgccaatccccctgctatcggccagcctacggtagtactttttgcaggtctacttgctag

SEQ ID NO: 29642 - DNA, 324 bp, Artificial Sequence
  Description of Artificial Sequence: Synthetic coding sequence
atggggaaaaaacgtactaaaggcaagactgtccccattgacgacagttccgagactcttgaaccagtttgtcgccacataagaaaaggcctggagcaaggcaatctgaaaaaggcgttggtcaatgttgagtggaatatctgccaggattgcaaaacagacaataaggttaaagacaaagccgaagaagaaacggaagagaagcccagtgtatggctgtgcctgaaatgcggtcatcagggatgcggacgcaattcgcaagaacagcacgcgctgaagcactacctgaccccaagatctgagccccactgcctggtgctctag

SEQ ID NO: 29643 - DNA, 2469 bp, Artificial Sequence
  Description of Artificial Sequence: Synthetic coding sequence
atgggtaagaaaaggacaaaaggcaagacagttcccattgatgacagcagtgaaactctagagcctgtgtgcaggcacatcagaaagggtcttgaacagggcaatctcaagaaggccttagtcaacgtggagtggaatatctgccaagattgtaagactgacaataaggtcaaggacaaagccgaagaagaaaccgaggaaaaaccttcagtttggctctgcttgaaatgtggccaccaaggttgtggccgtaacagccaggagcagcatgccctgaaacattatttaacacctagaagtgaaccacattgtttagtactcagcttggataattggtccgtctggtgctatgtgtgtgacaatgaggtacagtattgcagttctaatcaactcggccaggtcgttgattacgtccgaaaacaggccagcataactactcctaaacccgaaaaggataacggtaacatcgaattggaaaataaaaaactcgagaaggaaagtaagaacgaacaagagagggagaagaaggaaaacatggcaaaggaaaacccccctatgaactcaccttgccagatcactgtaaaggggctgtccaacctgggaaacacctgcttttttaatgccgtcatgcagaacttatctcagacccccgttctgcgggagctactaaaggaagtgaagatgtcaggcactattgtaaagatcgaaccacctgatctcgcactgacagagcccctcgaaattaacctggaacctccgggtcctctgaccctggcgatgtctcaattcttgaatgaaatgcaagagaccaagaagggagtagtgactcctaaagagttgttttctcaggtttgtaaaaaagctgtccgctttaaaggctaccagcagcaggacagccaggaactgcttcgttacctcctagacggaatgagggcagaagaacaccagcgcgtgtccaaagggatccttaaggccttcggcaacagcacggagaagctcgacgaggagctgaaaaataaagttaaggactacgagaagaagaagagtatgcctagttttgttgatcgaattttcgggggtgaattaacatccatgatcatgtgcgaccaatgccggaccgttagcctagttcatgaaagctttctggacctgtcgctccccgttttagacgatcaaagcgggaagaagagtgttaatgataaaaacctgaagaaaacagtagaggacgaagaccaggattccgaagaagagaaggataacgactcatacattaaggagcgaagcgatataccctctggaacatcgaaacacctacagaaaaaggcaaagaagcaagcgaaaaaacaagcaaaaaatcagcggcgtcagcaaaagatccagggaaaagttctccatcttaacgatatctgtactattgaccatcccgaagacagcgaatatgaggcagagatgtccctccagggcgaggttaatattaagtcaaaccatatctcccaggagggcgtgatgcacaaagaatattgtgtgaaccaaaaggacctaaatggtcaagccaagatgattgagagcgtaactgacaaccagaaaagtactgaggaggtagacatgaagaacatcaacatggataacgacttagaagtactcacctcaagtccgacaaggaatcttaacggtgcttacctaacagagggcagtaacggcgaggtagatatctctaacggttttaagaatctgaatctcaacgcagcccttcacccggatgagatcaacatcgaaattctgaacgacagccacactccaggtaccaaggtgtatgaagtcgttaacgaggaccccgaaacagccttctgtaccctggccaacagggaagtgttcaatacagacgagtgttcaatccagcactgtctttaccagtttactcggaatgagaagctacgggatgccaataagctcctctgcgaggtatgcactcgcagacagtgtaatgggccaaaggctaatattaaaggagagaggaaacacgtgtacactaatgcaaaaaaacagatgctgatttccctggcacctccagtgctgaccctccatctgaagcgctttcagcaggctggcttcaatctccgcaaggtgaacaagcacatcaaatttcctgaaatactcgatctagctccgttctgcacattgaaatgtaagaacgtcgctgaggaaaatacgagggtactttatagtctgtatggagtggtggagcacagcgggacgatgcgctccgggcattataccgcatatgccaaggccaggactgcaaattctcacctgagtaacctggtgcttcacggtgatatacctcaagatttcgagatggaatctaagggtcagtggttccacatttcagatacgcatgtccaagcagtacctactaccaaggtgttaaattctcaagcctacctgctcttctacgagcggatcctgtag

SEQ ID NO: 29644 - DNA, 2472 bp, Artificial Sequence
  Description of Artificial Sequence: Synthetic coding sequence
atgggcaaaaaacgcacaaagggcaagacggtccctatagacgactccagcgaaacattggaacccgtgtgcaggcacatccgaaagggtctggaacagggcaatctcaagaaggcactggtcaatgtcgagtggaatatctgtcaagactgtaaaacagacaataaggtgaaagacaaagccgaagaagagacagaagaaaaaccatcggtgtggctgtgccttaaatgtggccatcaaggctgcggaagaaacagtcaagagcagcatgctctgaaacattaccttacccccagaagtgagccacactgcctggtactctctctcgataattggtcagtttggtgctatgtttgtgataacgaggtccaatactgcagtagtaaccagttggggcaagtggtcgattatgtccgtaagcaagctagcatcaccacacctaaacctgctgagaaagacaacggcaatatcgagctcgagaacaagaaacttgagaaggagagcaaaaacgagcaggaaagagagaaaaaggagaacatggcaaaagagaatcctcccatgaacagtccttgtcaaatcacggttaagggcctctcaaatcttggtaacacttgtttcttcaacgcagtcatgcagaacctctcccagactcccgtgctccgtgagctcttgaaggaagtgaaaatgtccggtactattgtaaaaattgagcccccagacttagctctcacagagcccttggagattaatctggagcctccaggccctcttacgctggcaatgtcacaattcttgaatgagatgcaggagaccaagaagggggtcgttacgcctaaagaactcttttcacaggtctgcaaaaaggccgtccgatttaagggttaccaacagcaagacagccaggaacttctcagatatctgttggatggcatgcgtgccgaggagcatcagcgcgtctctaaaggaatcctcaaggctttcggaaattccacggagaagctggacgaagagctgaaaaataaagtgaaggactatgaaaagaagaagagcatgccttcatttgtcgatagaattttcgggggtgaactcacctctatgatcatgtgtgaccagtgtaggactgttagcctcgttcatgaaagctttctggatctgagcctgccagtcctcgacgatcagtctggtaagaagagtgtcaacgacaaaaacctgaagaagaccgtcgaggatgaagaccaggattccgaagaagagaaggacaatgactcttacataaaagagagaagcgatattccatccggtacctcaaaacacctgcagaaaaaggccaagaaacaggcaaagaagcaggccaagaatcagcgtcgccagcaaaaaatacagggaaaagtgcttcacctgaatgacatctgcactattgaccatccagaagactctgaatatgaagccgaaatgagtctgcagggagaggtcaacatcaagtccaatcacatctcacaggaaggcgtgatgcataaagaatactgcgtgaaccaaaaggacttgaacggccaggctaagatgatagagagtgtgaccgataatcagaagagtaccgaagaagttgacatgaagaacatcaatatggataatgacttggaagttctgacctccagcccaaccagaaacctgaacggcgcatatctgacagaaggatccaacggtgaagtggacatctctaatggtttcaaaaatttgaacctcaatgctgccctacaccctgacgagatcaatattgaaatactcaacgattctcacacccctggcaccaaggtgtatgaagtggtcaatgaggatccagagaccgctttttgtactctagcaaaccgggaggtattcaataccgacgaatgctcaatacaacactgcctgtatcaattcacgagaaatgagaagctgagggatgcaaacaagctgctgtgcgaggtctgcactaggaggcagtgcaatggccctaaagctaatatcaagggcgagaggaaacatgtttacaccaacgctaagaagcagatgctgatttccttagcgccacccgtcctaacattgcatctgaaaaggtttcagcaagcagggtttaacctcagaaaagtgaataagcacattaaatttccagagatccttgacctggcccctttctgcaccctgaaatgcaagaacgtggcggaagaaaatacacgggtactatatagtctttacggtgtcgtcgagcactcaggtaccatgcgtagtgggcactacacggcttatgcaaaggcccgaaccgccaatagtcatctgtccaatctggtgcttcatggcgatatacctcaggatttcgaaatggagtccaagggacagtggtttcatatttctgacactcacgtccaggccgtaccgacgacaaaggtcctgaattctcaggcgtacctgctgttttatgagaggatcctgtag

SEQ ID NO: 29645 - DNA, 1167 bp, Artificial Sequence
  Description of Artificial Sequence: Synthetic coding sequence
atggaccctatacggtccttctgtggcaagctcagatcactggcctccacactggattgcgaaacagccaggctccagcgcgctctggacggggaggagtcagactttgaggactatcctatgaggatcctgtacgacttacactccgaggtccagacacttaaggacgacgtgaacattctgctcgacaaagctaggctggaaaatcaggaaggcatcgactttatcaaggccaccaaggtgcttatggagaaaaacagcatggacataatgaagattcgcgaatacttccagaagtacggttacagcccacgcgtgaaaaagaatagtgtgcatgagcaagaagccattaattccgatcccgagctcagcaattgcgaaaattttcagaaaactgacgtgaaagacgatttgtcggacccgcctgtggctagctcctgtattagtgagaagagccctcgatctccgcagttgagcgatttcggccttgaacgttatatcgttagccaggtgctgcctaatccgcctcaggccgtcaataattacaaagaggaaccagtgatcgtgactccacctaccaagcagtccctagtcaaagtattgaagacccctaaatgtgctttgaaaatggatgatttcgagtgcgtcactccaaagctagaacatttcgggattagtgagtacacaatgtgtcttaacgaagattacaccatgggtctcaagaacgcgagaaataataagagcgaagaagccatcgataccgagtctcgcctgaatgacaatgttttcgccactccatcccccataattcagcagcttgagaagtcggatgcggagtacacaaactctcccctggtgccaactttctgtacaccgggacttaaaattccgagtacaaagaattctattgcgctagtgagcactaattaccccctaagcaaaactaattccagttcaaacgacttggaagttgaggaccggactagccttgtactaaacagtgacacttgttttgagaacttgaccgatccatccagtccaacaattagttcctacgaaaacctgctgcgaacccctactcctcccgaggttacgaaaattcctgaggatatccttcagaaattccagtggatctacccgacacagaagctcaataaaatgagatag

SEQ ID NO: 29646 - DNA, 1353 bp, Artificial Sequence
  Description of Artificial Sequence: Synthetic coding sequence
atgcgagagtgtatctcaatacatgtggggcaggcaggagtgcaaattggaaatgcgtgctgggaattatattgcctggagcatggcattcagccagatgggcagatgccctccgacaagaccatcggcggtggcgacgattcgttcaacaccttcttttctgaaacgggcgctggcaagcatgtaccccgtgcagtgttcgtggatctggaaccgacagtggtcgatgaggtaaggacaggcacctatcggcagctgttccacccagaacaactgatcactgggaaggaggacgcggctaacaactatgcaaggggtcactacacaattggcaaggagatcgtggatctggtgctggataggatcaggaagctggcagacttgtgtactggcctgcagggattcctgatattccattcatttgggggaggcacaggctctggcttcgcatccttattgatggaacgccttagcgtcgactatggtaaaaaatccaaactggaattcgctatctaccccgctccccaggtttcaactgccgtagtggagccgtacaacagcatccttaccacacacacaaccctcgaacattcagactgcgccttcatggtggacaatgaggctatctatgacatctgccgtcgaaacttggacatagaaagacccacctatactaatttaaatcgattgatcggccagattgtctcttccatcaccgcttcgctgaggtttgacggcgctctcaacgtggatctcacggagtttcagactaacctcgtgccgtacccaaggatccattttcctctggctacctatgctccagtcatttccgctgaaaaggcttaccatgaacagctctccgtggcggaaatcacaaacgcatgttttgagccagccaatcaaatggtcaaatgtgatcctcggcatggtaaatatatggcatgctgtatgctgtataggggtgatgtagttcctaaagatgttaacgcagccattgccacaatcaagacaaagcgaacaattcagtttgtagactggtgccccactggtttcaaagtgggaattaattatcaaccaccgacagttgtgcccggaggggatctagccaaagttcagcgagcagtatgtatgttgagcaacactactgctatagctgaggcttgggccaggctggaccacaagttcgatcttatgtacgccaaaagagcctttgtgcactggtacgtgggggaggggatggaagagggcgagttctcagaggcacgtgaggatctcgccgcacttgagaaggattacgaagaggtgggcgtcgacagcgttgaagcggaggccgaggagggcgaggagtattag

SEQ ID NO: 29647 - DNA, 3378 bp, Artificial Sequence
  Description of Artificial Sequence: Synthetic coding sequence
atgacagtggagcagaacgtcttacagcagagcgccgctcagaaacaccagcaaactttcttgaatcagctgagagagataaccggaattaacgacactcagatactgcagcaggcgctgaaagattcaaacggaaacctggagttggccgtggccttcctgacagccaagaacgcaaaaacaccacaacaggaggagacaacctattaccagactgctctgcctggcaacgatcgctatatctccgtagggagtcaggccgacacaaatgtgatagatctgaccggggacgacaaggatgacctgcagagggccatagctcttagtcttgccgaatctaaccgcgctttcagagaaacgggtatcactgatgaagagcaggctatcagccgagtcctggaggcctctatcgcagagaacaaagcatgcctgaaacgcacgccgaccgaggtgtggcgcgactctcgaaatccatacgatagaaaacgccaggataaagctcctgtggggctcaagaatgttggcaatacgtgctggttctctgccgtgatacagagcttgttcaatttactagaattccgccgactagtacttaactataagcccccttcaaacgcccaggatttacccagaaaccaaaaggagcaccggaatttaccctttatgagggaattgagataccttttcgctctcctcgtcggcaccaagcgcaagtacgtggacccaagcagagctgtcgagatcttgaaggacgcctttaagtccaatgattctcagcagcaggatgttagcgagtttacacacaagctgctcgattggttggaagacgctttccaaatgaaggctgaagaagagaccgatgaagagaagcccaaaaatccgatggttgaacttttctatgggaggttcctggctgtcggtgtcctcgaaggcaaaaaattcgaaaacacagagatgtttggccagtatcctctgcaggtcaatggtttcaaagatctgcacgaatgcctggaagctgctatgatcgaaggtgagatcgaatctctgcatagcgagaactccggaaagtcaggccaggagcactggttcacagaactgcctccagtattgacctttgaactctctcggtttgaatttaatcaagccctgggtagacccgaaaagattcataataaactggagttcccccaggttctgtatctcgatagatacatgcacaggaacagagaaattaccaggattaaacgagaggaaattaagcgcctcaaagactatttaaccgttctgcagcaaagactcgagcggtatctcagctacggtagcggcccaaagaggttccccttggtcgacgtactgcagtacgcccttgagttcgccagtagcaagcctgtctgcacctctcccgtggacgacattgacgcctcttctcctcctagcggatcgatcccgagccagacccttccctccactacagagcagcagggcgcactcagtagtgagctcccctctaccagcccttcctcagtggccgctattagttcccgaagtgtcattcacaagcctttcacacagtcgagaatcccaccagacttgccgatgcatccggctccccgacacatcacggaggaggaactgtccgtattagaaagctgccttcacaggtggagaacggagattgaaaatgacacgagagatctccaggagagtatttcaagaatacaccgaacaatcgagctgatgtacagcgataaaagcatgattcaagtcccgtaccgcctgcacgccgtactcgtgcacgaaggacaagctaacgccggtcactactgggcctatatcttcgaccatagggaatctcgctggatgaagtacaacgacatagctgtcaccaagtcttcttgggaagaactcgtacgggactcgttcggtggctaccgcaacgccagtgcatattgcctgatgtacatcaacgacaaagcacagttcctgattcaggaggagttcaacaaagagactggtcagcccctggtggggatagaaactctgccccctgatctaagagatttcgtggaagaggataatcaaagatttgaaaaggaacttgaggaatgggacgcgcaactcgcccaaaaggctctgcaagagaagctgttggccagtcagaaactccgcgagagcgagaccagcgtcaccaccgcccaagcagccggtgatcccgaatacctagagcaaccctctagatccgacttttcgaagcacttaaaagaagagacaatacagataattactaaggcgtcacacgagcacgaggataagtcccccgagacggttctccaatctaaaccagagaacactacatctcaaccactctctaaccaaagagtagtcgaagtggctataccacatgtgggcaagtttatgattgagtccaaggagggcggttatgacgacgaaattatgatgacccccaatatgcagggcattatcatggctatcggcaaatcccgttccgtgtacgataggtgcggaccagaagctggattcttcaaggctataaagcttgaatacgccagactggtaaagcttgcacaggaagacacccccccagagacggattacagattgcatcacgtggtggtgtactttatccagaatcaggccccaaagaagatcatagagaagaccctgctggagcagtttggcgaccggaatctttcctttgatgagcggtgtcacaatatcatgaaagtcgctcaggcaaagcttgaaatgatcaaacctgaggaagtaaacctggaggagtatgaagagtggcaccaggactacaggaaattccgggagacgaccatgtacctgattatcgggttggagaactttcagagggaaagttacattgacagcttactgttcctgatctgtgcgtaccaaaataataaagagctgctcagtaaaggcttgtatcgcggacatgatgaggaactgatctctcactacaggcgggagtgtctcctcaagctgaacgagcaagctgcggagctttttgaaagcggagaagacagggaagtgaataacggtctgattatcatgaacgaattcatcgtcccattcctgccacttcttctcgtagatgagatggaggagaaggacatcttagctgtggaggatatgcggaacagatggtgctcataccttggtcaggaaatggagccccacctgcaggaaaagctgacagactttctgccaaaacttcttgattgcagtatggaaattaaatcctttcacgaacccccaaagttaccctcctatagcacccatgaactttgcgaaagattcgccagaataatgctgtcactgagccgtacgcctgcggatggcaggtag

SEQ ID NO: 29648 - DNA, 1608 bp, Artificial Sequence
  Description of Artificial Sequence: Synthetic coding sequence
atggatctgagacaggcatgcaggacgccttctagagacgaagctggcgttgaactcctgatgacttactttatccagctcggctttgtggagtctaggttcttccccccaaccagacagatgggcttgcttttcacatggtacgacagtctcactggcgttcccgtctctcagcaaaacctattactcgagaaggcatccgtcctgttcaacaccggcgctctgtacacacagataggcacaaggtgtgacaggcaaacgcaggcagggctcgagagcgcaatcgacgccttccagcgggcagccggtgtgctgaattatctgaaggatacctttacccataccccgtcctacgacatgtcccccgctatgctgtctgtgcttgtgaaaatgatgctcgctcaggctcaagaatcagtcttcgaaaaaatctccctccccggaatccgcaacgagttctttatgttggttaaggttgcccaggaggccgctaaagtcggggaagtctaccagcagctgcacgctgctatgagccaggcacctgtgaaagagaacataccttacagttgggcgagcctggcttgcgtaaaagcccaccactatgccgctctcgctcactatttcaccgctattctcctaatagatcaccaggtcaaacctggcaccgatctggaccaccaggaaaagtgcctctctcaactttatgaccacatgccagaagggctcacgcctctcgcgaccctgaagaatgatcagcagcggagacagctagggaagtctcacctgagacgcgcaatggcgcaccacgaggaatcggtgagggaggcctctctgtgcaagaagctgagatcaattgaagttcttcagaaagtgttgtgtgccgcacaggaacgttctcgtctcacttatgcccagcatcaggaggaagacgacctactgaatcttattgacgctccgtcagtagtggctaagactgaacaggaggtagatatcatcctaccacagttcagtaagctgaccgtcacagacttcttccagaagctggggcctttatccgtctttagcgctaataaacggtggacaccaccacgatcgattcgctttaccgccgaagaaggggacttggggtttacactgcgtggaaacgcccctgtacaggttcacttcctcgatccatattgctccgctagcgttgcaggggcacgggaaggggattatatcgtgtccattcaactggtggactgtaaatggctaaccctctcagaggtcatgaagctcctgaaatcgttcggcgaggacgagattgaaatgaaagtcgtcagtctgctggactcgactagttccatgcacaataaatccgcgacttatagcgtgggaatgcagaagacgtacagtatgatctgtcttgccatcgacgacgatgacaagaccgataagacgaaaaaaattagtaaaaaattatcattcctgtcgtggggcacaaacaagaatcggcagaagtctgcttctacattatgcctcccgtcggttggagctgcgcgacctcaagttaagaagaaactccccagccccttcagcctcctgaatagcgattccagttggtactag

SEQ ID NO: 29649 - DNA, 2952 bp, Artificial Sequence
  Description of Artificial Sequence: Synthetic coding sequence
atggcaccacgactacagctggagaaggccgcttggcggtgggccgaaaccgtacggccagaagaagtgtcacaagaacacatcgagactgcctaccgtatttggcttgaaccctgtattaggggcgtgtgtaggcgcaattgcaaaggaaatcccaattgtctggtggggattggagagcatatttggctgggagagatcgacgaaaattcctttcataatatcgacgatccgaactgcgaaaggcgaaaaaagaactcattcgtgggactgacgaacctcggcgctacctgttatgtgaacactttcctgcaggtgtggtttctgaacctggagctgcgtcaggcactttacctgtgcccctcaacatgcagcgactatatgctgggggacggaattcaggaagaaaaggactacgaacctcagacaatctgtgaacaccttcagtacctgttcgctctccttcagaacagtaaccgtcgttacatagatccatctggctttgtaaaagccttgggtctggatactggacagcagcaggatgcccaggagttcagtaagctcttcatgtccttgcttgaggacacactgtccaaacagaaaaatccggacgtgcgcaatattgttcagcaacaattttgcggtgaatacgcctatgtgaccgtttgcaaccagtgcggtagagaatcaaaactcctctccaagttttacgagctggagctcaacattcagggccacaagcagcttaccgattgtatatcggagttcttgaaggaggagaagctggagggcgataaccggtatttctgcgaaaattgccagtcaaagcagaacgcgacccgaaagatccggctgttgagcctgccatgtacactgaacctccagctcatgaggtttgttttcgatagacagactgggcacaagaagaagctgaatacatatatcgggttttctgagattttggatatggagccatatgtagaacacaaagggggtagctacgtctatgagctcagtgctgttttgattcacaggggggtatccgcttattccggccattacatcgcacacgtcaaagatcctcagtctggagagtggtataagtttaatgatgaagatatcgagaagatggagggcaaaaagctgcagcttggcattgaagaggatctcgctgaaccctcgaaatcccagacaaggaaacccaaatgcgggaagggaacccattgcagtcgcaacgcttacatgctcgtgtatcgcctccagacacaggaaaaacccaatacaactgtccaagtgcccgcattcctccaggagctcgtcgatcgggacaattcaaaatttgaggagtggtgtatcgagatggctgaaatgagaaagcaatccgtcgataagggtaaagccaaacatgaggaagtaaaagagctctaccagagactgcccgcaggagctgaaccgtatgaatttgtgagcttggaatggctccaaaagtggctcgatgagagcactcctaccaaaccaatcgataaccacgcttgcttgtgttcacatgacaaactccaccctgacaagatcagtattatgaagagaatcagcgaatacgccgcagacatcttctacagccggtacgggggtggccctcgtctgaccgtcaaagctctgtgcaaggagtgcgtcgtggaaaggtgccgtatactgaggcttaaaaaccagctgaacgaggactacaagaccgtgaataacctgcttaaggccgctgtcaaaggctctgacgggttttgggttgggaaaagctccttgcgatcctggcgacagctggcgctcgagcaactggacgagcaggatggagatgcagaacagtcaaatggaaaaatgaacggcagcacactcaacaaagatgagtccaaggaggagcgcaaagaagaagaggagctgaactttaacgaagatattctctgcccacacggcgaactttgtatctccgaaaacgaaagaaggctggtttcaaaggaggcttggagcaagttgcaacaatactttccaaaggcacccgagtttcccagctacaaagagtgctgctctcagtgtaagattctggagcgcgaaggagaagagaacgaagccctgcataagatgattgccaacgagcagaagacatccctgccgaatctttttcaggacaaaaaccgtccatgtctatccaactggcccgaggacacggacgtcctgtacatcgtgtcacagttttttgttgaagagtggcgcaagtttgtgcgcaagccaacaagatgctctccggtgtccagcgtaggtaattcagctctactatgtccacatggcggtttgatgttcacatttgcctctatgaccaaagaagatagtaagctgatcgccttgatctggccttccgaatggcaaatgattcagaagcttttcgttgtcgaccacgtcatcaaaatcacacggatcgaggtgggggacgtgaatccctccgaaacgcaatacatttccgagcccaagctctgtcctgaatgccgagagggcttgctttgccagcagcaacgagatctgagggagtatacgcaagccaccatttatgttcacaaagtcgtcgataacaagaaggtcatgaaagacagtgcccctgaactgaatgtttcaagtagcgaaacagaagaggacaaggaggaggcaaagcccgatggcgagaaggatcctgactttaatcagatcatgcatgccttcagtgtggccccttttgaccagaatctcagtattgatggaaagatcctgagcgatgactgcgccacccttgggacacttggagtgatcccagaatccgtgatcctcttaaaagcagatgagcccatcgccgactatgccgctatggatgacgtcatgcaagtctgcatgcccgaggaaggcttcaagggcaccggactactgggccactag

SEQ ID NO: 29650 - DNA, 738 bp, Artificial Sequence
  Description of Artificial Sequence: Synthetic coding sequence
atgtcggtctgttccagtgacctttcatatgggagccgtgtgtgccttcccggatcgtgcgactcctgtagtgattcctggcaggtggatgattgtcccgaatcatgctgtgaaccaccatgctgcgctcctgccccttgtctgagcctggtgtgtacccccgttagccgagtgtctagtccctgctgtcgagttacttgtgagcctagcccttgtcagtcaggctgcacaagtagttgcacacccagttgctgtcaacaaagcagctgtcagccggcatgctgcacgagctcaccatgtcaacaggcatgttgtgtgcctgtgtgctgtaagaccgtctgctgcaagcccgtgtgctgtatgcctgtttgctgcggcccatccagcagttgttgtcagcagagcagttgccagcccgcttgctgcatcagttcgccttgccagcaatcatgttgtgtccccgtgtgctgtaaaccaatctgttgtgtgcccgtgtgttctggcgctagtagcctatgttgccagcagagtagctgtcagcctgcctgctgtacaactagttgttgcagacccagcagctcggtatccctgctttgtaggcctgtctgcagaccagcaagacgtgtcccagtgccttcttgttgtgttccaacatcatcatgccagccaagttgtgggagattggcctcttgcggctcgctcctctgtcggcctacatgttccagactggcatgctag

SEQ ID NO: 29651 - DNA, 1098 bp, Artificial Sequence
  Description of Artificial Sequence: Synthetic coding sequence
atggccgctagcaccatgagcgtatgctcaagcgacttatcttatggcagccgcgtttgtctgcctgggtcctgcgattcgtgcagcgactcgtggcaggtggacgattgcccagagtcctgctgtgagccaccgtgctgcgcgccagcaccctgcctgtcactcgtttgcaccccagtgtctagagtcagttcaccttgttgcccagtgacttgcgagccaagcccctgtcaatcaggctgtactagctcgtgcacacctagttgttgccagcaatcatcctgtcagctggcctgttgcgcctctagcccttgtcagcaggcatgttgtgtgccagtttgctgtaagactgtgtgctgtaagccagtctgctgtgtaagcgtgtgctgcggtgacagttcatgctgtcagcagtctagctgccaaagtgcctgctgtacctctagcccgtgccagcaggcatgctgcgtgcccgtctgctgtaagcctgtgtgttctggaatatcttcaagttgttgccagcagtccagttgtgtttcctgtgtttcatctccctgctgccaagcagtttgcgaaccgtcgccctgccagagtgggtgcacttccagttgcaccccatcctgctgccagcagtcctcatgccagccaacgtgctgtacaagttcaccatgccagcaagcatgttgcgtgccagtatgctgtgtgcctgtgtgttgcgtgcccacctgcagcgaagattccagctcctgttgccagcaatcctcatgtcagcctgcttgctgcacttcaagcccatgtcagcatgcatgttgcgtgccggtgtgcagtggagctagcacttcatgctgtcagcagtctagttgccagccagcttgctgcacagcatcttgttgcagaccaagcagctctgttagtctcctgtgccaccctgtctgcaaatcaacatgctgcgtcccggtgcctagctgtggcgcttcggccagctcctgccagccttcatgctgtcgtaccgcttcatgcgtgagtttgttgtgccgccctatgtgttctagacccgcatgctacagcctgtgctctggccagaagagcagctgctag

SEQ ID NO: 29652 - DNA, 816 bp, Artificial Sequence
  Description of Artificial Sequence: Synthetic coding sequence
atggcagcgtgtactatgtccgtttgctcatcagcgtgcagtgacagttggagagtcgacgactgcccagaaagctgttgtgagccaccatgtggcactgccccatgtctgactctagtgtgcacccccgttagctgcgtaagtagtccttgctgccaagccgcatgcgagcctagtccatgtcagagtggctgcacatcttcttgcactcccagctgctgccaaccagcatgttgcgcttccagcccctgtcagcaagcttgctgcgtgcctgtgtgttgtaagcccgtttgttgcctccccacgtgctcaaaggatagtagctcctgctgtcagcagtcaagttgtcaacccacctgctgtgcatcatctagttgccagcagtcttgctgcgttccggtatgctgtaaaccagtctgttgcgtgccaacctgctctgaagatagttcctcttgctgtcagcactctagctgccaaccgacttgttgcacaagcagcccttgtcagcagagttgctatgtcccggtgtgctgcaagcctgtctgttttaaaccaatctgctgcgtgcccgtgtgttctggagcaagtacatcctgctgtcagcagagtagttgccagcctgcttgctgtacaacatcctgttgcaggccctcgtcctcggtgagtttgctttgtaggcccatctgccgtccagcctgctgcgtgccaatctctagctgctgcgcacctgcttctagctaccaggccagttgctgccgccctgcttcatgcgtatcactgctgtgtcgacctgcttgctcaaggctggcttgttag

SEQ ID NO: 29653 - DNA, 1206 bp, Artificial Sequence
  Description of Artificial Sequence: Synthetic coding sequence
atgagtgtctgttcttccgacttgtcttactctagccgcgtgtgcctacccggttcttgcgacagctgctcggacagttggcaggtggatgattgcccggaatcttgttgtgaacccccttgttgtgctccctcctgctgtgcccctgcaccttgtctgagcctggtctgcacccccgtcagccgtgtttccagcccatgctgtcccgtaacatgtgagccatctccatgccagagtggctgcacttcatcatgcactccatcctgttgccagcaatcttcctgtcagttagcgtgttgcgcgagctcaccgtgtcagcaggcctgttgtgttcctgtgtgctgtaagactgtgtgctgcaagccggtttgctgtgtgcctgtatgttgtggggatagtagctgttgccagcagtcatcctgccaatccgcatgttgtacatcaagcccttgccagcaggcttgctgcgttcccatctgctgcaaaccagtctgttcaggcatcagcagctcctgttgccagcagagctcctgcgtgagctgtgttagtagtccctgctgtcaagctgtctgcgagcctagtccctgtcagtccggatgtatttcctcctgcaccccatcctgttgccagcagtcctcctgtcagcctgcatgctgcaccagcagtagttgccagcaagcttgttgcgttcccgtgtgctgcaaaaccgtctgctgcaagcctgtgtgttccgaggactccagttcctgttgccagcagtcatcctgtcaacccgcatgctgcacatctagcccatgccagcaggcatgctgcgtgcctgtgtgttgtaaacctgtttgctgtaaacctgtgggatccgtgcctatctgttctggcgctagctccctgtgctgccagcaaagcagttgtcagcctgcctgttgcacatccagccaaagccagcaaggctgctgtgtgcctgtgtgctgcaagcctgtatcctgcgttcctgtgtgctcaggtgccagttcatcctgctgtcagcaatcatcatgccaacccgcttgttgcacaacttcatgctgcagacctagctcatcggtgtcactcctttgccggccagtgtgccgacccgcttgttgcgtgcctgtcccctcttgctgcgcacccacttccagctgccagccttcctgctgtcggccagcgagctgcgtgtccctgctatag

SEQ ID NO: 29654 - DNA, 849 bp, Artificial Sequence
  Description of Artificial Sequence: Synthetic coding sequence
atggctgcctcaacaatgagcgtatgctcaagcgcgtgctccgatagctggcaggttgacgcctgtcctgagtcatgctgcgagccacactgctgcgctctgtcttgctgcgcacccgctccgtgcctgacattggtgtgcactccagtgtcccgcgtctcctctccctgttgccaagcagcttgcgaaccctcgccctgtcagagcggctgcaccagctcatgtacccctagctgctgtcagcagagctcctgtcaaccagcctgctgcacttcatcgccctgccaacaggcttgttgcgttccagtgtgttgcaaacccgtgtgctgtttgccaacttgctccaaggacagctcctcctgttgccagcagagtagctgtcaaccaacatgctgcgcttcctcatcgagtcagcagtcttgctgcgtgcccgtctgttgcaagcctgtttgctacgtgccgacttgttccgaagactcttcatcttgctgccagcagtccagttgccatcccgcatgctgcaccagctcgccgtgtcagcaggcctgctgcgtccctgtgaggtgtaagccagtgtgctgtaaacctatctgctgtgtacctgtatgctccggtgcctccacatcttgttgccagcaatctagctgccaacccgcatgctgcacgacatcttgctgtagaccatcaagctccgtgtccttgctgtgccgccctgtctgtaggccagcttgttgcatgcctgtgagttcgtgctgtgcccctgccagtagctgtcaggcctcctgttgtcgcccagccagttgcgtgtctctcctgtgtagacctgcctgcagccgacccgcttgttag

SEQ ID NO: 29655 - DNA, 891 bp, Artificial Sequence
  Description of Artificial Sequence: Synthetic coding sequence
atggcttcttccccgctccccggacccaatgacatcttgctagcatccccgagctccgcttttcaaccagatactctatctcagccccgtcccggacacgcaaatctgaaacccaaccaagtcgggcaggtgatattgtatggaatcccgattgtgtccctggttattgacgggcaggagagactgtgcctggcccagatttccaacaccctgttgaagaacttttcatataatgagatccataaccgacgtgtagctctcggcattacttgtgttcagtgtacccccgtccagctggaaatattaaggcgagccggtgctatgcccatcagctctcggaggtgcggcatgatcacaaagcgtgaagccgaacggttgtgcaagtccttcctgggggagaaccgcccacctaagctgcccgataatttcgcgttcgacgtctcgcatgagtgtgcctgggggtgtagagggagctttattccagcacgttacaacagctctcgcgcaaagtgtattaagtgctcttattgcaacatgtacttctcgccaaataagtttatctttcactcgcatagaacccccgatgcgaagtatactcaacccgacgcagccaactttaattcatggaggcgtcatcttaagcttaccgacaagagtcctcaggacgagttggtgttcgcttgggaggacgtgaaagccatgtttaacggcggatcgcgtaaaagagccctgccccagccaggggcacaccctgcgtgtcacccactgtcatctatccggacccgaagcatcgcgttttcgtctcagactctcatgctgctggaggaaattttcggagagaaagatcaagaagattatatgcgcataaacgaggataacatctggctctag

SEQ ID NO: 29656 - DNA, 5345 bp, Artificial Sequence
  Description of Artificial Sequence: Synthetic coding sequence
gtcaaaaagatccaccgccacagactgtcccccgctactgagaagggagcagcctctagcggggagggagacaaagatcctcctcctcccgctcacgaagatatcgccgtgaagggcactgcaaccgccgcaggaacagggccagggaccggagccgctgccgcagctgccgcagcagtgccacctcctcatccagctgcggctgctgccgctgctgccgctgctgctgccgcagccgcagctgcggtaccccctccacatccgaacatcagagcactgcagacccaggcaccacagcaaattccaagaggccctgttcagcagccactagaggatagaatcttcacacctgccgtgtcagcggtctattccactgtgacacaggtagctaggcagcctggcactccaaccccctccccatacagcgctcatgaaatcaacaaagggcaccccaacttagcagctaccccacccggtcatgcctcaagcccgggactcagccaaaccccgtaccccagcggtcagaacgccggtcctaccacccttgtatatccacagactccgcagacaatgaactctcagcctcagacaagatcccctgtgatcttttcgccaagccagtttttccagagaccgcagatacagccacctagagctactatccctaacagcagtccctccattcgaccaggtgctcagacccccaccgcagtgtatcaggcaaaccagcacatcatgatggtcaatcatctgccaatgccctatcccgtgccacaggggccacagtattgtattccgcaataccgccactccggccctccctatgtgggtcccccacagcagtaccctgtccagccacctggccctggtccattctacccgggtcctgggccaggggatttccctaacgcatatggcacacccttctatccttcccagccagtttaccagagcgcgccaatcatcgtcccgacacagcaacagcccccacccgctaaacgggagaaaaagaccatccgaattcgggaccctaaccaaggcggtaaggatattactgaggagattatgagtggagggggatcaagaaatccgacacccccaatcggcaggcccacctcaactccaaccccacctcaacttccatcccaagtgccagaacactctccagtggtgtatggcactgttgaatccgcccacctagccgcttccactccagtcaccgcagcctccgaccagaaacaagaagagaaacctaaacctgatcccgtgctcaagtccccctctcccgtgcttcggctcgtgttaagtggggagaaaaaagaacaggaggggcagacctcagagactacagccatagtgtcaatcgccgaactgcctctgccaccttcacctactacagttagttctgtcgccaggtctaccattgccgctcctacatcgagtgcacttagctcccagcccatcttcaccactgcaattgacgatcgttgtgagttaagctctcctcgagaagacactatacctatcccttcgcttacctcttgcacggagacttccgatccactgcccacaaatgaaaatgacgacgatatctgtaagaaaccttgtagtgtggcgcctaacgacattccactggtctccagcaccaatttgattaatgagattaatggcgtgagcgagaagctgtcagcgactgagtctatcgttgagatcgtaaagcaggaagtgctccctcttacactggagctggaaatcctggagaaccctcccgaagaaatgaaacttgagtgtatccctgccccaattacacctagtactgtgccttcattcccccctacacccccaacaccccctgcctctcctccgcacacacccgtcattgtgccagcggcagccaccactgtgagctcgccgagcgccgctattaccgtgcaaagagtgctggaggaagacgagtccatccgcacctgtttgtcggaggacgccaaggaaatccagaacaaaattgaagtcgaggccgatgggcaaacagaagagatactagattcacaaaatcttaactctcggagaagccccgtgccagctcagatagcaattactgttccaaaaacctggaaaaaacccaaagatcggaccagaacaacagaagaaatgttggaagctgagctggagctcaaagccgaggaggagttaagcattgacaaggtcctggaaagcgaacaagacaagatgtctcaggggttccaccccgagagagatccctccgacttgaaaaaggtgaaagccgtggaggaaaacggcgaagaggccgagccagtacggaatggagctgaatcggtttccgagggcgagggtatcgatgccaactcaggaagtaccgactcctctggtgatggagtaactttcccgttcaaacctgaaagctggaaaccaacagataccgaagggaaaaaacagtatgaccgcgagtttctgctggactttcagtttatgcctgcgtgcatacagaaaccagaagggttgccccctatcagtgacgtcgtgctggacaagattaatcagcccaaacttccaatgcgaacactggaccccaggatcctgccaagagggccagatttcactcctgctttcgctgatttcggcaggcaaacccctggaggcagaggcgtgccactgctcaatgtgggctctcgaagaagtcagcctgggcagcgccgagagccaagaaagatcattacagtcagcgttaaggaggatgtgcatctaaagaaggccgaaaacgcatggaagcccagccagaagagggacagccaggcagacgacccggagaacattaagacgcaagaactgttcaggaaggtgcggtccatcctgaataaactgactccacaaatgtttaaccaactcatgaagcaggtttccggcttaactgtagacactgaggaaagacttaaaggtgttattgatctcgtgttcgagaaagcaattgacgagcctagctttagcgtggcttatgccaacatgtgccgatgccttgtcacgctgaaagtaccaatggctgataagcccggaaatacagtgaatttccggaaactgctccttaatcgctgtcaaaaagagttcgagaaggacaaggccgacgatgatgtttttgagaaaaaacagaaggagttagaggctgcctctgccccagaggaacggacacgcttgcatgacgagctggaggaggcaaaagataaggccaggcgcagaagcatcgggaacattaagttcattggagagctttttaaactgaaaatgctcactgaggcgattatgcacgactgtgttgtcaagctgctgaagaaccatgatgaagagagtttagaatgcctctgtagattattaacaaccatcggtaaggatcttgattttgagaaggccaagcccaggatggatcaatattttaaccagatggagaaaatcgtcaaggagcggaaaacctcatccaggatccgctttatgttgcaggacgtgattgatctgcgcttatgtaattgggtgtccagaagggcggatcaggggccaaaaacaattgaacagattcataaagaggccaagattgaggagcaggaagaacagcggaaagtccagcagctcatgactaaagagaagcgacggcctggcgtccagcgggtcgatgaaggaggatggaatactgtccagggcgctaaaaatagtagagttctggatccttccaagttccttaagattaccaagcccaccattgacgaaaaaattcagctggtccccaaagcacagttgggatcttgggggaagggaagtagtggaggcgctaaggcttcagaaacagacgccctgcggagcagcgcctcaagtttaaaccggttctccgcgctgcagcccccagccccttccggatccacacccagcacccccgtcgaattcgatagcaggcgcaccctgactagccgagggtccatgggcagagagaaaaacgataagcccctgcccagtgccactgccaggcctaatacttttatgcggggaggcagctcgaaggatctgcttgacaatcaaagtcaagaggaacagcgccgagagatgctggaaacagtcaagcagctgaccggcggagtggatgtagagaggaacagtacggaggccgaacgcaacaaaactcgggagagcgccaaacctgaaatcagcgccatgtccgcccatgataaagcggctctctctgaggaagaactggaacggaaatcaaagtctatcatcgatgagttcttgcacattaacgattttaaggaagccatgcagtgtgttgaagaactgaatgcccagggactgcttcacgtgttcgtgagggttggggtggaatccacattagagagatcccagattacccgtgatcacatgggccaattgctgtatcaactggtgcagtccgagaagctgtccaagcaggatttttttaaaggtttctctgagaccctagagctggccgacgatatggccatcgacatcccccacatctggctgtaccttgcagaactcgttacaccaatgttaaaggagggcggaatttctatgcgcgaacttaccattgagttctccaagccgctcttacctgtgggacgagccggtgttctgctgtccgaaatcctgcacctgctgtgtaaacaaatgtcacacaagaaggtcggcgcactctggagggaggcagacctttcatggaaagattttctgcccgagggcgaagatgtgcataacttcttgcttgaacagaagctcgactttatcgagtcagactccccttgttcaagcgaagctctctcaaagaaagagctgagtgctgaagaactttacaagcgccttgaaaagctcattatagaagataaggctaacgacgagcagattttcgattgggtggaagctaatctagacgagattcagatgagcagtcctacctttctgagagccttgatgactgccgtctgcaaagcagccataattgcagattctagcactttcagagtggataccgccgtcattaagcagcgagttcccatcctcttaaaatatctcgattcggataccgaaaaggagctgcaggcgctgtacgcactgcaggccagcatcgtcaaactcgaccagcctgcaaatctgctgcgcatgttctttgactgcctgtatgacgaggaggtgatcagtgaggatgccttttacaaatgggagtcctccaaggatcccgctgagcaaaatgggaaaggagtggccttgaagtcagtgaccgctttctttacatggttgcgggaagctgaagaagaatctgaggataatta

SEQ ID NO: 29657 - DNA, 4758 bp, Artificial Sequence
  Description of Artificial Sequence: Synthetic coding sequence
atgaattctcaacctcagactcggtcacccttctttcaaaggccacagatccagccaccacgcgcaactatcccgaatagctccccatccatcagaccaggggctcagacaccaacagctgtttatcaggcaaaccagcacattatgatggttaaccatttacctatgccctatccagtgccgcaggggccacagtattgtattccacagtatagacattctgggcctccgtacgtgggccctccccaacagtacccggtacaaccaccaggcccaggacccttctaccccggaccaggccctggagattttcctaacgcctacggaactcctttttatccaagccagccagtgtaccagagcgcccctattattgtgcccacacagcagcagccccctcccgctaaaagggagaaaaaaacaatacgaataagggatcccaaccagggcggaaaggatatcacagaggagattatgtccggtggcggatccagaaaccccacaccaccaattggaaggcccaccagtacccctactccaccgcaacagctccccagtcaggtccctgagcattctccagtcgtttatggcaccgtcgaatccgctcatcttgctgcctctacccctgtgacagccgcttcagatcaaaagcaagaggagaaacccaagccagacccagtgttgaagtctccatctccggttttacgcttggtgctgtctggcgagaagaaagagcaagagggtcaaacatctgagacgacagcaatcgtgagcatcgctgaactgcctctgccacccagtcccaccactgtcagttcagtcgccaggagtactatcgccgcaccaacaagcagtgctctttcttctcagcctatattcacaaccgccatcgatgacaggtgtgaactatcaagtcctcgcgaagacacgatccccatcccgagcctcacctcttgcaccgaaactagcgatccgttacccacaaacgaaaacgacgacgatatctgcaaaaagccttgctctgtggctcccaatgatattcccctggtgagctccactaatctgataaacgaaatcaacggggtatcagagaaactttcggctactgagtctatagtggagattgtaaagcaagaggtgttacccctgacgttggagctggagatactggagaacccccctgaggagatgaagctggagtgcattccggcacccattacgccaagtaccgtcccatcgtttccgcctactcctccgactcccccagcatccccccctcatacacctgtcattgttcccgctgcagcgacaactgtatctagccccagtgccgctatcaccgttcagcgcgtcttggaggaggacgaatccatcagaacctgcttgtccgaagacgccaaggagatccagaacaagatcgaagtcgaagccgacgggcaaacggaggagattctagattcccagaatctgaattctcggaggtccccagtgcctgcccagatagccattacggttcctaagacatggaagaagccgaaagaccgcacccgcactactgaagagatgttggaggccgagctggaattgaaggcagaggaagagctgtccatcgacaaggttctggaaagcgagcaagacaagatgtctcaaggatttcacccagagagagatcccagcgatctgaaaaaggtgaaagcagtggaggaaaatggggaggaggctgaaccagtccgcaacggagcagagagcgtgtcagaaggtgaaggtattgacgcaaactctggttctaccgattcatcaggtgatggcgtgacttttccgtttaagcctgagtcatggaaaccgactgacactgaaggcaagaaacaatatgaccgggagttcctcctggattttcagtttatgccagcctgcatacagaagcccgagggactaccccctattagcgatgttgtcctggacaaaattaatcagcccaagttgccgatgagaacacttgatcctcgaatccttccgaggggacccgactttacgcccgctttcgcagatttcggtcggcagacacccggaggcagaggagtgcccctactgaacgtgggatcaagaaggtcgcaaccaggccagaggcgggagccgaggaagattattactgttagcgtcaaagaagacgtgcatctgaaaaaagctgagaacgcatggaaaccctcacagaagcgggactctcaggcggacgacccagaaaacataaaaactcaagaactgtttagaaaggtcaggagtatcctgaataaacttacaccccaaatgtttaaccagctgatgaagcaagtgtctggactgaccgttgatacagaagagagactgaagggcgtgatagatctggtgttcgaaaaagctatagatgaacctagtttcagtgttgcgtatgccaatatgtgtcggtgcttagtgacactcaaggtgcctatggccgacaagccaggcaataccgtgaactttcggaaactgctgttgaaccgctgccagaaggagttcgagaaggataaggcagacgatgacgtgttcgagaagaagcaaaaagaactggaagctgcgagcgctcctgaggagagaactaggctgcacgatgagttggaggaggctaaggataaggcacgtcgcaggtctattggcaacatcaagttcatcggcgagctatttaaattgaaaatgctgactgaagctattatgcacgactgcgtcgtaaaactgctgaaaaatcacgacgaggaaagcctggaatgtctttgcagactgttgactactataggcaaggacctggatttcgagaaagccaaaccacgaatggatcagtactttaatcagatggagaagattgtcaaagagcgaaagacaagcagccgaatccggttcatgcttcaggatgttattgatctgcgactgtgtaactgggtgagtcggcgagccgaccaagggcctaagaccatagagcaaatccacaaggaagctaaaatcgaggagcaggaggagcagaggaaagttcagcaactcatgacaaaggaaaagcggagacctggtgttcaaagggtggatgaggggggatggaatactgtgcaaggggctaagaattccagggtcctggatccgagcaagttcctgaaaattactaaacccaccattgacgagaagatccagctggtccctaaagcccagctggggagttggggcaagggctcgtctggcggtgccaaagctagcgagaccgacgcactgcggtctagcgcttcttcactcaacaggttctccgccctccaaccccctgcaccatccggatccacccctagcactcccgtggagtttgattccagacgaacactgacttcacgcggatcaatggggagggagaagaacgataagcccctaccctcagccactgcacgcccaaatactttcatgagaggtggttccagtaaagatttactggacaatcaatcccaggaagaacaaaggcgtgagatgttagagaccgtcaagcagttgaccggtggagtagatgtcgagcgaaactctactgaagctgaaagaaataagacccgtgagtccgctaagcccgaaatctctgcaatgtcagcccatgataaggctgcactcagtgaagaggaactggagcgtaagtccaaatctatcattgacgagttcctacacattaacgattttaaggaagccatgcagtgcgtagaagaattaaacgcccaggggttactccacgttttcgtccgggtcggtgtagagtccaccttggagcgctctcaaattactcgggatcacatggggcaattgttgtaccaactcgtgcagagcgaaaagctctctaagcaggacttttttaagggtttctctgagaccctcgagctcgcagacgatatggcaatcgacatcccacacatctggctgtatctggccgaactcgtgactcccatgcttaaggagggaggaatctctatgcgggagttgacaatcgagttctctaagcccctgctcccggtaggcagggcaggcgtgttgctatccgagatcctccatctcctgtgtaagcagatgtctcataagaaagtaggcgctctgtggcgcgaagccgaccttagctggaaagactttctgccagagggcgaggatgtccataatttcttgctggagcagaaactggactttattgaatctgattctccatgttccagcgaagctctgagtaagaaggaactttccgccgaagaactgtataagcgattagaaaagctgataatcgaagataaggctaatgacgagcagatctttgattgggtggaagcaaatctggatgagatccagatgtcgagccccaccttcctgcgggctctgatgacagcagtgtgtaaggccgcaatcatcgccgattctagcaccttccgagtggacactgccgttattaagcagagagtacctattcttctgaaatatctggatagcgacaccgagaaggagctccaggccctttacgcactgcaggccagcattgtcaagctggaccagcccgcaaacctcctccggatgttcttcgattgtctctatgatgaggaagttatctccgaggatgcattttacaaatgggagtcaagcaaggatccagctgagcagaatggaaagggcgtagccctcaagtctgtgaccgctttcttcacgtggctccgggaagctgaggaagagagcgaggataactag

SEQ ID NO: 29658 - DNA, 3087 bp, Artificial Sequence
  Description of Artificial Sequence: Synthetic coding sequence
atggcttcggaggccgtgaaagtcgtagtgcggtgcagacccatgaatcaacgcgaaagagagctgaggtgccagcccgtggtgacagtggactgtgcccgagcacagtgctgtattcagaatccaggcgctgcggacgagcccccaaagcagtttactttcgatggggcatatcatgtcgaccatgttactgagcagatttataatgaaatcgcttaccctctcgtcgaaggggtcaccgaagggtataacggtaccatattcgcctacggtcagacaggttctggtaaatcctttaccatgcagggactcccagaccctccttcacagcgtggcatcataccaagagcttttgagcacgtgtttgagtctgtgcaatgtgcagaaaacaccaaatttctggtacgagccagttatctggaaatttacaacgaggatgttcgcgatctactaggcgctgacactaagcaaaagctggagctcaaggagcaccctgaaaagggcgtctacgtcaaggggctgagcatgcacactgtccattccgtcgctcagtgcgagcacataatggagaccggatggaagaacaggagtgtgggatacaccttgatgaataaggatagctcacggagccactccatttttacaatctccattgagatgtctgctgtggacgaacgaggtaaggatcacttaagggcgggtaaacttaacctggtagacctcgctgggagtgagaggcagagcaaaacaggcgctacaggcgagaggctgaaagaagcaaccaaaattaatctgtctcttagcgctctcgggaacgtgattagtgccctggtagacggaagatgcaagcacgtgccctacagagactccaagcttacgcgcctgctacaggattctctgggtggtaacacaaagacacttatggtcgcctgcttaagtcccgctgataataactatgatgaaactctgagcacactgagatacgcgaatagagctaaaaacattcgtaataagccacgtatcaacgaagatcccaaggacgccctgctgcgggagtaccaagaagagattaaaaaactgaaggctattctgacccaacagatgtccccgtcctccctgtctgcccttttgagcaggcaagtgccacccgatcccgtgcaggtggaagagaaactcttgccacagcctgtgattcaacatgacgttgaggccgaaaagcagctgatccgcgaagaatatgaggagcgactggcacggttgaaagccgattacaaagccgaacaggaaagtcgagccagactggaggaagacataaccgccatgcgtaactcatacgacgtgcgcctgtctaccttggaggagaacttgagaaaagagaccgaagccgtgctgcaggttggcgtcctctacaaagctgaggtgatgtcccgcgctgaattcgcctcttcagccgaatatccaccagcgtttcaatacgaaaccgtggttaaaccaaaggtgtttagcaccaccgacacgctgccctctgatgacgtcagtaagacccaagtgtcaagcagattcgcagagttacctaaggttgagcccagcaagtcagagatctctttggggtcttccgagtcaagctcactggaggagacaagcgtgagtgaggccttccctggccctgaagagccaagtaatgtggaagtctcaatgcccacagaggagtctcgatccaggtactttctggatgaatgtttaggtcaggaagcagcaggccatttactgggtgaacagaattacctccctcaggaagaaccacaggaggtgcctctccagggactcctcgggctgcaggacccctttgccgaggtcgaagccaaactggcacggctctcttcaactgtggcgcgaacagacgctccccaagcagacgtccctaaagttccagttcaggtgcccgcacctactgacttgttggaacccagcgatgccaggcccgaggctgaggccgctgacgatttcccgcctagacctgaggtggatctggctagtgaagttgctctggaagttgtgagaaccgctgaacccggtgtgtggctggaagcccaagccccagttgctttagtggcccagccagaaccccttcccgctactgccggagtcaagagagaatccgtaggaatggaagtagcggtcctaaccgatgacccactgcccgtggtcgatcagcaacaggtgttggccagactgcagctgctcgaacaacaggtggtgggaggggagcaggctaaaaacaaggatctgaaagaaaagcataagcgtagaaagaggtacgccgacgagagacgcaagcagttggtggccgctctgcagaattccgacgaggattcaggcgattgggttcttctgaatgtgtacgacagtattcaagaggaggtcagggccaaatccaagctgctggagaagatgcagcggaaacttcgcgctgccgaggtggagatcaaagatttgcagtcagaatttcagcttgaaaaaatcgactacctagcaaccattagaaggcaggagcgggacagcatgctcctgcagcagctcctcgagcaagttcagcctcttatccgcagagattgcaattacagcaacctggagaagattttgcgcgaaagttgctgggatgaggacaatgggttctggaaaattccccatcctgtcatcacaaaaactagcctccccgtggtgagtacgggtccgcagaacaaaccggcaaggaagacatctgctgcagataacggtgagcctaacatggaagacgaccggtaccgactcatgctctctcggagtaactcggaaaacatagcaagcaattacttccgctccaagcgtgcgtcccagatcctaagcacagacgccaggaaatcactaacgcaccataattcacctccagggctttcgtgtccattaagcaacaattctgctattccacctacccaggcccctgagatgcctcagcctaggccctttagactggaaagcctagatatcccttttacgaaagctaagcgcaagaaatcgaaatctaattttggatctgaaccactatag

SEQ ID NO: 29659 - DNA, 921 bp, Artificial Sequence
  Description of Artificial Sequence: Synthetic coding sequence
atgaggcagcatgataccaggaatggcagaatcgtattaatttcaggccgtcggagtttttgttccattttcagtgtgcttccctatcgtgattcgacccaagtaggggacctgaagctggatggaggccgtcagtcaacaggtgcggtgtccttgaaagaaattatcgggcttgagggagtcgagctgggcgcagatggcaagaccgtgtcctacacccagttccttttgcccaccaacgccttcggggcaaggcgcaatactattgacagcacatcaagctttagccagttcagaaatctttcgcaccgctcactgtcaattggcagagccagtgggacgcaagggagcctcgacacgggcagcgacctgggggatttcatggattatgaccctaacctgttggatgatccacagtggccctgcggcaagcataagcgagtgctgatttttccatcatacatgacaactgtgattgactatgtgaagccatcagacctgaaaaaggatatgaatgagacttttaaggaaaagttcccccacattaaattaactctgtcaaaaatccggagcttgaaacgggagatgcgtaaattggctcaggaggactgcgggctcgaagaaccaactgttgccatggcctttgtgtatttcgagaaactggccctgaagggcaaactgaataagcagaacaggaagctctgcgctggagcctgtgtccttctcgcggcaaagattggttctgatctaaagaagcatgaagtgaaacacctaatcgacaaacttgaggaaaaattccggctcaacagacgtgaactaatcgcgttcgaattccccgtgcttgtcgctctggagtttgccctccacctgcctgagcacgaagttatgccacattaccgccgattggtccagagctcctag

SEQ ID NO: 29660 - DNA, 2820 bp, Artificial Sequence
  Description of Artificial Sequence: Synthetic coding sequence
atggctgcccagccacccagaggtattaggctatctgctctgtgtccaaagtttttgcatactaactctacgagtcacacctggccattctctgctgtcgccgagctgattgacaacgcctatgacccggatgtgaatgccaagcaaatttggatcgacaaaaccgttattaacgatcatatctgcctcacatttaccgataatggtaacggaatgactagcgataaactacacaagatgctgagtttcggtttctctgataaagtaaccatgaatggtcacgtgccagttggactgtatgggaatggttttaaatccggatctatgcggctaggcaaggatgccatcgtctttacgaagaatggggagtcaatgagtgttggtttactctcccaaacttatttagaggtgattaaggcagaacacgtggtggtgcctatcgtggcattcaacaaacatagacaaatgataaatcttgctgagtccaaagcatcactcgccgcaattttagagcattccctgttttctacagagcaaaaattgcttgcggaattggatgctattataggaaagaaaggtacacgtattattatctggaacctgagatcctacaagaatgccactgagtttgactttgaaaaagataaatatgacatacgaatcccagaggacttagacgagataaccggcaagaagggatataaaaagcaagagcggatggatcagatcgccccagagagcgactacagtctgagagcctactgttcaattctgtacctcaaacctcgcatgcaaattatcctccgcggacagaaggtcaagacacagctggtgagcaaatcactggcctatatcgagagagacgtgtacagaccaaagtttttgtccaagaccgttaggattacattcggcttcaactgcaggaataaagaccattacgggattatgatgtatcacagaaaccggttgataaaggcatatgagaaggtgggctgccagctacgggctaataacatgggagttggagttgtcggaataatcgagtgcaacttcttaaagcccactcataataagcaggacttcgattacaccaatgagtacagactaacaatcacggccctgggagaaaagctgaacgactactggaatgagatgaaagttaagaagaataccgagtatcctctgaatctgcctgtggaagacatccagaaacgccctgatcagacctgggttcagtgcgatgcatgtctaaagtggcgcaagctgcctgacggaatggaccagctgccagagaaatggtattgtagtaacaacccagacccacaattccggaactgcgaggtccccgaagagcctgaggacgaagacttggttcatcctacctacgaaaaaacctacaagaaaacaaacaaagagaagtttcgaataaggcagcctgaaatgatacccaggattaatgcggagctgctctttagacccaccgccctttctaccccttcattttctagcccaaaagagagcgttcccagacgccacctgagcgaagggaccaattcttatgcgactcgactcctgaacaaccaccaggtgcctccacagtccgaacccgaaagcaacagcctgaagcgccgactctctacccgcagttccatactaaatgccaaaaacaggagactctctagccaatttgaaaattccgtttacaagggtgatgacgatgacgaggatgtcatcatacttgaggaaaatagtaccccaaagcctgcagttgatcacgacattgacatgaagtcagaacagagccacgtggagcagggtggtgtgcaggtggaattcgtgggcgactcggaaccctgtggccaaacaggcagtacttcaacgagcagcagccggtgcgaccagggcaacaccgcagctacacagacagaggtgccatccctagttgtgaagaaagaagaaaccgtggaagacgagattgatgtaaggaatgacgccgtgattctgccatcttgtgtggaggctgaggctaaaattcacgagacccaagaaactactgacaaatctgccgacgacgcaggatgccagctccaagaattgagaaaccagctgcttcttgttaccgaagagaaagaaaattataagagacagtgtcatatgtttaccgatcaaattaaggttctccaacagcgaattttggagatgaatgacaagtacgtgaagaaggagacatgtcaccagagtacggagactgatgcagtgttccttctggagtctatcaatgggaagtcagagagcccagatcacatggtgtctcaataccagcaggcgctggaagagattgaaagattaaagaaacagtgtagcgcactccagcatgtgaaggctgagtgctcccagtgcagcaacaacgaatccaaatctgagatggacgaaatggcagtgcagcttgacgacgtgtttaggcagttagataagtgctccatcgagcgggaccagtacaaaagtgaagtcgaacttctggaaatggagaagagtcaaatacgttctcagtgcgaagaactcaagacagaagttgagcagctgaagtcaacgaaccagcaaacagccactgacgttagtacttcctccaatatcgaggaatcagtgaaccatatggacggcgaatctttgaagttgaggtccctgcgtgtaaacgtgggtcagctgttagccatgatcgtccccgacctggacctgcagcaagtgaattacgacgtggatgtagttgatgaaatcttgggacaggtcgtagagcaaatgagtgaaatttcctccacctag

SEQ ID NO: 29661 - DNA, 1149 bp, Artificial Sequence
  Description of Artificial Sequence: Synthetic coding sequence
atgtcagccgcaaaccctgagactcccaattcgactatttccagagaagcctccactcagtcctctagcgctgcggcttctcagggctgggtgctgcctgaggggaagatcgttccaaacactgtattcgtgggcggtatcgacgcaaggatggatgagacagaaatcggcagctgtttcggacggtacggatcagtgaaggaagtaaaaatcatcactaatcgaaccggagtgtcgaaaggctacggctttgtatccttcgtcaatgacgttgacgtgcagaaaatcgtcggatcgcaaatacacttccacgggaagaagctgaagctgggaccggcaattcgcaagcagaagctgtgcgccaggcacgtgcaaccacgtcctctcgtcgtgaatccgcctccgcctccacagtttcagaatgtgtggaggaaccctaacaccgagacttatttgcagcctcagataaccccaaatcccgtcacacaacacgtgcaggcctattccgcatatcctcacagccctggccaggtcattaccggatgccagttgctggtctataactaccaagaatatccaacatatcccgacagcgcctttcaggtgaccacaggataccagctgccagtgtataactatcagccttttccagcatatcctcgaagcccttttcaggtgactgctggataccagttgccagtgtataactaccaggcttttcctgcgtatcctaattccccgtttcaggttgcaactggataccagttccctgtgtataactatcagccatttcctgcctacccttctagcccctttcaagtcactgctgggtatcagctgcccgtgtacaattaccaggcgttccctgcttatccaaacagcccttttcaggttgccactggttatcagttcccggtgtataattatcaagcgttcccagcctacccaaactcacccgtacaagtgactacaggttatcagctcccggtatataactaccaggcatttcccgcttaccccaactcaccttttcaagtggccaccggttatcagtttcccgtctataattatcaggctttccctgcatacccaaatagcccggtgcaggtcacaaccgggtatcaactgcctgtctacaactaccagtag

SEQ ID NO: 29662 - DNA, 5057 bp, Artificial Sequence
  Description of Artificial Sequence: Synthetic coding sequence
atgtcattacccttctaccagcggtgtcatcaacactatgatttgagttacaggaataaggatgtgaggtccacagtttcccactaccagcgagagaaaaagcgctccgccgtgtatactcaaggaagcactgcatactcatctcgaagtagcgccgctcaccggcgtgagtccgaggcgttccgccgagcaagtgcctcctcgtcacagcagcaggcttcacagcacgcgctgagttcagaggtgtcccgcaaggcagcaagcgcatatgactatgggtccagtcacggcctgacggactcctctctgttgctcgacgactattctagcaagctaagtccgaaacctaaaagggccaagcactcacttctgtcaggcgaagagaaggaaaacttgccgtctgattacatggtgcccattttttcaggaagacagaaacatgtgagtggtattaccgatacagaagaggaacgcattaaggaggcagcagcatatatagcacagcgtaatctgctggcaagcgaagaagggatcactaccagtaagcagtccacagcatctaagcaaactactgcctccaagcagagtactgcctccaagcagagtaccgcaagtaagcagagtacagcctctcgtcagtctaccgccagtcggcaatcagtggtctctaaacaagcgacctccgccctgcaacaggaggagacgtccgagaaaaagagtcggaaggtggtgatccgcgagaaagctgaaagactcagccttagaaaaaccctggaagagaccgaaacataccacgccaaactgaacgaggaccacttgcttcacgcacccgagttcatcattaagccacggagccacaccgtgtgggagaaggagaacgtcaaactccactgcagcatcgcaggttggccagagccccgagtcacctggtataaaaaccaagtaccgatcaatgtgcatgctaatccaggtaaatatatcatcgaatcccggtacggaatgcacacattagaaatcaatggctgcgacttcgaggatacagcccagtatcgcgctagtgccatgaatgtcaagggagagctgtccgcctacgccagtgtggtcgtgaagcggtataaaggtgaattcgatgaaacgagattccacgccggagctagcaccatgccgctgagctttggagtcaccccctatgggtacgccagtagattcgaaatccacttcgacgataagtttgacgtgtcgttcggccgagaaggcgaaaccatgtctttgggttgtagggtggttataacccccgaaattaaacatttccagcctgagattcagtggtaccggaacggagttcccctgtctccaagcaagtgggttcaaacactctggtcaggcgaaagagctacactgactttttcccacctgaacaaggaggatgagggcctgtatacaatacgggtgcggatgggagaatactatgaacagtattccgcctacgtgttcgtacgcgatgcggacgccgaaattgagggcgcacccgcagccccactcgatgtaaagtgccttgaagcaaacaaggattacatcataatctcatggaagcagcccgcagtggacggagggagcccgatcctagggtactttattgacaaatgcgaggtgggtaccgactcttggagccagtgcaatgacaccccagttaaattcgcaaggttccctgtcacaggactgatagaaggcaggtcatacatcttcagagtacgggcagtgaacaagatggggataggatttccctcccgggtgtctgagccggtcgcggctttggaccccgctgagaaggctaggctcaaatctcggcctagcgcgccttggactggtcagatcatcgttaccgaggaggaaccctcggagggcatcgttccaggcccacccaccgacttgtccgttacggaggctaccagatcctacgtggttttgtcctggaaaccaccaggtcagaggggtcacgagggtatcatgtacttcgtggaaaagtgtgaggctggcaccgaaaattggcagagagttaacactgagctgccagtaaagagtcctcggtttgccctattcgatttagccgagggcaagtcctactgctttcgggttcggtgcagtaacagtgccggagtgggtgagccctccgaggcaaccgaagtcacagtggtaggggataagttggacatcccaaaagccccaggcaagataattccaagcaggaacactgatacctcagtggtggtatcctgggaagagtccaaagacgcgaaagagctggtgggatactatatcgaggcctctgtggctggttccggtaagtgggagccctgtaacaacaatcccgttaagggttctcgctttacttgtcatggcctggtcaccggccagtcgtatattttccgggtgagggcagttaatgcggcagggttatctgagtattcccaggatagtgaggcgattgaggtcaaagccgctatcggaggaggcgtgagtcctgacgtatgtcctgcactgtcagatgaaccagggggactgacggccagtcgtggtcgagttcacgaggccagccctcctaccttccagaaggatgccctgcttggctccaagcctaacaaaccctcattaccgtctagtagccagaacctgggtcagactgaggtcagtaaggtgtccgaaaccgtgcaagaagagctcacacctcctccccagaaagcagccccacagggaaaaagtaagagtgatccattaaagaagaagacggaccgggctcctccgagccctccatgcgacattacctgtctggagagctttcgagattcaatggtgctgggctggaagcagcccgacaagataggcggtgcagagatcaccggatactatgtgaactatcgggaagttatcgacggagttccaggaaagtggcgcgaggccaatgttaaagctgtctcagaggaggcatataaaattagcaacctgaaggagaatatggtctatcagttccaggtcgctgccatgaacatggcagggctaggggcaccctctgcggtctcggagtgcttcaagtgcgaggagtggacaatcgcagtgcctggcccaccccattcactgaagtgcagtgaggtcagaaaagactcattggtgctgcaatggaaacccccagtgcatagcggcagaacacccgtcacgggctactttgtggatcttaaggaagctaaggctaaagaggaccaatggagaggcctgaatgaggcggctatcaaaaatgtatacctcaaggtgagggggctgaaggagggcgtgagttacgtgtttcgagtgcgcgctatcaatcaagccggtgtggggaagccaagtgacctggctggaccggttgtggccgaaaccaggcccggaaccaaggaggtcgtggtgaacgtcgacgatgacggggtcattagtctgaattttgagtgcgataagatgacaccgaagagcgagtttagctggtcgaaagattatgtgagtaccgaagattctccaagacttgaggtcgaatctaagggaaacaaaaccaagatgacttttaaggacctcggcatggacgacctgggcatctactcctgtgacgtcaccgatacggacggaatagctagttcctacttaatcgacgaggaagagctgaagcgtctgctagccctgagccacgaacacaagtttccgacggtaccggtgaaaagtgaactagcagtggaaatcttggagaaaggtcaggtccggttttggatgcaggccgaaaaactcagtggcaatgctaaagttaattatatcttcaatgagaaagagatattcgaaggccctaagtacaagatgcacatcgaccgcaacacagggattatagaaatgttcatggagaagctccaagacgaggacgaaggcacctatactttccaacttcaggacggcaaggcaaccaaccattccaccgtggtgctggttggagacgtgttcaagaaattgcaaaaagaagccgaattccagaggcaggagtggatccgaaagcagggaccacatttcgtggagtacctgagctgggaggtcaccggggagtgtaatgttctcctgaagtgcaaagtggctaacatcaagaaggaaactcacatcgtctggtacaaggatgaacgggagatctctgtggacgaaaagcacgatttcaaagacggcatttgcaccctcctgattaccgagtttagcaagaaggacgccggtatttacgaagttattcttaaggatgacaggggcaaagacaagtcacgactcaaacttgtcgacgaggcatttaaggaactcatgatggaggtatgcaaaaaaatagctctatcagccacagatttgaagattcagtccacggctgaagggattcagctatattcatttgtgacttattacgtggaagacctgaaagtcaactggtcccataatgggtctgccattcggtatagtgatcgagttaaaaccggcgtaaccggagaacagatttggctacagattaatgaaccaactcccaacgacaaggggaagtatgttatggagctctttgacggaaagactggacaccagaaaaccgtcgacctatctggtcaagcctacgatgaagcctacgccgaatttcagagactgaaaaaatcgctgctgtttcaaaaagaccgcgcacgcgtgttagggggactccctgacgtggtcactatccaggaaggaaaggcccttaacctcacttgcaacgtctggggggatccaccaccagaggtcagctggctcaaaaatgaaaaagctctagcctccgatgatcactgcaatctgaagttcgaggccggaagaaccgcatatttcaccattaatggagtgtctacagctgactccgggaaatacggtctcgtggttaaaaataaatatgggtccgaaacatctgatttcaccgtgtccgtattcattcctgaggaggaagcaagaatggcagcactggagagcctcaaggggggaaagaaggctaagta

SEQ ID NO: 29663 - DNA, 3456 bp, Artificial Sequence
  Description of Artificial Sequence: Synthetic coding sequence
atgatggccgcagcgctgggacccccagaagtgatagcacagctagagaacgcagctaaggtgctgatggctcctccatcaatggtgaataatgaacagcggcagcacgccgagcatattttcctgtccttcaggaagagcaagtctccattcgctgtgtgtaagcatatcttggaaacttcgaaagtcgactatgtactgtttcaggccgcaaccgccatcatggaagcagtcgtcagagaatggattcttcttgaaaagggctcaattgagtctctgcggacctttctgcttacctatgttctgcagcgcccaaacctgcagaagtatgtacgggaacagattctgctggccgtggcagtgattgttaagagagggagcctggataagagtatagattgcaaaagtatttttcatgaagttagccaactgatcagctctgggaatcctaccgttcagacgcttgcgtgcagcattctgactgcgttactctcagagtttagttccagttccaaaacatctaatattggattgtccatggagttccacggaaattgcaaacgggtcttccaggaagaggacctgcgtcagatttttatgttgacagtggaagtcctgcaggaattctcaagacgtgagaacctaaacgctcagatgtcctccgtcttccaacgctacctggcactggccaaccaggtgctctcgtggaacttcctacctcccaaattgggtcggcattatatcgctatgttcgagtcctcccagaatgtcctgctgaagcccactgagtcttggcgtgaaactttgctggactctcgggttatggaattgttcttcactgtgcataggaagattagagaagattctgacatggctcaggactcactccaatgcctcgcacagctggcctctctccacggtccgatctttcctgacgaaggttctcaggtggactatctggcacatttcatcgaaggcctgttgaacaccataaacggcatcgaaatagaggactccgaggccgtgggcatttcttcaatcatctccaatctcataactgtgttcccgcgaaatgtgttgaccgccattccctccgaactcttttcctccttcgtcaactgccttacccacttgacttgcagttttggacggtcagccgctttagaagaagtgttggacaaggatgatatggtatatatggaagcttacgataaactgctcgaatcctggctcacacttgtccaggatgacaagcatttccataaagggttttttactcagcacgccgtacaggtttttaactcttacattcagtgtcacctcgcagcaccagacggcactcggaacctgacagctaacggcgtggcctcccgcgaagaggaggaaatctcggaattacaggaagacgaccgggaccagttcagcgaccagctcgctagtgtaggaatgttaggcaggattgctgccgagcattgcattccattattgacgtcactcctcgaagagagagtgacaagactccacggacagctccagaggcaccagcagcaactcctggcatccccaggctcatccactgtggataataaaatgctggatgacctttatgaagatattcattggctgattcttgtcacagggtacctgcttgccgacgatacccagggcgaaacccccctcatcccgccagaaataatggagtattcgatcaagcactccagcgaggtggacatcaacaccacactgcagatcctcggcagcccgggagaaaaagccagctctattcctggttataaccggactgactctgtaattcgactgctctcggctattctgcgggtttctgaagtggagtctcgcgcaatacgggcagatctgactcatctcttatcaccccaaatgggaaaggatattgtttggttcctgaaacgatgggcgaagacctacctgcttgtggatgaaaagctttatgaccagattagtctgcccttttcaaccgctttcggcgcagatactgaaggatctcagtggattattggttacctgctacagaaggtcatttcaaacctgtcagtatggagctctgagcaggacctcgcgaatgacactgtacagttacttgtcacgctggtcgagcgtcgggagagggcgaacctggtgatacagtgcgaaaactggtggaatctcgctaagcagttcgcctcccgctctccaccactcaactttctttctagccctgtgcagaggaccctcatgaaagctctggtcctcggaggtttcgcccacatggataccgaaactaaacaacagtattggacagaggtgctccaacccctccagcaaagatttctgagggtcattaatcaggaaaacttccaacagatgtgccaacaagaagaagttaaacaggagatcacggccacacttgaggcattatgcggcatagctgaggcaacccaaatagacaacgtcgccatcctcttcaacttcctcatggacttcctgacaaattgcattggactgatggaggtgtacaagaatacacctgagaccgttaatctgatcatagaggtgttcgtcgaagtggctcacaagcagatctgttacctgggagagtccaaggcaatgaacctatatgaagcgtgcctcaccctgctgcaggtatactctaaaaataaccttgggcgacagcgcatcgacgttacagctgaggaggagcaataccaggacctactgctgatcatggagctcctgaccaatttgctgtcgaaggaattcatcgactttagcgatacagacgaggtgtttcgcggtcatgaacctgggcaagccgcaaatagaagcgtctccgcagctgacgtcgtgctgtatggcgtgaatctgattctgccccttatgagtcaggatttactcaaattcccaaccctgtgtaatcaatattataagctgatcactttcatctgtgagatcttccccgagaagataccccagctgccagaagaccttttcaagagtctgatgtacagtctcgaactcggaatgacctctatgtcttctgaggtttgccagttgtgcctcgaagccctcacacctctcgctgaacagtgtgcgaaagcgcaagagactgactctccactgtttctcgctacacgtcattttctgaaacttgtcttcgatatgctggtgctgcagaaacacaacacagagatgacgacagccgctggagaagctttttacaccctggtgtgcctgcaccaagccgaatatagtgagctggttgagactctgctttccagccagcaggatcccgtgatttatcaaagactcgcagacgcatttaacaagttgaccgcctcctcaaccccccctacactggacaggaagcagaagatggcgtttcttaagtcgcttgaagagtttatggctaacgtgggcggactgctgtgcgtcaagtag

SEQ ID NO: 29664 - DNA, 420 bp, Artificial Sequence
  Description of Artificial Sequence: Synthetic coding sequence
atgggcggaggtgaaaggtacaatattcccgctccccagtcccgaaatgttagcaagaaccagcagcagctcaaccgacagaagaccaaagaacagaactcccagatgaagattgtgcacaagaagaaggagcgtggccacggttacaattcctcagcagcagcttggcaggccatgcagaatggcggaaagaacaagaatttccctaataatcagtcttggaatagcagtctgtccggccctcgccttctcttcaaaagccaggccaatcagaattacgccggtgccaaattctctgagccaccttccccgtccgtgctccccaagccgccatcacactgggtgcccgtgagcttcaatccgtctgacaaggaaattatgaccttccagcttaaaactctgttgaaggtgcaggtctag

SEQ ID NO: 29665 - DNA, 984 bp, Artificial Sequence
  Description of Artificial Sequence: Synthetic coding sequence
atgaaagaaatgctggccaaggatctggaagaatctcagggaggcaaatccagcgaagtactgagcgcaaccgagcttagagttcaactggcccaaaaggagcaggaattggcacgtgcaaaggaggcgctccaggccatgaaagccgatcgtaagcgcctgaaaggcgaaaaaactgacctcgtaagccagatgcagcagctctacgctacacttgagtcccgagaggagcagctgcgggacttcatccgaaactacgaacagcaccgaaaggaatcggaggatgccgtgaaggctctagctaaggagaaggatctgctggaaagagaaaagtgggagctgaggagacaagccaaagaagcgactgatcacgccaccgccctgcggtcgcagctagatctgaaagataatagaatgaaggagctcgaggccgagttagccatggccaaacaatcattagccacattgacgaaagatgtgcccaagaggcactccctggctatgcccggtgaaacagttctgaatggcaatcaggagtgggttgttcaagctgacttgcctctgaccgccgctatccggcaatctcaacagacattataccactctcaccctcctcatccggctgacagacaggccgtgcgcgtgtcaccatgtcattcaagacagcccagtgtgatcagcgacgccagtgctgcggaaggcgacaggtcctcgacaccttctgatatcaatagccctaggcatcggactcatagcctttgcaacggggactctccaggacccgtccagaagaatctgcataaccccatcgtacaatcactggaggacctggaagatcaaaagagaaaaaagaagaaggaaaaaatgggctttggtagtatctcaagggtctttgctagaggcaaacagcgaaagagtctggaccccggactgttcgacggcaccgctcctgactactatatagaggaagacgctgactggtag

SEQ ID NO: 29666 - DNA, 984 bp, Artificial Sequence
  Description of Artificial Sequence: Synthetic coding sequence
atgaaggaaatgctggcgaaggatctcgaggaatcgcagggcggaaagtcatcagaggttctctcagccacagagctgcgcgtgcaactggcacagaaagaacaggagctagctagagccaaagaggccctccaggccatgaaggccgacaggaagcgattaaagggagaaaagaccgacctcgtgagccagatgcagcagttgtatgccacacttgaatctagagaggagcaacttcgtgactttatccggaattatgagcaacatagaaaggagtccgaggatgccgtcaaagctctcgccaaagagaaagacctgctcgaaagggagaagtgggagctgcggcgtcaggccaaggaggccacagatcacgctacggcactccgaagccagctggatctgaaggataaccgtatgaaggagctcgaggccgaactggcaatggctaaacagtctctcgccactctaaccaaggacgtgccaaagaggcactcccttgccatgcctggagaaacagttctcaatggaaaccaagagtgggtggttcaggccgacctccctctgaccgccgcaattcggcaaagccagcagaccctctaccacagccatcctccccacccagctgaccggcaggcagttcgagttagcccttgccactcccggcagcccagcgtgatcagcgatgcttccgccgctgaaggcgaccggagctcgaccccctctgacatcaattccccaaggcaccgaacccactccctttgcaacggggactccccaggacctgtccaaaagaacctccataaccctatagtgcagtctctggaagatctggaggaccaaaagcgcaaaaagaagaaggaaaagatgggatttggcagcataagcagagtgtttgcgaggggcaagcaaagaaaaagtcttgacccgggtctctttgacggtaccgccccagattactacattgaggaagatgctgattggtag

SEQ ID NO: 29667 - DNA, 609 bp, Artificial Sequence
  Description of Artificial Sequence: Synthetic coding sequence
atggacgaacaggccctgttgggcctgaatcccaacgccgatagtgatttcaggcaaagggccctggcatactttgaacagctcaagatctctcccgacgcctggcaggtctgcgcagaggccctggcgcagcggacgtatagtgacgaccacgtcaaatttttttgcttccaggtcttggagcatcaagttaagtacaaatacagcgagctgaccacggtccaacagcagctgattagagagactctaattagttggctgcaggcccagatgctcaatcctcagccggaaaagacttttatacgtaacaaggctgctcaggtattcgcattgctctttgtgaccgagtatctgaccaagtggccaaagtttttttttgatattttgagcgtggtggatttaaaccctcgaggggtggatctctatctacggatcctgatggctatcgactcagagctggtcgatagagatgtcgtccacaccagcgaggaggcacgtcggaataccctgatcaaggacaccatgagagagcagtgtattcccaatctcgtggaatcttggtaccagatcttgcagaactaccaattcactaactcagaggtgacgtag

SEQ ID NO: 29668 - DNA, 1803 bp, Artificial Sequence
  Description of Artificial Sequence: Synthetic coding sequence
atgagtcgtgtagctaaatataggcggcaggtgagtgaagacccggacatcgacagcctgctcgaaactctcagccccgaggagatggaggagctggaaaaagaactcgacgtggtcgacccggatggcagtgtgcctgttggtctcaggcagagaaatcaaaccgagaagcaatctacaggagtgtacaaccgggaggcgatgttgaatttttgtgaaaaggagaccaagaaactcatgcagcgggagatgtcaatggatgagtctaaacaagtggagaccaagacagatgccaagaatggcgaggaacggggtcgtgacgctagcaagaaggcacttgggccacggagagacagcgacctgggaaaagaacctaagagaggcggactaaaaaagagtttcagccgcgacagggacgaagcgggtgggaagagtggggagaaacccaaagaggagaagatcatccgcggtattgacaaagggagagttcgcgcagccgttgacaaaaaggaagccggtaaagacggcagaggcgaagagcgagccgttgctacgaagaaagaggaggagaaaaaaggatccgatcggaacacaggtctcagtagagacaaagataagaagagggaagagatgaaggaggtcgcgaaaaaagaggacgatgagaaagtcaagggcgaacgaaggaacaccgatactaggaaagagggcgaaaaaatgaaacgcgctggaggcaataccgatatgaagaaggaggacgagaaagttaaaagggggaccggaaacaccgatactaagaaggacgacgagaaggtcaaaaagaatgagccactacacgaaaaggaagctaaagacgattccaaaactaagacccccgagaagcagactccatctggacctactaagccttcagagggaccagcgaaggtcgaagaagaggccgctccttcaatttttgacgaaccccttgagagagtcaagaacaatgaccccgagatgacggaggtcaacgtgaataattcagactgcattactaacgagatactcgttcggttcactgaggccctggaattcaacaccgtggtcaaactgttcgccctggccaacaccagagccgacgaccacgtcgcttttgctatcgccattatgctcaaagctaacaaaactattacatctctgaatctggattctaaccatattacgggaaaggggattctggccatttttagggctctgcttcagaataacactctgacggaattacgctttcacaaccagcggcatatttgcggcggaaagaccgagatggaaatcgccaaacttctgaaggagaacactactctcttgaaactgggttaccacttcgagctcgcaggacccaggatgaccgtgaccaacctgctgtccaggaacatggataagcagagacagaaaaggctgcaggagcagagacaggcccaggaggctaagggtgaaaaaaaagatctgctggaagttcctaaagctggggcagtggctaaaggctcgcctaaacccagcccacagccaagtcctaagccttcccctaagaacagtcccaagaagggaggggctccagccgctcctccgccacctcccccacccctggcccctcccctcattatggaaaacctaaaaaacagcttgtcccctgccactcagcggaaaatgggggataaggtgctgcccgctcaggaaaagaacagccgggatcagctcctcgctgcgatcagatcaagtaacctgaaacagctcaaaaagctggaactgcctcttttactccaatag

SEQ ID NO: 29669 - DNA, 201 bp, Artificial Sequence
  Description of Artificial Sequence: Synthetic coding sequence
atgatcgggacaaccgaagttccctgctgtggaccaagtgcaacctgggcactacgctggtctgatcagatcaccctgccttcactcccgtggaccatgtcctctctgtggtgtatccctctgaaaggaatgctcgcgacttgcccggtatctctgttagaacacgcctattccaacgctttaagagggtggaagccttag

SEQ ID NO: 29670 - DNA, 2121 bp, Artificial Sequence
  Description of Artificial Sequence: Synthetic coding sequence
atggctaccgctaactttggcaagatacagatagggatctacgtggagattaaacgcagtgacgggcgaattcaccaggcaatggttacgtccctgaatgaggataatgagtcagtgaccgtcgagtggatagagaacggagatacaaaagggaaggagatagatctggagtcaatatttagcctgaacccagacctcgtgcccgacgaggaaatcgagcctagccccgagaccccgccacctccagcaagctctgccaaagttaataagattgtgaagaatcggagaactgttgcaagcattaagaacgacccaccaagtcgcgataacagggtggttgggtctgcccgagctagaccctcccaatttcctgagcagtcttcttctgcccagcagaatggatctgtgtcagacatcagtccagtgcaagcagcaaagaaagagtttggtccaccaagcagaagaaagtccaactgtgtgaaggaggtcgagaagttgcaggagaagagggaaaagaggagacttcagcaacaggagctccgcgaaaagagggcacaggacgtagacgccacaaatcccaactacgagatcatgtgcatgatccgagacttcagaggttcattggactatcgacctctgaccacggccgaccccatcgacgagcaccgcatttgcgtctgtgttagaaaacgtcccctgaataaaaaagagacacagatgaaagacctcgatgtgatcaccataccatcaaaggatgtggtaatggtgcacgagcccaagcagaaggtcgatctgacgagatacctggagaaccaaacttttcggtttgattatgcgtttgatgattcagccccaaacgagatggtttaccgatttactgccaggcccctggtcgaaacaatttttgaaagaggaatggccacctgcttcgcgtacggtcagacaggatccggcaagacacacaccatgggcggagactttagcggcaagaaccaggattgttccaaggggatctacgcgctggcagcaagggacgtgttcctgatgctgaagaagcctaattacaagaaacttgaattgcaggtgtacgccacgttctttgagatttatagcggcaaggtctttgacctgcttaataggaagaccaagctgagggtgctggaggacggtaaacagcaggtgcaggtggtcggcttgcaggaacgggaagtgaaatgcgttgaagacgtgctgaaattaattgacattggcaatagctgtcgtacctccgggcagacgagcgctaacgcccattctagtcgcagccacgccgtgtttcagatcatcttgaggcgtaaagggaagctccatgggaaattctctcttattgacctggcaggcaatgaaaggggcgcagatacctcatcagctgatcgccagaccaggctggaaggtgcagagataaacaagagtctactcgctcttaaggaatgcatcagagctctagggagaaacaaaccacacactccttttcgtgcttctaagctcacacaggtccttcgggattcttttatcggagagaactctcggacctgcatgattgcaactatcagtcccggaatggctagctgcgagaatactctgaatacgctgcgatatgcaaaccgcgtcaaggaattgactgtggatcccaccgctgctggtgatgtgcgccctataatgcatcacccacccaatcagatcgatgacctcgaaactcaatggggagtgggatctagtccccagagagacgacctgaagttgctttgcgagcagaacgaggaagaagtctcaccgcagctgtttacctttcacgaagcagtgtcgcaaatggtggagatggaggaacaagtagtggaagatcatcgagcagtgtttcaggaatccattagatggcttgaagatgagaaagccctcctggaaatgacggaagaagtcgactacgacgtcgattcatacgccacgcaactagaggccatcctagaacagaaaatcgacatcctcactgaattgagggataaggtgaagtcattcagggctgcactccaggaggaagaacaagcctctaaacagattaatccaaaacgtcccagagccttgtag

SEQ ID NO: 29671 - DNA, 1281 bp, Artificial Sequence
  Description of Artificial Sequence: Synthetic coding sequence
atggctcatttgcgaggttttgccaaccagcactcgagggtcgaccctgaggaattgttcaccaagcttgaccgcatcgggaagggctccttcggcgaagtctacaagggtatagacaatcatacaaaggaggtcgtggcaatcaaaattattgacctggaagaagctgaagacgagatcgaagacattcagcaggaaatcacggtattatcccagtgcgattccccatacataaccaggtacttcgggtcatacctgaagtccacaaagctctggatcattatggagtacctgggaggcggaagcgccctggacctgttgaaaccaggtcctcttgaggaaacctacatcgctactattctgcgcgaaatactcaagggcctggattacctccacagtgagaggaaaattcacagagacatcaaggcggctaatgttctgctaagcgagcagggcgatgtcaaactggcggattttggcgtggccggtcagctgacagacacccaaataaagcggaacaccttcgtgggcacccctttctggatggcgccagaagtgatcaaacaaagcgcatacgatttcaaggccgacatatggtcgctggggattacagccattgaactcgccaagggggagccgcctaatagcgatctccatcccatgcgcgtcctctttctcattcccaagaattccccaccgacactcgaaggacagcattctaagcccttcaaggaattcgtcgaggcatgcctaaacaaagatcctagattcaggcccacagccaaggagttgcttaagcacaagttcataactcgctacaccaagaaaaccagcttcctgaccgaactgattgacagatataagaggtggaaatcagaaggacatggcgaggagagttcttctgaggacagtgatatcgacggcgaggccgaggacggtgaacaaggtccgatctggacctttcctcctaccatccggccaagtcctcatagtaagctacacaaggggaccgcattgcattcaagtcagaaacctgcagagcccgtgaaaagacagcccagatctcagtgtctgagcaccctggtgaggcccgttttcggggagctgaaggagaagcataaacagtccggaggctccgttggcgcactggaggagctggagaacgcatttagtctagccgaggagagttgtccaggaatctcagataagctcatggtgcacctcgtggagagggtacagcggttctctcacaaccggaaccaccttaccagtacaagatag

SEQ ID NO: 29672 - DNA, 996 bp, Artificial Sequence
  Description of Artificial Sequence: Synthetic coding sequence
atgcttcggtgtggtcagatgatttttgcgcaggcccttgtgtgtcggcatctgggtcgtgactggaggtggacacagagaaaacggcagcccgactcatatttcagtgtgttgaacgccttcattgaccgaaaagattcttactattccatccaccagatcgcccagatgggcgtgggcgagggtaagtcaattggtcagtggtatggccctaacaccgtagcccaagtgcttaaaaagcttgccgtgtttgatacatggagtagcctggctgtgcatattgccatggataatactgtcgttatggaagagatccggaggttgtgtcggacttctgtgccatgcgctggcgcaactgcgttccccgctgattcggatcggcactgtaatggcttccccgcaggcgctgaggtgacgaaccgcccatcaccttggcgtcccctggtgttactcattccgctccggcttggcctgacagatattaacgaagcatatgtcgagactctcaaacactgcttcatgatgccccagtctttaggcgtaattggcggtaagcccaactcagcccactatttcatcggctacgtgggggaagagctgatatacctcgacccacatacgacacagcctgccgtagagccaacagacgggtgcttcattcccgatgagtccttccactgtcagcatcccccttgtcggatgagcatcgccgagctggaccctagcattgcagtaggtttcttttgcaagaccgaagacgacttcaacgactggtgccagcaggtgaaaaaactgagtctattaggcggagccctgccaatgtttgagctggtggagctgcagccctctcacttggcctgtcctgatgtgcttaaccttagcctcggggaatcgtgtcaggtgcaggtaggctcactgggagacagctctgacgttgagaggttagagagattctttgattcggaggacgaagattttgagatactgagtctgtag

SEQ ID NO: 29673 - DNA, 1461 bp, Artificial Sequence
  Description of Artificial Sequence: Synthetic coding sequence
atgagtgtgacctatgacgactcagtaggagtggaggtttcctccgactcattttgggaagtagggaattataagcggaccgtgaagcgaatcgacgatggacaccgcctttgttctgatctgatgaactgtctgcatgagcgggctagaattgaaaaagcttatgctcagcagttgaccgagtgggcaagacggtggcggcagttggtcgagaaaggccctcagtacgggaccgtggaaaaggcctggatggctttcatgtcagaagccgaacgtgtgagcgaactccacttggaagtgaaggcttctcttatgaatgacgatttcgagaaaatcaagaactggcaaaaggaggcctttcataaacagatgatggggggattcaaagagacgaaggaggcagaggacgggtttcgaaaagcccagaaaccctgggctaagaagctgaaggaggtggaggctgcaaagaaggcacatcatgctgcttgcaaggaggagaaactggcaatctctagggaggccaactccaaagctgatccttcactgaaccctgaacagctgaaaaaactgcaagataaaattgagaaatgtaagcaggatgtccttaagactaaagagaaatacgaaaagtctttgaaagaacttgatcaaggcacaccccagtacatggagaacatggagcaggtgttcgagcagtgccaacaattcgaggagaagcgcctgcgcttctttcgggaggtgctgttagaggtccagaaacacctcgatctttccaacgtcgcaggatacaaagctatctaccatgacctggagcagagcatccgcgctgccgatgcagtggaggacctccgttggtttcgggcaaatcacggacccggtatggcaatgaactggccgcaattcgaagaatggagcgccgaccttaatcggacactgagtcgaagggagaagaaaaaagccaccgacggcgtaacattaaccggcattaaccaaaccggcgatcagtctttgccctctaagccgagttcaacgctgaatgtgccctccaaccccgcacagagcgctcaaagccaatcatcttataacccatttgaagatgaagacgacactggttcaacggtctcagaaaaagacgatactaaggcaaagaacgtgagcagctatgaaaaaacccagagctacccaactgactggtcggatgatgaatcaaacaatccattctcttcaaccgatgcgaacggagacagtaacccatttgacgacgacgccacatctggtacagaagttcgggttagggctctgtatgactacgagggacaagagcatgacgaactgtcctttaaggcaggtgatgaactgactaagatggaggatgaggatgaacaggggtggtgtaaaggcaggctggacaacggtcaggttgggctgtatccagcgaattatgtagaggcaatacagtag

SEQ ID NO: 29674 - DNA, 3075 bp, Artificial Sequence
  Description of Artificial Sequence: Synthetic coding sequence
atgaatttcataaaggataattccagagccctgattcaaaggatgggtatgacagtcattaaacagatcaccgatgacttgttcgtgtggaacgttctaaacagggaagaggtgaacattatatgctgcgagaaggtggagcaggatgcagcccgaggtattatacacatgatccttaagaaggggagcgagtcctgcaacctctttttgaaaagtctcaaggagtggaactatccactattccaggatctaaatggacagtcgctgtttcatcagacctctgagggcgacctcgacgatttagctcaagacctgaaagatctttaccacacacccagctttttgaacttctatcctttgggggaggacatcgacatcatcttcaacttgaagtccactttcaccgaaccagtgctgtggcgaaaggaccagcaccaccaccgcgtcgagcagcttaccctcaatggacttctgcaggcactgcagtctccctgtattattgagggcgaaagcggcaagggtaagagcacattacttcagagaatagcaatgctctgggggtcaggcaaatgtaaggcactgacaaaattcaaattcgtgttttttctgcgcctgagccgggctcaggggggtcttttcgagactctctgcgatcaattattagacatccctggtacaattcgcaagcaaacttttatggccatgttgctgaagcttcgccaacgcgtgttattcctactagacggctacaatgagtttaaaccccagaactgtcctgagattgaagcactcatcaaggagaatcacaggttcaaaaatatggtcatagtaactacaaccaccgagtgcctacggcatattagacagttcggggcactgaccgccgaagttggcgacatgacagaagactcagctcaggctcttatacgcgaggtgctaataaaggagctggctgaaggcctgctgttacagatacagaagtctagatgcctgaggaatctcatgaagacacccctgttcgtagttattacatgtgccattcagatgggagaatcagagttccattctcacacccagaccaccctgtttcacaccttctatgacctactgattcaaaagaataaacacaaacataagggcgtcgctgcctccgacttcatccggtcattggatcactgcggggaccttgccttggagggggttttcagtcataagttcgacttcgaattgcaagacgtgagtagtgtcaacgaagacgtgctgcttactaccggactgctttgcaaatacacagcgcagaggttcaaaccgaaatacaagtttttccataaatctttccaggaatacacggcgggtaggagactgtcttccctgttgacctcccacgaacctgaagaagtaaccaaaggcaatggttatctccagaaaatggtttcaattagtgacatcacttctacctattccagcctgttaaggtacacatgtggaagcagtgtggaggccacccgggctgtgatgaaacacttagccgctgtctatcagcatggatgtcttcttggtttgagtatcgccaaaaggcccctgtggagacaggaatctctgcagtccgtgaaaaataccaccgagcaagagattctgaaagcaatcaatattaactcttttgtagaatgcggcatccacttgtaccaggagagcacgtcaaagtctgctcttagtcaagagtttgaagctttctttcaagggaaatccttgtatatcaattcagggaacattcccgactacctgttcgacttcttcgagcatttgcccaattgcgcttcagccttggattttattaagctggatttctacggcggtgcgatggccagctgggagaaggctgctgaagatacggggggaattcacatggaggaggcaccggagacatatattccctcacgagccgtgagcctctttttcaactggaaacaagaatttcgaactcttgaagtcactttgagagacttctctaaactgaataaacaggatatcagatacctgggcaagatcttctccagtgcgaccagcctcagactgcagataaaacggtgtgcaggcgtcgctggttctttatcactggtcttgtcgacctgtaaaaacatttactcattaatggtggaagcaagccccctaaccattgaagatgagcggcatataacatctgtgacaaacttgaagacactctctatccatgacctccaaaatcagcgtttgcctggcggactgacggacagtttgggaaacctgaagaatttaaccaagctcattatggacaacatcaagatgaatgaagaggacgctatcaaacttgccgagggcctgaagaacctcaagaaaatgtgcctgtttcatctaacccatctctccgatattggcgagggcatggactatatcgtcaagtcattaagcagcgagccttgcgatctcgaagagatccagctggtgtcatgctgcctcagcgcaaacgccgtaaagatccttgctcagaaccttcacaatctggtaaagctgtcgattctggatctttctgaaaactacctggagaaggatggcaatgaagcactgcatgaattaattgacaggatgaatgttctcgagcagctgaccgccctgatgctaccgtggggatgtgacgtgcaggggagcctttcgagtcttcttaaacacctggaggaagttccacagctggtgaagttgggcctgaaaaactggcgattgaccgatacggagatccgcatccttggcgcattcttcggcaaaaaccccctcaaaaatttccaacagttgaacctggccggtaatcgtgtctctagtgatggctggctggcctttatgggcgtgttcgagaatctcaaacaattagtgttttttgactttagcaccaaagaattcctcccagaccctgctcttgtgcggaagctgtcccaggtgttatctaagctaacattcctgcaggaggccagactggtgggctggcagttcgatgatgacgacctgtccgtaatcaccggggcattcaaactcgtcactgcctag

SEQ ID NO: 29675 - DNA, 339 bp, Artificial Sequence
  Description of Artificial Sequence: Synthetic coding sequence
atggacgataaggcctccgtggggaagatctccgtgtcttctgactctgtgagtactttaaacagtgaagatttcgttctcgtctctagacagggcgatgagacacctagcacgaacaacggatcagacgacgagaaaacaggcttgaagatcgtgggcaacggatccgagcagcagcttcaaaaggaactggccgacgttctgatggaccctccgatggacgaccagcccggagagaaggagctggtgaaaagatcacagctagatggtgagggcgacggccctttgagcaaccagctgtctgcgtcttccaccattaaccccgtccccctggtctag

SEQ ID NO: 29676 - DNA, 441 bp, Artificial Sequence
  Description of Artificial Sequence: Synthetic coding sequence
atgctgaaagaagactgtgccagcgagcttaaggtgcaccttgccaagtccctgcctctaccttctagtgtaaaccggccaaggatcgacctgatcgtgttcgtcgtgaatctccactcaaagtacagcctccagaataccgaagagtcactgcgtcatgttgacgcctctttttttctcggaaaggtctgttttctggctacaggcgcaggaagggagagtcattgttcaatacatcgacacacagtggttaagttagctcacacctaccagagtcctttactgtactgcgatctggaggttgaaggctttcgagcaactatggcgcagcggctcgtgagagttctgcagatctgcgcaggccatgtgccaggtgtgtcagcactgaacctgctgagcctcctacggtcctctgagggtcctagccttgaagatctttag

SEQ ID NO: 29677 - DNA, 1203 bp, Artificial Sequence
  Description of Artificial Sequence: Synthetic coding sequence
atggcgtctgatactcaggcggttccagatgtgtcaggacggtcacgggcacgacgatatgcagaatggtcttcaggactgaggtcagggagggcgggtggaggggagacctctgttgaacgacgcagaacatgcgcttttgataccttagaggccttccttatcatggacggagaggatattcccgacttttccagcctgaaggaagaaaccgcatattggaaagagctgagcctgaagtacaagcagagctttcaggaggccagggatgaactggtagaatttcaagaagggagccgtgaactcgaggccgagctcgaagctcaactggtacaggccgaacaaagaaatagagaccttcaggccgacaaccagagactgaagtacgaggttgaggcgctcaaggagaaacttgaacaccaatacgcacagtcctataagcaggtgtccgtcctcgaggacgatttgtcccaaacccgtgcgattaaggagcagcttcacaaatacgtcagggaacttgagcaggccaatgacgatctggagcgagccaagcgggcaacaattgtgtctttggaagacttcgaacagcgtctgaaccaggccatcgaacgaaacgcctttctcgagtctgaattagatgaaaaggagtctttgttggtttcagtacagcggcttaaggacgaggcaagggacctgcggcaggagctcgccgttcgggagcgacagcaggaggtgacaaggaagtcagctcctagcagcccgacactcgactgcgagaaaatggactcggctgttcaggcctcactcagtctgccagccacaccagtgggcaaggggaccgaaaacaccttcccaagccctaaagctattccaaacggattcggtactagcccattaactccaagtgctagaatctctgcactaaatattgtcggcgatctccttagaaaagtgggcgctttggaaagcaagctggccgcatgtagaaatttcgccaaggatcaagcctctaggaaatcctacatctctgggaatgtgaattgtggcgtactaaatggtaacgggactaaattcagccgctccggtcatacctccttttttgataaaggagctgttaacggatttgaccctgcgcctcccccaccaggactaggctcatctaggccttcgagtgccccaggaatgctgcccctctccgtatag

SEQ ID NO: 29678 - DNA, 699 bp, Artificial Sequence
  Description of Artificial Sequence: Synthetic coding sequence
atgacccctcctcagcagccacctcccctgcgcagtgagcctgggactttgggttcagccgcatcatcctattcacctttaggactgaatggcgtgcccggttctatctgggatttcgtctccggaagcttcagccctagtcccagccccatactttcagctggaccaccttcttcaagttccgcgtccccaaacggagctgagctggcgagggttcgcagacaactggatgaagccaagcgcaagattcggcaatgggaggagtcttggcagcaggtgaaacaagtctgtgatgcatggcagagagaggcccaggaggcgaaagagagggcacgcgtagctgattcagaccgccaactcgcattgcagaaaaaggaggaggtggaagcccaggtgaaacaactgcaggaggagctggaagggcttggagttgccagtaccctcccaggcttacgcggatgcggagatatcggcaccattcctctccctaagctgcactccctgcagagtcagctccgcttagatctcgaggccgtcgatggagtcatcttccaactgcgagccaagcaatgcgtagcctgtagggaaagggcgcatggtgcggtgctgcgcccttgccaacaccatatcctatgtgagccctgtgccgcaacagcccctgaatgtccctactgcaagggccagcccctgcagtggtag

SEQ ID NO: 29679 - DNA, 1500 bp, Artificial Sequence
  Description of Artificial Sequence: Synthetic coding sequence
atgctgccctggcccccagcattagctatgccgatgcccaccgaaggaacacctccccctctgtccggcactcctatacccgtgcctgcatacttccgacatgctgaacccggattcagtctgaaaagacccagaggcctgagccgaagtctgcccccaccccctcccgctaaggggtccatccccatttctcgcctgttcccacccagaacgcctgggtggcaccagctacagccgagaagggtaagtttcagaggtgaagcctctgagaccctacagtcacctggatacgatcctagtcggccagaatccttcttccagcaatcctttcagcggctttcccgcctgggccatgggagctacggcgaggtcttcaaagtcaggtctaaggaggacggaagactgtacgctgtgaaacgcagcatgtcaccattccggggaccaaaggacagggcccgaaagttggcagaggtcggctctcacgaaaaggtcggacagcatccttgttgtgtgaggctggagcaggcatgggaggaaggaggcattctgtatttgcagacggagctgtgtgggccttccctgcagcagcactgcgaggcttggggtgcttctctccccgaggcgcaagtttgggggtatcttagggatacactcctggcgttagcgcaccttcactcccagggtcttgtgcatcttgacgtgaaaccagctaacatcttcctcggccctcggggaagatgcaagctgggtgattttggcttgcttgtggaattggggaccgcaggcgcaggagaagtgcaggagggcgacccgagatacatggctcctgagctcttacagggatcctacgggaccgccgctgacgtgttctctttaggtctgaccatcctggaggtcgcttgtaacatggagcttcctcacgggggagaaggctggcaacagctcagacagggatatctgcccccagaattcaccgcaggcctgagcagcgaactccgttctgtgttggtcatgatgctggaacctgatccgaagttaagagcaacagccgaagccttgctggctttgcccgttttaagacagccccgtgcgtggggcgtgctctggtgtatggccgcagaagcgctttctcgcggttgggctctgtggcaggcactcctggcgctgctatgctggctgtggcatggtctggcccatccagcatcatggctccagccgctggggcctcctgccaccccgcctggaagccctccctgttctctcttgctggattccagcctaagtagcaactgggacgatgatagcctcggtcctagcctctccccggaggccgtgttggcccgaaccgtggggtccacgtcgacaccgcgatccagatgtacgccacgggatgccctggatctttccgacatcaattctgaaccgccacggggatcattcccctcttttgagccacgcaacctcctctccttattcgaggacactctcgaccccacgtag

SEQ ID NO: 29680 - DNA, 3153 bp, Artificial Sequence
  Description of Artificial Sequence: Synthetic coding sequence
atgctgtgctgggggtattggtctctcggccagcccggtattagcacaaacctgcagggtatcgtcgcagaaccgcaagtatgtgggttcatcagtgaccgatctgtcaaggaagtagcctgtggcggaaatcactcagtctttctactggaagatggcgaggtttacacctgcggtctcaatacgaaggggcagctggggcatgagagggagggcaacaaaccagaacaaataggggcactggccgaccaacatatcatacacgttgcctgcggtgaaagtcatagcttagccttatcggacagaggacaactcttcagctggggggcaggaagcgatggccagctcggcctgatgactacagaagacagcgtggctgtgcccaggctgattcagaaactgaaccaacagaccattctgcaagtctcctgtggcaattggcactgtctggcactggcggctgatggacaatttttcacgtggggtaagaatagtcacggccagttgggcttaggtaaggaatttccctcccaggcatcacctcagagggtacggagtctggagggcatcccactcgcacaggtggcagctggaggagcacacagcttcgccctctctctctctggtgcagtgttcggctgggggatgaacaacgccggacagctggggctcagtgacgaaaaagatagggagtcgccttgccacgtgaagctgttgcggacccagaaggtcgtgtatattagctgcggggaggagcacactgccgttctgacaaaaagcggaggggttttcacattcggcgcaggctcatgtggtcagctcgggcatgatagcatgaatgacgaagtcaatcccagaagagttcttgagcttatggggtcagaggtcactcagatcgcatgcgggaggcagcacaccctcgccttcgtgccctcttctggcctgatttacgctttcgggtgcggggctcgcggacaattgggcaccggccacacgtgtaacgtcaagtgtcctagcccagttaaaggctactgggcagcacactctgggcagctctccgctcgggctgaccggttcaagtatcacattgtgaagcaaatattcagcggaggagatcagacatttgtcctgtgttctaaatacgagaattattctcctgccgtcgacttccgcactatgaaccaggcccattatacttcgctcataaacgacgagacaatagcggtgtggagacaaaagctgtccgagcacaataatgctaacaccatcaacggtgtggtacagattctaagtagtgcagcctgttggaacggcagctttttagagaagaaaatcgatgaacattttaagaccagtccaaagatccctggcatcgatctgaacagcacccgcgtcctttttgaaaaacttatgaattcacaacattcgatgattctggagcaaattttaaacagttttgagtcatgtctgatcccccagctatcgtcttcccccccagatgttgaggcgatgagaatttatctgattctgcccgagtttccattgttgcaggatagtaaatactatatcaccctaactatccctctcgccatggctatactgagactggataccaacccatccaaagtcctggacaattggtggtcccaggtctgcccaaaatactttatgaaactagtaaatctgtataaaggagcagtcctataccttctgcgcggaaggaaaacctttttgattcctgtgctcttcaacaactatattaccgccgcactcaaactgctcgagaaactttataaagtgaatctcaaggtgaagcatgtcgagtatgacaccttctacattccagagattagcaacttggtagacatacaggaagattacttgatgtggtttttacaccaggccggaatgaaggcaagaccctccatcatccaggatacagtgaccttatgtagttacccttttatctttgacgcccaggcaaagaccaagatgctgcagaccgatgctgagttgcagatgcaggtagcagtgaacggcgcaaacctgcagaacgtgttcatgctgcttacactggagccacttctagctcgctcccccttcttagttttgcatgttcgtcgtaataacctggtcggtgatgctctaagggaattatctatccacagtgatatcgatctgaaaaagccactgaaggttatctttgacggcgaagaggccgttgacgctgggggtgtgaccaaggaattctttttactgttgctgaaagagctgctgaatcctatttatgggatgttcacctactatcaagacagcaatcttttgtggttttctgatacatgcttcgtggagcataattggtttcatctgatcggcataacctgcggcctggccatatacaattctactgtagtcgacttgcatttccctctcgccttgtacaaaaagcttctgaatgtgaaacctggccttgaggacctaaaggaactctctcctaccgagggacgcagcttgcaggaacttcttgactatcctggggaagacgtggaagagacattttgtctcaatttcacaatttgccgagagtcctacggagttatcgaacagaaaaaactgataccgggtggagataacgtgacagtgtgtaaggacaataggcaggagttcgtggatgcatacgtgaattatgtgtttcaaatctctgtgcacgagtggtacactgctttctcttctggctttctgaaggtgtgcggtgggaaagtcttagagttgttccaaccaagtgaactccgagctatgatggtgggaaactctaactacaactgggaggaactggaagaaacagcgatctataagggcgactatagtgctacacaccccaccgtgaaattgttctgggagacatttcacgaatttccgctggaaaaaaaaaagaaattccttctgttcctgacaggaagtgatcggattcctatttacgggatggcctcactacaaatcgtgatccagtccacagccagtggggaggaatacctgccagtggcgcatacctgctacaatctgctggatctaccaaagtatagttccaaggagatattaagcgcacgcctgacacaggcactggacaactacgagggcttcagcctagcgtag

SEQ ID NO: 29681 - DNA, 363 bp, Artificial Sequence
  Description of Artificial Sequence: Synthetic coding sequence
atgagcatcggagtgccaatcaaggtgcttcacgaggcagaaggccatatcgtgacgtgcgagactaacactggagaagtctaccggggaaaactcatagaggctgaggacaatatgaattgccagatgagtaacattacagtcacatatagggacggaagagtggcccagctcgagcaggtgtacatcagaggctccaagatcagattccttatcctgcctgacatgcttaagaatgcaccaatgctgaagtccatgaagaacaagaaccaaggaagcggggctgggaggggaaaggcagctatcttgaaagctcagggttatctgtcttctttagagtgggtactggtgcacatttgctag

SEQ ID NO: 29682 - DNA, 1182 bp, Artificial Sequence
  Description of Artificial Sequence: Synthetic coding sequence
atggaagaaaataatcttcagtgctcctccgtggttgatggcaacttcgaggaggtgccacgtgaaacggccatccagtttaaacccccactctaccggcagcgatatcagtttgtgaagaacctggtggaccagcacgaacctaagaaggtcgctgatctgggatgcggggatacctcacttttaaggctacttaaggtaaatccttgcatcgaactgcttgtcggcgtcgatataaacgaagacaaactacggtggcggggagacagtttagccccttttctgggcgatttcctcaagccacgcgacctaaacttgacgatcaccctttatcacgggtcggtcgtcgagagggattcccgccttctgggtttcgacctgataacatgcatagagttgattgaacatctcgactctggggatctagctaggtttccagaagtggtatttgggtatctctctccctccatgatcgtcatctcaacccccaactccgaatttaatcctttattccctagtgtgacccttcgagatagcgaccacaagtttgaatggacacggatggagttccagacatgggcactgtacgtggctaacagatatgactacagtgttgagttcactggagtaggggagccccctgccggagcggaaaacgtcggctactgcacccaaataggcatttttcggaagaatgggggtaaagccactgaatcctgtctgagtgagcagcacgatcaacacgtctataaagctgtctttactacatcatatccctctttgcagcaagaaaggttcttcaagctggtactcgttaatgaagtctcacagcaggtagagagcctgcgggtgagccatctacccaggaggaaggaacaggccggtgaaagaggcgacaaacctaaggatataggagggtccaaggctcccgtgccatgcttcggccctgtctttaccgaggtcgagaaggccaagattgagaactctccgactcctttttgcgtgggcgacaagttttttgtccctttgcaacggttactggcttaccccaaactgaacagactgtgcgccaacgaagagatgatgcgctctgtcatagctgattctatccctctgtcctccgatgggtcagcagtagttgcggacttgcgaaactattttgatgaacagttcgagttttag

SEQ ID NO: 29683 - DNA, 228 bp, Artificial Sequence
  Description of Artificial Sequence: Synthetic coding sequence
atgtctccccagaagagagttaagaacgtacaagcccagaatcgcacaagccaaggttctagcagcttccagaccactttatctgcttggaaagtcaaacaggacccctccaattcaaaaaatatctccaagcacggacagaacaaccccgtaggcgactatgagcatgctgatgatcaggccgaagaggatgccctgcagatggctgtgggttacttcgagaagtag

SEQ ID NO: 29684 - DNA, 996 bp, Artificial Sequence
  Description of Artificial Sequence: Synthetic coding sequence
atggcatttgtcactcggcaattcatgcgttctgtttcaagctcttccacagccagcgcatccgccaaaaaaatcatcgtcaagcacgtgacagtcatcgggggagggctaatgggggcaggaattgcgcaagtcgcagctgccactggccataccgtggtactagttgatcagacggaggacatcctcgctaaaagtaagaagggaattgaagagagcctgcgaaaggtggccaaaaaaaaattcgcggagaacttaaaagcgggtgatgagttcgtggaaaagacccttagcaccatcgcaacctcaactgatgccgcttccgtggtgcattctacagatctggtggttgaggctattgtggaaaatttaaaggtgaaaaacgagctatttaagcgacttgacaagtttgcggctgagcatacgatattcgcttctaatacatcctctctccaaatcaccagcatcgccaacgcgactactcgccaagacagatttgccggactgcactttttcaaccctgtgcctgtgatgaaactggtcgaggtgatcaagacacccatgaccagccaaaagacatttgagagcctggtggatttttccaaagctctaggcaagcacccagtgtcttgcaaggatacgcccggttttatcgtgaataggctcctcgtgccctatttaatggaagctatcagattgtacgagagagattttcaaacctgtggcgatagcaattctgggctgggctttagtctgaagggtgatgcttcaaaggaagacatagacaccgccatgaaattaggggctggttatcctatgggtcctttcgaattgctagactacgtcggcctggacactacaaagtttatagtggatgggtggcacgagatggatgctgagaaccctcttcaccagcctagtccaagccttaataagctggtggctgagaataagtttggtaagaaaaccggagaaggattttacaaatacaaatag

SEQ ID NO: 29685 - DNA, 1281 bp, Artificial Sequence
  Description of Artificial Sequence: Synthetic coding sequence
atggcccacttgcgagggtttgccaatcagcactcacgggtggaccccgaggagctcttcaccaagctggataggatcggtaagggaagttttggagaggtttataaaggcattgataatcacaccaaagaggtggtcgcaattaagatcattgacctggaggaagctgaagacgaaatcgaagatatccaacaggaaatcactgtcctgtctcagtgtgacagcccatatataacacgatatttcggttcctatctgaagtcaacaaagctctggatcatcatggaatatctgggaggtgggagtgcgctcgatttactgaagcctggacctttggaagagacgtatattgcaacaattctccgggaaatacttaagggtctggactatctccactccgaacggaagatacatagggacatcaaagcagctaatgtactgttgtcggaacagggcgacgtgaagctcgccgattttggggttgctggacaattaactgatactcagattaagcgcaatacattcgttggcactcccttctggatggcaccggaggtcataaaacagtctgcttacgatttcaaggcagacatttggagtctaggaataacagctatcgaattggccaagggggaaccgccaaattccgatctccatcccatgcgcgtgctcttccttatacctaagaactcaccccctacattggaggggcaacattccaaacctttcaaagagttcgttgaggcttgtctcaataaggatccgagatttcggccaacggccaaggagttattgaaacataagtttattacacggtacacaaagaaaacctcctttttgaccgagcttatcgaccggtataagcgctggaagtccgaaggccatggggaagagtcgtcctcggaagacagcgacattgacggggaagctgaagacggagaacagggaccgatttggaccttcccgcctacaatcagaccaagcccacactctaagctgcacaagggcaccgcgctccatagtagtcagaagcccgctgaacctgtgaagcgacagcctcggtcacagtgcctgtctaccttggttaggcccgtcttcggcgaactgaaggaaaagcataaacagagcggtgggagcgtcggggctctggaagagctcgaaaacgccttcagtttggcggaagagtcctgtccgggaattagcgataaattaatggtccacctggtcgagagagttcaacggttctctcataatcggaatcacctgacctccacgcggtag

SEQ ID NO: 29686 - DNA, 1290 bp, Artificial Sequence
  Description of Artificial Sequence: Synthetic coding sequence
atgccgaacgtcctgctgccaccaaaggaaagcaacttgttcaagcgtatcctgaagtgctacgagcagaagcagtacaagaatggcctcaaattctgtaaaatgatcctcagcaacccgaaatttgctgaacatggggagacgctcgccatgaaagggctaacactgaactgcctggggaagaaggaagaggcttatgagttcgtgaggaaaggcttgcgcaacgacgtcaagagccatgtatgctggcacgtctacggcctgttgcagcgctcggataaaaagtacgacgaggccatcaaatgttaccgtaacgctttgaaactggataaggataacctgcagattctaagggatctttcgttgctgcaaatccagatgagagacctggagggttaccgcgaaacccgctaccaactactgcagctccggccaacccagcgggcaagttggattggctatgctatagcttatcacctgctcaaagactacgatatggcactgaagttgctggaagagttccgccagacacaacaggtgccaccaaacaagattgattacgagtactccgaactcatcttataccaaaaccaggttatgcgggaagccgatctgttacaggagtctctggaacacattgagatgtacgagaaacaaatctgcgataagctgttggttgaagagattaagggggagattctccttaagctcggtcggctgaaggaggcaagtgaggtgttcaaaaatttgattgaccgtaacgctgagaactggtgttattatgaaggactggagaaagctctgcagatcagtactctggaggaaaggcttcagatatacgaggaaatttccaaacagcacccaaaggcgatcacaccccgacgactccctctgacactggtccctggcgaaagattccgggagctcatggacaagttcctgcgggtgaatttctctaaaggttgccccccactgttcacaacactcaagagtctgtactacaacacggagaaggtgtcaattattcaggagctagtgacaaactacgaggcctccctgaagacatgcgatttcttcagcccttacgaaaatggtgagaaagaaccacctactactcttctgtgggtgcagtactttcttgcccagcatttcgacaaactggggcagtacagcctggccctcgactacatcaatgccgctatcgcgtcaacgcctactctcatcgagttattttacatgaaagctaaaatttataaggtgaaatcagagtcctgttttctctcgtcatag

SEQ ID NO: 29687 - DNA, 360 bp, Artificial Sequence
  Description of Artificial Sequence: Synthetic coding sequence
atggacaaaaatattggcgagcagttgaacaaggcctatgaggcatttaggcaggcctgtatggaccgggattcggcagtgaaagaactccagcagaagacagaaaactatgagcagcggatcagagaacagcaggaacagctgtctcttcagcagaccataattgataagctgaagagccagctgctgctggttaatagtacccaggataataactatgggtgtgtcccgctgctcgaagactccgagaccaggaaaaacaacctaaccctggaccagccccaggacaaggttatttcaggcattgcaagagagaagctcccaaaagttgatatcgcaagtgccgaaagttccatctag

SEQ ID NO: 29688 - DNA, 699 bp, Artificial Sequence
  Description of Artificial Sequence: Synthetic coding sequence
atgactcccccacagcagccaccgccactgaggagtgaaccaggaaccctcggcagcgctgcctcctcgtattcccctttagggcttaacggcgttcctggctccatatgggatttcgtgtctggcagtttttcaccttccccctccccaatcctgagcgctggcccacccagctcctcctccgcttcgcccaatggggcagaacttgcccgtgttcgcaggcagcttgacgaggccaagaggaagatccgacagtgggaggagtcttggcagcaagtcaaacaggtatgcgatgcgtggcagagagaagctcaggaggccaaggaaagagctcgagtggcagactccgaccgacagctggcgctacagaagaaggaggaggtagaagctcaggtgaaacagctgcaggaggagttggaagggctgggagtggccagcaccctccccggtctgagagggtgcggggatatcggcaccattccattacccaagttacactccttacagtcgcagttgcgtcttgacctcgaggcagtagacggcgtcatatttcagctgcgagccaagcagtgtgttgcttgccgggaacgcgcacatggcgcagttttgcgaccctgccagcatcacattctctgcgagccctgcgccgctactgcccctgaatgcccttattgtaaagggcagccactgcagtggtag
